United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 99

SEQ ID NO: 193748 - DNA, 1254 bp, Artificial Sequence
  Description of Artificial Sequence: Synthetic coding sequence
atggccgcccccggcagcgcccggcggcccctgctgctgctgctgttgctcttgttgctcggactaatgcactgcgccagcgccgccatgttcatggttaagaacgggaacgggaccgcttgcattatggcgaacttcagcgccgcctttagcgtgaactatgatactaaatcaggccctaagaatatgacatttgatctaccctccgacgcaacagtggttttgaataggtcaagttgcgggaaagaaaatacttcagatcccagcctggtcattgccttcggacggggccacaccctcacactgaacttcacccgcaatgcaacgcgttattccgtgcagctgatgtccttcgtctacaatctctctgacacacatctgtttccaaacgcctccagcaaagaaatcaagactgttgaatcgattacagacatcagggccgacattgataaaaagtacaggtgtgtgtccggcacccaggtacacatgaataacgttactgtgacattgcatgatgcgacaatacaggcttacctgtccaacagcagtttttctagaggcgaaacccggtgcgagcaagacaggccatctcccacaaccgctccacccgcccccccgagtcctagccccagtcctgtaccgaagagcccgtccgtggataagtataatgtgtctggaacaaatgggacatgcttgctggccagcatgggtctccaactgaacctaacttatgagcgtaaggataacacaaccgtgactcgcctcttgaacataaaccccaataaaacctcagcctctggcagctgcggggcccacttggttactctggaactccactctgaagggacaacagtgctccttttccaattcggtatgaatgcctctagcagtcgcttttttcttcagggcattcagttgaatacaatattaccagatgccagagatccagcctttaaagccgcaaacggaagtctgcgagctctacaggctactgttggcaacagctacaagtgtaatgctgaagagcatgtccgagtaactaaggccttctcagtgaacatcttcaaggtatgggttcaggcctttaaagtcgaaggaggacaattcggttccgttgaggaatgtttactcgacgaaaacagtatgcttatccctattgcagtaggaggtgccctcgctggactggtcctgattgtattaattgcatacctcgtcggcagaaagcgctcccatgcgggatatcagactatttag

SEQ ID NO: 193749 - DNA, 1095 bp, Artificial Sequence
  Description of Artificial Sequence: Synthetic coding sequence
atggccgcccccggcagcgcccggcggcccctgctgctgctgctgcttctccttctgttgggattgatgcactgcgcttctgccgctatgtttatggtgaaaaacgggaacggcaccgcctgtatcatggcaaacttttccgcggcattttctgtgaactacgacaccaagtcgggcccgaagaatatgacctttgacctgcccagcgacgctacagtggtcctgaaccgatcatcatgcggaaaggagaataccagtgacccaagcctcgtgatcgcgtttgggaggggccacacactcacactgaatttcactagaaacgcgacccgatacagcgtccagctcatgagtttcgtgtacaacctgtctgatactcatctattcccaaacgcctcgagcaaggaaacgaggtgtgaacaggaccgaccaagcccaaccactgctcctcctgcccctccttccccatcacccagccccgtcccaaagtccccttctgtcgacaaatataacgtgagtggtacgaatgggacatgtctgctggcctctatgggccttcagctgaatctgacctatgaaagaaaagataatacaaccgttactagacttttgaacatcaaccccaataaaacttctgcctcaggctcatgcggagcccatctcgtgacactcgagctccacagtgaaggaactactgtcctgctttttcagtttggaatgaatgccagtagttcacgattttttctgcaaggcattcaactcaataccatcctaccggacgcgcgggacccagccttcaaggctgctaatggtagtctgcgggcgttgcaggccactgtaggaaatagctacaagtgtaatgcggaagagcacgtgcgcgtgacgaaagcctttagcgtaaacatttttaaggtgtgggtgcaagccttcaaggtggaagggggccaattcgggtccgtggaggaatgtctcctggacgagaactctatgctgattccaatcgcagtggggggcgcacttgccgggctagtgctaatagtgttaattgcctatctcgtcggccgcaagcggtctcatgcgggatatcagacaatttag

SEQ ID NO: 193750 - DNA, 1233 bp, Artificial Sequence
  Description of Artificial Sequence: Synthetic coding sequence
atggtgtgcttccggctgttccccgtgcccggcagcggcctggtgctggtgtgcctggtactgggggccgttcgctcttacgccttggagttaaacctgaccgatagcgaaaatgcaacttgcctttacgccaagtggcagatgaacttcactgtgcgctatgaaaccaccaacaagacatacaaaactgtaaccatctcagatcacggaactgtaacgtataacggctccatctgtggggatgatcagaatggacctaagatagccgtgcagttcgggcctggtttttcatggatcgctaattttaccaaggccgcttccacctattccatcgattccgtcagtttcagctacaacaccggagacaataccacgttccctgatgccgaggataagggtatcctgactgtggatgagctgctcgccatcaggatccccctgaatgacttattccgctgcaattccttaagcacactggagaagaacgacgttgtgcagcattattgggacgtcctggtacaggcctttgtgcagaacgggacagtgagcactaacgaattcctttgtgataaggacaagacatccaccgttgccccaactattcataccacggtgccgagtcccaccactacgcctaccccgaaagagaagccagaggctggcacgtactcagttaataacggaaacgacacctgcctgctggccaccatgggcttgcagttaaacattactcaagataaggtggcctccgtgatcaacataaacccaaatacaacacattcgacgggttcctgccgctcacacacagcattactgcgactcaactcctctacaatcaagtatctcgacttcgtgttcgccgtgaagaatgaaaatagattctacttaaaagaagttaacatttctatgtacctggtcaatgggtccgtgttttcaattgccaacaacaatttgtcttactgggacgctccgctcggaagctcctacatgtgtaataaggaacagactgtgagtgtttccggtgcttttcagattaatacttttgatcttagggtgcagccgttcaacgtgacgcaggggaagtattcgacagcgcaggattgtagtgcggacgacgataattttctggtgccaatcgctgtgggagccgctctggcaggtgttctcattctcgtattgctagcatatttcatcgggctcaaacatcatcatgccggatatgaacagttttag

SEQ ID NO: 193751 - DNA, 1233 bp, Artificial Sequence
  Description of Artificial Sequence: Synthetic coding sequence
atggtgtgcttccggctgttccccgtgcccggcagcggcctggtgcttgtttgtctcgtgttgggagccgttcgcagctacgccctagaactgaacctgactgatagcgaaaatgctacctgcctctacgccaaatggcagatgaactttacagtaagatatgagacaactaacaagacatacaaaactgttaccatttccgaccacggaaccgtgacatataacggcagcatttgtggcgacgaccagaatggcccaaagatcgctgttcaattcggaccaggcttttcctggatagctaactttaccaaggcagcatcaacatattcaattgattcagtatcattctcatacaacaccggggataacacaacctttcccgacgcagaagacaaggggatcctgaccgtggacgagctactggccatccgcattcctctcaacgatctgttcaggtgcaattccctcagcaccctcgaaaagaacgacgtggtgcaacactattgggacgtcctcgtgcaggcctttgtgcaaaatggcacagtgtccacaaatgagtttctgtgtgataaagacaagaccagtacagtagcccccaccatccataccactgttcccagccccacaaccacacccactcccaaggagaaaccagaggcaggcacgtattccgtgaataacggcaatgatacctgcttactggcgacaatggggctccaacttaacattacgcaggataaagtggcttcagttattaacattaatccaaacaccacacattcaacagggtcctgccgctcgcataccgcactattaagactgaattcttccaccataaaatacctagatttcgtctttgccgtgaagaacgagaataggttctatctgaaggaggtaaatatcagtatgtatctggtgaatggttccgtcttcagcatcgccaataataatctgtcatactgggacgctcccctgggctcttcctacatgtgcaacaaggaacagacagtcagcgtgagcggcgctttccagattaatacctttgatctgcgggtacagcctttcaatgttacccagggaaaatacagtacagcccaagaatgttcccttgatgatgacacaatcctaattcccatcatagtcggcgccggtctatcaggtctgattatcgtgatcgttatcgcctacgttatcgggaggcgaaagtcttacgcgggctaccagacgctttag

SEQ ID NO: 193752 - DNA, 1236 bp, Artificial Sequence
  Description of Artificial Sequence: Synthetic coding sequence
atggtgtgcttccggctgttccccgtgcccggcagcggcctggtgctggtgtgtttggttcttggtgccgtgaggtcttatgctctggagctcaatctgaccgactccgaaaatgccacgtgcctgtatgctaagtggcagatgaatttcacagtcaggtatgaaacgactaataagacctacaagaccgttacaattagtgaccatggaactgtgacttataatggctcaatttgcggcgatgaccagaacggtcccaaaattgcagtgcagtttggaccaggattttcttggattgcaaactttaccaaagccgcctccacatactctatagatagtgtgtctttcagctataataccggtgacaatacaacattcccagacgcagaggataagggtattctgacagtggacgaactgcttgccattaggatacctctcaacgacctattcagatgtaattctttgagcacactggagaagaacgacgtggtgcagcactattgggatgtcctggtccaggcttttgtacagaatggtaccgtctccacaaacgagtttctctgtgataaggataaaacctcaactgtggcacctacaatccacaccacagtcccgagtcccaccacaactcctactcccaaggaaaagccagaggccgggacatactcagtcaataacggaaacgatacatgtctgttggcaactatgggattacagctcaacatcacccaggacaaagtcgcatctgtgatcaatatcaatccaaacacaacgcactctacaggaagttgcaggagccacacagctctgttaaggctgaacagttccaccatcaagtaccttgatttcgtttttgccgtcaaaaacgaaaatcggttctatttgaaagaggtgaacatctctatgtacctggtgaatgggtccgtcttctccattgctaataataatttgtcatactgggacgcgcctcttggctcaagctatatgtgtaataaagagcagactgttagcgtctctggagcgttccagattaacaccttcgatttaagagtgcaaccctttaacgtcacacaggggaaatattctaccgctgaagaatgtagcgctgattctgatctgaacttcctaataccggtagcagtgggcgtcgctctcggatttttaatcatcgttgtctttatctcctacatgatcgggcgcagaaagtccaggactggctaccagagcgtgtag

SEQ ID NO: 193753 - DNA, 903 bp, Artificial Sequence
  Description of Artificial Sequence: Synthetic coding sequence
atggtgtgcttccggctgttccccgtgcccggcagcggcctggtgctcgtttgcctggtcctggggatattgaccgtggacgaactgctcgccataagaattccattaaacgatcttttccggtgtaattccctgagcacacttgagaagaatgacgtggtacagcactactgggatgttttagtccaggcatttgtgcagaacggaaccgtgtctaccaacgaatttctgtgcgacaaagataagacctctaccgtggcacccaccatccacaccaccgtgccttctcccactaccaccccaactccaaaagagaagcccgaggctgggacctattccgtaaacaatggtaatgatacctgtctgctggcaactatgggactccagctgaacatcactcaagataaagtcgcttccgtcattaacatcaatccaaacaccacccactccacagggagttgccgcagtcacaccgccctgctcagacttaactcctcaaccatcaagtatttagactttgtattcgctgtgaagaatgagaatcggttttatctgaaggaagtgaatatttcaatgtatctagtgaacggatcagtgttcagtatagctaataacaacctgagctactgggatgccccactggggtcttcttatatgtgtaataaggagcagactgtgtcagtgtctggagcttttcagattaacacatttgacctgagagtccagcctttcaatgttacacagggcaagtatagcaccgcagaggagtgttccgcagactccgacttgaacttcttgatcccagtggccgtgggagtggctctcggttttctgattattgtggtctttatatcttatatgattggccgccgaaagagtcggacgggctaccaaagcgtgtag

SEQ ID NO: 193754 - DNA, 1092 bp, Artificial Sequence
  Description of Artificial Sequence: Synthetic coding sequence
atgaacttcaccgtgcggtacgagaccaccaacaagacctacaagacggtgacaattagcgaccacggcactgttacatacaatggaagcatttgcggagatgaccagaatggtccgaaaattgcagtacaatttggacccggcttttcctggatcgctaatttcactaaggcggcttcaacttattcaattgactccgtttctttcagctataataccggtgataacactacattccccgacgcagaagacaagggtattctgacagtcgacgagctgctggcaatccggatccccttaaacgatctttttcgatgtaacagtctcagcacactggagaaaaatgatgtggtgcaacattattgggacgtgttggtacaggcatttgtgcaaaatgggaccgtgagtacaaatgagtttctgtgcgacaaagataagacttcaaccgttgcccccacaattcatacaacagtcccatccccgaccacaacccctactccgaaggaaaagcctgaggccggaacttacagtgtgaataacggaaacgatacatgcctgcttgctacgatgggcttacagctcaacatcacacaggataaagtggcgagcgtgatcaatattaatcccaatacaacccactccaccggcagctgccgctcgcacactgcactcttacggctgaattccagcactataaagtacttggattttgtatttgcagttaaaaacgagaaccgcttctatttgaaggaggtgaatatttccatgtacctcgtaaatggatccgtgttctcaatcgcgaacaataatctctcctattgggacgctccgctgggatctagctatatgtgcaacaaggaacagacagtcagtgtatcgggagcttttcagatcaacacttttgacttgcgcgtccagcccttcaatgttactcaggggaagtattcaaccgcccaggagtgcagcctggacgatgatactatcttgattcctattatcgtaggagcaggtttgtccggactgatcatcgtcattgtcattgcctatgttattggcagaaggaagagctacgcagggtaccagacattatag

SEQ ID NO: 193755 - DNA, 447 bp, Artificial Sequence
  Description of Artificial Sequence: Synthetic coding sequence
atgaaggccctgatcgtgctgggcctggtgctgctgagcgtgaccgttcagggaaaagtttttgaacggtgtgaattggcccgcacactcaagaggctgggaatggacggatacagaggcatttccctcgccaactggatgtgcctggcgaagtgggagtctgggtataatacacgggctacaaactataacgcgggtgaccgaagtacggactacgggatcttccaaataaactcccgctattggtgtaatgatggaaaaactcctggcgcagtgaacgcctgtcatctatcatgctctgcgctgctgcaagataatattgcagacgccgtcgcttgcgcaaagcgggtggtacgcgaccctcagggcatccgtgcctgggtggcctggcggaacaggtgtcagaatagggatgtgcggcagtatgtgcaggggtgcggcgtctag

SEQ ID NO: 193756 - DNA, 585 bp, Artificial Sequence
  Description of Artificial Sequence: Synthetic coding sequence
atgcaggacgcccccctgagctgcctgagccccaccaagtggagctccgtcagctcagccgactcaacagagaagtccgccagcgcagcaggaacacgcaatctcccgttccagttctgcctccggcaggccctccgaatgaaagcggcaggtatactcaccttgatagggtgcttagtcacaggagctgaatctaaaatctataccagatgtaaactggccaaaatttttagtcgggccgggctcgataactactggggcttcagcctcggcaattggatctgtatggcttactacgaaagtgggtacaacaccacagcgcaaactgtgctcgacgatggttccattgattacggcatctttcagatcaactcctttgcttggtgtagaaggggtaaactgaaggaaaacaatcactgtcatgtggcctgtagcgcgctcgttactgacgatctgaccgacgccatcatatgcgctaaaaaaattgtaaaggagacacagggcatgaactactggcaggggtggaagaaacactgcgaagggcgtgatctcagcgactggaaaaaagactgcgaggtgagctag

SEQ ID NO: 193757 - DNA, 441 bp, Artificial Sequence
  Description of Artificial Sequence: Synthetic coding sequence
atgaaggccagcgtggtgctgagcctgctgggctacctggtggtgccatctggcgcgtatattttgggacggtgcacggttgccaagaaacttcacgacggcggcctggattacttcgagggctacagcctcgagaactgggtgtgtttagcctactttgagagcaaatttaatcctatggccatctacgagaacacacgggagggttacaccggattcggattgttccagatgaggggcagtgattggtgcggggaccatgggcgaaaccgctgccacatgagttgctccgccctcttaaaccctaatctggagaagacgataaaatgcgccaaaactatagtgaaagggaaagaggggatgggagcctggccgacgtggagcagatactgtcaatatagcgacacattagcacgatggcttgatggctgtaaactgtag

SEQ ID NO: 193758 - DNA, 441 bp, Artificial Sequence
  Description of Artificial Sequence: Synthetic coding sequence
atgaaggccagcgtggtgctgagcctgctgggctacctggtggtgcccagtggggcgtacatccttggaagatgcactgtcgccaagaaactgcatgacggaggcctcgattatttcgaaggttatagcctggagaattgggtgtgtctggcttatttcgagagcaaattcaacccaatggccatctatgagaatacaagagaaggttacacgggattcggactctttcagatgcgcggtagcgactggtgtggcgaccacggcagaaaccggtgtcatatgagctgttcggccctgctcaatcccaatctggagaaaaccattaaatgcgccaagaccatcgtgaagggtaaggaaggcatgggggcctggcccacttggagtagatactgtcagtactcagatacacttgcccgctggcttgatgggtgcaaactctag

SEQ ID NO: 193759 - DNA, 447 bp, Artificial Sequence
  Description of Artificial Sequence: Synthetic coding sequence
atgaccaaggccctgctgatctacctggtgagcagcttcctggccctcaatcaggcttcgctaatttctcggtgcgatttggcccaagttttgcagctggaagatctggacggcttcgagggatatagtttgagtgattggctctgtctcgctttcgtggaaagcaaatttaacattagtaaaattaatgagaacgcagacggaagtttcgactacggcctgttccaaataaattcgcactattggtgtaatgattataaatcttacagcgagaacctatgtcacgtggattgccaagacctcctgaacccaaacctccttgcagggatccactgcgccaaacgaattgtgagcggcgccaggggtatgaataactgggttgaatggcgacttcactgtagtggacgccctctgttttactggcttaccggctgtcggctccgctag

SEQ ID NO: 193760 - DNA, 447 bp, Artificial Sequence
  Description of Artificial Sequence: Synthetic coding sequence
atgaccaaggccctgctgatctacctggtgagcagcttcctggcccttaatcaagcgtctctgattagtcgctgcgacctggcccaggtgctccagctggaggatctcgacgggttcgagggctacagcctttccgattggctgtgtctcgcgtttgtggagagtaaatttaacatctccaagatcaatgaaaatgcagacgggagtttcgattatggcctgtttcagattaactcgcattactggtgtaatgactataagtcctatagcgaaaatttgtgccacgttgattgccaggacctcctgaacccaaacctgctggccggcattcattgcgccaagcgtatcgtgtctggtgctcgaggcatgaataactgggtagagtggcgccttcattgcagtgggcgacccctattctactggctgacgggctgtaggctgaggtag

SEQ ID NO: 193761 - DNA, 447 bp, Artificial Sequence
  Description of Artificial Sequence: Synthetic coding sequence
atgaccaaggccctgctgatctacctggtgagcagcttcctggccttgaatcaggcctccttaatcagtagatgcgatctggcacaggttctacagttggaagatttggacggctttgagggatatagcctgtctgactggctctgtctcgcgttcgtcgagtcaaaatttaatatcagcaagatcaatgagaatgccgatgggtcattcgactacgggttgttccagatcaatagccactactggtgcaacgactataaaagctactcagagaatctgtgccatgttgactgccaggatctgttgaacccaaacctgctggcgggaattcattgtgcgaagaggatagtgtccggtgcaagaggtatgaataactgggtggaatggcgattgcattgctcggggagacccctattctactggttgaccggctgtagacttcgatag

SEQ ID NO: 193762 - DNA, 2952 bp, Artificial Sequence
  Description of Artificial Sequence: Synthetic coding sequence
atggagatgaagctgcccggccaggagggcttcgaggccagcagcgctccacgaaacatcccctccggcgagctcgattccaatccagaccctggaaccggcccctcccctgacggtccttcagacacagagtctaaggaactgggggtacccaaagaccccttgctgtttatacagcttaacgaacttctcggatggccccaagcgctcgaatggcgtgagacagggtcatcttccgccagtctcctgctcgatatgggcgagatgccgagcattactttgagcacccatttgcatcacaggtgggtgctctttgaggaaaagctggaggttgctgcagggaggtggtccgctccccacgtgcctacgctggcacttccgtcgctccaaaagctgagatcccttcttgctgaagggctcgttctcctcgactgcccggcacagtctctactcgagctagtggagcaagtgacgcgagttgagtctctgagcccggaactcagagggcagttgcaggccctcctgttacagcgcccacagcactataaccaaactactgggacacgaccctgctggggcagcactcacccacggaaggcttccgataatgaggaagctcctttgcgagaacagtgtcagaaccctttgaggcaaaagttacctcccggcgctgaggcaggcacggtgctggccggggagctgggattcctggctcaaccactgggagcattcgtacgtttaaggaaccccgtcgtactggggagtctaactgaggtctcgctaccgtcacgttttttctgcttactgctgggaccgtgcatgctaggcaaaggataccatgagatgggacgggcagccgcagtactgctgtccgacccacaatttcagtggtccgtcagacgggcgagtaacctgcacgatctgctcgctgcactggacgcgttccttgaggaggtcacagtgctaccacccggacggtgggatcctacggccaggattcctccacccaagtgtctgccttcccagcacaaacgcttaccctctcagcagcgcgaaatcagggggcccgccgtgcctcggttgacatccgccgaggacagacatcggcacggaccgcatgctcactcgcccgaacttcagcggactgggagattgttcggcgggttgattcaggacgtgaggcgcaaggtgccttggtacccaagcgatttcttggacgctctgcacctccagtgcttttcagccgtgttatacatttacttagcaaccgtcactaatgctatcacttttggcgggctcctgggagacgccaccgatggcgcgcagggggtgctggagtcttttctagggaccgccgtggcgggcgccgccttctgcctaatggcagggcagccacttaccatcctctcatcaactggccctgtgctggtgttcgagagattgttgttcagcttctctcgcgattattcgcttgattacctccccttccgtctgtgggtgggcatctgggtggccacgttctgcctagttctggtggccaccgaggctagcgtcctggtgcgctattttacccgctttacggaggaggggttctgtgcattaataagtttgatctttatatatgacgctgttggtaaaatgctcaatcttacacacacctatcccatccagaaaccgggctcgagtgcctatggatgcctctgccagtatccaggtcccggaggaaatgaaagtcagtggatcagaactaggcccaaagaccgagacgacatcgtttccatggaccttggcttgatcaatgcgagcctgctccccccacctgaatgcacccgccagggagggcacccccgtgggcccggatgccacacagttcccgacatcgcctttttctcattgctgctctttctgacaagtttcttttttgccatggccttgaagtgcgtcaagacctctagattttttccttcagtggtgaggaagggcctgtcagatttctcaagcgtgctcgcaattctgcttggatgtggtctggacgcattcctcgggttagccaccccaaagctgatggtgccccgtgagttcaagcccaccctcccagggcgagggtggcttgtctctccttttggagcaaatccctggtggtggagtgtggcagctgctttgcccgccctactcttaagtatactgatcttcatggaccagcaaataacggccgtcatcttgaatcgcatggaataccgcctccagaaaggcgccgggtttcacttggacctattctgtgttgccgtgcttatgctcctaactagtgccctaggattaccctggtacgtttcagcaacagtgatctcattagcacacatggattctctccggcgcgagagtagagcctgtgcacccggtgaacggcccaatttcctcgggatccgggagcagcgcctgaccggactcgttgtgttcatcctgaccggagcctccattttcctcgcgcccgtcctcaagtttattccaatgccagtgttatatgggatatttctctacatgggagtcgctgccctttcaagtattcagttcaccaatagggtgaaactgctattgatgccagctaagcatcaacctgatctgctgctgttaagacacgtgccactcacccgggtccatctctttacagcaatacagttggcttgtttgggcctgctgtggattattaaatctacccccgccgctatcatctttcccctgatgcttctcgggctagtgggtgttaggaaagccttggagcgtgtttttagtccacaggagttgctttggttggacgaattaatgcccgaagaggaacgctctattcccgaaaagggattggaaccggagcatagtttttcaggaagtgactccgaggattcagagttaatgtaccagcctaaggcacctgagatcaacatctccgtcaactag

SEQ ID NO: 193763 - DNA, 123 bp, Artificial Sequence
  Description of Artificial Sequence: Synthetic coding sequence
atgcggttcgcctggaccgtgctgctgctgggccccctgcagctgtgtgcgttagtccattgcgcccccccagccgcgggtcaacagcagccccccagagaacccccagccgcccccgggtag

SEQ ID NO: 193764 - DNA, 1134 bp, Artificial Sequence
  Description of Artificial Sequence: Synthetic coding sequence
atgcggttcgcctggaccgtgctgctgctgggccccctgcagctgtgcgcattagtccactgcgctccccctgcagcagggcagcaacagcctcccagggagcctcccgccgcccccggagcagctagtgcccaacagcctcggacccctatcctgttgattcgcgacaacaggacggccgcggccagaactcgcacagccggatcctccggtgtcaccgccgggcggccccgccccactgcgcggcattggtttcaggctggatatagtacatctcgtgccagggaagccggcgccagcagggctgaaaaccagacagcaccgggggaagtaccagccctatctaatctgcgacccccatcacgcgtggatggcatggtgggggatgacccctataacccatacaagtactctgacgataacccctactacaattattacgacacttatgagcggcccaggccagggggcaggtatcgcccaggatacggaacagggtattttcaatacggactgccagaccttgtggcagacccttactatatccaagccagcacatacgtccagaaaatgagcatgtataaccttcgctgcgccgctgaagagaattgccttgccagcacggcctatcgcgcagatgttagagattacgaccatcgggtcctgctcagattcccccaaagagtgaagaaccaaggcacttcagatttccttccctctaggcccaggtatagctgggagtggcactcatgtcatcagcactatcacagcatggatgagttctcccattacgacctgcttgatgccaacacacagaggcgcgttgccgaaggtcacaaagcttcgttttgcttggaggacacctcctgtgactatgggtaccatcggagatttgcatgcactgctcacacacagggcctttcccccggatgttatgatacctacggcgccgacatagactgccagtggattgatatcactgatgtaaagccagggaactacatcctgaaagtttccgtgaatcctagctatctggtgcccgaaagcgactacacaaataatgtggtgcgctgcgacatcaggtataccggacaccacgcttacgcctcaggctgtacaatatctccttactag

SEQ ID NO: 193765 - DNA, 2325 bp, Artificial Sequence
  Description of Artificial Sequence: Synthetic coding sequence
atggagcggcccctgtgcagccacctgtgcagctgcctggccatgttggcccttctgtcacctctttccctggctcagtacgatagctggcctcattatcccgaatacttccagcagccggctccagagtaccaccaacctcaagccccagccaatgttgccaagattcaattacggctagccgggcagaagagaaagcattccgagggacgagtggaagtgtactacgatggccaatggggaactgtgtgtgacgacgatttcagcatacatgcagcgcatgtcgtatgccgtgagttggggtatgtggaggctaagtcttggacagcatcctcttcttacgggaagggtgagggtcccatttggttggataatctgcactgtactggaaatgaggcaacactcgctgcttgcacttctaacggatggggggtaacagattgtaaacacacagaggacgttggcgtggtctgctccgataaaagaatacctggtttcaagttcgacaacagccttatcaaccaaattgagaatctgaacattcaggtggaagacatacgtattagagccatattgtcaacatatcgtaagaggactccagttatggaaggttacgtggaggtcaaagagggtaaaacatggaagcagatttgcgataagcactggacagcaaaaaattctcgagtcgtgtgtggtatgtttggcttccctggggaaagaacctataacaccaaggtgtacaagatgtttgcgagtcggcggaagcagcgttattggcctttttctatggattgcacgggaaccgaagcccatatttctagttgcaagctggggccccaggtcagcttggaccccatgaaaaatgtgacttgtgaaaacggcctcccagcagtggtctcttgcgtaccggggcaggtattctcaccagacgggccttcgagattccggaaggcatataagccagagcagcccctggtcaggcttcgcgggggggcatatatcggcgagggtagggtggaagtgttaaaaaatggggaatggggcaccgtatgtgatgataaatgggacctggtttccgcaagcgtggtgtgccgagagctcggcttcggatctgcaaaggaggcagtgacaggaagtagacttggacagggcataggcccgattcatctgaatgagattcagtgtacaggaaatgaaaaaagcataatcgactgcaagttcaatgccgagagccagggctgcaatcacgaggaggacgcaggggtgaggtgcaacacccctgctatgggtctgcagaaaaagctccgtctgaatggaggtagaaatccttatgagggaagggtggaggtacttgtggaaaggaacggctcgcttgtgtggggaatggtttgtggtcaaaactgggggattgtggaggcaatggtagtatgtcgtcagctgggcctgggctttgcctcgaacgcttttcaggaaacatggtactggcatggagacgtgaactcaaacaaggtggtgatgagtggggtcaaatgctcaggaactgagctatctctggctcactgtaggcatgacggagaggatgtagcttgcccccaaggcggagtgcagtacggggcgggggtggcctgctcggagacagccccggatctcgtactgaacgccgagatggttcagcaaacaacttacctcgaagaccgccccatgtttatgttgcagtgcgccatggaggaaaactgcctctctgccagcgcggcccagacagatcccactactggatatcgtagattgctcaggttcagctctcagatccacaataacgggcagagcgacttccgccctaagaacggtagacacgcatggatatggcatgattgccaccgtcattaccacagtatggaagtatttacacattatgacctgctgaatttgaatggaaccaaggtagcagaaggacataaggcttctttttgtctggaagatacggagtgtgaaggggacattcagaaaaactacgaatgtgctaattttggcgatcaagggatcaccatgggatgttgggacatgtatcgccatgacatcgactgtcagtgggtcgacataactgacgttcccccaggcgattacctttttcaagtggtcataaacccgaatttcgaggtggccgagtccgactacagtaacaacatcatgaaatgccgatctcgatatgacggacaccggatctggatgtacaactgccatatcggggggagtttcagcgaagagaccgagaaaaagttcgagcacttttctggactgcttaacaaccagctctctcctcagtag

SEQ ID NO: 193766 - DNA, 456 bp, Artificial Sequence
  Description of Artificial Sequence: Synthetic coding sequence
atggagcggcccctgtgcagccacctgtgcagctgcctggccatgctggcccttctgagccccctatctcttgctcagtacgactcgtggccacactaccccgagtattttcagcagcccgcccctgagtatcaccagcctcaggctcccgcaaacgttgcgaagatccagttacgactggctggtcagaaaagaaaacatagcgaagggagagtggaggtctactatgacggtcaatggggtacagtgtgcgatgacgacttcagtatacacgctgcccacgtggtgtgccgcgagcttgggtacgtggaggcaaagagctggaccgcgagtagctcctacggtaaaggggagggcccaatctggctggacaacctgcattgcacaggcaacgaagccaccttggccgcatgcacatccaatggctggggtgttactgactgcaaacatacatag

SEQ ID NO: 193767 - DNA, 291 bp, Artificial Sequence
  Description of Artificial Sequence: Synthetic coding sequence
atggagcggcccctgtgcagccacctgtgcagctgcctggccatgctggctctgttatctcctctgagtcttgctcagtatgacagctggccacattatcccgaatatttccagcaacccgcaccagaatatcatcagcctcaagcaccagctaatgtggccaagatacagctccggcttgcaggccagaagaggaagcatagtgagggacgggtggaggtgtactatgatggccagtgggggacagtgtgtgacgatgatttttcgatacacgcagctcacgtcgtgtag

SEQ ID NO: 193768 - DNA, 420 bp, Artificial Sequence
  Description of Artificial Sequence: Synthetic coding sequence
atggagcggcccctgtgcagccacctgtgcagctgcctggccatgctggccctcttgtccccactcagtttagctcagtacgacagctggccccattacccagaatactttcagcaacctgctcccgaataccaccagccacaggcaccagcaaatgtagcaaagatccaacttcgactggctggtcagaaacgtaagcacagcgaaggacgagtggaagtctactacgatggccagtggggcaccgtgtgcgatgatgatttttctattcatgcagcacacgttgtctgcagagaactggggtacgtggaagccaagagttggacagctagctcaagttatggcaagggcgaggggccgatctggctggacaacctgcactgcactggaaatgaggcgactctcgccgcttgcacgtag

SEQ ID NO: 193769 - DNA, 2262 bp, Artificial Sequence
  Description of Artificial Sequence: Synthetic coding sequence
atgcggcccgtgagcgtgtggcagtggagcccctggggcctgctgctgtgtttgctttgttcttcctgcctcggttcaccatcacccagcacaggccccgagaaaaaagcaggttcccagggccttcggtttaggctcgctggcttcccaaggaagccctacgaggggcgcgtggaaatccaaagggctggcgagtgggggaccatttgcgatgacgattttacccttcaggctgcacacatactttgccgagaactcgggttcactgaggcaaccggctggacccactcggcaaagtatggacccggaaccggcagaatctggctggataatctaagttgctccggaacagaacagagcgttactgagtgtgcaagtagggggtggggcaatagcgattgtactcatgacgaggacgccggggttatttgcaaagaccagagattgcctggatttagtgactctaacgtcatcgaggttgagcatcatttacaagtggaagaggtcaggattagaccagccgtgggctggggtcgacgacctctgccagtgactgaagggttagtggaggtgagactgccagatggatggtctcaggtttgtgacaaaggatggtctgctcataattcccacgtggtctgcggcatgctgggctttccatccgagaaacgggtaaacgcggcattctacaggcttctggcccagcggcaacagcatagctttggactccatggagttgcatgtgtgggtactgaagcacacctcagcctctgctctttagaattctaccgcgcgaatgacacagcccgctgcccagggggaggaccggcagtggtctcatgcgtgcctggacccgtgtatgctgctagctccggccaaaagaaacagcaacagtcaaagccccaaggggaagctcgagtccgcttgaaggggggggcacacccgggtgagggtagagttgaggtgctgaaggcctctacgtggggcaccgtatgcgatcgtaaatgggatctgcacgctgcatcagtcgtgtgtcgcgaactcgggttcggctctgccagggaggcactgtcaggcgcccgaatggggcaggggatgggagctatccacctttcagaggtgcgctgttctgggcaagagctttctctttggaagtgtccacacaaaaacatcacagcagaagactgtagccactcccaggatgcaggtgttaggtgtaatctgccctacacaggagccgagactcgaatcagactctctgggggaaggagtcagcacgaaggccgggtggaagtccaaattgggggtcccggtcctttaaggtggggcttaatttgtggcgacgattggggcaccttagaggccatggtggcctgtagacagctgggccttgggtacgccaaccatgggcttcaggaaacttggtactgggacagcggaaatataacagaggtggtcatgtctggcgtccgatgcactggaaccgagctttctctggatcagtgcgcgcatcacggcacgcatattacatgtaagagaacagggacccggttcacagccggagtcatatgttccgaaactgcatcagatttacttctgcactccgctctagtgcaggagacggcttatattgaggatagaccactgcacatgctttactgcgccgccgaggaaaactgcctggcctccagtgcccgcagcgccaactggccctacgggcataggcgccttctgcgctttagttcacagatccacaacctaggccgcgccgacttcaggccaaaagctggaagacattcctgggtttggcatgagtgtcatgggcactatcattcaatggacatctttacacactacgacattctgacacctaacggcacaaaagtggcagagggccacaaggcctctttctgcctcgaggacaccgaatgccaagaggacgtgtcgaaacgttacgagtgcgctaatttcggcgaacaggggatcaccgtaggatgttgggacttgtatcggcacgatatcgactgtcagtggattgacattactgatgtgaaaccaggaaattatatcttgcaagtcgtcatcaatcctaactttgaggttgccgagtccgatttcactaataatgccatgaagtgcaactgcaaatacgatggacatcgcatatgggtgcacaactgtcacattggagacgctttttccgaagaagccaacagacgttttgaacgttaccccggtcaaacgagcaaccaaatcatctag

SEQ ID NO: 193770 - DNA, 1827 bp, Artificial Sequence
  Description of Artificial Sequence: Synthetic coding sequence
atgcggcccgtgagcgtgtggcagtggagcccctggggcctgctgctgtgcctgctgtgcagctcctgcctgggctctccatcaccatcaacagggcccgaaaagaaggcaggatcccagggtcttaggttcagattggcgggcttcccgaggaagccttatgaaggccgggtagagatccagagggcaggtgaatggggcactatttgtgatgacgatttcacactgcaggcagcgcatattctctgcagggagctagggtttacagaggctacaggctggacacacagcgcaaaatacggacctggcaccggccgtatctggctagacaatctgagctgctctggaaccgaacaaagcgtcacagaatgcgcatccagggggtgggggaacagcgactgtacccacgatgaggatgccggtgtcatttgtaaggatcaaaggctccctggattttctgactccaacgtgattgaagctcgcgtccgcctgaaagggggagctcatccaggggaaggaagggtcgaagtgttgaaagcctccacatggggtaccgtgtgtgatcgtaagtgggatctccatgccgccagtgttgtgtgcagagagcttggcttcggaagcgcgagagaggctttgtccggcgctagaatgggtcaaggcatgggagctatccacctgagcgaggtacgctgttccggacaggaattatctctctggaaatgtcctcataagaatatcacggcagaggattgctcccactcgcaggacgccggggtccgatgcaatctgccttatacaggcgccgaaacaagaattaggttgtccgggggcagatcccagcatgagggcagggtggaggtgcagattggcgggcccgggcctctgcgctggggactgatttgtggtgatgactggggtaccctcgaagccatggtagcctgccggcaactcggattgggctacgccaatcacggacttcaggagacttggtactgggacagtggcaatattacagaggtcgttatgagcggggtaaggtgtaccggaacagagctgtccctggaccagtgcgcccaccacggcactcatattacgtgcaaaagaacaggaacccggtttacagctggagtcatttgttccgagaccgcctcagatctgctgttacatagcgccctcgtgcaagagacagcatacatagaggacagacctctgcacatgctgtactgtgccgcggaagagaattgcttggcatcctctgctcgatcagccaactggccatacggccaccgccgcctccttcgattttcctctcaaatccacaatctcgggcgggctgattttcggcccaaggcaggaagacactcatgggtgtggcacgagtgccacggtcactaccactccatggatatcttcacacactacgacatccttaccccgaatggcaccaaggttgcggaaggtcataaagcatcgttttgtctcgaagacacagagtgccaggaggacgtgagcaaaagatacgaatgtgccaactttggggagcagggcataactgtaggatgctgggatctgtataggcacgacattgactgtcagtggatcgacattacggatgtgaagccaggaaactacattttgcaggtggtgatcaacccgaattttgaagttgcagaaagcgattttaccaataacgccatgaaatgtaattgcaaatatgatgggcaccggatctgggttcacaattgccatatcggcgacgccttctccgaggaggcaaaccgccggttcgagaggtacccagggcaaacatcaaaccagattatatag

SEQ ID NO: 193771 - DNA, 2094 bp, Artificial Sequence
  Description of Artificial Sequence: Synthetic coding sequence
atgcggcccgtgagcgtgtggcagtggagcccctggggcctgctgctgtgtcttttgtgttcgtcttgcttggggtcaccgtcgccttccactggaccggagaaaaaggcaggaagccagggactgcggttccgtctcgccgggtttcctcggaagccctacgagggacgcgtcgaaattcaaagggcaggggagtggggcaccatatgcgatgacgactttaccctacaggcagcgcacattctctgtagagagttaggctttactgaggccaccggctggacccatagcgcaaaatatggccccggcacgggccggatttggcttgataacctcagctgtagcggcacagagcagagcgtgacagaatgcgcaagccgcgggtggggcaattcggattgtacacacgacgaagatgccggggtgatctgtaaggaccagagattgccaggcttttctgactccaatgtgattgaagtcgagcatcatctgcaggttgaggaggtgcggatccgtccagccgtgggatgggggcgacgacctctcccagtgacagagggacttgtggaggtgcggctccctgatggttggtcccaggtctgcgacaaaggctggagcgcccacaacagccacgttgtgtgtggcatgctggggttcccaagtgagaagagggtcaacgctgctttttataggctgcttgcacagagacagcagcattcttttggactccacggggtggcctgcgtagggacggaagcacacctcagcctttgctcacttgagttctatagggctaacgataccgctagatgtccgggcggggggcctgccgtcgttagctgcgtgccgggacctgtgtatgccgcaagcagcggccaaaaaaaacagcaacagtccaaaccccagggggaggccagagtgagactaaaagggggggctcaccctggcgaaggccgtgtggaggtgctgaaagcttctacatgggggacggtgtgcgatcgcaagtgggatctccacgcagctagcgttgtgtgtagggaattgggctttggaagcgctagagaggctctgtcaggagccaggatgggccagggcatgggagctatacacctgagtgaggtgcgttgtagtggccaagagcttagcctgtggaaatgtcctcacaagaatattacggcagaggactgttcacatagtcaggatgctggagtaagatgcaacctgccatatactggagctgagacccgggaaacatggtattgggacagcgggaacattaccgaagttgtgatgtctggggtgagatgtaccggtaccgagctgtctctcgaccagtgcgcacaccacgggactcacattacctgcaaacggacaggcacgcgatttactgccggtgtgatctgcagcgagacggcctcagacctgctgctgcactccgcactggtccaagaaacagcttatattgaggacagacccctccatatgctgtattgtgccgccgaagagaattgtctggcctcctccgccagaagcgcgaattggccatacggacaccggaggctcctgaggtttagcagccaaatccacaacctgggtcgagcggatttccgcccgaaggcgggacggcacagctgggtgtggcatgaatgccacggccattaccattccatggatatctttactcattatgacatcttgacccctaacggaactaaagtggcagagggccacaaagccagcttttgtctagaggacactgagtgccaagaggacgtcagtaagcgatatgaatgtgctaactttggcgaacagggaataacggtcggatgctgggatctgtacaggcacgacatcgattgccagtggatagacattactgatgttaagcctggtaactacatcctgcaagtcgtcattaaccccaacttcgaagtggccgaatccgatttcaccaacaatgctatgaaatgcaactgtaaatatgatgggcatcgcatctgggtccacaattgccacatcggagatgccttcagcgaagaagctaataggcggttcgagcggtaccctggacaaaccagtaaccagattatctag

SEQ ID NO: 193772 - DNA, 912 bp, Artificial Sequence
  Description of Artificial Sequence: Synthetic coding sequence
atgcggcccgtgagcgtgtggcagtggagcccctggggcctgctgttgtgtctcctgtgctccagctgtctggggtccccgagtccctctacaggtccggagaagaaggctggttctcagggtctcagattcagactcgcagggtttccaaggaaaccctatgaagggcgcgttgagatccagagagccggcgagtggggcactatctgcgacgacgatttcaccttgcaagccgctcatatcctgtgccgggagttgggattcacggaagctactgggtggactcattcagccaaatatggaccgggaactggtaggatttggcttgacaatctctcttgctccggaacggagcagtccgtcaccgaatgcgctagccgaggatgggggaactcagattgcacccatgacgaagatgcaggcgtcatctgtaaggatcaaaggcttccaggatttagcgattcaaacgtcattgaggtggagcatcatttgcaggtcgaagaggtgagaatccgccctgcggtggggtggggcaggcgcccactaccagtaacggagggcctagtcgaagtgcggctgcccgacgggtggagccaggtttgtgataaaggatggagtgcccacaatagccacgtggtgtgtggaatgctgggtttcccctccgaaaagagggttaacgccgcattctataggctgctcgcccaacggcagcagcatagtttcggccttcatggggtggcctgcgtggggacagaagcgcacttgagtctgtgctccctcgaattttatcgagcgaacgacacggcgcgatgtccgggcggaggcccagcagtggtctcctgcgtaccaggaccagtctacgctgcctcttccgggcagaagaagcagcagcaaagtaagccacaaggatag

SEQ ID NO: 193773 - DNA, 2271 bp, Artificial Sequence
  Description of Artificial Sequence: Synthetic coding sequence
atggcctggagcccccccgccaccctgttcctgttcctgctgctgctgggacagccccccccttctcggcctcagtcgttgggtaccacgaaactgagacttgttggccccgagtccaaaccagaggagggcaggctagaggtgttgcaccagggacaatgggggaccgtctgcgatgataattttgcgattcaggaggcaacggtagcctgccgacagctgggttttgaagcggccctgacatgggcccattcagctaagtacggacagggagaaggacccatatggctggacaatgtaagatgcgtcggaaccgaaagtagcctggatcaatgcggaagcaacgggtggggtgtgtcggattgctctcactctgaagatgtaggggtaatctgccatcccagacggcatcgaggttatctcagcgagacagtgtccaatgcactgggccctcagggcaggaggctcgaggaagtcaggctgaagccgatcttagcatcagcaaagcagcactcacccgtgaccgagggagccgttgaggtaaagtatgagggacactggaggcaagtgtgtgatcagggctggacaatgaataatagcagggtggtgtgcggaatgctgggcttccccagcgaggttccagtcgattctcactattaccgcaaggtgtgggatctgaaaatgcgggaccccaagagtagattgaagagcttaaccaacaagaactccttttggattcaccaggtaacatgtctaggcaccgaacctcatatggctaattgtcaggtgcaggtcgcgccggcccgcgggaagcttcggcctgcttgcccgggcggcatgcacgctgttgttagttgcgtggcagggcctcatttccgccctcccaaaactaagcctcagcggaaagggagttgggcggaggagccaagggtgagactgaggtctggggcccaggtgggcgaggggagagttgaggtattgatgaatcgacaatggggcactgtctgtgaccaccggtggaatcttattagcgctagcgtagtctgccggcagcttgggtttggaagtgctagggaggccctgttcggagcccgacttggacaggggctgggccccatccatctttccgaggtaaggtgcaggggctatgagcgaaccttatctgactgtcctgcactggaaggctcccagaacggttgccaacacgagaatgacgcagccgtgcggtgcaacgtgcccaacatgggattccagaatcaagtgcggttggcaggcggcagaatccccgaggaggggctgctggaagttcaggttgaggtgaacggggtccccagatggggcagcgtttgctcagagaactggggacttacagaggccatggttgcctgcaggcagctaggcctcgggttcgctattcacgcttataaagagacgtggttttggtccggcacaccaagggcccaagaggtggtcatgagtggggtgagatgcagtggcacagagctggcgcttcagcagtgtcagcggcacggccctgtgcactgcagtcacgggggggggcgctttttagccggagtctcatgcatggattctgccccggatctcgtaatgaacgcgcagttagtgcaggagaccgcctatctcgaagatagaccactctctcagctgtactgcgcacacgaagagaattgtctctcgaaatctgcagaccacatggactggccttatgggtataggagattgctgcgctttagtactcaaatttacaatctcggccgaaccgacttccggcccaagacagggcgggactcttgggtttggcaccaatgccacagacactatcactcaattgaggttttcactcactacgacctattaacattaaacgggtcaaaggttgccgaaggccacaaagcatccttctgcctcgaggatactaactgtccgaccggcctccagagaaggtatgcgtgcgccaacttcggagagcagggtgtgaccgtgggatgctgggacacatatagacacgacatcgattgccagtgggtcgacatcactgatgtcggacccggcaactatattttccaggtaattgtgaacccgcattatgaggtggccgagtctgatttctccaataacatgcttcagtgccgatgcaaatacgacggtcacagagtgtggctccataattgccatacgggcaatagctatcctgccaacgctgagctgagcctcgagcaggaacagcgcctgcgtaataatctcatttag

SEQ ID NO: 193774 - DNA, 1794 bp, Artificial Sequence
  Description of Artificial Sequence: Synthetic coding sequence
atggccgccgtgcaggccgccgaggtgaaggtggacggcagcgagcctaagctgtccaaaaacgaactgaaacggaggctaaaggctgagaaaaaagtggcggaaaaggaagccaagcaaaaggaactctctgagaaacaactgtcacaggctacagcagccgcaacaaaccatacaacagacaatggcgtgggcccggaagaggagtctgtagacccaaatcagtactataagattcgtagccaggctatccatcagctcaaggtgaacggagaggacccatacccgcacaagttccacgtcgacatatccctgaccgacttcattcagaaatacagtcacctgcagcctggagaccatctgacagacatcaccttgaaagtggcgggaaggattcacgctaaacgcgctagcggcggcaagcttattttctatgacttgcgcggcgagggagttaagctccaggtaatggcaaatagcagaaactacaaatccgaagaagagtttatccatataaacaacaaactgcggaggggagatatcataggggtccagggcaacccaggcaagacaaagaagggggagctgtccattatcccatacgaaataaccctgctctcaccttgccttcacatgcttccacacctgcacttcggacttaaggataaggagaccagatatcgccaaagatatttggacctgattctcaacgacttcgtgaggcaaaaatttattattcgctccaagattataacttatatccgctcatttctggacgaactaggctttctagaaatcgagacacccatgatgaatatcataccaggaggggctgtggccaagccgttcatcacataccacaacgagttagacatgaacttgtacatgagaatcgctcccgagctataccataaaatgttggtcgtgggagggattgatcgtgtgtatgaaattggcaggcagttccgcaacgaaggcatcgacctcacacacaacccagaatttactacttgcgaattctatatggcttatgctgattaccacgacctaatggaaatcacagaaaagatggtatccggtatggttaaacatattacgggttcatataaggtgacctatcatcctgacggccccgagggacaagcttatgacgtggacttcactccgccgtttaggaggatcaatatggtcgaagagctcgaaaaggcccttggtatgaagttgccagagaccaatctgtttgaaacggaagagacccgtaagatactggacgatatctgcgtggccaaagccgttgaatgtcccccgcccaggacaacagctcggctccttgacaagctcgtgggggaatttctagaagtgacatgcattaatcccacgttcatttgtgaccatcctcagattatgtcccccttggctaagtggcatcggtctaaggaaggacttactgagaggttcgagttgttcgttatgaagaaagagatatgcaacgcctatacagagctgaacgacccaatgcgccagcggcagctgttcgaggagcaggctaaggccaaggctgccggcgatgacgaagcaatgttcattgacgaaaatttctgtaccgccctggagtacgggttgcctcccactgccggttggggaatgggcatagatcgagtcgcaatgttcctgacagatagcaacaatattaaggaggttctcctgtttcctgccatgaagcccgaagacaagaaagaaaatgtagccaccacagacactctcgagtccaccactgtcggcacctcagtgtag

SEQ ID NO: 193775 - DNA, 1878 bp, Artificial Sequence
  Description of Artificial Sequence: Synthetic coding sequence
atgctgacccaggccgccgtgcggctggtgcggggcagcctgcggaagaccagctgggcggagtgggggcaccgggagttgcgcctgggacagttagcccccttcactgctccccataaggacaagagctttagcgatcagcggtcagaactaaaacgccggttgaaggcagaaaagaaggtggcagaaaaggaagctaagcagaaggaacttagcgaaaaacagctgtcccaggcaactgccgctgcgaccaaccacacaaccgacaacggggtggggcccgaagaagagtcggtggatcccaaccaatactataaaattcgttcacaggcgattcaccaactcaaggttaacggagaagatccatatccacataaatttcatgtggacatttctctgacggactttattcagaaatactcacacctgcaacctggggatcatttgaccgacattactctcaaagtagccgggcggatccacgccaagcgggcttctggaggaaaactcatcttttacgacttaaggggcgagggcgtgaagctacaagtcatggcgaattcaagaaactacaaatccgaagaagaatttatccacattaacaataaactgagacgaggggacattatcggtgttcagggtaaccctggcaagactaaaaagggagagctgtccattatcccatatgaaatcaccttactgtccccatgtttacatatgctgccgcatttgcactttgggctgaaagataaggaaacccggtaccggcagagatatctggaccttatcttgaacgatttcgttagacagaaattcattatccgctccaagatcatcacctacattcgttcatttcttgacgaactgggctttttggagatcgagacgccgatgatgaacatcatccctggtggagcggtcgccaagcccttcataacttaccataatgaactcgatatgaacttgtatatgcgtatcgccccagaactgtatcacaaaatgcttgtcgtcggtggtattgaccgggtttatgaaattgggaggcaatttcggaatgagggaatagacttgacccataacccggaattcacaacctgcgaattttacatggcttatgctgactaccatgacttgatggaaatcaccgaaaagatggtgtctggaatggtcaagcacatcactgggtcctacaaggtgacctaccacccagacggcccagagggccaggcttatgatgttgacttcactcctcctttccgacggatcaacatggttgaggaactggagaaggcgttaggcatgaaactcccggagaccaacttattcgagaccgaggagacccggaagattctggacgatatctgcgtggcgaaggctgtggagtgtcctccaccacggaccacagcccgtctgctcgataaattagtgggggagtttctggaagtgacctgtatcaacccaacgttcatctgcgatcaccctcagattatgagcccacttgccaagtggcatcgcagtaaagaggggttgaccgagagattcgaacttttcgtgatgaagaaggagatctgcaatgcttacacagagctgaacgacccaatgagacagcgccaacttttcgaggagcaggctaaagccaaagcagcaggggacgacgaagccatgtttatagatgaaaatttctgcactgccctggagtatggattgccacctaccgctggctgggggatgggcatcgatcgcgtggccatgtttcttaccgactccaacaatatcaaggaggttttactgtttcctgcaatgaagcccgaagataagaaggagaatgttgcgactaccgacactcttgaatccactacagtaggtacttctgtttag

SEQ ID NO: 193776 - DNA, 1569 bp, Artificial Sequence
  Description of Artificial Sequence: Synthetic coding sequence
atgcagccctggcacggcaaggccatgcagcgggccagcgaggccggcgccaccgcccccaaggcatcagcccgaaacgccagaggcgctccaatggaccccacagaaagtcctgcagcccccgaggccgctctacctaaggccggcaagtttggcccagcaaggaagagtgggagcaggcagaagaagtccgcccctgacacccaggaaaggcctcccgtgcgcgctacaggcgctagagcaaagaaagctcctcaacgcgcgcaagacactcagcctagtgacgccactagcgccccaggtgcagagggactcgagccccctgccgccagggagcctgcactgagtagagctggctcttgccggcagcgaggcgctcgttgttcgacgaagcctagaccacccccggggccctgggacgtccccagtcctggacttccagtgtctgcgcccatcctggtgagaagagacgccgctcccggcgcttctaagctgagggctgttctggagaaattaaagctgtcccgtgatgatatcagtactgccgcaggtatggtaaagggggttgtggaccaccttctgctccgtttaaagtgcgattccgcatttaggggcgtcgggctattgaatacaggatcttactatgagcacgtgaagatctccgcccctaacgagttcgacgtaatgttcaagctcgaggtacccaggatccaattggaagagtactctaatacacgggcctactattttgtaaagttcaagcgtaatcccaaggagaaccctctaagccagtttctggagggcgagatcctgtcagcctcaaaaatgctttctaagttcagaaaaattattaaggaagaaattaatgacattaaggacactgacgtaattatgaagcgaaaacggggaggatcacctgccgtgaccctcctcattagtgagaagatttccgtcgacattacgctggctctggaaagcaaaagcagctggcccgcctcaacccaggagggcttacgaatacaaaactggttgtctgctaaagttcgtaaacaactgagactgaagcctttctacctggtgccaaagcatgccaaggaggggaatggcttccaggaagaaacatggagattgagtttctctcatatcgagaaagaaattttgaacaaccacgggaaaagcaagacctgttgtgaaaacaaggaagagaagtgttgccgtaaggactgcctgaaactgatgaagtacctgttggaacagctgaaggaacgctttaaggataagaagcacctggacaagttcagcagctaccacgtcaagacagcttttttccatgtgtgcacgcagaatccacaggactcgcaatgggaccggaaagacctcggcctctgttttgacaactgcgtcacctatttcctgcagtgcttaaggaccgagaagctcgaaaattatttcatacccgaatttaacttattttcatctaacctgatcgataaacggagtaaagagttcctaacgaaacaaattgaatatgagaggaataatgagttccccgttttcgacgagttctag

SEQ ID NO: 193777 - DNA, 1344 bp, Artificial Sequence
  Description of Artificial Sequence: Synthetic coding sequence
atgcagccctggcacggcaaggccatgcagcgggccagcgaggccggggcaacagctccaaaagcctcagcacgtaatgctcggggagctcccatggatcctactgagtcccccgccgccccagaggccgcactgccaaaggctggaaagttcggccctgccaggaaatccggatcaaggcagaaaaagagcgccccagacacacaggagcgcccccccgtccgagccacaggcgctagggcgaaaaaggcccctcagagagcccaggacactcaacctagtgacgcaacttccgcacctggggctgaaggtctggaacctcctgcagcgagagagcccgccctgagcagggcgggttcctgcaggcaacgcggggccagatgcagcacaaagccacgacccccccctggcccctgggacgtcccatcccccggcctcccagtgagcgccccaattctggtgaggcgggatgccgctccgggcgcctcaaaattgagggcagtgctagaaaaactgaagctcagtcgagacgatatctccacggcggccggaatggtgaaaggtgtcgtggatcaccttctgctccggctgaaatgtgactcagccttcaggggggtgggcctattgaataccgggagttactatgagcacgtgaagatctccgcaccgaatgagttcgacgtcatgtttaaactggaggtccctaggattcagttggaggagtattccaacacgcgggcctactattttgtgaaatttaaaagaaatcctaaggaaaatcctctgagtcaatttctcgaaggggaaatcctgtctgcttccaagatgctgagcaagtttcggaagataatcaaggaggaaattaatgatattaaggatacagatgtgataatgaaacggaaacgagggggcagccccgccgttacccttcttatctctgagaagatttccgttgatatcaccctggccttggagtctaagtctagttggcccgccagcacacaggaaggcctgcgcatacagaattggctttctgccaaggttcggaaacagcttaggctcaagccattctacctggtacctaaacacgcaaaggaggggaacggatttcaggaagagacgtggcggctcagcttctcgcacattgagaaggaaatcctcaacaaccatggcaagtctaagacgtgctgtgaaaataaggaagaaaaatgttgtaggaaggactgcctgaagctgatgaagtatcttctcgaacagctcaaagagagatttaaggacaagaagcacttagataagttctcttcatatcacgttaagaccgcctttttccaccgtttgtattag

SEQ ID NO: 193778 - DNA, 1080 bp, Artificial Sequence
  Description of Artificial Sequence: Synthetic coding sequence
atgatcgccgcccaggccaagctggtgtaccacctgaacaagtactataatgaaaaatgccaggcacggaaagctgctattgcaaagacgattcgcgaggtttgcaaggtagtgtcagatgttctcaaagaggtggaggtgcaagaaccccgattcatttcatcactaaatgagatggacaacagatacgaaggactcgaagtgattagcccgacagaattcgaagttgttctgtatctaaatcagatgggggtcttcaacttcgtggacgacggcagcctcccaggctgcgctgttctgaagctgtcagacggcaggaagcgatccatgtccctgtgggtggagtttataaccgccagtggctatctgtcagctagaaaaataagaagccgattccaaacactggtggctcaggccgtagacaaatgcagctaccgtgatgttgtcaagatggtggcagacaccagcgaggtcaaacttaggataagagacagatacgttgtgcagattacgccagcatttaaatgcacaggcatctggcccagatccgcggcgcactggcctctcccgcacataccttggcccggcccaaacagggtggctgaagttaaagccgaggggttcaacttattgagtaaggagtgtcacagcctggctggtaagcagtcctccgcagagtctgatgcctgggtgttacaattcgctgaggccgagaatcgtctgcagatgggagggtgccgcaagaaatgcctttccattctcaagacacttcgggataggcacctggagcttccaggccagcccctcaataattatcacatgaagacactggtgtcctacgaatgcgaaaagcatccacgggaatccgactgggatgaaagctgcctaggtgataggctgaatgggattttgctgcaattaatttcctgccttcagtgccggcgctgcccccactattttctgccaaacctagatcttttccaaggtaagccacactccgctctggagaacgccgcgaagcagacctggcggctggcacgagaaattttaaccaatcctaagtccctcgaaaagctctag

SEQ ID NO: 193779 - DNA, 1176 bp, Artificial Sequence
  Description of Artificial Sequence: Synthetic coding sequence
atgagcggccccgtgcccagccgggcccgggtgtacaccgacgtgaatacccaccgccctcgcgagtactgggactacgagagccatgtggtggagtggggaaatcaagatgattaccagcttgttagaaaactgggaaggggtaagtattctgaggtattcgaggcgataaatattaccaacaatgaaaaggtcgtggtgaagatcctcaagccagtaaagaaaaaaaaaatcaagcgagagattaaaattctcgagaatctgagggggggcccaaatatcatcacactggctgatatcgtcaaggatccggtgagtcggacaccagcattagtcttcgagcacgtcaacaataccgactttaagcagctttaccaaacgctcaccgattatgacataaggttctatatgtatgagatcctgaaagcactggactattgccactcgatggggattatgcatagagatgtgaaacctcataatgttatgattgaccacgagcacagaaagctcaggctaatcgattggggtttggcagagttctatcacccaggccaagagtataatgtgcgagtagcctcacgctacttcaaggggccagaattgctggttgattatcagatgtatgattacagtttggacatgtggagcctgggatgtatgttggctagcatgattttcagaaaggagcctttttttcatggacacgacaattacgaccagctggtacggattgcaaaggtcctgggaactgaagatctctacgactacatcgacaaatataacatagaactggaccctaggtttaacgacatccttggtaggcactccagaaaaaggtgggagagatttgtccatagtgagaaccagcacctggtcagtcccgaagctctggacttcctggacaaactgctgaggtacgaccaccaaagcaggctgaccgccagagaggcaatggagcatccctatttttacaccgtggtgaaggaccaggctcggatgggttcttcttctatgccaggtggaagtacccctgtgtccagcgccaatatgatgtctggaatctcctccgtacctacaccgagtccactgggcccactggccgggtcccctgtaattgccgcagccaacccattgggaatgcctgttcctgctgctgctggggcccagcagtag

SEQ ID NO: 193780 - DNA, 1347 bp, Artificial Sequence
  Description of Artificial Sequence: Synthetic coding sequence
atgtaccccagcaacaagaagaagaaggtgtggcgggaggagaaggaaagactcctaaaaatgactttagaggaaaggaggaaagagtacctccgcgactacattccgctcaacagcatcctcagctggaaggaagaaatgaaagggaagggacagaatgatgaagaaaacacacaggagacctcacaggtgaagaagtctttgactgaaaaagtttccttgtatcggggggatattaccctgcttgaagtagacgccattgtgaacgctgctaatgctagcttattgggcggagggggcgtggatggttgcatccaccgagcagcagggccatgtctgcttgccgagtgcagaaacctgaatgggtgcgacactggccacgctaaaataacatgtggctacgacctccccgccaagtacgttatccatacagtgggacccatcgcacgaggccacattaatggctcacataaggaagatcttgctaattgttacaagtcttcactgaagctcgtgaaagagaataacattcggtcggtagcctttccctgtataagtactggtatttatggattccccaacgagcccgcagccgtgatcgcgctgaacacgataaaagagtggcttgccaaaaaccaccacgaggtagacaggatcatattctgtgtgtttttagaggtcgattttaagatctacaagaagaaaatgaacgaattcttctccgtggatgataacaatgaagaggaggaagacgttgaaatgaaagaagactccgatgaaaatggcccggaggagaaacaatctgtggaagaaatggaggagcagagtcaggatgccgacggagtgaatactgtgaccgtgccaggcccagcaagtgaggaagctgtggaagactgcaaagacgaggatttcgccaaggacgaaaatatcactaaaggtggcgaagttaccgaccatagtgttagagaccaggaccacccagacggacaggagaatgactctaccaagaatgaaattaagatagagaccgaatcacagagctcttatatggaaactgaagagctttcctccaaccaggaagatgcagtgattgtggaacagcccgaagtcataccactcacggaagatcaggaagagaaggagggcgaaaaggctcccggggaagacacccccaggatgccggggaagtcagagggcagctccgaccttgagaacacacccggccccgacgtggaaatgaatagtcaggtggataaggtcaatgatcccacagaatctcagcaagaagaccagctgatagcaggtgcgcaagacgaggcgaaggaacaaaggaatggtactaaatag

SEQ ID NO: 193781 - DNA, 642 bp, Artificial Sequence
  Description of Artificial Sequence: Synthetic coding sequence
atgaacgagttcttcagcgtggacgacaacaacgaggaggaggaggacgtcgagatgaaggaagactcagacgagaacggcccggaggagaagcagagcgtggaggaaatggaggagcagtctcaggatgctgacggcgttaatactgtaaccgttcccggtcccgcgagcgaggaagccgttgaggactgcaaagacgaagattttgcgaaggacgagaacataaccaaaggaggcgaggtgaccgatcactctgtcagggatcaagaccaccccgacggccaagagaacgacagtaccaagaacgaaatcaagattgagacagagtctcagagctcatatatggagaccgaagaactctcttctaatcaggaggacgcagtgatcgtggagcagcccgaggtgatccctcttaccgaggatcaagaggagaaggagggggagaaggccccaggtgaggacacgcctaggatgcctggtaagtccgaggggtctagcgatctggaaaacactccaggccctgatgtcgaaatgaactcccaagtggataaggtgaacgatcccaccgagtcccagcaggaagaccagctcatcgcaggggctcaggacgaagccaaggaacagcggaacgggactaagtag

SEQ ID NO: 193782 - DNA, 642 bp, Artificial Sequence
  Description of Artificial Sequence: Synthetic coding sequence
atgaacgagttcttcagcgtggacgacaacaacgaggaggaggaggacgtggaaatgaaagaggattcggacgagaacggaccggaggagaagcaatcagtcgaagagatggaagagcagagtcaggatgctgatggagtaaacaccgtcaccgtgcccgggcccgcttccgaggaagccgtcgaggattgtaaggacgaggattttgcaaaagatgaaaatatcaccaaagggggcgaggttacagatcatagtgttcgcgatcaggaccatcctgatggccaggagaacgactcaacaaagaatgaaatcaaaatcgaaactgaatcccagtcatcctatatggaaacagaggagctttcctctaaccaggaggatgctgtgatagtggagcagccggaggttataccgcttactgaggatcaggaggagaaagagggggaaaaggctccaggcgaggacactcctcgtatgccagggaagtctgagggatcttccgatctggaaaataccccagggccagacgtggagatgaactcacaggtggacaaggtgaacgacccaacagagtcccagcaggaagaccaactgatagccggtgcccaggacgaggcaaaggagcagcggaacgggacgaagtag

SEQ ID NO: 193783 - DNA, 1068 bp, Artificial Sequence
  Description of Artificial Sequence: Synthetic coding sequence
atggccgtgcaggagagcgccgcccagctgagcatgaccctgaaggtgcaggagtatcctaccctgaaggttccctacgagaccctgaataaacgcttcagagccgcccaaaagaatattgatagagaaacctcccacgtgactatggtggtcgccgaactcgagaagacactgtcaggctgccctgccgtggactcagtcgtttcattactcgatggcgtggtggaaaaactttcagtcctgaagagaaaagccgtcgaatccatccaggctgaggacgagagcgctaagctgtgcaagcgacggatagaacacttgaaggaacactcaagcgatcagccagccgcggcctccgtctggaaaaggaagcgcatggaccgtatgatggtggagcatctgctcagatgcggatactataacacagcagttaagctggccagacagagtggcatcgagagttgtctggaattctccctgaggatccaagagttcatcgaacttattagacagaacaagagactggatgccgttcggcacgcgcgtaaacacttctcccaggctgaaggcagccagctggatgaagtgcgccaggctatggggatgctggctttcccacccgacactcacatttcaccctacaaggatctcctggacccagctcgatggcggatgctgatccagcagtttcgctacgacaactatcgtctgcatcagttaggtaataactccgtctttacccttactctgcaagccgggctgtcagccataaaaacaccgcagtgctataaagaagacggttcttctaagagccccgattgccccgtgtgcagcaggtctttaaataagctagcacaaccacttcccatggctcactgcgctaacagtaggctagtgtgtaaaatttccggggatgttatgaacgaaaataatccaccaatgatgttacccaacggttacgtctatggatataacagcttgttgagcatccgtcaagacgataaagtcgtgtgtccacgcactaaggaggtgttccacttcagccaagccgagaaggtctacataatgtag

SEQ ID NO: 193784 - DNA, 1191 bp, Artificial Sequence
  Description of Artificial Sequence: Synthetic coding sequence
atggccgtgcaggagagcgccgcccagctgagcatgaccctgaaggtgcaggaatacccgaccttgaaagttccctacgaaactttaaacaagcggtttagagctgcccagaagaatatagatagggaaactagccatgttacaatggtggtagccgagctggaaaagacactttccggttgtccagccgtagatagtgtcgtcagcctgttggacggcgtggttgagaaactgagtgtgctgaaacggaaagccgtggagtctatccaggcagaggatgagagcgccaaattgtgcaaacgaaggattgaacacctcaaagagcactccagcgatcagcccgcagctgctagtgtatggaaacgtaaaaggatggatcggatgatggtcgaacacttgttacgatgcggatactacaacacagccgtcaagcttgcccgccagtctggcatagaggacctggtgaacatcgagatgtttttgacagccaaagaggtggaggaatccctggagcgaagggagaccgcaacctgcctcgcctggtgccacgataacaaatctcggcttcgcaagatgaagtcgtgtcttgagttttctcttcggatccaagagttcattgaactgatccgacaaaacaagaggttagacgcagtgagacacgcccgaaagcacttctctcaggcggaaggatcccagcttgatgaggttcgccaagctatgggaatgctggcctttccaccggatactcatataagtccatacaaagacttactggacccagctcgttggcgcatgctgatacagcaatttagatatgataattacaggcttcaccaacttgggaataactctgtcttcaccttgacactgcaggccggcctttcggccatcaaaacccctcagtgctacaaagaggacggcagttctaagtcacccgactgtcccgtttgctcacggagcctcaacaagctggcccagcctctccctatggctcactgcgctaactccaggctcgtctgcaagatcagcggagatgtgatgaatgagaataatccaccgatgatgcttcccaatggatatgtatacggatacaattctttgttgtcaataagacaggatgacaaggtggtctgccctagaactaaagaagtattccatttcagccaggctgaaaaggtgtacatcatgtag

SEQ ID NO: 193785 - DNA, 987 bp, Artificial Sequence
  Description of Artificial Sequence: Synthetic coding sequence
atggccgtgcaggagagcgccgcccagctgagcatgaccctgaaggtgcaggagtatcctacacttaaagtgccctacgagactctgaacaaacggttccgggccgcacagaaaaatattgacagagagactagccacgtgaccatggttgtggccgagctcgagaagactctgtctggctgtccagctgttgactctgtggttagtttgctggatggcgttgtggagaagctgagcgttcttaaaagaaaagcagtggagtcgattcaagcagaggacgagtcagccaagttatgtaaaagacgcatcgagcacctaaaagagcactcatctgatcagcctgccgccgcttctgtctggaagcggaagaggatggacaggatgatggttgagcacttgttgaggtgtggatactacaacaccgctgtcaaacttgcccgccaatcggggattgagacatgtaagaaagcactgcaaccctcccggcgcgagccagctggaaggggggctccaggccatggtcacgcaggtctgcctgctcggcatgcacacttgccagtgcagggcccttcaggcccctgtacggttgcagacgctgaccccgctgtcccagtcaggcagctgcctacaacaccagcaggcaaacagttttgtgtgcacccacatcccgccggctggccactgagtcaccaggagcagtgctacaaggaagacgggtcgtccaagagtcccgactgccctgtttgttccaggtccctgaataagctcgctcagccccttcctatggcacactgtgccaactctcggctcgtctgtaagatctccggtgacgttatgaatgaaaacaatcccccaatgatgttgccaaatggctacgtttacggctataatagtctcctgtctatccgccaggatgataaggtcgtgtgcccccgcaccaaagaggtcttccattttagtcaggccgaaaaagtgtacatcatgtag

SEQ ID NO: 193786 - DNA, 954 bp, Artificial Sequence
  Description of Artificial Sequence: Synthetic coding sequence
atgaccctgaaggtgcaggagtaccccaccctgaaggtgccctacgagaccctgaataagcgctttcgggctgcacagaaaaatattgacagggagacctctcatgtcacaatggttgtcgccgagctggagaaaacattgtctggttgcccagcagtggattccgtagtgagcttattagacggggtagtggaaaaactgtctgttctgaagaggaaagacctagttaatatagagatgttccttacggcgaaagaggtggaggagtcattggaacgaagagaaacagccacttgcctagcttggtgccatgacaataagagcaggctgcgaaaaatgaaaagctgcctggagttctcgctgaggatccaggaatttatcgagttgattcgccagaataaaaggctggacgcagtccgtcacgcacgcaagcacttttcccaagccgagggatcccagttggatgaggtgcgccaggctatggggatgctcgccttccctccagacacccatatctcgccatacaaagacttactcgaccccgccagatggcgcatgctcatccagcagtttaggtatgataactaccgcctccaccagcttggtaacaattctgtctttactttgaccctgcaggctggcctgagtgcaatcaagaccccacagtgctacaaagaagatgggagctccaaatctcctgactgtcccgtgtgctccagatcccttaacaaactggctcaaccactccccatggcccactgtgccaatagccgcctggtgtgcaagatctccggagacgtgatgaacgaaaacaatcccccgatgatgctgccaaacggatatgtgtatggctataactccctactgagcattagacaggacgacaaggttgtctgccctcggactaaggaagtgttccacttctcacaggctgaaaaagtttacattatgtag

SEQ ID NO: 193787 - DNA, 1305 bp, Artificial Sequence
  Description of Artificial Sequence: Synthetic coding sequence
atggccgtgcaggagagcgccgcccagctgagcatgaccctgaaggtccaggagtaccctacactcaaggtcccttacgagacactaaacaagaggtttcgcgccgcacagaagaatatagaccgcgaaacgagtcacgtaacaatggtcgtggcagagctagaaaaaactttgagcggctgcccagctgtcgatagtgtggtgtcccttctggacggagtggtggagaagctgagcgtgctgaagcggaaggccgtcgaaagcattcaagccgaggacgaatcagcgaagctttgtaagagacgtatcgaacacctgaaagaacattccagtgaccagccagcagcagcctcggtatggaagcggaaaagaatggacaggatgatggtggaacatctgttgcgttgcggatattataacacggccgtgaagctggccagacagagtgggattgaggatctggtcaacatcgagatgtttctcactgccaaggaggtggaagaaagcctcgagagacgcgagaccgcaacctgtctggcttggtgtcacgacaacaagtcccgactacgaaagatgaaaggcagacagaataagcacgaagctaaaaccggcaggaagtctagagctgcttcttcttcaccaaaggaaagtttggacctgggtatggagacgttaaagggaaagccagagctgtcttgtctagagttttcacttcgtatccaggagtttatcgagctgatcaggcagaacaaacgactggacgctgtgcgccatgcccgtaagcatttttcccaggctgagggaagtcaactggatgaggtgcgccaagctatggggatgctcgcctttcctccagatacccatatcagcccatacaaggatctgttggatccggcgcggtggcggatgctgattcagcaatttaggtatgataactacagactgcatcaactggggaacaactccgtgttcactttaacactgcaagcggggttgtccgctattaagacaccacagtgttacaaggaggacggctcttccaaatccccagattgccccgtctgctcgcgctctctgaataagctggcccagcccctgccgatggcacactgcgccaattcacgccttgtttgcaagatttccggcgatgtgatgaacgaaaacaaccctcccatgatgctgccaaacggctacgtgtacggatataactccctgcttagcatccggcaggacgataaggtggtatgtcccagaacaaaggaggtgtttcacttctcccaagctgaaaaggtgtacatcatgtag

SEQ ID NO: 193788 - DNA, 1047 bp, Artificial Sequence
  Description of Artificial Sequence: Synthetic coding sequence
atggtggtggccgagctggagaagaccctgagcggctgccccgccgtggactccgtggttagccttttagatggagtggtggagaaactgagcgttttgaaacggaaagcagtggaatccattcaagcagaggacgagtctgcaaaactgtgcaagaggagaatcgagcatcttaaggagcacagctctgaccagcccgcagcagcgagtgtgtggaaaagaaaaagaatggatagaatgatggtggaacaccttttgagatgtggttactataacacagctgtgaagctcgccagacagagtggaatcgaagacctcgtaaacatcgagatgtttctgaccgctaaggaagtggaggaatccctagagcggcgcgaaacggcaacatgtcttgcatggtgtcacgataacaagtctcggttgaggaagatgaagtcctgtctggagtttagtctccggatccaggaatttattgagcttatcagacagaataaaaggcttgacgcagtacgccatgcacggaaacatttcagccaggcagagggttcacagctcgacgaagtcaggcaagcgatggggatgctggcgttcccgccagacactcacatcagcccatacaaagacctgctagatccagccaggtggaggatgctcatccagcagtttaggtatgacaactaccggctgcaccagctcggaaataatagtgtattcaccctcacgctgcaggccgggcttagcgcaatcaaaactcctcaatgctataaagaggatggatcaagcaagagtcccgattgccctgtgtgtagtcgctcactgaacaaactggctcagcctcttcctatggcccattgcgcgaacagtcgtctcgtgtgcaagatctctggggacgttatgaatgagaacaatcctcctatgatgctgcctaatggctacgtctatggatacaactccctcctgtccatccgacaggacgataaggtggtctgccccaggacaaaagaggtcttccatttctcacaggccgagaaggtgtacatcatgtag

SEQ ID NO: 193789 - DNA, 1188 bp, Artificial Sequence
  Description of Artificial Sequence: Synthetic coding sequence
atgtggaccctgcgggccaccggccgggaggtgggcagcagcagctgtgaggacacagtggcgcctgtgccctacgagacactaaataagaggttcagagcggctcagaaaaatattgaccgggagacctctcatgtcaccatggtggtcgcggagctagaaaagacgttaagtgggtgtcccgctgtggactcggtggtgtctctgctggatggagtcgttgaaaagttaagcgttctcaaacgcaaagccgtggagagcatacaagcagaagacgaaagtgcgaaactttgtaagcggagaatagagcatctgaaagaacattcgtccgatcagccggcggccgcttccgtatggaagagaaagcggatggaccggatgatggttgaacaccttctccgctgtggatattacaatacggccgtcaaacttgcgaggcaatccggaatagaggacctggtcaacattgagatgttcctgaccgctaaagaagtcgaggaaagcctggaaaggagggagactgcaacttgtcttgcttggtgtcatgacaacaagtctagactgcggaaaatgaagagctgtctcgaattctcattgagaatccaagagtttattgagctgataagacagaacaaaagactggacgcagtgcggcatgccaggaagcatttctcccaagcggaaggctcccagctggatgaagtcagacaggcaatgggcatgctggctttcccacccgacacccacatctccccttacaaggatctgctggaccctgcccggtggcggatgcttatccagcagttccggtatgacaattatagactccatcagctagggaataactcagttttcactctaacactgcaggccgggctgtccgccattaaaacaccccagtgttacaaagaagacgggagtagcaaaagcccagactgcccggtttgtagccgctctctgaataagctggcacagccgctccccatggcacactgcgccaattcaaggctcgtttgtaagattagcggcgacgtgatgaacgaaaataaccctccgatgatgctgccaaacggctatgtttacggatataactcccttctgtctattcggcaagacgataaagtggtgtgccctcgtacaaaagaggtgtttcacttctcacaggctgaaaaagtgtatatcatgtag

SEQ ID NO: 193790 - DNA, 987 bp, Artificial Sequence
  Description of Artificial Sequence: Synthetic coding sequence
atggccgtgcaggagagcgccgcccagctgagcatgaccctgaaggttcaagagtaccccacccttaaagtgccgtacgagacgcttaataaaaggttcagggccgcccaaaagaacatcgatcgagaaaccagccatgtcacaatggtggtggccgagctggaaaaaacgctgtctggttgtcccgccgttgactcagtagtcagcttgttagacggggtagtagaaaaactgtcggttctgaagcgcaaagccgtcgaatcgatacaggctgaagacgaaagcgctaagttatgcaaaaggcgtatagagcacctgaaagagcattcctcagatcagcccgctgcagcgtctgtgtggaagcgaaaacggatggacagaatgatggtggagcacctcttgcgttgtggatattacaatactgcagtgaaactggcgcggcagagtggcatcgaaacctgtaagaaggctctgcagccctctaggagagagcctgccggcagaggcgccccgggacacggccatgcaggcctgcccgcccggcatgcacacctgccagtgcaaggaccatccggcccctgtactgtggctgatgccgaccctgcagtccctgtccgccaattacccaccaccccagctgggaaacagttctgcgtgcatccccatcctgccggatggccactgagccatcaggacacctgctataaagaagacggctcctctaagagtccggactgcccggtgtgttctcggtctctcaacaagctggcccagccgctgcccatggcccactgtgctaactcgaggcttgtgtgcaagatcagtggggacgtgatgaatgagaataaccctccaatgatgttgccaaacggctacgtgtacggctacaactctctgctctcaatcaggcaggacgataaagttgtgtgtccacgcaccaaagaagtcttccacttctctcaggccgagaaggtgtacatcatgtag

SEQ ID NO: 193791 - DNA, 1128 bp, Artificial Sequence
  Description of Artificial Sequence: Synthetic coding sequence
atggccgtgcaggagagcgccgcccagctgagcatgaccctgaaggtacaggaatatccaactctcaaagtaccgtacgagaccctcaataaacgatttagagcagcccagaaaaatatagaccgggaaacatcccacgtcacgatggtggtggcagaacttgaaaaactgagtgtcttgaagagaaaggccgtagagtcgatccaggctgaagatgaaagcgctaaattatgtaaacgcaggatcgaacacttaaaggaacattcctccgaccagcccgccgcggcctcagtgtggaagcggaagcgcatggacagaatgatggtcgagcacttgttaagatgcgggtattacaacacggctgttaagttggcccgccagtcagggatcgaggacctcgtaaacatcgagatgttcctcacggccaaggaggtggaagaatcgttggaaagacgcgagaccgcaacttgcctggcttggtgccacgacaataaaagccgtttgcgcaagatgaaatcttgcctggagttcagtctgcgaattcaggagtttatagaactgatcagacagaacaagcgcttagatgctgttcggcatgctcgcaagcatttctctcaggccgaaggatcccagctagacgaagtgcggcaggccatgggtatgctcgccttccctccggacacccacatatctccgtacaaggacctacttgaccccgccagatggcgcatgttgattcagcagttccgttacgacaactatagattacaccagctagggaataactccgtctttacactcacactgcaagccgggctcagcgctatcaagacaccccagtgttacaaggaggacggttcatccaagtcacctgactgcccggtttgctcccgctcccttaataaactggcacagcccctgccaatggcccactgcgccaatagcagactggtgtgcaaaattagcggcgatgtgatgaacgaaaataaccctccaatgatgctccctaatggttatgtgtatgggtataacagtttattatcaatacggcaggatgacaaagttgtgtgccctaggactaaggaagtttttcacttctctcaggcagaaaaggtgtacattatgtag

SEQ ID NO: 193792 - DNA, 1467 bp, Artificial Sequence
  Description of Artificial Sequence: Synthetic coding sequence
atggcccccgccgcctggctgcggagcgccgccgcccgggccctgctcccccctatgttgctgctgctgctgcagcccccacccttactagctcgggctctgcccccagacgcacaccacctccacgccgagcgccgaggtccccagccctggcacgcagccctcccaagttctccagcacctgcgcccgccacacaggaagcgcccagacctgcctctagtctcaggccaccgcgctgcggggttcctgacccctccgatggccttagcgccagaaatcggcaaaaaaggtttgtactatcaggtgggcgctgggagaaaaccgaccttacctataggatacttaggttcccttggcaactcgtgcaggagcaggttaggcagaccatggcagaagcactcaaggtgtggagtgacgtgacacccctcacgttcaccgaggtgcacgaaggacgcgcagacattatgatcgactttgcaaggtactggcacggggatgatttgcccttcgacgggccaggaggcatcctggctcacgcgttcttccctaaaacacacagagaaggcgacgttcattttgattatgatgaaacatggacgattggcgatgatcagggtaccgatctgcttcaggttgctgctcacgagttcgggcatgtgctgggcctccagcacactaccgctgccaaggctttaatgtctgcattctataccttccgctaccccctttcactctcgcccgacgattgtcgcggcgtgcaacacctgtacggccaaccatggcccactgtcacgagtcgcacaccagcactgggtccgcaggccggtatcgatactaacgaaatcgccccccttgaacctgacgcaccgccggacgcttgtgaagcctctttcgatgccgtcagcaccatccgcggcgaactattttttttcaaggcgggttttgtctggcggctgcgcggagggcaattacagcctggctaccctgcgctggcctctcgccattggcaagggctacctagtcccgtcgacgccgcattcgaagacgctcaggggcatatttggttcttccagggtgctcagtactgggtttatgacggggagaaacctgtcctgggccccgcacctctgactgaactcgggctcgtccgctttcccgttcacgctgctttagtgtgggggcccgagaaaaataagatctatttcttccggggacgcgactattggcggttccatcccagtacacggcgcgtcgattccccagtacctaggcgcgcgactgactggcgcggcgtgccatccgaaattgatgccgcgtttcaggatgccgacgggtacgcctatttcctgagaggcagactgtactggaagttcgaccccgtcaaggtcaaggccctggaaggcttccctcgtttagtgggacccgacttttttggctgtgctgagccagcaaatacattcctttag

SEQ ID NO: 193793 - DNA, 1563 bp, Artificial Sequence
  Description of Artificial Sequence: Synthetic coding sequence
atgcggaacaagaagatcctgaaggaggacgagctgctgagcgagacccagcaggcagcattccatcagattgctatggagcctttcgagatcaatgtgcccaaacctaaacgaaggaacggagtcaacttttccttggccgtggtggttatttatcttatcctactgacagccggcgcgggcctgcttgttgttcaggtgctcaatctgcaggcacgcctcagagtgctggaaatgtattttttgaacgataccctcgctgctgaggactctcccagcttttctctccttcagtccgctcacccaggcgaacatttggcacagggagcctctagactacaagtccttcaagctcagcttacttgggtgcgggtgagtcacgaacatctattgcagcgagtggacaacttcacacaaaatccagggatgttcagaataaaaggtgagcaaggagccccaggtctccaggggcacaaaggggccatgggcatgcctggagctccaggaccaccgggtccgcccgcagagaagggcgctaagggcgcaatgggtcgagacggcgccaccgggccctccggtccgcagggccctcctggggttaaaggcgaagctggtctgcaaggaccccagggggctcctggcaagcagggggccaccggtacccctgggcctcaaggggagaaggggtcaaagggggacggcggacttatcggcccaaagggggagacaggtactaagggcgagaaaggagacctcggacttccaggctccaaaggcgatcgcgggatgaaaggtgacgcgggggtgatgggaccccctggcgcccaggggtccaaaggcgactttggccgccctggacctcccgggctagcagggttcccgggcgctaaaggcgaccagggccagccaggcctgcagggagtcccaggtcccccaggtgcagtaggccaccctggggcaaaaggagagcctgggagtgcagggtcgcctggccgtgcgggacttcctggttcgcccggctccccgggcgccaccggactcaagggctctaagggggatacagggcttcagggccagcaaggcagaaaaggcgaaagcggtgtccctggacccgccggagttaagggcgagcagggctcccccggccttgcaggacctaagggtgcccctggacaagcagggcagaagggcgatcagggcgtcaagggttcgtcaggagagcagggagttaaaggagagaaaggcgaacgtggcgagaacagcgtctcagttcgcatcgttggcagctctaatcgtggtcgcgccgaggtttactactccggcacctggggcaccatctgcgacgacgaatggcagaactctgatgcaatagtgttttgtcgaatgctgggatactccaagggacgtgccctttacaaggtgggcgctggcaccgggcagatctggctggacaacgtgcagtgcagaggaacggagagcacgctgtggtcctgtaccaaaaacagctggggccaccacgactgctcacatgaggaagacgccggggtggagtgctcagtgtag

SEQ ID NO: 193794 - DNA, 1329 bp, Artificial Sequence
  Description of Artificial Sequence: Synthetic coding sequence
atgtacttcctgaacgacaccctggccgccgaggacagccccagcttcagcttgctacagagcgctcacccaggagagcaccttgcccagggcgcctctagattgcaggtactccaggcccagctgacctgggtgagagtcagccacgagcatctcttgcaaagagtggacaattttactcagaaccccggaatgtttaggatcaaaggagagcagggcgccccgggcctgcaggggcacaagggagccatggggatgcctggagccccgggccctcctgggccaccggctgaaaagggcgctaaaggagccatgggccgtgacggcgccactggcccatccggacctcagggcccacctggcgtgaagggggaagcaggattgcagggcccacagggcgcaccaggtaaacagggggcaacaggcacacctgggccacagggtgagaaagggagtaagggagatggcggcttgattggccccaagggtgagacgggcaccaaaggggagaaaggagacctcggcctgccaggttccaagggagaccggggtatgaagggggacgccggcgttatgggaccgccaggagctcaggggtcaaagggcgacttcggtcgccctggcccaccaggcttggctggctttcccggcgccaaaggtgaccaaggacagcctggcctacagggtgttcccgggcccccgggcgccgttggtcacccaggagccaagggggagccagggagtgccggatcacccggtcgggcaggattgcccggatctcccgggtccccaggcgccacaggactgaaaggttctaaaggcgatactgggctgcagggacagcagggccgcaaaggggaatccggagtgcctggtccagcgggggttaaaggggagcaaggatctcctgggcttgcgggcccgaagggagccccggggcaggctggacagaaaggcgatcagggcgtgaaaggcagcagtggcgaacagggagtcaagggcgaaaaaggcgagaggggcgagaattctgtctccgttcggatagtgggcagtagcaaccgtgggagagctgaggtgtactatagcggaacatggggtaccatctgcgacgatgaatggcaaaacagcgatgcaatcgtgttctgtcgcatgcttggctactccaaagggagagctttatacaaagtgggcgctggcaccggccagatctggctcgacaatgtgcagtgtcgcgggaccgaatcgactctttggtcttgtacgaagaactcttggggacaccatgattgtagtcatgaagaagatgcaggggtggagtgctccgtgtag

SEQ ID NO: 193795 - DNA, 1356 bp, Artificial Sequence
  Description of Artificial Sequence: Synthetic coding sequence
atggagcagtgggaccacttccacaaccagcaggaggacaccgacagttgttcggagtccgtgaagtttgatgcgcggagtatgactgccctgttgccgcccaaccccaagaacagcccttcactccaggaaaagctaaaatcctttaaggccgccctgatcgctttatacttgcttgttttcgccgtgctgattcctctgatcggcatcgtcgcagcgcagttattaaagtgggaaaccaagaactgtagtgtgtcatcaactaatgctaatgatattacgcagagtctgacagggaaagggaatgacagtgaagaagagatgcggtttcaggaagtgttcatggagcacatgtccaacatggagaagcgcatacagcatatcctggacatggaggctaatctcatggacaccgagcattttcagaacttttctatgacaacagatcagcggttcaatgatatcctgctccagctgagcacactgttctcatccgtccagggccacgggaatgccatcgacgagataagtaaaagccttatctcccttaatacaacactgttggatctgcagcttaatatagagaacctcaatggtaaaatccaggagaacaccttcaaacaacaggaagagatcagcaagctggaagaaagagtgtataatgtgagtgccgaaataatggcgatgaaagaagaacaggttcatttggagcaggagataaagggagaagtcaaggtgctaaacaacatcactaatgatctccggcttaaggactgggaacactcacagacccttaggaatatcactctgattcagggccccccagggcccccaggagagaaaggggaccggggacctactggagagtcaggcccaagagggtttcctggacctatcggtccaccgggactcaaaggcgatcgcggtgcaataggatttcccgggagcagaggtctgcccggatacgcgggcagaccaggcaacagcggccccaagggccagaaaggggagaaaggaagtggcaacactctcactccattcactaaggtgcggctcgtgggaggatcagggccacacgagggccgcgtcgagatcctacactctggtcagtggggtacaatttgcgatgacagatgggaggtccgggtgggacaggtggtgtgccgcagtctggggtaccccggagtgcaggcagtgcacaaagctgcacactttggtcaggggactgggcctatctggctgaacgaagtgttttgctttggccgcgagtcatcaattgaggaatgtaaaatccggcagtggggaaccagagcctgtagtcactccgaggatgctggggtgacgtgtacactgtag

SEQ ID NO: 193796 - DNA, 1167 bp, Artificial Sequence
  Description of Artificial Sequence: Synthetic coding sequence
atggagcagtgggaccacttccacaaccagcaggaggacaccgacagctgttccgagtcggtcaaatttgacgcacgctcgatgacagcccttctgcccccaaaccccaagaatagcccatcgctacaggaaaaactcaagtccttcaaggcagcacttattgcgttatacctgcttgtcttcgcagtgctcattcctctgatcggcatagttgctgcccagctgcttaagtgggagaccaaaaactgttctgtatcgtccacaaacgcaaacgatatcactcagtccttgaccggtaagggaaacgactcagaagaggaaatgcggttccaggaagtctttatggagcacatgagcaacatggagaaaagaatacagcacatcctggatatggaggccaatttgatggatacagagcatttccaaaacttctccatgactactgaccagcggttcaacgatatcttactgcaattaagtacccttttcagctctgtacaaggccatggtaacgctatagacgaaatttctaaatctctgatcagtctgaacacaacccttctggacctccaattgaatatcgaaaacctgaacggcaaaattcaagaaaacaccttcaagcaacaggaggagatctccaaacttgaggaaagggtgtataacgtatctgccgaaataatggccatgaaggaagagcaagttcacttagagcaggaaatcaagggcgaggtcaaggttctcaacaacataacaaatgacctcagactgaaagactgggagcactctcagaccctgaggaatatcactctcatacagggcccacccggaccacctggagagaagggagatagaggccctacaggcgagagcgggccacgcgggttcccagggcccatcggtcctcctggactgaagggcgacagaggcgcaatcgggtttcccggcagcagagggctgcccggatatgccggcaggcctgggaattctggcccaaaggggcagaaaggagagaagggtagcggcaatactctgagtaccggaccgatctggcttaacgaggtgttttgcttcggccgggagagtagcatcgaagagtgtaagattcgacagtggggcacaagagcgtgttctcacagcgaggacgccggcgttacgtgtaccctgtag

SEQ ID NO: 193797 - DNA, 1167 bp, Artificial Sequence
  Description of Artificial Sequence: Synthetic coding sequence
atggagcagtgggaccacttccacaaccagcaggaggacaccgactcatgttctgagtcagtgaagtttgatgcccggagcatgaccgcgctcctgcctccaaacccaaagaactccccgtcattacaggagaaactcaagagctttaaagccgccctgatcgccctgtacctgctggtctttgccgtgctgattcccctgattgggatagtagcggcgcaactcttgaaatgggaaaccaagaactgtagcgtaagctccactaatgccaacgatattacacagtctttaacaggaaagggcaacgactctgaggaggaaatgcgctttcaggaagtttttatggagcatatgagtaatatggaaaagagaattcagcatatccttgacatggaggcgaacctgatggacacggagcattttcagaatttcagtatgactacggatcagcgcttcaatgacattctgcttcaattatcgactctctttagctctgtgcagggtcacgggaatgccatcgacgagataagtaaatcactcatctccctgaacaccactcttctggatctgcaattgaacatagagaacctcaacggcaagatacaggagaacacatttaaacagcaagaggaaattagcaaactcgaagaacgcgtctataatgtttcagctgagatcatggcaatgaaggaggaacaggtacacctcgagcaggaaattaagggagaagttaaagtgctgaataacatcacaaacgatctgaggctgaaagattgggagcattctcaaaccctgagaaacattacactgattcagggccccccgggtcctcctggggagaaaggggacagaggcccaacaggtgagtctggccccagggggtttccaggacctatcggtcctcctgggttgaagggggatcggggggcaattgggtttcccgggtctcggggattgcccggctatgccgggcggcccgggaatagtggtcctaaagggcagaaaggtgagaagggctctggaaatactctaagtaccggccccatctggttaaacgaggtattctgcttcggccgcgaatccagcatcgaggagtgcaaaatccgacagtggggcacaagagcctgctcccacagtgaggacgcgggagtcacgtgcacactgtag

SEQ ID NO: 193798 - DNA, 1077 bp, Artificial Sequence
  Description of Artificial Sequence: Synthetic coding sequence
atggagcagtgggaccacttccacaaccagcaggaggacaccgactcttgcagcgagagtgtgaaattcgatgctaggtctatgacggccctactgcctcccaaccctaaaaacagtccttcactgcaggagaagctcaaaagctttaaagcagcacttatcgccctttacctcttggttttcgcggtgctcataccactgataggaatcgtagccgcccagttgttgaaatgggaaacaaaaaattgctcagtgtcctccaccaatgctaacgatatcactcagtctctgaccggcaaagggaacgacagcgaagaggagatgcgtttccaggaggtgttcatggagcacatgtcaaacatggaaaagcgcattcagcatatcctggatatggaagccaatttgatggatacggagcacttccagaacttttcaatgactaccgaccagcgcttcaatgacatacttcttcagttgtctaccctgttttcttcagttcagggccacggcaacgctattgacgagatatccaagagcttgatttcactcaataccactctgctcgacctgcaattgaacattgagaatttgaatggcaaaatccaagaaaatacatttaagcagcaagaagagatcagtaaactggaggagagggtgtataacgtcagcgcagagattatggctatgaaagaagagcaggtgcatttagaacaggaaatcaagggagaagtcaaagtgctcaacaatattaccaacgatctgaggctgaaggactgggagcacagccagactctgaggaatatcaccctgattcagggtcccccggggccaccaggcgaaaaaggagaccggggccctaccggcgaatctggcccaaggggattcccaggtccaatcggtcctcccgggcttaagggagacagaggagcaattgggtttccagggtcgcgtggattgccgggttatgccggacggccaggaaatagcggaccaaagggacagaaaggcgaaaagggctccggaaatactttacgccccgtccaacttactgaccacatacgggctggaccgtcttag

SEQ ID NO: 193799 - DNA, 1410 bp, Artificial Sequence
  Description of Artificial Sequence: Synthetic coding sequence
atgtgctacctgagcgccatcatcagcatcagcctgctgaacaagaagccaagtatggaacagtgggaccactttcacaaccaacaggaagacactgatagttgcagcgaatccgtcaagttcgatgcccggagcatgacagctctgctccctccaaaccccaagaatagcccgtccctgcaggagaaactgaagtcatttaaagcggctttgatcgccttatatcttctcgtatttgccgtgctaattccgctgattggaatcgtcgcggcgcagctccttaagtgggagaccaaaaactgcagtgtctccagtactaatgccaacgacatcactcagagccttaccggcaaaggtaacgatagcgaggaagaaatgcgcttccaggaggtttttatggaacatatgtccaatatggagaaacggattcagcacattctagatatggaagccaacctgatggacaccgagcactttcagaatttcagtatgacaactgaccagcgattcaacgatattttgctccagttatcaacgctgtttagctcagtgcaaggccatgggaatgccatcgacgagatctctaaaagtctgatctccctaaacactaccctgctggatctccagctgaatatcgaaaatctaaatggaaagattcaggagaatacctttaaacaacaggaagaaatttcaaaactggaggaacgcgtttacaatgtgagcgctgagattatggccatgaaggaagagcaggtacatctggaacaggaaatcaaaggagaggtgaaggtcctgaataacatcacaaatgatctgcggcttaaggactgggagcattcccagactttacgcaatattacattaattcagggccctccgggtcctcctggggaaaagggagacaggggtccaacaggagagagtggccccagagggtttcccgggcccattggaccgccaggtctcaaaggtgataggggagcgatcggcttcccaggcagcagaggactccctggctacgctggcagaccagggaattccgggccaaaaggccaaaagggcgagaaggggtccggcaatactctgacgccttttaccaaagtgagactggtgggcggctctggaccacacgaggggagggtggaaattttgcatagcggtcagtggggaacaatatgcgacgaccggtgggaggtgagagtaggacaggtcgtttgtagatctctggggtaccctggggtgcaagccgtgcataaagccgcccacttcggtcagggcacaggccccatctggctgaacgaggtgttttgcttcggtagagaaagtagcatcgaagaatgcaagatccgccagtggggcacccgtgcctgctcacattctgaagatgctggcgtgacatgcaccctatag

SEQ ID NO: 193800 - DNA, 195 bp, Artificial Sequence
  Description of Artificial Sequence: Synthetic coding sequence
atggagcagtgggaccacttccacaaccagcaggaggacaccgacagctgtagtgaatccgttaaatttgatgctcggtcaatgacagccctgctgcctcctaacccaaaaaattctccatcactgcaggagaagctcaagtcctttaaggcggcattgatcgcactctacctgctcgtgttcgccgtgttatag

SEQ ID NO: 193801 - DNA, 399 bp, Artificial Sequence
  Description of Artificial Sequence: Synthetic coding sequence
atggccatgaaggaggagcaggtgcacctggagcaggagatcaagggggaagttaaagttctgaacaacatcaccaacgacttgagactgaaagactgggaacatagccagactctccgcaacatcactctgatccagggcccccccgggcctcctggagagaaaggggatcgcgggccaactggtgaatccggcccaagagggtttccaggacccattgggcctcctggactcaaaggcgaccgtggagctatcggatttcccggaagccggggtctgccaggatatgccggacgccctggaaattcgggacccaaggggcaaaagggtgaaaaaggctccggaaacacactcagaccagtccagttgaccgatcatattagagccgggccttcttag

SEQ ID NO: 193802 - DNA, 4203 bp, Artificial Sequence
  Description of Artificial Sequence: Synthetic coding sequence
atggagctgctgccccccctgccccagagcttcctgctgctgctgctactaccagccaaaccggctgccggagaggattggcagtgtccaagaacaccctacgccgcgagcagggactttgacgtgaagtatgtggtccccagtttcagcgctggtggtcttgtccaggccatggttacatatgagggtgatcgcaacgagtctgctgtttttgtagctattcgcaatcgcctccatgtgcttggtccggatctgaagagtgtccagtctctggcaacgggccccgccggcgaccctggatgccagacctgcgcagcttgcggccctggtcctcacggcccacctggagataccgatactaaagtactcgtgttagatcccgccttgcctgctctggtcagctgtggcagttctctgcaggggagatgcttcctgcacgatttagaacctcaggggaccgccgtccatctggcggctcctgcatgtctgttctctgcccaccataaccgccctgacgattgcccagattgcgtcgcatcccctctcggtacgcgggtgactgttgtggaacaggggcaggccagctacttctacgtcgcctcatcccttgacgctgcagtggccgcctcattttcccccaggtccgtctccatcagacggcttaaagccgacgcatcaggatttgcccctggttttgtggctctgtccgtgctgcccaagcacctcgtgtcctacagcattgagtacgtacactcctttcataccggtgcttttgtatactttctgactgttcagccggcctctgtgaccgacgatccaagcgccctgcacacccgccttgccagactgtcagctactgagcctgagctgggcgactaccgagagctggtcttagattgccgcttcgcccccaagcggaggcggcgaggcgctcccgaagggggccagccttaccccgtcctccgcgtcgctcattctgcccctgtgggggctcagctagcaacagagctctcaatcgccgagggccaggaggtgctgttcggcgtcttcgtgaccgggaaggacgggggacctggggtagggcccaattccgtggtgtgcgcgttccctatagatctcctggacacactgatcgacgagggggtcgagcgctgctgcgaaagtccagtccacccaggactacgccgaggactggatttttttcagagcccttcattctgtcccaatcctcccggcctcgaagctctctcacccaatacaagttgccgtcatttccctctgctggtcagctctagcttctcccgggtggatctgttcaacgggctgctagggcccgttcaagtcacagccctctatgttacgcgtttagataacgtgacggtggctcacatgggaaccatggacggacgcatcctgcaggtggagctggtgcggtccttgaattacctcctgtatgtctctaacttcagcctcggggactcagggcaaccggtccaacgagacgtgtcccgcttgggggaccatttgttgtttgcctctggggatcaggtgttccaagtgcctatccagggaccaggttgtaggcacttccttacctgcgggcggtgtctgagggcctggcacttcatgggctgtgggtggtgtggaaacatgtgcggccagcaaaaggaatgccccgggtcttggcagcaggatcattgccctcctaaactcactgaatttcatcctcattccggcccactgcggggctctacacgattaaccctgtgtggcagcaacttctatttgcatccctcgggcctggtcccagagggcactcatcaagtgactgtcggacagtccccttgtcgaccattacccaaggacagttccaagttgagacctgtgcctcggaaggactttgtggaggagttcgagtgcgaactcgagccactaggcacccaggccgtcgggccgactaatgtatccctgacagtgactaatatgccaccaggaaagcattttagggtggatggcacctctgttctgagaggcttttctttcatggaacccgtactcattgcagtgcagccattgttcgggccccgggcgggcggaacgtgcctgactcttgaggggcagagcctgagcgtggggacgagtcgcgccgttcttgtgaacgggactgagtgccttcttgccagggtgagtgaaggtcagttgctttgtgccaccccaccaggcgcaaccgtggcgtctgtgccactcagtctgcaggtcggaggagcccaggtgccaggaagttggacattccagtatagggaggatccagttgtcctctccataagccccaactgcggatacattaattctcatattactatttgcggtcaacacctgacaagcgcctggcacttggtgctgtccttccatgacggcctgagagccgtcgagtcccgttgtgagcgtcagctgcctgaacaacagttgtgccgtttgccagaatacgtcgttcgggacccgcagggctgggtcgccggtaacctgtccgcccgcggcgacggagccgcagggttcacattaccaggctttagatttctccctccaccccacccaccgtccgccaacctcgtgcccctcaaacccgaggagcacgccataaagtttgaatatattggcttgggagctgtcgccgattgcgtagggataaacgtaaccgttggaggggagagctgccagcatgagttccgtggagacatggtggtctgtcctttacctccttccttgcagcttgggcaggacggggcgcccctgcaggtttgtgtggatggcgaatgtcacatccttggtcgagtagtacgccctggccctgacggggtgcctcagtcaactctgctcgggattttactccctctgttgcttttggtggctgctctggcgacggccttggtgttttcttactggtggagacgcaagcaactggtgctcccgcctaatcttaatgacctcgctagtttagaccaaaccgcaggggcaacacctctgcccattctgtacagcggctccgactatcgatccgggctggctctgcccgccatcgacggcttggactctactacctgcgtccacggagccagcttcagtgattctgaggacgagtcatgtgtgcccttgctgcgcaaagagtctatccagctgcgcgacctggattccgccctgttagccgaggtgaaagacgttctcatccctcacgagagggtggtgactcattccgacagagtgatcggtaaaggccacttcggagtggtgtatcatggagaatatatagaccaggctcagaataggattcaatgcgccataaagagcctaagcaggattacagagatgcagcaagtggaagctttcctgcgtgaaggcctgttgatgaggggactgaatcatccaaacgtcctggccctcattggtattatgctgcctcctgaaggattacctcacgtgctcctgccgtacatgtgccacggagacctgttgcagttcatacggtccccccagaggaacccaacggtcaaagatttgattagctttggcctacaggtggctagatccatggagtacctcgccgagcagaagtttgtgcatcgagaccttgctgctcgtaattgtatgcttgatgagagttttacagtgaaggtggcagacttcgggctagcacgggacatcctggatcgagagtactactccgtacaacaacaccgtcacgctaggctccccgtcaagtggatggcactggaaagcttgcagacttatcgctttaccactaagtctgatgtatggtccttcggcgtgctgctgtgggaactgctaacgagaggggcccctccgtatcgccacattgatccttttgacctgactcactttttggcgcagggcagacggctgccgcagcccgaatattgtcccgacagcttgtatcaggttatgcagcaatgttgggaagcagaccctgccgtgcgacccacgttcagggtgcttgtgggcgaggtcgaacagatcgtgtccgctctcctgggcgaccactacgtgcagctacccgccacctacatgaacctgggcccaagcacctcccacgaaatgaacgtgaggccagagcagccacagttctcacccatgcctggtaacgtccgcagacctagacctctctctgaaccaccacgacctacgtag

SEQ ID NO: 193803 - DNA, 4056 bp, Artificial Sequence
  Description of Artificial Sequence: Synthetic coding sequence
atggagctgctgccccccctgccccagagcttcctgctgctgctgctcttgccagccaaacccgccgctggcgaagattggcagtgccccaggacaccatacgcggcaagcagagattttgatgttaagtatgtcgtgccctcattttccgcggggggccttgttcaagccatggttacatacgaaggggatagaaacgaaagtgcagtgtttgttgctatcaggaaccggcttcatgttttgggcccagaccttaagtccgtacaaagcctcgctaccggtcccgccggcgacccggggtgtcagacttgtgcggcatgcggacctggaccacatggtcctcccggtgacaccgataccaaggtattagtgttagacccagcccttcccgccttagtgtcctgcggatcatctctccaaggccgttgcttcctgcatgaccttgaaccacaaggaaccgcggtgcaccttgccgctcctgcctgcctgttttccgcacaccacaaccggccagacgattgcccggattgcgtcgcctccccactcggtacccgggttactgtcgtggaacagggccaggcatcttatttttacgtagcgtcatccttggacgccgcagtcgctgcctcgttttctccgcgatcggtttcaatcaggcggctcaaggccgacgcgagcggctttgctccaggctttgttgcattaagcgtgctccctaaacatttggtgtcatattctattgagtacgtgcactcattccacactggtgcatttgtctatttcctgacagttcagccagcctccgtgaccgacgacccgagtgctcttcatacacgtcttgccagacttagcgccactgaacccgaactgggagactacagggaattagtgctagattgcaggttcgcccccaagcggcgtcggcggggggcccccgagggagggcagccctacccagtgctgcgcgtggcccactccgcccccgttggcgctcagctagcaacagagttgtcaatagcggagggtcaggaagtcttgtttggagtattcgtaaccgggaaagacggaggtcccggtgtgggccctaattccgtggtttgtgcatttcccatcgatcttctggacactctaatcgacgagggggtggagcgatgctgcgagtctccagtgcatccgggacttaggcgtggcctagacttctttcagagcccttcattctgtcccaatcccccaggactggaagccctgagtccaaacaccagctgtcgccattttcccctgctcgtatcaagcagcttttcacgtgtggacctgtttaacggactgctaggtcccgtgcaggtaacagccctctacgtaacgcgacttgacaacgttacagtagcgcatatgggtacaatggatggacggattttgcaagtcgagctcgtacgctccctgaactatctcctgtatgtctccaacttcagcctgggtgactccggacagccagttcaaagagacgtttccagactgggcgaccatctgttattcgcctcaggggaccaggtcttccaggtgcctattcaaggtccaggttgcagacacttcctgacttgcggcagatgccttagggcctggcacttcatgggctgcgggtggtgcggaaacatgtgcggacaacaaaaagaatgtcccgggagctggcagcaagatcattgcccaccaaagttgaccgagtttcatcctcattcggggccgctccgagggtctacaaggctgacactttgtgggtccaatttctatctgcacccgtctggcttagtgccagaagggactcaccaagtcaccgtcggtcaatccccatgcagaccactgcccaaggactcatctaaactccgacctgtaccccgcaaggacttcgttgaggaatttgagtgcgagttggagccattggggacccaggccgttgggccaacaaatgtgtctctgacagtgactaatatgccccccgggaagcacttcagggttgatggaacttctgtcttgaggggcttttctttcatggaaccagtgctgatcgcagtgcagccattgttcggaccgcgcgcaggcggcacatgcctgactctcgagggccaatcattaagcgttggcacctccagggccgtgctggtcaacggcacggagtgcttgcttgctagagtcagcgagggtcagctcctttgcgccaccccacccggggccactgtggccagtgttcctctgtccctacaagtgggcggtgcccaggtgcctggctcctggacattccaataccgcgaggaccccgtggtgctgagtatctcccccaactgtgggtacatcaactctcacataactatctgcgggcagcatctgacctccgcctggcacttggtgttgagttttcacgacggactgagggccgtggaatcccgctgcgagaggcagctgcctgaacagcagctctgtcgcctcccagaatatgttgtgcgagatccgcagggctgggtcgctggcaatctgagcgctaggggagacggcgccgctggctttaccctgccggggtttaggttcctgcctccaccccatccaccaagcgcaaatctagttcctctgaagcccgaggagcacgctataaaattcgaagtgtgtgtcgacggggagtgccacatccttgggcgagtggtcaggccaggcccagacggcgtgccccagagcaccctcctgggaatcctactgccgctgctcctacttgtggcggcccttgccacggccctggttttcagttactggtggaggaggaagcagctagtactgccaccgaatctgaacgacctcgcctcattagaccagaccgccggagctaccccattacccatcctgtatagcgggagcgactacaggtctggcctggcactgcccgccattgacgggctggactcaaccacctgcgtacatggcgcttctttctccgatagcgaagacgaaagctgcgtgcctctcttaagaaaagaatccattcagctgcgagaccttgactctgctttgctcgccgaagttaaagacgttctcatcccacacgaaagagtggtgacacattcggacagagttattggaaaggggcactttggcgttgtgtatcatggggagtacatcgaccaagcccagaatcgtattcagtgtgcaatcaaatctctgagcagaatcacagaaatgcagcaggtcgaggcattcttgcgtgagggtcttttaatgcgcggattgaatcatccaaacgtcctggcccttataggaatcatgcttccacccgagggcctgccacacgtcctcctgccttacatgtgccacggcgatctgttgcagtttatcagatccccccagcgcaatccaactgtcaaagatctcatttcctttggcctgcaggtagccagatctatggaatatctggcagaacagaagttcgtccaccgcgacctggctgctagaaattgcatgctcgatgaaagcttcactgttaaggtagcagattttggtctcgcccgggacattcttgacagggaatactactcagtacagcagcaccggcatgccaggttgcctgtgaaatggatggccctagagtcgctccagacctatcgcttcacaaccaagtctgatgtttggtcattcggcgtactgctttgggaactcttgacccgcggggctccaccttaccgccatattgacccctttgatcttacccacttcctggcacaggggaggcgcctgccacagcctgaatattgccccgacagcctataccaggtgatgcagcagtgctgggaagctgacccggccgtgcgtccaacatttcgagtgctggttggcgaagttgagcagattgtttctgctctgcttggcgaccactacgtgcagctgccggctacctacatgaacttgggaccaagtaccagtcacgagatgaacgtgaggcctgaacaaccgcagtttagtcccatgcctggaaatgtaaggagacccagaccactgtccgagccccctagacctacatag

SEQ ID NO: 193804 - DNA, 2157 bp, Artificial Sequence
  Description of Artificial Sequence: Synthetic coding sequence
atggaggacctgggcgagaacaccatggtgctgagcaccctgcggtctctgaataacttcatctcgcagcgcgtcgagggtggaagtggcttggatatttccacctccgctcccggttccctgcagatgcagtatcagcagagtatgcagctggaggaacgtgctgaacagatcagaagtaaatctcacctgatccaggtggaacgggagaaaatgcagatggagttgtcccataaacgtgctagggtggagctggaacgggctgcttccacaagcgcccgaaactatgaaagggaagtggaccgtaatcaggagcttttaactagaatcaggcagctacaggagcgcgaggcaggcgcggaggagaagatgcaggagcagctagagagaaacagacagtgccagcagaacctggacgctgccagcaaaagacttcgtgaaaaagaggactccctggctcaggcaggggaaacaattaacgccctgaagggccggatctccgagctacagtggtctgtgatggaccaagagatgcgggtcaagcgccttgagtcagaaaaacaggagcttcaagagcagttggatcttcagcacaagaaatgtcaggaagcaaaccaaaagatacaagagttacaggccagtcaggaagcccgagctgaccacgagcagcagatcaaggatctggaacaaaagctttcactacaggagcaggatgcggcgatcgtgaaaaacatgaagagtgagctagtgagattgccccggctagaacgagaactgaagcagttgcgggaggaatctgctcacttgcgcgagatgagggagacaaacggtcttctgcaggaggaactcgaaggactgcaaagaaagttaggccgccaagagaaaatgcaggaaaccctcgtcggcctagagctcgagaacgagcgtctgctggccaagctccaatcgtgggagcggctggaccagactatgggacttagcatcagaactccagaagatctaagccggtttgtcgtagagctgcagcagagagagctggcactgaaggataagaattcggctgtgacctcttctgccagaggcctcgaaaaagctcggcagcaactgcaggaagagctaagacaggtgtccggacagcttctcgaggaacgcaaaaagcgagaaacgcacgaagctttagcaagaaggctacaaaagagagttttactcctgaccaaggaacgagacggtatgagggctattttggggtcatacgactctgagctcaccccagctgaatacagtcctcagttgactcgccgtatgcgggaggccgaggatatggtgcaaaaggttcacagccactccgcagagatggaagcgcagctgtcacaagcactggaagaactcggtggtcagaaacagcgagcggacatgctggagatggagctcaaaatgttaaaaagccagtcgtccagcgctgagcagagctttctgttctcaagggaggaggccgatactctgagactgaaggttgaagaattggaaggcgaaaggagccgtcttgaggaggagaagcggatgctggaggcccagctcgaaagacgggctttacagggcgattacgaccagtcccgcaccaaggtcttgcacatgagcctgaatcccacaagcgtcgcccgccaacgcctgagagaggatcattcccaacttcaagcggaatgtgagaggctgcggggtcttttacgggctatggaaagagggggtacagtgccggccgaccttgaggctgccgccgctagcctgcctagctctaaagaggtggcagaactcaagaagcaggtcgagtccgcggagttaaaaaatcagcgtttaaaggaagtcttccagactaaaatccaggaattcagaaaggcctgctataccctgacaggataccaaatcgatattaccaccgagaaccaataccgcctgacttctttgtatgccgaacaccccggcgactgtctcattttcaaggcaacgagcccatccgggagcaagatgcagttgttggagacggagttctcccacacagtcggagagctcattgaggtacacctccgacgccaggactccattccagcgttcctcagctctttaaccctggaactgttctcccggcagacagtggcgtag

SEQ ID NO: 193805 - DNA, 2157 bp, Artificial Sequence
  Description of Artificial Sequence: Synthetic coding sequence
atggaggacctgggcgagaacaccatggtgctgagcaccctgcggtcgttgaacaactttatttcccagcgggttgaaggagggtcaggcctggatataagcacgagcgcacctggatcacttcagatgcaataccagcagtccatgcaactggaggaaagggcagaacagattaggtccaagagccatctcatacaggtggaacgggagaaaatgcagatggagctcagccacaagcgagcacgtgtcgaactggagcgcgccgcttcaacctccgctcggaattatgaacgcgaagtggatcgcaatcaggaactgctgactagaattcggcagcttcaggagcgggaagccggagcagaggagaagatgcaggaacagcttgagaggaaccgacagtgccaacagaatttggatgctgcctctaaaagattaagggagaaggaagacagtctggctcaagccggggaaaccattaacgccctgaagggccgcattagcgaactccagtggagcgtgatggaccaagagatgagggtgaagaggctcgagtctgaaaaacaggagttgcaagagcagttggacttgcagcacaagaaatgccaggaggccaaccagaagattcaggaattgcaggcctctcaggaggcaagggcagatcatgaacaacaaatcaaagacctggagcagaaactgagcctgcaggagcaggacgcagccatagtcaagaacatgaaatcggagctggtgcgcctcccccggttggagcgcgagctaaaacagttaagggaagagtccgcccatcttagagagatgcgagagacaaacgggctgcttcaggaggaactggaaggcctgcagcggaagctgggaagacaggaaaaaatgcaggagacattagtagggctagaattggaaaacgagaggctgctcgccaagctccagagctgggaacggctggatcagactatgggcctctcgattcggacgcccgaggacctgtcccgcttcgtggttgaattgcaacagcgggagctggcactgaaagataaaaacagcgctgtcaccagcagcgcaaggggcttggagaaggccagacaacagttacaagaagaactgaggcaagtcagcggccagctgctcgaagagcgcaagaagagagagacgcacgaggccttggcccggcgcctacagaaacgagtgctgctgctcactaaagaaagagacgggatgagggccatcttaggatcttatgattcagaactcacccctgcggaatatagcccacagttgacaagaaggatgagagaggccgaagatatggtccaaaaagtgcattcccatagcgcagaaatggaggctcagctctcacaggccctggaggaattaggaggtcaaaagcaacgggctgatatgctggaaatggagcttaagatgctgaagtcgcagtcaagctctgctgagcagtcttttctcttcagcagggaggaagcagatacactcagattaaaggttgaagaattggagggggaacgatcaaggttggaggaagaaaagcgcatgctggaggcgcaactagaacgaagagccctccaaggcgactacgatcaaagcagaactaaagtgttgcacatgtctctgaaccccacatccgtcgcacgccaaaggctcagggaagaccactctcagcttcaagcagagtgcgagcgcctgaggggactgctgcgtgccatggaaaggggcggcaccgtgccggctgacctggaggccgctgcagctagcctcccaagttctaaggaggtggccgaattgaaaaagcaggtggaatcagctgagctgaagaatcagcgactaaaggaggtgtttcagacaaaaatccaggaatttcgcaaagcttgctacaccctgactggctatcaaattgatattacaaccgagaaccagtacaggctgaccagcctgtatgccgagcatcccggcgattgtctaattttcaaggcgacatcacccagtggctcaaaaatgcagctcctggaaaccgagttttctcatacagttggggagctaatcgaggtgcacctaaggagacaggattctattccagcatttttaagcagcctcaccttggagcttttttcacgtcagactgtggcctag

SEQ ID NO: 193806 - DNA, 1881 bp, Artificial Sequence
  Description of Artificial Sequence: Synthetic coding sequence
atgctgcccgcccggggctgcgtgcggaagcggaccgtgtggcccaggctggcccgcgtgttgattgtgacactgctgacacttgagctgtcttatgctcctctgccatgtcagctcagcggcgtgccatacaatactggcgatccagtgggcaggtgggccaggccatgtatttggccctgtccttggcacactaccattaacgccctcaagggtcgtatcagcgagctccagtggtcggtgatggaccaggaaatgagagtgaagaggctagagtccgaaaagcaagagctgcaggagcaattggacctgcagcataagaaatgccaagaggctaaccagaagatccaggaactgcaggctagtcaggaagcccgtgcggaccatgaacagcaaatcaaagacctcgaacagaaactcagtctgcaagaacaggacgccgctatagttaagaacatgaaatccgaattggtgcgtttgccaaggctcgagagggaactgaaacagttaagagaagaaagcgcacatttaagggagatgcgagagacaaatggtttgctccaggaagaactggagggcctgcagaggaagctggggcggcaggagaagatgcaagagacattggtgggacttgagcttgagaatgagaggctcctggcaaagctgcaatcatgggagagactggaccagacaatgggactatcaatcaggactcccgaggacctgtctaggtttgttgtggagttgcaacagcgggagctggcactgaaggataagaactcagccgtaacatcatcagctcgcggcctggagaaggcaagacaacagctccaggaagaactacgccaggtgtccgggcagcttcttgaagagcggaagaagagggagactcacgaagcgttggcaaggcgcttgcagaagagagtgcttctgctgaccaaagagcgggatgggatgagagctatactaggttcttatgattctgagctcacgcctgccgagtactcaccacagttgacacgcaggatgagagaggccgaagacatggtgcagaaggtgcacagtcatagtgctgagatggaagcacaactgagccaggctctggaggaacttggggggcagaagcaacgcgccgacatgcttgaaatggagctgaaaatgctcaagtctcagagctcgtcagctgaacaatcttttctcttctcccgcgaagaagcggatactctgcggcttaaggtcgaggaacttgagggcgagcgctcaaggcttgaagaggaaaagaggatgctcgaagctcagctggaaagacgcgctttacagggagactacgaccagtccagaaccaaggttttgcacatgtctctgaaccccacgagcgtggcgaggcagagattgcgcgaggaccactcacagcttcaagcagaatgtgagcgactgagaggcctgctgagagccatggagcggggcggtactgtgccagcagacttagaggcagccgctgcctcattgccatcttccaaggaagtggctgagcttaaaaagcaagtggaaagcgcggaactgaagaaccagagattgaaagaggtctttcagacaaaaatacaggagtttcgtaaagcttgctatacactaaccgggtaccagattgacatcactacggaaaatcaataccgactgacgagcctgtatgctgagcaccctggagattgcctcatattcaaagcaacatcccccagcggctcaaagatgcagctattggagaccgaattctctcacactgtcggggagttaattgaagtgcacttgaggcgacaggattccatccccgctttcctttccagtctgacactggagctattttcccgccagaccgttgcctag

SEQ ID NO: 193807 - DNA, 2157 bp, Artificial Sequence
  Description of Artificial Sequence: Synthetic coding sequence
atggaggacctgggcgagaacaccatggtgctgagcaccctgcggtcgctgaacaacttcatctcacaacgtgtggagggagggtccggactggatatatctacatccgcacccggttctctccagatgcagtaccagcagtcgatgcagctggaggagcgtgcagaacaaatcaggagcaagtctcacctgatccaggtggaacgggagaaaatgcagatggagttgtctcataagcgagcacgagttgagttggagagggctgcctcaactagcgcccgtaactatgaacgcgaggtggatcgcaaccaagagctgttgactcggattagacagctgcaggagagggaggctggcgccgaggaaaaaatgcaggaacagctggaacgcaatcggcaatgccagcagaatttagacgccgcttcaaagcgcctgcgggagaaagaagactcgcttgcgcaggctggggaaaccatcaacgcactgaagggacgcataagtgagctgcaatggagcgtgatggatcaggagatgagggtgaaacgcctagaaagtgaaaaacaggaactgcaggagcagcttgacttgcagcacaagaaatgccaagaagctaatcagaagattcaggaactgcaggcctcccaagaagcgagagcggatcatgagcaacaaatcaaggatctggagcagaagctgagcttacaggaacaggatgccgctattgtgaaaaacatgaagtcagagctggtgcgtctgccccgactggagagagaactcaagcagttgcgggaggaatccgctcacctgcgggaaatgagggaaacaaatggactgctgcaagaagaattagaaggtctgcagaggaagctgggcaggcaggagaagatgcaggaaaccctagttgggcttgagctggaaaacgagcgtctccttgccaaactacagtcttgggagaggcttgatcaaactatggggctgagcattcgcaccccagaagacctgtctcggttcgtagtggagctgcagcagagggagttagccctcaaggacaagaattctgctgtcacgagctctgccagagggcttgaaaaggccaggcagcaactccaggaggagttgcgccaggtgtcaggccagctgctcgaggagcgtaagaaacgggagacgcacgaagcattggctcggcgcttgcagaagcgggttctgctgctgacaaaagagcgggatggcatgcgggccatcctgggaagctacgactctgagcttactccggccgaatattctccccagcttacacggaggatgagggaggcagaagacatggtccagaaagtgcatagtcattctgcagagatggaggcgcaattatcgcaggcactggaagaactgggtggccaaaaacagcgcgccgacatgttggaaatggaactaaagatgcttaagtcccaatctagttcggccgagcagtctttcctgttttctcgagaagaggcggacacgctccggctgaaagtagaagaactggaaggggagagatcccgattagaggaagagaagcgcatgctggaggctcagcttgaaagacgcgcactgcagggagattacgaccagtcgcgtaccaaggtcctgcacatgtctttgaatccaacttccgtggctcgccagcgtctccgggaggaccattcccagttacaagctgagtgtgagaggctccgcggtttactacgtgcaatggagagggggggcactgtcccagccgacctggaggcggccgcagctagcctgccctcatcaaaagaggtggccgaactgaagaagcaagtggagtctgccgagttgaagaatcaaagactcaaagaggtctttcagaccaagatccaagagtttagaaaggcttgttacaccctgaccggttaccagattgatatcactacggagaatcaatataggctgacgtccctttacgctgaacaccctggcgactgcctcattttcaaagccacctccccgagcggaagcaaaatgcagctacttgagacagaattctcacacactgtcggggaactaatcgaggttcatctgcgaagacaggactcaatccccgctttcctgtcgtcgctaaccttagagcttttttctagacagaccgtcgcttag

SEQ ID NO: 193808 - DNA, 474 bp, Artificial Sequence
  Description of Artificial Sequence: Synthetic coding sequence
atggaggacctgggcgagaacaccatggtgctgagcaccctgcggtctttgaataattttatctctcagagagttgaagggggttcaggcctggatattagtacctccgccccaggttctctgcagatgcaatatcagcagtcgatgcagcttgaggagcgggccgagcagatccgaagcaaaagccacctgatccaagtcgaacgggagaaaatgcaaatggagctgagccacaaaagggcccgcgtcgagttggagcgtgcggctagtaccagtgctcggaactacgagagagaggtggatcgcaatcaagagctgctgaccaggatcagacagttacaggagcgggaagcaggcgccgaggaaaagatgcaagaacagttagaacgcaacagacaatgtcagcagaacctggacgccgccagcaaacgattacgagagaaggaggactctctggcccaggccggggaatag

SEQ ID NO: 193809 - DNA, 810 bp, Artificial Sequence
  Description of Artificial Sequence: Synthetic coding sequence
atgcgggagctggagttcgccaagctggagtgctgcctggcctggcagcttcaggctagccggcgggagctggagatggagctgaaaatgcttaaatcccagtcatcctccgcagaacaatctttcctattctcacgcgaggaagctgatactctgcggctaaaggtcgaagagttggagggagagaggtccaggctggaagaagagaagagaatgcttgaagcgcaactcgagaggagagctctgcagggagattatgatcagagccgtaccaaggtgttgcatatgagtctgaatcccaccagtgtagcacgccagcggctgcgcgaagatcactcacagctccaggccgagtgcgagaggttgaggggacttctgcgagcaatggaaagaggggggactgtgcccgcagatctggaggcggccgcagcttctctgccgagttccaaagaagtagccgagctgaaaaagcaagtagaatccgcagagttgaaaaaccagaggctcaaagaggtgttccagacaaagatccaggagttccggaaagcttgctatacactgactgggtatcagatcgacattaccactgaaaatcaataccggctaaccagcttgtatgcagagcaccccggggactgcttaatctttaaggctacctctccttccggatctaaaatgcagctgctggaaacagagtttagtcacacagtgggtgagcttattgaagttcacttgagaagacaggacagcatccccgctttcttgagcagtctgaccctagagttattttctcgtcaaacagtagcctag

SEQ ID NO: 193810 - DNA, 618 bp, Artificial Sequence
  Description of Artificial Sequence: Synthetic coding sequence
atggccctgcagctgagccgggagcagggcatcaccctgcggggcagtgccgagattgtggctgagttctttagttttggaatcaactctatcctttatcaacgcgggatctaccctagcgaaaccttcactcgcgtccagaagtacggtctgaccctattagtcacaaccgatcttgagctgatcaaatatctcaacaacgtggtagagcagttaaaggattggctctacaaatgctcagttcagaaactcgtggttgtcatttcaaacatcgagtccggcgaagttctggagcgttggcagtttgacattgaatgcgacaagaccgctaaagacgactctgcaccccgagaaaagagtcaaaaggccattcaggatgagatccggtcagtcattagacagatcacagccactgtgaccttcctgccactccttgaagtcagctgctcctttgatttgctgatctatacagacaaagacctggtggttcccgagaagtgggaagaatccggaccacaatttattacgaattcagaggaagtgcggctcagatccttcaccaccacaatccacaaagtcaattcaatggtggcatataaaataccagttaacgattag

SEQ ID NO: 193811 - DNA, 1212 bp, Artificial Sequence
  Description of Artificial Sequence: Synthetic coding sequence
atgcccaaccggaaggccagccggaacgcctactacttcttcgtgcaggaaaagatcccagagctgcgacggcgcgggctgccagtcgctcgggtcgcagacgctattccatactgctcctctgattgggccaagcccgtttttacgccactgcggcgcccggggatgctggtgcccaagcaaaacgtgtcgcctccagatatgtccgcactcagtcttaagggggatcaggcgctactcggcggcatcttttattttctgaatattttttctcatggagaactgcccccccactgcgaacagcgctttctgccctgtgagatcggttgcgtgaaatacagcctccaggagggtatcatggcagactttcattcattcattaatcccggggagatccctcgaggcttccggtttcattgccaggccgcgagtgactcctcgcataagatcccaatctcaaactttgaacggggccataatcaggcgacagtgctccagaatctctatcgctttatccatccaaaccctggcaattggccgccgatatattgtaaaagcgatgacagaactagggtcaattggtgtttaaaacatatggctaaggcatcggaaatcaggcaagacctccaactgctcacagtggaagacctcgtggtaggcatttaccaacagaaatttcttaaggagccatccaaaacatggatccgcagcctgctcgatgtggccatgtgggattattcttccaacacaaggtgcaagtggcacgaagagaatgacattcttttttgtgccttggctgtatgcaagaagatcgcgtattgtattagtaactcacttgctaccttattcgggattcagctgactgaagcacacgttccgctccaggactacgaagcatccaattctgtgaccccaaaaatggtggtgctcgatgccgggcgctaccaaaagctgcgggtgggtagcagcggcttctctcatttcaattcatctaacgaggaacagcggagtaatacgcctataggtgactacccttcccgagcaaaaatttcaggccagaattcttccgttaggggaagagggataactagactgttggagtctatcagtaatagcagttcaaacatacacaaattttctaattgcgatactagcctgtccccatacatgagccagaaggacgggtataagagcttttcatcgctctcttag

SEQ ID NO: 193812 - DNA, 1305 bp, Artificial Sequence
  Description of Artificial Sequence: Synthetic coding sequence
atgcccaaccggaaggccagccggaacgcctactacttcttcgtgcaggaaaaaatccctgaactgcggaggcgcggccttcctgtggcgcgggtagccgatgctataccttactgttcttctgactgggctttgctgagagaggaggagaaggaaaagtacgcggaaatggctagggaatggcgggccgcccagggaaaagaccccgggcctagcgagaaacagaagcctgtcttcacccccctccggcgccccggaatgctcgtgcctaaacagaatgtttcaccacctgacatgtcagctctaagcctgaagggagaccaggccctgctgggcgggatcttctacttcctcaacatcttctcacacggagagttgcctcctcattgtgagcagcggtttttaccttgtgagatcggctgcgttaagtattcattgcaggagggtatcatggctgatttccacagctttattaaccccggcgagatccccagaggcttccggttccactgtcaggctgcgagcgatagctcacataaaatcccaatctccaactttgaaagaggccataatcaggctaccgttttgcaaaacctttaccggttcatacaccctaatcctggcaattggccccccatctactgtaagtccgatgacagaacaagagtcaattggtgtctgaagcatatggctaaagccagtgagattcgccaagacttgcaacttctcactgttgaggacctggtggtgggtatttatcagcaaaagtttctaaaggaacctagcaagacttggattaggagtctccttgatgttgctatgtgggactacagttcaaacacccgttgcaaatggcatgaagaaaatgatattctgttttgcgcgctcgcagtgtgtaagaagatcgcatattgcatctccaattctttagctaccctgtttggcattcaactcacagaggctcacgtccccctgcaggactacgaggcttccaattctgttactcccaagatggtcgttctagatgcaggacggtaccagaagctacgggtgggaagctccggattctctcacttcaattcctccaatgaagagcagagaagcaacacgccaatcggcgactatccctcgagggccaagatttccgggcagaactctagcgtccggggccgggggataacaagattattagagtccatctccaacagcagctctaacatacataagttctcaaactgcgacaccagcctatcaccttacatgagtcagaaggacggttacaagtctttttcctccctgagctag

SEQ ID NO: 193813 - DNA, 951 bp, Artificial Sequence
  Description of Artificial Sequence: Synthetic coding sequence
atgcccaaccggaaggccagccggaacgcctactacttcttcgtgcaggagaagatccccgagctgcgtcgcagaggcctgcctgtcgctcgagtggcagacgccattccctactgttcttctgactgggccaaaccggttttcacccctctgcgtcggccgggcatgttagtccctaaacagaatgtgtccccgcctgacatgtccgccttgtccctgaaaggagaccaggctctcctcggcggcatcttttactttctaaacatctttagccacggtgagcttccaccacactgcgagcagcggtttctgccctgcgaaataggttgcgtgaaatactccctccaggagggcattatggcggactttcactcttttattaatcccggcgaaattcccaggggatttcgtttccactgccaggctgccagtgacagttctcacaaaatcccaatttcaaattttgaacggggccataaccaggccactgtcctacaaaatctgtacaggtttatccacccaaacccaggtaactggccccccatttattgtaagtccgacgacaggacgagggtcaattggtgtcttaagcacatggcaaaggccagtgaaattcgccaggacctgcagctactgacagtggaggatctggtagttggtatttaccagcagaaattcctgaaagagccctccaaaacatggattcggtctttgctggacgtagctatgtgggactactcgagtaataccaggtgtaaatggcacgaggagaatgatattctgttttgcgcccttgctgtctgcaagaagatcgcttattgtatcagcaattcacttgctactctgtttggaatccagctgactgaagcccacgtccctttacaggattatgaagccagcaattctgttacacccaaaatggtggtgctagatgcgggtcgctaccagtag

SEQ ID NO: 193814 - DNA, 471 bp, Artificial Sequence
  Description of Artificial Sequence: Synthetic coding sequence
ctgctgcagcggtgcaagtggcacgaggagaacgacatcctgttctgcgctctcgcagtgtgcaaaaaaatcgcctactgtattagtaacagcctggccaccttattcgggatccagctgacggaggctcatgtcccgctgcaggattacgaggcctctaacagcgtcacgccaaagatggtggtgctcgatgcggggcggtatcagaaattaagggtcggatctagtggattcagccatttcaatagtagtaacgaggaacaacggtccaacaccccgatcggggattatccctctagagccaagatcagtggacagaactcctctgtaagaggcagaggcatcactagactccttgagtccatttccaacagcagtagcaacatacataaattctctaactgtgatacgtccctgtctccctacatgagccagaaggacggttataaatctttttctagtctgtcttag

SEQ ID NO: 193815 - DNA, 747 bp, Artificial Sequence
  Description of Artificial Sequence: Synthetic coding sequence
atggaccagcggcagcggcggatcctgggccagcccctgagcatccccacttcccaacctaagcaaaaacgcacatccatgattagcttcttctcgaaggtgtcttggaaactcagattccagaagagggagcctctgaaaaacgtgttctttattctggcggagagagctagggatccctcagcgaaaaagcggcatatggccatgagaaacctggggacaatggcttatgaagcgcccgacaaagtccggaaatataaaaagattgttcttgacctgctcgtttatggcctgtacgaccccgtgaaccttgaggtgattcacgagagcatgaaaacacttacggttgtcctcggcaagatccaggggaagggcctcggttcttttttcatcgacattacacttcagacccgtactctgctggatgatgaaaatgactccttgaggtacagcgcattcgtactctttgggcagctggctgctttcgccgggcggaagtggaaaaagttcttcactagtcaggtgaaacagacacgggattcacttttaatccaccttcaggatcgcaacccacaagtagctaaggcatgtaagaccacctttcaggcatgcagtccttatcttaaattgaaagaggaatattcttttcagtcagaagaggaccagagaaataccaagctgtaccaacagctctcccactatcacccagaaatacttcaattcttttatgccaacaagatattgtag

SEQ ID NO: 193816 - DNA, 747 bp, Artificial Sequence
  Description of Artificial Sequence: Synthetic coding sequence
atggaccagcggcagcggcggatcctgggccagcccctgagcatcccgacttcccagccgaagcagaaacggacctcgatgatatcctttttctcaaaagtgtcttggaagttaaggtttcagaaacgggagcccctgaagaacgtgttctttatactggctgaacgtgccagagaccccagtgccaaaaagagacatatggccatgcgaaatctgggtactatggcctacgaggcgcccgacaaagtgagaaagtacaaaaaaatcgtgcttgatctcctcgtctacggactgtatgaccctgttaatctcgaagtgatccacgagagtatgaaaactctgaccgtggtcctcgggaagatacaaggaaaagggctgggcagcttttttattgatatcacactccagactcgcactctacttgatgacgagaacgactctctaagatatagtgccttcgtgttattcggccaactggccgcattcgctggccggaagtggaaaaaattttttacatcacaggtgaagcagacaagagacagcctcttgatccacttacaggatagaaatccgcaggtcgccaaggcgtgcaaaacaacctttcaggcgtgttctccgtatctgaagttaaaagaggagtacagttttcagtcagaggaggatcaacgaaacaccaaactctatcaacaactcagccactatcaccctgaaatcttgcaattcttctacgccaataagattttgtag

SEQ ID NO: 193817 - DNA, 591 bp, Artificial Sequence
  Description of Artificial Sequence: Synthetic coding sequence
atggaccagcggcagcggcggatcctgggccagcccctgagcatccccacctcccaaccaaagcagaagagaactagtatgataagtttctttagcaaagtgtcctggaagcttcgctttcagaaacgggagcctcttaaaaacgtctttttcattctggcggagcgagctagagacccatccgccaagaagagacacatggctatgcgcaatctcgggaccatggcgtatgaggcacccgacaaagtcaggaagtacaagaagatcgtgcttgatttgcttgtctatggcctttacgaccctgttaatctggaggttatacatgaatctatgaaaacccttacagtggtcctgggtaagatacagggcaaaggactcgggtccttttttattgacatcactctgcagacaagaacactgctggatgacgcctgcaaaactaccttccaagcgtgcagtccatatttaaaacttaaggaggagtactccttccagtcggaagaggaccagaggaacactaaactctatcaacagctttctcactatcatcccgaaatcctccagttcttctatgcaaataaaatcctgtag

SEQ ID NO: 193818 - DNA, 633 bp, Artificial Sequence
  Description of Artificial Sequence: Synthetic coding sequence
atggcctggggcagcaagggcatccagggctgggagaacctggccgagtctagtcacctggccacaacccgtgagtcatctccccctgagtcaggaaccggctccggcagcagccgcggaagtcggttgcaggaacctcaggtgtcttggaagctacggtttcaaaaaagagagcctctgaaaaatgtgttctttattctagcagagagggcacgtgacccaagcgccaaaaagagacacatggcaatgagaaatctcggaaccatggcatatgaggccccagacaaagtgcgcaagtacaaaaaaatcgtcctggacctgctcgtgtatggcctgtacgacccggtgaaccttgaagtcatccatgagtcaatgaagacccttactgtggtcctgggcaagatccaaggcaagggtcttgggtcattctttatcgacattactctccagacaaggacgctgcttgatgacgcatgcaaaactacatttcaggcgtgcagtccctatcttaagctaaaggaggagtacagcttccagtccgaggaagaccagcgtaacactaagctgtaccagcagctttcacattatcaccctgaaatcctccagttcttttatgccaataagattctatag

SEQ ID NO: 193819 - DNA, 789 bp, Artificial Sequence
  Description of Artificial Sequence: Synthetic coding sequence
atggcctggggcagcaagggcatccagggctgggagaacctggccgagagctcccatctggctactaccagggaatcctctccgcccgagtcaggaacaggatcaggctctagtcgtggatcccgtctgcaggagccacaggtttcttggaaactgcgctttcagaagagggagccgttgaaaaatgtcttttttattcttgccgagagagcccgcgatccctcagctaaaaagcgtcacatggctatgcgcaacctgggcacaatggcttacgaagcacccgataaggtgcgcaaatataagaagatcgtgcttgaccttctcgtgtatggcctgtacgatcctgtcaatctggaggttattcacgaatctatgaaaacactgactgtcgttctgggtaaaattcagggcaagggccttggatctttctttattgatatcactctgcagactcgaacattattggacgatgagaatgattccctgcggtacagcgctttcgtcctgtttgggcaattggcagctttcgccggccggaagtggaagaaattcttcacgagtcaggtaaagcagactcgcgactctctgctcatccacctgcaggaccgcaacccgcaggttgccaaagcttgcaagactacttttcaagcttgcagtccctacttgaagctcaaagaagaatacagtttccaatcagaagaggaccagcgtaatacgaagttataccagcagctgtcgcactatcaccccgagattctacaattcttttacgccaataaaatcctgtag

SEQ ID NO: 193820 - DNA, 591 bp, Artificial Sequence
  Description of Artificial Sequence: Synthetic coding sequence
atggaccagcggcagcggcggatcctgggccagcccctgagcatccctacttcacagcccaagcagaagagaaccagtatgataagtttctttagcaaagtgtcttggaaactgcgcttccagaaacgagagcccttgaagaacgtcttctttattctggccgagcgggctagggatccatccgccaagaagaggcacatggccatgagaaacttaggaaccatggcatatgaagctccagacaaagtgcgcaagtacaaaaagatcgtactcgatctcctcgtttatggtctgtatgatccagtgaacctggaggtaattcatgagagcatgaagaccctgactgtagtattaggaaagattcaaggcaaaggtttagggtcttttttcattgatataaccctgcagaccaggaccttactcgacgatgcctgtaagaccacctttcaagcatgtagtccgtatctcaagttaaaagaggaatactcctttcagtccgaagaggatcagcggaacacaaagctgtaccagcaacttagccactaccatcctgagatactgcagtttttctatgcaaataaaattctatag

SEQ ID NO: 193821 - DNA, 771 bp, Artificial Sequence
  Description of Artificial Sequence: Synthetic coding sequence
atgaagctgctggagaacagcagcttcgaggccatcaacagccagttgacagttgagaccggagacgcacatatcataggacgaattgaatcctactcttgcaagatggccggggacgacaagcacatgttcaaacagttctgtcaggaaggtcaaccccatgttcttgaggcgctgtcacctcctcaaacatcagggttgtccccttctcggctgagcaagagccaggggggcgaggaggaaggccctctgtctgacaaatgttcaagaaagactctcttttacctgattgctactctgaatgaaagttttcgtccagactatgacttctccacagcaaggtcacatgagttcagcagggaacctagcctctcttgggtcgtcaatgctgtcaactgcagcctgttctcagcagtccgtgaagatttcaaggatctcaagccacaactctggaatgcagtagatgaagagatatgcctggcagaatgcgacatttatagttacaatcctgacctagactcagacccttttggcgaagatgggagcctgtggagtttcaattactttttttacaataaacgactgaagcgtatagtttttttctcttgccggtccatctctggatcaacctacacgccgtcggaggcggggaatgagctggacatggagctcggagaggaagaagttgaggaggagtctcggtcaggcggaagtggagctgaagaaacctccacgatggaggaagatcgggtccccgtaatttgcatatag

SEQ ID NO: 193822 - DNA, 213 bp, Artificial Sequence
  Description of Artificial Sequence: Synthetic coding sequence
atgaagctgctggagaacagcagcttcgaggccatcaacagccagctgaccgtcgagacgggcgacgcccacatcatcggacggattgagagctacagttgtaagatggccggtgatgataaacacatgtttaaacaattttgtcaggaaggccagccgcacgtgttggaggcactgtcacctcctcagacctccggactatcccccagctag

SEQ ID NO: 193823 - DNA, 771 bp, Artificial Sequence
  Description of Artificial Sequence: Synthetic coding sequence
atgaagctgctggagaacagcagcttcgaggccatcaacagccagcttaccgtcgagacgggtgacgctcacatcatagggcgaatcgagtcctattcctgcaaaatggccggcgatgacaagcatatgtttaagcagttctgtcaggaggggcagcctcacgtgctggaggcactgtctccaccccagacttccggcttgtcccccagcagactctccaagagccagggaggggaggaggaagggccactatcagacaaatgttctcgtaaaacactcttctaccttatcgcgactcttaacgagtcatttcgccctgactacgacttcagtaccgcgcggagtcatgagttttcacgtgagccatctttgagctgggtcgtaaacgctgtcaactgctcactgtttagcgccgttcgagaggatttcaaggatctgaagccgcagctgtggaacgccgttgatgaagaaatttgcctggctgagtgtgacatctacagctataatcccgatttggacagcgacccatttggagaagacggatcactttggtccttcaactacttcttctacaacaaaaggctgaaaagaatcgtcttcttttcttgcagatcaatctccggcagcacttatactcccagcgaagccggcaacgagctagatatggagctgggggaggaggaagtagaggaggaaagtagaagtggcgggtccggagccgaggagactagcacgatggaggaggatcgggtgcctgtgatctgtatttag

SEQ ID NO: 193824 - DNA, 1104 bp, Artificial Sequence
  Description of Artificial Sequence: Synthetic coding sequence
atgcggaagggcaagggccccatctgcctgttcagccggcccaccctccgcccatcccggtccaaggtatccctgatcgaaggtcgcggggcaaacatggcggcgaggtggaggttttggtgtgtctcagtgactatggtggtggcacttctgattgtatgtgacgtcccaagcgcctcagctcagcgcaagaaagaaatggtgctcagcgagaaggtgtcgcagctgatggaatggacaaataagcggcctgtcattcgtatgaacggagacaagttcaggcggctggtcaaagccccccctagaaactatagtgtcatcgttatgttcacagctcttcagttgcatcggcagtgtgttgtatgcaaacaggccgacgaagaattccagatattagccaacagttggcgctattcgagcgcgttcaccaatcggatcttttttgctatggtggacttcgatgaagggagcgatgtgttccagatgctgaacatgaattctgcacccacttttattaacttcccggccaaggggaagccaaaacgcggcgacacctatgaacttcaggtcagaggatttagcgccgaacaaattgcgagatggatagctgacaggaccgacgtgaacatacgcgttattcgcccgccaaactatgcagggcctctcatgcttggactgttgctggctgtcatcggcgggttggtgtatctccgtaggtccaatatggagttcctgtttaacaaaactgggtgggcttttgctgccttgtgtttcgtgcttgccatgaccagcggccagatgtggaatcatatccgcggtccaccatatgcccacaagaatccacacacagggcacgtgaattacattcatgggagttcccaagcacagtttgtggccgaaacacacatagttttgctattcaatggaggtgtcaccttggggatggtcttgttatgcgaagccgcaaccagcgacatggatattggtaagcgcaagatcatgtgtgtggccggcatcgggcttgtagtcctcttcttttcatggatgctaagcattttccggtctaaatatcacggttacccatactccttcctgatgtcttag

SEQ ID NO: 193825 - DNA, 657 bp, Artificial Sequence
  Description of Artificial Sequence: Synthetic coding sequence
atggtggacttcgacgagggcagcgacgtgttccagatgctgaacatgaattctgcacccacatttatcaacttccccgctaagggaaaaccaaaaagaggcgacacctatgaactccaggtgcgaggatttagtgcggagcagatagcccgctggattgcggaccggactgacgtcaatattagagtgatcaggccaccgaactacgcaggccctctgatgctcggactactgctagccgtgattggcggactggtgtaccttaggcgctccaatatggaatttctatttaataagaccggctgggcttttgccgctctttgctttgttttggcaatgacaagtggacagatgtggaaccacatacgaggtcctccgtacgcccataagaatccacacacgggccacgttaactacatccacgggtcctctcaggcacagtttgtggctgaaactcacattgtgctgttgtttaatggtggcgtcaccctgggtatggtcctgctgtgcgaggctgccactagtgatatggacattggtaaaagaaaaatcatgtgtgtcgcaggaattggcttggtcgttctgttcttttcctggatgcttagcatcttccgatctaagtatcacggctatccctatagcttcctcatgtcctag

SEQ ID NO: 193826 - DNA, 330 bp, Artificial Sequence
  Description of Artificial Sequence: Synthetic coding sequence
atggagagcgacttctacctgcggtactacgtgggccacaagggcaaattcggtcacgagtttctcgagtttgaatttagacccgatgggaagctgcggtacgcaaataacagcaattataagaacgatgtgatgatccgaaaagaagaactggagattgtcataggcgatgagcatatttcatttaccacctcaaagatcggatccctgattgatgtgaatcagagcaaggacccggaggggctccgtgtgttctactatcttgtacaggatctgaagtgtctagtctttagcctgattggcctgcactttaagataaaaccaatttag

SEQ ID NO: 193827 - DNA, 441 bp, Artificial Sequence
  Description of Artificial Sequence: Synthetic coding sequence
atggagagcgacttctacctgcggtactacgtgggccacaagggcaaatttggtcatgagtttctcgagtttgagttcaggcccgatggcaagcttcgttatgccaacaacagtaactacaagaacgacgtcatgattcgcaaggaggcctacgttcacaagagtgtcatggaagagttaaaaaggatcattgacgactccgaaattacgaaggaggacgacgccctttggcctcctcctgatagagtgggacgccaagaactggagatagtcatcggcgacgagcatatcagtttcactacatcaaagattggaagcttgatagacgttaatcagtccaaagaccccgagggtctgcgggtgttttactacttggttcaggacctgaagtgcttggtgttctcactgatagggctccactttaagatcaaacctatttag

SEQ ID NO: 193828 - DNA, 1731 bp, Artificial Sequence
  Description of Artificial Sequence: Synthetic coding sequence
atgggcagcatcctgagccggcggatcgccggcgtggaggacatcgacatccaggcaaactcagcttatcgctatccccctaaaagtggaaattatttcgcttcacactttttcatgggcggagaaaaatttgatacacctcatcctgaaggctatcttttcggtgaaaacatggacttaaatttcctgggatcacgacctgtgcaatttccgtacgtgacgccagctccccacgaacccgtgaaaacactgcgcagcctcgtcaacatcaggaaagattcactgcgactggtgcgctataaggacgacgctgacagccccactgaagacggagataaacctagggtgctgtattcgttagaatttaccttcgacgcggacgccagggtcgccattaccatttactgtcaggctagtgaagaatttctcaatggacgcgcggtatactctccaaagtcaccatcgctgcagagcgagaccgtgcactataagcgtggggtgagccagcagttcagcctgccatccttcaaaatcgactttagtgagtggaaggacgatgaacttaatttcgatctggataggggggtgttccccgtggttatccaggctgtcgtcgacgagggcgacgtcgtggaagttacagggcatgcccacgtcttgttggcagccttcgagaaacatatggatggaagcttctcagtgaaacctctcaagcagaaacagattgtagacagagtgagttatctcctacaggaaatctacggtatagagaacaagaacaaccaggaaaccaaacccagcgacgatgagaacagcgataattccaacgaatgtgtcgtctgtctatctgacctcagggatacgctgatcctaccatgtcgtcacctctgcctctgcaccagctgcgcagatacactcaggtatcaagctaacaactgtcctatttgccgcctgccatttcgcgcacttcttcagattcgggctgttcggaagaagcctggcgctctttcgcctgtatccttttccccggtgctggcccagtccctggaacacgatgaacactcctgtcccttcaagaagagcaagcctcaccccgcgtccctcgcttccaagaaacccaagcgggagaccaactcagatagcgtacccccaggctacgagcctatttctttgctcgaagccctaaatggacttagagcggtctcaccagcgatccctagcgccccactgtacgaagagatcacatatagtgggatctccgacgggcttagccaggcatcttgccccctggctgccattgatcacattctggattcatcgaggcaaaagggacgcccacagagcaaggctcctgactctacactacggagcccctcctcccccatccacgaggaagacgaggagaagctgagcgaggatgtggacgcccctccccctctcggtggggctgaactggcgctgcgcgagtcctcatcgcccgaatcattcattacagaagaggtggacgagagttcatctccacagcaaggcacccgtgcggccagcatcgaaaacgtcctgcaggattcttcacccgagcactgtgggcgcggcccaccagctgatatctaccttcctggacgacctacatctatggagacagctcatgggttggcgacaacaagtcccacctggcctcctctcggcgggccctctccagatcccagcgccgctgaactgactccgctatag

SEQ ID NO: 193829 - DNA, 1659 bp, Artificial Sequence
  Description of Artificial Sequence: Synthetic coding sequence
atgggcagcatcctgagccggcggatcgccggcgtggaggacatcgacattcaggctaactccgcctataggtaccctccaaagagtggtaactacttcgcctctcacttcttcatgggcggtgagaaattcgacacgccgcacccagaagggtacctgtttggggagaacatggaccttaatttcttgggttcacggcccgttcagtttccttacgtaactccggcacctcatgagcccgtcaaaactctgagatctctggtgaacatacgcaaggattcccttcgattggtccggtacaaagacgacgcggatagccctactgaggatggcgacaagcccagggtgctgtactcacttgagtttactttcgacgccgatgcacgtgtggcaattacaatctattgccaagcatccgaggagttcttgaatggccgcgcggtgtactcaccaaagtccccatccctgcaaagcgagaccgtccattataaacgtggagtctcacagcagttttcgttgccgagctttaagatcgatttcagcgagtggaaagacgacgaactcaacttcgatctcgaccgtggcgtctttccagtggtcattcaagccgtagtcgacgagggcgacgtcgtcgaggtaacaggtcacgcccacgtgttgcttgccgccttcgaaaaacacatggatgggtctttctccgtcaaacctctgaagcaaaaacagatagtggaccgagtcagctatctgctccaggagatctatgggattgaaaacaaaaataatcaagaaactaaaccaagcgacgacgaaaactcagataacagcaacgagtgtgtcgtttgcctgtctgatctgcgggatactctcattctgccctgcaggcatctgtgcttatgcacctcctgtgccgatacgctccggtatcaggcaaataattgcccaatctgcaggctgccgttccgcgctctcttacagatcagggcagtcaggaaaaagcctggggccttgagccctgtgtcctttagcccagtgttggctcagtccctggagcacgatgaacacagctgtcccttcaaaaagtctaagccccatccagcatctctcgcatccaaaaagccaaagagagaaacaaacagtgactccgtgcctcctggctacgagccaatctccctgttagaggctttaaatggtctgagggcagtctcgcctgcaattccttcggcccctctgtatgaggagatcacgtattctggtatctctgatggccttagccaagcatcttgcccactcgcagcaattgaccatatcttagactcctcgaggcagaaaggcaggccacaaagtaaggcccctgatagcaccttgaggagccctagctccccaattcacgaagaagacgaggaaaagttatcagaggacgtggacgcccccccccccctgggaggtgccgaactcgccctgcgcgaaagttctagtccagagtcgtttataactgaggaggtagatgagagctctagtccccagcaggggaccagggccgccagtattgagaacgtgttacaggactcctctccagaacattgcggtaggggccctcccgccgatatttacctccccgctctcgggcctgatagttgttctgtgggcatcgacgagtag

SEQ ID NO: 193830 - DNA, 1596 bp, Artificial Sequence
  Description of Artificial Sequence: Synthetic coding sequence
atgggcagcatcctgagccggcggatcgccggcgtggaggacatcgatattcaggctaattcagcctataggtacccacccaaatcaggcaattacttcgcaagtcactttttcatggggggtgagaagtttgatacaccgcaccctgagggatacttgttcggggagaacatggatctgaacttcctgggctcccgacccgtgcagtttccttatgtaacccccgctccccatgagcccgttaaaacccttaggtctctggtcaacattaggaaggattcactaaggttggtgaggtacaaagacgacgcggacagcccgacagaagacggggataaacccagagtgctttactccttggaatttacctttgatgcagatgctagagtcgctataaccatttactgccaggctagcgaggagttcctgaatggcagggccgtctacagcccaaaatccccctccttgcagtcggaaaccgttcattataaacgaggagtgagccagcaattctcactaccatcctttaagatagattttagcgagtggaaggatgatgaactgaacttcgacctggatcggggcgtttttccagtggttattcaagccgtagttgacgagggagacgctgtggtcgaggtgacaggtcacgcccacgtgctgctcgctgccttcgaaaagcacatggatggatccttctctgtgaaaccactgaagcagaagcagattgtggatcgcgttagctacctgctgcaagagatctacggaattgagaataagaacaaccaagagactaagcccagcgacgacgaaaactccgacaacagtaacgagtgtgtggtctgcctgtcagacctgagggacaccctaatattgccgtgtcgccacctatgtctttgtacttcctgtgccgacacattgcgataccaggcaaataattgcccgatctgtcgcttgcctttcagagccctgctgcagattcgagcggtgcgaaagaagccaggcgctctgagtcccgtatcattcagccccgtcctagctcaaagcctggaacatgacgaacacagcaattctgactcagtcccccctggttacgaaccaatctctttattggaagccctcaatggcttacgcgcagtgagcccagccatcccctcggcccccctttatgaggagatcacgtattcgggaatttctgacggtctttcacaggcctcctgtcccttagccgctatcgaccatatcttggactccagccgccagaaggggcgtccgcagagcaaggcccctgattcgacgcttcgaagtccaagcagccctatacacgaggaggatgaggagaagctctctgaggacgtggatgcaccgcctccactcgggggcgcagagttggccctacgagaatccagcagccccgagtcttttataaccgaagaggtggacgagtcttcttcacctcagcaaggcacgcgggctgcctcgattgagaacgtgctacaggattcgagccccgagcactgtggcaggggaccgcccgcagacatctacctgcctgcactggggcccgattcctgttcggtgggcattgatgagtag

SEQ ID NO: 193831 - DNA, 963 bp, Artificial Sequence
  Description of Artificial Sequence: Synthetic coding sequence
atgggcagcatcctgagccggcggatcgccggcgtggaggacatcgacatccaggcgaactccgcctatcggtatcccccaaagtcaggcaattactttgccagccacttctttatgggaggtgaaaaattcgatacccctcaccccgaaggatatctgtttggcgagaatatggatctgaatttcctcggctccaggcccgtacagtttccctacgtcacgccagcaccacacgagcctgtaaagacactcaggagccttgtcaatataagaaaggattctttgcgccttgtgcgttataaggacgatgctgattccccaacagaggatggtgacaaaccgagagtgttgtattctttagaattcaccttcgatgctgacgcaagggtggccatcacgatctactgccaggcaagcgaagagtttctgaacggcagagccgtctactcaccaaaatcacccagcctgcagagcgagaccgttcactacaaacggggcgtctcccagcaattctcattaccctcgtttaaaatcgatttcagcgagtggaaggatgacgagctaaacttcgatctcgatcgtggagtgtttcccgtcgtcatacaggccgtcgtggacgagggtgacgtcgtagaagtgactggacatgcgcacgtcctgctggccgccttcgaaaaacacatggatggttccttctctgtcaaaccgcttaaacagaaacaaattgtggaccgcgtatcatatttgttgcaggaaatttatgggatcgaaaacaagaataaccaggagacaaaaccatctgatgatgagaattccgacaatagcaacgagtgtgtggtgtgtctctcagatttgagagatacattaatcttgccatgccgacacctgtgcttatgtactagctgtgcggacacattaaggtatcaagccaataactgtccaatctgccggctgcaactatag

SEQ ID NO: 193832 - DNA, 1632 bp, Artificial Sequence
  Description of Artificial Sequence: Synthetic coding sequence
atggccaagggcgagggcgccgagagcggcagcgccgccggcctgttgcctacctccattctgcagtctaccgagagaccagcccaagtgaagaaagaacctaagaagaagaaacaacagctttctgtctgcaataaattgtgttatgccctgggaggggcaccatatcaggttacggggtgcgccttggggttttttctccagatctacctcctggatgtggctcagaaggacgaggaagtcgttttctgtttctccagcttccaagtcggccccttttcagcctccatcatactgttcgtcggacgcgcctgggacgcgattacagaccccctcgtgggactgtgcatcagcaagagcccatggacttgcttgggacggctgatgccatggattatattttcaactccgctggccgtcatcgcgtacttcttgatttggttcgtccccgactttcctcacggacagacttactggtatttactgttctattgcttatttgagacgatggtgacatgctttcatgttccgtactccgctctgacaatgttcataagcacagagcagactgagcgcgatagcgctactgcgtataggatgaccgtcgaagtcctaggaacagtcctgggtacggcaatccagggccagatcgtgggccaggccgatacaccttgtttccaggacctcaattcttccacggttgcctctcagagcgcgaatcacacacatggaaccactagccaccgcgaaacccagaaagcatatctgctggcagcgggagtaattgtctgtatctatattatttgtgctgtgatcctgattttgggtgtgagagagcagcgcgaaccatatgaggcacaacagtcagaacccatagcgtattttcggggcttaagactggtcatgagtcatggaccctacatcaaactcatcaccggattcctctttacatcattggcatttatgctagtcgaggggaattttgtactgttttgcacgtatacgctgggatttcggaacgagttccaaaatctcctgcttgccatcatgctcagtgccacactaactatccccatttggcagtggttcctgactcggttcggcaagaagaccgcagtctacgtgggcataagctcagcagtccctttcctgattcttgtggcgttgatggaatcgaatttgatcattacttatgctgttgccgttgcggccgggattagcgttgccgccgcatttctgctgccctggagtatgctgccagacgtcattgatgattttcacttgaaacaaccccatttccacggtacggaacccatatttttcagcttctatgtcttcttcacaaaattcgctagcggggtttccctgggaatctcgacgttgtcactcgacttcgctggctatcagacccgcggttgcagccaaccggagcgggtcaagttcacccttaacatgctggtcaccatggcacccattgttctgattctgcttggtctgctcctgtttaagatgtatccaattgatgaagagagacgcaggcagaacaagaaggccctgcaggcactgagagacgaagcatccagctccggctgcagcgagacggattctactgagttggcctcaattttatag

SEQ ID NO: 193833 - DNA, 1593 bp, Artificial Sequence
  Description of Artificial Sequence: Synthetic coding sequence
atggccaagggcgagggcgccgagagcggcagcgccgccggcctgctgcccacctccatccttcagagtaccgaacgcccggcacaagtgaaaaaagagccaaagaaaaagaaacagcaactgtcggtttgcaacaaactgtgctatgccctgggcggagctccctatcaggtgacaggttgtgctctgggattttttctccagatctacctgctggacgtggcccaagtgggcccttttagcgctagtattatccttttcgtaggacgtgcgtgggacgccatcacagaccccttggtcggtctgtgtatttcaaaatcaccctggacctgtttgggccggctgatgccttggataatcttctccacgcccttggctgtgatagcctactttttgatttggttcgtgcctgattttccacacggccagacctactggtatctgcttttttactgtctctttgagacgatggtcacttgctttcatgtgccttacagcgcattaacaatgttcatctctaccgagcagaccgaaagggattcagccaccgcctaccgtatgacggtggaagtgttggggactgtgctggggactgccattcaaggccagatcgtcggtcaggccgacaccccctgctttcaggaccttaactcttcaaccgtggcctctcagagtgctaaccatacacatgggaccacatcccaccgcgaaacccagaaggcatacctgctagccgcaggggtgattgtctgcatctacataatttgtgctgtgatcctcatccttggagtcagggaacagagagagccatatgaagcccagcagagcgagcctatcgcatattttcggggcctgagactggtgatgagtcacggtccatatataaagctgataacagggttcctgttcacttccttagcgttcatgttggtggaaggaaatttcgttctcttttgcacatatactctaggcttcagaaacgagtttcagaacctcttattggccataatgctaagtgcaacccttacgatccctatttggcagtggtttctcacccggtttggcaagaaaacagctgtgtacgtaggtatatcttctgctgtccccttcctgattttggtggcacttatggaaagcaatttgatcattacatacgcagtggcggtggctgctggaattagcgtcgccgctgcattcttgctgccgtggtctatgcttcccgacgtgattgatgactttcacctgaagcaaccccacttccacggaaccgagccaatcttcttctcgttctatgtcttttttaccaaattcgcctctggcgtctcgctaggcatcagtacactaagcctggactttgcagggtaccagacgagaggctgcagccagccggagcgggtgaaatttactcttaacatgctggtaacaatggcccccatcgtcttgatcctgcttgggctgctgttattcaagatgtatcccatcgacgaagagcggcggcgacagaacaagaaagccctccaagccttgcgcgacgaagcgtcttccagcggatgctccgagaccgattctacggaattggcttctatactttag

SEQ ID NO: 193834 - DNA, 1125 bp, Artificial Sequence
  Description of Artificial Sequence: Synthetic coding sequence
atggtgacctgcttccacgtgccctacagcgccctgaccatgttcatctctacggagcaaaccgaacgagacagtgccaccgcctacagaatgacggtggaagtactcggcaccgtcctgggcaccgccatacagggccagatcgtgggacaggccgatactccttgctttcaggacctgaactcctcaaccgtggcgagccagtccgctaaccatactcacgggaccacctcccatcgggaaacgcagaaggcctacctactcgctgccggcgtgattgtgtgcatctatattatctgtgctgtcattttgattttaggagtgcgggagcagcgcgagccttacgaggcacagcaatctgagcccattgcctatttcaggggtttgcgcttggtgatgtcccatgggccctacatcaaactcattacagggtttttattcacttccctcgccttcatgttggtcgaaggcaactttgtcctgttttgcacatacacactgggcttcaggaatgagttccagaatttgcttctggccattatgttatccgcgacgttaacgattccaatctggcaatggtttttaactaggttcgggaaaaaaaccgcagtatacgtggggatttccagcgctgttcccttcctcatcttagtggcacttatggagtccaacttgatcatcacctacgccgtagccgtcgcagctggtataagcgtggcggctgccttcctactcccctggtcgatgctgcccgatgtcattgatgattttcaccttaaacagcctcacttccatggcactgagccgatattcttttccttttacgtgttcttcacgaagttcgcctccggggtgtccctgggtatttctacactgtcactggactttgcaggttaccagacaagaggatgcagtcagccagaaagggtgaaatttacgctcaatatgctcgttaccatggcccccattgttctgatcctgctcggactgctgctgtttaaaatgtatccaattgatgaggaacggaggcgccagaacaaaaaggctttacaggccctgagggacgaagccagcagctcgggctgcagtgagaccgattcaacggagctcgcatcgattctgtag

SEQ ID NO: 193835 - DNA, 801 bp, Artificial Sequence
  Description of Artificial Sequence: Synthetic coding sequence
atggccaagggcgagggcgccgagagcggcagcgccgccggcctgctgcctacttctatcctgcagagtaccgagcggcctgcccagaaggagcctaagaagaaaaagcagcagttgtccgtctgcaacaagctgtgttacgcattgggtggggccccctatcaggtaacggggtgcgccctgggttttttcctgcagatctacttactggacgtggcccaagtgggtcccttctctgccagcatcatcctctttgttggacgggcatgggacgcaattactgaccccctcgtgggattgtgtatctcaaaaagtccctggacctgtcttggccgtttaatgccttggatcattttcagcacgcccttggccgtgattgcctattttctcatatggtttgttcccgacttcccgcacggccaaacatactggtaccttctcttctattgccttttcgagaccatggtgacatgttttcatgtaccctatagcgccctgaccatgttcatctctaccgagcagacagagagggattcagccacagcctatcggatgaccgtagaggttcttggaaccgtgctcggcacagctatccagggccagatagtgggacaagcagacaccccgtgttttcaggatttgaactcatcaaccgttgctagtcaaagcgctaatcacacccacggcacaacctcccatagagagacacagaaggcctacctgctggccgccggagtgatcgtctgtatctacataatttgtgctgtaattttgattctgggggtccgtgagcagcggtag

SEQ ID NO: 193836 - DNA, 2376 bp, Artificial Sequence
  Description of Artificial Sequence: Synthetic coding sequence
atggccgacgacaaggtggccatcctgaccgacgacgaggaggagcagaagcgtaaatacgtccttgccgacccgtttaatgggattagcagggaacccgagcctccctcaaatgaaactccttcgagtacagagactagtgcaattcctgaggaagaaattgattggattgagaaacactgcgttaagataaataatgacctgctgatcagcaaggtcttttacttcttcttttatagtgcctacggctccctgtatcctcttctgcccgtgtactataaacaactggggatgagcccctctcaaagcggcctcttggtggggattagatatttcatcgagttctgctcagctccgttctggggtgtcgtcgcagaccgttttaagaagggcaagatcgtcctcctattctcattgctgtgctgggtcctgtttaatctgggcataggattcgttaaacctgccactcttcggtgcgtgcctaagatcaggcccacgacgcatcctacaaatgcttctcaccaactcactatcctgcccactaattctagctttaccagcttcctcacgatttcacccaaaatgcgcgaaaaaagaaacctactcgaaacccgactgaatgtgtcagatacagtcactctccccacggcacccaacatgaattctgaaccaaccctgcagcctcagacaggcgaaatcaccaacagaatgatggacttgacgctgaactcttccacggcaacaccagtgagtccaggatcggtcacgaaagaaaccactactgtcattgtcaccactacaaagtcactgccttccgaccaggttatgctcgtttatgaccagcaggaggtggaggcgatcttccttgtgatcctggttgtggtgattatcggtgaattcttttccgcatcctccgtcacaattgtggatactgtgaccctccagtatctgggtaaacatcgcgaccgatatggtctgcaacggatgtgggggagcctgggttggggactggctatgctctctgtcgggatcggaatagattatactcatattgaggtgttgattgacgggaaaggctgtaaaccacccgaatatcgaaactaccagatcgtgttcatcgtgttcggggtgctaatgactatggcgctgattgttgctacccagtttcgattccgctataatcattttaagaacgacgacagcaaagggaaggaagtcgagattcctcaagtggagaggaataacagcaccgaatcaagcgaagagacacctaccacgacgagccactcacaggcctttaatttctgggatctgatcaagctcctgtgttcagtgcagtatggttcggtgctcttcgtggcctggttcatggggttcggatatggctttgtcttcacctttctgtactggcacctggaggaccttaatggtaccactaccctgtttggagtgtgttctgtcctgtcccacgtaagcgagcttaccgcatacttcttcagtcacaagttgatcgaactcatcggacacattcgagtgctgtacattggactggcttgtaacacagcaaggtacatttatatatcttatcttgaaaacgcatggacggtgttgccaatggaggtgctgcagggcgtgacccatgccgctatttgggccgcttgtatatcatatctctccgccgccgtgcccccagaactgagaacctcggctcagggtattttgcagggattacaccttgggctggggcggggatgtggagctatgatcgggggagtcctcgtcaactactttggggccgctgcaacgtttcgcggaataggcatggcatgcctagtaatcctcttgctgttcgccctgatccaatggctggctgtccccgatgaggaagaagacaaaacgatgcttgccgaacgcatcccagtgcccagttcccccgtaccaatagcaacaattgatctggttcagcaacagactgaggatgtgatgcctaggatcgagccaaggctgccacctaaaaagaccaaacatcaggaggaacaggaagacgtaaacaagcccgcatggggagtttcttctagcccttgggttacattcgtttacgctctttaccagatcaaagaaatgatgcagcttactagagacaaccgagcatcagaaatccaaccactgcagggtaccaacgagaatcgggagaacagtccggctggccgggcacaaccggtaccctgtgagactcactcggatccctcgagaaatcagccttcccctgacgccgctgcaagccagacccagacaagtccagcccacccgagtgtggatccctgtactgaggaatctgaggaacagcaggcccagctggccgcagggggccattag

SEQ ID NO: 193837 - DNA, 2376 bp, Artificial Sequence
  Description of Artificial Sequence: Synthetic coding sequence
atggccgacgacaaggtggccatcctgaccgacgacgaggaggagcaaaaacggaaatacgtgcttgccgaccctttcaatggaatctctcgtgagcccgaaccaccatccaatgagaccccctcttctacggagacctcagcaatccctgaagaggaaattgattggatcgaaaagcattgcgtgaagatcaataacgacctgctgatatccaaggttttttactttttcttttacagtgcctacggctccctctatcctcttttgccggtgtactataaacagctcggtatgtcacccagccagtcgggcttactggtcgggattcgctacttcatcgagttttgctcggcccctttctggggagtcgtggcagacagatttaaaaaagggaaaattgtactcctattttcattgttatgctgggtcctattcaatttgggaattgggttcgtgaaaccagcgacattacgatgcgttcctaagattaggcctacgacccaccccacgaatgcaagtcaccaactgaccattttacccacaaactcaagctttactagttttctgactatttcgcccaagatgagggagaaaaggaatctgcttgagactcggctgaacgtatccgacacagtaactcttccaactgccccaaatatgaattccgagccaactttgcagccccaaaccggggaaatcacaaataggatgatggacctgacgttgaactcatcaacagcaactcccgtatcaccaggatcggtgacgaaagagactacaacagtgattgtgaccaccaccaaatcccttccatctgaccaagtgatgttggtctacgatcaacaggaggtggaggccatttttctcgtgattctagtggtggttataattggagagttctttagtgcaagttcagttacaatcgttgatacagtgacattgcagtatctgggtaagcaccgagatcgttacggccttcagaggatgtggggcagcctgggatggggtttggctatgctgtctgtaggcataggaattgattatactcatatcgaggttctcatcgatggcaagggctgcaaacccccagagtatcgaaactaccagatagttttcattgtcttcggcgtgctgatgaccatggccctgatcgtcgctacccaattccggtttagatataaccattttaagaacgatgactccaagggaaaggaggtggaaatacctcaagtggaacgcaacaactccactgagagctcagaggaaacacctacaacaacttcacacagccaagcctttaatttctgggacctgatcaagctgttatgtagcgtccaatacggtagcgtcctatttgtggcctggttcatgggctttggatatggcttcgtctttacgtttttgtactggcacctcgaggacctgaatgggaccacgacgctgtttggggtttgcagcgtgctgagccacgtttccgagctgaccgcatattttttttcacacaaactgattgaactaattggccacataagagttctctatatcgggctggcctgcaatactgcccgatacatttacatcagctatctggagaatgcctggactgtcctaccaatggaggtcctgcagggagtgacccatgcggcaatctgggcagcctgtatctcctacttatccgccgcagttccacccgaactgaggacatcagcccaaggtattcttcagggtctacatctggggttaggacggggatgcggcgcgatgattggcggagtgctcgtgaactactttggtgcggcagcgacgttcagggggattggaatggcatgcctagtgatacttctactgtttgcactgatccagtggctagccgtgcctgacgaagaggaggataagactatgcttgcggagcgtatccccgtgcctagctctcccgttcctatagctacaatcgatctggtgcaacagcagacggaagatgtgatgccacgcattgaacctaggctcccccctaagaaaaccaaacaccaggaggagcaggaggatgtgaacaaaccagcctggggggttagttcttctccatgggtcaccttcgtgtatgcactgtatcaaatcaaggagatgatgcagctaaccagagataatagggcctcagagattcagccattgcagggaactaacgagaatcgcgagaattcgccagctgggagagcacagcccgttccctgcgaaacccactcagatccatctaggaaccagccaagcccagatgccgccgcaagtcaaactcagacaagtccggctcaccccagcgtcgatccctgtactgaggagtcggaggaacagcaggcacagctggccgcaggcggccactag

SEQ ID NO: 193838 - DNA, 129 bp, Artificial Sequence
  Description of Artificial Sequence: Synthetic coding sequence
atggccgacgacaaggtggccatcctgaccgacgacgaggaggagcagaagcgcaaatacgtcctggccgatccctttaacggcataagccgggaacctgagcctccctcaaatgagacgccaagttag

SEQ ID NO: 193839 - DNA, 345 bp, Artificial Sequence
  Description of Artificial Sequence: Synthetic coding sequence
atggccgacgacaaggtggccatcctgaccgacgacgaggaggagcagaagagaaagtatgtgctggccgatccttttaatggaatttccagagagccggagcctccttccaacgagaccccatcaagcacggaaacatctgcgatacctgaggaagagatagactggatcgaaaaacactgtgtgaaaattaataacgacctcctgatttctaaagtattttacttttttttttattccgcctacggcagcctctaccctctgctgccagtgtattacaaacagctcggtatgagtccctctcaatccggtttgctggttggaatccgatatttcattgaatag

SEQ ID NO: 193840 - DNA, 471 bp, Artificial Sequence
  Description of Artificial Sequence: Synthetic coding sequence
atggccgacgacaaggtggccatcctgaccgacgacgaggaggagcaaaagcgtaagtatgttctggccgatccctttaacggcatcagcagggagccggaacccccctccaatgagaccccatcctccacagagacttccgccatcccagaagaggaaattgattggatcgaaaagcactgcgtgaaaattaataacgacctgctcatcagtaaagtcttttatttcttcttctattcagcctacggcagcctgtatccactcctgcccgtgtattataagcagctaggaatgagcccctcccagagcgggctcctggtgggcatccggtacttcatagagttctgcagtgctcccttctggggcgtcgtagctgaccggttcaagaaggggaagattgtcttactcttctcactgctttgctgggtcctcttcaatctggggattggatttgtcaaacccgcgacttag

SEQ ID NO: 193841 - DNA, 762 bp, Artificial Sequence
  Description of Artificial Sequence: Synthetic coding sequence
atggaggtgctgcagggcgtgacccacgccgccatctgggccgcctgcatttcctacctgtcagctgctgtgcccccagagctgcggacgagcgcgcagggcatcctacaggggctgcatctgggacttggaagaggttgtggcgccatgatcggaggcgttctcgtaaattatttcggagctgccgccaccttcagggggattggcatggcctgccttgttatcctgctgctgttcgccttaattcagtggctggcagtgcctgatgaggaggaagacaagaccatgctcgctgagagaattcccgtgccctcctcgccagtgcctatcgccaccatcgatttagtgcagcagcaaaccgaggacgtgatgcctcgcatcgaacctcgcctcccccctaaaaaaaccaaacaccaggaggaacaggaggatgtcaataagcctgcttggggtgtctctagctcaccctgggtgaccttcgtgtacgcgctgtatcagattaaggagatgatgcagctgacgagggacaatcgggctagcgagatccagcccttgcaaggaacgaatgagaacagagagaactcgcccgccggccgcgcccaaccagtcccttgtgaaactcatagcgatccaagccgcaatcagcccagccccgacgccgcggcatctcagacccagacctccccagctcatccttccgtggatccatgcaccgaggaaagcgaggaacagcaggcccaacttgctgcgggtggacactag

SEQ ID NO: 193842 - DNA, 696 bp, Artificial Sequence
  Description of Artificial Sequence: Synthetic coding sequence
atggaggtgctgcagggcgtgacccacgccgccatctgggccgcctgcatttcctatcttagcgctgctgtgccccctgagctacgcacatcagctcaggggattcttcagggtctccatttaggtctgggtcgcggttgcggcgctatgatcggcggagtgctggtgaactacttcggcgcggccgcaacctttagaggcataggcatggcctgtctggtgatactgctactcttcgcccttatacagtggctcgccgttccggatgaggaggaggacaaaacgatgctcgctgaaaggattccggtgccttcttcaccagtccccatcgcgactattgatctcgtgcagcagcaaacggaggatgtgaataagccggcctggggagtgtcatcctctccttgggtcacattcgtgtacgccctttaccagattaaggagatgatgcagctaactagagacaacagggcctctgagatacagccactgcagggtacaaacgaaaacagagagaactcccccgccggaagagctcagccggtcccctgcgaaacccactctgacccgtcccgaaaccagccctcgcccgacgccgcagcgtcccagacgcaaactagtcccgcccacccctcggttgatccctgcacagaggaatccgaggaacagcaggcacagctcgccgccggaggacactag

SEQ ID NO: 193843 - DNA, 1557 bp, Artificial Sequence
  Description of Artificial Sequence: Synthetic coding sequence
atggccggcctgcggaacgagagcgagcaggagcccctgctgggcgacacacctggcagtcgcgaatgggacatcctcgaaacagaggaacactacaaatcaaggtggcggagcatccgaattctgtacttgaccatgtttctctccagtgttggtttcagcgtagttatgatgagcatctggccctatctacagaagatcgacccaactgctgacacatcatttctgggatgggtcattgcctcctacagtctgggtcagatggtcgcctcccccatctttggcctgtggtctaattacaggccaagaaaggagcctctgatcgtgtccatattgatttctgtagcggcgaattgcttgtacgcctaccttcatattcctgcctctcataacaaatattacatgctggtcgcccgcggtctactcggcattggtgctgggaacgtagcagtggtgagaagctatactgcgggtgcgacctccctgcaggaacgcacttcctcaatggccaatatcagtatgtgtcaggcattagggttcatcctggggccagttttccagacctgtttcaccttcctaggcgaaaagggcgtgacttgggatgtaatcaaactacagataaatatgtacacaacccccgttctcctcagcgcctttcttggaattctgaatatcatcctcatcttggctattctgcgggaacatagagtcgacgacagcgggcgccaatgtaaaagcatcaatttcgaggaggccagtacagacgaagcccaggtgcctcagggcaacatcgaccaggtagctgttgttgctatcaatgttctgtttttcgtaactttgtttatatttgcattgtttgagacaatcattacccccctgactatggacatgtacgcatggacacaggaacaggccgttttgtacaatgggattattctcgccgcactgggtgtcgaggcagtcgttatcttccttggcgttaagctcctgtcgaagaaaatcggggagagggccatcctgttgggggggctcatagtcgtctgggtaggcttctttatactgttgccttgggggaaccaattcccaaagattcagtgggaggatctgcataataattctatcccgaatacgacgttcggcgaaattatcatagggctgtggaaatctccaatggaggacgacaacgagcgcccaacgggttgcagcattgagcaggcctggtgcttatacacccccgtgatccacttggcacagtttctaacaagcgcagtgctgatcggtctggggtaccctgtttgcaacctaatgtcctacacactgtactctaaaattctcggcccaaagccccaaggcgtgtacatgggatggctgacagccagtggcagcggggcccggattctagggccaatgtttatttcacaggtatatgcgcactggggccctcgatgggccttctcacttgtctgtggcattattgttttaaccatcacattactgggggtggtgtataaaagacttattgccctgtctgttaggtacgggagaatacaggagtag

SEQ ID NO: 193844 - DNA, 462 bp, Artificial Sequence
  Description of Artificial Sequence: Synthetic coding sequence
atgttcctgagcagcgtgggcttcagcgtggtgatgatgagcatctggccctacctgcagaagatcgatccaaccgcagacacttcattcctcggttgggtgatcgctagctactctttaggacaaatggtggcatccccaatttttgggctctggtcaaactatcgcccccgaaaggaaccgctaattgtctccattcttattagcgttgccgctaactgtttgtacgcctacctgcatattcccgcctctcacaataagtactacatgctagtggcccgaggcctccttggcattggcgcggtgtttcaaacttgctttacgtttttaggggagaagggcgttacgtgggatgtgatcaagctgcaaatcaacatgtacaccaccccagtgctactgtcggcgttcttaggcattctcaatatcatccttatactcgctatcctctccaagtaccgttag

SEQ ID NO: 193845 - DNA, 555 bp, Artificial Sequence
  Description of Artificial Sequence: Synthetic coding sequence
atgttcctgagcagcgtgggcttcagcgtggtgatgatgagcatctggccgtatctgcagaagatagaccccacggctgatacatcattcctcggctgggttatcgctagctacagtctcgggcaaatggtggccagccccatttttggcctctggtcaaattaccgtccaagaaaggagccgctgatcgtctccatcctcatttccgtggccgccaactgcctctatgcttacttgcatatacccgcttctcataataaatactacatgctcgtggcacgcggcttgctggggattggagcaggcaatgtagccgtggtgagatcctatacagcgggcgcaacctccctgcaggagaggacttctagcatggcaaatatatcgatgtgtcaagcactgggattcattctcggacctgagaatatcgtgtggatgacgcaggaggactcggtcaaggtgctcatccttaaaaagcaggtgcagatgaaactgcgcttccctaaggaaattctgacaaggctgttattgtggcccagcatgttctgttttctctag

SEQ ID NO: 193846 - DNA, 750 bp, Artificial Sequence
  Description of Artificial Sequence: Synthetic coding sequence
atgggcgagctgatggccttcctgctgcccctgatcatcgtgctgatggtaaaacacagcgattctcgaactcactcgctgagatacttccggttaggggtgtcagatccaattcacggagtacctgaatttatctcagtaggatatgttgactcacaccctattactacgtatgattccgtaactcgccagaaggagccgagagctccctggatggcagagaatctggcacctgaccactgggaacgttacacacagcttctgcggggctggcagcagatgttcaaggtcgagctgaaacgactccagcgccactacaaccactctggcagtcacacctaccagcggatgattggctgcgaactgctggaggacggatcaactaccggatttttacagtatgcctacgacgggcaggattttcttatcttcaataaagacacattgtcttggctggcggtagataacgtggcccatacgattaagcaggcttgggaagcaaaccagcacgaactgctctaccaaaaaaattggcttgaggaggagtgcattgcatggctcaagaggtttcttgagtatggaaaggatacactccagcggacagaatctgaaaccatccctttggtgatgaaggctgtgagcggatcaatcgtcttagtgattgtgctcgctggcgtgggggtgctagtgtggcgcaggaggccccgggagcaaaacggcgccatatatctgcctacccctgaccgctag

SEQ ID NO: 193847 - DNA, 783 bp, Artificial Sequence
  Description of Artificial Sequence: Synthetic coding sequence
atgcggcccgaggaccggatgttccacatccgggccgtgatcctgcgggcactgagcctggcgttccttttgtccctgcggggcgcgggcgccatcaaggccgaccacgtctcaacctacgctgccttcgttcagacccacaggcctaccggagaattcatgttcgaatttgacgaagatgagatgttctacgtggacctcgacaagaaagaaacagtgtggcaccttgaggagttcggccaggccttttcattcgaggcccagggagggttggcgaacatcgccattctcaataacaatctcaacaccttgatccaaaggtcaaaccacactcaggctactaatgacccccccgaagtaaccgttttccccaaagagcctgtcgaactggggcagccaaatactctgatctgtcatatcgacaaatttttcccacccgtactcaacgtgacttggctgtgtaacggggagctggtcaccgagggggtggcagaaagtctcttcctgccccgaactgattattctttccacaagttccattacctgacctttgttccatcagccgaagatttctatgactgtcgcgtggagcactggggtcttgaccagcctctcctgaaacattgggaagcccaagaacctattcagatgccagagacaacagagacggtgttgtgcgccctcggactggttttgggcctcgttgggatcattgtcgggaccgttttgattatcaagtcccttaggtcaggacacgaccctagggcacaaggtactctctag

SEQ ID NO: 193848 - DNA, 783 bp, Artificial Sequence
  Description of Artificial Sequence: Synthetic coding sequence
atgcggcccgaggaccggatgttccacatccgggccgtgatcctgagggccctgtccctagcattcttactgagtctgaggggagcgggggccatcaaagcagatcacgtgtccacatatgccgctttcgtacagacgcatagacccactggtgaatttatgttcgaatttgatgaggacgaaatgttttatgttgatctggacaagaaagaaacggtgtggcacctggaagaatttggccaggcattctcattcgaagcccagggtggactggctaacattgccatactgaataacaatctgaacaccttgattcagcgcagtaatcacactcaagccacaaacgacccgccagaagtgacagtgtttcctaaggagcccgtggaattgggacagccaaatacacttatctgccatatcgataagtttttcccacccgtgcttaacgtcacttggctgtgcaatggagagctggttactgagggcgtagccgagtcactgtttctcccccgtacagattacagttttcacaagtttcactatctgacctttgttccatccgccgaggacttctatgactgtcgggtagaacactgggggcttgatcagcccttactgaaacactgggaagcccaggaacctatacagatgcccgagaccacggaaactgtcctttgtgccctgggcctcgtgctgggtctcgtcgggatcattgtgggtacagtgctcataatcaaatccctgcggtcagggcacgaccctagagcccagggcacgctttag

SEQ ID NO: 193849 - DNA, 72 bp, Artificial Sequence
  Description of Artificial Sequence: Synthetic coding sequence
atgcggcccgaggaccggatgttccacatccgggccgtgatcctgcgggccttaagccttgccttcctctag

SEQ ID NO: 193850 - DNA, 387 bp, Artificial Sequence
  Description of Artificial Sequence: Synthetic coding sequence
tgaaacaccctgatctgccacatcgacaagttcttcccccccgtgttaaacgttacttggctttgcaacggggaattagtgactgagggagtggccgaaagccttttccttccgcgaacagattactcattccataagttccactatctcacgtttgtccctagcgcggaggacttttacgattgccgcgtggaacactggggcttggaccaaccacttctaaagcattgggaagctcaagaacccatccagatgccagagacaaccgagacagttttgtgtgctcttggtctggttttgggcctcgttgggatcatcgtggggaccgtcctgattatcaaaagcttgaggagcggtcacgaccctagagcgcagggaactctgtag

SEQ ID NO: 193851 - DNA, 630 bp, Artificial Sequence
  Description of Artificial Sequence: Synthetic coding sequence
atgcggcccgaggaccggatgttccacatccgggccgtgatcctgagagcattatcgctggccttcctgttaagtctgaggggagctggagccatcaaggctgatcatgtttcgacatatgctgcttttgtgcagactcatcgacccaccggcgaatttatgttcgagttcgatgaggacgaaatgttctatgtggatctggataaaaaggaaacagtctggcatctggaagagtttgggcaagcattctcctttgaggcccagggcggcctcgccaacattgcaatcttgaataataatctcaacacactgatccagcgaagtaatcatacacaggctaccaatgatccaccggaggtgactgtgttccccaaggagcctgtggagcttggccagccaaatacccttatctgtcatatagacaaattctttcccccagtcctgaatgtcacctggttatgtaacggcgaactcgttaccgaaggtgtggcagagtctctctttttgcccaggacagactactctttccacaagttccattatcttacctttgtcccctccgccgaagacttttatgattgtcgcgtggagcattggggcctggaccagccacttctcaagcattggtag

SEQ ID NO: 193852 - DNA, 783 bp, Artificial Sequence
  Description of Artificial Sequence: Synthetic coding sequence
atgcggcccgaggaccggatgttccacatccgggccgtgatcctgcgcgcactgtccttggcattcttgctgtctctgcggggtgcaggcgcaatcaaagcagatcacgtatccacatacgctgcttttgtgcagacacatcgtcccacaggcgagtttatgtttgaatttgacgaggatgagatgttttacgtagacttagataagaaggagaccgtctggcatctggaagagtttggccaggcctttagctttgaagcccagggaggcctagcaaacattgccattctcaataataacctgaatacactgattcaaaggtccaatcacactcaggcgacgaacgaccctcctgaggtgactgtctttccaaaggaacctgtggaactggggcagcccaataccctcatttgccatatcgataagttctttccccctgtgctaaatgtcacctggttgtgcaacggggaattagttaccgaaggagtggccgagtctctgttcctgccccgcacagactatagcttccataaattccattatttgacctttgtgccatccgcggaggatttctatgactgccgcgtggagcactggggacttgatcagccgctgctgaagcattgggaagcccaggaaccgattcaaatgcccgagacgacagaaaccgtgctatgtgccctcggactggtcttgggactggttgggatcatagtgggcacagtgcttattatcaagtcgctgaggtccggacacgatccaagggcacagggcacgctgtag

SEQ ID NO: 193853 - DNA, 72 bp, Artificial Sequence
  Description of Artificial Sequence: Synthetic coding sequence
atgcggcccgaggaccggatgttccacatccgggccgtgatcctgagagcgctcagtctggcgtttctgtag

SEQ ID NO: 193854 - DNA, 783 bp, Artificial Sequence
  Description of Artificial Sequence: Synthetic coding sequence
atgcggcccgaggaccggatgttccacatccgggccgtgatcctgcgggcactcagcctcgcctttttactcagcctaaggggtgccggagctattaaagctgatcacgtctctacctatgccgccttcgtgcagacccacaggcctactggcgaattcatgttcgagttcgacgaagatgagatgttctacgtggatctcgacaaaaaggaaaccgtgtggcacctcgaggaattcggccaggctttcagctttgaggctcagggtgggcttgcaaacattgccatcctgaacaataatctgaatactctgattcagcggtccaaccatactcaggccactaatgaccctcctgaagttacagtcttccccaaggaaccagtggaattggggcagcctaataccctgatttgccacatagacaaattcttcccgccggtgctcaatgtaacttggctgtgtaatggagaactcgtgacggagggagtcgctgaatctctgttcttgccccgcactgactattcgttccacaagtttcactaccttactttcgtgccctctgctgaggatttttacgattgtagggtggagcactggggcctcgaccagcccctgcttaagcactgggaggcgcaggagcctattcagatgcccgaaacaaccgaaacagtgctgtgtgcgttgggcctcgtcctcggtctggtcgggattatcgtgggtaccgtgctgataattaaaagcttgcggtcagggcatgatccccgcgcccagggcaccctgtag

SEQ ID NO: 193855 - DNA, 387 bp, Artificial Sequence
  Description of Artificial Sequence: Synthetic coding sequence
tgaaacaccctgatctgccacatcgacaagttcttcccccccgtgctcaacgtgacttggttgtgcaatggcgaactggtgacagagggtgtcgccgagtctctcttcctaccgaggactgactattcgttccataagttccattacttgacgttcgtcccgtcggccgaagacttctatgattgccgcgtggagcactggggactggaccagccactgctcaaacactgggaggcccaggaaccgattcaaatgccggagacgactgaaacagtactgtgtgctctcggccttgtgctgggtctggttgggatcattgttggcactgtgttgatcattaagagccttagatcgggccatgacccccgcgcccagggcaccctgtag

SEQ ID NO: 193856 - DNA, 783 bp, Artificial Sequence
  Description of Artificial Sequence: Synthetic coding sequence
atgcggcccgaggaccggatgttccacatccgggccgtgatcctgagggcgctttctttggcttttctactttcacttcggggcgcgggggctatcaaggctgaccatgtatcaacttacgccgccttcgtccaaactcacaggcccacaggtgagttcatgttcgagtttgacgaggacgaaatgttttatgtggacctggataagaaggagactgtgtggcaccttgaggaattcggccaagctttttcgtttgaggctcagggaggacttgccaacatagccattctcaataacaatctaaatacactgattcaacgaagtaaccacacacaagccaccaacgatcctcctgaagtgactgtctttccgaaggaacccgtcgagttaggacagcccaatactctgatatgtcacattgataaattctttccccctgtcctcaatgtcacatggctctgcaatggtgaactcgtgaccgaaggtgtcgccgaaagtctcttcctgcctagaaccgattactcctttcacaagttccactacctaaccttcgtgccatcggccgaagacttttacgactgcagagtggaacattggggcctcgaccagcccctacttaaacactgggaggcccaggagcccatacagatgcccgaaacaactgagactgttctttgtgcgctcggactcgtgctcggcctggttggaatcattgtaggcacagtgctcatcattaagtcgctgaggtccgggcatgacccacgggcacagggtaccctctag

SEQ ID NO: 193857 - DNA, 72 bp, Artificial Sequence
  Description of Artificial Sequence: Synthetic coding sequence
atgcggcccgaggaccggatgttccacatccgggccgtgatcctgcgagctctttctttggctttcctctag

SEQ ID NO: 193858 - DNA, 630 bp, Artificial Sequence
  Description of Artificial Sequence: Synthetic coding sequence
atgcggcccgaggaccggatgttccacatccgggccgtgatcctgagggctcttagtctggcattcctgctcagcctgcgaggagcgggagccattaaggcggaccacgtgagcacatacgctgctttcgtgcagacccatagacccacaggggaattcatgtttgagtttgatgaagacgagatgttttatgtagatctggataagaaagaaaccgtctggcatctggaagaattcgggcaggctttcagtttcgaggcccaagggggcctggccaatattgcaattctcaacaataatctcaacaccttgatacagcggagtaatcacacgcaggcaaccaacgatccaccggaggtgacagtctttccaaaggaaccagttgagctggggcagcctaacaccctgatatgccacatcgataaattcttcccgccagtattgaatgttacgtggttgtgcaatggggaactcgttaccgaaggtgttgccgaatcccttttcttaccgaggacagactacagctttcataaattccactacctcacgttcgtcccttccgccgaggacttttatgactgccgtgtcgaacactggggtctggatcagcccttactcaaacactggtag

SEQ ID NO: 193859 - DNA, 72 bp, Artificial Sequence
  Description of Artificial Sequence: Synthetic coding sequence
atgcggcccgaggaccggatgttccacatccgggccgtgatcctgagagcactgtcactggccttcctgtag

SEQ ID NO: 193860 - DNA, 387 bp, Artificial Sequence
  Description of Artificial Sequence: Synthetic coding sequence
tgaaacaccctgatctgccacatcgacaagttcttcccccccgtgctcaatgtcacttggctgtgcaacggtgagcttgtaactgagggcgtggctgagtcattgtttcttccgagaactgactacagctttcataaatttcattatttaactttcgtcccgagtgcagaagatttttatgattgccgagtcgagcactggggactggatcagccccttctgaaacattgggaagctcaagagccgatccaaatgcccgaaactacagaaactgtgctgtgtgccctaggcctggtgcttggcctggtgggtatcatcgtgggcaccgtgcttattatcaagagtctgcgcagcggacacgatcctcgagcccagggtacgctctag

SEQ ID NO: 193861 - DNA, 783 bp, Artificial Sequence
  Description of Artificial Sequence: Synthetic coding sequence
atgcggcccgaggaccggatgttccacatccgggccgtgatcctgcgtgccctgtccctcgctttcctgctgagcttgaggggagctggcgctatcaaagctgatcatgtcagcacctacgctgcatttgttcagactcacagaccaactggcgaattcatgttcgagttcgatgaggatgagatgttttatgtggaccttgacaagaaggaaacggtgtggcacttggaggagttcggtcaagctttttccttcgaggcacaaggcggacttgccaacattgctatccttaacaacaacttgaacacactcatccagcgttccaatcacacacaagctacaaatgacccccctgaggtgaccgtctttccaaaggagccagttgagctcggtcagccgaatacgcttatctgtcacatcgataagttcttcccacctgtacttaatgtgacctggctgtgtaatggcgagctggttacggagggggtggcagaatccctgttcctgccgaggacagactactcctttcacaagttccactatctgacgttcgtcccgagtgccgaagacttctatgactgccgggtggaacattggggtctagatcaacctctcttgaagcactgggaggcccaggagcctattcagatgcctgagactacagaaacagtgctctgcgcacttggcttggtgctcgggttagttgggatcatagttggcacagtactgatcattaaatctctccggagtggacacgaccctagggctcagggaactctctag

SEQ ID NO: 193862 - DNA, 387 bp, Artificial Sequence
  Description of Artificial Sequence: Synthetic coding sequence
tgaaacaccctgatctgccacatcgacaagttcttcccccccgtgctgaatgtgacatggctgtgcaacggtgagcttgtgaccgaaggcgtagccgaatctctgtttttgcctagaaccgactactcctttcacaaattccattacttgacttttgtcccaagcgctgaagacttctacgattgtagggtggagcattggggactcgaccagcctcttctcaaacactgggaggcacaggaaccaattcagatgccagagactacagaaaccgtgctgtgtgcattgggactcgttctcggattggtcggcatcatcgtaggaacagtcctgatcatcaaaagtctccgctcaggccacgatcccagagcccaggggacgctgtag

SEQ ID NO: 193863 - DNA, 72 bp, Artificial Sequence
  Description of Artificial Sequence: Synthetic coding sequence
atgcggcccgaggaccggatgttccacatccgggccgtgatcctgcgagctctctccctcgcatttctgtag

SEQ ID NO: 193864 - DNA, 630 bp, Artificial Sequence
  Description of Artificial Sequence: Synthetic coding sequence
atgcggcccgaggaccggatgttccacatccgggccgtgatcctgcgggcgctgtctctggctttcctcctctctctgcggggcgcaggcgccatcaaagccgatcacgtgtccacctacgctgcttttgtgcagacgcacagacccacaggcgagttcatgttcgagttcgacgaggacgagatgttttacgtcgatctcgataaaaaagaaaccgtgtggcatttggaggagttcggccaagcattcagctttgaagctcaggggggtctcgcaaacatcgccattctgaataataaccttaacaccttgattcagcggtctaaccatacacaggccactaacgaccctcctgaggttaccgtctttcccaaggagcccgtggagctgggacagcctaacaccctgatatgccacattgataagttctttcctcccgtcctcaatgtgacctggctgtgtaacggggagcttgtgacggaaggggtggctgaatcactttttttgccaagaacagactatagtttccacaaatttcattacctcacttttgtgccctccgcggaggatttctatgactgcagagtggaacactggggacttgatcaacctctgctaaagcattggtag

SEQ ID NO: 193865 - DNA, 639 bp, Artificial Sequence
  Description of Artificial Sequence: Synthetic coding sequence
atgcggcccgaggaccggatgttccacatccgggccgtgatcctgcgtgcactctccctggccttccttctgtcattaagaggcgcaggcgctatcaaagctgatcacgttagcacctacgctgccttcgtgcagacacatcgacccactggagaatttatgtttgaatttgatgaggacgagatgttttacgtggacctggataaaaaggagaccgtgtggcatctggaagagtttggccaagccttctccttcgaggtaaccgtctttccaaaagagccagtggagttagggcagcctaacacactgatttgccacatagataagtttttcccacccgtgcttaatgtcacatggctgtgtaacggcgaattggttactgagggagtggccgaaagtctattcctgccacgcacagattatagctttcataagtttcactatttgaccttcgtgccttccgctgaggatttctatgactgccgcgttgaacattggggattggaccaacccctgttgaaacactgggaggctcaggagccaattcagatgcctgagacaactgaaactgtcctgtgtgccctcggcctggtgttgggattggtcggcataatagtcggaaccgtactgattatatag

SEQ ID NO: 193866 - DNA, 639 bp, Artificial Sequence
  Description of Artificial Sequence: Synthetic coding sequence
atgcggcccgaggaccggatgttccacatccgggccgtgatcctgagggcgctgtcattggccttccttctgtctctgcggggcgctggggccatcaaggcggaccacgtaagcacctacgccgccttcgtacagacacaccggcccaccggagagtttatgtttgagttcgacgaagacgagatgttttacgttgatttggataagaaagaaactgtatggcatctggaagaatttggccaggcattcagtttcgaggtgacagtgtttcccaaggagcctgtagagttgggccagccaaacaccttgatttgtcacattgataagttcttcccacctgtcttgaacgttacgtggctgtgcaacggcgagctggtcactgagggcgtagccgagagcttgtttcttccacgaaccgactactcttttcacaagttccactaccttacatttgttccttccgcagaagacttctacgactgcagggtcgagcattggggattggaccagcccctgctgaaacactgggaggctcaggaacccatccaaatgccagaaaccacggaaaccgtcttgtgtgcgcttgggctcgtgctgggtctcgtaggcattatcgtcggaaccgtactgattatttag

SEQ ID NO: 193867 - DNA, 387 bp, Artificial Sequence
  Description of Artificial Sequence: Synthetic coding sequence
tgaaacaccctgatctgccacatcgacaagttcttcccccccgtgcttaatgtcacttggctgtgtaatggcgagctggtgacggaaggggtcgccgagtctctcttcctaccccggacggattatagctttcacaagtttcactatttgacattcgtgccttcagcagaggacttctacgactgtagagtggaacactggggactggatcagccgctgttgaagcactgggaggcgcaagagcctatccagatgcctgagacaaccgaaactgtcctttgtgccttaggattggtcctcggcctggtgggaatcatcgtcggaaccgtgctgatcatcaagagcctgcgctcaggccatgatcctagagcacaaggaactctatag

SEQ ID NO: 193868 - DNA, 639 bp, Artificial Sequence
  Description of Artificial Sequence: Synthetic coding sequence
atgcggcccgaggaccggatgttccacatccgggccgtgatcctgcgcgcactcagtctggccttccttttgagccttcgcggcgcaggcgccatcaaggctgatcatgtcagcacttacgccgcctttgtccagactcaccggcccactggggagtttatgtttgaattcgatgaggatgagatgttctacgtagacctcgacaaaaaagaaactgtatggcacttagaagagttcgggcaggcattttctttcgaggtcacggtgttccccaaggagcctgtagagctaggtcagccaaataccctgatctgtcacattgataagtttttcccacccgtactgaacgttacttggttgtgcaacggtgagctagtgacggaaggagtggccgaatcactcttcttgccccgtaccgattattcatttcataaatttcactacctcaccttcgtgccctcggccgaagacttttatgactgtcgggtggagcactggggtctcgaccaaccccttctgaagcactgggaggcacaggaaccaatccagatgccagagacgactgagactgttttatgcgcgctcggcctggtgctgggcttagtgggtataatcgtcggaaccgtactaataatctag

SEQ ID NO: 193869 - DNA, 630 bp, Artificial Sequence
  Description of Artificial Sequence: Synthetic coding sequence
atgcggcccgaggaccggatgttccacatccgggccgtgatcctgagagctctcagcctggcctttttacttagcctacgaggagcaggagctatcaaagcagaccacgtgagcacctacgccgcattcgtccaaacccatcgcccaactggggagttcatgttcgagttcgatgaagacgaaatgttctacgtggatctggacaaaaaggaaacagtgtggcatctggaggaatttggccaggccttttccttcgaggcacaagggggcctcgctaatattgcaattctcaataataatctaaatacactgattcaacgcagtaaccatacccaggctactaatgaccctcctgaggtgactgtttttccgaaggagcctgtggaactcggccaacccaataccctgatttgtcacatagacaaattctttccacccgtgttaaatgtgacatggctctgtaatggcgagctcgtgactgagggggtagccgaaagcttgttcctgccgcggacagattattctttccacaagtttcactacctaacattcgttccaagcgcggaagacttttatgactgcagggttgaacactgggggctcgaccagccccttctaaagcactggtag

SEQ ID NO: 193870 - DNA, 72 bp, Artificial Sequence
  Description of Artificial Sequence: Synthetic coding sequence
atgcggcccgaggaccggatgttccacatccgggccgtgatcctgcgcgcactgtctctggctttcctctag

SEQ ID NO: 193871 - DNA, 639 bp, Artificial Sequence
  Description of Artificial Sequence: Synthetic coding sequence
atgcggcccgaggaccggatgttccacatccgggccgtgatcctgcgggcactttcactggccttccttctttctctgcgcggcgccggggctattaaggccgaccacgtctccacttacgctgcgtttgttcaaacgcatcggcctaccggcgaatttatgttcgagttcgacgaggacgagatgttctatgtggaccttgataagaaggagaccgtctggcatttggaggaattcggtcaggcattctcattcgaagtaacggtgtttccgaaggagcctgtcgaattaggacaacccaataccctcatatgtcacattgacaagttttttcctcccgtactcaatgtgacttggctttgtaatggggaactggtcaccgaaggggtggccgaaagcctttttctgccgcgaactgattattcattccataaatttcactatctcacatttgtaccttcagccgaagacttttatgactgcagagtggagcattggggccttgaccagccactactcaagcattgggaagcacaggaaccaatccagatgcctgaaaccaccgaaacagtgctctgtgcattaggcctggtattgggcttggttggaattatcgttgggacagtcctgatcatctag

SEQ ID NO: 193872 - DNA, 630 bp, Artificial Sequence
  Description of Artificial Sequence: Synthetic coding sequence
atgcggcccgaggaccggatgttccacatccgggccgtgatcctgagagcactgagcctggcctttctactcagcctgcgaggcgctggtgcaataaaggcagatcacgtatcgacgtatgctgccttcgtccaaacacatcgcccaacgggggagttcatgtttgagttcgatgaagatgagatgttctatgtggacctcgataagaaggagaccgtgtggcacctggaggaattcggacaggctttctccttcgaggcccaaggcgggttggcaaacattgcaatactaaataacaacctgaacactcttatacagcggagcaatcatacgcaggccacaaacgatcctcctgaggtgactgtctttcccaaggagcctgtcgagctggggcaacctaacactcttatatgccatatcgacaagttctttccacccgtgctcaatgtaacctggttgtgtaatggggaactcgtgaccgaaggcgtggccgaatcccttttcttgcctagaaccgattattctttccacaaatttcactatctgacattcgtgccaagcgccgaggacttttacgactgcagagtcgaacattggggtctggatcagccactgcttaagcattggtag

SEQ ID NO: 193873 - DNA, 387 bp, Artificial Sequence
  Description of Artificial Sequence: Synthetic coding sequence
tgaaacaccctgatctgccacatcgacaagttcttcccccccgtgttaaacgtgacctggctctgcaacggagagctcgtaactgaaggtgttgcagaaagcctctttctgccaagaacggattattctttccataaattccactatctgaccttcgtgcccagcgccgaggacttttatgactgcagagtggagcattggggactggatcagccattgctcaaacactgggaggcacaggagcccattcagatgccagaaacaacggagactgtgctgtgtgccctcggcttggtcttgggcctggttggcataattgttggtacagtgttgattatcaagagcttaagatcaggccatgatccacgcgcccaggggactctgtag

SEQ ID NO: 193874 - DNA, 783 bp, Artificial Sequence
  Description of Artificial Sequence: Synthetic coding sequence
atgcggcccgaggaccggatgttccacatccgggccgtgatcctgcgggctctctctctcgctttcctgctgtctctcaggggcgctggggcgataaaagcagatcatgtttcgacatatgctgccttcgtccagacgcaccggcctacaggagagtttatgtttgaattcgacgaagatgagatgttttacgtggacttagacaaaaaagagaccgtgtggcatctggaggaattcggtcaagctttctccttcgaagcacaaggcggactggccaatatcgctattttgaataataaccttaacaccctgatacagcgatctaaccacacacaggccacgaatgacccccccgaggtcactgtgtttccaaaggaaccagtggagttaggtcagcccaataccctcatttgtcatatagacaagttctttccccccgtgctcaatgtgacctggttgtgtaatggtgaactcgttacagagggtgtggccgagtcgctcttcctgccgcggaccgactattcctttcataagttccattacttgaccttcgtaccctctgccgaagatttttatgactgcagagtagaacattggggtctcgaccagccgctactcaagcactgggaggcccaggagcccatccaaatgccggaaacgacagagactgttctctgtgcactgggcctagtactggggctggtaggaattattgttggaaccgttctcattatcaagtccctccgcagcggacacgaccccagagcgcagggaacgctgtag

SEQ ID NO: 193875 - DNA, 639 bp, Artificial Sequence
  Description of Artificial Sequence: Synthetic coding sequence
atgcggcccgaggaccggatgttccacatccgggccgtgatcctgagagcactgtcacttgcatttctgttgtcccttcgaggggctggggccattaaagcggaccacgtgtccacctatgccgctttcgttcaaacacatcgcccaaccggagaatttatgttcgaatttgatgaagacgagatgttctacgttgacctggataaaaaggagaccgtgtggcacttagaagaattcgggcaggcattctccttcgaagtcaccgtatttccgaaggaaccagttgaactcgggcagcctaacaccctgatatgccatatagacaagttcttcccaccagtgctcaatgtgacctggttgtgtaatggcgagctcgtgacggagggcgtcgccgaaagtcttttcttgcctaggacagactacagtttccataagtttcattatctgacatttgtcccatctgccgaagatttttacgattgtcgagttgaacattggggcctcgaccagccacttctgaaacactgggaagcccaggaaccaattcagatgcctgaaaccactgaaactgtgctgtgcgctctgggactggtattggggttggtgggcataattgtcggtaccgtgttgatcatttag

SEQ ID NO: 193876 - DNA, 72 bp, Artificial Sequence
  Description of Artificial Sequence: Synthetic coding sequence
atgcggcccgaggaccggatgttccacatccgggccgtgatcctgagggccctgagccttgcgttcctgtag

SEQ ID NO: 193877 - DNA, 639 bp, Artificial Sequence
  Description of Artificial Sequence: Synthetic coding sequence
atgcggcccgaggaccggatgttccacatccgggccgtgatcctgagggccctgtccctcgcttttctgctctctctgcgcggggctggcgcaattaaggcagatcacgtcagcacgtatgcagcatttgtgcagacacacagacccaccggagaattcatgtttgagtttgacgaagacgagatgttctatgtcgacctggataagaaagaaactgtgtggcaccttgaggagttcggacaggctttttctttcgaagtgacagtgtttccaaaagaacctgtggagctcggacagcctaataccctgatatgtcacatagacaagttcttccccccggtgctgaatgtgacgtggttatgcaatggtgagctggtgactgaaggggtggctgaatcactgtttctgcctcgtaccgattactcctttcacaaatttcattatctcaccttcgtgcctagcgcagaggatttttacgactgtagagtggagcactgggggttagatcagcccctgctgaaacactgggaagctcaagaacctatccagatgcctgaaacaactgaaacagtcctctgtgccctgggactcgtgctcggcctagtgggaattatcgtaggtactgttctcatcatctag

SEQ ID NO: 193878 - DNA, 72 bp, Artificial Sequence
  Description of Artificial Sequence: Synthetic coding sequence
atgcggcccgaggaccggatgttccacatccgggccgtgatcctgcgggcccttagtctggccttcctgtag

SEQ ID NO: 193879 - DNA, 639 bp, Artificial Sequence
  Description of Artificial Sequence: Synthetic coding sequence
atgcggcccgaggaccggatgttccacatccgggccgtgatcctgcgagccctcagcctggccttcttgctgtccctgcgcggcgccggcgccataaaggccgatcacgtgagcacctacgctgcttttgtccagacgcacaggccgaccggtgagtttatgtttgaattcgatgaagatgagatgttttacgtggacttggacaagaaagaaacagtttggcacctcgaagagtttggccaggccttctcatttgaagtgactgtctttcccaaggaaccagtagaactgggtcaaccaaacaccctgatatgtcatattgacaaattcttcccgcccgtgctgaacgtcacctggttgtgtaacggtgaactggtgaccgaaggcgtcgctgagagccttttcttgcctcgtaccgattacagctttcataaattccactatctgacgttcgtcccctcggctgaagatttctatgattgccgtgtcgaacattggggcttggaccaacctttgctgaagcactgggaggctcaggaaccgattcagatgccagagaccacagagacagttctgtgcgcactgggactggtgctcggcctggtagggattattgtagggacggtgctgatcatctag

SEQ ID NO: 193880 - DNA, 387 bp, Artificial Sequence
  Description of Artificial Sequence: Synthetic coding sequence
tgaaacaccctgatctgccacatcgacaagttcttcccccccgtgctcaacgtaacttggctgtgcaatggggaactcgttacagaaggggtcgccgagagtctgttcctgccgaggacagactattcctttcacaagttccactatctaacttttgttccttccgctgaggacttttatgattgccgcgtcgaacattgggggttggatcagcccctgctgaaacactgggaagctcaagagccaatacagatgcctgagacaacagaaacggtcttgtgtgcccttggactggtgctgggtttggtggggatcattgtcggaaccgtgttgatcattaaatcacttcgttcggggcacgacccccgggcccagggtaccctctag

SEQ ID NO: 193881 - DNA, 630 bp, Artificial Sequence
  Description of Artificial Sequence: Synthetic coding sequence
atgcggcccgaggaccggatgttccacatccgggccgtgatcctgcgtgcactcagcctggcatttctgctgtcactccgcggggctggggccatcaaagccgaccacgtctccacctacgctgccttcgtgcagactcatcggccaaccggtgaatttatgttcgaattcgatgaggacgagatgttctacgtggatttagataagaaagagaccgtttggcacctagaagagtttggccaggccttttctttcgaagcacagggcggactggcgaacatcgcgattctaaataataatttgaataccttgattcagcggtcaaaccatacacaggctactaacgacccacctgaggtgacggtgtttcccaaggagccagtggaattggggcagcccaacaccctgatttgtcacatcgacaagttttttccccccgtgttaaacgtcacctggctctgtaacggcgaattagtgaccgagggagtggcggagagcttgttcctgcctcgtaccgactattccttccataagtttcactacctaacatttgtacctagtgccgaggacttctacgattgcagagtggagcactgggggcttgatcaaccacttctgaaacactggtag

SEQ ID NO: 193882 - DNA, 783 bp, Artificial Sequence
  Description of Artificial Sequence: Synthetic coding sequence
atgcggcccgaggaccggatgttccacatccgggccgtgatcctgcgagctctgagcctggccttcctgctatccctaagaggtgccggggccatcaaggcggaccatgtctcaacatatgctgccttcgtccagacccatagaccaaccggagagtttatgttcgagttcgatgaagatgaaatgttctacgtggaccttgataaaaaggagacagtatggcatctcgaggagttcggacaagccttttcttttgaggctcaaggcggcctggcaaacatcgccatcttgaacaataatctgaacacactgatccaacgctccaatcacacccaggctaccaacgacccacctgaggtcacagtgtttcctaaagagcctgtggagctggggcaacctaataccctcatctgtcatatcgacaagttttttccacctgttcttaacgtcacttggctgtgcaacggagaactggttacagaaggcgttgcagaaagtttgttccttccgcggaccgactacagttttcacaagttccattatttgactttcgtgccatccgctgaggatttttacgactgcagggtggagcactggggtttggaccagcctttactgaagcattgggaagctcaggagccaattcagatgccggagaccacggagaccgtcctttgcgcactcggcttagtgctgggcctcgtcggaatcatcgttggtacagtccttattatcaagagtctaagatcgggtcacgaccccagggcccaggggaccctgtag

SEQ ID NO: 193883 - DNA, 387 bp, Artificial Sequence
  Description of Artificial Sequence: Synthetic coding sequence
tgaaacaccctgatctgccacatcgacaagttcttcccccccgtgctgaatgtaacttggttgtgtaacggcgaactggtgacagagggtgtggccgagtctctgttcttacctcgcaccgactattcctttcataagttccactacttaaccttcgttccatcagctgaagatttctacgattgcagggttgaacactggggactggatcagccactgctgaagcactgggaagcacaggaaccaattcagatgcccgaaactacagagacagtgctttgcgcacttggcctagtgctggggctagtcggtataatagtgggcacagtgctgatcattaaatctctccggagtggccacgatccccgcgcccagggcaccttgtag

SEQ ID NO: 193884 - DNA, 630 bp, Artificial Sequence
  Description of Artificial Sequence: Synthetic coding sequence
atgcggcccgaggaccggatgttccacatccgggccgtgatcctgcgcgccctctctctggcttttctgctgtctctgcgtggcgccggtgccatcaaagccgatcacgtgtctacctatgctgcgtttgtgcagactcatagacccactggcgaattcatgttcgaatttgatgaagacgaaatgttttacgttgatctggacaaaaaggagacagtatggcacctcgaggagttcgggcaagccttctccttcgaggctcagggtggcctggccaatatagcaatcctgaacaacaacctcaacactttaatacaaaggtctaaccatacgcaagccaccaatgacccaccagaggttactgtgtttcccaaagaaccagtggagttagggcagccaaatactctaatttgccacattgataagttcttccctcccgtactgaatgtgacttggctctgcaatggggagctcgtaacagaaggcgtggccgagagtttatttctgccacggacagactacagttttcacaaatttcactatctgacttttgtgccttctgcagaggacttctacgactgccgggttgagcattggggactggatcagccactcctcaagcactggtag

SEQ ID NO: 193885 - DNA, 630 bp, Artificial Sequence
  Description of Artificial Sequence: Synthetic coding sequence
atgcggcccgaggaccggatgttccacatccgggccgtgatcctgcgtgccttgtcgctggcttttctcctgtcactgaggggggcgggagcgataaaggctgaccatgtatccacttacgccgcttttgtccagacccaccgacccacaggagagtttatgtttgagttcgacgaagatgaaatgttctatgtcgatctcgacaagaaagagaccgtatggcacctggaggagttcgggcaggccttttcatttgaagcccaaggggggctggctaatattgccatactgaacaacaacctgaacaccttaattcagcgttctaaccacactcaggctaccaatgacccacctgaggtaacagtgttccctaaagagcccgttgaattgggacagccaaacaccctgatctgtcacattgacaaattcttcccccctgtgctgaatgtaacatggctgtgcaacggggagctggttacagagggggttgccgagagcttgttcctgccacgcaccgattactcttttcacaagtttcattatttgacttttgtgccttccgcggaagatttttacgactgccgggtagagcactggggcctggatcagccgctccttaaacattggtag

SEQ ID NO: 193886 - DNA, 783 bp, Artificial Sequence
  Description of Artificial Sequence: Synthetic coding sequence
atgcggcccgaggaccggatgttccacatccgggccgtgatcctgcgcgccctgtccctggcatttctgttgtcgctgcgtggggctggcgccatcaaggccgatcatgtgtcgacatatgcagcattcgtccagacgcaccggccaacaggtgaattcatgtttgagttcgacgaggatgaaatgttctatgtggatttagataaaaaagagacagtgtggcatctagaggaatttggccaagccttctcattcgaggcccagggcggcctggcaaacattgcaatacttaacaataatctgaatacgctcatacagaggagcaaccacacccaggccacgaatgatccccccgaagtgaccgtgttcccaaaggagcctgttgagctggggcagcctaacactcttatttgtcatatcgacaagttcttcccgcctgtcctgaatgtgacctggctgtgcaacggagagctcgtgaccgaaggcgtcgccgagtctctgttcctaccaagaaccgactactccttccacaagttccactatctgacctttgttccttccgctgaagatttctacgactgccgggtcgagcattggggactagaccagcctcttctgaagcattgggaagctcaagagcccattcaaatgcccgaaactacagagacagtgctgtgtgccctcggcctggttctgggccttgtgggaatcatcgtgggaacagtgctcattataaagtcacttaggagcgggcacgatccccgggcacagggaaccttgtag

SEQ ID NO: 193887 - DNA, 639 bp, Artificial Sequence
  Description of Artificial Sequence: Synthetic coding sequence
atgcggcccgaggaccggatgttccacatccgggccgtgatcctgcgcgccctgtccctagcatttcttctttccctgcgcggggctggggcgattaaggctgaccacgtgtcgacgtacgcagcattcgtgcagactcaccgacccactggcgagttcatgttcgaattcgacgaggatgagatgttttatgtcgatctggacaaaaaggagaccgtatggcatctggaagaattcggacaggctttcagtttcgaggtcacggtctttcccaaagagcctgtggaactgggacaacctaatacgcttatctgtcatatcgacaaattttttccacccgttctgaatgtgacatggttatgtaatggagaactggtaaccgagggagtagccgaatctttattccttccaaggacagattacagctttcacaagttccactatctaaccttcgtgccaagcgccgaagacttctacgattgccgggtggagcactggggcctggatcagccactgcttaagcactgggaagcccaagaaccaatccagatgccggaaacgacagaaacagtactgtgcgccctcggcctggtgctgggactggtgggcatcattgtcggcacagtcctgattatatag

SEQ ID NO: 193888 - DNA, 783 bp, Artificial Sequence
  Description of Artificial Sequence: Synthetic coding sequence
atgcggcccgaggaccggatgttccacatccgggccgtgatcctgcgtgccttatccctggcatttcttctcagccttagaggtgcaggcgccatcaaggccgaccacgtgtctacctatgcggccttcgtgcagactcatcggcccacaggtgagttcatgtttgagtttgacgaagatgaaatgttttacgtggacctggataagaaagaaacagtttggcatttggaagagtttggacaggcattcagcttcgaggcgcaggggggcctcgccaatattgctattttgaacaataacctcaacaccctgatacagaggtctaatcatacccaggccaccaatgatccccctgaggtgacagtgttcccgaaggaacctgtggagctcgggcagccaaatacactaatttgtcacatcgacaagttttttccccccgtgctgaatgtgacgtggctgtgtaacggcgaactggtaaccgaaggcgtggccgaatctctctttctgcccaggactgattactcttttcataaattccactacttgacctttgtaccatctgccgaagacttctatgattgccgggttgagcactggggattagatcagcctctcttaaagcattgggaggcccaagagcccattcagatgcctgaaacaacagaaacagtcctgtgtgccctaggactggtgctgggattagtaggcattattgtgggaactgtactcataattaaaagtctgcgaagcgggcacgaccctagagcccagggtactttatag

SEQ ID NO: 193889 - DNA, 783 bp, Artificial Sequence
  Description of Artificial Sequence: Synthetic coding sequence
atgcggcccgaggaccggatgttccacatccgggccgtgatcctgagggcgctctctctagcctttcttctctcgttgcgcggagcaggggccattaaagccgatcacgtgtctacctacgcggccttcgtgcaaactcacagaccgactggcgagtttatgtttgagttcgacgaagacgagatgttttatgttgatcttgataaaaaagaaacagtttggcatcttgaagaatttggccaagcattcagctttgaagctcagggagggctagccaatattgccattctgaacaataatctgaatacccttatccagaggtctaaccatacacaagcgactaatgatccaccggaggtgaccgtgtttcctaaagaacccgttgaacttgggcagcccaatacattgatctgccacatcgataaatttttcccgccagtgttgaacgtgacatggctgtgtaacggcgagctggtgaccgagggcgtggcagagagtttgtttttgcccagaactgattattccttccacaaattccattatctgacttttgtgcccagtgctgaagacttttacgattgtcgggtggagcattgggggctggaccagcctttgttaaagcattgggaggcacaggagccaatccaaatgcctgagactaccgagaccgtcctctgtgcactggggttggtcctgggactcgtgggaatcatagtgggcactgtcttaattatcaagtctcttcgctccggacacgatccccgggcacagggcacactgtag

SEQ ID NO: 193890 - DNA, 783 bp, Artificial Sequence
  Description of Artificial Sequence: Synthetic coding sequence
atgcggcccgaggaccggatgttccacatccgggccgtgatcctgagggctctctccctggcattcctgctgtcccttcggggagccggcgcgatcaaggccgaccatgttagcacatatgcagcctttgtgcaaactcatcggcctactggcgagttcatgtttgaattcgacgaggacgaaatgttttacgtcgatttggacaagaaagagactgtctggcatcttgaggagtttgggcaggccttcagtttcgaagcccagggcggcctcgccaatattgccatactcaacaacaatctaaacaccctgatccaaaggagcaaccacacacaggccactaatgacccacctgaagttactgtgtttccaaaggagcctgtggaactgggccagccaaatacactgatatgccacatcgataaattctttccgcccgtcttgaatgtcacttggctttgtaacggggaactggtgactgagggcgttgccgagtcactcttcctacctcggaccgactacagctttcataagttccattacctgacgtttgtgccgtctgccgaggacttttacgattgtagggtggagcattggggactcgaccagccactcctgaagcattgggaggcacaggagccaatacaaatgcccgagacgaccgaaaccgtattgtgcgctcttggcctggtgctgggacttgtcggtattattgtaggaacagtgctgattattaagtccctacgctcaggccacgaccccagggcccaaggaactctgtag

SEQ ID NO: 193891 - DNA, 783 bp, Artificial Sequence
  Description of Artificial Sequence: Synthetic coding sequence
atgcggcccgaggaccggatgttccacatccgggccgtgatcctgagagccttatccttggccttcttgctgagcctacgcggtgccggggctatcaaagctgatcatgtatctacgtatgctgcctttgttcagacacatcggcctaccggtgaattcatgtttgaatttgatgaagatgaaatgttctacgtggatttagataaaaaggaaactgtgtggcaccttgaagaatttggacaggcctttagcttcgaggctcaggggggcttagcaaacatcgcaatcctgaataacaacctaaacactttaatacagaggagcaaccacacccaagctactaatgacccccctgaagtgacagtcttcccaaaggagccagtggagctcgggcaacctaatacattgatctgccacatcgataagttttttcccccagtgctgaatgtgacatggctttgcaacggtgagcttgtgaccgagggagtggccgagtccctttttctaccccgcactgattactcattccataagtttcattatttaaccttcgtaccttctgccgaagacttttacgactgtcgggtggaacactgggggctggatcaaccgttgttgaagcactgggaggcgcaggagccaatacaaatgcctgagacgaccgaaacagtcctttgcgcccttggcctcgtacttggtctcgtgggtattattgtggggacggtactgatcattaagtctctccggagcgggcacgatccacgggctcagggcactctctag

SEQ ID NO: 193892 - DNA, 783 bp, Artificial Sequence
  Description of Artificial Sequence: Synthetic coding sequence
atgcggcccgaggaccggatgttccacatccgggccgtgatcctgcgcgcactatcattggctttcttgctgtctctgagaggggccggagccatcaaagcggatcacgtgtccacttatgcggcctttgtgcagacacatcggccaaccggggaattcatgttcgaattcgatgaggacgagatgttctacgtagatctggacaagaaagaaacagtgtggcatctggaggaatttggtcaggcattcagctttgaggcacaaggtgggctcgcgaatattgccatacttaacaataatttgaacactcttatacagaggtctaaccacactcaggcgacaaatgaccccccagaggtcacggtttttccaaaagaaccagtggagctgggtcagccgaatacattgatatgccacatcgataaatttttccctcctgtgctgaatgtgacatggctctgcaacggcgagttggtgactgagggagtggctgaaagcctctttctcccacgaaccgactacagcttccacaaattccactatctgacgttcgttccttccgcagaggacttctacgattgtagagtcgagcactggggactggatcaaccactgctgaaacattgggaagctcaggagcctatccagatgccagaaaccaccgaaactgtgctgtgcgccctggggttagtgctgggtctcgttggtatcatcgtaggcaccgtgctcattataaaatccctgcgtagcggccacgaccctcgggcccaggggaccctctag

SEQ ID NO: 193893 - DNA, 783 bp, Artificial Sequence
  Description of Artificial Sequence: Synthetic coding sequence
atgcggcccgaggaccggatgttccacatccgggccgtgatcctgcgggcactatcacttgcgtttctactgagcctccggggagctggggccattaaagccgaccatgtcagcacatacgcggctttcgtgcagacccacaggccaactggggagttcatgttcgaatttgatgaggacgaaatgttctatgtggatttggacaaaaaggaaactgtatggcatctcgaggagtttggacaggcattctcattcgaggcccaggggggtctggccaacatcgccattcttaataataatttaaacactctaattcagaggagtaaccacacacaggctactaatgacccccccgaggtaacagttttccctaaagaacctgtggaacttggacagcccaacaccttgatctgccacatagataagttttttcctccagtcctgaacgtcacatggctgtgtaacggggagctggtcaccgagggagtggctgagtcattgttcctgccgaggaccgattactctttccacaagttccattacttgacatttgttcctagcgcggaagacttttatgattgtagagtcgagcactggggactggatcagccccttctcaaacactgggaggcccaggaacccatccagatgcctgagaccactgagaccgttctgtgtgccctagggttggtactgggccttgtggggataatcgtcggcaccgttctgatcatcaaatccttgcgcagcggtcatgaccctagagctcagggaactctgtag

SEQ ID NO: 193894 - DNA, 777 bp, Artificial Sequence
  Description of Artificial Sequence: Synthetic coding sequence
atgatggtgctgcaggtgagcgccgccccccggaccgtggccctgaccgcattattaatggtgctgctgacttcagtcgtgcagggcagagcaaccccggagaactatgtgtaccagctgaggcaagagtgctatgccttcaatggcacccagagattccttgaacggtatatctataatcgcgaggaatttgtccgcttcgattctgatgtaggggaattcagggcagtcaccgaactcgggcgacccgacgaagattattggaactcccagaaggatctgctggaggagaagcgcgccgtaccagatcgggtatgccgtcacaattatgaactagatgaggccgtgactctgcagcgtagggtccagccaaaagtgaacgtctctccatccaagaaaggaccgctgcaacatcacaatctgttggtctgtcacgtgactgatttttatcccgggtccattcaggtgagatggttcctgaatggccaggaagaaaccgcgggcgtggtcagcaccaacctgatccgaaacggggattggactttccagatcctggttatgctggagatgacaccccagcagggcgacgtctatatctgtcaagtggagcatacttctctcgacagccctgtgacagtagagtggaaagcccaaagtgactctgcaagatccaagacgctgactggcgccggcggctttgtgctgggcctgatcatatgcggggtggggatattcatgcacaggcggagcaagaaagtgcagcgggggtccgcctag

SEQ ID NO: 193895 - DNA, 687 bp, Artificial Sequence
  Description of Artificial Sequence: Synthetic coding sequence
atgatggtgctgcaggtgagcgccgccccccggaccgtggccctgacggcactgctgatggttctcctgacttcagtagtccaagggagggccactcccgaaaattatctgttccagggcaggcaggaatgctacgcatttaatggcacccaacgctttctggagagatacatctataacagagaggagttggtgaggttcgactctgacgtaggagagttcagagcagtgaccgagctcggtcgaccggaggccgaatattggaacagccagaaggacatcctcgaggaagaacgtgccgtccctgatcgaatgtgtaggcacaattacgaattgggcggcccaatgactctgcagcggcgaggtagtatccaggttaggtggttcctgaatggtcaagaagagaccgctggagtagtatccaccaatctgatcaggaacggggattggacgtttcagattctcgtgatgctggaaatgacaccgcagcaaggtgacgtctatacatgtcaggtagagcacacatcactggattcccccgtaaccgtggagtggaaagctcagagtgattccgctagatcaaagacgcttactggagcgggtggattcgtcctgggtctcatcatctgtggcgtcggcatctttatgcatcgccggagtaaaaaggtccagagagggagtgcctag

SEQ ID NO: 193896 - DNA, 777 bp, Artificial Sequence
  Description of Artificial Sequence: Synthetic coding sequence
atgatggtgctgcaggtgagcgccgccccccggaccgtggccctgaccgctctcttgatggtcctgttgacatccgtggtccaaggcagagcaacaccagagaattacctttttcaagggcgccaggagtgttacgcctttaatggcacccaaagatttttagagagatacatctacaatcgtgaggagctggttagatttgactcagacgtgggtgagtttagggcggtgacggagcttggaaggcctgaagccgaatattggaacagtcagaaggatatcctggaagaggagcgggcagttcctgacagaatgtgccgccacaactacgagctgggtggccctatgacactacagcggagggtgcaaccccgggtgaacgtctctcctagcaagaagggtccactccagcatcacaacctgctggtgtgtcacgtcactgacttttaccctggctctatccaggtcaggtggtttttgaacggacaggaagagacagcgggcgtggtgtcaactaatttaatcaggaatggcgactggacgtttcagatcctcgtcatgttggagatgactcctcaacagggagatgtctacacttgccaggttgagcatacctctctggattccccggtgacggtggagtggaaggctcagagtgactccgctcggagtaaaacgttaaccggagcaggtggttttgttcttggtctcatcatttgtggtgtgggtatttttatgcaccgtcggtccaagaaagtgcagcgaggctcggcctag

SEQ ID NO: 193897 - DNA, 690 bp, Artificial Sequence
  Description of Artificial Sequence: Synthetic coding sequence
aagcaggcctggcggggcagcgccacccggctgggcccccagaactccggtaggcaggagtgttacgcatttaatgggacccagaggttcctcgaacgctatatctataaccgggaagaactcgttcgctttgatagcgatgtcggggagtttcgggcggttaccgagctggggagaccggaggccgagtattggaatagccaaaaggatatccttgaggaggagcgagcagtgcctgacagaatgtgccgacacaactacgaattaggtggaccaatgaccctgcaacggcgcgttcagccccgggtcaacgttagcccttccaagaaaggaccacttcagcatcacaacttactggtttgtcatgtgaccgatttttacccgggttccatccaggtccgttggttccttaacgggcaggaagaaaccgccggggtggtaagcaccaatttaatccgaaatggcgattggacctttcaaatcctagtgatgctcgaaatgacacctcaacagggggatgtttatacttgtcaggtggagcatacctccctggatagcccagtcacagtggaatggaaggcgcagagcgattccgcaagaagtaaaaccctgacaggtgcaggtgggtttgtgctggggttaatcatctgtggggttggcatctttatgcaccgccgctccaaaaagtag

SEQ ID NO: 193898 - DNA, 687 bp, Artificial Sequence
  Description of Artificial Sequence: Synthetic coding sequence
atgatggtgctgcaggtgagcgccgccccccggaccgtggccctgacggcattgctaatggtgctccttacgtcggttgtgcagggccgggccacaccagaaaattacctgtttcagggcaggcaggaatgttacgcgtttaacgggacccaaagattcttagaaagatacatctataaccgggaggaatttgcaagatttgactcggatgtgggagaatttagggcggtcacagaactcggacggcccgcggctgagtactggaactcccaaaaggatatccttgaggaaaagcgggcagtgcccgatcgaatgtgtagacacaactacgagctgggcggccccatgacactgcagagaaggggaagtattcaggttcgctggttcctgaacgggcaagaggagacagccggcgttgtctccacaaatctgatcagaaacggagattggaccttccagattcttgtaatgctggagatgaccccgcaacagggcgacgtatacacctgccaggtggaacataccagcttggattcacctgtaactgtggagtggaaggctcagagtgacagcgctcggtcaaagactttgactggcgccggcggcttcgtgctgggcctcatcatctgcggggtgggcattttcatgcacagacgtagcaagaaagtacagcgcggaagtgcatag

SEQ ID NO: 193899 - DNA, 687 bp, Artificial Sequence
  Description of Artificial Sequence: Synthetic coding sequence
atgatggtgctgcaggtgagcgccgccccccggaccgtggccctgaccgccctcctcatggtgctactgactagtgtcgttcaggggagggccactcctgagaactatttattccagggccgtcaagagtgctatgccttcaacggtacacaaagatttcttgagagatatatctacaatcgagaagagttcgtgaggtttgactcagacgttggggagtttcgagcagtcactgagttagggcggccagacgaagagtattggaactctcagaaggatatattggaggagaaacgcgccgtccccgatcgaatgtgtcgccacaactacgagctgggtggtcctatgaccttacaacgcagagggtctattcaggttcggtggtttcttaatggccaagaagaaacggccggcgtggtctctaccaacttaattcggaacggagattggaccttccagatcctggtgatgcttgaaatgacgccccagcagggggacgtttacacttgtcaggttgagcatacgagtatggattctcccgtgacggtcgaatggaaagcacagagcgatagcgctcgcagcaaaacacttacgggggcaggaggtttcgttcttgggctaataatatgcggagttgggattttcatgcacaggcgctccaaaaaggttcaacgcggctccgcgtag

SEQ ID NO: 193900 - DNA, 708 bp, Artificial Sequence
  Description of Artificial Sequence: Synthetic coding sequence
tgaaactacctgttccagggccggcaggagtgctacgccttcaacggtacacagcgattcctggaacggtacatctacaaccgagaagagtttgttcgatttgattcggacgtcggagagtttagagcagtgaccgagctaggccggccagacgaggaatattggaactctcagaaagatatcctcgaggagaaaagggctgtgcccgatagaatgtgccgccacaactatgaactgggaggacctatgaccctgcagcggcgggtgcaacctagggtgaatgtctctccatctaaaaaaggcccgctgcaacatcacaacctcctcgtctgtcatgtgactgacttttaccctggctctatacaggtgcgatggttcttgaacgggcaagaggagaccgccggcgtcgtgtcaaccaacctaatccgtaatggcgattggacattccagatcctggtgatgctggagatgacaccccagcagggggatgtgtacacttgccaggttgagcatacctccatggacagcccagtgacggtcgaatggaaggcacagagtgattccgcacgttccaagactctgaccggagctgggggctttgtcctgggactaataatctgtggggttggaatttttatgcatcgccggagcaagaagggagaaaaagcctgccgcttcaacgaggacctgcataagcaggggtcgtag

SEQ ID NO: 193901 - DNA, 777 bp, Artificial Sequence
  Description of Artificial Sequence: Synthetic coding sequence
atgatggtgctgcaggtgagcgccgccccccggaccgtggccctgacagctctgctgatggttcttctcaccagtgtcgtacagggacgagccacccccgagaactacctctttcaagggagacaagagtgctacgccttcaatggcacacaacggttcctggagcgatacatctataatcgggaggagttcgtgagattcgactccgatgtaggtgaatttcgggcagttactgaactcgggagacccgacgaggagtattggaactcccagaaggacatcctggaggagaagcgcgcggtcccagacaggatgtgtagacataactacgaacttggcggccctatgactctccagagacgcgtgcagccccgagttaacgtgtccccttcaaagaagggccctctgcagcaccacaatctactcgtgtgtcacgtgactgacttttatcccggctctatccaggtgaggtggtttctaaatggacaagaggagaccgcaggagttgtgtctacaaatctgataaggaacggggactggacgtttcaaatcctggttatgctcgagatgacacctcagcagggcgatgtttacacttgtcaggtggaacatactagcatggactcccccgttactgtagaatggaaggcccagtctgattccgcacgctctaaaacccttaccggggcagggggttttgtgctgggcctcatcatatgcggggtcggcatttttatgcacagacgatctaagaaggtgcagagaggaagtgcctag

SEQ ID NO: 193902 - DNA, 687 bp, Artificial Sequence
  Description of Artificial Sequence: Synthetic coding sequence
atgatggtgctgcaggtgagcgccgccccccggaccgtggccctgactgccctcctgatggttctcctgacctctgtggtgcaaggaagagcaacccctgagaactacttatttcaaggacgacaagagtgctatgcctttaacggcacacagcggttcttggagcgctatatttataaccgggaggaattcgctcgcttcgattccgacgttggagagttccgagctgtgaccgagctgggccggccagccgctgaatactggaatagccagaaagacatcttggaagagaaaagagctgtgccggaccgaatgtgtaggcacaactatgaactgggggggcctatgactttacagcgcagaggctccatccaggtgcgctggtttttgaacggccaagaagagaccgcaggggtggtgtccacaaacctcatccggaatggggactggacctttcagatactagtcatgctggagatgaccccacagcagggcgatgtatacacatgccaggtcgagcatacctccctcgacagccccgtgaccgttgaatggaaggcccagagtgatagtgccaggagcaaaaccctcaccggggcagggggttttgtgctcggacttatcatatgcggagtgggtatctttatgcaccgccggagtaaaaaagttcaaaggggctccgcctag

SEQ ID NO: 193903 - DNA, 690 bp, Artificial Sequence
  Description of Artificial Sequence: Synthetic coding sequence
aagcaggcctggcggggcagcgccacccggctgggcccccagaactctggcaggcaggagtgttacgcatttaacggaactcagcgctttctggagagatatatatacaatcgtgaagaatttgtccggtttgatagcgacgtaggcgaattccgagcagtaaccgagttgggaagacccgatgaagagtattggaacagccaaaaagatatattggaagaagagagggccgtgccggatcgtatgtgcagacacaactacgagctcggaggccctatgactttgcaacgtcgggtgcagccccgggtgaacgttagcccctctaaaaaggggcctctgcaacaccataacctgctggtgtgtcatgttacggatttttacccaggcagcattcaggtgcggtggttcctcaacggtcaagaagaaaccgccggagtggtgagtacaaatctgattagaaatggggactggacattccagatactcgttatgctcgagatgactccccaacagggtgacgtgtacacctgtcaggtggagcacacttcactggattctcctgtgactgtagagtggaaggcccaatctgattccgccaggtctaaaaccctgacaggggccggaggctttgtgctagggcttatcatttgcggcgtgggaatatttatgcatcgacggagtaaaaaatag

SEQ ID NO: 193904 - DNA, 777 bp, Artificial Sequence
  Description of Artificial Sequence: Synthetic coding sequence
atgatggtgctgcaggtgagcgccgccccccggaccgtggccctgaccgccctgctgatggtactgctcacgtccgttgtgcagggtcgggccacaccagaaaactatttgttccagggaagacaggagtgttatgcttttaacggaactcagagattcctggagagatacatctacaatcgcgaggaatttgtacgcttcgactctgatgtcggagagttccgagctgtgaccgagttagggcgacccgacgaggaatactggaattcccagaaggatatcttggaggaagagagagccgtccctgacagaatgtgccgccacaattatgagctgggcggtcccatgaccctccagcggagagttcagccccgtgtaaacgtgtcaccgagtaaaaagggcccgctgcagcatcataacctcttggtgtgccacgtcaccgacttctatccgggatctatccaggtgcgatggtttctcaatggtcaggaggagacagctggcgtagtgagcacaaacctcatccgtaacggtgactggactttccagatccttgttatgcttgagatgactccccagcagggtgacgtatacacttgccaagtggaacacacgtccctcgacagtccagtgaccgttgagtggaaggcgcagtcagattccgcccgatctaaaaccctgacaggggccggcggcttcgttctcggccttattatctgtggcgtcgggatatttatgcacaggcggagtaaaaaagtgcagaggggcagcgcctag

SEQ ID NO: 193905 - DNA, 708 bp, Artificial Sequence
  Description of Artificial Sequence: Synthetic coding sequence
tgaaactacctgttccagggccggcaggagtgctacgccttcaacggcacccagagattcttggaacggtacatctataacagggaggagtttgcgaggttcgatagcgatgttggcgaatttcgggccgtgaccgagctcggaagacccgcagctgaatattggaatagtcaaaaagacattttggaagaaaaacgagctgtcccagatagaatgtgtcggcataattacgagttggggggccccatgacattgcagcggcgagttcaaccccgcgtaaatgtaagcccaagcaaaaagggccctctgcagcaccataatcttttggtgtgtcacgtcaccgacttctatcccggctcaattcaggttcggtggtttcttaacggtcaggaagagacggcaggggtcgtgagtacaaacctgataagaaatggagattggacatttcagatactggttatgttggagatgactccccaacagggcgacgtgtatacgtgtcaggtggaacacacctcgcttgactcacctgtgacagtcgagtggaaagcacagagcgattccgccagaagtaagaccttgactggagccgggggctttgtcttagggctgataatctgtggagttggcatttttatgcacaggcggagtaaaaagggagaaaaagcctgcaggttcaatgaagacctgcataaacaggggtcttag

SEQ ID NO: 193906 - DNA, 690 bp, Artificial Sequence
  Description of Artificial Sequence: Synthetic coding sequence
aagcaggcctggcggggcagcgccacccggctgggcccccagaactcagggcgccaggagtgttatgcctttaatggaactcagcggttccttgagaggtacatttataacagggaggagtttgcccgcttcgattcagacgttggcgagtttcgcgccgtgactgaactaggacggcccgctgcggagtactggaattcccaaaaagacatcctcgaggaaaagcgggccgtgccggatcgaatgtgccggcacaactatgagctgggtggacctatgaccctccagaggagagtacagcctcgtgtgaacgtgagcccgagcaagaagggcccactgcagcatcacaaccttctggtgtgtcacgttacagatttctaccctgggtcaatacaggtgcggtggttcctgaacggccaggaagagactgcaggggtcgtttcaactaacttaataagaaacggcgattggaccttccagatactggtaatgctcgaaatgacgccccagcagggggacgtgtatacctgtcaggttgagcataccagcttggattctcctgtcacagtggaatggaaggctcaatctgattcagctagatccaagactctgacaggcgcaggcggctttgtcctggggttgatcatttgcggcgtgggtatttttatgcaccggagaagtaaaaagtag

SEQ ID NO: 193907 - DNA, 777 bp, Artificial Sequence
  Description of Artificial Sequence: Synthetic coding sequence
atgatggtgctgcaggtgagcgccgccccccggaccgtggccctgaccgcgttgcttatggtcctcctgacttccgtcgttcagggtagggctaccccagagaactatttgttccaaggaaggcaggaatgttatgcttttaatggtacacaaagatttcttgagaggtacatctacaatagggaggagtttgcccggtttgacagcgatgtgggggaatttagggccgtcacagaactgggccgtcccgcagctgaatactggaactcacagaaagacatcctcgaggagaagcgggcagtgcccgataggatgtgccggcataactatgagctgggtggtccaatgaccctacagagacgtgtgcaacccagggttaatgtgagccctagcaaaaaagggcccctgcagcaccataacctgctcgtgtgtcacgtgaccgatttctaccctggtagcattcaagtcagatggttcctcaacggccaggaagagacagcaggggtggttagcaccaaccttatacggaatggcgattggacgtttcagatccttgttatgcttgaaatgacacctcagcagggcgacgtgtacacctgccaggtcgaacacactagcctggactccccagtcactgtcgaatggaaggctcagtcggactcagctcggtctaaaacactgaccggcgcaggaggcttcgtcttgggactgattatctgtggcgtgggaattttcatgcatagaagaagtaagaaagtccaacgggggagcgcatag

SEQ ID NO: 193908 - DNA, 249 bp, Artificial Sequence
  Description of Artificial Sequence: Synthetic coding sequence
atgaccccccagcagggcgacgtgtacacctgccaggtggagcacacgtctctggattcaccagtgacggtggaatggaaggcgcagagcgacagtgcacgctccaagacgttgactggagccggaggacgggccggcgcccaccatctgtggtcgggccatctgcacgcgcaggaagaacaggagagttcaacccggatctgcatcaacagggtccccgaattgaccgagaagaccattgtgccctag

SEQ ID NO: 193909 - DNA, 777 bp, Artificial Sequence
  Description of Artificial Sequence: Synthetic coding sequence
atgatggtgctgcaggtgagcgccgccccccggaccgtggccctgacggctctccttatggtgctgttgacttccgtcgttcagggcagggccactccagaaaactatttgtttcagggccgtcaagaatgttatgctttcaatgggactcagagattcctcgagaggtacatctacaatcgcgaagaattcgtgaggtttgattccgacgtcggagaattccgggcagtgacagagctaggccgacctgacgaggaatactggaactcccaaaaagatatcctggaggaaaaaagggccgtcccggatcgcatgtgcagacataattacgagctcggcggacccatgaccttacaacgccgtgttcagcccagagtcaacgtctccccatcaaagaaggggccactccaacatcataatctactcgtgtgccacgtcacggatttttaccctggcagcatccaggtcaggtggttcttaaacggccaagaagaaacggcaggcgtagtgagcactaacctgattagaaatggagactggacattccagatcttggttatgctcgagatgacccctcagcagggcgatgtttacacctgccaggttgagcatacaagtatggatagccccgtgacagtggagtggaaagcgcagtctgatagtgcacggagcaaaacactgaccggcgccggaggattcgtgctaggcttgattatatgcggcgtgggcattttcatgcatcggcgctccaaaaaagtccagagaggcagtgcctag

SEQ ID NO: 193910 - DNA, 690 bp, Artificial Sequence
  Description of Artificial Sequence: Synthetic coding sequence
aagcaggcctggcggggcagcgccacccggctgggcccccagaactcaggtagacaggagtgttatgcgttcaatggcacccaacggtttctggaaaggtacatctacaatcgggaagagttcgcaagatttgattctgatgttggggagttccgcgccgtgaccgaacttggacggcccgcggcagaatattggaactcccaaaaggatatcctggaggaaaaaagggcagtgccagacagaatgtgccggcacaactatgagctcggagggcctatgacgctgcagcgtcgagtccagccacgggtgaacgtgagcccaagtaagaaggggccactgcagcatcacaacctcctcgtgtgtcatgttaccgatttctaccctggcagcattcaggtccgctggttcctgaatggacaggaagagaccgccggcgtcgtgagcacaaacttaattaggaacggcgactggactttccagattctagtaatgctggagatgacccctcagcagggagatgtctatacatgccaagtggagcacacctcccttgactctcccgttaccgtggagtggaaagctcagtccgattcagcccgcagtaagaccctgaccggagccggaggcttcgtgctgggtctcattatctgcggagtgggtatattcatgcatcgtaggagcaagaagtag

SEQ ID NO: 193911 - DNA, 708 bp, Artificial Sequence
  Description of Artificial Sequence: Synthetic coding sequence
tgaaactacctgttccagggccggcaggagtgctacgccttcaacggcacacaacgctttctcgagcgctatatttataatcgcgaagagttggttcgctttgactccgatgtgggagagttccgtgccgttacagaactggggcgccctgaagcggaatattggaatagccaaaaagatatcttggaggaggagagggcagtgcccgatcggatgtgccggcataattacgagcttggtggccctatgacactccagaggcgggtccagccaagagtgaacgtaagcccttctaagaaggggccactgcaacatcataacctgcttgtctgccatgtgactgatttctacccaggatcaatacaagtgcgatggttcctgaacgggcaagaggagaccgcaggggtcgtgtcaacaaacctcatccgtaatggagactggacctttcagattctggtgatgctcgagatgacgcctcagcagggcgacgtgtacacctgtcaggtcgagcataccagcctggacagtccggttactgtggagtggaaggctcagtccgacagcgcccgcagcaagacactaacaggcgccggcggattcgtgctgggcctgataatctgtggcgtgggcatattcatgcaccgaaggtctaagaagggcgagaaagcttgtcgctttaatgaggatctgcacaaacagggctcttag

SEQ ID NO: 193912 - DNA, 777 bp, Artificial Sequence
  Description of Artificial Sequence: Synthetic coding sequence
atgatggtgctgcaggtgagcgccgccccccggaccgtggccctgaccgcactgctgatggtcctgctcacttcagtggtccaaggtcgggccaccccggagaactatctctttcagggaaggcaagaatgctacgccttcaacggtacacaacggttccttgaacgctacatctacaatcgggaggaatttgcccgcttcgactccgatgtgggggaattcagagctgtgaccgagctgggaagacctgccgccgagtactggaacagccaaaaagacatcctggaggaaaaacgcgctgtccctgatagaatgtgcaggcacaattacgagttgggcggaccaatgacgctgcagaggcgggttcagcccagagtcaatgtgagcccgtcaaaaaaagggccactgcagcaccacaatctgctggtgtgccatgttaccgatttctaccccggcagcatacaggttaggtggttcctcaatggacaggaggaaacggccggggtggtgtcgactaacctgatcagaaacggggattggaccttccaaatcctggtaatgctggagatgacgccccagcagggagacgtgtatacatgccaagtggagcatacaagcttggacagccccgtcacagttgagtggaaggcccagagtgattccgccaggtctaagactctcacaggagccggaggcttcgtgctgggcctaattatttgtggggtcggaattttcatgcatcgtcggagcaaaaaggtgcaacgagggtcggcatag

SEQ ID NO: 193913 - DNA, 708 bp, Artificial Sequence
  Description of Artificial Sequence: Synthetic coding sequence
tgaaactacgtgtaccagctgcggcaggagtgctacgccttcaacggcacacagcgcttcttagagaggtacatttataaccgggaggagtttgtccgctttgacagcgacgtcggtgagttcagagcagtgacagagctcggccgtcctgacgaggactactggaacagtcaaaaagatctgctggaagagaagcgggcagtgcccgatagagtgtgtaggcacaactacgagctagacgaggctgtgaccctgcagagacgtgtgcagccaaaggtgaatgttagtccaagtaaaaaaggacctctgcaacatcataacctgttagtgtgtcatgtcacagatttctatcctggcagcatccaggtgaggtggtttctgaacggccaggaggaaaccgccggcgtcgtaagcacgaatctcatcagaaatggagattggacatttcaaattctggtgatgctggagatgacaccacagcagggtgacgtctacatctgccaagtggaacatacctccctagacagccctgtgactgtcgagtggaaagctcagagcgattcggctcgcagcaaaaccctgaccggtgccggtggctttgtgctgggtctgatcatctgcggcgtgggcatattcatgcatcgccgctccaaaaaaggggaaaaagcatgcaagttcaacgaggacttacacaaacagggatcttag

SEQ ID NO: 193914 - DNA, 690 bp, Artificial Sequence
  Description of Artificial Sequence: Synthetic coding sequence
aagcaggcctggcggggcagcgccacccggctgggcccccagaactcagggcggcaggagtgctacgcattcaacggcacgcagcgctttttagagcgctatatttacaacagggaagagttcgtccgcttcgatagcgatgttggagagttccgggccgtgacagaactgggacgtcctgatgaggagtattggaacagccaaaaagacatcctggaggaaaagagggctgtccccgatcggatgtgtcggcacaactacgaactcggcggcccgatgactcttcaacgccgtgtccagccaagagtgaatgtgtccccatcaaaaaaaggtcctctgcagcaccacaacctgctggtctgtcacgtgaccgacttctaccctgggtctatacaggttagatggtttctcaacgggcaggaggagactgccggcgtcgtatccacgaatttgatcagaaatggggactggacgtttcagattcttgtaatgctcgagatgacccctcaacaaggagacgtgtatacctgccaggtggagcatactagtatggatagtcctgtgaccgttgagtggaaagcccaatcagactctgcacgctccaagactttaaccggcgctggtgggttcgtgctgggcttaatcatttgtggcgtcggaatatttatgcacaggcggtcaaagaagtag

SEQ ID NO: 193915 - DNA, 687 bp, Artificial Sequence
  Description of Artificial Sequence: Synthetic coding sequence
atgatggtgctgcaggtgagcgccgccccccggaccgtggccctgacggcgctcctgatggttctactgacatctgtcgtgcagggtcgtgccacccccgagaattacgtgtaccagctgcggcaggagtgctacgctttcaatggcacccagaggtttctggaacggtacatttacaatcgggaagaattcgtgagatttgatagcgatgttggcgagttcagagctgttactgagctcgggcggcccgacgaggattactggaactcccagaaggacttgctcgaagagaaacgggccgttccagatcgagtgtgccgccataattacgaactagacgaggcagtgacgcttcaaagacggggttctatccaggtgagatggtttctcaacggccaggaggaaactgctggagttgtgagcaccaatttgatccgaaatggggattggacgtttcagattctggtgatgttggagatgactccacaacagggggatgtgtacatctgccaggtcgagcatacatccctggattcacccgtgacggttgagtggaaagcccagtctgactctgctagatcaaagaccctgacgggagcaggcggattcgtgctcggactgatcatctgcggggtcggaatctttatgcaccgcagaagtaagaaagtgcagcgcggctctgcctag

SEQ ID NO: 193916 - DNA, 687 bp, Artificial Sequence
  Description of Artificial Sequence: Synthetic coding sequence
atgatggtgctgcaggtgagcgccgccccccggaccgtggccctgacagcattgctgatggtgctcctgacctctgttgttcagggaagagcaacacctgagaattacttgttccaggggagacaggagtgttacgccttcaacgggacccagcgattcctggagaggtacatctataaccgggaagagtttgtccgatttgacagcgatgtgggcgaattccgggctgttactgaattgggccgaccggacgaggagtactggaatagtcagaaagatatcctggaggagaagcgagcagttcccgatcgcatgtgtcgccacaattacgagcttggcgggcccatgaccctccaacggcggggaagtattcaggtcagatggtttctgaacggtcaagaggagaccgccggtgtagtctctacaaatctgatcaggaacggtgactggacatttcagattctagtgatgctggagatgaccccccagcagggagacgtgtacacatgccaggtggaacataccagtatggattcccccgtgacagtcgagtggaaggcacaatctgattccgcccgctcaaagactctgacaggggcagggggctttgtgctgggcctgattatctgcggagtgggcatctttatgcacagacgctcaaaaaaggtgcagagagggagcgcctag

SEQ ID NO: 193917 - DNA, 687 bp, Artificial Sequence
  Description of Artificial Sequence: Synthetic coding sequence
atgatggtgctgcaggtgagcgccgccccccggaccgtggccctgacagcattgctgatggtcctcttgactagcgtcgtgcagggacgggcaacccccgaaaattacctgtttcagggcaggcaggaatgttacgccttcaacggtacacagaggttcctggaacgctacatttacaaccgcgaggaatttgccagattcgattccgacgtcggtgagttccgagccgttactgaactgggccggcccgccgcagagtattggaactcccagaaggacatactggaggaaaagcgggctgtgccggatcggatgtgccgccacaattacgaactcggcggccccatgaccctccagagaagaggctccatccaagtgcgctggttcctaaacgggcaagaagaaacagccggtgtggtttcaacgaacttaattcgaaacggagactggacatttcaaattctcgtgatgctggagatgactcctcagcagggagacgtgtacacttgtcaggtggaacacaccagcctcgattcgccagttacagtggagtggaaagcccaatccgacagtgcccgctccaaaaccctcacaggcgccggcggctttgttctgggcctcatcatctgtggcgtgggcatatttatgcaccgaagaagtaagaaggttcagcggggaagtgcttag

SEQ ID NO: 193918 - DNA, 690 bp, Artificial Sequence
  Description of Artificial Sequence: Synthetic coding sequence
aagcaggcctggcggggcagcgccacccggctgggcccccagaacagtggcagacaagaatgttacgccttcaacggaactcagcgattcttagagcgttatatttataatcgagaggaattcgtgcgattcgatagcgatgtcggcgagttcagggccgtgacggagctggggaggccagacgaggaatattggaactctcagaaagacatcctcgaggagaagcgggctgtgcctgatagaatgtgccggcacaattacgagcttggcggccctatgaccctgcaacggcgcgtgcagccccgtgttaatgtcagcccaagcaaaaaaggaccacttcagcatcacaatttactggtatgtcacgtgactgacttttatcctggcagtatccaggtccgatggtttctaaacgggcaggaggagacagctggagtcgtgagtactaacctgatacgcaatggggattggaccttccagatcctagtgatgctggagatgactccacaacaaggcgacgtctatacctgtcaagtggagcacacgagcatggacagcccagtgactgttgagtggaaagcccagtctgacagtgctcggtccaaaactctgacaggcgccggaggttttgtgctcggcttgattatttgcggcgtgggtatctttatgcaccggcgatccaaaaaatag

SEQ ID NO: 193919 - DNA, 708 bp, Artificial Sequence
  Description of Artificial Sequence: Synthetic coding sequence
tgaaactacctgttccagggccggcaggagtgctacgccttcaacggaacccagcgatttctcgagcgttacatatataacagagaggaatttgtgaggtttgacagcgatgtgggcgagtttagggccgtgactgagttaggtcgcccagacgaggagtattggaatagccagaaggatattctcgaagaggagcgcgccgtgcctgatcgtatgtgccgacataattatgagctgggcggtccaatgaccctacaacggagggtgcagcctcgagttaacgttagcccaagtaagaagggacccctccagcaccacaatctgttggtgtgtcatgttacggacttttatcctggctctattcaggtaagatggttcttaaacggacaggaagaaacagccggagttgtgtccacaaatttaatccgtaacggggattggacatttcagatcctagttatgctggaaatgaccccccagcagggcgacgtgtatacatgccaggtcgagcacacttctctcgattctccagtcacggtcgaatggaaagcccaaagtgacagtgcgcggagcaagaccctcaccggagctggaggatttgtcctcgggttgatcatttgcggcgtaggaattttcatgcaccgcaggtccaagaaaggagaaaaggcctgccggttcaacgaagacctgcacaagcaggggtcttag

SEQ ID NO: 193920 - DNA, 708 bp, Artificial Sequence
  Description of Artificial Sequence: Synthetic coding sequence
tgaaactacctgttccagggccggcaggagtgctacgccttcaacggaacacagcgcttcctggagaggtacatctacaatagagaggaatttgcacgtttcgatagcgatgtgggagagttccgcgctgtgactgaactcgggagacctgcagcagagtattggaatagtcaaaaggatatactggaggagaaaagagctgtacccgaccggatgtgtaggcacaactacgagctgggcggacctatgacgctccagaggcgggtgcagccccgggtaaatgtgtctccgagcaagaaaggccctctgcaacatcataatctcctagtgtgtcacgtgaccgacttctatccgggatccatccaggtacggtggttcctaaacggtcaggaggagacggccggagttgtgagtacaaatctgatcagaaacggggattggacgttccagatcctcgtcatgctggagatgactccccagcagggcgacgtgtacacttgccaggtggagcacacctccctagacagtcccgtgaccgtggagtggaaagcccagtctgactcagcaaggtccaagaccttgactggggcaggtgggtttgttctcggcctgatcatttgtggggttgggatcttcatgcacaggcgctctaagaagggggaaaaggcctgcaggtttaatgaagatcttcataaacaaggtagttag

SEQ ID NO: 193921 - DNA, 687 bp, Artificial Sequence
  Description of Artificial Sequence: Synthetic coding sequence
atgatggtgctgcaggtgagcgccgccccccggaccgtggccctgactgctctgcttatggtgctgttaacttcggttgttcaaggcagagctactcccgagaactacttattccaggggaggcaggagtgctatgccttcaacggcactcaacggttcctcgagcgttacatttacaatagggaagagttcgttagatttgattcagacgtcggggagttccgcgccgttacagagcttggccggcccgatgaggagtactggaacagtcaaaaagacattctcgaggaagaaagagcggtgccagaccgtatgtgtaggcataactacgaactagggggccccatgacgctccagcgcaggggctccattcaggtgcggtggtttttaaatggacaggaggagacagccggtgtcgtgtctactaatctaattcggaacggcgactggacgttccaaatcctggtaatgctagagatgaccccacagcagggggacgtatacacatgtcaggtggagcatacgtcccttgactcacctgtgacggttgagtggaaggcccagtcagactctgccagaagtaagacccttactggcgccgggggttttgttctcgggctgatcatctgtggagtcggtattttcatgcatcgacgttctaaaaaagtgcagcggggctccgcctag

SEQ ID NO: 193922 - DNA, 690 bp, Artificial Sequence
  Description of Artificial Sequence: Synthetic coding sequence
aagcaggcctggcggggcagcgccacccggctgggcccccagaactctctgcgacaggagtgttacgctttcaatgggacacagcgcttcctggaaaggtatatctacaaccgagaggaatttgtccgcttcgactccgacgtaggcgagttcagagctgtgaccgagctgggcaggccagatgaagactactggaacagccagaaggacctgttagaagaaaagagggcagtgccggatcgggtatgcaggcataactacgagctggatgaagccgtaacactccagaggagagttcaaccaaaggtgaacgtttctccatccaagaagggcccattacagcaccacaacttgcttgtgtgccatgtcactgacttctacccaggatctattcaggtgagatggtttctcaacggacaggaggaaaccgctggcgtcgtctcaacaaatttgatccgtaacggggactggacgtttcagatcttagtgatgttggagatgacaccccagcagggggatgtatacatttgccaggtggagcacacctcactggactctcccgtcaccgtagaatggaaagcacaaagcgactccgcccggagcaaaactctgactggagcaggcggctttgtgctgggtctcatcatttgtggggtcgggatatttatgcatcggcgaagtaaaaagtag

SEQ ID NO: 193923 - DNA, 777 bp, Artificial Sequence
  Description of Artificial Sequence: Synthetic coding sequence
atgatggtgctgcaggtgagcgccgccccccggaccgtggccctgacagcccttctgatggttctgctgaccagcgtcgttcaaggtcgtgctacccctgagaactatctctttcagggccgacaggaatgctacgccttcaatgggacacaaaggtttctcgaacgctatatttacaatcgcgaggagttcgcacgttttgactccgatgtgggcgaattcagggcggtgacggagttggggaggccggctgccgagtactggaactcacagaaagacattctggaggaaaaacgggcagtgcccgatcgcatgtgccgccataactacgagcttgggggccctatgactctgcagaggcgcgtgcagcctagggtcaacgtttcaccatctaagaaggggcccctacagcaccacaatcttctggtatgccacgtaactgatttttatcctggtagcattcaagtaagatggtttctgaacggacaggaggagaccgctggtgtcgtaagtacaaacctcattcgcaacggggactggaccttccagatcctcgtgatgctcgagatgacgcctcaacagggagatgtttacacttgtcaggttgaacatacctccttggattcccccgtaactgtggagtggaaggcgcaatctgattccgctaggagtaagaccctgacaggggccggtggcttcgtactgggtctgattatttgtggcgtcggcatttttatgcacaggcgctcaaagaaggtccaacgcgggtcagcgtag

SEQ ID NO: 193924 - DNA, 708 bp, Artificial Sequence
  Description of Artificial Sequence: Synthetic coding sequence
tgaaactacctgttccagggccggcaggagtgctacgccttcaacggtacacaacggttcttggaacgatacatctataatcgggaagagtttgtacgcttcgattccgacgtgggggagttcagagctgtaacagagctcgggcgcccagatgaggagtattggaacagccagaaagacatcttagaagagaagagagcagttcctgatcgaatgtgccgccacaattatgaactgggtggccccatgactttgcagaggcgcgtccagcctagggtcaatgtgagtcccagtaaaaaggggccgctgcaacatcacaatctgcttgtttgccatgttacagatttttaccccggaagcattcaagtccgatggttcctgaatggacaggaggagacagctggggtcgtgagtaccaatcttattagaaatggagattggaccttccagattcttgtgatgcttgagatgacgccccagcagggtgatgtgtatacttgtcaggtggagcatacatctatggattcacccgtgaccgtggagtggaaggcccagtcagattctgctcgttccaaaaccctgacgggcgccggcgggttcgtgcttggccttattatatgcggggtcgggatctttatgcacagacggtctaagaaaggggagaaggcatgcaggtttaatgaagacctccacaagcagggaagttag

SEQ ID NO: 193925 - DNA, 690 bp, Artificial Sequence
  Description of Artificial Sequence: Synthetic coding sequence
aagcaggcctggcggggcagcgccacccggctgggcccccagaactcaggccggcaggagtgttacgcctttaatgggacacaaagattcctggaaaggtacatctacaaccgtgaggagttcgccaggtttgactccgatgtgggtgagttccgggctgtgactgaactgggtagaccagcagccgaatattggaatagccagaaggacatccttgaggagaaacgggccgttcccgacagaatgtgtaggcacaactatgagctgggcgggccgatgacgcttcaaagacgcgtacagcctagagtaaatgtttcaccatctaaaaaagggccactccaacaccataatctgctggtttgccacgtgactgacttttacccagggtccatacaagtgcgctggttcttgaacgggcaggaagagacagccggcgtggtctcaaccaatctcattcggaatggagattggactttccaaatcctggtcatgttggagatgacaccacagcagggtgacgtgtacacctgtcaggtggaacatacatccttagactcacctgtcacagtcgagtggaaggcccagtccgattctgccagatctaaaactctgacaggcgccgggggatttgtgttaggtctgattatttgcggagtcggcatcttcatgcatcgacggagcaaaaagtag

SEQ ID NO: 193926 - DNA, 708 bp, Artificial Sequence
  Description of Artificial Sequence: Synthetic coding sequence
tgaaactacctgttccagggccggcaggagtgctacgccttcaacgggacgcaaaggttcctggagcgctacatatataatagggaggaattcgcaaggttcgacagcgatgtcggggaattcagagcggttactgaactgggtagacccgccgccgagtattggaactctcagaaagatatattagaggagaaacgtgccgttcccgatcgcatgtgtagacataattatgagctagggggccctatgaccctgcagaggcgcgttcaaccccgtgtcaacgtgagcccgtccaagaaaggacccctccaacatcacaacctgttggtgtgtcatgtgactgatttctaccccggaagcatccaagtgcgatggttcctcaacggccaggaggaaactgctggggtggtgagtacaaaccttattaggaatggcgattggacctttcagattctcgtgatgttagaaatgaccccccagcaaggggacgtgtatacctgtcaggtggaacataccagtctcgactcccccgtaacagtcgaatggaaggcacaaagtgatagcgccagaagcaagaccctaacaggagcaggggggttcgtgctgggtctgataatttgcggtgtcggaatctttatgcatcggcggtcaaagaagggcgaaaaagcgtgcagattcaacgaagacttacacaagcaaggtagctag

SEQ ID NO: 193927 - DNA, 372 bp, Artificial Sequence
  Description of Artificial Sequence: Synthetic coding sequence
atgatggtgctgcaggtgagcgccgccccccggaccgtggccctgactgcacttcttatggttctcctgacatcggttgtgcagggccgcgctacgccagagaactatctgtttcagggcagacaagagtgctacgcgttcaacggtactcagcgtttcctggagagatacatctacaatagggaagagttcgccaggttcgacagcgatgttggagagttccgggcggtgaccgagctcggccgccccgcggccgaatattggaattctcagaaggatatcctggaggaaaagagagccgtgcccgatcggatgtgtcgacacaattacgaactgggaggccccatgaccctgcagaggcggggggagtag

SEQ ID NO: 193928 - DNA, 249 bp, Artificial Sequence
  Description of Artificial Sequence: Synthetic coding sequence
atgaccccccagcagggcgacgtgtacacctgccaggtggagcacacatccctggatagcccagtgaccgtcgaatggaaagcccaatcggactccgctcggagtaaaactcttaccggggccggcggaagagccggtgctcatcatctctggtcaggccatcttcacgctcaagaagagcaggagagctccactcgaatttgcataaacagggttcccgagctgacagaaaagacaatagtgccctag

SEQ ID NO: 193929 - DNA, 249 bp, Artificial Sequence
  Description of Artificial Sequence: Synthetic coding sequence
atgaccccccagcagggcgacgtgtacacctgccaggtggagcacaccagtctggattccccggtgacggtcgagtggaaggcccagtctgactctgccaggagtaagaccctcaccggcgccggcggacgcgcaggtgcccatcacttgtggtctggacatcttcatgcacaagaggaacaggagtcgtccacgaggatttgtattaaccgggtgcccgagctgaccgaaaagaccatagttccttag

SEQ ID NO: 193930 - DNA, 372 bp, Artificial Sequence
  Description of Artificial Sequence: Synthetic coding sequence
atgatggtgctgcaggtgagcgccgccccccggaccgtggccctgacggccctgctgatggtgctcttaacatctgtagtccaaggaagggctacgccggaaaattacctgttccagggacgccaggaatgttatgcgttcaatggtacccagcgctttctggaacgctatatatataaccgcgaggaactggtgcgctttgatagcgatgtgggagagtttagagccgtgaccgaactggggaggccagaagccgagtactggaattctcagaaagatattctcgaggaagagcgggcggtgccagataggatgtgtcggcataactacgagcttggcggtccgatgacattacagcggcggggagagtag

SEQ ID NO: 193931 - DNA, 372 bp, Artificial Sequence
  Description of Artificial Sequence: Synthetic coding sequence
atgatggtgctgcaggtgagcgccgccccccggaccgtggccctgaccgcgctcctgatggtgctactgacatctgtcgtccagggacgcgcgacccctgagaactacttgtttcagggaaggcaggagtgttatgcattcaatggcacacaacggtttctggagagatacatttacaaccgagaggaattcgtacggtttgactccgacgtgggagagtttagggccgtcaccgaactgggacgtccggatgaggaatactggaactctcagaaagacatccttgaggaaaaacgcgccgtgccggataggatgtgtcgccataactacgagctcggcggccccatgactctgcaacgacgcggagagtag

SEQ ID NO: 193932 - DNA, 372 bp, Artificial Sequence
  Description of Artificial Sequence: Synthetic coding sequence
atgatggtgctgcaggtgagcgccgccccccggaccgtggccctgacagccctattaatggtgctgctcacctctgtggttcaggggcgtgctacgccagagaattatctattccagggtagacaagagtgttatgctttcaacggtacccaacggttcctggaacgctatatttataatagggaggaattcgttagattcgatagcgacgttggcgagtttagggccgttaccgaactaggcagacccgatgaggaatactggaactctcagaaggatattctggaggaggaaagggccgttccagaccgaatgtgccgccataattatgagttgggaggcccaatgaccctgcagcggcgtggggagtag

SEQ ID NO: 193933 - DNA, 750 bp, Artificial Sequence
  Description of Artificial Sequence: Synthetic coding sequence
atggtgctgctgaccagcgtggtgcagggccgggccacccccgagaattatgtgtaccagcttaggcaagaatgctatgccttcaacggcacacagcgctttctcgagaggtacatctacaaccgggaagagtttgtccggttcgattcagacgtaggtgagtttcgagctgtcacagagctcggcagacccgatgaggactattggaactcccagaaagatcttcttgaggagaagagggccgtgcccgatcgggtatgtcgtcataattatgagcttgatgaggctgtgacactgcagcggcgtgtgcagcccaaggttaacgtgagcccatcgaagaaaggccctctgcagcatcacaatctgctggtgtgccacgtcaccgatttttaccccggcagtattcaggtgcgctggtttctgaatgggcaggaagagaccgcaggggttgtgagtaccaaccttatcagaaacggagactggacgttccaaattctggtcatgttggagatgacaccccaacagggtgatgtgtatatctgccaggtagaacacacaagcctcgatagtccggtgacagtggaatggaaggctcagtctgactctgcccgtagtaaaacactgaccggtgctggcggattcgtgctcggcttgatcatatgtggggttggcatatttatgcataggagatctaagaagggggaaaaagcatgtaaatttaacgaggacctccacaagcaggggtcttag

SEQ ID NO: 193934 - DNA, 249 bp, Artificial Sequence
  Description of Artificial Sequence: Synthetic coding sequence
atgaccccccagcagggcgacgtgtacacctgccaggtggagcacactagtttggacagtcccgtcacggttgaatggaaggcccagtcagactctgctaggtcaaagacccttactggtgccggcggaagggcaggagctcatcatctctggtctggacacctacacgcacaagaagagcaggaatccagtactaggatctgtatcaacagggtacccgagcttaccgaaaaaacaatcgtaccttag

SEQ ID NO: 193935 - DNA, 372 bp, Artificial Sequence
  Description of Artificial Sequence: Synthetic coding sequence
atgatggtgctgcaggtgagcgccgccccccggaccgtggccctgaccgcccttctcatggtcctcctgaccagtgtagtccagggtcgggccactcctgaaaactatctgtttcaaggcaggcaggagtgctacgctttcaacggaacccagaggtttttagaaaggtatatttataacagggaagagtttgctcgcttcgattccgacgtaggcgaatttagggccgtgacagaactggggcggcccgccgcagagtattggaactcccagaaagacatcctggaggagaagcgggccgttccggaccggatgtgtcggcataactacgagttaggagggccgatgacactccaaagacgcggcgagtag

SEQ ID NO: 193936 - DNA, 372 bp, Artificial Sequence
  Description of Artificial Sequence: Synthetic coding sequence
atgatggtgctgcaggtgagcgccgccccccggaccgtggccctgactgcgctgcttatggtgctgttgacctccgttgtccaggggcgcgccacaccagagaattatctcttccagggtaggcaagagtgttatgcatttaacggcacccagcggttcctggaaaggtatatctataatcgggaggaatttgcgcggttcgatagcgatgtgggggagtttcgagccgtgaccgagctcggaaggcccgcagccgaatattggaacagtcagaaagacatcctcgaggagaagcgagctgtgccagacagaatgtgtcgccataactacgagttgggaggtcctatgacattgcagcgtaggggagaatag

SEQ ID NO: 193937 - DNA, 198 bp, Artificial Sequence
  Description of Artificial Sequence: Synthetic coding sequence
atggacagccccgtgaccgtggagtggaaggcccagagcgacagcgcgaggtccaaaaccctgaccggagcaggtggaagggccggtgctcaccatctctggtcaggccatctgcatgcccaggaggagcaagagagttccacaagaatctgtatcaacagagtcccggaactcacggaaaagaccatcgtcccctag

SEQ ID NO: 193938 - DNA, 381 bp, Artificial Sequence
  Description of Artificial Sequence: Synthetic coding sequence
atgatggtgctgcaggtgagcgccgccccccggaccgtggccctgaccgcactgttgatggtgctgttaaccagtgtagttcaggggagagcaacaccagaaaactatgtgtatcaactgcgccaggaatgctatgcttttaacggcacgcagagattcctagaacgctatatttataacagagaggagttcgtgcgcttcgactccgacgtgggcgaatttcgtgctgtcacggagctaggaaggcctgacgaggattattggaactcacagaaagacctgctggaagagaagcgagccgtccctgaccgggtctgtcgccacaattacgagctggacgaggcggtcaccctccagaggcgcgagcgtggcaaaaagtag

SEQ ID NO: 193939 - DNA, 249 bp, Artificial Sequence
  Description of Artificial Sequence: Synthetic coding sequence
atgaccccccagcagggcgacgtgtacatctgccaggtggagcacacatcactcgatagtcccgtgacagtcgaatggaaggctcaatcagactccgctaggtctaagaccctcaccggcgcaggcgggagagctggcgcccaccacttgtggagcggccatcttcatgcccaagaggagcaggagagctctacacggatctgcattaaccgagtgcccgatctgacggagaaaaccaacgtgccttag

SEQ ID NO: 193940 - DNA, 249 bp, Artificial Sequence
  Description of Artificial Sequence: Synthetic coding sequence
atgaccccccagcagggcgacgtgtacacctgccaggtggagcacactagcttggactctcctgtgaccgttgaatggaaggctcagagcgactccgcaaggtccaagactctcacgggcgcaggcggtcgggctggcgcacatcacctttggtcgggccaccttcacgctcaagaagaacaggaatcctccacaagaatttgcatcaacagagtgcctgagctgactgaaaaaacgatagtaccgtag

SEQ ID NO: 193941 - DNA, 372 bp, Artificial Sequence
  Description of Artificial Sequence: Synthetic coding sequence
atgatggtgctgcaggtgagcgccgccccccggaccgtggccctgaccgcgctgctaatggttctgctgacatctgtggtacagggccgcgccacacctgagaactacttatttcagggacggcaggaatgttatgcctttaacggaactcaaaggttcctcgagaggtacatatataaccgcgaggaatttgtcaggtttgattccgatgtaggtgaattcagggcagtgaccgagcttgggagaccagatgaggagtactggaacagtcaaaaagacattttggaggagaagagggccgtgccagaccgcatgtgccggcataactacgagctgggaggacctatgacactgcagagaaggggcgaatag

SEQ ID NO: 193942 - DNA, 198 bp, Artificial Sequence
  Description of Artificial Sequence: Synthetic coding sequence
atggacagccccgtgaccgtggagtggaaggcccagagcgacagcgccaggtccaagacactcacaggcgccggcggccgagcaggcgcacatcacttgtggagcggacacctgcacgcccaggaggaacaggagtcctccacccgaatctgtatcaatcgggtgcctgagttaacagaaaaaacaattgtcccctag

SEQ ID NO: 193943 - DNA, 768 bp, Artificial Sequence
  Description of Artificial Sequence: Synthetic coding sequence
atgatcctgaacaaggccctgctgctgggcgccctggccctgaccaccgtgatgagcccgtgcggaggtgaagacattgtggcagaccacgttgcctcatgtggcgtaaacctttatcagttttatgggccctccgggcagtacacgcacgagtttgacggtgatgagcagttttacgtggaccttgaacgcaaagaaaccgcatggagatggcccgagttctctaaatttggtggatttgaccctcagggcgctttgagaaacatggctgtggctaagcataacctgaatattatgataaaacggtacaactctactgctgctaccaacgaggtgccggaagtcacagtgtttagcaagtcacccgtgacattgggccaacctaacacccttatctgcctggttgataacatttttcctcctgtagtcaacataacctggcttagtaatggacagagcgtgaccgagggtgtttcggaaacctcctttttatctaaaagcgaccattccttttttaaaatctcatatcttaccttcttgcctagtgcagatgaaatttacgattgtaaggtcgagcattggggacttgaccagcccctgctgaaacattgggaacctgagattcccgcccctatgagcgaactaacagagaccgtggtgtgcgcccttggcctgagcgtcgggctgatgggaattgttgtgggcacagttttcatcatccaaggtttaaggagcgtgggggcgagccggcatcagggccccttatag

SEQ ID NO: 193944 - DNA, 768 bp, Artificial Sequence
  Description of Artificial Sequence: Synthetic coding sequence
atgatcctgaacaaggccctgctgctgggcgccctggccctgaccacagtcatgtcaccttgcggcggcgaggatattgtggctgaccacgttgccagctgcggcgtaaacctgtaccagttttacgggcccagtggccagtacactcatgaatttgatggggatgagcagttctacgtcgaccttgagcggaaggaaacagcatggagatggcctgaattcagcaagtttgggggattcgacccacagggagcactcaggaatatggcagtggcaaaacacaacctcaacattatgatcaagagatataactctaccgccgccactaacgaggttcccgaggtgaccgtcttctcaaagagccccgtcaccttgggacagccaaacactctgatctgccttgttgacaatatattcccccctgtagtcaatatcacttggcttagtaatggacaaagcgtcacagagggggtcagcgaaaccagttttttaagcaaaagtgaccattcattttttaagatcagctacctcaccttcctgccgtctgcagatgagatttatgactgtaaggtggagcactgggggttggaccagcctctgctgaaacattgggagccagagatcccggctcccatgtccgaactgaccgagaccgttgtttgcgccctaggcttaagtgtgggactcatgggcatcgtggtaggcactgtgttcataattcagggactgcgctctgtgggagctagcagacaccaaggcccactctag

SEQ ID NO: 193945 - DNA, 765 bp, Artificial Sequence
  Description of Artificial Sequence: Synthetic coding sequence
atgatcctgaacaaggccctgatgctgggcgccctggccctgaccactgtgatgtctccctgcggaggagaagacatcgtggccgaccacgtggctagctatggagttaacctgtaccagtcttatggccctagcggccagtacacacatgagtttgacggtgacgagcagttttatgtcgatctggggagaaaagaaaccgtctggtgccttccagtgctaagacaattcaggtttgacccccaattcgcgctaacaaatatagctgtcctgaagcataaccttaattcactgatcaaaagatcaaattctaccgcggccaccaacgaggtccccgaagttactgtctttagtaagagccccgtgacgctggggcagccaaacatcctgatttgcctggtggataatatatttcctcctgttgttaacatcacttggctgtctaacggacacagcgtaaccgagggggtctctgaaacctcctttctcagcaagtctgaccacagcttttttaaaatttcatacttaaccttacttcccagtgccgaagagtcatacgattgtaaagtcgaacattggggactggacaagccactattgaagcattgggagcccgaaatcccggcacctatgagcgagcttactgagaccgtggtgtgtgctttgggcctcagtgtaggcctcgtgggcattgtggtcgggactgtgttcatcattagaggccttaggtccgtgggcgcgtctagacaccagggtcctttgtag

SEQ ID NO: 193946 - DNA, 768 bp, Artificial Sequence
  Description of Artificial Sequence: Synthetic coding sequence
atgatcctgaacaaggccctgctgctgggcgccctggccctgaccactgtgatgtccccctgcggaggcgaggatattgtcgctgaccacgtagcctcttgcggagtaaacttgtaccaattctatggtccctctggtcagtatacccatgaattcgatggggacgaacagttttatgttgacctggagcgcaaggaaactgcctggagatggcccgaattttcaaagttcggtggcttcgacccacagggtgcactgagaaacatggctgttgccaagcacaatttaaacattatgatcaagagatacaacagcaccgccgccacaaacgaggtccctgaggtaactgtgtttagcaaatctcccgtgacccttggccagcccaatacattgatttgcttggtcgataacattttccctccagtggtcaacattacgtggctgtctaacggtcagagcgtgaccgaaggcgttagtgagacaagttttttgtcaaaaagcgaccactcattctttaaaatcagctacctaaccttcctcccctcagcagacgaaatatatgactgcaaagtagaacactgggggctcgaccagcccctgcttaagcactgggagccagagatccctgcgcctatgtcagagcttaccgagactgtggtgtgcgccctgggcctatcagtgggcctaatgggaattgtggtcggaacggtcttcatcatccagggacttcgcagcgtgggagcctcaagacatcagggccccttgtag

SEQ ID NO: 193947 - DNA, 768 bp, Artificial Sequence
  Description of Artificial Sequence: Synthetic coding sequence
atgatcctgaacaaggccctgctgctgggcgccctggccctgaccacagtcatgtcgccctgcggaggcgaagatatcgtggccgaccatgtggcctcctgtggggtgaatctttatcagttttacgggccaagcggtcagtacacacacgagtttgacggcgatgaacagttctacgtagatctcgaaagaaaagagaccgcttggagatggccggaattctcaaagtttggcgggttcgatccacagggagcccttcgtaacatggcagtcgccaaacacaaccttaatatcatgattaaaaggtataatagcacggcggcaactaatgaggttccagaagtcaccgtgttttctaagtctccagtgaccctgggtcaacccaatacgctgatctgcctcgtggacaatatttttcccccagtagttaatattacctggctgtctaacgggcaatctgttacggagggcgtgagtgagactagttttctgagcaagtcagatcactcattcttcaaaatcagctatttgacttttctgccatcagccgacgaaatatacgattgtaaggtggagcactggggcctggaccagccgctcctgaagcattgggagcccgagatcccagcgcctatgtcggagctaactgaaactgtggtctgcgcccttggactttctgtgggcctgatgggtatagtggtggggaccgtgttcatcatccaagggctgagatccgtgggggcatcgcggcaccagggacccctgtag

SEQ ID NO: 193948 - DNA, 765 bp, Artificial Sequence
  Description of Artificial Sequence: Synthetic coding sequence
atgatcctgaacaaggccctgatgctgggcgccctggccctgaccactgtcatgagtccttgcggcggggaagacattgttgcagatcacgtcgctagttacggagtcaacctgtaccagagttatggcccctccggacaatacacacatgaattcgacggggatgagcagttctacgtggatttaggacgcaaggaaacagtttggtgccttcccgttctgaggcagttcagattcgatccgcagttcgccctcacaaacattgctgtattgaaacataatcttaattccctgattaagagaagcaactcaactgccgctactaacgaggtccccgaggtgacagtattctcaaagagccccgtgactttaggacaaccaaatattcttatctgcctggtagataatattttcccccccgtcgtgaacatcacttggctgtcaaatggccactccgtgaccgagggcgtgagcgaaactagcttcctctcaaagtctgaccatagcttcttcaaaatatcttatcttactctccttccttctgcggaggagagctatgactgtaaagtcgaacattggggcctagacaaaccactactaaagcactgggaacccgagattcccgcgccgatgtcagaacttactgaaaccgttgtgtgcgccctcggattatcagtcggactagttggcatcgtcgtggggaccgtctttatcattcgggggttaagatcagtcggagcctcacgacatcagggccccctttag

SEQ ID NO: 193949 - DNA, 765 bp, Artificial Sequence
  Description of Artificial Sequence: Synthetic coding sequence
atgatcctgaacaaggccctgatgctgggcgccctggccctgaccactgtgatgtcaccgtgcgggggcgaagacatcgttgcagaccacgtcgctagttacggggttaatttataccaatcctatgggccgtctggtcagtatacccatgagttcgatggggacgagcaattttacgtcgacctgggccgtaaggaaacagtttggtgcctcccggtgctcaggcagtttcgatttgacccccaattcgccctaacaaatattgccgtgctcaagcacaaccttaattcgcttatcaaaagatctaatagcaccgccgccacaaatgaggttccagaagtgacagtgttttccaagagcccggtgacactcggccagcctaacatcttgatctgcctggtggataacatctttccacctgtggtgaacattacatggcttagtaatggacattcagtcactgagggagtgtcggagacttcttttttatctaagagcgaccactctttctttaagatcagctatctgacattgctccctagtgccgaagaaagctatgactgtaaggtggaacattggggccttgataagcctctgcttaaacattgggaacccgagatccccgccccaatgtcagagctcaccgagaccgtggtgtgcgctttgggcttatccgtaggactggtcggcatagtggttggcaccgtgttcataatcagaggcctgcggagcgttggcgcatcacgacatcagggtccgctctag

SEQ ID NO: 193950 - DNA, 75 bp, Artificial Sequence
  Description of Artificial Sequence: Synthetic coding sequence
atgatcctgaacaaggccctgatgctgggcgccctggccctgaccacagtaatgtcaccatgcgggggtgaatag

SEQ ID NO: 193951 - DNA, 765 bp, Artificial Sequence
  Description of Artificial Sequence: Synthetic coding sequence
atgatcctgaacaaggccctgatgctgggcgccctggccctgaccactgtgatgtcaccatgcggcggggaggacatcgtggcagaccacgtggcttcctatggggttaacttgtatcagagctatgggccaagtgggcaatttactcacgagtttgacggcgacgaagagttttacgtcgacctggagcgaaaagagaccgtatggaaacttccactgtttcatcgtctgcggttcgacccccagttcgccctgacaaatatcgcagtattgaagcataacttaaatatactgattaagagatccaattcaactgccgcaacaaacgaagttccagaagtgacagtcttttccaaaagcccagtaacacttggacagccaaataccttgatctgcctggtcgataacatcttcccccctgttgtgaacataacctggctttccaatgggcattccgtgactgagggagtcagtgagacctccttcttatccaagagcgatcattcgttctttaaaataagctaccttacattccttccttcggcagacgaaatctacgactgcaaggtcgagcactggggattagacgagccgcttctcaaacactgggaacccgaaattcccgcaccaatgagtgaactaaccgagaccgtcgtttgcgcccttggactctcagtgggtctggtcggaattgtcgtgggaacagtgttgatcattcgaggcctgaggtccgtgggagcctcccggcatcaaggccccctctag

SEQ ID NO: 193952 - DNA, 768 bp, Artificial Sequence
  Description of Artificial Sequence: Synthetic coding sequence
atgatcctgaacaaggccctgatgctgggcgccctggccctgaccacggtaatgtctccttgtggcggagaggatatcgtcgctgaccacgtggcctcttacggggtgaacctctatcaatcttacggaccttcaggtcagtactctcatgaattcgatggcgatgaggaattctacgtcgatttagagcgtaaagaaacggtgtggcagctgcccttattccggcgtttcaggcgattcgacccacaatttgccctcactaacattgctgttctgaaacataatctgaatatcgtgatcaagaggtctaatagcaccgctgctaccaacgaagtgccagaagttaccgtcttctcaaaaagccctgtgactctgggccagcctaatactcttatatgtctggtggataacatctttcccccagtcgttaatattacctggctgtcaaacggacactctgttactgagggggtctcagagacttcttttctatctaagtcagaccactcctttttcaagatctcatacctgacatttctgcccagcgcagatgaaatatatgattgcaaggtggaacattggggtctcgacgagccacttttgaagcactgggaacccgaaattcccactcctatgagcgaactgaccgaaactgtggtgtgcgccctgggcctgagcgtgggacttgtgggcattgtcgtgggcacagtactaatcatcaggggactccgatcggttggtgctagccgtcatcaaggaccgctatag

SEQ ID NO: 193953 - DNA, 768 bp, Artificial Sequence
  Description of Artificial Sequence: Synthetic coding sequence
atgatcctgaacaaggccctgatgctgggcgccctggccctgaccaccgttatgtctccttgtggtggcgaggacatcgtcgccgaccatgtagccagctatggtgtaaatctctaccagtcttatggccctagcggtcagtacagccatgaatttgatggggacgaagagttttatgtcgatctggaacggaaggagaccgtgtggcagttgcccctcttccgacgcttccgcaggtttgatccacagttcgctttgactaatattgcagtgctgaagcataacctgaacatcgttataaaaagatccaactctaccgcggccacgaacgaagtaccagaggtgacggtcttttcaaagtctcccgtgacactcggtcagcctaacaccctgatctgccttgtggacaatatctttccacccgtcgtcaatatcacctggctatcaaacgggcactcggtaactgagggcgtatccgagacatcattcctgtctaagagcgatcattccttttttaaaatctcttatctcaccttcttaccctccgatgatgaaatctatgactgtaaagtggagcattggggactagatgaaccactcctcaagcactgggaacccgagattcctactcccatgtctgagcttacagaaaccgtcgtctgtgcacttggactatccgtgggcctggtcggcattgtagtgggcactgttctgattattcgcgggctacggagtgtgggagctagtcgtcatcagggcccattatag

SEQ ID NO: 193954 - DNA, 75 bp, Artificial Sequence
  Description of Artificial Sequence: Synthetic coding sequence
atgatcctgaacaaggccctgctgctgggcgccctggccctgaccacagtcatgagtccttgtggcggggagtag

SEQ ID NO: 193955 - DNA, 768 bp, Artificial Sequence
  Description of Artificial Sequence: Synthetic coding sequence
atgatcctgaacaaggccctgatgctgggcgccctggccctgaccacggtgatgtcaccctgtggaggggaggatatcgttgcagaccatgtagcttcctatggagtgaatctataccagagctacggcccctccggacagtatagccacgagttcgacggtgacgaggaattttacgtggatctggaacgcaaggagaccgtctggcagctccctttgttccgtcgcttccggcggttcgatccgcagttcgcgctgaccaacatagctgtcctcaaacacaatctgaacatagtcattaagcgctccaattcaaccgctgcgacgaatgaggtgcccgaggtcaccgtattcagcaagtctcctgttacacttggtcagcccaatactctgatttgtctcgtcgacaacattttcccaccggtagtcaacatcacttggctgtctaacggacactcagttacagaaggcgttagcgaaacttcttttctgagtaaatctgaccattctttcttcaagatcagctatctaactttccttccctccgatgacgaaatttacgactgtaaggtagagcattgggggctagacgaacccctgttgaagcattgggagcctgaaatccctacacccatgtccgagctcaccgagaccgtggtgtgtgcactgggcttaagtgtgggactggtaggaatcgtggtaggcaccgtcctcattatccgcggtttacgatcagtgggcgcatcccggcaccagggacccctgtag

SEQ ID NO: 193956 - DNA, 765 bp, Artificial Sequence
  Description of Artificial Sequence: Synthetic coding sequence
atgatcctgaacaaggccctgatgctgggcgccctggccctgaccaccgtcatgtcgccctgtgggggtgaagacattgtcgccgatcacgtcgcgtcgtacggcgtgaatctgtatcagtcctacggtccttcaggccaattcactcacgagtttgatggagacgaagagttctatgttgacctcgagcgaaaggaaactgtgtggaaactgcctcttttccaccggttacgcttcgacccacaattcgcacttactaatattgcggttcttaagcataacctgaatatactcatcaaacggagtaattccacagccgctactaacgaagtccccgaagtcactgtgttcagcaaatccccagtgactctggggcagcccaatacgctgatctgccttgtggataacatattcccccccgtagtaaacattacatggctctcaaacgggcattccgtgaccgagggcgtctcagagacaagtttcctttcaaaatcggaccacagctttttcaagattagctatctgacctttctgcctagcgctgacgagatatacgactgcaaagtggagcactggggattggacgaaccacttttaaaacactgggagcctgagatccctgctccaatgagcgaattgactgagaccgttgtgtgcgccctgggcctctcagttgggttggttggcattgtggtgggaaccgttctgatcattagggggctgagatctgtcggcgctagccggcatcaagggccactgtag

SEQ ID NO: 193957 - DNA, 765 bp, Artificial Sequence
  Description of Artificial Sequence: Synthetic coding sequence
atgatcctgaacaaggccctgatgctgggcgccctggccctgaccacagtgatgtctccatgcgggggtgaagatattgtcgccgatcatgtggccagctacggcgtaaatctctatcagagctatggaccctccgggcagtttacgcacgagttcgatggggatgaggagttttacgttgacttggaacgtaaggagaccgtatggaaactgccattgtttcatcggttgcgctttgaccctcaatttgccctgaccaatatagcggttctcaaacacaacctgaatatcctgattaagcgtagcaattctactgctgcgaccaatgaggtccctgaagtgaccgtcttttcaaagtcacctgttacgctgggccaacccaacacccttatttgtttagtcgataatatctttccacctgtggtcaacattacatggctctcgaacggtcacagtgttacagaaggcgtcagcgagacaagttttttaagcaagagtgaccactcattctttaagattagttatctcacctttttgccgagtgctgacgagatctatgactgtaaggtggagcactggggtcttgatgagccactgctgaagcattgggagccagaaatacctgccccaatgagtgagcttaccgagacagtggtttgcgctctcggcctatcagttggtcttgtgggcatcgtcgtggggaccgtgctgatcatcagaggactgcggagtgttggggccagtagacaccaggggccattgtag

SEQ ID NO: 193958 - DNA, 765 bp, Artificial Sequence
  Description of Artificial Sequence: Synthetic coding sequence
atgatcctgaacaaggccctgatgctgggcgccctggccctgaccactgtgatgtcgccatgcggaggggaggatattgtggccgatcacgttgccagctatggggtgaatttataccaatcctatgggccatccggccagttcacacacgaattcgatggcgacgaggagttttatgtcgacctcgaacgcaaagagactgtgtggaagctgccgctgtttcatagactgaggtttgatccacagtttgccttgaccaacattgctgttctcaagcacaatctgaatatactcatcaagagatcaaacagcactgcggctaccaacgaggttccagaagtgacggtattttcaaagagcccagttaccttgggccagccgaacaccctgatatgtctggtggataacatcttcccacctgtggtgaatataacctggttaagcaatggtcacagcgtgactgaaggagtgagtgaaacttcattcctaagcaagtctgaccactctttcttcaaaatcagctacctcaccttcctgccgtccgcagacgaaatttacgattgtaaagtggagcactggggtctggacgagcctctgcttaaacattgggaacctgaaatccccgcccctatgagcgagttgactgaaactgttgtgtgcgcactgggtttgagcgttggccttgtgggaattgtcgtgggtactgtgctgatcattagggggctgcgcagtgttggagcatccagacaccagggccctctgtag

SEQ ID NO: 193959 - DNA, 768 bp, Artificial Sequence
  Description of Artificial Sequence: Synthetic coding sequence
atgatcctgaacaaggccctgatgctgggcgccctggccctgaccaccgtgatgtctccatgtggtggcgaggacatcgttgcagatcacgtagcttcttacggcgtcaatctctatcagagctacggaccgagcggacaatactctcacgaatttgacggtgatgaggaattctatgttgacctcgaacgtaaggagacagtatggcaactgccactgttccgccggtttagacggttcgatcctcaattcgctcttacaaacatcgcggtactgaaacataatctcaatatcgttataaaacggtccaactctacagcagccactaatgaggtcccggaagtgacagtgttcagcaaatcccctgtgactcttggacagccaaacaccctcatctgtttagttgataatatatttccacccgtggtgaatatcacatggctgtcaaacggacactcagtgaccgagggggtgtctgagacctcttttctgtccaagtctgatcattcgtttttcaagataagctacttaactttcctaccgtccgcggatgagatatatgattgtaaagtcgagcactggggactcgacgagccgctgttaaagcattgggagccagaaatccccactccgatgtcggaacttacggagacggtggtgtgcgcactaggactctcagtgggattggtgggcatagttgtggggactgtcctgataatcaggggcctgaggagcgtgggggccagtagacatcaggggcccttatag

SEQ ID NO: 193960 - DNA, 75 bp, Artificial Sequence
  Description of Artificial Sequence: Synthetic coding sequence
atgatcctgaacaaggccctgatgctgggcgccctggccctgaccacagtcatgtctccatgcggcggtgaatag

SEQ ID NO: 193961 - DNA, 75 bp, Artificial Sequence
  Description of Artificial Sequence: Synthetic coding sequence
atgatcctgaacaaggccctgatgctgggcgccctggccctgaccactgtgatgtccccctgtgggggtgagtag

SEQ ID NO: 193962 - DNA, 768 bp, Artificial Sequence
  Description of Artificial Sequence: Synthetic coding sequence
atgatcctgaacaaggccctgatgctgggcgccctggccctgaccacggtgatgtctccatgtgggggggaggatatcgtggctgatcacgtggccagttatggtgtgaacctgtaccagagttatgggccatctggccaatacagccacgaatttgatggcgatgaagaattttatgtagacctcgaaaggaaggagaccgtgtggcaactgccattgtttaggcggtttcgtagatttgacccacagttcgcgctcaccaacatagcagtcttaaagcacaatcttaacattgtaatcaagagaagcaatagtaccgccgcgaccaatgaggtgcctgaagttacggttttcagtaaatcaccagtgactctcggacagcccaacacacttatttgtttagttgataacattttccctcctgtggttaatatcacttggctctccaatggtcatagcgtgaccgagggagtctccgagacctccttcctgtcaaagtccgaccatagctttttcaagatctcttacctgactttccttccaagtgacgacgaaatctacgactgtaaggtggaacactggggtctggacgaaccacttctcaagcattgggagcctgaaattccgacccctatgtcggaactgactgaaacggtcgtctgtgctctgggactatctgtgggacttgtcggcattgtggtcggcacagtcttgattatacggggtctaagatctgttggtgcctcacgacatcaaggtccattatag

SEQ ID NO: 193963 - DNA, 765 bp, Artificial Sequence
  Description of Artificial Sequence: Synthetic coding sequence
atgatcctgaacaaggccctgatgctgggcgccctggccctgaccacagtgatgtccccctgcgggggcgaagatatagtggcagatcacgtggcaagctacggcgtaaacctgtaccagagctacggaccctctggacagttcacccatgagtttgatggtgacgaagaattttacgtggacctggagcggaaggagacggtgtggaaactaccattgttccaccgtctcaggttcgatcctcagttcgccctgactaacatagctgtgctcaagcacaatttgaacatcttgatcaaaagaagtaactcgacagccgccaccaatgaggtgcccgaagtcaccgtctttagcaagtcaccagtgaccttaggacagccaaataccctgatctgtctggtcgacaatatttttccgccagttgtcaacattacctggttgtctaacgggcactctgtgactgagggagtgagtgagacaagttttcttagcaaaagcgatcacagtttttttaagataagctacttaacatttctccccagtgcggacgagatctacgattgtaaagtcgagcactggggactagacgaaccgcttcttaaacattgggagcccgagataccggctccaatgtcagagctcacagaaacagtggtctgcgctctgggcttgtctgtcgggctcgtgggtattgtcgtggggacagtgctgatcatccgcgggctgcgctcagtaggggcgtctaggcatcagggtcccctatag

SEQ ID NO: 193964 - DNA, 765 bp, Artificial Sequence
  Description of Artificial Sequence: Synthetic coding sequence
atgatcctgaacaaggccctgatgctgggcgccctggccctgaccaccgtcatgagtccatgcggaggggaggacatcgtggcagaccatgtggcatcatacggggtgaacctctatcagtcgtatgggccgagtgggcagttcacacatgagttcgatggcgacgaggaattttacgtagatctcgaaaggaaggaaacggtttggaaattgcctctctttcatagactgaggtttgaccctcaatttgccctgacgaacatagccgtgctgaaacataatttgaatatattaatcaagaggagcaactctaccgcagccaccaacgaggtccccgaggtgaccgtgttttctaagagcccagtgaccctgggtcagccaaataccctcatctgtctcgtggataacattttccccccagttgttaatatcacatggctctctaatggacacagtgtcacagagggagtctccgagacttcctttttatcgaaaagcgatcattccttttttaaaataagctatcttacctttctcccctctgccgatgaaatttacgattgtaaagtggaacactggggcctggatgagcctttactgaagcactgggagcccgaaatccctgccccaatgagcgagctcacagaaactgtggtgtgcgccctggggctatccgtcgggctggtggggattgtggttgggactgtcttgattatcaggggcctccggtccgtgggcgctagtcgacaccaaggtcctttatag

SEQ ID NO: 193965 - DNA, 765 bp, Artificial Sequence
  Description of Artificial Sequence: Synthetic coding sequence
atgatcctgaacaaggccctgatgctgggcgccctggccctgaccaccgttatgtccccgtgcggaggggaggatattgtcgcggaccacgtggcttcttatggagttaatctgtatcagtcttatggacccagcggccaattcacgcatgaattcgatggggatgaagagttttatgtggacctggaacgcaaagagacggtgtggaaactcccgttgttccaccgcctgaggttcgacccacaatttgccttgactaatatagctgtgctaaagcataatttaaatatactaatcaagaggtcgaactccactgccgcaacaaatgaggtcccagaagtgacagtgttttccaagtcacccgtcaccttaggacagccaaacacactgatctgcttagtggataacatttttccgcccgttgtcaatatcacctggctgtccaatgggcacagcgttactgagggagtgtccgaaacctcattcctgagtaaatcagaccactcgtttttcaagattagctacctcaccttcttaccatctgccgatgaaatatatgattgcaaagtggagcactggggcctggatgaacctttgctgaagcactgggaacccgaaatccctgcgcccatgtctgagctgacagagactgttgtgtgcgcactgggtctttctgtcggactcgttgggattgtggtcggaacagtgctgatcatcagaggcctgcgtagtgtgggggctagtcggcatcagggcccgttatag

SEQ ID NO: 193966 - DNA, 768 bp, Artificial Sequence
  Description of Artificial Sequence: Synthetic coding sequence
atgatcctgaacaaggccctgatgctgggcgccctggccctgaccaccgtgatgtccccgtgtggcggcgaagatattgttgccgatcacgtggcttcgtatggggtgaacctttaccagtcatacggaccatcagggcagtactcccatgagtttgatggggatgaagaattctatgtggacctcgaaagaaaggagaccgtttggcagctgcccctgttcagacggtttagacgcttcgatcctcaattcgccctgactaatatcgcagtcttgaaacacaacctgaatattgtgatcaagagaagcaactctacagccgcaacaaatgaggtgccggaggtgacagtatttagcaagagccccgtgaccctgggacaacctaacacacttatatgccttgtcgacaacatcttcccaccggtcgtgaacattacttggttatcgaacggccactctgttactgagggcgtatcagagacctctttcttatcgaaatccgaccactcgtttttcaaaatcagctacctgacttttctgcctagcgacgatgagatatatgactgtaaggtggagcactggggactcgatgaaccgctcctcaaacattgggagccagagattccgacccccatgtccgagctgacagaaaccgtcgtttgtgcgctaggactgagcgttggcctggtgggcatcgtggtgggcacagtgctgatcatacgaggtcttcgaagtgttggcgcctcccggcatcagggtcccctctag

SEQ ID NO: 193967 - DNA, 765 bp, Artificial Sequence
  Description of Artificial Sequence: Synthetic coding sequence
atgatcctgaacaaggccctgatgctgggcgccctggccctgaccactgtgatgtctccatgtggaggggaagatatcgtcgctgatcatgtggcttcctatggggtcaatttgtatcaatcctacggcccctcgggacagttcacccacgaatttgatggagacgaggaattctatgtcgatctggagcgcaaggagacggtatggaagttgccgctcttccacaggctgcggtttgacccccagtttgcgcttactaacattgccgtcctcaaacacaacctcaatatcctgattaaacgcagtaactctaccgcagctaccaacgaagtcccagaagttaccgtgttctccaagtcacctgtgaccttaggtcagccgaacaccctaatctgcctggtggacaacattttccccccagtcgttaacattacttggctttctaatggccactccgtcacagaaggagtgagcgagaccagttttttgtctaaatccgaccactcgttcttcaagataagctatctaacatttctgccttccgcagacgaaatatacgactgtaaggtagaacactggggcctagatgaaccactgctaaaacactgggagcccgagatccccgcacctatgtccgagttgactgagactgtggtttgtgcactgggcttatcagtgggtttagttgggatagtggttggtaccgtgctaataatccgtggtctgaggtctgtgggggccagtagacaccagggacctttgtag

SEQ ID NO: 193968 - DNA, 645 bp, Artificial Sequence
  Description of Artificial Sequence: Synthetic coding sequence
atgatcctgaacaaggccctgctgctgggcgccctggccctgaccactgtaatgtccccttgtggtggtgaagatatagttgccgatcatgttgcgtcctgtggcgtgaacctttatcagttctacggtccctccggacagtacacacacgagtttgatggggatgaacaattttatgtggacctagaacggaaagagactgcatggagatggcctgaatttagcaagttcggcggctttgatccgcagggtgccctgcgcaatatggcagtggctaaacataacctgaatatcatgatcaagagatataactccacagctgccactaatgaggtccccgaagttaccgtgtttagcaaatctcctgttacccttgggcagcccaatacactgatctgtcttgtggataacatcttcccccccgttgtaaacatcacctggctctcaaacggtcagtcggttactgagggggttagcgagaccagtttcctgagtaaaagcgaccacagctttttcaagatctcatacctcacctttttaccaagtgctgatgagatctacgactgtaaggtggaacattggggccttgaccagccactgctgaagcattggggggcatccccatctaccggtgcagaagagtag

SEQ ID NO: 193969 - DNA, 576 bp, Artificial Sequence
  Description of Artificial Sequence: Synthetic coding sequence
atgagcccctgcggcggcgaggacatcgtggccgaccacgtggccagctatggagtcaatttgtatcaaagctacgggcccagtggacagtatagccatgagttcgacggagacgaggaattttacgttgacctggagaggaaggagactgtgtggcagctgcccttgtttcgtcgcttcaggcggtttgatccgcagttcgccctcaccaacatagcggttcttaaacataatctgaatattgtaataaagcgtagcaatagcacagctgcaacaaacgaagtcccggaggtgaccgtgttcagcaagtcgcccgtgactctgggccagcccaacactctcatctgcttggtggacaatatcttccctccagtcgtcaacattacctggttaagtaatggacactctgtgaccgaaggtgtttcagagacttctttcctgagcaaatccgaccattctttcttcaagatcagctacttaacctttctgccctcagcggacgagatatacgattgtaaggtggagcactggggactggacgagcctcttctcaaacattggggtttactccactag

SEQ ID NO: 193970 - DNA, 441 bp, Artificial Sequence
  Description of Artificial Sequence: Synthetic coding sequence
atgatcctgaacaaggccctgatgctgggcgccctggccctgaccaccgtcatgagcccgtgtggcggggaggatattgtcgcagatcatgtggcatcctatggtgtgaatctttaccagtcctatggacctagcggacagtatacccacgaattcgacggcgatgagcagttttacgtcgatttgggtcggaaagagactgtgtggtgcttgcccgtgctgagacagtttcggttcgaccctcagtttgctcttacaaacatgtgcatcgcaatctataggtctagaagagttgatcttctgcacgacctcgctctattcagtggcccaatctaccacatcccgtttctactgcagatgtttcttctctccccactgctttgggacctcaattgttatatttgctcagaacttaccaatgcgtttgagctttttccctag

SEQ ID NO: 193971 - DNA, 762 bp, Artificial Sequence
  Description of Artificial Sequence: Synthetic coding sequence
ggctgcctgggcaagcggatgatcctgaacaaggccctgatgctgggggctctcgctcttactactgtcatgtccccttgtggaggggaggacatagtggctgatcatgtggcatcttacggagtgaacttataccaaagctacggcccttccggacagtatacccacgaattcgacggagacgaacaattttacgtcgatttggggaggaaggaaacagtatggtgcctccctgtgttgcgacagttcaggtttgaccctcagttcgcccttaccaacatcgccgttttgaaacacaaccttaattctctaatcaagcgttcgaattcaacagctgccacgaacgaagtgccagaagtgactgtttttagtaagagccccgtgaccctgggccagcctaatatactgatttgcctggtggataatatcttcccacctgtggttaatataacatggttgagtaacggccattcagtaaccgaaggtgtttccgagactagctttctgagtaagtcagaccatagtttttttaaaattagttatctgaccctcctgcccagtgcggaggaatcctatgattgtaaggtggagcactggggcctcgacaagcccctgcttaagcactggggtaaagacgaatttcaccattttctgatgctgagctgtctgagcagtagcgagctccctgctttttatagctacatcccgaaacttgtattccatacttcatgggtgagcttcttcctcattttcttcttttag

SEQ ID NO: 193972 - DNA, 603 bp, Artificial Sequence
  Description of Artificial Sequence: Synthetic coding sequence
atgagcccctgcggcggcgaggacatcgtggccgaccacgtggccagctatggagtgaatctgtatcagtcgtacggtccatcaggacagtattcccacgagtttgacggcgacgaggagttttatgtcgatcttgagcggaaagagacagtctggcagctgcctctgttccgaaggtttagaaggttcgatccccagtttgccctcacgaacatcgccgtattgaaacataatctcaatatcgtcattaagcggagtaacagcacagcagcaacaaacgaagtgcctgaagtgacagtgttcagcaaatccccagttaccctcggacaacctaacacacttatttgtcttgtggacaatatcttccctcccgtggtgaacattacgtggctgtccaatggccatagcgtgaccgaaggcgtaagcgagacctctttccttagcaagtctgatcactctttctttaagatctcatacctaacctttctgcctagcgccgatgagatttatgattgtaaagtcgagcactggggcctggacgaacctctgctcaaacactgggaatcacagtcacgtgaatctgaggagtcaacgaaaagctag

SEQ ID NO: 193973 - DNA, 582 bp, Artificial Sequence
  Description of Artificial Sequence: Synthetic coding sequence
atgagcccctgcggcggcgaggacatcgtggccgaccacgtggcctcctacggcgtgaatctctaccagtcttatgggccatccgggcagtacacccatgagttcgacggagatgagcagttctatgtggacttgggaaggaaagagaccgtctggtgtttgcccgtgctccgacaatttaggtttgacccgcaatttgctctgaccaatattgccgtgctcaaacacaaccttaattccctgatcaagcgatcaaacagcaccgccgccacaaatgaggtgccagaagtgaccgtgttcagtaagagccccgtgaccttggggcaacccaacattctgatctgcctggtggataacattttcccacccgtcgtgaacataacttggttgtctaatggccattccgtcaccgagggcgtttcagaaacctccttccttagcaagagcgatcatagtttcttcaaaatttcctatcttacactcctgcctagtgcagaggaatcctacgactgtaaagtggagcactggggcctcgataagcccttgctaaagcactgggttcacgggtttttatcattctag

SEQ ID NO: 193974 - DNA, 606 bp, Artificial Sequence
  Description of Artificial Sequence: Synthetic coding sequence
atgagcccctgcggcggcgaggacatcgtggccgaccacgtggccagctatggcgttaatctataccagagctacggcccatccggtcagtactcccacgaatttgatggcgatgaggagttctatgtcgacttggaacgcaaagagactgtgtggcagctgcctctattccggcgttttagaagatttgatccacagttcgcccttactaatatcgcagtgctaaaacataacctgaacatcgtgatcaaacgaagcaactctactgcggccacgaatgaggttcccgaagttactgtgttcagtaaatctcccgtgaccttgggacaaccaaacaccctcatctgtcttgtagataacatctttcctcccgttgtaaacatcacctggctcagcaacgggcatagcgtgactgaaggagttagtgagacctcatttctttctaaatccgatcattcatttttcaaaatcagttatctcactttcctgcccagcgcggatgagatttatgactgcaaagtcgaacactggggattggatgaacccctgctaaaacactgggggatacaagccgaagagggccagaggcggaaaaagctgggctag

SEQ ID NO: 193975 - DNA, 258 bp, Artificial Sequence
  Description of Artificial Sequence: Synthetic coding sequence
aacaccctgatctgcctggtggacaacatcttcccccccgtggtgaacattacctggctgagtaacggccacagcgtaacagaaggtgtctctgagacgtcctttctttccaagagtgatcacagttttttcaaaataagttatcttacgtttcttccatctgctgacgaaatttacgattgcaaggttgagcactgggggctagacgagccattgttaaagcactgggggaaggactttatgtccttcttctactag

SEQ ID NO: 193976 - DNA, 390 bp, Artificial Sequence
  Description of Artificial Sequence: Synthetic coding sequence
ggctgcctgggcaagcggatgatcctgaacaaggccctgatgctgggtgccttggccctgaccacggttatgagcccctgcggcggcgaggacatagttgcagatcacgtggccagttatggggtaaacctgtatcaatcatacggaccttcaggtcaatacagccatgaatttgatggggatgaggaattctatgtggatctagaaagaaaagagactgtttggcagctgcccctgttccgcagattccggcgctttgacccacagttcgccctgacaaacatcgcagttctgaaacataacctgaatatagtaataaagaggtctaattccacagcagcaaccaatgaagtgccagaggtgaccgtcttttcaaagtccccagtctag

SEQ ID NO: 193977 - DNA, 768 bp, Artificial Sequence
  Description of Artificial Sequence: Synthetic coding sequence
atgatcctgaacaaggccctgctgctgggcgccctggccctgaccgctgttatgagcccgtgcggcggtgaggatattgtagccgaccatgtggccagctacggggtgaacttttatcagagccatggtccttccggccagtatacccacgaattcgatggggatgaggagttttacgttgacttggagacaaaggaaactgtatggcaattgcccatgttttctaagttcataagtttcgacccccagagtgcactcaggaatatggccgtgggaaagcacaccttggagtttatgatgagacagagcaatagcacagctgctactaatgaagtgcctgaggtgacagtgttcagcaagttccccgtgaccctcggccagccgaacaccttgatttgcttggtggacaatattttccctccagtggtgaacataacatggttgtctaatggacattctgttaccgaaggcgtgagcgagacgtctttcttgtcaaagtctgaccactccttctttaaaattagttacttaacatttctgcctagcgccgacgaaatttacgactgtaaagtggagcactggggcctggatgagcctttgctcaaacactgggagccagagatcccagccccaatgagcgaacttacagaaacactggtctgtgccctcggcctaagcgttgggctgatggggattgtggtggggactgtgttcatcattcagggtctgcggtccgttgacgcaagtcgccaccaaggtctgctgtag

SEQ ID NO: 193978 - DNA, 768 bp, Artificial Sequence
  Description of Artificial Sequence: Synthetic coding sequence
atgatcctgaacaaggccctgctgctgggcgccctggccctgaccgctgtcatgagcccctgcgggggtgaagacattgttgccgatcacgtcgcatcctacggggttaacttttatcaatcgcatggtccgtccgggcagtatacacatgaatttgacggggacgaggagttctatgtggacttggagacgaaggaaactgtgtggcagctccctatgttttccaaattcatctccttcgacccccagtcggctcttaggaacatggccgtgggtaaacacacgctggaattcatgatgaggcagtcaaattcaactgccgcaactaacgaggtaccagaggtcactgtgttcagtaagttcccagtcacgttgggacagcccaacactctgatctgcctcgtagataatatttttcctccagtggtgaatattacttggctctctaacggccactctgtgacagagggggtctcggaaacatcctttctcagcaaatctgatcatagttttttcaaaatttcttacctcacttttctcccgtctgccgacgaaatatatgattgtaaggtggaacactggggtctcgatgaacctctgttgaagcactgggagcccgaaatacctgctccaatgagcgagttgactgaaactctcgtctgtgcactcggcctgtctgtcgggctcatgggcatcgtggttggaactgtgtttatcatccaaggcctaaggtctgtcggggccagcaggcatcaggggctcttgtag

SEQ ID NO: 193979 - DNA, 768 bp, Artificial Sequence
  Description of Artificial Sequence: Synthetic coding sequence
atgatcctgaacaaggccctgctgctgggcgccctggccctgaccgcagtgatgtccccgtgtggaggtgaggatatcgtggccgaccatgtggcttcttatggcgtgaacttctaccaatcccatggcccctcaggtcaatatactcacgaatttgacggcgacgaggagttctatgtggacctcgagacaaaagaaactgtttggcagttgcccatgttttctaagttcatcagcttcgatccacagtctgcacttcggaacatggctgttgggaaacacacgctggaattcatgatggggcagtctaactctacagctgctacaaacgaggtcccagaggtgacagtattcagcaagttccccgtgacccttggacagcctaataccctaatctgtcttgtcgataacattttccccccagtagtaaacatcacctggctgtctaatggccactccgttaccgagggcgtgtccgaaacctcattcctgtcaaagtcagaccattcattttttaagatttcgtacctgacgtttttacctagcgcggatgagatatacgactgtaaggtcgaacattgggggctcgatgagcctctcctgaagcactgggaaccagagattccagctcctatgagcgaactgacagaaacgctcgtgtgcgcgcttgggctgtcagtgggcttgatgggcatcgtcgttgggacggtatttatcattcagggcctgcgttcagtcggtgcgtctcggcaccagggccttctctag

SEQ ID NO: 193980 - DNA, 768 bp, Artificial Sequence
  Description of Artificial Sequence: Synthetic coding sequence
atgatcctgaacaaggccctgctgctgggcgccctggccctgaccgccgttatgagtccttgcgggggcgaagatatcgtggccgatcacgtggcctcatacggcgttaatttctatcagtcccatggcccatccggacagtacacccatgagtttgatggcgacgaagaattttatgtggatttagaaactaaagagactgtttggcaacttccaatgttcagtaagtttatctcatttgacccacagtccgcgctaaggaacatggccgtagggaaacacactcttgaattcatgatgcggcaatcaaatagcacagctgcgacaaacgaggtaccagaggttaccgtgttctcaaaatttccggtgaccctcggtcagcctaacacattgatctgcctggtggacaacatctttcctccagtagtgaatattacttggctcagcaacgggcacagcgtgaccgaaggcgtctccgaaacgtcattcctgagcaagtcggatcattccttttttaaaatttcatacctaacatttcttccttctgccgatgagatctatgactgtaaagtcgaacattggggattggacgagccccttctcaaacattgggagcccgagatccccgcacccatgtctgagctcactgagactttggtgtgcgctctgggcctcagcgtgggactaatgggcatcgtcgtggggaccgtgtttatcatccagggcctacgctccgtcggagcgtcccgacatcaggggctactctag

SEQ ID NO: 193981 - DNA, 768 bp, Artificial Sequence
  Description of Artificial Sequence: Synthetic coding sequence
atgatcctgaacaaggccctgctgctgggcgccctggccctgaccgccgtgatgagtccctgcggcggcgaggatattgtggctgatcatgtcgccagttatggcgtgaatttctaccagtcacacggcccatccggccagtatactcatgagttcgatggggacgaggagttttacgtggatctggagaccaaggagactgtgtggcagctacctatgttcagtaaattcattagttttgatcctcaaagcgctctacgcaatatggcagtggggaagcacacactcgagttcatgatgcgccagtcaaattccacagctgcaacaaacgaggtgccagaggtgacagtgtttagcaaatttcccgtgactctgggacagcctaacaccctgatatgtctggtcgataatatcttcccgcccgtggtcaatatcacttggctgtcaaatgggcattccgtgactgagggcgtgagtgaaaccagttttctgagcaaatccgaccattccttctttaaaatatcgtacctgactttcttaccaagcgccgatgaaatctatgactgtaaggtagagcactggggactggatgagcccctcctcaagcactgggaacccgaaatccccgcccctatgtccgagttgactgaaactcttgtctgcgcccttggcctttccgcgggactgatgggaatcgtggttggtacagtattcattattcagggacttagatcagttggcgccagccgtcaccagggcctactgtag

SEQ ID NO: 193982 - DNA, 768 bp, Artificial Sequence
  Description of Artificial Sequence: Synthetic coding sequence
atgatcctgaacaaggccctgctgctgggcgccctggccctgaccgcagtcatgtctccctgcggcggagaagatattgtggcagatcacgttgcttcttatggcgtgaacttttaccagtctcatgggccatctggccagtacactcacgaatttgacggcgatgaagaattctacgtcgacttggagactaaggaaacggtctggcaactgccaatgttttctaagttcattagttttgaccctcagtcagcattgcgcaacatggcggtcggtaaacacactctggaattcatgatgagacagtcaaactccacggctgctaccaacgaggtgccagaggttaccgtgtttagcaaatttcccgtcacacttggtcagcctaacaccctcatctgcctggtcgataatatatttccccccgttgtcaatattacatggctgtccaacgggcactcagtgacagagggagtaagtgagacatccttcctctctaagagtgatcattccttttttaagatctcctaccttacatttctcccctccgccgatgaaatctatgactgtaaggtcgaacactggggcctcgacgaaccgctactgaagcattgggagccggagatcccagctcccatgtctgaattgacagagactttggtctgtgcacttggtctgtctgtggggctgatgggaatcgtcgtgggcaccgtgtttatcatccaggggcttcggtctgtcggagcaagtaggcaccagggtcttctatag

SEQ ID NO: 193983 - DNA, 768 bp, Artificial Sequence
  Description of Artificial Sequence: Synthetic coding sequence
atgatcctgaacaaggccctgctgctgggcgccctggccctgaccgccgtgatgtccccctgcggcggggaggacatcgtggcggaccacgttgcctcctacggcgtgaatttttaccagtctcacgggccttccggccagtacacacacgaattcgatggagacgaagaattttacgtggacctggaaacaaaggagacggtgtggcaattgcccatgttctccaaatttattagtttcgacccgcaatcagctctgagaaatatggcggttggcaaacacactcttgaatttatgatgagacagagtaatagcaccgccgcgaccaatgaggtgccggaggtcactgtttttagtaagttccctgttactttaggacagcccaatactctgatctgccttgtcgacaacatctttccacccgtagtgaatatcacatggctgtctaatggacattccgtcacagagggagtgagcgagacttccttcctatctaagtccgatcattctttttttaagataagttacctcacattcctgcccagcgcagacgaaatttacgattgcaaggtcgaacactggggtctcgacgaacccttacttaaacattgggaacctgaaatacctgctccaatgtctgaactcacggagactctggtatgtgcacttggtctaagtgtagggcttatgggtattgtggtgggcaccgtgtttattattcaggggttgcgatcggtcggcgcaagcagacaccagggtctgttgtag

SEQ ID NO: 193984 - DNA, 768 bp, Artificial Sequence
  Description of Artificial Sequence: Synthetic coding sequence
atgatcctgaacaaggccctgctgctgggcgccctggccctgaccgccgtgatgagcccctgcggcggtgaggacatcgtagccgaccatgtggctagctatggagtaaacttctaccaaagtcacggcccttccggccagtacacccatgaatttgatggagatgaggagttttacgtggacctggagaccaaggagacagtctggcaacttccgatgttctcaaaatttatcagctttgatccccaatcagctctaagaaatatggcagttggaaagcacaccctagagttcatgatgagacagtcaaatagcaccgccgctacgaatgaggtacccgaagtcacggtatttagcaaattcccggtgactctggggcaaccaaacactctcatctgcttggtagacaatatctttcctcccgtggtgaatattacctggctctctaatgggcattccgtgaccgaaggcgtgagcgagacctcattcctgtcgaaaagcgaccattcctttttcaagatatcttacctgacatttttacccagcgctgatgagatctacgattgtaaggtggaacactggggcctggatgagcccctcctaaagcattgggagcctgaaatccccgccccaatgtcagaactgacggagacccttgtgtgcgccctcgggttgtctgccggactcatgggaattgtggttggaacagtgttcataatccagggcctccggtctgtcggcgcctctagacatcagggcctgctgtag

SEQ ID NO: 193985 - DNA, 768 bp, Artificial Sequence
  Description of Artificial Sequence: Synthetic coding sequence
atgatcctgaacaaggccctgctgctgggcgccctggccctgaccgccgtaatgtccccttgtgggggggaggacatcgtggcagaccatgtcgcttcttatggagtcaatttctatcagtcacacgggcccagcgggcagtatacacacgaattcgatggggatgaggagttctacgtggatctggaaactaaggagacggtttggcagttacccatgttttcgaagtttattagtttcgacccccagtccgcactgcgaaacatggcggtcggtaagcacacattggagttcatgatgagacaatctaattctactgccgcaaccaatgaagttccggaggttacagtgtttagcaagtttcccgtgacccttggccagcctaacacactgatttgtctcgtggataacatttttccacctgtagttaacataacttggctcagcaatggacattcagtgacggaaggcgtgagtgagacgtctttcctgtccaaatcagatcactcatttttcaagatcagctacctgacgttcctcccctccgctgacgagatttacgactgcaaggtcgaacattggggcctcgatgaacccctgttgaagcactgggaacccgagatccctgccccaatgagtgaacttaccgagactctggtgtgtgcgcttgggctatctgttgggctgatggggattgtagttggaacggtgttcataatacagggcctgaggagtgtgggcgcatctaggcaccagggcttgttgtag

SEQ ID NO: 193986 - DNA, 249 bp, Artificial Sequence
  Description of Artificial Sequence: Synthetic coding sequence
gaccacgtggccagctacggcgtgaacttctaccagagccacggcccgtccggacagtacacgcatgagtttgacggcgacgaagagttctatgttgatctggagaccaaggagacggtgtggcagctgccaatgttttccaaattcataagcttcgacccccagtctgcactacgcaacatggccgtcggaaaacacacactggagttcatgatgagacaatctaattctacggccgccaccaattag

SEQ ID NO: 193987 - DNA, 768 bp, Artificial Sequence
  Description of Artificial Sequence: Synthetic coding sequence
atgatcctgaacaaggccctgctgctgggcgccctggccctgaccgccgtgatgtccccttgcgggggagaggatattgtcgccgatcacgttgcttcttatggggtgaacttctaccagagccatggtcccagcggccagtacacccacgagtttgacggcgatgaggagttttatgtggacttggaaacaaaagaaaccgtgtggcagctgcccatgttcagtaaatttatctctttcgatccccagtcagccctcaggaatatggcagtaggtaagcacacactggagttcatgatgaggcagtccaatagtaccgctgcaactaatgaagtgcctgaggtgacagtgtttagcaagttcccagtgacactcgggcagccgaacacactgatttgcctggtggataatatctttccccctgtggtcaacataacttggctttcgaacggccacagcgtaactgaaggcgtttctgaaacaagcttcctcagcaagtccgaccacagtttcttcaagatctcatatctcacattcctgccgtccgccgacgaaatttatgattgtaaagttgagcattggggcctcgatgagccattacttaaacattgggaaccagagatccctgctcctatgtctgaattaacggaaactcttgtctgtgccttgggtctgagtgttggcttgatggggatcgtcgtgggaaccgtgttcatcatacaaggacttcgctcagtgggggcctccaggcatcaggggctgctctag

SEQ ID NO: 193988 - DNA, 84 bp, Artificial Sequence
  Description of Artificial Sequence: Synthetic coding sequence
atgatcctgaacaaggccctgctgctgggcgccctggccctgaccgctgttatgagtccatgcggcggcgaagacattgtttag

SEQ ID NO: 193989 - DNA, 810 bp, Artificial Sequence
  Description of Artificial Sequence: Synthetic coding sequence
atgagctggaagaaggccctgcggatccccggcgacctgcgggtggcgactgttactctgatgctcgccatgttgtcatctttgcttgccgagggccgggatagccctgaggattttgtttttcaatttaaaggaatgtgctacttcacaaacggcactgagcgcgttaggctggtgacacgatatatctacaacagagaggagtacgcgcgtttcgactccgacgtgggagtttaccgggccgtgaccccacagggaaggcccgacgccgagtactggaacagccagaaggaggtgcttgaggggaccagagccgagctcgacaccgtgtgtcggcacaattatgaagtggcgtttagaggcattttacaaagacgagtcgagcctaccgttaccattagtcctagccgaacagaggctttgaaccaccacaacttgctggtgtgctctgtcaccgatttctaccctgggcagataaaggtacgatggtttagaaacgaccaggaggagaccgcgggggtggtgagtacacctttgatacggaacggtgactggacgttccaaattctggtgatgctggagatgacaccacagaggggcgatgtgtacacctgtcacgttgaacatccatctctccaatctccaatcaccgtggagtggagggcacaatctgagtcagctcaatccaagatgttaagcggcgtgggcgggtttgtcctgggactgatctttctgggcttaggattgatcataagacagcgctcgcagaaaggccctcagggcccaccgccggcgggactgctgcactag

SEQ ID NO: 193990 - DNA, 786 bp, Artificial Sequence
  Description of Artificial Sequence: Synthetic coding sequence
atgagctggaagaaggccctgcggatccccggcggcctgcgggccgcaaccgtgactttgatgttaagtatgctatctacccctgtggcagaaggaagggatagtcccgaggatttcgtctatcagttcaagggaatgtgttactttactaacggcacagagcgcgtgaggctggtctcgcgttccatctataacagagaggagatcgtgagattcgatagcgatgtgggcgagttcagagcggtaacgttgctcgggctgcccgccgcggaatactggaattcccagaaagatatccttgagcggaaaagggccgcagtggaccgcgtgtgcagacacaattaccaactggagctccggacaacgctgcagaggagggtggagcctactgtgacgattagtccaagtcgcaccgaagccttgaatcaccacaacctcttggtgtgttcggtaaccgacttttatcccgcgcagataaaggtacggtggtttaggaatgaccaggaagaaaccgccggcgtggtatcgacacccctgatcaggaacggagattggaccttccaaatcctggttatgctggagatgactcctcagcgtggcgatgtgtatacttgtcacgtggagcacccgagcctgcagtcgccaatcacggtggaatggagagcccaatctgagagtgcccaaagcaaaatgctgtccggcattggcggttttgtgttgggcttgattttcctcgggctaggtctcatcatacaccatagaagtcagaaagggttgctgcactag

SEQ ID NO: 193991 - DNA, 786 bp, Artificial Sequence
  Description of Artificial Sequence: Synthetic coding sequence
atgagctggaagaaggccctgcggatccccggcggcctgcgggccgcaactgttacgctgatgcttagtatgctctcaacgcccgttgccgagggaagagacagcccagaggatttcgtttaccagttcaaggggatgtgctatttcacaaacggcacagaaagggtgcggctcgtgagccgctccatatacaacagggaggagatcgtgagattcgacagtgatgtcggggaatttagagctgtgaccttgttgggactgcctgccgccgagtattggaatagccagaaggatatcctggaacgcaagcgagctgccgttgatcgggtttgccggcataattaccaattagaattaaggacgacgctccagaggcgggttgagcctactgtcaccatcagccccagcaggacagaagcactgaaccaccataacttgctggtctgctctgttaccgatttttatcctgcacagattaaagtgcggtggttcaggaacgatcaggaggagactgcgggcgttgttagtacccctctgatccgtaacggcgactggacatttcaaattctggtgatgttagaaatgacaccccagcgtggagatgtgtacacctgccacgtcgaacaccccagtctgcaatcgcctattacagtggaatggcgtgcccagtccgaatctgcccagtctaagatgctgtccggtattgggggctttgtgctgggcctgattttcctgggcctcgggctcattattcaccacagatcgcagaagggtctgctacattag

SEQ ID NO: 193992 - DNA, 810 bp, Artificial Sequence
  Description of Artificial Sequence: Synthetic coding sequence
atgagctggaagaaggccctgcggatccccggcggcctgcgggccgcaaccgtgactctcatgctcgcaatgcttagtacccctgttgccgagggccgagattctcctgaagattttgtttatcaattcaaagccatgtgttattttactaatggaaccgagagagtgagatatgtgactcgctacatctataacagggaggaatacgctcgttttgatagcgacgtagaagtttaccgtgccgtcacaccactcggtcctccagatgcagagtactggaattcccagaaggaggtcctggagcgtacccgcgccgaacttgacaccgtgtgtaggcacaactatcagctcgagttaagaactaccctccagcggcgggtggaacctacagtgaccatttccccatctagaaccgaggcgctgaatcaccacaaccttctggtgtgctctgtaaccgatttttaccctgcccaaatcaaggtacgctggttccgcaacgaccaggaggagaccaccggtgtcgtttcaacaccgttaatccgaaacggggattggacttttcaaatcttagtaatgctggagatgactccacaacacggagatgtctacacatgtcatgtggagcacccttccctgcaaaatccgattaccgttgagtggcgcgctcaatctgagtctgcccagtcaaaaatgctctcaggcattggaggctttgtgctgggcctaattttcctaggcctgggactcattatacatcaccggagccagaaaggcccccaaggcccccctccagctggactgctccattag

SEQ ID NO: 193993 - DNA, 810 bp, Artificial Sequence
  Description of Artificial Sequence: Synthetic coding sequence
atgagctggaagaaggccctgcggatccccggcggcctgcgggtggctacagttaccctcatgcttgccatgctgtccactccagtggccgagggtcgggactccccagaagactttgtgtatcagttcaagggaatgtgctatttcactaacggcacagagagagtaagattggtgacacgatacatttataacagagaagaatacgcacggtttgacagcgacgtgggcgtataccgggccgtgacccctttagggccccccgatgccgagtattggaacagtcaaaaggaagttctcgagagaacacgggccgagctcgacacagtatgtaggcataattatcagctcgagctgcgcaccaccctgcagaggcgggtggaacccactgttacaatttctccgagtcgaacagaggcgctaaaccatcacaacctgctggtctgctccgtgacggacttctatcccgctcaaatcaaagtccgctggttccgaaacgatcaggaggagaccaccggagtcgtgagcactccactgataaggaacggggactggacgttccagattctggtcatgttggagatgacccctcagcggggagacgtctatacgtgtcacgtggagcacccaagtcttcaaaaccctattattgtcgaatggagggcccagtcagagtcagcacaatcaaagatgctttcaggcatcggaggatttgtgctgggactcatttttctgggattggggttaatcattcaccacagaagtcagaaaggaccccaaggcccacctccagccggactcttgcattag

SEQ ID NO: 193994 - DNA, 675 bp, Artificial Sequence
  Description of Artificial Sequence: Synthetic coding sequence
atgagctggaagaaggccctgcggatccccggcgacctgcgggtggcaaccgtgaccctaatgctggctatgctgtcttcgctgttagctgaggggcgagattctcccgaagacttcgtgttccagttcaaaggcatgtgctattttactaacggcactgagcgggtgcgcctcgtcaccaggtacatctataatcgggaggaatacgcccgctttgattccgacgtaggagtgtatcgcgcggtaacgccccaggggagaccagacgcggaatattggaattctcagaaagaggtgctggagggcacaagggcagaactcgacaccgtttgcaggcacaattatgaggtggcatttaggggaatcttgcagcggagagtggagcctaccgttacaatctccccctccagaactgaggccctgaatcatcataacttgttagtgtgctctgtgactgacttctacccaggccaaattaaggtgcggtggttccggaacgatcaggaggaaaccgcgggggtcgtgagcacccccttgattcgtaatggcgactggactttccagatccttgttatgttggagatgacaccccagagaggagatgtgtatacatgtcacgtggaacaccctagccttcagtctccaattaccgtggaatggcggcttctgcattag

SEQ ID NO: 193995 - DNA, 786 bp, Artificial Sequence
  Description of Artificial Sequence: Synthetic coding sequence
atgagctggaagaaggccctgcggatccccggcgacctgcgggtggcaacagttacactgatgctggccatgctgtcaagcctgctagccgaaggacgagatagcccagaagactttgtgttccagttcaagggaatgtgttacttcacaaatggcactgagcgcgttaggctcgtgacccggtatatttataatagggaagagtatgcccggtttgactcagatgtgggagtctacagggccgttactccacaggggaggccagatgccgaatactggaatagtcagaaagaagtgctggaaggtacgagagctgaactagacactgtctgccgccataactacgaagttgcatttcgagggatactgcaaaggagagtggagccgactgtgaccattagtccaagccgtaccgaagctctgaatcatcataacctgctcgtctgtagcgtcacagatttctatccaggacaaatcaaggtcagatggttccgcaatgatcaagaggaaactgctggagtggtaagtacacctctgattagaaatggcgattggacgttccaaatcctggtcatgttagaaatgacccctcagagaggtgatgtctatacgtgccatgtggagcacccaagtttgcagagccccataacagtggaatggagagcccagagcgaaagcgcccagtccaagatgctaagcggtgtgggcggcttcgttttaggcctgatcttcctggggctgggactaatcataagacaacggtctcagaagggtctcttgcactag

SEQ ID NO: 193996 - DNA, 786 bp, Artificial Sequence
  Description of Artificial Sequence: Synthetic coding sequence
atgagctggaagaaggccctgcggatccccggcggcctgcgggccgccacggtcacactcatgctggcaatgttgagtactccagtcgctgaaggccgggacagtcccgaagatttcgtctaccagtttaaggccatgtgctatttcacaaatggtacggagcgggtccggtatgtcaccagatacatttacaaccgagaggaatatgcacgtttcgatagcgacgtcgaagtgtatcgtgcggtgaccccattggggcctccagatgctgagtactggaactcccagaaggaggtattagaacgtactagggccgagttagatacagtgtgccgtcacaattatcagctcgaactgaggaccacactgcagaggcgggtagaaccaaccgttacgatctcccctagccgcaccgaggcattgaaccaccacaacctgttagtatgcagcgttaccgacttctatccagcacaaatcaaagtgaggtggttccgcaacgatcaggaggaaacaacaggcgttgtttccactcccctgattcgaaatggagactggactttccagatcctggtgatgctggagatgacaccccagcacggtgacgtgtacacctgtcacgttgaacatccatcgctgcagaatcccatcacagtggaatggagggcacagagcgaatcagcacagagtaaaatgctctctggtatcggcggctttgtgttgggcttgatattcctaggacttggattaattattcatcatcgctcacaaaagggcctcttgcattag

SEQ ID NO: 193997 - DNA, 675 bp, Artificial Sequence
  Description of Artificial Sequence: Synthetic coding sequence
atgagctggaagaaggccctgcggatccccggcggcctgcgggccgccacagtaaccctcatgctcagcatgctctctacccctgtcgctgagggcagagattctcctgaggattttgtctaccagtttaaaggcatgtgttattttacaaatggcaccgagcgtgtcaggctcgtgtcccggtctatctacaaccgtgaagaaatagtcagattcgactccgacgtcggcgaattccgcgccgtgactctgctggggctgcctgccgccgagtactggaacagccagaaggatatcctcgagcgaaagcgggctgcagtggaccgggtttgcagacacaattatcagttagagcttaggactacattacagcgccgtgtggagcccaccgtaaccatctctccatcccgcacagaggccctgaatcaccacaacctgctcgtttgctctgttaccgatttctaccccgctcagataaaggtccggtggttccggaacgatcaggaggaaaccgccggagtggtgtcaacccctctgatcagaaatggcgactggactttccagattctggtgatgctggagatgaccccccagcggggtgatgtctacacctgtcacgtggaacaccccagtttgcagagcccaatcacagttgagtggcgcctgttgcactag

SEQ ID NO: 193998 - DNA, 786 bp, Artificial Sequence
  Description of Artificial Sequence: Synthetic coding sequence
atgagctggaagaaggccctgcggatccccggcggcctgcgggccgccactgtgaccttgatgctagccatgctcagtaccccagtagcggaaggtcgcgacagtccggaggatttcgtctatcagtttaaagctatgtgttatttcacaaatggaaccgagagggtgagatatgtcacgagatatatctataatagggaagaatacgctcgcttcgattctgatgtagaagtatacagagccgttaccccactgggccccccagacgctgaatactggaacagccagaaggaagttctcgaacggacccgggctgaactggacacggtgtgccggcacaactaccagttagaactgcggacgactctgcagcgacgtgtggagccgaccgtgaccattagcccctcacggacggaagccctgaaccaccataatttgctggtgtgctctgtgaccgatttttatcccgcgcagatcaaagtgaggtggtttagaaatgatcaggaggaaaccaccggggtcgtgagcactcctctgatccggaatggggattggacattccaaatactggtcatgctcgagatgacgccacagcacggagatgtctacacctgccacgtcgagcaccctagcctccagaatcccattacagtggagtggcgggcacagtccgagagcgcacaaagtaagatgctaagcggcatcggcgggttcgtgctcggattaattttccttggactgggcctgattattcaccaccggtctcagaaggggctactgcattag

SEQ ID NO: 193999 - DNA, 786 bp, Artificial Sequence
  Description of Artificial Sequence: Synthetic coding sequence
atgagctggaagaaggccctgcggatccccggcggcctgcgggtggccaccgtgactctgatgctggcgatgctgtccaccccggtggctgagggacgcgattcgccagaggatttcgtgtaccagttcaaggggatgtgctactttacgaatgggacagaacgagtccggggagtgacccggtacatatacaaccgtgaagagtacgcgaggtttgacagtgacgtgggggtgtatagagctgtgactcctttgggaccacctgccgccgaatactggaactcacagaaagaagtgctcgagcgcacccgagcagaactcgatactgtctgcaggcataattatcagttagagctcaggactacactacagagacgggttgagcccacagttactattagcccaagccggactgaagctctaaaccaccataatctcctggtatgtagcgttaccgatttctatcctgcacagatcaaggtgagatggttcaggaacgaccaggaagaaacgaccggggtggtgtccacacctctgatccgcaatggtgattggaccttccagattctggttatgctggagatgaccccccagcgcggtgatgtgtatacgtgccacgtggagcatccatccctgcagaatccaatcattgtagaatggagggcccaatcggagagcgcccagtccaaaatgcttagtggaatcgggggattcgtcctgggactcatcttccttggactgggtctaataatccaccaccgtagccagaaaggactgttgcattag

SEQ ID NO: 194000 - DNA, 675 bp, Artificial Sequence
  Description of Artificial Sequence: Synthetic coding sequence
atgagctggaagaaggccctgcggatccccggcggcctgcgggccgctactgtcaccctcatgctgtctatgctcagtacacctgtggcagagggaagagatagtcctgaggattttgtgtaccagttcaaaggtatgtgttactttactaatggcaccgaaagggtgcggctcgtgtctagaagcatctacaacagagaagaaatagtcaggttcgactctgatgtcggtgaattccgagctgtcacgctgctcggcctgcctgctgcagaatactggaactcgcaaaaggacatcctggaacgtaagcgcgccgccgtcgaccgggtgtgcagacataactatcaactggaattgcgtaccaccctgcaaaggcgagtggaaccgacagttacaatctcccctagcagaactgaagctcttaatcatcacaacctgctcgtatgctctgtaacagatttctaccccgctcagataaaagtccgttggttccgtaacgggcaggaggagaccgccggagtggtgtccaccccgcttatacgcaacggcgactggactttccagattctagtgatgctggaaatgactccccagaggggcgatgtctatacctgtcatgtggagcacccgagcctccagagccctatcactgtggaatggcgtctcttacattag

SEQ ID NO: 194001 - DNA, 786 bp, Artificial Sequence
  Description of Artificial Sequence: Synthetic coding sequence
atgagctggaagaaggccctgcggatccccggcggcctgcgggtggccacggtcactctgatgctcgcaatgctcagcacaccagttgccgagggacgggacagcccagaggatttcgtttatcaattcaaaggcatgtgttacttcacgaacggcaccgaacgcgtccgcctggtcaccagatacatctataatcgcgaggagtacgcccggttcgatagcgatgtaggggtgtatagagccgttacaccgctaggtccacccgacgcagagtactggaacagtcagaaagaggtattggagagaactagagctgaactggatactgtttgtcgacacaattatcagctggaactgcggaccacccttcaaaggcgagtggagcctacggtcaccatctccccttccaggactgaggctttaaaccatcacaatcttctcgtgtgttctgttacagacttttacccagcccagatcaaggtccgatggttcagaaacgaccaagaagagacaaccggtgttgtgagcactccattgatccggaacggagactggactttccagatcctcgttatgttggaaatgacaccacaacgcggagacgtctacacatgccacgtcgagcacccctcccttcagaatcccatcatcgtcgaatggcgagctcagtctgagagtgcccagtccaagatgcttagcggcatagggggctttgtcctgggtcttatttttctcggtctcggcctgatcatccatcataggagccaaaagggcctactccattag

SEQ ID NO: 194002 - DNA, 786 bp, Artificial Sequence
  Description of Artificial Sequence: Synthetic coding sequence
atgagctggaagaaggccctgcggatccccggcggcctgcgggccgccaccgtcactttgatgctttcaatgctatccactcccgtggctgagggacgcgacagtcccgaggattttgtgtatcagttcaaggggatgtgctattttactaatggcacggaacgcgttagactagttagtagatccatttacaatcgcgaagagatcgtcaggttcgattctgatgtaggggagttccgggcagtgacactcctgggcctcccagcagcggagtattggaattcccagaaagatattctcgagcgaaagcgggcagccgttgatagagtgtgccgccacaattatcagctggagctgcggacaacactgcagaggagagtcgaacccacggtgaccattagtccatccagaaccgaagccctgaatcaccacaatctgctggtgtgttccgtgactgatttctatcccgcacagatcaaggtccggtggttccgcaatgggcaggaggagacagccggcgttgttagcactcccctgatacgtaacggcgattggacatttcagatcctggtcatgctcgagatgaccccgcagcggggtgatgtctacacatgccatgttgaacacccctcactgcagagtcctattacagtcgagtggcgggcccagtcggagtcagctcagagtaagatgttatctggaatcgggggtttcgtgctggggttgatcttcctgggccttgggcttattattcaccacagaagccagaagggcttgctacactag

SEQ ID NO: 194003 - DNA, 810 bp, Artificial Sequence
  Description of Artificial Sequence: Synthetic coding sequence
atgagctggaagaaggccctgcggatccccggcggcctgcgggccgcgaccgtgacgctgatgctgtctatgctgtccactccagttgctgagggccgggactcacccgaggacttcgtctaccaatttaaaggcatgtgttatttcacaaatggaacggagcgcgtgagactggtgagcaggtcaatttacaatagagaggaaatcgtaagattcgattcagatgtcggggagtttcgagccgtcacactgctgggtctgcctgctgccgaatactggaactctcagaaggatattctggagcgtaaaagggcagctgttgacagggtgtgccggcacaattatcagctcgagctccgcacaacattacagcgcagagtagaacccacagtgacaatctcccctagtagaaccgaggctctcaatcaccataacctgctggtgtgctccgtgaccgatttctacccggctcagattaaggtccggtggttcagaaacggtcaagaggagaccgccggggtggtgtccacccctctgatccgtaacggagattggacctttcaaattcttgtgatgctggaaatgacaccacaaagaggagatgtgtatacctgccacgtggaacacccgagcttacagagcccaattacagtggaatggagggcccagtcggaatcggcccaaagcaagatgctgagcggaataggaggcttcgtcctgggtttaatcttccttgggctgggattaatcatccatcaccgctcacaaaagggaccccagggacccccacccgcaggactgctgcactag

SEQ ID NO: 194004 - DNA, 786 bp, Artificial Sequence
  Description of Artificial Sequence: Synthetic coding sequence
atgagctggaagaaggccctgcggatccccggcggcctgcgggtggcaacagtcacccttatgctggcaatgctctcaacccccgtggcggagggccgggacagcccagaggatttcgtctatcagtttaagggcatgtgttatttcacaaatggaactgagcgtgtgcgtctggtcactaggtacatttacaatagagaggaatacgccagatttgattcagatgttggggtttacagagcggtgactccgttgggtcctccggatgcagagtattggaactcccaaaaggaggtcctggaaaggaccagggcagaactcgatacagtgtgtagacataattaccagcttgaattgcgcacgactctccagagaagggtcgagcccaccgtgaccatctccccttcaaggactgaggcgctgaaccatcataacctgctcgtttgcagcgtgaccgatttttacccagctcagattaaggtccggtggttcagaaatgaccaggaggaaaccaccggagtggtctctacgcccttgatccggaatggcgactggacatttcagattctggttatgcttgagatgactcctcagaggggggacgtgtacacttgccatgtggagcatccctccttgcagaatcccatcattgtcgagtggagggctcagagcgagagcgcacagagtaaaatgctgtccggcatcggcggtttcgtcttagggcttatcttcctgggcctggggctgataatccaccaccgcagccaaaagggtttattacactag

SEQ ID NO: 194005 - DNA, 675 bp, Artificial Sequence
  Description of Artificial Sequence: Synthetic coding sequence
atgagctggaagaaggccctgcggatccccggcggcctgcgggccgcaacagtaactcttatgctcgcaatgctctcaacacccgttgccgaaggtagagactccccggaggactttgtgtatcaatttaaagcaatgtgttatttcacgaacggcacagaacgagttcggtatgttactcgctacatttacaacagagaggagtacgctagattcgactcggacgttgaggtgtatagagctgttacaccgcttggccctcccgacgcagaatactggaactctcagaaggaggtgctggagaggacccgggctgaactcgacacagtgtgccggcataactatcagctggaacttcggaccactctacagagaagggtagaacccacagtcaccatttctccatctaggacagaggcgctcaaccaccataatctactcgtgtgctctgtgaccgatttttacccagcacagataaaggttcggtggtttaggaacgatcaagaagagactacaggcgtggtgtcaacaccccttattagaaatggtgattggactttccaaatcctggtgatgctcgaaatgacgcctcaacacggagacgtctatacttgccatgtcgagcaccccagtctgcagaatccgatcacagtcgaatggcgactgctccactag

SEQ ID NO: 194006 - DNA, 786 bp, Artificial Sequence
  Description of Artificial Sequence: Synthetic coding sequence
atgagctggaagaaggccctgcggatccccggcggcctgcgggccgccacagtaactctgatgctgagcatgttgtctacgccagtggctgagggacgggattctcctgaggatttcgtgtaccagtttaaaggaatgtgttactttaccaacggtactgagcgggtgcggctggtgtccagaagtatttataatagagaagagatcgtgcgcttcgactcagacgttggcgagtttagggccgtcaccctcctgggcctcccggctgcggaatactggaatagccagaaggatatactggaacgaaagagagctgccgtcgatcgggtctgtcggcacaattatcaactagaactacggacaaccctccagcggcgggtggagcccacagtcaccatctctcccagcaggaccgaagctcttaaccaccataatctgttggtttgctcagtgactgacttttatccagcacaaatcaaggtgcggtggtttagaaatggccaggaagagacagctggcgtcgtcagcacgcccctgattagaaacggggactggacatttcagatcctagtgatgttagaaatgacgcctcaacgaggcgatgtgtacacttgtcatgtggagcatccttcactgcagagccctattacggtggagtggagggcacagtccgagagcgcccaatccaaaatgttaagcggaatcggaggattcgtgctcggcctgatttttctaggtttgggactgatcattcaccatagatcacaaaaaggcctgctccactag

SEQ ID NO: 194007 - DNA, 405 bp, Artificial Sequence
  Description of Artificial Sequence: Synthetic coding sequence
atgagctggaagaaggccctgcggatccccggcggcctgcgggccgcaacggtaactctcatgctcagcatgctgagtacgccagtagctgagggacgtgacagccctgtggagcccaccgtgaccatttcgccatctcgcacggaggccctgaatcaccacaatctgctggtgtgttccgtgacggacttttaccccgcccaaattaaggttcgttggtttagaaacggccaggaagaaacggcaggcgtggtgtcgacccccctgatcaggaatggagattggacattccagatcctggttatgcttgagatgaccccccagaggggagatgtttacacttgtcacgtcgaacacccctcgcttcagagccccattacagtggaatggagacttctccactag

SEQ ID NO: 194008 - DNA, 405 bp, Artificial Sequence
  Description of Artificial Sequence: Synthetic coding sequence
atgagctggaagaaggccctgcggatccccggcggcctgcgggtggcaaccgttaccttaatgctcgccatgctgtctacacccgtcgctgagggccgggactctccagtcgagccgactgttacaatcagtccttcacgcacagaagctctgaaccaccacaatctactggtgtgctctgtgaccgacttctatcctgctcagataaaggtgagatggtttaggaacgaccaggaggagacgactggcgtcgtgagtaccccactcatacgcaacggcgactggacgttccagattcttgtaatgctggagatgaccccccaaaggggtgacgtgtacacctgtcatgttgagcatccgtcattacagaatccgatcattgtggagtggcgattgctgcattag

SEQ ID NO: 194009 - DNA, 435 bp, Artificial Sequence
  Description of Artificial Sequence: Synthetic coding sequence
atgagctggaagaaggccctgcggatccccggcggcctgcgggtggctaccgttacacctcttggacccccagatgccgaatattggaactcccagaaggaggtgttagaacggacaagagccgaactagatacggtctgccgtcataattaccagcttgagttgagaactactcttcagaggcgcgtggaacccacagtgacaatctcccctagcaggactgaggccctgaatcaccacaaccttttggtctgttccgtgacagatttctatcccgctcaaataaaagtcaggtggttccggaacgaccaggaagaaactacaggggtcgtgagtacacctcttatccgcaacggggattggacgttccagattctcgtgatgctcgagatgacacctcaaagaggtgacgtgtatacctgccacgttgaatag

SEQ ID NO: 194010 - DNA, 405 bp, Artificial Sequence
  Description of Artificial Sequence: Synthetic coding sequence
atgagctggaagaaggccctgcggatccccggcggcctgcgggccgctacagttacactgatgctggcaatgctgtccactccagtggcagagggcagagatagtcctgtcgagcctactgtgactatctctccatcaagaacagaggctttgaatcaccacaacttgttggtctgttctgtcacggacttttatccagcccagatcaaggttcgttggtttcgtaacgaccaggaagaaaccaccggtgtcgtgtccaccccattgatccggaatggggattggaccttccagattctggtcatgttagaaatgacgccccagcacggcgacgtttatacctgtcacgttgaacatccaagccttcagaatcccattacagttgagtggcgattactgcattag

SEQ ID NO: 194011 - DNA, 786 bp, Artificial Sequence
  Description of Artificial Sequence: Synthetic coding sequence
atgagctggaagaaggccctgcggatccccggcgacctgcgggtggcaactgtgacactgatgctggccatgcttagttctttgctggccgagggtcgtgacagcccagaagatttcgtgtttcagtttaaaggaatgtgttatttcacaaatgggacagagcgagtgcgactggtaacccggtacatttataatcgcgaggaatacgcccgttttgattcggatgtcggtgtatatcgagccgtgacaccacagggtagacccgatgcagagtattggaatagccagaaagaagtccttgagggcactcgggccgagctggacactgtgtgccgccacaactatgaggtcgccttccgcggtatcctgcagcgacgggtggagccgactgtgacaatctctccttcgcggacggaggccctcaatcatcacaatctattagtgtgctcagttacagacttctatcccggacagatcaaggtgagatggtttagaaatgatcaagaggaaaccgcaggagtggtgtctaccccgttgattcgtaatggcgactggaccttccaaattctggtaatgttagagatgacgccacaacgaggagacgtttacacgtgccacgtggagcaccccagtctgcagagtcctattaccgtagagtggcgggcccaatccgaatcagcacagtccaagatgctctccggtgttggcgggttcgtactcggcctaatctttcttgggctgggacttatcattcgccaacggtcccagaagggccttctccactag

SEQ ID NO: 194012 - DNA, 675 bp, Artificial Sequence
  Description of Artificial Sequence: Synthetic coding sequence
atgagctggaagaaggccctgcggatccccggcggcctgcgggtggccaccgtcaccttgatgctcgccatgctgtccacaccggtggcggaaggccgcgactctcccgaggactttgtgtatcagtttaaaggcatgtgctacttcaccaatgggacagagagggtacgattggtgaccagatatatttataatcgcgaagagtatgcaaggtttgactctgacgtgggggtgtatcgggcggtcacgcccctggggccgcccgacgcggagtactggaattcccagaaagaagttctggaacgaacaagagcagaactcgatacagtctgccgccataattatcagctggagttgcgaaccacacttcaacggagggtggagcccacggtgactatttcccctagccgaaccgaagccttgaaccaccataatctgctggtgtgcagcgtgacagacttttaccccgcccaaatcaaggtgcgttggtttaggaacgatcaggaggaaaccacgggcgtggtatctacccctctcatccggaacggtgactggacattccagatactcgtgatgctggaaatgacgccacagcgcggtgatgtatatacatgccacgtggagcatcccagtctgcaaaatcccatcattgtggagtggcggctgttacattag

SEQ ID NO: 194013 - DNA, 435 bp, Artificial Sequence
  Description of Artificial Sequence: Synthetic coding sequence
atgagctggaagaaggccctgcggatccccggcgacctgcgggtggccaccgtgacaccgcagggtcggcccgatgccgagtattggaatagtcagaaagaggtcctggagggaacgcgagctgagttagatacagtgtgcagacacaactatgaagtggccttccgtggaattctacaacggcgcgtcgaaccaacagtaacaatttcaccatcccggacggaagcactgaatcaccacaatctgctggtctgttcggttaccgatttctaccccggacagatcaaagtaagatggttccgcaacgatcaggaagagaccgcaggagtggtcagtacgcctcttattaggaacggcgactggacctttcagatacttgtgatgctggagatgactccccagcggggtgacgtttacacttgccatgtggagtag

SEQ ID NO: 194014 - DNA, 435 bp, Artificial Sequence
  Description of Artificial Sequence: Synthetic coding sequence
atgagctggaagaaggccctgcggatccccggcggcctgcgggccgctacagttaccctgctcggcttaccagcagcagagtattggaacagtcagaaagatatcttagaacgcaaaagggcggctgtggacagggtctgccggcacaactatcaactggaattgcgtactaccctgcagagaagggtggagccaaccgtcactatctctccctccaggaccgaggccttgaatcatcataacctcctggtgtgctctgtcaccgatttctacccagcccagataaaggttcgatggttcagaaacggccaggaggagacagctggagtagtgagcacccctctgatccggaacggagattggacgttccaaattctggtcatgctggagatgacgccccagagaggcgatgtttatacctgccacgtggagtag

SEQ ID NO: 194015 - DNA, 435 bp, Artificial Sequence
  Description of Artificial Sequence: Synthetic coding sequence
atgagctggaagaaggccctgcggatccccggcggcctgcgggccgcaactgtcacccctctcggtccccccgacgcagagtactggaacagccaaaaggaggtgctcgaacgaaccagggcagaattagataccgtgtgtagacacaactatcagctggagctccgtacaactctacagcggcgtgtagagccgaccgtgaccatctccccaagccggacggaagctttgaatcatcacaatcttctcgtgtgttccgtgacagacttctacccagcccaaatcaaggtgcgctggtttaggaacgatcaagaagagacgacaggcgtcgtgtccacgccactgatccgaaatggtgattggacgtttcaaattctggtcatgctggagatgacaccccagcacggggatgtgtacacgtgtcacgtggaatag

SEQ ID NO: 194016 - DNA, 411 bp, Artificial Sequence
  Description of Artificial Sequence: Synthetic coding sequence
atgagctggaagaaggccctgcggatccccggcggcctgcgggccgcaacggtcaccctcatgctgtcaatgctgtctacccccgtggcagaggggcgggattcccccgaagactttgtgtaccaattcaaaggaatgtgctactttacgaatggtacagagcgcgttcggctggtgtcgagatccatttacaaccgggaagaaatcgtgcgttttgattcagacgtcggtgagtttagagctgtgacactcctggggctgcctgcagccgagtattggaactcccagaaggacatactcgagcgaaagagagctgctgtggatcgggtctgtcggcacaattaccagctggagctcaggacaacgctgcaaagaaggggtatggtaacaggcccctccagatcctggtag

SEQ ID NO: 194017 - DNA, 411 bp, Artificial Sequence
  Description of Artificial Sequence: Synthetic coding sequence
atgagctggaagaaggccctgcggatccccggcggcctgcgggccgcaactgtgaccctcatgttggcgatgttatccactcccgtcgccgaaggacgcgactcccccgaggattttgtttaccagttcaaggccatgtgttattttactaacgggacagaaagagtgagatacgtgacgagatatatttacaacagggaagagtacgccagatttgattccgacgtggaagtataccgcgccgtcacccccttgggcccacctgatgccgagtactggaatagtcaaaaagaggtgctcgagaggacaagagcagagctggacaccgtttgccgtcataactatcaactcgagttgaggacaactttacagcggcggggcactgtcacaggccctagcaggagttggtag

SEQ ID NO: 194018 - DNA, 411 bp, Artificial Sequence
  Description of Artificial Sequence: Synthetic coding sequence
atgagctggaagaaggccctgcggatccccggcgacctgcgggtggccacagtgacgctgatgctggccatgctgagcagcctcctggcggaaggcagagactccccggaggacttcgtttttcagtttaagggcatgtgctattttacgaatgggactgaaagagtgaggctagttacacgatacatctacaacagagaggagtacgcaaggttcgacagcgatgtaggggtataccgggccgtcaccccccaagggcgccccgacgccgaatactggaacagccaaaaggaggtgctcgagggcaccagagccgagttagacaccgtgtgtagacacaattacgaggtggcgttcagaggtatccttcagagaagggggatggtcaccggcctgagccggagttggtag

SEQ ID NO: 194019 - DNA, 717 bp, Artificial Sequence
  Description of Artificial Sequence: Synthetic coding sequence
atgctgagcacccccgtggccgagggccgggacagccccgaggacttcgtctaccagttcaaaggaatgtgttacttcacaaatgggacagagcgagtgagacttgtgagccggtccatatacaacagggaagagatagtgaggttcgatagcgatgttggtgaattcagggccgtgacccttctcggattgcccgctgccgagtactggaattctcagaaagatatactcgagcgtaaacgcgccgctgtagaccgcgtctgtcgccacaactaccagcttgagttgagaaccacgctccagagacgggtggagcccacagtcacaatctccccctcacgaacggaagccctgaatcaccataatctccttgtgtgttctgtgacagatttctacccagcgcagattaaagtgcgttggtttcgcaatggacaagaagagacagccggtgtggtatctactccactcatccgtaacggtgactggacatttcagatcctcgtgatgctggagatgactccccagagaggcgacgtttatacctgtcatgttgaacaccccagtttgcaatctcccataacagtggagtggcgggcccagagcgagagtgctcagtctaagatgttatccggtatcgggggttttgttttaggactgatctttctcggcctcggcctaatcattcatcacagaagccagaagggactcctccactag

SEQ ID NO: 194020 - DNA, 543 bp, Artificial Sequence
  Description of Artificial Sequence: Synthetic coding sequence
atgtgctacttcaccaacggcaccgagcgggtgcggggcgtgacccgctatatctacaatcgagaggagtacgccagatttgatagcgatgtgggtgtttaccgggcggtgaccccactgggacctccggctgcagaatattggaattcacagaaggaggtgctcgaaaggactcgtgccgagctggatacagtgtgtagacacaactaccagctcgagctcaggactactctacaaaggcgagtggagcctacagtgacaatcagcccaagtcggacggaagctttaaatcatcacaacctgctggtgtgttcggtgaccgacttctacccagctcagattaaggtgcggtggttcaggaacgaccaggaggagaccacgggtgtcgtaagtactcccctgattcgaaacggagattggacatttcagatcctggtcatgctcgaaatgaccccccagaggggagatgtgtatacatgccacgtagagcaccccagtttacagaatcccatcatcgttgagtggcgtatggacgaattctag

SEQ ID NO: 194021 - DNA, 717 bp, Artificial Sequence
  Description of Artificial Sequence: Synthetic coding sequence
atgctgagcacccccgtggccgagggccgggacagccccgaggacttcgtataccagtttaaggggatgtgctacttcacaaacggaacagagcgggtgcgcctggtgtcacgatcgatttacaaccgcgaggaaatagtccgttttgattctgacgtgggtgaattccgggccgttaccttgctcggacttccagccgctgaatactggaacagccagaaagacatccttgaacggaagcgggcagccgtggatagagtatgtaggcacaactaccagctcgaattgcggaccacactgcaaaggagagtggaacccaccgtcacaatctcaccaagccggaccgaagccctaaatcaccataatctgctggtttgcagcgtgacagatttttatcctgcacagataaaagtgcggtggtttagaaatgatcaagaagaaaccgccggagtggtgtctactcctttgatcaggaacggcgactggactttccagattctggttatgctcgagatgactcctcaacggggggatgtgtatacttgccacgtcgagcaccctagcctgcagtcaccaataactgtagaatggcgtgctcagagcgagagtgcccagtctaagatgctcagcggcataggcggatttgtgctcggactgatttttcttggtctggggttaatcattcaccatagaagccaaaagggattgctccattag

SEQ ID NO: 194022 - DNA, 744 bp, Artificial Sequence
  Description of Artificial Sequence: Synthetic coding sequence
atgctgagcacccccgtggccgagggccgggacagccccgaggactttgtgtatcagtttaaagggatgtgttactttacgaacggtaccgaacgcgttagaggcgtgacccggtatatttacaatcgcgaggagtatgctagattcgacagcgacgtaggcgtgtacagggcagtgacgcccctagggccccccgccgctgagtattggaatagccagaaggaagtattggagagaacgcgagcagaactcgacactgtgtgcagacataactaccaactcgagttgcggaccactttacagcgcagagtggaacccaccgtgacaattagcccgtcgcgcaccgaggcgctgaatcatcacaatcttcttgtgtgtagcgtcacagacttctatccggctcaaatcaaggtccggtggtttagaaacgatcaggaggagacgacaggagtggtatctacaccgctgattaggaacggcgactggacttttcagattctcgtgatgctggagatgacaccacagaggggtgatgtctacacatgtcatgtggaacacccctccctgcagaaccccattattgtggagtggcgtgcacaatctgagagtgcccagtcaaagatgctcagcggcattggaggctttgtactcggactgattttcctgggcttgggtctgatcatccatcacagatctcagaaagcccttccccagggacctcctccagctggcgatataagttag

SEQ ID NO: 194023 - DNA, 717 bp, Artificial Sequence
  Description of Artificial Sequence: Synthetic coding sequence
atgctgagcacccccgtggccgagggccgggacagccccgaggacttcgtgtaccagtttaaagggatgtgttattttaccaatggcaccgagagggtgagactggtgtctcgcagcatctacaaccgagaggaaatcgtgaggtttgacagtgatgtaggcgaatttagagccgtaaccctactgggtctgcccgcggccgaatattggaatagccagaaggacattctagaacgtaagcgagccgccgtggatcgtgtgtgtaggcacaattatcaattggagctccggaccacactgcaaaggagagtagagcctaccgtaacaatatctccgtctcgaacagaggcactaaatcatcacaatctattggtttgctccgtgacggacttctaccccgcacaaattaaagtccgctggtttcgaaacgaccaggaagagaccgccggcgtggtttccacacctctaatccgcaatggtgactggacgtttcagattttagtgatgctcgaaatgaccccgcagcggggcgatgtgtacacatgtcatgtggaacacccttctttacagagcccaatcacagtggaatggcgcgcccagtcagaatctgcgcagagtaagatgttgtctggtatcggcggctttgtattggggctgatattcctgggtctggggctgattatccatcaccgcagtcagaagggactgctgcactag

SEQ ID NO: 194024 - DNA, 801 bp, Artificial Sequence
  Description of Artificial Sequence: Synthetic coding sequence
atggtgtgcctgcggctgcccggcggcagctgcatggccgtgctgaccgttactcttatggtcttgagttcaccactggccctcgccggagacaccaggccacggtttctcgagtacagcacgtccgagtgccactttttcaatgggacagagagggttaggtacttggatagatactttcacaaccaggaggaaaacgtccggtttgacagcgacgtaggtgagtttagagctgtaactgagctgggcagaccagatgcggaatattggaattcccaaaaagatctcctggagcagaaacgcggccgcgtggataactattgtcggcacaactacggagtagtggaatcttttaccgtacagcgaagggtgcacccgaaggttaccgtgtatcccagcaagacacaacccctgcagcatcataatctgcttgtctgttcagtgagcgggttttacccgggaagcatagaagtgagatggttccgcaatggacaggaggagaaaactggagtcgtgagcaccggccttatccacaacggcgactggacattccagacactggtgatgctggagaccgtgcctcgtagcggtgaagtgtatacgtgccaagtggagcatccgtccgttacgagcccactcaccgtcgagtggcgcgccaggtcagagtcagctcagtctaaaatgctcagtggagtgggcggcttcgtgctgggtcttctattcctgggcgccggcctatttatctactttagaaaccagaaggggcattcagggctgcagcctagaggcttcttgtcttag

SEQ ID NO: 194025 - DNA, 801 bp, Artificial Sequence
  Description of Artificial Sequence: Synthetic coding sequence
atggtgtgcctgaagctgcccggcggcagctgcatgaccgccctgacagtgaccctcatggtcttaagttcgcccctcgcccttagcggcgacacccggccgaggttcctttggcagccaaagcgtgaatgtcattttttcaacggcaccgaacgcgttcgattcctggataggtacttctacaatcaggaagaaagcgtcagatttgacagcgacgttggggaatttcgggcagtgacagagctcggtaggcccgatgctgaatactggaatagccagaaagatatactcgaacaggctagggctgcagttgatacgtactgtagacataactatggtgtcgtggagagcttcacggttcagcgacgggtgcagcctaaggtaactgtatacccatcaaaaacccaaccactgcagcatcacaacttgctggtctgctccgttagcggtttctatcctggaagcatcgaggtgagatggttcctcaatggccaggaggagaaagccggtatggtgagcacaggactgattcagaacggagactggaccttccagactctggtgatgctcgagaccgtgccccgatctggagaagtctacacttgtcaagtggaacaccctagcgtaacaagtccgctaacagtagagtggagagccaggtctgagtcagcccagtccaagatgctgtctggtgtcggaggtttcgtgctgggactgctcttcctgggcgccggtctgttcatctacttcaggaaccaaaaggggcattcgggcctgcaaccgaccggtttcttgtcgtag

SEQ ID NO: 194026 - DNA, 801 bp, Artificial Sequence
  Description of Artificial Sequence: Synthetic coding sequence
atggtgtgcctgcggctgcccggcggcagctgcatggccgtgctgactgttacacttatggtactatcttccccactcgctctagctggggatactaggccaagattcctcgagtattcaaccagtgaatgccacttttttaatggcacggagagagttaggtacctggacaggtactttcataaccaggaagaaaacgtcagatttgactccgatgtcggggagttccgcgctgttacggagctgggtcggcccgatgcagagtattggaacagtcagaaagatctgctcgaacagaaacgtggacgggtcgataactattgcaggcataactacggtgtagtcgagagttttacagtgcaaaggcgcgtgcacccaaaggttacagtgtacccctccaagacacaacctctgcaacaccacaatcttttggtctgttccgtgagcggcttttaccccggatccatcgaagttcgctggttcagaaatgggcaggaagagaagaccggggtggtctctacagggttgatccacaacggggattggacgttccagaccctggtgatgctcgagaccgtccctcggtctggcgaagtctacacttgccaggtagagcatcctagcgttacctctccactgactgtcgaatggcgagccagatctgagtcagctcagagcaagatgctgagtggagtcggaggcttcgtcctggggctgctctttctgggtgcgggactttttatatatttcaggaatcagaaggggcattcagggctgcagcctaggggcttcctatcatag

SEQ ID NO: 194027 - DNA, 753 bp, Artificial Sequence
  Description of Artificial Sequence: Synthetic coding sequence
ctgctgaagctgacccgggacttcccccagcggcacgagaagtaccagtcttgggccggcacctttcatttgtgcctgaagaagaacaagtacccagatagtagatcgaccttcattaagcacgcaggctcttacctgaagcggggcgaattcctttcaatccatactgcaatcacctgctttttcctgcagatctcagcgagatttctggagcaagtgaagcatgagtgtcatttttttaatggcactgagagagttcgcttcctggaccgctacttttatcatcaagaggaatatgtgcgttttgatagcgacgtgggggaatatagggctgtgacagagctgggtcgcccggacgcagagtactggaattcccagaaggatctcctcgagcaaagacgggctgaggtggatacatactgccgtcataattatggagtggttgagagctttacagttcagcgaagggtttacccagaggtgacagtgtaccccgccaagactcagcccttacagcaccacaacctcttagtgtgctccgtaaatgggttttatcccggcagtatcgaagtgcggtggttccgtaacgggcaagaagaaaaaactggggtggtttctacaggtctgatccaaaacggggattggacctttcagaccttggtgatgctggagacagtgccacgtagcggtgaggtgtatacttgccaggtcgaacacccaagtctcacatctccactgaccgtggagtggtag

SEQ ID NO: 194028 - DNA, 756 bp, Artificial Sequence
  Description of Artificial Sequence: Synthetic coding sequence
tgactgctgaagctgacccgggacttcccccagcggcacgagaagtaccagtcttgggctggcactttccacctttgcttgaaaaaaaataagtatcctgactccaggagcacatttattaaacatgccggttcgtacctgaagcggggcgagttcttggcaatccatacagctatcacgtgcttcttccgacagatcagtgctcgtttccttgagtacagtacatctgaatgtcatttttttaatggcacagagagggtgcgctatttagaccgttatttccataatcaggaggaaaatgtaaggttcgactcagacgtcggtgaattcagggctgtgacagagctgggccgacccgacgccgaatattggaattcacaaaaagaccttcttgaacagaaaagaggtagagtggacaattattgtaggcataattatggggtcgttgaatccttcacagtgcagcgacgggtacaccccaaagtcacagtctacccgtccaagacacagcctcttcagcaccataacttgctggtgtgttcagtatctggtttctatcctggcagcattgaagtccgatggttccgcaatggtcaagaggagaagaccggggttgtctccactggactgatacacaacggcgattggacatttcaaacactggttatgttggagaccgtgccccggagtggagaagtgtacacctgccaggttgaacaccccagtgtcacctcaccattgaccgttgagtggtag

SEQ ID NO: 194029 - DNA, 801 bp, Artificial Sequence
  Description of Artificial Sequence: Synthetic coding sequence
atggtgtgcctgaagttccccggcggcagctgcatggccgccctgaccgtgaccctcatggtgctgtcatcccctctggccctggccggggatactaggcctcgctttctggaacaggttaaacacgagtgtcactttttcaacggtactgagagggtgcgctttttagaccggtacttctatcatcaggaggaatacgttcgttttgatagcgatgttggagaatatcgagctgtgacagaactgggcagaccagatgccgagtactggaactcccagaaagaccttttggaacagaggcgcgctgaggtggacacctactgtaggcataattacggggtcgtggagtcctttacagtgcagcgtcgggtgtacccagaagtcacagtatatcctgctaagacccagcccctacaacaccacaatctgctcgtctgctctgttaacggattctatcccggttcaatcgaagtgcgatggtttcggaatggccaagaagagaaaacaggcgtggtatctaccgggctcattcagaatggcgactggacgttccaaaccctcgtgatgctcgagactgttccaaggtcaggagaggtgtacacctgccaggtagagcatccttccttgacttctccacttacggtagaatggagagcaaggtccgagagcgcccagagcaagatgctttccggtgtgggggggttcgttctgggactgctgtttctgggagctgggttatttatctactttagaaaccaaaagggccactcgggactacaaccgacagggtttctgagttag

SEQ ID NO: 194030 - DNA, 756 bp, Artificial Sequence
  Description of Artificial Sequence: Synthetic coding sequence
tgactgctgaagctgacccgggacttcccccagcggcacgagaagtaccagtcttgggctggcactttccacctgtgcctgaaaaagaataagtatcctgatagccggagcacctttattaagcatgcagggtcttacttaaagcgcggcgaatttctggccattcatacggccataacatgcttctttcgtcaaatttcggcgagattcttagaatactcaaccagcgagtgccacttttttaatggcacggaaagagtccgatatctggaccgctacttccacaatcaggaagaaaatgtgcgctttgactcagatgtaggagaattccgggccgttactgagctgggccgtccagatgctgagtattggaactctcagaaagacttgcttgaacagaaaagagggagggtggataattattgtcggcacaattacggcgtcgtcgagtcttttacagtacagagaagggtccatccaaaggtgaccgtctatccaagtaagacacaacccctgcagcaccacaatctcttagtctgctctgtcagtggattctatcctggatcaatcgaggtcagatggttcagaaacggacaggaagaaaaaaccggcgtcgtgagcaccgggttaatccacaatggggactggacctttcagaccctggtgatgctggaaaccgtccctagatccggcgaagtatacacttgccaagttgaacatccatccgtgacctcacccttaaccgtggagtggtag

SEQ ID NO: 194031 - DNA, 753 bp, Artificial Sequence
  Description of Artificial Sequence: Synthetic coding sequence
tgactgctgaagctgacccgggacttcccccagcggcacgagaagtaccagtcgtgggccggcactttccacttgtgtcttaaaaagaacaaataccccgacagcaggtctacttttatcaagcatgcaggctcctacttaaagaggggggaattcctgagcattcacaccgccattacatgctttttccttcagatctctgcccgcttcctgtggcaaggcaagtataagtgtcacttctttaacgggactgagagggtgcagttcctcgaaagactgttttacaaccaggaagagttcgttagatttgacagcgatgtgggcgagtatcgcgcggttactgaactgggcaggcccgtggcagagagctggaactcccagaaggatattttggaggatagacggggacaagtggacactgtctgcagacataattacggcgtgggggaatcctttacagtgcagcgaagagtccatcctgaagtaaccgtctaccccgctaaaacccaaccactgcagcaccataatttgctcgtgtgttctgtctccggtttctatccaggttcgatcgaggtgagatggtttagaaatggtcaagaggagaaagccggtgtagtcagcacaggactaatccagaatggcgattggacctttcagacccttgtcatgctcgagacagtcccccgatccggtgaagtgtacacatgccaggtggaacacccatccgtgatgagtccactaaccgtggagtag

SEQ ID NO: 194032 - DNA, 801 bp, Artificial Sequence
  Description of Artificial Sequence: Synthetic coding sequence
atggtgtgcctgaagctgcccggcggcagctgcatggccgccctgactgtgacactgatggtgctgtcatccccactggccctcgccggagacacacagccgcgctttctgtggcagggtaagtacaagtgtcacttcttcaacgggaccgagcgagtgcaatttctcgaacgcctgttttacaaccaggaggagttcgtgaggtttgatagtgatgtgggagagtatcgagccgtgaccgaactggggcgccccgttgctgaaagctggaattcacaaaaggacatccttgaagataggcgtggccaggttgataccgtgtgtcgacacaactatggggtgggtgaaagctttaccgtccagcggagagtacacccagaagtaaccgtctacccagccaagactcagcccctgcagcaccacaacctgctcgtgtgtagtgtcagtggcttttacccagggagcatcgaggttcggtggttccgaaatggtcaggaagagaaagccggtgttgtgtcaaccggtttgattcagaatggcgattggacatttcagactctcgtgatgctcgaaaccgtgcctcgcagcggggaagtatatacttgccaggtcgagcaccctagcgtcatgagtccactcactgtagagtggagagccaggagcgagtccgcgcagtccaagatgctgagcggtgtcggaggatttgtcttgggactcttgtttttaggggccggtttattcatttattttagaaatcagaaggggcatagcggtcttcagcctactggcttcttatcctag

SEQ ID NO: 194033 - DNA, 801 bp, Artificial Sequence
  Description of Artificial Sequence: Synthetic coding sequence
atggtgtgcctgaagctgcccggcggcagctgcatggccgccctgacggtcactttaatggtgttgagctctcccctggctctggccggagatacacagccgcgctttctctggcagggaaaatataagtgccacttcttcaatgggacagagcgcgtgcagttcctggaacgccttttctacaaccaggaagaattcgtgcgctttgactcagacgttggagaatacagagcagtgaccgagctcggaagaccagtggcagagagttggaactcccaaaaagatatactcgaggatcgcaggggccaggtggatactgtttgcaggcacaactacggtgtgggcgagtccttcactgtacagagacgcgtacaccctgaggtgacagtctacccggcaaaaacccagccactgcaacatcacaatcttctggtctgcagtgtgtccggcttttacccaggttcaattgaggtgcgttggtttcgcaacggacaagaagaaaaagccggcgtagtttccaccgggttgatccaaaatggcgactggacgttccaaactcttgttatgctcgagactgtgcccaggtcaggggaagtgtacacatgtcaggtcgaacacccttctgtgatgagcccattgacggtggagtggagggctaggtctgagagcgctcaatccaaaatgctcagtggagtggggggttttgtgctcggactactcttcctcggcgcaggcctgtttatttatttcaggaaccagaaaggccactctggtcttcagccaaccggcttcctcagctag

SEQ ID NO: 194034 - DNA, 810 bp, Artificial Sequence
  Description of Artificial Sequence: Synthetic coding sequence
atgagctggaagaaggccctgcggatccccggcggcctgcgggtggccacagtcacactgatgctggctatgttgagtaccccagttgcagaagggcgtgactctccagaggattttgtgtaccaatttaaaggaatgtgctatttcaccaatgggacagagcgtgtgaggggggtgactagatacatatataacagagaggagtatgctcgattcgactccgatgtgggtgtttatagagctgttacccctctgggcccccctgctgccgagtattggaactctcagaaagaggtgttggaaagaacaagggctgaactggacacagtttgtcggcacaactatcagctcgagctgcgcacaacactacaacgccgggtgtatccagaggtcacagtgtatccggcgaagactcaacctctgcaacaccataacctgctggtgtgctctgtgaatggcttctatcctggatccatcgaagttcgctggttccggaacggacaggaggaaaaaaccggagtggtgtctacaggcctgatccagaatggtgattggacctttcagacgctggtgatgttggagactgtgcctcgctctggcgaagtgtacacatgtcaggtggaacacccctcacttaccagcccattgactgtggaatggagggcacgtagcgagtcagcccagtctaagatgctcagcggtgttggtggttttgtgttgggacttcttttcctgggagccggtctttttatatacttccggaatcagaaaggccatagcggactacagcccaccggatttctgtcctag

SEQ ID NO: 194035 - DNA, 792 bp, Artificial Sequence
  Description of Artificial Sequence: Synthetic coding sequence
atggtgtgcctgaagttccccggcggcagctgcatggccgccctgactgtgacactaatggtgctgtcctcacctctcgcactagctggtgacaccaggcctagattcctggagcaggtcaagcacgaatgtcacttctttaatggcacagagcgagtgcgatttctggatagatacttctaccatcaggaggagtacgttcgctttgacagtgacgttggcgagtatagagcagtcacagaactgggtcggcccgatgctgagtattggaacagtcagaaggatctgctcgaacagcgtagggccgaggttgacacttattgccgacataattacggcgtcgtggagagctttaccgtacagcgccgcgtgtaccccgaagtgaccgtctacccggctaaaacccagcccctgcagcaccacaatttactggtctgtagcgtcaatggtttctatccgggaagcattgaagtcagatggtttcgaaacggacaagaggaaaaaacgggagtagtgagcaccggcctgatccaaaacggcgactggacatttcaaacattagtgatgcttgagaccgtccctcgctcgggtgaggtgtacacatgccaggtggaacacccaagtctgacatcacccctaactgtggaatggcgggccaggtctgagagtgcacagtctaagatgctcagcggcgttggtggctttgtcctaggactgctcttcttgggtgctggcttgttcatttatttccgcaatcaaaaaggacacagtggcttgcagccaacaggatag

SEQ ID NO: 194036 - DNA, 141 bp, Artificial Sequence
  Description of Artificial Sequence: Synthetic coding sequence
cacagcggcctgcagcccaccggcaacaccttcagcagcagcctgcgcaacaggtttgggggccaggcacagcatgcttgtaacccttccacgctgggtggtcggggagggcggatcatgcggattccagaacttaaatag

SEQ ID NO: 194037 - DNA, 891 bp, Artificial Sequence
  Description of Artificial Sequence: Synthetic coding sequence
atggtgtgcctgaagttccccggcggcagctgcatggccgccctgactgtgactctgatggtgctctcttcccccttggcactggcgggtgacaccagaccacgttttttagagcaggtcaagcacgaatgccacttttttaatggtaccgagcgcgtgcgcttcttagaccgctacttctatcaccaggaggagtatgtaagatttgattctgacgtgggtgagtacagggccgtgaccgagctgggccgcccagacgcagagtattggaacagccaaaaggatctcttggagcaacgccgtgctgaagtggacacctattgcaggcacaactatggcgtggtggagtccttcaccgtccagcggcgggtgtacccggaagttaccgtttaccctgcaaagacccagcctctgcagcaccacaatctcctggtgtgcagcgtcaatggcttctaccctggatcaatcgaggtccgctggttcaggaatggccaggaggaaaagactggtgtagtatcaactggacttatccagaatggcgactggaccttccagaccctggtgatgctggaaacagtaccacgaagtggcgaagtttatacgtgtcaggtggagcacccctccttgacttccccactgaccgtcgagtggagagccaggtctgagtccgctcagtcaaaaatgctctctggggtggggggatttgttctgggcctgctttttctgggagctggactttttatctacttccgcaaccagaagggacactctggtctgcagccaactggcaatactttctcctcttctctgcgtaacagattcggaggacaggcgcaatggttaaccccagtgatacctgcgctctgggaggccgaggcgggggagagctag

SEQ ID NO: 194038 - DNA, 801 bp, Artificial Sequence
  Description of Artificial Sequence: Synthetic coding sequence
atggtgtgcctgaagctgcccggcggcagcagcctggccgccctgaccgtgaccctgatggttttatcttctcgcctcgctttcgctggtgataccagacctaggtttctggagctgctgaagtccgagtgccatttcttcaacgggacagagcgagtgaggtttctcgagcgacacttccataaccaggaagaatatgccaggttcgactccgacgttggagagtaccgcgcagtacgggaactgggcagacccgacgcggagtactggaactcccagaaggaccttctcgagcagaagcggggacaggtagataactattgtagacacaactacggcgtcggagagtcctttaccgtccagagacgagtgcatccccaggtgacagtctatccagccaagacccagcccttgcaacaccacaatctcttggtgtgttctgtctcggggttctaccccgggtctattgaggtccgttggtttcggaatgggcaagaagagaaagcgggcgtggtctccaccggccttatccagaacggcgattggacttttcagacactggtcatgttggagactgtgccccgaagtggtgaagtgtacacctgccaggtagagcaccctagtgtgacgagccccctgactgtggaatggagtgcccggagcgaaagcgcccagagtaaaatgttatcaggagtgggtggatttgttcttgggctgctatttctgggcgctggactcttcatttattttcgaaatcagaaggggcattctggattgcaaccaactggctttctaagctag

SEQ ID NO: 194039 - DNA, 801 bp, Artificial Sequence
  Description of Artificial Sequence: Synthetic coding sequence
atggtgtgcctgaagctgcccggcggcagcagcctggccgccctgacagtgactttaatggtcctctcgagccgtctggcatttgccggtgatacaagaccgaggtttctcgagctgcgtaagagcgaatgccacttctttaacggcaccgagcgcgtgagataccttgacaggtattttcataatcaggaggagttcctgagatttgattctgacgtaggcgagtaccgtgctgtgacagagttgggcagacctgtggcggagagctggaacagccagaaggatctgctggaacaaaaaagggggcgagtggacaattactgtaggcacaactacggcgtcggggaaagctttacagtgcagcgcagggtacacccgcaggtcacagtttacccagctaagacacaaccactgcagcatcataatctcttggtttgcagcgtgtcggggttctaccccgggtctatcgaagtcaggtggttccgaaatggtcaggaggagaaggccggcgtggtctcgacaggactgatccagaatggtgactggacttttcagacactcgttatgctggagaccgtccccaggtccggggaagtatacacctgccaggtggaacatccatctgtcacaagcgctctgaccgtcgaatggcgcgctcggtccgagtcagcccagagtaagatgctgagtggcgttggtgggttcgtactgggtctgctcttcttaggagccggcctgtttatctatttccgcaaccagaaaggccactctggcctccagcctaccggatttctttcatag

SEQ ID NO: 194040 - DNA, 801 bp, Artificial Sequence
  Description of Artificial Sequence: Synthetic coding sequence
atggtgtgcctgaagctgcccggcggcagcagcctggccgccctgacagtcacgctcatggtcctgagtagtcgcctcgcctttgcaggggatacaagacctagattcttggaacttttgaaaagcgaatgtcactttttcaatggtacagagagagttcggtttcttgaacggcactttcacaaccaggaagaatacgcaaggttcgactccgatgtgggtgagtatagagccgtgcgggagctgggccgacctgacgccgaatactggaactcccaaaaagacctgttagaacagaagcgcggacaggtggacaactactgtagacacaactacggagtgggagagagcttcacagttcaacgcagagtacatccccaggttacagtgtatccagctaagacccaaccattgcagcaccacaacctgctggtctgttctgtgtctgggttttatcccggctcaattgaggtgagatggttccgaaacggccaagaggagaaagccggggtggtgagcacgggattgattcagaacggggactggacgtttcaaaccttggtaatgctcgagacagttcctcggtccggggaggtgtatacatgtcaggtcgagcatccatccgtcacgtcacccctcacagtggaatggtccgcccggtccgagtcagctcagtccaaaatgctgtccggggtgggcgggttcgtgctaggattgcttttcctaggcgctggactctttatctacttccgcaaccaaaagggccacagcgggctacagcctaccgggtttctatcatag

SEQ ID NO: 194041 - DNA, 801 bp, Artificial Sequence
  Description of Artificial Sequence: Synthetic coding sequence
atggtgtgcctgaagctgcccggcggcagctacatggccaagctgaccgtgacactcatggtgctctccagcccgctggctctggctggcgataccaggccaaggttcttgcagcaggataaatacgagtgccatttcttcaacggtaccgaaagagtgcgctttctacaccgcgatatttataatcaggaggaggacctgagatttgattccgatgtgggtgaatatcgagctgtgacggagctaggccgacccgacgcagagtattggaattcccagaaggattttctggaggatcgcagagctgctgtcgacacatattgcaggcataattacggcgtgggggagagttttactgtgcaacgcagggtcgagcccaaggtcactgtgtatcctgcaagaacccagactctgcagcatcataacctgctggtctgcagtgtcaatggcttctacccaggcagtatagaggtgcgttggttcagaaactctcaggaagaaaaggccggagttgtgtccacaggcttaattcagaatggcgattggacctttcagaccctggtgatgttggaaactgtgccacgctcaggggaggtgtacacctgtcaggtggaacacccgagcgtgactagccccctgaccgtggagtggcgtgcccagagcgagagtgcacagtccaagatgctctctggggttggcgggttcgtgctcggccttctgtttctcggagccgggctatttatatactttaagaaccagaaaggtcattctggactacaccctaccggtttggtctcctag

SEQ ID NO: 194042 - DNA, 891 bp, Artificial Sequence
  Description of Artificial Sequence: Synthetic coding sequence
atgggcgagctgatggccttcctgctgcccctgatcatcgtgctgatggttaagcactctgatagccggacccactcactccgctactttcgtctaggagtgtccgatccaattcacggtgtccctgaattcatcagcgtcggatacgtggactcgcaccctatcactacatacgacagtgtcacgcgacagaaggagcccagagcaccctggatggctgagaatctggcccctgatcactgggaaagatacacacagctcctaagaggatggcagcagatgtttaaagtcgaacttaaaaggctgcagcggcactacaaccactccgataacgttgcccacaccattaagcaagcctgggaggctaatcaacatgagctcctttaccagaagaattggctggaggaagaatgcatcgcttggctcaagagatttttggagtacggcaaagacactctgcagagaacagagccacctctggtccgagtgaaccggaaggagacatttcctggcgtgacagcgctgttttgcaaggcccatggcttctatcccccagaaatctacatgacgtggatgaaaaacggagaagagatagtgcaggagattgattacggtgatattcttccgtccggggatggcacttatcaagcctgggcgagcatcgaattggacccacagtcaagtaatctgtattcctgccatgtggagcattgcggggtacatatggtgctccaggtgccgcaggaaagtgaaacaatccccctagtgatgaaggctgtgtccggcagtatagtgctagtgatagtgttagccggagtgggcgtattggtatggcgccgccgcccaagggaacagaatggcgctatatatctgcccacacctgaccgttag

SEQ ID NO: 194043 - DNA, 1026 bp, Artificial Sequence
  Description of Artificial Sequence: Synthetic coding sequence
atgggcgagctgatggccttcctgctgcccctgatcatcgtgctgatggtcaaacacagcgactctcgcacacattctctccgatattttcgcctgggggtctccgatcccatccatggggtgccagaatttatttccgtggggtacgttgatagtcaccctattaccacgtacgatagcgtcacacgtcagaaggagcctagggccccctggatggctgagaatctggcccccgaccactgggagcggtatactcaattgcttcgagggtggcagcagatgttcaaggtggaacttaaaaggctgcaaagacactacaatcattccggctcacatacataccaacggatgataggttgtgaactgctagaagacggcagtacaacgggtttccttcagtatgcatatgacggccaggacttcctgatcttcaacaaggataccctttcctggctggccgtggacaacgtggcccacactatcaaacaggcctgggaggcaaatcagcacgaactgctctatcagaagaactggctggaagaggaatgcatagcctggcttaagaggtttctggagtacgggaaagataccctgcagaggacagaacctcctctggtgcgtgttaatcggaaagagacattccctggggtcaccgcactcttctgtaaagcacatggtttttacccacccgaaatctatatgacttggatgaagaatggagaggagatcgtgcaggaaatcgactatggagatattcttcccagcggggacggcacttaccaggcatgggccagtattgaactcgacccccaaagtagcaatctgtatagctgtcatgtggaacactgcggagttcatatggttctgcaggtgcctcaagagtccgagaccatcccactggttatgaaggctgtcagtggcagtatcgtcttggtgattgtgttagccggtgttggcgtactggtttggcgtagaagaccacgggaacaaaacggcgccatctacctgcccacgcctgatcgctag

SEQ ID NO: 194044 - DNA, 645 bp, Artificial Sequence
  Description of Artificial Sequence: Synthetic coding sequence
atgggcgagctgatggccttcctgctgcccctgatcatcgtgctgatggtgaaacattccgacagtaggacgcacagtctgaggtacttccggctgggcgtgtccgaccctatccacggggtgccagagtttatcagtgtgggttatgtcgactctcatcctattaccacgtacgattcagtgacccggcagaaagaaccccgagctccttggatggctgaaaatctggcccccgaccactgggaacgttatactcagctgctcagaggatggcagcaaatgttcaaagttgagctgaagcgactgcagcgacactacaaccattccgggtcccatacctatcaacgtatgataggctgcgagctgttagaggacggaagcaccacaggatttctgcagtacgcttacgacggacaggatttcctgatctttaacaaggatacactgtcgtggctggccgtcgacaacgtggcccacacaatcaaacaggcgtgggaagcaaaccagcacgaattgctatatcagaaaaattggctggaagaggagtgtattgcatggctgaaacgattcctggaatatgggaaggatactctacagcggacagagcaaaatggggcaatctatctgcctacgcccgacaggtag

SEQ ID NO: 194045 - DNA, 792 bp, Artificial Sequence
  Description of Artificial Sequence: Synthetic coding sequence
atgtgggagctgcggagcgccagcttctggcgggccatcttcgccgagttctttgctaccctgttttatgtctttttcggtttaggctctagcctccgctgggctcctggccctctccatgtcctccaagtggccatggctttcggcctcgctctggcgacgctcgtgcagtccgtgggccatattagtggggcacacgttaatcccgcagtaacattcgcctttcttgttggaagccagatgtcgttactgagagcattttgctatatggccgcacagctgttgggagctgtggcaggcgccgccgtgctgtactcagtaacccctccagccgtccgcggcaatttggcgttaaacaccctacaccccgcagtgagcgtgggacaggccactactgtcgagatcttcctcacgctgcaatttgttctgtgcatttttgcaacctacgatgaacggaggaatggacagctgggaagtgtggctctggctgtaggattctcactcgcactcggacatctgtttgggatgtactacacaggcgctggcatgaaccccgcccgatcttttgcccccgccatattaacgggcaattttactaaccattgggtctactgggtgggtccgataatcggtggtgggcttggcagtctgctgtatgactttcttttgtttccgagactgaagtctatttccgaaaggctgagtgtcttgaaaggggcgaagccagatgtatccaacggccagccagaagtgacaggtgagcccgtcgagctcaatacacaggcgctctag

SEQ ID NO: 194046 - DNA, 2682 bp, Artificial Sequence
  Description of Artificial Sequence: Synthetic coding sequence
atggccaccgaggagttcatcatccggatccccccctaccactacattcacgtcctggatcaaaattcaaatgtttcaagagtggaggtggggccaaagacctacatccgacaggataacgaaagggtgctctttgcacctatgagaatggttaccgtgccccctcgccattactgcaccgtggccaacccagtcagccgggacgcccaggggctggtcctattcgacgtgaccgggcaggtgcggctgcgccatgcagaccttgagattcggctcgcccaagacccctttcccctttacccaggtgaggtgctggaaaaggatataaccccactgcaggtggtgctgcccaacactgctttgcacctgaaggccctgctcgacttcgaagataaggatggcgataaagtagtggctggagacgaatggctgttcgagggacccggtacttatatcccaaggaaagaggtcgaagtcgttgagataatccaggccaccataataagacaaaatcaagccctgcgtttgagggctcgaaaagaatgctgggatcgtgacggaaaagagcgcgtgacgggtgaagaatggttagtgacaaccgtgggggcctacttgcccgccgtgttcgaggaagtactggacctggtggacgctgtgattcttactgaaaagaccgccctgcacctacgtgcccgacgaaattttagagatttcaggggcgtatcccgtaggaccggggaagaatggctggtaacggtgcaagacaccgaagctcatgtgccagatgtgcacgaagaagtcctgggagtcgtgccaataacaaccttagggccacataattactgcgtgattctcgatcccgtcggtcctgatgggaagaaccaattaggacagaaaagggtggtaaagggagaaaaatcattctttctccaaccgggggaacaactcgagcagggcattcaggacgtgtatgtgctgagcgagcagcaggggctgctgctgcgagcccttcagcccttagaggagggcgaggacgaggaaaaagtgtcacaccaagccggtgaccactggctcattagaggacctctcgagtacgtacccagcgccaaggtggaggtggtcgaggagagacaagcaatcccgttggacgaaaatgaaggcatttacgtccaagacgtgaagacaggtaaggtgagggccgtgatcggatctacatacatgttgacccaggacgaagtgctctgggagaaggaactgccccccggcgtagaagaattacttaataaggggcaagatcctttagccgatcgaggcgaaaaggacaccgccaaatcattacagcctctcgccccccgaaacaaaacccgtgtcgtctcttatcgggtaccccataacgccgccgtgcaggtgtatgactatagggagaagcgtgcccgggttgttttcggacccgaactggtgtccctgggtcctgaggagcaattcaccgttttaagcctgtccgcaggacgccctaagcgtccacatgctagaagagccctatgtctgctcttggggcccgattttttcacggacgtgattacgatcgaaaccgccgaccacgcccggctgcagctgcagcttgcctataattggcactttgaagtgaatgatcgtaaagatccacaggaaacagctaaacttttcagcgtgcctgattttgtgggagacgcttgtaaggcgatcgcttcccgggtccggggtgcagtggcctctgtaactttcgatgatttccacaagaattccgccagaattatcaggactgcggtgtttgggttcgaaaccagcgaggctaaaggcccagatggaatggctctacctaggccaagagaccaagcagtcttccctcagaacggcctggtggtgtcttcagtggacgtgcagtctgtggagcctgtggaccagcgtacacgcgacgcactccagagaagcgtccagctggccatcgagataaccaccaattctcaagaagcggcagctaaacatgaagcccagagactcgaacaggaggcccgcggaagactggagcgtcagaagatcctggatcagtccgaagccgaaaaggccaggaaggagcttctcgagctggaagccttatccatggccgtggagtctacgggtactgctaaagccgaagccgaatctagagctgaagcagcgaggatagagggtgaaggatccgtgctccaggctaaacttaaggcacaagctcttgctattgagactgaggctgaattacagcgggtgcaaaaggtgcgtgaacttgagctggtgtacgccagagctcaactggagttggaggtttctaaggctcagcagcttgcagaggtggaggtaaaaaagtttaaacagatgactgaggcaattgggccgagtactatccgggatctcgcagtggctggccctgaaatgcaagtaaagttgttacagtcactcggactgaaatctactctgatcacagatggatcgactcccattaacctgttcaacacagccttcggtctgctggggatgggtcctgagggccaacccctgggccggcgggtcgcctctggacctagcccgggagaaggaatctccccccagtctgcccaggcaccccaggcgcccggagacaaccacgttgtaccagtcctgcgctag

SEQ ID NO: 194047 - DNA, 2682 bp, Artificial Sequence
  Description of Artificial Sequence: Synthetic coding sequence
atggccaccgaggagttcatcatccggatccccccctaccactacatccatgtcttggaccagaatagtaacgtctcaagggtggaagttgggcctaagacatatatcagacaagacaacgaaagggtgctgtttgcccccatgaggatggtcacagtgccccctaggcactactgcacagttgcgaatccagtcagtcgggatgcccaaggcctggtcttgtttgacgttactgggcaagtgcggttacggcatgccgacctggaaattcgcttggctcaggatccttttccactttaccctggcgaagtcctcgaaaaagatattacccctcttcaggtagtgcttcccaacactgcgcttcatttgaaggccttgctggattttgaggataaagatggcgataaggtggtggctggggatgaatggttgttcgaggggcccggaacttatattccccgcaaagaagtggaggtggtggagattatccaagctactattatccgccagaatcaggccttgagattacgtgcccgcaaagagtgctgggaccgtgatggtaaagagcgcgtgacgggggaagagtggctggtcacgacggtgggagcctaccttccagctgttttcgaagaagttctggacctggtcgatgccgtcatcttaactgaaaaaacggctctgcaccttcgggcccgtaggaatttcagagactttcggggtgtctcgcgtcgtacgggtgaggaatggctggtgaccgtgcaggacaccgaggctcacgtgcccgacgtgcacgaagaggttttaggcgtggtgcccatcacaaccctaggaccacataactactgcgtaattcttgatccagtgggccccgatggtaaaaatcagctaggccagaaaagggtcgtcaagggggagaagtctttttttctccagcctggagaacagctcgagcagggcatccaagacgtgtacgtactgtccgaacaacagggactcctgctgcgggccctgcaacccctagaagagggtgaagatgaggagaaggtgtcccatcaagccggggatcactggcttatcagagggccactcgaatacgtgccttctgctaaggtcgaggtcgttgaggaaagacaagcaattccattggacgaaaacgaggggatttacgtgcaggacgttaaaactggcaaggtgcgtgcagtcattggctccacatatatgctcacccaggacgaggtgctctgggagaaagagctgcctccaggcgtggaagaactgctgaataaaggtcaggatccccttgctgataggggagagaaggatactgctaagagcttacagccactggcgcccaggaataagacgcgtgtggtgagctatcgggtcccgcataacgcggctgtacaggtctatgattaccgggagaaaagagcgcgagtggtgttcgggcctgaactcgtctctttgggccctgaggaacaattcaccgtcctgagtctatcagcgggcagaccaaaacgcccacacgcgcggcgtgccttgtgcctacttctgggtccggactttttcaccgacgtcatcaccatcgagaccgcggatcacgcccgcctacagctgcagctggcttataactggcatttcgaagtgaatgacaggaaagacccacaggaaacagcaaagttattttcggtgcccgattttgtcggagatgcctgtaaggcaatcgctagtagggtcaggggagctgtggctagcgttacatttgatgattttcacaagaacagcgctcggatcattagaaccgcagtgtttggcttcgaaaccagtgaagctaaggggccagatggaatggctctgcctaggcctcgagatcaggcagtattcccccagaatggactggttgtctcaagcgtggatgttcagtcagtggagccagtcgaccagcgcactagggatgctcttcaacgcagtgtccagctggccattgagatcaccactaatagccaggaggctgcggctaaacacgaggcccagcgcctggagcaggaggctcggggccgcctcgagcgacagaagatcctcgaccagagcgaggcagagaaggcgcgcaaggagttattggaactggaggccctctcgatggcggtggagtcgactgggacagctaaggccgaagccgagtctagggctgaggctgctcgtatcgagggagagggaagcgtgctgcaggccaagctgaaggcgcaggccctggcgatagagaccgaggccgagcttcagcgcgtgcagaaggtccgagaactggagctcgtgtacgcccgcgcccagctggagcttgaagtctctaaggcgcagcagctggccgaagtagaggtcaaaaaattcaaacagatgaccgaagcaatcggcccatccacaattagggacttagctgtggccggacctgaaatgcaggtcaagctgcttcagtctctgggtttgaaaagtacactgataacagacggttccacccccataaatttatttaacacagccttcggcctccttggaatgggtcctgaaggccagcccttgggacgccgtgtcgcctctggaccctcacccggcgaagggatctcaccacagtctgcgcaggcaccccaggcccccggggacaaccacgttgtccccgttctccgctag

SEQ ID NO: 194048 - DNA, 480 bp, Artificial Sequence
  Description of Artificial Sequence: Synthetic coding sequence
atgtgctggacccggaccgccacctgccccgtgtggcggagcggccagagacctacatcggggaggacaatgcgaggtagcgggtttggcggtaggagacacccctacggcaaagactcaccagcacctcccggaagtgctgaactacctggactacagggctcagtgccacctcactggggaggtgtggcaggcaacagcgccggacacagagggccacgagctaggtgtcccagaggtggggcaggcggatgtgctcaccatcaccccggacctccgcaactgcttcgggactcacggccctgccgtactggctggcaggagtcagcaggcgctgaagcacgcgggcaggggcgggaagtcttctttccccccgcacggagggcagcggggactaggcatccggggtgcgtgtgtgctgtgggtgccgctggcgctgccgcggaggggcccgccgcccctggcggcggaggaggttag

SEQ ID NO: 194049 - DNA, 1251 bp, Artificial Sequence
  Description of Artificial Sequence: Synthetic coding sequence
atgagcaccaagcagatcacctgccggtacttcatgcacggcgtgtgtcgcgaaggatctcagtgtctcttttcacatgacctggccaatagtaagccaagcacgatctgtaagtactatcagaagggatactgcgcctacgggacccgctgtagatacgatcacactcgaccctcagccgctgctggtggtgcagtcgggacaatggcccattccgtgcctagccctgcgtttcactcccctcaccccccttcagaggtgacagcaagcattgttaagactaactctcacgaacctgggaagagggagaagcgcactctggtcctgcgcgatcgaaacctatccggcatggctgagaggaagacccagcctagcatggtatccaatcccggctcatgctctgatccgcagccatcaccagaaatgaaaccccatagctatctggatgctatcaggagtggactggacgatgtagaggcttcatcatcttacagcaacgagcagcagctgtgcccatatgccgccgctggcgagtgtagattcggcgacgcctgtgtctatctgcacggcgaggtgtgtgaaatttgccggctgcaggtgctgcatccattcgatcccgaacagcgtaaggcccatgagaagatttgtatgttgacatttgagcacgagatggagaaagcgttcgcctttcaagctagtcaggataaagtatgcagcatctgtatggaggtcattctcgaaaaggcgtccgccagcgaaaggcgctttggaatactgagcaactgcaaccatacatattgcttgagttgtatcaggcagtggcgctgtgcaaagcaattcgagaacccaatcataaagagctgcccggaatgcagagtcattagtgaatttgtaattcctagcgtgtactgggttgaggatcagaataaaaagaatgaactgatagaagcattcaaacaaggaatgggcaaaaaggcatgtaaatattttgagcagggaaagggaacctgcccttttgggagtaaatgtttgtataggcatgcctatcccgatggacgcctcgccgagcctgaaaagcccaggaagcagctgagcagccaggggacagtgcgatttttcaatagtgttaggctgtgggatttcatcgagaacagagagtctcgccatgtgcctaataatgaagacgtggacatgactgagctaggagacctttttatgcatctgtcaggagtggagagttccgagccttag

SEQ ID NO: 194050 - DNA, 1524 bp, Artificial Sequence
  Description of Artificial Sequence: Synthetic coding sequence
atggaggagcccgccgcccccagcgaggcccacgaggccgccggcgcacaggcgggcgccgaagccgcaagagagggagtgtcgggccccgaccttcctgtgtgtgaacccagtggggagtcagcagcacccgactcagctcttccacatgccgctagaggctgggccccgtttcccgttgctcccgttcccgctcatttgcggcgaggcggactgcggccggcacctgctagcggtgggggggcatggcctagtcccctgccatcacgatcctccggtatctggactaaacagattatttgtcgctattatattcacgggcagtgcaaggaaggggagaattgtcgctactcccatgatctgtctggccgaaagatggccacagagggcggagtgagtccacccggcgcctccgcaggcggcggcccctctaccgccgcccatatcgagcctccaacacaggaagtcgccgaagcgccaccggctgccagtagcttgtcattacccgttatcggctccgccgctgagcggggcttctttgaagccgagagggataacgccgaccgcggagccgcagggggcgccggtgttgaatcctgggcggacgcgatagaattcgttccaggacagccataccgggggagatgggttgcctcggccccagaggctccgcttcagagttcggagactgagcgcaagcagatggctgtgggaagtggcctcagattttgctactacgcgagccggggagtgtgttttagaggagaatcctgcatgtacttgcacggcgatatttgcgacatgtgtggcttacagactctacatcctatggacgctgctcaacgggaagaacacatgcgggcgtgcattgaggcccacgaaaaagatatggaactgagcttcgccgtgcaacgcggaatggacaaggtctgcggtatctgtatggaggtcgtctacgaaaaggctaatcctaatgatcgcagattcggaattttgagtaattgtaatcattccttttgtattcgctgcattcgtaggtggagatctgcgaggcaattcgagaatcgaatcgtgaagtcatgcccacagtgtcgggttacctctgagcttgttattccatcggaattttgggtcgaggaggaagaggagaagcagaagctcatccagcagtacaaggaggccatgtctaataaggcctgtcggtatttcgctgaagggaggggtaactgtccattcggtgatacatgtttctataagcacgagtatcctgagggctggggcgatgaaccccctggccccggcgggggcagctttagcgcctactggcatcagctggtcgagcctgttaggatgggagagggcaacatgctgtacaaaagcatcaagaaagagctcgttgtcctacgtttggcctcactgctgttcaagcggttcctgagcctgcgcgacgaacttccgttctccgaggatcagtgggaccttctccactacgagctggaggagtattttaacctgattctctag

SEQ ID NO: 194051 - DNA, 462 bp, Artificial Sequence
  Description of Artificial Sequence: Synthetic coding sequence
atggcccccgccgccgccaccggcggcagcaccctgcccagcggcttttccgtgttcactaccctgcctgatcttctattcatctttgagtttatttttggcgggctggtctggattctggtggcctccagtctggtgccttggccactggttcagggttgggtcatgtttgtcagcgttttttgcttcgttgcgacgactacactaatcatcctctatataatcggtgctcacgggggtgagacatcctgggtgacccttgacgcagcctaccactgtacggccgctcttttttacctgtccgcttctgtactggaagccctagcaactatcaccatgcaggatgggtttacctataggcactatcacgagaacattgccgcggtggttttcagctatatcgccacactgctatacgtggtccacgccgtgttttcgcttatcagatggaagtcctcctag

SEQ ID NO: 194052 - DNA, 168 bp, Artificial Sequence
  Description of Artificial Sequence: Synthetic coding sequence
atggcccccgccgccgccaccggcggcagcaccctgcccagcggcttctccgtgtttacaacacttcccgaccttcttttcatatttgagttcgttttttcttacatcgcaactcttctctacgtagtgcacgcagtgttctccctcatccggtggaaatcttcttag

SEQ ID NO: 194053 - DNA, 336 bp, Artificial Sequence
  Description of Artificial Sequence: Synthetic coding sequence
atggcccccgccgccgccaccggcggcagcaccctgcccagcggcttttcagtctttacaacgctaccagatctcttgtttatttttgagttcatattcggcggcttggtgtggattcttgtggccagctccctagttccttggcctctggtgcaggggtgggtgatgttcgtgtcagtgttttgctttgtggccacaacaactttaatcatcctctatataattggagcacacggcggtgagactagctgggtgaccctggtgttcagctatattgcaactctgctgtatgtagtgcacgcagtcttttcattaatccgctggaaatccagctag

SEQ ID NO: 194054 - DNA, 294 bp, Artificial Sequence
  Description of Artificial Sequence: Synthetic coding sequence
atggcccccgccgccgccaccggcggcagcaccctgcccagcggcttctccgtttttactactcttcccgacttgttgttcattttcgaatttgatgctgcctaccactgcactgccgccctcttctatctgagtgctagcgtgttagaagctctggctactataactatgcaagatggttttacctataggcattaccacgagaatatcgcagccgtcgtattttcctacatcgcgacactcttatacgtagtgcatgcagtattctcccttattcgttggaagtcttcctag

SEQ ID NO: 194055 - DNA, 462 bp, Artificial Sequence
  Description of Artificial Sequence: Synthetic coding sequence
atggccagccccgacccccccgccaccagctacgcccccagcgacgtaccatccggcgtggcgctgttccttacaatcccgttcgcgtttttcctgcccgagctaattttcggatttctggtttggactatggtggctgcaacgcacattgtataccccctgctgcagggctgggtaatgtacgtgagcttaacttcctttttaatttctctcatgttcctgctcagctaccttttcggattttataagcggttcgaatcgtggcgagtacttgactcattgtaccatggcacaacggggatactgtacatgtcagctgctgtccttcaagtacacgccaccattgtttccgagaagctgcttgatccccgcatttactatattaacagcgccgctagcttttttgctttcatagcaaccctcttgtatatcctacatgccttcagtatttactatcattag

SEQ ID NO: 194056 - DNA, 6216 bp, Artificial Sequence
  Description of Artificial Sequence: Synthetic coding sequence
atggagctggcccacagcctgctgctgaacgaggaggccctggcccagattacagaggcgaagagaccggtgttcattttcgagtggcttcgcttcctggacaaagtgctggtggccgccaacaaaacagatgtaaaggagaaacagaagaagttggtggagcaactgacaggactgatttcatcctctcctggcccaccaacgaggaagttgctggcaaagaacctggcagccctgtacagtataggggacacctttacagtcttccagacactcgataaatgcaacgatataataagaaacaaggatgatactgccgcatacctacctaccaagctggctgcggtcgcatgcgtgggagccttttacgagaaaatgggtagaatgctgggttccgccttccctgaaactgtaaacaaccttttaaaatcccttaagagcgcggaatctcaggggcgctccgaaatactaatgtctctgcaaaaagtgctgtccggcttaggaggcgcagccgcatcttcacatcgcgacatctacaagaacgccaggagcctccttaccgacaggtctatggccgtgcgctgcgccgtcgcaaagtgcctgctggagctgcagaacgaagcagttttcatgtggacagctgaactggaaaacattgcaacactgtgcttcaaagcgctcgaaaacagtaactacggagtgagggttgccgtgtcaaaactgcttggcacagtcatggctactgctttgatgccaaagcaggccactgtcatgcgacagaacgttaagagggccacatttgacgaggtgctggagttaatggctaccggtttccttagggggggctctggattcctgaaatctgggggggagatgctgaaggtcggcgggagcgtgaatagggaggttagagtgggcgtgacgcaagcctatgtcgtgtttgtgacaacccttggtggacaatggctggagcggagcttcgcaaccttcctctcccatgtcctggacctcgtgagtcacccacgggcaactcagacccacgttgaggccgtttattcacgccggtgcgtctccttcatattgagggctactgttggctccctactgggtgagaaggcgcaaattgctgctgctaaggagatctgtcaggccattggcaagcagatgaaagccgtagaggccgtagtcaacgatacatccggcgaaaacaagtccggcgccgcggatatcgccgcttcccagcatgttatggtgtgcgcccttcaggaactgggctccttggtacagtcacttaacgctaccgcgtcccctcttatacaggaggccagcattggcttacttgaaatagtcacttcagtgctgctgcatccgtctatggctgcgaggttggctgccgcttggtgcttgcggtgcgtggccgtggctttgccatttcagttgacccccttcttggaccgctgtgccgaacgtttgaacaacctcaaaacaagccccgaggccgttagcggatactctttcgctatggccgccctcctagggggggtccatcaatgtccgctaggaattccgcacgcgaagggcaaaatggtggtgagtatcgcggaggacttgttgcgcacagccgcccagaattcacggctgtccttgcagcgaacccaggccggatggctgctgctgggtgccttgatgacactaggacccagtgtggtcaggtatcacttgcctaaaatgcttctcctgtggcgcaacgtgttcccccgctccctcaaagagctggaggcagaaaaagcccgtggtgacagcttcacgtggcaggtgactctcgaggggcgagccggggctctgtgcgccatgaggagctttgtggctcactgtccagagctgcttacggaggacgtgattcggaagttaatgacacccatagagtgtgccatgaccatgatgagccacatcccttcagtgatgaaggctcacggcgcccaccttaaggcaagtgcggcaatggttagactgagactgtacgacatcctggcccttctgccccccaagacctatgaaggctcattcaacgctctgttgcgagaactcgtagcggagtttacgcttaccgacaattcagccaatactacaaccagccttcttaggtctctttgccactacgacgacagtgtgctgttgggcagctggctgcaggagacagaccacaagagtattgaagaccaactgcagcctaacagtgcttcgggttccggagccctcgaacacgatcccagtagcatctaccttcggataccagccggggaagcggtgcctggtccgctccccttgggagttagtgttattgacgccagcgtcgccctttttggagtggtattccctcacgtctcttataagcatagactgcaaatgctggatcacttcgccgaatgtgtcaagcaggccaagggcgtgcgccagcaagccgtgcagctgaacatcttcaccgccgttctgtcagccctcaagggcttggctgagaacaagagcaccctgggcccggaggaagttagaaaatctgccctgactttggtcatgggtcccctggataatcctaatccaattttacggtgcgccgccggcgaggccctggggagaatggcacaggtggtcggggaagctacatttatagcccgcatggcccagtactcctttgataagttaaagagcgcgcgagatgtggtgagccgcaccggacattccttagccctgggttgcttacacagatacgtaggaggcattggcagtggacaacacttgaagacttctgtctcaatcctgttagcactggcccaagacggcacgagtcccgaggtgcagacctggtccttgcactctttggcactaatagtggatagtagcggcccaatgtaccgcgggtatgtggaacccacgctgagcttagtgctcactcttctcctgaccgtgcctcccagtcataccgaggtgcaccagtgtttgggccgatgcctgggagccattattacaaccgtgggcccggaattgcaaggaaatggggcaaccaccagcacaatcagatcatcttgtcttgtgggctgcgccataacccaggaccattccgactcactggtgcaagcagctgctatcagctgtctgcagcagctgcatatgttcgcccctaggcacgtgaaccttagctctctcgttccttctctgtgcgttcacctgtgcagctcgcacctactcctgcgcagagcggcggttgcctgcctgagacagctagcccaaagggaagcggccgaggtctgtgaatacgctatgagcctagctaagaacaccggagataaagagtcgtcttcagccaacgtcagcccgtttgcacctggagtctcctccaggactgacatccattgtaggcatcagggggttaatatcactgaaacgggcctggaagggttgctctttggtatgctggatcgtgaaaccgaccggaaactctgttcagacatccatgacacgctgggacatatgctctccagtctggctgtggagaagctgagccactggctgatgctttgtaaagatgtgcttgccgcttcaagcgacatgtctactgctacgctgttgtctagcggcaaggacgaagaggcagagaaaaaggacgaaatggacgatgacacgatgttcacaactctcggagaggaggataaatcaaagccttttgtggctcccaggtgggctacgcgcgtatttgcggccgattgcttgtgtaggatcatcaacttgtgtgagaatgccgatcaggctcactttgacctggcacttgcgagaagtgcaaaactgcgtaacccgaccaacgatctgctcgttctgcatctatctgatttaattaggatggcctttatggctgctaccgaccactctaatcagctgcgtatggctggtctccaggctctggaagatatcataaagaaattcgcctccgtgcctgagccagagttcccaggtcacgtcatcctcgagcagtaccaggcaaacgttggagcagcattgagacctgcatttagtcaagacacccccagcgatataatcgctaaagcctgccaggtctgtagcacttggattggtagtggggtcgtgtctgatctaaatgacctgaggcgcgtacacaacctgctggtatcatctctggataaagttcaggcgggtaagggatcctcctcccagctttatcgcgaaagtgccacaaccatggaaaaattggctgttctgaaggcctgggccgaggtatacgtggtggcaatgaacattaaaaaggaagctgaatcaaagccaaaacgtgctatcaagaacactgatgatgatgatgatgactgtggcactattgacgagcttccacccgacagtctgattaccttggtgcagcctgagctgccaacccttagtcgtctgtggcttgcagcactgaaggactacgcactccttacactgccagcagagttctcttcccagttgcctcctgatgggggtgctttctataccccggaaacgatagacactgcaaggttacactatcggaactcctgggcccccatactccatgcagtagccctctggcttaattctacggggttcacatgctccgagtcaaccgaggccgcagccatctctgggcttcagaagagaagcacaagcgtgaacttgaaccaggccagcggagccgtgggaagcgcaaagtctctccccgaaatcaacaaggacaggatgcatctcatcctcggtgtttcaattcagtttctatgcagcccgcggccggaagaacccattgagcacgtcaccgcgtgtctccaggccctacacacgctgctggattccccctacgcccgcgtacacattgctgaggaccagctcattggagtcgagcttttgtcagttctacatagacttttactgacctggaacccttcttccgtgcagctcttggtgactggagttgtgcagcagattgtacgtgccgcacaggattatctacaggaaaagagaaacactctgaatgaggatgatatggagaaagaggcatgcaccgtcctcggtgagggcggggacagtggaggcctcatccccggcaagtcccttgtattcgccaccatggagctgctgatgttcattctggtgcgacacatgccacacctctctactaaggtctctgattctccgagccacatcgcaaccaagacccgtctcagtgaggagtctgcccggttagttgccgctacagtcactatcttgtctgatttgccctccttgtgcagcccggctggatgtatgacaattttgccgaccatcctcttcttgattgcacggatactgaaggacactgccataaagtcagcggacaaccaggtcccaccacctgtgagtgcagcactgcaggggataaaaagtattgtcacattatccatggccaagactgaagcgggtgttcaaaaacagtggacagcccttatcaggagcacccttgcatgcatactggagtacagtcagcccgaggattccgttcccacccccgatgaggtcagcatgctgacagccatcgccctcttcttgtggtcagccagcaacgaaatcatcggtgttcaatccttacaaaacggttgcatgaatcgtttcaaaaatgccttaaatagctgtgatccatgggtgcaagccaaatgctaccagctccttttgtccgtgtttcagcacagtaacagggccctgtctaccccatatatacacagcctcgctccgatcgttgttgagaagctgaaggctgtggaaaggaaccggccagcttctaatattgaactgttagccgttcaagaggggatcaaggtgctcgaaaccctagtggctttaggtgaggagcagaatagggttcagttgcttgcactgctggtgcctacgttgatctcctacctgctcgacgaaaacagtttcgcatccgcttcaagcgcctccaaggacctgcacgaatttgccctccagaacctgatgcacatcgggcctctgtacccccacgcgttcaaaaccgtgatgggtgcggcacctgaactgaaagttcgcctggagaccgctgtccgtgccagccaggcaagcaaggctaaggctgccgctcgccagccagccccagcaatccatagcgctcccacaatcaaactcaaaacaagtttcttctag

SEQ ID NO: 194057 - DNA, 1005 bp, Artificial Sequence
  Description of Artificial Sequence: Synthetic coding sequence
atgagcgagcccatccgggtgctggtgaccggcgccgccggccagattgcctattccctgctgtacagtatcgggaatggatctgttttcggtaaggaccagcctattattctcgtcttactggacataacaccaatgatgggtgttctggatggagtactaatggaacttcaagactgcgccctgcctctgcttaaggacgttatcgcaaccgataaagaggacgtggcatttaaggacttggacgtggcaattttggtgggcagtatgccacgtcgtgaaggtatggaaagaaaggacctcctgaaagccaatgtgaaaatatttaagtcacagggggccgctctggacaagtacgcgaagaaatcagtcaaagtcatagttgtcggcaaccccgccaataccaattgcctgaccgcttccaagtccgctccaagcatacccaaggaaaacttcagttgcctcacacggctggaccataaccgagcaaaagcccaaattgctctcaagctcggcgtgactgctaacgatgtgaaaaacgtgattatttggggcaaccatagttccactcaatacccagacgtgaaccatgcaaaagtaaaattgcagggaaaagaggtcggggtctatgaggccctcaaggacgatagctggttaaagggcgagttcgtaactaccgtacagcagagaggagctgcagtgatcaaggctcgcaaactgagctctgccatgagtgccgctaaggcgatctgtgaccatgtgcgtgacatatggttcggcaccccggaaggtgaatttgtctccatgggcgttatctccgatggcaacagctatggggtgcctgacgacctgttgtactcattccccgttgttatcaagaataagacctggaagttcgttgagggccttccgattaatgattttagtagggagaagatggaccttactgcaaaggaactaactgaagaaaaagaaagcgcctttgagtttctgtcctctgcgtag

SEQ ID NO: 194058 - DNA, 1059 bp, Artificial Sequence
  Description of Artificial Sequence: Synthetic coding sequence
atgcggcggtgcagctacttccccaaggacgtgaccgtgttcgacaaggatgataagtctgagccgattcgtgtcttggttacaggagccgctggtcagatagcttactcactcttgtactctataggcaacggatccgtgtttggaaaggaccagcctatcattttggtgttactagatatcactccaatgatgggcgtcctggacggcgtgttaatggaactccaggactgcgcactgccactgctcaaggatgtgatcgctactgataaggaagatgttgcttttaaagatctcgacgtggctatcctggtcggcagcatgccacggcgggaaggcatggaaaggaaggatttgctgaaagccaatgtgaagattttcaagtcacagggggccgcccttgataagtatgccaagaagtccgtgaaggtaatcgtagtcggaaaccctgctaacaccaactgtcttaccgcaagtaaatcagcgcccagcatcccaaaggagaattttagttgccttacccgattggatcataatcgagctaaggctcagattgcgctcaaactgggagtgacggcaaacgacgtaaaaaatgtgattatatggggaaatcattcctctacccagtatccagacgtcaaccacgccaaggttaagctacaaggaaaggaagtcggcgtttacgaggccctgaaagatgactcgtggcttaaaggcgaattcgtgaccacggtgcagcagcggggcgcagccgtaattaaggctaggaaactgtccagcgcaatgagtgccgccaaagccatttgcgaccatgttagggatatttggtttggcaccccagaaggtgagttcgtatctatgggagtgatcagcgacgggaattcctacggtgtgccagatgatctgctatacagtttcccggtggtgattaaaaataagacttggaaattcgtcgaaggcttacctattaatgatttcagccgggaaaaaatggaccttacagccaaggaacttactgaagagaaagaaagcgccttcgagttcctgtctagtgcatag

SEQ ID NO: 194059 - DNA, 738 bp, Artificial Sequence
  Description of Artificial Sequence: Synthetic coding sequence
atgccccggcgggagggcatggagcggaaggacctgctgaaggccaacgtgaagattttcaagtcgcaaggggccgccctcgacaaatacgcgaagaaatccgtgaaggtcatcgtagtagggaacccggctaacacaaactgccttacagcttcaaaatctgctccatcgataccaaaagagaatttcagttgtctgacccgactggatcataaccgagcgaaagctcagatcgcactgaaacttggagtgacggctaacgatgtcaaaaatgttatcatttggggcaaccatagcagcacacagtaccccgacgtgaatcatgctaaagtcaaactgcagggaaaggaagtgggggtgtatgaagcgctgaaggatgatagttggctgaagggggaattcgtgacaacagtccagcaacgcggtgccgccgtcataaaggccaggaagctgagctccgccatgtccgccgctaaggccatttgcgatcacgtgcgcgacatttggttcggcacaccggagggggagttcgtttcaatgggcgtgatctcagacgggaattcctacggagtgcccgacgacctgttgtacagcttccccgtggttatcaaaaacaagacatggaaatttgtcgagggcctgcccatcaatgatttttcaagggaaaaaatggacctgactgctaaagagctgaccgaggagaaggaaagtgccttcgagttcctcagtagtgcctag

SEQ ID NO: 194060 - DNA, 1017 bp, Artificial Sequence
  Description of Artificial Sequence: Synthetic coding sequence
atgctgagcgccctggcccggcccgccagcgccgccctgcggcggtcgttcagcaccagcgctcagaataacgcaaaggtggctgttttaggcgcctcaggagggattgggcagcctctcagcctgcttctcaaaaacagtcccctcgtgtctcgccttactctttatgatattgcccacacccccggggtcgcggcagatctgtctcacattgaaacaaaggctgcagtgaaaggatacctgggccccgaacagcttcccgattgtctcaaaggctgtgacgtagtggtgattcctgccggagttccacggaagcccgggatgacacgggacgacttgtttaataccaatgctactatcgtcgccaccttgactgcagcgtgcgcacagcattgcccggaagctatgatatgcgtgatcgctaaccccgtaaattccacaatcccaattacagctgaagtgttcaagaagcacggggtgtacaacccaaataagatctttggcgtcacaaccctagatattgtccgggcaaataccttcgtggctgagctgaaaggcttggatccagccagagtcaatgtgcctgtcataggggggcacgctggcaagacgatcatcccactgatttctcaatgcacacccaaggtagattttccccaggaccaattgacggccttgactggaagaatacaggaagcagggaccgaggtcgtgaaagctaaggcgggtgccggtagcgctacgttgtcaatggcttacgccggcgcccgtttcgtgttctccctcgtggacgctatgaatgggaaagagggcgttgttgagtgcagtttcgtaaagtctcaagagacagaatgcacgtacttttcaactcccctgctgctggggaagaaagggattgaaaaaaacctagggatcggtaaagtctcttcattcgaagagaaaatgataagcgacgccatccctgagctgaaagcaagcataaagaaaggcgaagatttcgtgaaaaccttgaagtag

SEQ ID NO: 194061 - DNA, 1872 bp, Artificial Sequence
  Description of Artificial Sequence: Synthetic coding sequence
atgaaccggtacaccaccatgcggcagctgggcgacggcacctacggttccgttcttatgggaaaatccaatgagagtggggaactggtcgctattaaaaggatgaaacggaagttttacagttgggatgaatgtatgaatctgcgcgaagtcaaatctttgaagaaattgaatcacgcaaatgtcattaaattgaaagaggtaatacgagagaatgaccatttgtatttcatcttcgagtacatgaaagaaaacttgtatcagctcatgaaagatcgtaataagctgttccccgagtcagtgattcggaatattatgtatcagatattacagggtcttgcgtttatccataaacacgggttctttcatcgcgatatgaaaccagaaaatctcctgtgcatgggccctgagctcgtcaaaatagccgactttgggctcgcacgtgagctgaggtctcagcccccttatacagactatgtgtccacccggtggtaccgtgcacctgaggttctcctgaggtcaagcgtgtattctagcccaatcgatgtatgggccgttggctcaattatggctgagctttatatgctcaggcctctattcccggggactagcgaggtggacgagatatttaaaatttgccaagtgcttggcactcctaagaaaagtgactggccagagggttaccagctagccagttcaatgaatttccggtttcctcaatgtgtgcccatcaacctaaaaacacttatccccaacgctagtaatgaagcaatccagttgatgaccgaaatgctgaactgggatcccaagaaacggcctaccgcgagccaagctctaaagcatccctacttccaggtgggacaggttctcggtccaagctctaaccacctggagagcaaacagtccctgaataagcagctgcaacctctcgaatcaaaaccttccctggtggaagtagagcccaaacccctccctgatatcattgatcaagtggtgggccaacctcaacctaagacgtcccagcagcctctgcaacccatccagcctccccaaaacttgagtgtacagcagcctccaaaacaacagtcccaagagaagccaccccagactttgtttcccagtatcgtaaaaaatatgcccaccaagcccaatggcactttaagccacaaaagtggtcggcgaagatggggccagacgattttcaagtccggagactcctgggaagaactggaggattacgacttcggcgcttcccacagcaagaagccatctatgggagtttttaaggaaaagaggaagaaggatagcccgtttcgccttcccgagcccgtgcctagtggctccaaccactctactggcgaaaacaaaagtcttccagcagtgacttcgctgaagagcgattctgagcttagtaccgctccgaccagcaagcagtattatctgaaacaaagccgctacttgcctggcgtaaaccctaaaaaagtgagcctgattgcctcagggaaggaaatcaatcctcacacatggagcaaccagctgtttcccaagtcattgggtcccgttggggcagaattggccttcaaaagatctaacgcaggtaatctgggctcatacgccacttacaaccagagcggttatattccatccttcctaaagaaagaggtgcaaagcgccggacagaggatccacctggcccccttgaatgctactgcctcagagtatacctggaacactaaaactggtcgcgggcagtttagcgggcggacctataatcctacagcaaaaaaccttaatattgtgaaccgggcacagcctataccttcagtacacggtcgaaccgattgggtggctaagtacggaggccaccggtag

SEQ ID NO: 194062 - DNA, 1872 bp, Artificial Sequence
  Description of Artificial Sequence: Synthetic coding sequence
atgaaccggtacaccaccatgcggcagctgggcgacggcacctacgggagtgttctaatggggaaatccaatgagtccggagagctggtggcaattaaacgaatgaaacgaaaattttactcctgggatgagtgtatgaaccttagggaagttaagtctctgaaaaaacttaaccacgcaaacgtgattaaattgaaagaagtgatccgcgagaacgatcacctgtactttatttttgaatacatgaaagagaacttataccagttgatgaaggacaggaataagttgtttccggaatctgtgatacgcaatatcatgtaccagatcctgcaggggcttgcctttattcataaacatgggttctttcatagagacatgaagcccgagaatttgctgtgtatgggccccgagttagtcaagatcgcagatttcggcctggcacgagaactgcgcagtcagccaccgtatactgattatgtcagcacgcgatggtatagggcccctgaggtgctcctgcgatcctctgtgtacagttccccaatcgacgtttgggcggtcggatcgatcatggcggagctctacatgctcagaccacttttcccaggcacctctgaggttgatgaaattttcaaaatatgccaggtattggggacccctaaaaaaagcgattggcccgaaggttatcagctggcttccagcatgaatttccggtttccccagtgcgtgccgattaacctcaagactctcatcccaaacgcatcaaacgaggctatccagctcatgacagagatgctgaactgggatccgaagaagcgacccacagctagccaggccctaaaacatccctacttccaggttgggcaggtgctgggcccaagtagcaaccaccttgagagtaagcagtcactgaacaagcagctccagcctttagaatctaaaccttccctggtcgaggttgaacccaaaccactccctgacatcatcgaccaagtggttggacagcctcagcccaagacatcccagcagcctctccagccaatccagcctccccagaacctctcagttcagcagcctccaaaacagcagtctcaagagaaacccccccagacattatttccatctatcgtcaagaatatgccaactaaaccaaacggcaccttgagtcacaaaagcggcaggaggagatggggtcagactatttttaagagcggcgattcttgggaagagctcgaggattatgacttcggggcgtcacattccaagaaaccgtcaatgggagtgttcaaggagaagcgtaaaaaagactcaccgttccgcttgcctgaacccgtcccatccgggagcaaccactcaacgggggaaaacaagtctctgcccgcagtgacatcccttaagtcagacagtgaactatccactgcgccgactagcaagcagtactatttgaagcagagcaggtacttacccggcgtgaaccctaagaaggtgagcttgattgccagtggaaaggagattaacccacacacatggagtaaccagctttttccaaaaagtctagggcccgttggggctgaactcgccttcaagcggagcaacgcaggcaatttaggaagctacgcaacatacaaccagtccggatatatcccaagctttctgaaaaaggaggtgcaatcggcaggacagcgcattcacctggctcccttgaatgccacagcctccgaatacacctggaatacaaaaacgggccgagggcagttcagcgggcgaacttataacccgacagctaagaatctcaacatagtaaatcgcgctcagcccattccctcggtgcatgggagaacagactgggtcgccaaatacggcggtcacagatag

SEQ ID NO: 194063 - DNA, 867 bp, Artificial Sequence
  Description of Artificial Sequence: Synthetic coding sequence
atgaaccggtacaccaccatgcggcagctgggcgacggcacctacggctccgtcctgatgggtaaatctaacgaatcaggggagctcgtagccatcaagaggatgaaacggaagttttatagttgggatgaatgtatgaacctccgagaagtgaaatctctgaagaagttgaaccacgctaacgtgatcaaattgaaagaggtgatccgggaaaacgatcacttgtatttcatatttgaatacatgaaagagaacctctatcagctcatgaaggatcgcaacaaactcttccccgagagcgtgattcggaatataatgtaccagattcttcagggactggcatttattcacaaacatggattcttccaccgcgacatgaagcctgaaaatctgttgtgcatgggaccagagctcgttaagattgccgactttgggctggcccgggagttacgtagccagcctccttatacagactatgtgtccactcggtggtatcgagctcctgaggtgttgctgcggagttctgtttacagcagccccattgacgtctgggcagtgggatccattatggccgagctgtacatgcttcggcctttattccctggcacaagcgaagtggatgagattttcaaaatatgtcaggtcctggggacacccaaaaagagcgactggcctgaaggctatcaattagcttcctctatgaactttagatttccacagtgtgtgcccattaacctgaaaactcttatccctaacgcatcgaatgaggccatccaactgatgacagagatgctaaactgggatcccaaaaaaaggcccacggcctcccaaccctgttttcttgtggaagtcgagagacccaactag

SEQ ID NO: 194064 - DNA, 1374 bp, Artificial Sequence
  Description of Artificial Sequence: Synthetic coding sequence
atgaaccggtacaccaccatgcggcagctgggcgacggcacctacggaagtgtactgatggggaagagcaacgaaagtggggaacttgtcgctatcaaacggatgaagagaaagttctattcatgggacgaatgcatgaatttacgggaggtgaagagcctgaaaaaactgaatcatgctaatgtaatcaagctgaaggaagttattcgggagaacgaccatttgtatttcatttttgagtacatgaaagagaacttgtaccaactcatgaaagatagaaacaaactttttcccgagtcagtcatcaggaatattatgtaccagattctccaaggtctggctttcattcacaagcacggattttttcatcgcgatatgaagcccgaaaatctcctatgtatggggcccgaattggtgaagattgctgactttggcctggcaagggagcttcgaagccagcctccctacaccgattatgtaagcacccgatggtaccgcgcccctgaagtcctcctgagaagctctgtgtatagctctcccattgatgtgtgggctgtgggctcaatcatggccgaattatatatgttgcgcccacttttcccaggcacttcagaggtcgatgagatttttaagatttgccaggttctgggaaccccaaaaaagtcagactggcctgaggggtaccagcttgctagttctatgaacttccggtttccccagtgtgtgcctatcaatcttaagactctgatacccaacgcctcgaatgaagcgatacaactgatgactgagatgctgaattgggatcctaagaagaggcctacggcttcccaagcactgaaacacccttactttcaggtgggccaagtcctggggccatcctccaaccacttagagtctaaacagtcactgaataagcagctccagccactggagagcaagccgtccctggttgaggtggaacctaaaccactgccagatattattgatcaggttgtaggacagcctcaaccaaaaactagccaacaacctctgcagcctatccaaccaccacagaatcttagtgtgcaacagcccccaaaacaacagagccaagagaaaccgccgcagaccctatttccttccattgtcaaaaatatgcctacaaagccaaacgggactctctcacataagtcaggcagaagacggtggggccagaccatattcaagagtggtgatagttgggaagagcttgaggactacgactttggagcctcgcacagtaaaaaaccttctatgggcgtgttcaaggagaagaggaagaaagactccccattccggcagcaggtgaaaatggccgttatttccctctccgcccaccagtttcctacattatag

SEQ ID NO: 194065 - DNA, 942 bp, Artificial Sequence
  Description of Artificial Sequence: Synthetic coding sequence
atggaggagatgagcggcgagagcgtggtgagcagcgccgtgcccgccgctgctacccgcactacttccttcaaagggaccagtccttcctctaagtacgtgaagttaaacgtcggcggagcactttactacaccacgatgcagactctgacaaagcaagacaccatgttgaaagccatgttttcagggcggatggaggtactgactgattccgagggttggatccttattgacagatgtgggaagcacttcggtaccattctgaattacttgcgtgacggagccgttcccttaccagaaagcagacgcgaaatcgaagagctccttgccgaggcaaaatattacctggtgcagggcctagtcgaggaatgccaagccgccctccagaacaaagacacttacgaacccttttgtaaggtccctgtgatcacctcaagtaaagaagagcaaaaattaattgcgacttctaataaaccagccgtcaagctgctctacaaccgttccaataacaaatattcatacactagcaattcagacgataacatgctaaagaatattgagctgttcgacaagctgagtctccgatttaacggccgcgtgctgtttataaaggatgttatcggcgacgagatttgctgttggagcttttacggccaggggcggaagatcgcggaggtgtgctgtacttcgatcgtgtacgcaaccgagaaaaaacagactaaagtggagtttcctgaggcaagaatctatgaggagacactgaatatccttctctatgaagctcaagacggccgcggccctgacaacgccctactggaagcgacaggaggtgcggcaggtcgcagccaccacctcgacgaggacgaagaacgcgaacgcatcgagcgtgtccggagaatccacattaaaaggccagatgacagggcacatcttcatcagtag

SEQ ID NO: 194066 - DNA, 558 bp, Artificial Sequence
  Description of Artificial Sequence: Synthetic coding sequence
atgggccccgagcggcacctgagcggcgcccccgcccggatggccactgtcgttttaggaggagacactatggggcctgaacggatcttcccgaatcaaacagaagagttagggcatcaggggccaagtgaaggcaccggggactggagtagtgaggaaccagaggaggagcaggaagagaccggttccggcccagcggggtacagttaccagcctctaaatcaggatcccgaacaagaagaggtggagctcgcgccagtgggcgatggtgatgtggttgctgacatccaagatcgtatccaggctctcggcctccacctgccagatcctccgctggaatcagaggacgaagatgaggagggagcaactgctctgaacaatcacagctcaatccctatggaccctgagcacgtagagttggttaagcgcacgatggctggcgtaagccttccggcacctggcgtgccagcgtgggccagggagatctctgacgctcaatgggaagacgttgtgcagaaagcactgcaggcccgtcaggccagcccggcttggaaatag

SEQ ID NO: 194067 - DNA, 1719 bp, Artificial Sequence
  Description of Artificial Sequence: Synthetic coding sequence
atggagcccgaggccccccggcggcggcacacccaccagcggggctatctcctcactcgcaacccccatcttaacaaggatttagctttcacgcttgaggagcgacagcaactcaacatccacggcctactgcccccctctttcaactctcaggaaatccaggttttaagggtggtaaaaaacttcgaacatctaaactctgattttgaccgatacctgctgctgatggatctccaagatagaaatgaaaaactgttctaccgtgtgcttacttcagacattgagaagtttatgcccatcgtctacactcctactgtcgggctggcctgccagcaatatagtctcgtatttaggaaacctaggggcctgtttattacaattcacgaccgaggacacatagcatccgtccttaatgcatggcctgaggacgtgattaaagctatcgtggttaccgatggtgaacggattctgggcctgggggaccttggctgcaatggcatgggcatccctgttggtaagttggccctttataccgcttgtggaggcatgaaccctcaagagtgtcttccagtcattctagatgtgggtacagaaaatgaggagctcctgaaggatcccctgtacatcgggctgcggcagagaagagttaggggaagcgagtatgatgatttccttgatgaattcatggaggccgtctcgtcaaagtatgggatgaattgcctcattcaattcgaggactttgccaacgtcaatgcttttcggctgctgaacaagtaccgcaatcaatactgtacttttaacgacgacatacagggcacggctagtgtcgccgtagcaggcttgctggctgccctccgcatcacaaaaaataagctgagcgatcagactatcctctttcaaggcgctggtgaggcggcactcgggatcgctcacttaattgttatggcattagaaaaagaaggactgcctaaggaaaaggccatcaagaaaatctggctggtggatagcaagggtctcatcgtgaagggacgcgcctccctgacacaggagaaggagaagttcgcacacgaacacgaggaaatgaagaacctggaggctatagttcaagaaatcaaacccacggcattgataggagtcgcagccatcggcggcgccttctccgaacagatactgaaagacatggcagctttcaatgaaagacccatcatttttgccttgtccaatcctacctccaaagcagaatgttcggctgagcagtgttacaaaattaccaagggaagagcaatttttgcctccggtagtccgtttgacccagtgaccctgcctaatggccagaccttgtatcccgggcagggtaataatagttatgtgttccccggggtcgcgctgggcgtagtagcctgtggtctgaggcagatcaccgataacattttcctgacaactgccgaagttattgctcagcaggtgagtgataagcacctggaagaggggcggctttatcctcctttaaacaccatccgggatgtctccctgaagatagccgaaaaaatcgttaaagatgcttatcaagagaagaccgcgactgtataccctgaacctcaaaacaaagaggcttttgtccgcagccagatgtattccacagactatgaccaaatccttccggattgctatagctggccagaagaggttcagaagattcagacaaaggtcgaccaatag

SEQ ID NO: 194068 - DNA, 699 bp, Artificial Sequence
  Description of Artificial Sequence: Synthetic coding sequence
gtgaagggccgggccagcctgacccaggagaaggagaagttcgcccacgagcacgaagaaatgaagaacctagaggccattgttcaagagataaagccaaccgcattaattggcgtggctgccatcggcggagcattctccgagcagatactgaaagacatggctgcctttaacgaaagacccataattttcgccctgtcaaatcctacttctaaggctgagtgttcagccgagcagtgctacaagatcacaaaggggagagctattttcgctagtgggtctcccttcgacccagtgaccttgccgaatggacagactctctatccgggacaggggaataacagctacgtatttcccggcgtggctcttggcgttgtggcatgcggcttgaggcaaatcaccgacaacattttcctcacaacggcagaagttatcgcacagcaggtgagtgacaagcatctggaggaggggcgcctgtacccccccttgaatactattcgcgatgttagcctgaagatcgctgaaaagatcgttaaggatgcataccaagagaagactgccacggtctaccctgaaccccaaaataaggaggcctttgtccgaagccagatgtattctaccgactacgatcaaatcttgccagattgctactcgtggccagaggaggttcagaaaattcagactaaggtcgaccaatag

SEQ ID NO: 194069 - DNA, 1221 bp, Artificial Sequence
  Description of Artificial Sequence: Synthetic coding sequence
atgggcatccccgtgggcaagctggccctgtacaccgcctgcggcgggatgaacccgcaggagtgcctcccagtaatcctcgacgtcggaacggaaaacgaggagctgcttaaagacccattgtacatagggcttaggcagcggagggtgagagggagcgagtacgacgacttcctggatgaatttatggaggcagtcagctcaaaatacggcatgaattgtctaatacaatttgaggacttcgccaatgtgaacgccttccgcctcttaaataaatacagaaaccagtattgtaccttcaatgacgacattcagggaacggccagcgtcgctgtggccggactgctcgccgccctgcgcatcaccaagaacaagctcagtgaccaaaccattttatttcaaggagccggagaggctgctctaggtattgcccatttaattgtgatggcactggagaaagaaggacttcctaaggaaaaggctatcaagaagatttggctggttgactccaaaggcctgatcgtcaaaggacgcgcctctttgacgcaagaaaaagagaagttcgctcatgaacacgaggaaatgaagaatctggaagcaatcgttcaggaaattaaacccacagcactgataggagtggctgcaattggcggagcattctcagagcaaatcctgaaggacatggctgcttttaacgagaggcccatcatcttcgctctgtccaaccctaccagcaaagccgagtgtagcgccgagcagtgttataaaatcactaagggccgtgccatattcgcttccgggtcccccttcgatcccgttactctgcctaacgggcagaccctttatcctggccagggcaacaacagctatgtgtttcctggtgttgcgctgggcgttgtggcctgtggacttcggcagatcactgataacatttttctaacaactgccgaggtgatcgcccaacaggtgtccgataagcacctggaggagggacggctgtacccccctctaaacaccatacgcgacgtgtctctcaaaatcgccgagaaaatcgtaaaagatgcctatcaggaaaagaccgcaaccgtgtatccggagccccaaaataaggaggcattcgtcaggtcccaaatgtactccaccgactacgaccaaatactgcccgactgctactcatggcctgaggaggtgcaaaagatccagaccaaggttgaccagtag

SEQ ID NO: 194070 - DNA, 1494 bp, Artificial Sequence
  Description of Artificial Sequence: Synthetic coding sequence
atggacctgcaggaccggaacgagaagctgttctaccgggtgctgacgtccgatatagagaaatttatgcctattgtgtacactcctaccgtgggcttggcctgccagcagtacagccttgtgttccgtaaaccccgcggcctttttatcacaattcatgacagggggcacattgcctcagtgctgaacgcctggcccgaagatgtcatcaaggcaattgtcgtgacagatggagaacgcatacttggactgggagatttggggtgtaacggcatgggcattccggtgggtaagctggcattgtacaccgcctgcggcgggatgaacccccaggagtgcttgccagtaatacttgacgtcggcacagagaatgaagagctcctgaaagatcccttgtatatcggtctacgccagagaagagtgagaggatcagagtacgacgacttccttgacgagtttatggaggccgtgtcttcaaagtatgggatgaattgtctcatacaatttgaggattttgcaaacgtgaatgcgttccggctgctgaataagtacaggaaccaatactgtacctttaacgacgatatccagggcacagcttctgttgcagtggccgggctcctggcagcactgcggattaccaagaataaactcagcgaccagactatcctattccagggcgctggggaagcagctctgggtattgcacatctcatagtcatggctctggagaaggaaggcttgcctaaagagaaagctatcaagaaaatttggctggtcgattccaaaggcttaatcgtgaagggacgagctagccttacacaggagaaagaaaagtttgcacatgaacatgaggagatgaagaatcttgaggccatcgtccaggaaattaagccaactgcattaatcggcgtggcagctattggcggggcattctctgagcagattctcaaagatatggcagccttcaatgagcgccctatcattttcgcgctgtccaatccgacatcaaaagccgagtgttccgcagagcagtgttacaagattacaaaaggccgtgcaatctttgccagtggatccccatttgaccccgtaaccttgccaaatgggcagaccctgtatccgggccaggggaataattcatacgtgtttcctggggtggcacttggcgtggtcgcatgcggcctgcgacagataaccgacaacatcttcctgactacggccgaagttattgcacagcaggtgtccgacaagcatctcgaagaaggccggctgtacccaccactcaacaccattagagacgtttccctgaagatcgccgaaaagatcgtcaaagatgcatatcaagagaagacggctacagtctatcctgaaccacagaacaaggaggcgttcgtgaggtcacagatgtacagtactgactatgaccagatcctgcccgactgttacagctggcccgaagaagttcagaagattcagacaaaggtagatcagtag

SEQ ID NO: 194071 - DNA, 1755 bp, Artificial Sequence
  Description of Artificial Sequence: Synthetic coding sequence
atgctgagccggctgcgggtggtgagcaccacctgcaccctggcctgtcgccaccttcatattaaggaaaagggcaaacccctgatgctgaacccacggacaaataagggcatggcatttaccctccaggagagacagatgctcggactccagggactcctgccaccgaaaattgagactcaggacatccaggccctgagatttcatagaaacctcaagaagatgacaagtcctctcgaaaaatatatctacattatgggaatccaggagaggaatgaaaagttattttaccgtatactccaggacgacatcgaaagtctcatgccaatcgtctacacaccaacagtgggactggcctgctcccagtacggacacatctttaggagaccaaaggggctgtttatctctatcagtgaccgagggcatgtgcgtagcatagtcgacaactggcccgagaaccacgtcaaggctgtagtggtcactgatggtgaacggatcttgggcctaggggatctaggggtgtacggaatgggaatccccgtggggaagttgtgcctttacacagcatgtgcagggattcggccagaccgctgcctgccggtgtgcattgacgtgggtactgataatatagcccttctcaaggaccccttttatatggggttataccagaagcgcgacaggacccagcagtacgacgatctgattgacgagttcatgaaagctattaccgacaggtatgggcgcaacactctaatccaatttgaggatttcggcaatcataatgcttttaggttcctgcggaagtatagggaaaagtactgtaccttcaatgacgatatccaggggactgccgcagtcgcccttgcagggctgctagctgctcagaaggtcatctccaaacccatcagcgagcataagatactgttcctgggagccggtgaggcagccctgggtatagcaaacttaattgtcatgagcatggttgaaaatggtctttccgaacaggaggctcaaaagaaaatctggatgtttgacaaatatggactgctggttaagggcaggaaagcaaaaatcgactcctaccaggagcctttcactcactcagcgcccgagtcaatccccgatacattcgaggacgccgtgaacatccttaagcccagcaccattattggcgtggcaggtgccggcagactgttcaccccagacgtgattcgtgccatggcatccatcaacgagcgtccagtgatcttcgctttatcaaatcccaccgcacaggccgagtgtactgctgaggaagcctacactctaaccgaaggccgctgcttgttcgcgtctggatccccgtttggcccagtcaagctgactgacggccgagtattcacacccggccagggaaacaacgtatacatttttccaggtgtcgcactggcagtgatcctgtgcaatactagacacatctcggacagtgtctttttggaagctgcaaaagctctgaccagccagctcaccgacgaggagcttgcacaaggacggctgtatcctcccctagcaaatatccaggaggtgagcatcaacatcgccatcaaggttaccgagtatctatatgccaataagatggcattccggtatcccgaacccgaggacaaagcaaagtatgtaaaggagaggacatggcgtagcgagtacgattctctccttcccgacgtctatgagtggcccgaatccgcatccagccctcctgttataactgaatag

SEQ ID NO: 194072 - DNA, 1440 bp, Artificial Sequence
  Description of Artificial Sequence: Synthetic coding sequence
atgctgagccggctgcgggtggtgagcaccacctgcaccctggcctgccgacacctgcacatcaaggaaaagggaaagcccctcatgttgaacccccgaactaataagggaatggcctttactttgcaggaaaggcagatgttgggcctacaggggttgctgcctcctaagattgagacacaggacatccaagcattacgcttccaccgcaatttgaagaagatgacaagtcctctcgagaagtatatctatatcatgggaatccaggagcggaacgagaagctcttttatcggatccttcaagacgatatcgagtcactcatgccaatcgtctacacacccacagtgggcttagcatgcagccaatacggacatatctttcgccgacctaaaggattgttcatctccattagcgatcgtggccatgtgcggtcaattgtggacaactggccagagaaccacgtgaaagcggtggtggtgacagatggggaaaggattctggggctgggtgatttgggcgtgtatggaatgggcatacccgtggggaagctgtgtttatacacagcttgcgccgggatccggccggacagatgtctgccagtgtgcatcgatgttggaactgacaacatcgctctgctgaaggatccattctacatgggtttataccagaagagagatcggacccagcagtatgatgatttgattgatgagttcatgaaggcgataacagaccgctacggacggaacactctaatccagtttgaggatttcgggaaccataatgcctttaggtttctcagaaagtaccgggagaagtattgtacgttcaacgacgatatccagggcaccgctgcagttgcgcttgccggcctgctcgcggcccagaaggttatctccaagcccatttcggagcacaaaattctgtttcttggagcaggagaggccgccctgggaattgcgaacttgatcgtcatgagcatggtggagaacggactcagcgagcaggaggctcagaaaaagatttggatgtttgacaagtatggtctcctggtaaaaggaagaaaggcgaagattgattcttaccaggagccctttacccattccgcccccgaaagtatccctgatacctttgaagatgctgtgaacattttgaagccatccaccatcattggggtcgctggagcaggcaggctgttcaccccagacgtcatacgcgccatggctagcatcaatgagagacccgttatcttcgccctgagtaaccctacagcgcaggcagaatgtacagccgaggaagcttataccctgaccgaaggtcggtgcctgtttgcctccgggagcccctttggacctgtcaagctgaccgacggccgcgtgtttacccccggtcagggaaacaacgtgtacatcttccctggatatcgaatccccatctgctag

SEQ ID NO: 194073 - DNA, 780 bp, Artificial Sequence
  Description of Artificial Sequence: Synthetic coding sequence
atggccttcaccctggaggagcggctgcagctgggcatccacggcttgatcccaccctgttttctctcccaggatgtccagctcttacggattatgagatactatgaaagacagcaaagcgacttggataaatatattatcctcatgacattacaggatcgcaatgagaaactgttctatagggtgttgacaagcgacgtggaaaaatttatgccaatcgtttacaccccaaccgttggactagcttgtcagcactacggcctgacctttcgacgaccgagagggctgttcatcaccatacacgataaagggcacctggccactatgcttaacagctggcccgaggacaacattaaggctgttgtcgttactgatggggagagaatcctggggctgggagacctggggtgctatggtatgggcatacccgttggcaaactggccctgtatacggcgtgcggtggggtcaacccgcagcagtgcctcccagttctcctggacgtgggtactaacaatgaagagctcctccgggaccccctgtatatcggacttaagcatcaaagggtgcacgggaaggcctatgatgacctgctggacgaattcatgcaggcggtgacagacaagttcggaattaattgcctgattcagtttgaggactttgctaatgccaatgcttttagactcctgaataaatatagaaacaaatattgcatgttcaatgatgacattcaggacgattttagtcggggacccaagagatcccagctcttcttcaagtag

SEQ ID NO: 194074 - DNA, 1815 bp, Artificial Sequence
  Description of Artificial Sequence: Synthetic coding sequence
atgggcgccgccctgggcaccggcacccggctggccccctggcccggacgtgcttgtggggccctccccaggtggacccccactgccccagcacaaggttgccatagcaagcccgggcctgctcgtccggttccactgaaaaaacgtggctacgacgtgacacgcaacccccaccttaacaaagggatggcgttcacactggaagaaagactgcagctggggattcatgggctcatacccccctgctttttgtctcaagacgttcagctcttgaggattatgaggtattacgaacggcagcagagcgacctggataagtacattattctaatgacgctgcaggacagaaacgaaaaattattctatcgggtcctgactagcgacgtcgaaaaattcatgccaatcgtgtataccccaacagtgggcttagcttgtcagcactacggactgacattccgacgcccacgaggcttatttattaccattcacgataaggggcacctcgcgacaatgctgaattcttggcctgaggacaatattaaagcggtggtggtcacagatggagagagaatccttggtctgggcgaccttggctgttacggaatgggaatcccagtgggaaagttggccttgtatactgcttgtggcggagttaacccgcaacagtgcttaccagtgctgctggatgtgggcaccaacaacgaggagcttctcagagatcctctgtacatcggcctgaagcatcagagagtgcatggcaaagcctacgatgatttacttgacgagttcatgcaggccgtgaccgacaagttcggcatcaattgtctgatccagttcgaagactttgccaatgccaacgccttccggcttctgaacaagtaccggaataagtactgtatgtttaatgatgatatccaaggtaccgccagcgtggccgtcgccggcattctggccgccctgcgcatcacaaaaaacaagctatctaatcacgtctttgtcttccagggagcaggcgaagctgccatgggcattgcccacctactcgtgatggcacttgaaaaggagggagttcctaaggctgaggctactcgaaagatctggatggtcgatagcaaaggcttaattgttaaggggcggagccaccttaaccatgagaaggaaatgttcgcccaggaccaccccgaagtgaattcactagaagaagtggtccggttggtcaagcctactgctattattggcgtcgccgccatagctggtgcgttcacagaacagatcttgagggatatggcctccttccacgagcgcccaattatctttgcattgtccaatcctacgtctaaggcagagtgcacagctgagaagtgttaccgtgtaaccgaggggaggggaatttttgcgtccggcagcccttttaaatcggtaaccctggaggatggaaaaacctttatccctgggcagggcaacaatgcttacgtgttccccggagttgccctgggtgtgatcgccggcggtatccgccacatccctgacgagattttcctgctaacagccgagcagatagcccaagaggtcagtgaacagcatcttagccaaggaagactttatcctcccctgagcactatcagagacgtgagtctcaggatcgcaataaaagttctggactatgcctataagcacaacctggccagttattaccccgaacccaaagataaggaggccttcgtaagatcgcttgtatacactcccgattatgactcctttactcttgattcctacacctggccaaaggaagcaatgaatgttcaaaccgtgtag

SEQ ID NO: 194075 - DNA, 1815 bp, Artificial Sequence
  Description of Artificial Sequence: Synthetic coding sequence
atgggcgccgccctgggcaccggcacccggctggccccctggcccgggcgcgcatgtggtgcccttccccgctggaccccaaccgcgcccgcccaagggtgtcacagcaagccaggccctgcccgaccagtgcctttgaaaaaaaggggctatgacgtgactcgcaaccctcaccttaataagggaatggccttcacattggaggaacggctccagcttggcatccatggcttaatccccccctgttttttgagccaggacgtgcagttgctgaggatcatgcgctactacgaacgccaacaaagcgaccttgataaatacatcatccttatgaccttacaggaccggaatgaaaagctattttatcgcgttctaacgtccgacgtggaaaagttcatgcccatcgtctacacacccactgttgggctagcctgtcagcactacggactgacatttcggagacctagaggcctgttcattacaatacacgataagggtcacctagccactatgctcaatagctggccggaggacaacattaaggctgtggtggttacagacggggagcgaatcttgggtctgggcgacttggggtgctatggcatgggcatccccgtaggtaagttggccttatacactgcttgtgggggagtaaatcctcaacagtgtctgcctgttctgttagacgtgggaactaacaatgaagagcttttgcgagacccattgtatattgggctcaagcatcaaagggtccatggcaaagcgtacgatgacttacttgacgagttcatgcaggccgtgacagacaagttcggcatcaactgcctgatacagttcgaagatttcgctaacgctaatgcatttcgcctgctgaacaaatataggaacaaatactgtatgttcaacgatgacatacaggggaccgccagcgtggccgtggctggcatcctggccgcgctccgcatcaccaaaaataagctttctaaccacgtgttcgtgttccaaggggccggggaagcggctatgggaattgcacacctgttagttatggccctggaaaaagagggcgtgcctaaggccgaagccaccagaaagatctggatggtggattccaaggggctgattgtaaagggacgatctcacctgaaccatgaaaaagaaatgttcgcacaagatcatcccgaggtaaattcactcgaagaggtggtgcgcctggttaagccgacagcaatcattggagtggcagcaattgctggtgccttcacagaacagatcttaagagatatggccagctttcacgaaaggccaattattttcgcactgagtaatcctacctcgaaggcagaatgtacggccgagaagtgttatagagtcacagaagggagagggatcttcgcctccggatcgcccttcaagagtgtgactttggaagacggcaagaccttcataccaggccaaggtaacaacgcatacgtatttcccggggtggccctgggggtaatcgctggcgggattagacacattcctgatgaaatctttctgctgaccgccgaacagatcgctcaggaagtgagtgaacagcacttgtcacagggtcgcttgtacccacctctgagtaccatacgggatgtgtccctgcggatcgctattaaagtgctcgactacgcttataagcataacctggccagctactatcctgaacctaaagacaaggaggcctttgtgcggagcctggtttataccccagactacgattcattcacattggatagttatacttggcctaaggaagctatgaatgtgcagacagtttag

SEQ ID NO: 194076 - DNA, 1746 bp, Artificial Sequence
  Description of Artificial Sequence: Synthetic coding sequence
atgggcgccgccctgggcaccggcacccggctggccccctggcccggccgcgcgtgtggggcattgcctagatggacacctaccgcccccgctcagggctgccactctaagccgggacctgcccggccagtccctctgaaaaagaggggctacgatgtcactcggaacccccacctcaacaagggcatggcctttacactggaagaacggctacagcttggcatccacgggctgatacccccttgttttctgagtcaggacgtgcaactgctcagaattatgagatattatgaaagacagcaaagtgaccttgataaatacattattctgatgaccctacaagacaggaatgaaaaactgttctatcgagtgctaacctccgacgtggagaaattcatgccaatcgtgtacacaccaactgtaggcttggcttgtcagcactacgggcttacgtttagacgtccgcgaggtcttttcataaccatacatgataaagggcacctggccactatgttgaacagttggccagaggataacataaaagcagtggttgtgaccgatggcgaacgaatacttggacttggagatctgggatgctacggcatggggatacccgtgggcaagttggccttatatacggcctgtggtggtgttaaccctcagcagtgtcttcccgtactgttagacgttggtactaacaatgaagagctgcttcgcgacccactgtacattggtctgaagcaccagagggtgcatggcaaagcatacgacgatctgcttgacgagttcatgcaggctgttacagataaatttggcatcaactgtctgatacaatttgaagatttcgccaatgctaacgcatttagactcctgaacaaataccggaacaaatactgcatgtttaacgacgacatacagggcaccgcatctgttgctgtagcgggcattttggccgccctgaggatcacaaaaaacaagttaagtaatcatgtcttcgtgttccagggcgccggagaggcagctatgggcatcgcccatttattggtgatggccctggaaaaggagggagtcccaaaagctgaagctacacgcaagatttggatggtcgactcaaaaggactgattgtcaagggtagatcccacttgaaccacgagaaagaaatgttcgcccaagatcacccagaagtcaactccttagaggaagttgtacgtctcgtgaagcctactgcgataattggggtcgctgccatcgccggagcattcaccgaacagatcctacgggatatggcctccttccacgagagaccaatcattttcgcattgtcaaaccccaccagtaaagcagagtgcaccgctgaaaagtgctaccgggtcactgaaggtaggggcatatttgccagtggaagtcccttcaaatctgtcactctcgaagatggcaagacatttattccaggacagggtaataatgcatacgtgttccccggcgtggccctgggggttatcgccggaggtattcgacacatccctgacgagatcttcctccttaccgcggagcagatcgcacaggaggtgagtgaacagcacctctcacagggccgtctttatcctccactgagcacaatccgcgacgtgagtttgcggatcgctataaaggtgctggactacgcctacaaacataacctcgcttcatattatcccgaaccaaaggataaagaggccttcgttcgtagcctggtgtacacatag

SEQ ID NO: 194077 - DNA, 1029 bp, Artificial Sequence
  Description of Artificial Sequence: Synthetic coding sequence
atgggcgccgccctgggcaccggcacccggctggccccctggcccggaagggcttgcggcgcactgccgcgatggacgcctacagccccagcacagggttgccactcaaagcctggtccggccaggccggtacccttgaagaagcggggctatgacgttacccggaatcctcacctgaataaagggatggccttcactcttgaagagcgtctacagctaggcatccatggtctgattcccccttgtttcctgtctcaagatgtacagctcctcagaattatgcggtactatgaacggcagcagagcgatcttgacaaatatataatactcatgacgctgcaggacagaaacgagaagctgttttaccgtgtactgacatccgacgtggagaagtttatgccaatcgtttacacgcccacagtaggattggcctgccagcattacggcttaacctttcgcagaccaaggggattattcattactatacatgataagggccatctggctacaatgctcaactcgtggcccgaggataacattaaagcagtggtggtgacggacggcgagcgcatcctggggcttggggatctcgggtgttacgggatgggaatcccggtcgggaaattagctctttataccgcctgtggcggagttaacccacagcagtgccttcctgtgttgctggacgtgggcactaacaacgaagaactgcttcgcgaccccctctatatagggcttaagcaccagagggttcacggtaaggcctacgacgacctgctcgacgagttcatgcaagcagtgacggacaagttcggtattaattgcctgatccagttcgaagacttcgccaacgcgaacgccttccgccttctgaacaaataccggaataagtattgcatgtttaacgacgatatccagggcacaacctgccataccttctcatgcccctggcatctttgggcacaggtcatgttccagcacattcccgggcccatggggttcagcgaatggttacccagaaacagctag

SEQ ID NO: 194078 - DNA, 189 bp, Artificial Sequence
  Description of Artificial Sequence: Synthetic coding sequence
atgggcgccgccctgggcaccggcacccggctggccccctggcccggtcgcgcctgtggagccttgccgcgatggactcccaccgcccctgcccaaggttgccacagtaagcccggtccggctaggcctgtgcccctgaagaagcgtgggtacgacgtcactcgcaacccccacctcaataaagtgtag

SEQ ID NO: 194079 - DNA, 186 bp, Artificial Sequence
  Description of Artificial Sequence: Synthetic coding sequence
atgggcgccgccctgggcaccggcacccggctggccccctggcccggtcgagcctgcggcgcccttcctcgctggactcccaccgccccagcccaggggtgtcactccaaacccggccccgcacgacccgtgccgctgaagaaacgcggatatgatgtcaccaggaacccacacctcaacaaatag

SEQ ID NO: 194080 - DNA, 456 bp, Artificial Sequence
  Description of Artificial Sequence: Synthetic coding sequence
atgggcgccgccctgggcaccggcacccggctggccccctggcccggaagggcttgcggtgccttgccccggtggacacctacggcacctgcccagggctgtcattcgaagccaggtcccgctagaccagtgcccttgaagaaacgcgggtacgacgtgacaaggaacccacatctcaataaggggatggccttcaccctagaagaaagactccagttaggcatccacggactgattcccccttgcttcctttcgcaggacgtgcaactcctgcggattatgaggtattacgaacgccagcagagcgatctggataaatacatcattctgatgacgttgcaagataggaatgagaaactgttttacagggtactgaccagcgatgtcgagaaattcatgcccattgtgtacactcctaccgtgggcctggcctgccagcactatggactgacgtag

SEQ ID NO: 194081 - DNA, 240 bp, Artificial Sequence
  Description of Artificial Sequence: Synthetic coding sequence
atgggcgccgccctgggcaccggcacccggctggccccctggcccggtagggcgtgcggtgcactcccccgctggacgccaaccgcacccgcccagggatgccactctaaacctggacctgcacggcctgtgcccttgaagaaacgaggatacgacgttacacggaatccccatctgaacaaggtcatggggcaacgcgccggccgcccagcgctccgcagtagaggatgtaggaagtag

SEQ ID NO: 194082 - DNA, 1815 bp, Artificial Sequence
  Description of Artificial Sequence: Synthetic coding sequence
atgggcgccgccctgggcaccggcacccggctggccccctggcccggccgggcctgtggggcactccctaggtggacgccaaccgcccctgctcagggttgtcattctaaacccggacccgcccggcctgtccccctgaagaaacgggggtacgatgtcactagaaacccccatctgaacaaaggaatggctttcaccctggaagaacgcctgcagctaggcatccacgggctgattcctccttgcttcctctcgcaggatgtgcagctcctgagaattatgcgatactatgaacgccagcagtcggatctcgataagtacattatcttgatgaccctgcaggaccggaacgaaaagttgttctatagggtgttgacatctgacgtagagaaattcatgcccatagtctacacccctactgtgggactggcctgtcagcactacgggctgacattcaggcggccgcgcggtctcttcattacgattcatgacaagggacacctggcgaccatgctcaatagttggcctgaggacaacataaaggccgtagttgttactgatggagaacgaatactcggcctgggcgacctgggatgctatggcatgggcatcccagtaggtaaactggcattgtacaccgcgtgcggcggggtgaacccccagcaatgtttgcccgtgcttcttgacgtcggtacaaacaacgaagaactgctgcgtgacccactttatatagggctgaagcaccagcgagtccatggcaaggcatacgacgatttgctagacgagtttatgcaagccgtaactgacaaattcggcataaattgtctgatacagtttgaggacttcgcaaatgctaatgcctttcggcttctgaacaagtaccgtaacaagtactgtatgtttaacgacgatattcagggcaccgcctcagtggcagttgccggaattcttgccgcactgcgaatcaccaagaataaactgagcaatcacgtgttcgtttttcagggggccggggaagccgctatgggaattgcgcacctccttgtgatggccctggaaaaggaaggggtgcctaaggccgaggcgacaaggaagatctggatggttgattccaagggcctcatcgtaaagggcagatcacacctcaatcatgagaaggagatgtttgcccaggaccatcctgaagtaaacagcttggaggaggtcgttcgcctggtcaagcccacagccatcatcggagtcgccgcaatagccggtgctttcacggagcagatccttagagatatggccagctttcacgagagacccatcattttcgcactgagtaacccgacatctaaggccgaatgtaccgccgagaaatgctaccgcgtgacagagggccgagggatttttgcatcaggaagtccattcaagtcagtgacactcgaagacgggaaaacatttatccccggccagggcaacaacgcctatgtgtttcccggcgtcgccctgggtgtgattgccggagggatacgacacattcctgacgagatcttcctcctcaccgctgaacaaatcgcccaggaggtttctgagcagcatctgtcgcagggcagactctaccccccactcagcaccattagagacgtgtcacttaggatcgccatcaaagtcttggattatgcttataaacacaacctggctagctattacccggagcctaaggacaaagaagcttttgttagatcactggtgtacaccccagactatgatagctttacactcgacagctatacttggcctaaagaggctatgaatgtgcagacggtttag

SEQ ID NO: 194083 - DNA, 759 bp, Artificial Sequence
  Description of Artificial Sequence: Synthetic coding sequence
atggccttcaccctggaggagcggctgcagctgggcatccacggcctgattccgccctgcttcctgtcccaggatgtgcagcttctccgcatcatgcgctattatgaacggcagcagagcgacctggacaagtacattattttgatgacgcttcaggatcgtaatgaaaaactcttctatagagtcttaactagcgatgttgaaaagttcatgcccatagtgtatacgcctaccgtcgggctcgcctgtcagcattatggactgacctttagacggccccgaggtctctttatcaccattcacgataaaggccatcttgcaactatgcttaattcatggcccgaagacaacatcaaggccgtcgtggttaccgatggtgagcggattctgggattgggtgacctcgggtgctacggaatgggcatccccgttggcaaactagccctgtatacagcctgcggcggcgtgaatccccaacagtgcctgcctgtgctgctggacgtaggtacaaataacgaagagctgcttcgagacccactttacatcggactgaagcaccaacgagtgcacgggaaggcatatgacgatctgctcgacgagttcatgcaagcagtgactgataagttcggtatcaactgcctgatccagtttgaggatttcgcaaatgcgaacgcgtttcgcctcctgaacaaatacagaaacaagtactgcatgttcaatgatgacatccaggcgccctccacagccccagccacttag

SEQ ID NO: 194084 - DNA, 1482 bp, Artificial Sequence
  Description of Artificial Sequence: Synthetic coding sequence
atgcggggcttcggccccggcctgaccgcccggcggctgctgcccctgaggctgcccccacgtccccctggaccgaggctggcctctggccaagcggctggcgccttagaaagggctatggacgaactgctgcggcgcgcagttccaccaactcccgcctacgagctccgggaaaagacacccgcacctgctgagggccagtgcgctgacttcgtcagcttctacggagggctagcggagaccgctcagcgagccgagctgctggggcgacttgcccgaggctttggggttgatcacggacaggtggctgagcagtccgccggcgtgctgcatctgagacagcagcagagggaagctgctgtccttctccaggctgaagaccgattgcgctatgctttggtaccacggtaccgcggtttgtttcatcacatatctaaactcgatgggggtgttcgtttcctagtccagttaagggctgacctcttagaggctcaggcacttaagctagtggagggacctgatgtcagggagatgaacggagtgctgaaggggatgctcagcgaatggttctcctcaggctttctgaatctagagcgcgtgacatggcactccccctgcgaggttcttcagaagatttccgaggcagaggccgtccatccggtgaagaattggatggacatgaaaagacgggttggcccctatcggagatgctacttttttagccactgtagcacaccgggcgagcctctcgtcgtacttcacgtcgccctgacgggggacattagcagcaatatccaggccattgtgaaagagcacccaccgtccgagaccgaggagaagaataaaattacagccgctattttttactccatttcgctcacacaacaggggctccagggggtagaacttggaacattcctgatcaaacgcgtggtgaaggagctgcaaagagagttccctcatctgggagttttttcctccctgagcccaattcccggattcacaaagtggctgctcggcctgctaaattcacaaactaaggaacacggcaggaacgagctctttacagactccgagtgcaaggaaatttcagaaatcacaggcggccccataaacgagactctgaaactcctgctgtcttcttctgaatgggtccagagtgagaaactggtgcgtgctctccagacacctctgatgagactatgcgcatggtatttgtacggcgagaagcaccggggttatgcactcaaccctgttgctaacttccacttgcagaacggtgccgttctctggcggatcaactggatggcggatgtgtctctccgcgggattactggtagctgcggattgatggcaaattatcgttattttttagaggagaccggcccaaactctacttcctacctgggctccaagatcatcaaagcctccgagcaagttctgtcgctcgtggcacagttccagaaaaacagtaagttgtag

SEQ ID NO: 194085 - DNA, 558 bp, Artificial Sequence
  Description of Artificial Sequence: Synthetic coding sequence
atggcccggaagaagctgaagaagttcaccaccctggagatcgtgctgagcgtgttactattagtgttgtttatcatcagcatagttctcattgtcctattggctaaagagagcctaaaaagcaccgctccagatcccggaactaccgggacccccgatcctggcactacaggcacacctgatccaggcacaactggtacaacacacgcccgcaccaccggcccacctgatcccggcacaacaggtactacacccgttagtgctgagtgtcctgtggtgaatgagctcgagcggatcaactgcattccggaccagccccctaccaaggccacatgtgaccaacgcgggtgctgctggaatccccaaggtgcagtgtccgtgccttggtgctactactccaaaaatcattcttatcatgtcgagggcaatctggtgaatacaaatgccggtttcactgccagactcaagaaccttcctagctcaccagtgttcggctccaatgtggacaatgtgctacttactgcagagtatcagacatctaataggtttcacttctag

SEQ ID NO: 194086 - DNA, 4989 bp, Artificial Sequence
  Description of Artificial Sequence: Synthetic coding sequence
gccgtgagcgtgccctggtgctactacagcaagaaccacagctaccatgtggaaggcaacctggttaacaccaacgccggattcacagcacgcctgaagaatcttccatccagcccagtattcggaagcaatgttgataatgttttgctcacagccgaataccagacctcaaatcggttccattttaagttgacagatcagaccaacaaccgctttgaagtcccacatgagcatgtgcaatcctttagcggcaacgcagccgcctccctgacatatcaggtcgagattagtcgccagccattcagcatcaaggtaacgcgccgctctaataaccgcgttctattcgattccagtatcgggcctctcttgtttgcggatcagttcctgcaactctcaacgcgtctaccctctaccaacgtgtacggtctcggggagcacgttcaccagcagtacagacacgatatgaattggaagacatggccaatcttcaatcgagacaccacgcccaatgggaatggtactaacttgtatggagcccagaccttcttcctgtgccttgaagacgcatccgggctgagtttcggcgtcttcctgatgaacagcaatgccatggaggttgtgctgcaaccagccccagctattacatacagaactatcggagggatcctggatttctacgtgtttttgggaaacacccccgagcaagtcgtccaagagtacctggagctgatagggcgaccagctctgccctcatattgggcacttggctttcacctctcccgctacgagtacggtaccctggataacatgcgggaggtggtcgagcgaaaccgtgccgctcaacttccatatgatgtgcaacatgccgacatcgactacatggatgaacgacgcgatttcacctatgattcagtcgatttcaagggatttccagaattcgtgaatgagctacacaataacggccagaaactagtgataatagtggatcctgcgatttctaacaacagctcatcgagcaaaccgtatggcccctacgaccggggatctgatatgaaaatttgggtgaacagttcggacggagttaccccacttataggtgaggtgtggcctggccagacagtgttccccgactatacaaaccccaactgtgcggtgtggtggacaaaggagttcgagctgttccacaatcaagttgagttcgacgggatttggatcgatatgaacgaggtgtcgaatttcgtcgacggctcagtgtctggttgttctaccaataacctcaataatccccccttcacaccgcggatcctggacggctacctcttctgcaagaccttgtgcatggacgccgtgcaacattggggcaaacagtatgacatccacaacttgtacggatactcaatggcagtggcaacagctgaggctgccaagacagttttccccaacaaaaggagcttcatcttgacccgatccacctttgcaggctccggcaaatttgccgctcattggcttggggataatactgccacatgggatgatctgagatggagcattccgggtgtcttggaatttaacctgtttggcattccaatggttgggccagatatttgcgggtttgctctggacacccctgaagaactgtgtcgccggtggatgcagctcggggcgttttatcctttttctaggaaccacaacgggcaaggatataaggatcaggacccagccagttttggtgccgattccctgctgctaaacagttctcggcactacctgaacatccgatacactttgttgccctatttgtatacgctcttctttagagcccacagccggggcgacactgtcgcgagaccattgttacatgagttttatgaggataatagcacttgggatgtgcaccagcagttcctgtggggacctggattactgattacccccgtgttagatgagggtgctgaaaaggtgatggcatacgtacctgacgccgtttggtatgactatgagacaggtagtcaggtgagatggagaaaacagaaagttgaaatggagttgcccggtgacaagatagggctgcacctgcgagggggctatatttttcccactcaacagcccaacactactacactggcctcaagaaagaaccccctggggctgatcatcgctctggacgagaataaggaagccaagggagagctgttttgggataatggggagacaaaggacaccgtcgctaataaagtttatctcctgtgtgaattcagtgtgacacaaaatagactggaagtgaatattagccagtcaacctacaaggatcccaacaacctcgcgtttaatgagatcaagattcttggaactgaggaaccatctaatgtgactgtcaaacacaatggtgttcccagtcagacttctcctacagtgacatacgattctaacctgaaagttgctataattactgatattgatttactgttaggcgaggcgtatacggttgaatggtctattaaaattcgcgatgaggaaaagatcgactgctacccggacgaaaatggcgccagtgccgagaattgcacagccaggggatgcatctgggaagctagcaactccagcggagttccattttgctacttcgtgaatgacctgtatagtgtcagcgacgtgcagtacaactctcatggagcgacggctgacataagtttaaaatcttcagtctatgccaacgcatttccaagcacgccggtgaaccctctgaggctcgatgtcacctaccacaaaaacgaaatgctacaatttaaaatctacgaccccaataaaaacagatatgaagtacccgttcccctgaatattccaagcatgccttctagtacacccgaaggtcagctgtacgacgttctaattaaaaaaaatcctttcggaatcgagataagacggaaaagcactggaaccatcatttgggattcacagctgcttggctttactttcagcgatatgtttattcgcatcagcacccggcttccatctaagtacctctatggttttggggagacagagcatcggtcctatagaagagacctcgagtggcatacttgggggatgttctcgcgtgatcagcctccagggtataaaaagaattcctacggggttcacccctactacatgggcctagaggaggacggatcagcccatggggtccttctgctaaactctaatgcaatggatgtgaccttccagccgttgcctgcattgacataccgcaccactggtggagtgctcgacttctacgtgtttctgggccccactcctgagctagtgacccagcagtataccgaactaatcggtagacccgtcatggttccttattggtctctaggattccagttatgtaggtacggttatcagaacgactcagagattgcctccttgtatgacgagatggtcgctgcgcagatcccctacgatgtccagtactccgatatcgactacatggaacgtcagctggacttcacgctctccccaaagttcgctgggtttccggccctgattaatagaatgaaggctgatggcatgagggtgatcctgattctcgatccggctatctcaggtaatgagacacagccctacccggcgttcacacggggagttgaagatgatgtgtttattaagtatcccaatgacggcgacatagtttggggcaaggtttggcccgattttcctgatgttgtggtgaacggatcgctggactgggatagccaggtcgagctctacagagcatacgtggcttttcctgactttttcagaaacagcaccgctaaatggtggaagagagagatcgaggaactgtataacaaccctcagaaccctgaaagatctctgaagtttgatgggatgtggattgatatgaacgagcccagcagtttcgttaatggcgcagtctccccaggctgccgggacgctagcctgaatcatcctccgtatatgccacacctagaaagcagagacagaggcctgtcaagtaagacgttgtgcatggagtcacagcagatactgcctgatgggagcttagtgcagcattacaacgtgcacaatctgtacggctggtcccaaacacgtcccacttacgaggccgtccaagaggtgacagggcaacggggagttgtcattacacgttccactttcccctcatctggcaggtgggccgggcattggctcggagacaacactgcagcctgggatcagttgaagaagtccatcatcgggatgatggagttcagcctcttcggtataagctacaccggcgccgatatttgtggcttttttcaggatgccgaatatgagatgtgcgtgcggtggatgcagctcggggcattctatcccttttctcggaaccacaacacaattggcacgagaaggcaggaccctgtctcctgggacgctgcctttgtgaacataagcagaaacgtcctgcagaccaggtataccctcctgccatatctttataccctcatgcaaaaggcccacaccgagggcgtgaccgtggtcaggccactcctccatgagttcgtcagtgatcaggtaacatgggacatagactcgcaatttctgttaggccccgctttcctggtgtcacccgtgttggaaagaaatgccaggaacgtgaccgcttacttcccgcgcgctcggtggtatgattactacacgggagtggacatcaacgccaggggcgagtggaaaactttgcccgctcctttggatcacatcaacctgcatgtacgaggtggttacatacttccatggcaggagcctgcactaaacacgcacctttccagaaaaaatccgttagggcttattattgcattagacgagaataaagaggcaaaaggagagttgttttgggatgacggacagactaaagacacagtggccaagaaagtgtacctgctgtgcgagttttccgttacacaacaggtggtatttttaaatatcgtgttcaactag

SEQ ID NO: 194087 - DNA, 5574 bp, Artificial Sequence
  Description of Artificial Sequence: Synthetic coding sequence
atggcccggaagaagctgaagaagttcaccaccctggagatcgtgctgtctgttctactcctagtacttttcataatcagcatcgtcctgattgtcctgttggctaaagaaagtctgaagagcactgcacccgaccctggtacaaccggtacgcccgacccagggacgaccggcacgccagatcctgggaccaccggcacaactcatgcacggacaacaggtcccccggacccaggaacaacaggcaccaccccagtgtccgctgaatgccccgtcgtgaatgaactggagagaattaactgcattcctgatcagcctccaactaaagccacttgtgatcagaggggatgctgttggaatccccagggagccgtctcagtgccatggtgctactacagtaaaaatcacagctaccatgtggaagggaacttggtcaacactaacgccgggttcacagctaggctcaagaatctgccctcctcccccgtgtttggtagcaatgtcgacaacgtgctgctgaccgctgaatatcagacttcaaatcgattccactttaagctgacggatcagactaataatagatttgaggtcccccatgaacatgttcagtcgttttccggcaacgccgctgcctcactcacataccaggtcgaaatcagtcgacagccttttagcattaaagtcacccgacgctctaacaatcgggtactcttcgactctagcattggccccctgctgtttgctgaccagtttctgcagctgtccactcggctgccctccaccaatgtgtatggcctgggagagcatgtgcatcagcaataccggcatgatatgaactggaagacctggcctatatttaatagggacacaacaccaaacggcaatggaaccaatctgtacggggcccaaaccttcttcttgtgcctggaggacgccagcggactgtcttttggtgtcttcttgatgaattccaacgccatggaagtagtgttacaacctgcacccgccatcacgtatcgaacaattggcggcatcttggatttctacgtttttctcggaaacacacctgaacaggtggtccaggaatacctcgaattgattggaaggccagctctccccagttactgggcactgggattccacttgtccagatacgagtacgggaccctagataatatgcgtgaagtcgttgagagaaaccgggctgcccagctgccctacgacgttcagcatgcagacattgattacatggacgaaaggcgcgattttacctacgatagcgtcgatttcaaaggattccccgaattcgtaaacgagttgcataataatggacagaaactcgtcatcattgtcgacccagctattagcaataattcttcgtcctctaaaccttatgggccttatgaccggggctcagatatgaagatctgggtgaattcgtcggacggggttaccccgctgatcggtgaggtgtggccaggccagacagtgttccctgactacacaaaccccaattgcgcagtctggtggacgaaggagtttgagttgtttcataatcaggttgaattcgacggtatttggatcgatatgaatgaggtgtccaattttgttgacggaagtgtgtctggatgtagtaccaataacttaaataatccaccatttactccccggatactcgatggctaccttttttgcaaaactctgtgtatggatgccgtccagcactgggggaagcagtatgacatccataatttgtatggctatagcatggccgtcgctactgcagaggccgctaaaacagtatttccgaacaagcggtctttcatcctgacccgctcaacctttgctggaagtgggaagttcgccgcccactggctgggcgacaacaccgcgacctgggacgatttgagatggagcattccaggagtgctcgagttcaatctgtttggtatccccatggtgggacctgatatttgcggtttcgcattggacacaccagaagagctgtgtcgaaggtggatgcagctaggcgccttctatcctttctcgagaaatcacaacggacagggctataaagaccaggacccggcctcatttggtgctgatagcctgctcctcaactcatcccgccattatctgaatatcaggtatactttgctgccgtacttatacacgctgttctttcgtgcgcacagcaggggtgacacagtagcccgcccccttttacacgaattttacgaagacaatagtacctgggacgttcaccagcagttcttatggggtccaggcctattgatcaccccagttctcgatgagggcgcagaaaaggtgatggcatacgttccagacgccgtgtggtatgactacgagaccggcagccaagtacgctggcgaaagcagaaggttgagatggagctgcccggagacaagatcgggttgcacctgcgcggcggatatatatttcctactcagcaacccaataccaccacccttgcttctagaaaaaacccccttggtctgattatcgccctcgacgagaacaaggaggctaagggcgaactgttctgggataacggtgaaacgaaagatacagtagctaataaggtgtatttgctctgcgagttctccgtcactcagaaccgcctagaggttaacatctcgcaaagtacctacaaggacccaaacaatttggccttcaacgagataaaaatcttaggcactgaggagccctccaacgtgacagtaaagcacaatggagtaccatcccagacatcccccaccgtgacctacgacagtaacctcaaggtcgccatcatcacagatatcgaccttctcctgggagaagcttataccgtcgaatggtctatcaaaattcgcgacgaggaaaaaatcgactgctaccctgacgaaaacggagcctctgccgaaaactgcacggcccgcggatgcatttgggaggcctccaatagctccggcgtgcccttctgctactttgtcaacgacctgtactccgtaagcgatgtacagtacaactcccatggtgcaaccgccgatatctctcttaagtccagtgtttatgccaacgcgtttccatccacaccagttaatccgctacgactcgatgtgacataccacaaaaacgagatgttacagtttaaaatttatgatccgaacaagaatcgttatgaggtaccggtaccactcaatattcctagtatgccctcctcaaccccagagggccaactgtacgatgtactcattaaaaagaaccctttcggcattgagatacgccgaaaatccacaggcacgatcatttgggacagccagttgctggggtttaccttctccgatatgtttatcagaattagcacaagactaccttctaagtatctctacgggtttggcgagaccgaacatcgctcctatcgtcgcgacctcgagtggcacacatggggcatgttcagtagagatcagcccccgggttacaagaaaaacagttacggagtccatccgtactacatgggcctcgaggaggatggatccgcccacggcgtgctgctactcaatagcaatgcaatggacgtgacatttcagcctttgcccgccctaacctatcgaactactggcggtgtactagatttttacgtttttttagggcccactcccgaactagtgacccagcaatacacagagctgatcggccggccggtcatggttccttattggagtctaggcttccagctgtgccgttatggataccagaacgactctgagatcgcctcactctacgatgagatggttgccgcacagatcccctacgatgtgcagtactcagatatagattacatggagaggcagctcgacttcactctaagtccaaaatttgctggatttccggcactcataaacagaatgaaagcagatggcatgcgtgtgattctgattctcgacccagctatttctggaaacgaaactcagccatatcctgccttcacaagaggagttgaagatgacgtgtttattaagtaccctaacgacggcgacatcgtgtggggaaaggtgtggcctgatttccctgatgtggtcgtgaacggatccttagactgggattcccaggtagaactatatcgcgcctacgtggctttccccgacttcttccggaattccaccgctaagtggtggaagagggagatcgaggagctgtacaacaaccctcagaaccccgagcgctctctgaagttcgacggtatgtggattgacatgaacgagcccagttcctttgtgaacggagccgtctcacccgggtgccgagatgcatccctgaatcacccaccctatatgccccacctggagtccagagaccgcgggctgtcttcgaaaaccttgtgcatggagtcacaacagattttgcccgatgggtctctggtacagcattacaacgtgcacaacctctatggatggtcccagacccgcccaacatacgaagccgtccaggaggtgacaggccagcgcggcgttgtcataacccggtcaacattccctagttccggtaggtgggctggtcattggctgggtgataataccgccgcatgggaccagttgaaaaaatccatcatcggcatgatggagttttcattgtttggaatctcttacacaggagctgacatatgtgggttcttccaggacgccgaatacgagatgtgcgtgcgctggatgcagctgggcgctttttaccctttcagtcgcaatcacaatacaattggcacccgccgccaagaccctgtctcatgggacgttgccttcgtaaacataagccgaacagtcctacagacccgatataccctcctgccttatctttacacacttatgcacaaggcgcataccgagggagttacggttgtccgtccattgctccacgaatttgtgtccgaccaagtgacctgggacatcgattcgcagtttctgctagggcccgcatttctggtcagccctgtgctggaaagaaacgcccggaacgtgacagcttacttcccccgggccagatggtacgactactatacgggcgtcgatataaacgctagaggcgagtggaaaactctacctgctcccctagatcacattaaccttcatgtcagaggcgggtacatcctcccgtggcaggagccagcactaaatacccacttgagcaggcagaagtttatggggtttaagatcgctttggatgatgagggaacagccggcggctggctcttctgggatgatggtcagagtatcgatacatatgggaagggcctctactacctggcgagcttctccgccagccagaatactatgcagagtcatattattttcaataactacattacaggaaccaatcctctgaaactcggctatatcgagatttggggagtgggaagtgtgcctgtgaccagcgtgtctatttcagtttctggtatggtcatcacaccgtcttttaataatgacccaaccacacaggttctgtcaattgacgtcactgacaggaacatttccctgcataacttcaccagcctcacgtggatctcaacactgtag

SEQ ID NO: 194088 - DNA, 2061 bp, Artificial Sequence
  Description of Artificial Sequence: Synthetic coding sequence
atgctgctgcggggcgtgctgctggccctgcaggccctgcagctggctggagccctcgacctccctgcaggaagctgtgccttcgaggaaagcacctgcgggttcgattccgttctggcgtcactgccctggatcttgaacgaagagggccactatatttacgtggacacatcattcggtaaacagggcgaaaaagctgtgctcctctccccagatctccaggctgaagagtggtcctgcctgagactcgtgtatcaaattacaacctcatctgaatctctgagcgatccctcccaattgaatctctacatgcgatttgaggacgaaagtttcgacaggctactttggagtgctaaggaaccaagcgattcctggcttatcgctagtttggacctgcagaactcttcaaagaagtttaaaatcttaattgagggggtgctagggcagggcaataccgccagcatcgctctgttcgaaatcaaaatgacaacaggatactgcatcgaatgtgatttcgaggagaatcacctctgtggattcgtcaatagatggaatccaaatgtcaattggttcgttggcggtggatccattaggaacgtgcattctatcttgccacaggatcataccttcaagtctgagcttggacattacatgtacgtggactcagtttatgtgaagcacttccaggaggtcgcccagctcatcagtccacttacaacagcccctatggcggggtgcctgagcttttactatcagatacagcaggggaatgataacgtctttagtctttacactcgggatgtggccggcctttacgaggagatatggaaagctgacaggccaggaaatgcagcgtggaaccttgccgaggtcgagttctccgcgccctatcccatggaggtaatcttcgaggtggcatttaacggccctaaagggggatacgtcgctctggatgacatatctttttcacctgtgcattgccagaaccagactgaactgctgtttagcgcagttgaagcctcgtgtaacttcgagcaggacctttgcaacttctaccaggacaaggagggcccaggatggactcgcgttaaagtaaaaccaaatatgtacagggcaggtgatcacactacaggcctgggctactatctgctggccaacaccaagttcacatcacaacctggttatattggcagactctatggaccttctctgccgggaaacctccagtactgcttaagattccactatgccatctatggattcctcaaaatgagtgacacgctggcagtatatattttcgaggaaaaccacgtagtccaggaaaagatctggtccgtgttagaatctccgagaggcgtttggatgcaggccgaaattacgtttaagaagccaatgccaacaaaagtggtgtttatgagcctctgtaagtcattttgggactgtgggcttgtggcactagacgatattactattcagcttggcagttgttcgagctcagaaaagctgccacctcctcctggtgagtgtacgtttgagcaagacgaatgcacctttacccaggaaaagcggaatcggtcttcttggcataggaggaggggcgagactccgacctcttataccgggccaaaaggcgaccacactaccggagtgggatactacatgtatattgaggcaagtcatatggtttacggccagaaggccagacttctctcacgtcccttgagaggagtttctggcaagcactgtttgacttttttttaccatatgtacgggggcggcactggcctgctctctgtctacctgaagaaagaggaggattctgaggaaagtctgctgtggaggagacgaggtgaacagagtatctcatggctgcgcgcactgattgagtattcatgcgaaagacaacaccagattatatttgaggcgatcagaggggtctcaattagatctgacattgccatcgatgacgtgaaatttcaggctggaccctgcggggagatggaggacactactcagcagtcctccggatatagcgaggatcttaatgaaatagagtattag

SEQ ID NO: 194089 - DNA, 2880 bp, Artificial Sequence
  Description of Artificial Sequence: Synthetic coding sequence
atggaggtgacctgcctgctgctgctggccctgatccccttccactgccgaggtcaaggcgtgtatgccccggctcaggcccagatagtacatgccggtcaggcatgtgtggtgaaggaggacaatataagcgagagagtctacaccattcgggagggggacacactgatgctgcagtgcctagtcaccggccacccgcggccacaggtgcggtggacgaaaacagccggaagtgccagcgataagtttcaagaaacatcagtgttcaacgagaccctacggatcgagcggattgccaggacacaaggggggcgatattattgcaaagccgagaatggtgtgggggtgcctgcaattaagagcatccgggttgatgtccagtaccttgacgagccgatgttgacagtgcatcaaaccgtctcggatgtccgaggcaatttttatcaggaaaagaccgtgtttctcaggtgtacagtgaactccaatccaccggctcggttcatctggaagcgaggaagtgataccctgagccattcgcaggacaatggcgttgacatctatgagcctctatatacacagggcgagacaaaagtgttgaagctgaagaatctccgcccgcaggattacgcctcctatacatgtcaggtatccgtgagaaacgtgtgcggtattcccgataaggcaatcacatttcgactgacgaatacaacagctcctcccgccctgaagttgagcgtaaatgaaacactcgtggtgaaccccggtgagaacgtcaccgtgcaatgtctgctaaccggcggcgatcccttgccccagctgcagtggtcgcatggccccggccctctgccattaggcgccctcgcccaggggggtacactgagtatcccttctgtccaggcacgagattctggctattataattgcaccgcaaccaacaacgtgggaaacccggctaaaaaaactgtaaacctgcttgtccgctccatgaaaaacgcaacctttcagatcacgccagatgttattaaagagtctgagaacatccagctcggacaagatctcaaactgagctgtcacgtggacgccgtgccccaagagaaggtgacttaccagtggttcaagaacggaaaacctgccagaatgagcaaacggctgctcgtgacgcgcaatgatccagaactgcctgccgtgacatcttctcttgagctgatcgacttacacttttcagactacggcacctacctgtgcatggcaagctttcccggggcccccgttcctgatcttagcgtggaggtgaatataagttcggaaacggtgccacctacaatcagtgtgcctaaaggacgcgcagtggttactgttcgtgaaggatcccctgcagaacttcagtgtgaggtgcgtggcaaacctcgccctcccgttctgtggtcccgagtagataaagaggctgcattgctgccctcaggattgccacttgaggagacccccgacggtaaactgcgcctagagcgcgtgtcaagggacatgtccggaacttatcggtgccaaacagctaggtacaacggttttaatgtcagacccagggaagcacaggtgcaattaaacgttcagtcaccctgctttcctccggaagtggaacccagcagccaggatgtgaggcaggccctcggtaggcccgtgctcctcagatgcagcctgctgcgtggtagccctcagcggattgcttcagcggtgtggaggttcaagggacagctgctgcctcctccccctgtggttcctgctgcagctgaggcacctgaccacgcggagctccgactggatgctgtaacaagagactcaagcggaagttacgagtgctccgtgtctaacgatgttggtagtgcggcttgcctgtttcaggtctcggcaaaggcgtacagccccgaattctacttcgacacgccgaatccaactcgaagccacaagctctccaagaactactcctatgtgctgcaatggacccagagggaacccgacgcagtcgatccggtgctgaactatagactctctatccgccagcttaaccagcataacgcggttgttaaggctattcctgtcagaagggtagagaaaggacagctactcgaatatatactgaccgatctgcgtgtccctcactcttacgaggtgcgactgactccttacacaacattcggcgcaggagatatggcctctcgcatcatacattacaccgagctcctggcccttcgaacactgtccagcgataatacgtgccactttgaagatgaaaagatctgcgggtacacacaggatctgacagacaactttgactggacccggcagaatgctctcacacagaatccaaaacgttctccaaatacgggcccgcctactgatatttctggaactccggagggatattacatgtttattgaaacaagccggccccgcgagctgggtgatcgtgcaagactggttagccccctatacaatgctagcgcaaagttttattgtgtttcctttttctatcatatgtacggtaaacatattggatctctgaatctgcttgtcaggtcccgcaacaaaggggcactggacacccacgcctggagtctgagtggaaataagggcaatgtctggcagcaagcccacgtgccaatcagccctagcggtcccttccagattatcttcgagggcgtacggggaccaggctaccttggggatattgccatcgacgatgtcaccctgaagaagggggagtgtcctcgcaaacaaacagaccctaacaaggtcgtggttatgccaggcagtggcgctccgtgccagtcctctccacaactgtggggcccaatggccatttttctactcgcactgcagcgctag

SEQ ID NO: 194090 - DNA, 2868 bp, Artificial Sequence
  Description of Artificial Sequence: Synthetic coding sequence
atggaggtgacctgcctgctgctgctggccctgatccccttccactgcagagggcaaggggtgtacgcccctgctcaagcgcaaattgttcacgcagggcaggcctgcgtcgtcaaggaagataacatcagcgaacgcgtctacacaattcgggaaggagacacactgatgttacaatgcctggtcactggacaccccagaccacaagtcaggtggactaaaaccgccggcagcgctagcgataaatttcaagagactagcgtgtttaacgaaacgctcaggatcgagcggattgccagaactcagggaggacgctactattgcaaggccgagaatggcgtgggagtccctgcgatcaaatccattcgggtggacgttcagtatctggacgaaccaatgctaaccgtccaccagactgtgtccgacgtgagaggaaacttttaccaggagaaaactgtctttctgcgctgtacagttaacagcaacccacccgctcgtttcatttggaagaggggttctgatactttatcccatagtcaggacaacggcgttgatatctacgagccactgtatacacagggggagaccaaggtattgaagctgaaaaacttgcgcccacaagattatgcttcctacacctgtcaggtgtctgttcgaaatgtctgcgggatccctgacaaagccatcaccttccgattgactaatactaccgcccccccagcgctcaaattgtctgtcaatgaaactttggtagtcaaccctggagaaaatgtcactgttcaatgtttactcactggtggggatccactacctcagctacaatggtcccacgggccgggtcctctcccactgggcgctttggcccaagggggaactcttagcataccaagtgtgcaggccagggattccgggtactacaattgcacagctaccaacaacgttgggaaccccgccaaaaagaccgtgaaccttttggtgaggtccatgaaaaacgcaacctttcagatcacacctgatgttataaaggaatctgaaaacattcagctaggccaggacctgaagctgtcatgccatgtggacgcggtgccgcaggaaaaagtgacataccagtggttcaaaaatggaaaacccgcccgcatgagcaaacggttgctcgtgacaagaaacgatcccgagctgccagctgtcactagcagtcttgagcttattgatctccatttttctgactatgggacatatctctgcatggcctccttccctggagcccccgttccagatctctcggtggaggtgaatatttcaagcgaaactgtccccccaaccatctcagtcccaaaaggcagggccgtcgttacagttcgggagggaagtcccgcagaactacagtgcgaggtgagggggaagcctcgtcctcctgtgctgtggtccagggttgataaagaagcagctttgctgccttctggactgccactcgaggaaactccagacggcaaattgcgcttagagagggtgtcccgagacatgtccggtacctatcgctgccagaccgcccggtataatggcttcaatgtacgaccgcgagaggcacaagtacaactgaatgtccagttccctcccgaagttgagcccagttctcaagacgtcaggcaggctttgggccggccagttcttttacgctgttcactgctcaggggatctcctcagcgtatagcctcagccgtctggcgcttcaaaggccagctcctgcctcctccccctgtggtgcccgctgcagccgaggcaccggatcacgccgaactgagattggatgccgttaccagggattcctcggggtcttacgaatgttctgtgtccaatgatgtgggctctgcggcctgtctctttcaagtgtcagccaaagcatacagtcccgagttctactttgacaccccgaatcccacaaggtcacacaaactgagcaaaaactacagctatgtgttgcagtggactcagagagagccagacgccgtggatccagtgctaaattatcggctttctattcggcagctgaaccagcacaatgctgtggttaaagcaattcctgttcgccgagtggagaaagggcagctcttggagtacatcctaactgacctcagagttccgcactcctacgaagtcagactaaccccctacacgacctttggggctggtgacatggcctcacgcatcatccactacaccgagccaattaacagccctaatctgtccgacaacacatgtcacttcgaggacgagaagatttgtgggtacacacaggatcttaccgacaatttcgattggactcgtcaaaacgctctgacacagaatccaaaaagaagtccaaacaccggaccaccaactgatatttccggtacccccgaggggtactacatgttcatcgaaactagccggcccagggagcttggagatcgcgcaaggttagtaagcccattatacaatgctagcgcaaaattctactgtgtgtcttttttctatcacatgtatgggaagcacatcggatcactgaatctcctggtacggtctcggaacaagggggccctcgatacccatgcgtggtccctgagcggaaacaaaggcaacgtatggcagcaggcccacgtgccaatttcgccttccggcccctttcagatcatcttcgagggtgttaggggacccggatacctcggcgatatcgcaatagatgatgtgactctcaagaagggcgagtgccctcggaaacagactgaccccaataaggtcgttgtgatgccgggatctggggcgccatgtcagtcgagccctcaactttggggccctatggccatattccttttggcactgcagagatag

SEQ ID NO: 194091 - DNA, 2922 bp, Artificial Sequence
  Description of Artificial Sequence: Synthetic coding sequence
atggaggtgacctgcctgctgctgctggccctgatccccttccactgcaggggccagggggtgtatgcacctgcccaggcacaaatagttcatgcagggcaggcctgtgtagtgaaagaggacaatatatcagagagagtgtacacgatccgtgaaggggatacactcatgttgcagtgccttgtaaccggacacccccggccacaggtgcggtggacgaagaccgcggggagtgcaagcgataagtttcaggaaacaagcgtgtttaacgagaccctgcggattgaaagaatcgcacggacccagggcggacgctactactgcaaagccgagaatggggtgggcgtccctgcgattaagtccatcagggtggacgttcaatacttagatgagcccatgctcactgtgcaccagactgtgagcgatgtgcgcggaaatttctatcaggaaaaaacagtctttctgcgctgcactgtgaacagcaacccccccgcccggtttatatggaagcgcggcagtgatacgctgtcacacagccaggacaatggcgtcgacatttatgaacctttgtacacacaaggcgaaacaaaggtgttaaagctaaaaaacctgagaccccaagattacgcatcatacacctgccaggtgtctgtccggaatgtgtgcggcattcctgataaagcgatcactttccgactcaccaacactaccgcaccaccagccctcaagctcagcgtcaacgaaacattggtggtgaatcctggcgaaaatgtaaccgttcagtgccttttgaccggcggggatccactgccgcaactacaatggtcccatgggcctggtccattaccgctcggggccctcgcccagggcggtaccctgagcattccgtctgtgcaggccagagacagcggctactataactgcactgctactaataacgttggcaatcctgccaagaaaaccgtgaacctgctggttcggagcatgaaaaatgctacattccaaatcacaccagatgtgatcaaggagtccgagaatattcaactaggtcaggaccttaaactgtcatgtcacgtagacgccgtgcctcaagaaaaagtcacatatcaatggtttaagaatggcaagccagcgagaatgagcaagcggctccttgtaactagaaatgaccctgagctccccgcagtcacgagctccttggaactcatcgatcttcactttagtgactatggcacctacttgtgcatggcatcattcccaggggccccagtgccagatttgagcgtcgaagtgaatattagctctgaaaccgtgccccctacaatctcagtcccaaaggggagagccgtggtaaccgtgagagaaggatccccagctgagcttcagtgtgaagttaggggtaagccccggccaccggtactttggtctagagtcgacaaggaggccgctcttctgccttcaggtctgccgctcgaggaaacacctgacggtaagcttagactggagagagtgtcccgtgacatgtctgggacataccgatgtcagaccgcacgctacaatggatttaacgtgcgccccagagaggctcaggtgcagctgaatgtgcagtttccacccgaggtggaaccaagctctcaagacgtgaggcaggccctgggcagacctgtccttctgcgctgttccttactgcgggggagccctcagcgcattgcctctgctgtctggcgctttaaagggcagttgctcccaccacccccagtcgtacccgcagccgcagaagccccagaccacgctgagcttcgactggacgcagttactagggactctagcggatcgtacgagtgtagtgtgagcaatgacgtggggtcagctgcctgcttgtttcaggtgtctgctaaagcatactcccccgagttctacttcgacactcccaatcctactagatcccacaaactatctaaaaactactcctacgtgttgcagtggacgcagcgggagcctgatgccgtcgatcctgttctgaattaccggctttcgataagacagctaaatcagcacaacgcagtggtgaaggcgatccctgttagacgggttgagaaggggcaattgctggaatacattctcacagatctgcgcgttccgcactcctacgaggtaagactcactccatacacaaccttcggagcgggagacatggcaagccgtattattcactataccgagccaatcaattctcccaacctttctgacaacacatgtcactttgaagatgagaagatttgtggctacacacaggatctcaccgacaacttcgactggacacggcagaacgctcttacgcagaatccaaagcgtagccctaacactggccccccaactgatatttcgggcacgcccgaaggctattacatgttcatagagaccagccgcccaagggagttgggcgatagagcccgtctcgtgtcccccctgtacaatgcgtccgcaaagttttactgtgtgagttttttctatcacatgtatggcaagcatatcggctcgcttaacctacttgtccggtccaggaacaaaggagcactggatacacacgcttggagtctgtcagggaataaaggcaatgtctggcaacaagctcacgtgccaatcagtcccagcggcccctttcagatcatcttcgagggcgtgcggggcccaggctacctgggggatatcgccatcgacgatgtcactcttaaaaaaggcgagtgcccacgcaagcaaactgatcccaacaaaggagcccgcagggaggggggtggcggcgccgagtctggaggtagctgtgcttggcgtggctttctttcggtcgagggcggatgcctgggcctgaaccggggctctgagtgtctctctgatgggaatcatgtcgccctcaccgtgtag

SEQ ID NO: 194092 - DNA, 2184 bp, Artificial Sequence
  Description of Artificial Sequence: Synthetic coding sequence
atggtgagcttccggctgagcaacaagaccgccagccccagcatcaagcttttggtggacgatcctatcgtggttaacccaggtgaggccatcacactggtgtgcgtgaccacaggcggagaaccagctccaagcctgacatgggtgcgatccttcggaaccctccctgagaagactgttcttaatggtggcacacttaccatcccagctattacatcagacgatgctggaacttatagctgtatcgcgaataataatgttgggaatccagccaagaaaagcacaaacatcattgttcgcgctcttaaaaagggaaggttctggatcacaccagacccataccacaaggatgacaacatccagatcggaagagaggtgaagatcagctgccaagtggaagcggtgccgtcggaggagctcaccttttcatggttcaagaacggccgccctctgcggagttcagagcgcatggtgatcacgcaaacggatcccgatgtgagtccaggcacaacaaacctggacataatcgatctgaaattcactgatttcggaacttatacctgtgttgctagcctgaaaggaggaggtatctctgatataagtatcgatgttaatatctcaagcagcactgtgccacctaatctgaccgttcctcaggaaaaatcaccgttagtgacaagggagggtgatacaattgagctccagtgccaggtgacagggaaaccaaagccaatcatcctttggagtagagcagataaggaagtggccatgcctgacggatctatgcagatggagagctacgacggcaccctgcgcatagttaacgtcagtagggaaatgtctggaatgtatcgatgtcagacctcccagtataatgggttcaatgtaaaacccagagaagctctggtgcagctgattgtccagtacccccccgccgtggagcctgctttcctagaaattcggcaggggcaggacagatctgttacgatgtcatgccgcgtactgagggcctaccctatccgcgttctgacctacgaatggcgcctcggcaataagcttctcaggaccggccaattcgattcgcaagaatataccgagtacgccgttaaaagtctgagcaatgagaattacggcgtgtacaattgcagcattatcaatgaggcgggcgcaggccgctgcagtttccttgtgaccgggaaagcatacgctccggagttttactatgacacttataaccccgtatggcagaatcggcatcgtgtgtactcttactctctccaatggacccagatgaatccagacgccgtcgacagaatcgtcgcctacagactcggcattcgccaggcgggacaacaacggtggtgggaacaagagataaagataaatgggaacatccagaaaggcgagctgattacatataacctgactgagctcattaagcccgaagcatacgaggttcgtctgacccctctgacaaagtttggcgaaggggactccactattcgggtgatcaaatattctgcccctgttaatccccatcttcgcgagtttcattgtgggttcgaggacggaaatatctgcctcttcacccaggatgacacagacaactttgactggactaagcagtctacagcaaccaggaacacgaagtatactcccaacaccggtccaaacgctgacaggagtggatctaaggaggggttctacatgtacattgagaccagcaggccccgcctggagggggaaaaagcccgactcctgagccctgtcttctccatcgctcccaaaaatccatacggaccaacgaacactgcctactgttttagcttcttttaccacatgtacggccaacatataggggtgcttaacgtgtacctccgtcttaaaggccagactacgatagaaaaccctctatggtcatcttctgggaacaagggccagaggtggaacgaggcgcatgttaacatctatcccatcaccagtttccagctcattttcgagggtattcggggccctgggattgagggggacattgctatcgatgatgtgtccatcgcagagggcgaatgcgccaagcaagatctcgccactaagaacagcgttgacggcgcagtgggaatactagtacatatctggttatttccaattatagtgttaatttccattctgtctccacgacgttag

SEQ ID NO: 194093 - DNA, 477 bp, Artificial Sequence
  Description of Artificial Sequence: Synthetic coding sequence
atgtacatcgagaccagccggccccggctggagggcgagaaggccagactgttgtcaccggtcttttccatagcccccaaaaatccgtatggcccgacgaatacagcatactgtttcagtttcttttatcacatgtacggccagcatattggtgtgctgaatgtgtatcttcggttaaaaggccagaccaccattgaaaaccccctgtggagttcttcgggaaacaagggtcagcggtggaacgaggcccacgtaaatatttacccaattacaagcttccagctcatcttcgagggcatacgcggccctggcatcgagggggacatagccatcgacgatgtaagcatcgctgagggcgaatgtgccaagcaagatctggccacaaagaatagcgtggacggcgcagtcggcatactcgtccacatctggctatttcccatcattgtgcttatcagcatcctttctccaagaaggtag

SEQ ID NO: 194094 - DNA, 3078 bp, Artificial Sequence
  Description of Artificial Sequence: Synthetic coding sequence
atgagcgtgtggagcgccggcctgctgcggagcgcccggcggcggagacggggacggacagacggccggagatttcttctaagaagggcagtgccagggcacctcggccttgccagagctcgggtcgaaagggcctggctggccgcgggactacttaaggtgccacttcggacaccgtgggccggttacgtgcacgtgcacgtgaagatggacctcttgtacgggttagtatggctgttgaccgttctgctggagggtataagcggacagggcgtttacgcccctcctaccgttagaattgtgcacagcgggttggcatgtaacattgaagaggagagatactcagagcgcgtttacaccatccgggagggggaaaccctggagctgacttgcctcgtcactgggcaccctcggccgcagattcgatggacaaagaccgctgggtccgccagcgacagatttcaagatagtagcgtgtttaacgagacccttaggattaccaatatccagagacatcaggggggaaggtattactgtaaggcagaaaacggtctgggcagtcctgcgattaaatcgatacgcgtagacgtgtattacctagacgatcccgtggtgacagtgcaccagagcatcggagaagctaaagaacagttctactatgaaaggaccgtgttcttgaggtgtgtggctaatagtaatcccccggtaagatacagctggaggagaggccaagaggtcctgctgcagggctctgacaagggggtggagatttacgaaccgttcttcacacaaggagagactaagattctcaaactcaaaaatctgagacctcaggactacgccaactattcctgcattgcgtccgtgcgcaatgtatgcaacataccggacaaaatggtgagtttcagactgtctaacaaaactgcatccccatcgatcaaactgctggtggacgatcccatcgtggtgaatccgggggaggctattacgcttgtctgcgtgactaccggcggcgaacctgccccaagcctcacttgggtgagatcgttcggtactctgcccgaaaaaacagtcctgaatggggggaccctcacaattcccgccatcactagcgacgatgctggcacgtacagttgtatagccaacaacaacgtcgggaaccccgcgaaaaagtcaacgaacatcatcgtgagagcgctcaagaagggacggttctggataacacctgatccttatcataaggatgataatattcagatcgggagagaggtgaaaatctcctgtcaggttgaggccgtgccttcggaggagctcacatttagttggtttaagaatggaagaccactgagatcttccgagaggatggtaattacacaaacggaccccgacgtaagtccaggaacgaccaatctggacatcattgatctgaagtttactgatttcggaacatatacgtgcgtagccagcctgaaaggaggggggattagtgacatttccatcgatgtgaacataagttcatctaccgtcccacctaatctgacagtccctcaggaaaagtctccgctggtaacgcgagagggagataccatagaactacagtgtcaggtgaccggcaaacccaagccgatcattctgtggtctagagccgacaaagaggtggctatgcccgacggaagcatgcagatggaaagctatgacggaaccctgaggattgtgaatgtctcccgagagatgtccggcatgtataggtgccagacttcacagtacaatggatttaacgtgaaacctagagaagcattggttcaattaattgtgcagtatccaccagccgtcgagcccgcgttcttagagataaggcaggggcaggaccggtcagtgaccatgagttgtcgcgtccttagggcataccctattagagtgttaacctacgaatggcggctgggcaacaagctgctgcggaccggccagttcgatagccaggagtacaccgaatacgccgttaagagtttatccaacgagaattacggagtctataattgctccattatcaatgaagccggcgctggtaggtgctcatttctcgtgaccggaaaagcttacgcccctgaattctattacgacacatacaatccagtttggcagaatcggcatcgtgtgtattcctactcactgcagtggacccagatgaatcccgatgctgtcgatcgcatcgtggcttatcggctcggcataagacaagccggacagcagaggtggtgggaacaagagatcaaaatcaatggcaatatccaaaaaggagaactgattacctataatctgaccgaacttatcaaacccgaggcctacgaggtgcgcctgactcccctcacgaagtttggggagggtgactccacaatccgggtgatcaaatactccgcgcccgtcaacccccatcttcgggagtttcattgcggcttcgaggacggtaatatttgcctcttcacccaggacgacacggacaatttcgattggacaaagcaaagcactgctaccagaaatactaaatacacccctaacactggtcctaacgcagaccggtcaggctctaaggagggcttttatatgtacatagaaaccagtcggccacggctcgaaggagaaaaggcacgccttttatcgcccgtattctctattgcaccgaaaaacccgtacggccctacgaacactgcctattgtttcagtttcttctaccacatgtatggacagcatatcggcgtacttaacgtgtatctgcggctgaaggggcagactaccatcgagaaccccctctggtcctccagcggcaataaagggcagaggtggaatgaagctcacgtgaacatttaccccattacttcattccagctcatttttgagggaatcagagggcctggcatcgagggagacatcgccatcgacgatgtgtcaattgcagaaggggagtgcgccaagcaggacctggccactaagaattctgtggatggcgctgtcggcatcctagtgcacatttggctgtttcctattatcgtgttaatctctatcctgtctccaagacgctag

SEQ ID NO: 194095 - DNA, 2184 bp, Artificial Sequence
  Description of Artificial Sequence: Synthetic coding sequence
atggtgagcttccggctgagcaacaagaccgccagccccagcatcaagcttcttgtagacgatcccatcgttgtgaaccctggcgaagccataactcttgtatgtgtgacaaccggtggcgaacctgcgccgtccctaacatgggtcaggagttttgggaccttgcctgagaaaactgtgcttaacggtgggaccttgaccataccagccatcacctccgatgacgctggcacgtattcctgtattgccaacaacaacgtcgggaatcctgctaaaaaaagtaccaatatcatcgttcgcgctttgaaaaaggggaggttctggattacccccgacccttaccacaaggatgataacatccagatcggaagagaggttaagattagctgtcaggtcgaggctgttccttctgaagagctgaccttctcatggttcaaaaatggacggccgttaagatccagtgagcgaatggtgattactcagaccgatcctgacgtgagtcctggaacaacaaacttggacatcattgacttgaaattcactgattttggaacctacacatgcgtcgcttctttaaaaggaggcggcatctccgacatctcgatcgatgtcaatatttccagctctaccgtgccgccgaacctcactgtgccacaggaaaaatcccccctggtgacaagagagggcgatactatcgaacttcaatgccaggtgacaggtaagccaaagcccattattttgtggagccgggccgacaaggaggtcgcaatgcctgacgggagcatgcagatggaaagttatgatggcactctcagaatcgtgaatgtgtcccgagagatgtctggtatgtatcgatgtcaaacctcacaatacaacgggtttaatgtgaagcccagagaagccctggttcagttgatcgtccagtacccacccgccgtggagccagcttttctcgagatacgccagggtcaggatcggtcagtgactatgtcttgcagagtgcttcgggcataccccatacgggtgctgacatacgaatggcgactgggcaacaagctgcttcgcacaggccagtttgatagccaggagtatactgagtacgcggtcaaatccctaagcaacgagaactatggtgtttataactgtagtatcatcaatgaggccggagccggcagatgttctttccttgttactggaaaggcttacgctccagagttttactacgacacttataatccagtgtggcaaaataggcaccgggtgtatagttacagcctgcaatggacccagatgaacccagacgctgtggataggattgtcgcttacagactaggtattaggcaggcgggacaacagcggtggtgggaacaggaaattaagattaatggcaatatccagaaaggagagcttattacctacaatctgactgagctgatcaagcctgaagcgtacgaggtgaggctcacgcctctgacaaaattcggggagggggattcaaccatcagggtgatcaagtactctgctccagtcaatccacaccttcgcgagtttcattgcggctttgaggatggcaatatttgtctcttcactcaagacgacacggacaacttcgactggacgaaacaatcaaccgccactcggaacactaagtacacccctaacaccggcccaaatgccgataggagtggttccaaggaagggttttacatgtacattgagacgtccagaccaaggctggaaggcgagaaggcccggttgttgtctcctgtgttcagtatagcccctaagaatccctacggcccgaccaacaccgcctactgctttagtttcttttaccatatgtatggccagcacatcggtgtgctcaacgtatatctgagacttaaagggcagaccacaatcgagaacccgctttggagctccagcggaaataaggggcaaagatggaatgaagcacacgtgaacatctaccccatcacctctttccagctaatatttgaaggcatccggggccctgggattgaaggtgacatcgccatcgatgacgtctccatagccgaaggcgagtgtgctaagcaggatctggccactaagaatagcgtggatggagccgtcgggatactggttcacatctggctgtttccaattatcgtgctgattagtatcttatccccgagacgctag

SEQ ID NO: 194096 - DNA, 2871 bp, Artificial Sequence
  Description of Artificial Sequence: Synthetic coding sequence
atggacctgctgtacggcctggtgtggctgctgaccgtgctgctggaggggattagtggccaaggagtgtatgccccaccaaccgttcggattgtccactcgggattagcctgtaacattgaagaggagcggtatagcgagcgcgtatataccatcagagaaggcgagacactggagctcacctgcctggtaactgggcaccctcggcctcagatacgctggacaaagactgcgggatctgcctccgaccgttttcaggactcctccgtctttaatgagaccctcagaattaccaatattcagcgccaccaggggggccggtactattgtaaggcagagaatgggctgggctcacctgctatcaaaagcattcgggtggacgtttactacctggacgatccagtggtgaccgtgcatcagtccatcggtgaggccaaagagcaattttactatgagcggacagtctttctgcgctgcgtggccaactcaaatcccccggtcaggtattcgtggagaaggggtcaggaagtgcttttgcaaggctctgataagggagtggaaatttacgagcctttctttacccagggcgagacgaagatccttaagctgaagaatttgaggccccaagactatgccaactactcctgcatcgcaagcgttaggaacgtgtgtaacatccccgacaagatggtgagcttccgtctgagcaacaagactgcctccccatctattaagctattggtggatgaccctatcgtagttaaccctggcgaagctataaccctggtgtgtgtaaccaccggcggagaacccgccccatctctgacttgggtgcgatcctttggcacactgcccgagaaaaccgttctcaacggcggcacactgacaatcccagcgatcacgtcagatgacgccgggacatactcctgcattgcgaacaacaacgtgggaaatcctgctaaaaagtccaccaacatcatcgtacgggcgctgaaaaagggtaggttttggatcacaccagacccttaccataaagacgataatattcagatcggccgagaggtcaagatatcttgccaggtcgaggccgtgcccagtgaggaactgactttttcctggtttaagaacggccgacccctccgctcaagtgagagaatggtaattacccagacagaccctgatgtaagccctgggaccaccaatctggatatcatcgacctcaagtttacagatttcgggacatacacgtgcgtcgcgagtttaaaaggaggcggcatcagcgacatctcaatcgacgtgaacatatctagctccacggttcctcctaacctgacggtgccgcaggaaaaatcacccctggttacaagagaaggtgataccatcgagctgcagtgtcaggtgaccggtaaaccaaaaccaattatcttgtggagcagggcagataaggaggtggcaatgcctgacggctcaatgcagatggagtcctacgatggaacgctgcgtatcgtgaatgtgtcccgagagatgagtggcatgtatagatgtcagacatcccaatacaatggctttaatgtaaagccaagggaagctttggtccagctgattgtccagtacccaccagctgtcgagcccgcttttctggaaataagacaaggccaagacagaagcgtgactatgtcctgtagagttttacgcgcttatcccatacgagtactgacgtacgaatggcgcctgggcaacaaactcttgcggaccggccagttcgacagtcaagagtataccgagtatgcagtaaaaagtctgtccaatgaaaattacggtgtgtataattgctctatcataaacgaagccggggcaggacggtgcagtttcttggtcaccggaaaggcttacgcgcctgagttctactacgacacatacaatcccgtgtggcagaaccgacaccgtgtttactcttattccctgcagtggactcagatgaatcctgacgcagttgatagaattgtggcgtatcgcctgggaataaggcaagcaggtcagcagcgctggtgggaacaagagattaagattaacgggaatattcagaagggcgaactcataacctataacctaaccgagcttattaaacccgaagcttatgaggtgcgcttgacaccgctgacaaagttcggtgaaggagactctaccatcagagtgatcaaatactccgcacccgttaatccccatcttcgtgaatttcactgcggattcgaggacgggaatatctgcttatttacccaagatgacacggataactttgactggacgaaacagagcacggctactcggaacactaaatacacccccaacacaggacccaatgccgataggagcggatccaaggaagggttttatatgtatatagaaacatcccgccctagactcgagggggagaaagcacgtttgctaagtcctgtgtttagcatcgcccccaaaaatccctacgggcccaccaatacagcatactgcttcagttttttctaccatatgtacggacaacacattggcgtgcttaacgtttacctgcgattgaaaggacaaactaccattgaaaaccctctctggtcatccagtggaaacaaaggccaaagatggaacgaggctcatgtcaatatttatcccatcacctcgtttcaattgatcttcgaggggatcagaggaccagggatcgaaggagacatcgccatcgatgacgtgtccattgccgagggggagtgtgccaaacaggacctagctaccaagaactctgtagatggtgctgtcgggattctcgtgcatatctggctgttcccaattatcgttttaattagcatcctgtccccaaggaggtag

SEQ ID NO: 194097 - DNA, 1143 bp, Artificial Sequence
  Description of Artificial Sequence: Synthetic coding sequence
atgcggtggctgctgctgtactacgccctgtgcttcagcctgagcaaggcctcagcacatacagttgaactcaacaatatgttcggccagatccagagccccgggtaccccgactcctatccatccgattccgaggttacctggaatataacagtgcccgacgggttcagaatcaaactgtactttatgcacttcaaccttgagagctcctatctgtgcgagtacgactacgtgaaagtggaaacagaggatcaggtcctcgccaccttctgcgggcgcgaaacaaccgacactgagcaaactcccggacaggaggtggttctgtcacctggttcatttatgtccatcacctttagaagcgatttttctaacgaggaacgcttcactggctttgatgcccactacatggcggtggatgttgatgaatgtaaggagagggaggacgaggaactgtcttgcgaccactactgccacaactatatcggggggtattattgcagctgtcgttttggatacatcctccacactgacaatcgaacctgtcgcgtagagtgttcagacaatctgtttactcagcgaaccggggtgattacttccccagacttccctaacccttaccccaagtcttcggagtgcctatacactattgaattggaggaaggcttcatggtgaatctgcagtttgaggacatatttgatatagaagaccacccagaggtaccctgtccctacgattatataaagatcaaagtgggcccgaaggtgctgggcccgttctgcggcgaaaaggcccccgaaccgattagcacacagtctcacagcgtcctgatcctcttccattctgacaactctggagagaatcgtggctggcgcctgtcctacagggccgcaggaaatgaatgtcctgaactgcaacctccagtacacggaaaaattgaaccgtcacaggccaaatactttttcaaagatcaggtgctggtgtcctgcgacactgggtataaggtactcaaagataacgtggaaatggatactttccaaattgagtgcttgaaggacggcacgtggtccaataagatccccacgtgtaaaaaaaatgagatcgatctggaaagtgagctgaagtcagagcaagtcactgaatag

SEQ ID NO: 194098 - DNA, 2187 bp, Artificial Sequence
  Description of Artificial Sequence: Synthetic coding sequence
atgcggtggctgctgctgtactacgccctgtgcttcagcctgagcaaggctagtgcacacactgtagaattaaacaatatgttcgggcagatccagtcccccggctatccagacagttatccatccgacagcgaggtcacttggaacatcactgtccctgacgggttcagaatcaagctgtattttatgcattttaacctggagtccagctacctctgtgaatatgactacgtgaaagtggaaacagaggaccaggtgctcgccacgttctgtggtagggagaccactgataccgaacagactcccggccaggaggtggtgctgtcccctggttccttcatgtctatcactttccgctctgatttcagtaacgaggaaaggtttacggggtttgacgcccattacatggctgttgatgtggacgaatgtaaggaacgtgaagacgaagagcttagctgcgatcactactgccacaattacatcgggggatattattgttcctgtaggttcggatatattttacatactgacaatcgcacttgtagggtcgagtgcagtgacaatttgtttacacaacggacaggggtcattaccagtcccgactttccaaacccataccccaagtctagcgaatgtctttacacaatcgaattagaagaggggtttatggtaaacctgcagttcgaggacatctttgatatcgaagatcaccctgaggttccctgcccatatgactacattaaaatcaaggttggtccaaaagtgctgggccccttctgtggagaaaaagcacctgagcccatttctacgcaatcgcatagcgtgcttatattgtttcatagcgacaactctggggagaatagagggtggcgactgagctatcgggccgcgggcaatgagtgtcccgagctgcagccccctgtgcatggaaaaatcgagccctcccaggccaagtactttttcaaagatcaggtcttagtttcctgcgatacggggtataaggttctgaaggataacgtggaaatggacaccttccagatcgagtgtttgaaggacggcacttggagcaataagattcccacctgtaaaattgttgattgccgggcccccggtgagctggaacatgggcttatcactttctccactcgtaacaacctgactacttacaagagcgagatcaaatacagctgtcaggaaccgtactataagatgttgaataataacactgggatctacacctgcagtgctcaaggcgtctggatgaacaaagtccttggccggtccttgcccacatgtctacctgaatgcgggcagcctagcaggagtctgccctctctggtgaaacgtattattggagggagaaacgctgaacccggtctatttccctggcaggccttgatcgtcgttgaggatacgtcccgcgtgccaaatgacaagtggtttggtagcggcgcactgttgagcgcctcttggatccttacagcggcacatgtgctccgctcccagagacgggatactacagtcatacccgtgagcaaggaacatgtgaccgtgtatctcggactgcatgacgttcgagataaatcaggggccgtaaactcctctgcagccagagtcgtgctccatcctgactttaatattcagaactataatcacgatatcgcgttggtacagctccaggaaccagttccactgggtcctcatgtgatgccggtttgtctgcctcgtctggagccagagggtccagccccacatatgctggggcttgtggccgggtggggcatttctaatcctaatgttaccgtcgatgagatcattagctcaggtactcgcactttgtcagacgtcttacagtacgtcaagctacccgtggtgccgcacgccgagtgtaagacttcctacgaatctcgtagcggtaactattccgtgaccgagaatatgttctgtgctgggtattacgagggaggcaaagatacgtgcctcggcgactcggggggtgcgtttgtgatctttgacgacctgagccagaggtgggtggtgcagggcctggtatcctggggcggccccgaagagtgtggatcgaagcaggtttatggggtttacactaaggtgtctaactatgttgactgggtgtgggaacagatgggcctccctcagagcgttgtcgaaccccaggtggagcgttag

SEQ ID NO: 194099 - DNA, 2100 bp, Artificial Sequence
  Description of Artificial Sequence: Synthetic coding sequence
atgcggtggctgctgctgtactacgccctgtgcttcagcctgagcaaggccagcgcacacacagtagagttgaacaatatgtttggacagatccagagtcccggatatccagactcttatcccagcgattccgaggtcacttggaatatcactgtgccagacgggttcagaatcaaactgtacttcatgcattttaacctcgaatcatcctatctgtgcgaatacgactatgtaaaagtggagacagaagaccaggttttggctacgttctgcggacgcgaaactaccgacactgagcagactccggggcaggaagtggtgctgtcccctggaagtttcatgtccatcacctttcggtctgacttcagtaacgaggaaagattcaccggtttcgatgcccattatatggccgtggatgtggacgagtgcaaggaaagagaggatgaggagctgagctgcgatcattactgccataattacatcggtgggtattactgttcttgtagattcggttacatcctgcatacagataatcggacatgccgcgtggaatgttcagataacctgtttactcagagaacaggcgtgattacatctccggatttccccaacccctatcctaaatcctccgagtgcctctataccatcgaattggaggagggcttcatggtcaacctgcaattcgaggacatttttgatattgaagatcatcccgaggtaccttgtccctatgattacatcaaaatcaaggtggggccaaaagtgcttggccccttttgtggggagaaagcgcccgaacctatcagcacccagtcgcactctgtcctcatactttttcattccgataattccggagagaaccgtggctggcggctgtcctacagggcagccggaaatgagtgcccagaactccagcccccggtacacgggaagattgagcccagccaggccaaatacttctttaaggaccaggtattggtgtcatgcgatacgggatataaagtgttgaaggataatgtggagatggacacgtttcagatcgagtgcctgaaagacggcacatggagcaataaaatccccacgtgcaaaattgtagactgtcgcgcccctggagagcttgaacacggtctcattactttctcgaccagaaataacctgacaacttataagtccgagatcaaatacagctgccaggagccatactacaagatgttgaacaacaatacaggcatttacacatgctccgctcagggcgtttggatgaataaggtactgggccgcagtctgcccacctgcctgcccgtatgcggactgcccaaattctcaaggaaactcatggcacgaattttcaatggcagacctgcgcagaagggcactaccccttggattgccatgctgtcacatctcaatgggcaaccattttgtggaggaagcctcctaggctcttcctggatcgtcacagcagcacattgtctgcatcaaagcctggatccagaagatccaaccctccgcgactctgacctgctgtccccctcagactttaagatcattctcggcaaacactggcgattgaggtccgatgaaaacgagcagcacctgggtgtgaaacacaccaccttacacccccagtacgaccctaatacctttgaaaatgatgtggcgctcgtggaactattggagtccccagtcctcaatgcatttgttatgccaatttgcctgcctgaagggcctcagcaggaaggcgcgatggtcattgtatccgggtggggcaagcagtttctacagcgattccctgaaaccctgatggaaatcgagatcccaatagtcgatcatagcacatgccagaaggcatatgcaccgctaaagaagaaagtgacacgtgacatgatttgtgccggggaaaaggaagggggtaaagatgcatgtgcaggggacagtgggggtccaatggtgacccttaatagagagagaggccagtggtatttggtgggcaccgtgtcgtggggggatgattgtggcaagaaagaccgttacggggtctactcatatattcaccacaacaaagattggattcagcgggtaacaggtgttcgcaactag

SEQ ID NO: 194100 - DNA, 1848 bp, Artificial Sequence
  Description of Artificial Sequence: Synthetic coding sequence
atgagcatcaccttccggagcgacttcagcaacgaggagcggttcaccggattcgacgcccactatatggccgtggacgtcgatgagtgtaaagagagagaagacgaagagctaagctgtgaccattattgtcacaactacattggaggctactactgttcatgtcgattcgggtatattctccataccgataataggacctgtagggtggagtgtagcgacaatctcttcacacagcgaaccggagtgatcaccagccccgacttccccaacccctatcctaagtcaagcgaatgcctgtatacaattgaactggaagagggtttcatggttaatctgcagtttgaagacatcttcgacattgaggatcatcccgaagtcccgtgtccttacgattacatcaagattaaggtcggccctaaagtcctgggcccattctgcggagagaaagcaccagagccaatatctacacagtcccactctgtgctgattctgttccattccgataattctggtgaaaacagggggtggagactctcatacagggctgccggtaacgagtgtcctgaattgcagccccccgtgcatggcaaaatagaaccatcccaggcgaaatatttttttaaggatcaggttttagtgtcctgcgatactggctataaggtgctcaaggataatgtggaaatggacacatttcagatcgagtgtctgaaagacggcacctggtctaacaagatccccacctgcaagattgtggactgtcgggcaccgggtgagttggagcacgggctcattacattcagcacccgtaataacctgaccacatacaaatcagaaattaagtactcttgtcaggagccctactacaaaatgcttaataacaacacggggatatacacctgtagtgcacagggggtatggatgaacaaggtgttagggcggtccctcccaacttgtctccccgagtgtgggcagccctcaagatctctgcccagcttggtgaaaaggattatcggcgggagaaacgccgagccaggtctgttcccttggcaggccctcatcgtggtggaagacacctccagggttccaaacgataaatggtttggctccggtgctttactttccgcctcatggatccttacagcagcccacgtgctcaggagccaaaggcgcgacaccacagtcatccccgtctcaaaggaacacgtaaccgtctacctggggttgcatgatgtcagggacaagagcggagcggtcaactcttccgctgctcgagttgtccttcatccagatttcaatatccaaaactataaccacgatatcgccctggtccagctgcaggaacctgtgcctttgggtcctcacgtcatgccggtgtgtttgcccaggcttgagcccgaaggtcccgcaccccacatgcttggccttgttgcaggttggggtatctcaaatcccaacgtgactgtggatgagattatctcaagcggcaccagaactctgtccgatgtgctccagtacgtgaagcttccggtcgttccccatgctgaatgcaagacatcttatgagagccggtccggaaactattccgtgacagagaacatgttctgtgcagggtactatgagggtgggaaagatacatgtctcggcgattctggaggggcctttgtgatttttgatgatctttctcagcggtgggtggtgcaggggcttgtgagctggggcggcccagaagaatgtggttcaaagcaggtttacggggtctatactaaggtgtccaactatgttgattgggtctgggaacagatgggcctcccccagtcagttgttgaaccccaggtggagaggtag

SEQ ID NO: 194101 - DNA, 249 bp, Artificial Sequence
  Description of Artificial Sequence: Synthetic coding sequence
atgttctgcgccggctactacgagggcggcaaggacacctgcctgggcgattccggaggagcttttgtgatctttgacgacttgtcacagcggtgggtggtgcaggggctggtctcctggggcgggcccgaagagtgtggtagcaaacaggtgtacggagtgtataccaaagtgtcgaactacgttgattgggtgtgggagcagatggggcttcctcagagcgtggtggagccccaggtcgaacgctag

SEQ ID NO: 194102 - DNA, 1443 bp, Artificial Sequence
  Description of Artificial Sequence: Synthetic coding sequence
atgagcatcaccttccggagcgacttcagcaacgaggagcggttcactggttttgatgcacactatatggccgtggatgtggacgaatgtaaagagagagaagacgaggagctgtcttgcgaccactactgccataattacattggaggatactattgcagttgcaggtttgggtatatactgcacaccgacaacaggacctgtcgggttgaatgctctgataacctgttcacccagcggaccggtgtgattactagcccagattttcccaacccatatccaaagtcctccgaatgcttatacacaatcgagctggaggagggattcatggtcaacttacagttcgaagacatttttgatatcgaagatcaccctgaagtgccgtgtccctatgattatatcaaaatcaaagttggacccaaggtgttggggcctttctgcggtgaaaaggcccctgaacctatcagcactcagagtcactcggtcttaatcctcttccattctgacaacagcggtgagaatcgcggttggcgcttgagctatagagctgccggcaatgaatgtccagaactgcaaccaccggtgcatgggaaaatcgaacctagccaggccaagtactttttcaaggaccaggttttggtttcctgcgatactggttacaaagtgctgaaggacaacgtcgagatggacacattccaaatcgagtgtctgaaagatggaacctggtccaataagattcctacgtgcaaaatagtggactgtcgggcccctggagaattggaacacgggctcattaccttttcaacccggaataacctgaccacatacaaatctgaaatcaagtactcatgtcaagagccttattacaagatgctcaataataatacgggaatatacacatgtagtgcacagggcgtttggatgaacaaagtgttgggccggagcctgcctacgtgtctgccagaatgcggacagccctcccggtctctccccagtttagtaaaaaggatcatcgggggtagaaatgcagaacccggtctgttcccatggcaagccctcatcgtagtagaggatacctctcgcgtaccgaacgataagtggttcggcagcggtgctctcctgtcagcatcttggattcttacagctgcacacgtccttcgcagtcagcggagggatacaactgtcattccagtcagtaaggagcatgttactgtttacttgggccttcacgacgtgagagacaagtctggcgctgtcaactcatcagcagctcgggtcgtgctgcacccagatttcaatattcaaaactacaatcatgatatcgcactcgtccaattacaggagccggtgcctttaggcccccacgtgatgcccgtttgcttaccaagactggagccccccggagggcggcttggtcacctgcagagccaatgcgatagttag

SEQ ID NO: 194103 - DNA, 2061 bp, Artificial Sequence
  Description of Artificial Sequence: Synthetic coding sequence
atgcggctgctgaccctgctgggcctgctgtgcggcagcgtggccacacctctgggccctaaatggcctgagcccgtgtttgggaggttagcctcaccaggcttcccaggtgaatacgctaacgatcaggaacggagatggacccttaccgcacccccaggatacaggctgcgactgtacttcacacattttgatctggagctgtctcacctgtgcgaatacgattttgtgaaactgtcctctggagccaaggtgttggcaaccctctgcggacaagagagcaccgacactgagcgagcacctggaaaggacactttttatagcctcggcagttccctcgacattactttccggtctgactatagcaacgagaagcctttcaccggcttcgaggcattctacgccgccgaagatatagacgagtgccaggtggcacctggagaggctcccacctgtgatcatcattgtcacaatcacctaggcggattctactgctcctgccgggctgggtacgtacttcatcggaacaagcggacttgctccgcgctctgctccggccaggttttcactcaacgttcaggggaactgagtagccccgagtaccctcgcccataccctaaactgtcatcatgcacctactccatctccctcgaagagggcttcagtgtgatactggattttgtagagtcatttgatgttgaaactcatcctgaaacattgtgcccgtacgactttttgaaaatccaaactgatcgtgaggaacacggacctttctgtggaaagactctaccccaccgaatagagaccaaaagcaacacagtgacaatcacattcgttacagacgaatccggggaccacacaggctggaaaatacattatacttcaactgctcaaccctgtccctatccaatggccccccccaacgggcacgtcagccctgttcaggctaagtatattctaaaagactcctttagtatattctgcgaaaccggctacgagctgctccaagggcacctgccactgaagtcctttactgcagtgtgtcagaaggatggatcttgggatagacctatgcctgcctgcagcattgtggattgtggcccccctgacgacctcccgtccggcagggtagagtatatcacgggtccaggtgttacaacctataaggccgtcatccagtatagctgcgaggagaccttttatactatgaaagtgaatgacggtaaatacgtatgcgaagccgacggcttctggacatcctctaagggtgagaagagtctccccgtttgtgaaccggtgtgtggactttctgcccggactaccggcggccggatctatggaggccagaaggccaagcccggtgacttcccgtggcaagtgttgatcttagggggtactactgctgcgggagcactcctttatgacaactgggtgctgactgctgcacatgccgtgtatgaacaaaagcacgatgcctcagctttggacatacgaatgggcactctaaaacggctctctcctcactacacgcaggcgtggagtgaagccgtttttatacatgaaggatacacccatgatgccggcttcgataatgatatagccctgatcaaactgaacaataaagtagtcatcaattccaacattaccccgatctgccttccaagaaaagaagcagagagctttatgcgcactgatgatattggcaccgcctccggatgggggctgactcaaaggggattcctggcccgtaatttgatgtacgtagatatccccattgtagaccatcaaaagtgcactgctgcctatgaaaagccaccatatccgcgcggatctgtcaccgcaaatatgttatgcgcgggcctggagtcaggagggaaggattcctgtcggggcgactcaggaggagcgctcgttttcctggatagcgaaacggaacgctggtttgtggggggaattgtgtcatgggggagcatgaattgcggcgaggccggacaatacggcgtgtacaccaaagtaatcaattacatcccctggatcgaaaacatcatttccgatttttag

SEQ ID NO: 194104 - DNA, 558 bp, Artificial Sequence
  Description of Artificial Sequence: Synthetic coding sequence
atgcggctgctgaccctgctgggcctgctgtgcggcagcgtggccacaccactgggccccaaatggccggaacccgtgtttggccggctggccagccccgggtttcccggtgagtatgcaaatgaccaagagagacgctggaccctgacggcaccccccggctacagactccgcctgtacttcacacacttcgacttagaactgtcacatctttgtgaatacgattttgttaagctgagcagcggagctaaagtgttggcaaccctgtgcgggcaggaaagcacggacaccgaacgcgctcctgggaaggacaccttttattccctcggttcctctctggacattacgttccggagtgactacagcaatgagaaaccctttacgggcttcgaggctttttacgccgccgaagacatcgatgagtgtcaggtggccccaggagaggcccccacctgcgaccaccattgtcacaaccacctagggggtttttattgttcgtgccgcgcaggttacgtcttacatcggaataagagaacatgcagcgaacagtctctctag

SEQ ID NO: 194105 - DNA, 1089 bp, Artificial Sequence
  Description of Artificial Sequence: Synthetic coding sequence
atggccgccccccgggtgttccccctgagctgcgccgtgcagcagtacgcctgggggaagatgggatccaacagtgaagtggcccgacttcttgcgagctctgatccgttagctcaaatcgccgaagataaaccatacgcagagctctggatgggtactcatccacggggtgacgcaaagattctagacaaccggatcagtcagaagaccctctcccagtggatcgccgagaatcaggactcactcgggagtaaggtgaaggacacctttaatgggaacctgccctttttgttcaaagtgctgtccgttgagacgcctctgtcgattcaggcacaccccaataaggaattagctgaaaagctgcacctgcaggctccccagcactacccagatgctaatcacaaaccagagatggccatagccctgaccccttttcagggattatgtgggtttcgacccgttgaggaaatcgtcaccttcctgaaaactgctgctggcaataatatggaggatatcttcggggaacttttactccagctgcatcagcaatacccaggggatatcgggtgctttgccatctatttcctgaatctcttgacactcaagcccggcgaggccatgttcctagaagccaacgtaccgcatgcttatctaaagggagactgtgttgagtgcatggcctgctcggacaatactgtccgtgctggtcttacacccaagttcatagatgtgccaaccctatgcgaaatgttatcctatacaccaagctcctctaaagacagattgtttctccctacacggtctcaggaggacccgtatttaagcatatacgatcctccagtgccggacttcacaattatgaagactgaagttccaggatccgttactgaatataaagtcctggctctggactctgcgtccattctccttatggtacagggtaccgtcatcgctagcacccccactacacagacaccgattcctcttcaaagaggcggagtacttttcatcggagctaatgagagtgtctcactgaaactgacagaacccaaggatttactgatcttccgtgcatgctgtctcctgtag

SEQ ID NO: 194106 - DNA, 1272 bp, Artificial Sequence
  Description of Artificial Sequence: Synthetic coding sequence
atggccgccccccgggtgttccccctgagctgcgccgtgcagcagtatgcttggggcaagatgggttctaactccgaggtggcaaggctgctagctagctctgacccactggcacagattgctgaggacaaaccttacgcggaactgtggatgggcacccaccctcgcggcgacgccaaaatattggataaccggatcagtcagaaaacactatctcagtggatcgcggagaaccaagattccctgggttctaaggtcaaggatacattcaatggcaatcttccttttctgtttaaggtcctcagcgtggagacccccttgtccattcaagcccacccaaataaggagctggctgaaaagctacacctacaggctccccaacattatcctgacgccaatcacaaaccagaaatggcaatcgctttaacacctttccaaggcttatgtgggttccggccagtggaggaaattgtcacctttctaaaaaaggttcctgagtttcagttccttattggagacgaagccgccacacacctaaagcagactatgagccacgacagccaggcagtggcctcatcccttcagtcttgcttctctcacctgatgaagtccgaaaaaaaagttgtggtcgagcagctgaatctgcttgtgaaacggatttcgcaacaggctgcggctgggaacaacatggaggacattttcggcgaattgttactgcagctgcatcagcaatacccaggcgatattggctgcttcgcgatttactttctaaacttactgaccctgaagcctggcgaggcgatgttcttggaggccaacgtgccacacgcgtacctaaaaggtgactgcgttgagtgcatggcttgcagcgataatactgttcgcgccggcctcacacccaaatttatcgacgtgcctacgctgtgcgaaatgctctcgtacaccccctcatcctccaaggacagactatttctcccgacaaggagtcaagaggacccttacctctctatctacgatcctcccgtcccagacttcacaatcatgaaaacagaagtgccagggtcagtgactgagtacaaagtgctggctttagattctgcctctattctactgatggtgcaggggacagtgatcgcaagtacaccaaccactcaaacacccattcctctgcagcggggcggcgtgttgttcattggcgcgaatgaatccgtcagtctgaaactaaccgagccaaaggacctactgatcttccgggcctgctgtctcctgtag

SEQ ID NO: 194107 - DNA, 804 bp, Artificial Sequence
  Description of Artificial Sequence: Synthetic coding sequence
atgggcagcaacagcgaggtggcccggctgctggccagcagcgacccactggcgcagatcgcagaggacaagccttacgccgaactgtggatgggaacacaccccaggggtgacgctaagatacttgacaatcgaattagccaaaaaactctgtcacagtggatcgccgagaaccaggatagcttgggttcgaaggtcaaagacacttttaatggcaatttgccattcctattcaaggtgctgagcgtggagacccccctgtccattcaggcccatccgaataaggagctcgcagaaaagctgcacttgcaggctccccagcattatccggatgcaaaccataaaccggagatggctatcgcccttacaccatttcaaggtctctgcggtttccggcccgtcgaggagattgtgaccttcttgaaaaaagtgcctgagttccagttccttatcggcgatgaggcagccacacacctgaagcaaactatgagccacgatagccaggcggttgccagcagtttgcagtcatgtttcagccacctgatgaaaagtgaaaagaaggtggttgtggagcaacttaatctccttgtgaaaaggatcagccagcaggccgccgcggggaacaacatggaggacattttcggggaactcctgcttcaactacatcagcagtatcccggggatatcggctgtttcgctatctatttcctcaacctgttgaccttgaaacctggagaggccatgttcttggaggccaacgtcccccatgcttatctcaagggcggaccttggctctgccactag

SEQ ID NO: 194108 - DNA, 1122 bp, Artificial Sequence
  Description of Artificial Sequence: Synthetic coding sequence
atgggcacccacccccggggcgacgccaagatcctggacaaccggatatcgcagaagaccctgtctcagtggattgccgaaaatcaagattcactggggagcaaggtgaaggacactttcaacgggaatttgccttttttgtttaaagtcctctctgtggagacgcccctcagcatccaagctcaccccaacaaagagctcgcggaaaagctgcatcttcaggccccacaacattatcctgatgccaaccacaaaccggagatggcaatcgctcttaccccttttcagggtttatgtgggtttcggccagtggaggagatcgtaacatttctcaaaaaggtccctgagtttcagtttctgataggagatgaggccgccacccatttgaaacagacaatgagccatgatagccaggccgtcgctagctccctacagtcctgcttctcccacctgatgaagtcagagaagaaggtggtcgtcgagcagctgaacttgctggtgaagaggatttcacaacaggctgccgctggcaacaatatggaggacattttcggggaattacttttgcagttgcaccagcagtatccgggcgacataggctgcttcgctatctacttcctgaatttgctgacgctcaaacctggcgaggccatgtttttggaggctaacgtgcctcatgcctatcttaaaggtgactgtgtagaatgcatggcctgcagcgacaacaccgtgcgggcgggactcacccctaaattcatcgacgttccaacactctgcgagatgctgtcttacaccccttcatcaagcaaagatagactgtttctgccaaccagaagtcaggaagacccatatctgtccatctatgatccaccagtgccagatttcactatcatgaaaacagaggtccccgggtctgtgacggaatacaaggtgctggctctcgatagtgccagcatcctcttgatggtgcaaggcaccgttatagctagcacaccaacaacccaaaccccaatcccactgcaaaggggtggagttttgtttataggtgcaaatgaatcagtttccctaaagctgacagagcccaaagatctgcttatcttccgggcgtgttgcttgctctag

SEQ ID NO: 194109 - DNA, 4371 bp, Artificial Sequence
  Description of Artificial Sequence: Synthetic coding sequence
atgcggctgcccctgctgctggtgttcgccagcgtgatccccggcgcggtgctgctgcttgacactaggcagttccttatttacaatgaggatcacaaacgatgtgtagacgcagtgagcccatctgccgtgcagacggccgcttgtaaccaggatgctgagtcccagaaattccgctgggtgagcgagtcacagattatgagtgtggccttcaagctgtgtctgggagtgccatcaaaaaccgattgggtagcaattacactgtatgcctgtgacagcaaaagtgagtttcagaagtgggagtgcaagaacgacaccctattgggtatcaaaggagaagacctctttttcaactatggaaaccgccaggaaaaaaacattatgctgtataagggcagcggcttgtggtcccggtggaagatctatggtaccaccgataacctgtgctcccgcggttacgaagccatgtacacactgctcggaaacgccaatggcgctacttgtgccttcccattcaagtttgagaataaatggtacgctgactgcacctccgcaggcagaagtgacggatggctgtggtgtggtactaccacggactatgacaccgacaagctgttcggctattgtcctcttaaattcgaggggagtgagtcgctgtggaataaagatccactaacatctgtgagttatcaaattaactccaagtcagccctcacatggcaccaagcacgcaagtcctgtcagcagcagaatgccgaactcctgagtattacggagatccacgagcaaacatatctaaccggactgacatcatccctgactagtggcctctggatcggcttaaactctctcagtttcaatagtggatggcagtggtcagatcgaagccccttccgatacctaaattggctgcctggatctccaagcgcagaaccgggcaaatcctgtgtgtcactcaatccagggaaaaatgctaaatgggagaaccttgaatgcgtgcagaagctggggtatatttgtaagaaaggcaacaccactctgaactccttcgtgataccaagtgaatcagatgtgcctacacattgcccgtcacagtggtggccgtacgctggacactgctacaagattcatagagacgagaaaaaaatacaacgcgacgcgctcacaacttgcaggaaggaggggggggacctcacgagtatccatactatagaggagctcgatttcatcatatctcagctgggctatgaacccaacgatgaactctggatcggcctcaacgatattaagatccagatgtactttgaatggtcggatggcacgcccgtgaccttcacaaagtggctgcgcggagagccgagccacgaaaataataggcaggaggactgcgttgttatgaagggcaaagacggatactgggcggaccgtggatgcgagtggccgctaggatatatttgcaaaatgaaaagcaggtcccagggccccgaaatagttgaagtggaaaaaggctgtaggaaaggctggaagaagcatcacttttactgctatatgatcgggcatactcttagtacgttcgccgaagctaatcaaacctgcaacaatgagaatgcttacttaaccactatcgaagatagatatgaacaggccttcctgactagttttgttgggctgaggccggagaagtacttctggactggcctatctgatatacagaccaaggggacttttcagtggacaattgaggaggaagtgcggtttactcactggaacagtgatatgcctgggaggaagcctgggtgcgttgccatgcgtacaggaatcgcaggaggcctgtgggacgtattgaagtgtgacgaaaaagctaagtttgtctgcaaacactgggcggagggggtgacacaccccccgaaacccactactactcccgagccaaaatgcccggaagattggggcgcatcctctaggacctcattatgctttaaattgtatgccaaagggaaacacgaaaagaagacttggttcgagagtagggacttttgccgcgcactcgggggtgacctggccagcattaataataaggaggagcagcagacaatatggcggctcattactgctagcggatcctaccacaagctattttggctcggactgacctacggatcacccagcgaagggttcacctggagtgacggctctcctgtgtcctatgaaaattgggcatatggagaaccaaacaactaccaaaatgtagaatactgtggcgagctcaaaggagatcccaccatgtcttggaatgacatcaactgcgaacacctgaacaattggatctgccagatccagaagggacagacccccaagcccgagcctacacctgccccacaggacaacccgcccgtcaccgaagacggctgggtgatttataaagactaccagtactactttagcaaggaaaaagagacaatggacaacgccagagctttctgtaagcgaaacttcggggatctggtgtcaattcagtcagaatcagagaaaaagtttttatggaagtacgtgaaccgcaacgatgcacagagcgcttattttataggcctactcatcagcctggacaaaaagtttgcgtggatggacggcagcaaggtggattacgtctcatgggccacaggcgagccaaatttcgccaacgaggatgaaaattgcgtcacgatgtactcaaacagtggcttctggaacgatatcaattgtgggtatcccaacgctttcatttgtcagagacataattcgtccatcaacgccacgaccgtcatgcccactatgccctccgtgccgagtggttgtaaggaaggctggaacttttactcaaacaaatgttttaagatcttcggttttatggaagaggagagaaaaaactggcaggaggctcgcaaggcttgcattggttttggcggcaatcttgttagcattcagaatgagaaggaacaagctttcctaacgtaccacatgaaagactctactttcagcgcctggactggactgaacgacgtaaacagtgagcatacattcctttggactgacgggagaggtgtccattacacaaattggggtaagggctatcctggcggccgccgtagttcgctttcctatgaggacgcagactgcgtggtgattataggaggggcatcgaacgaagcgggtaagtggatggacgacacctgcgattctaaacggggatatatttgccaaacacgtagcgatcccagcttgaccaatcccccagccacaattcagactgatgggttcgtaaagtatggcaagtctagctacagcttgatgaggcagaaatttcagtggcatgaagccgagacatactgtaagctgcataacagtctcatcgcttccatcctggacccatacagtaacgctttcgcttggcttcagatggagacgtccaatgaaagagtgtggattgcattgaacagtaaccttacggacaatcagtatacgtggacagataagtggagggtgcggtacacgaattgggccgcggatgaaccaaagctgaaatccgcctgcgtgtatctagacctggatggctattggaaaaccgcacactgtaacgagtctttttattttctgtgtaaaaggtcggacgaaatcccggccaccgagcctcctcagctgcccggacgttgcccagaatctgaccacactgcctggatccccttccatggacactgctattatattgaatctagttatacgcggaattggggccaagcatctctggagtgcctgaggatgggttccagtctggtgtcaatcgagagtgctgccgagtcctcctttttatcttatcgcgtcgaacctctgaagagtaagaccaacttctggatcggcctgttccgaaacgtggagggcacttggctgtggatcaataattcccccgtcagcttcgtcaattggaacactggcgatccgagcggcgagagaaatgattgcgtcgccctccacgcgtcttccggcttttggtcaaacatccactgttctagttataaggggtacatatgcaagagacctaagattattgacgctaagcccacccacgagttgctgactacaaaggctgacacgcgtaagatggatccatcaaaaccctccagcaacgtcgcgggtgtggtgatcatagtgatcctcctgatccttacaggcgcagggcttgccgcttactttttttataaaaaacggcgcgtgcacttgcctcaggagggggcgttcgaaaacacactatatttcaatagccagtcttccccagggacctcagatatgaaggacctggtggggaacatagagcaaaacgagcattccgtaatctag

SEQ ID NO: 194110 - DNA, 4440 bp, Artificial Sequence
  Description of Artificial Sequence: Synthetic coding sequence
atgggccccggccggcccgcccccgccccctggccccggcacctgctgcgctgcgttttgctcctgggctgtctccatctggggagacctggagctcctggggatgccgcactgcccgaaccaaacgtgttcctaatattctcccacgggctgcagggctgcctcgaggcccaaggaggccaggtacgggtgacaccagcctgcaatacaagcctccccgcccagagatggaaatgggtctcacggaaccggcttttcaacctaggaacgatgcagtgcttagggactggctggccaggaaccaatacgacagcctcattgggcatgtatgagtgcgatcgcgaagcactcaacctacggtggcactgtagaactctgggcgaccaattaagcctcctgctgggcgccagaacttcgaatatttcaaagcccggaaccttggagagaggagatcaaacacgaagtggccaatggagaatttacggatccgaggaggacctctgcgccttaccataccacgaagtctatacgatccagggtaattcgcacgggaaaccatgtacgatacccttcaaatacgataaccaatggttccacgggtgcacatctaccgggagagaggatggccacctttggtgtgcaaccacccaggattacggcaaggatgagagatggggattctgtcccataaagtccaatgactgcgagacgttttgggacaaggaccagctgaccgattcctgttatcagtttaacttccaatccactctgtcatggagagaggcgtgggctagttgcgagcagcagggcgccgatctgctttcaatcacagagatacacgagcagacctatataaatggtctgcttactggttatagttcgacactgtggatcgggctgaacgacctcgatactagcggcgggtggcagtggtctgacaattcccccttgaagtacctaaactgggagtctgatcagccagacaacccatcggaggaaaattgcggagttatccgcacggaatccagtggcgggtggcaaaatcgggactgctctatcgcgcttccatacgtctgtaaaaagaagcccaatgccactgccgagccaacaccgcctgataggtgggccaacgtcaaggttgagtgcgaacccagctggcagcctttccagggccactgttatcgccttcaagcagagaagagaagctggcaggagagtaaaaaggcctgtcttagaggcgggggcgacttggtttctattcacagcatggcggaacttgagtttattaccaagcagatcaagcaggaggtcgaggaactgtggatcgggctgaatgacctcaaactgcagatgaactttgagtggtccgacggttctctggtgagttttactcattggcatcccttcgaaccgaataattttcgcgacagtctggaagactgcgtgactatctggggcccagaggggagatggaatgactccccctgtaaccaaagcctgcccagtatctgtaagaaggctggccagcttagccaaggcgcggcagaagaggatcacgggtgtaggaagggttggacctggcattccccctcctgctactggctgggagaggaccaagtcacgtacagtgaggcgcgccggctctgcaccgaccatggaagtcaactggtgaccatcacaaatcgtttcgaacaggccttcgtcagctcactcatctacaattgggaaggcgaatacttctggaccgctctgcaggatttgaacagcacaggatcctttttctggctctcaggtgacgaagtcatgtacacacactggaatcgcgaccaacccggatactctcggggcggatgcgtagctttggctaccggaagcgccatggggctctgggaggtgaagaattgtacctcctttagggctcgatatatctgtaggcagtctctaggtactccggtcaccccagagctgcccgggccagatccgacaccttctctgacgggatcttgcccacagggctgggcctccgacacaaagctgagatattgctacaaagtctttagttctgagaggctgcaggataagaaatcttgggtgcaggcccagggagcatgccaggagctcggggcgcagctgctgagcctcgctagttacgaagaggagcactttgttgccaatatgcttaataaaatcttcggagaatctgaaccagaaattcatgaacagcactggttctggatcggactgaatcggcgggaccctcggggcggtcaatcttggcgctggtcagatggggtcggatttagttatcataattttgaccggtcacggcatgacgacgatgacataaggggatgcgccgtgctggaccttgcctctctccagtgggtcgctatgcaatgtgacacccagctggattggatttgtaaaatcccacggggaaccgacgtgagagaacccgacgattctccacaggggcgccgggagtggctgcgcttccaagaggctgagtacaaattcttcgaacaccattctacctgggcgcaagcccagagaatctgtacatggttccaggccgaactgaccagtgtgcactcacaggcggagctggacttcctcagtcacaacctacagaagttctcgagagcccaagaacaacactggtggatcggcttacacacctccgagtctgacggcagattccgctggaccgacgggtcaatcattaactttatctcctgggctcccgggaaaccaagacccgtgggtaaagacaaaaagtgtgtgtatatgacagcatccagagaagactggggagatcaacgctgtttaactgcactcccatatatctgcaagaggagcaacgttacaaaggaaacacaacctcctgatttgcctactaccgccttgggcggctgcccctctgattggatccagtttttgaacaaatgcttccaggtccaaggtcaggagccccagagtcgggtgaagtggtccgaagcacagtttagttgtgagcagcaagaagctcagttggtgactattaccaatcctcttgaacaggcatttatcactgccagcctgcccaacgtcacatttgacctctggattggcctgcacgcctctcaaagggactttcagtgggtggaacaggagcccttaatgtacgctaactgggcacctggcgagcctagcggcccgtctcccgcccctagcggcaacaaacccacaagttgcgccgtagtgctgcacagcccaagtgctcattttactgggaggtgggacgacagaagttgtacagaagaaacccacggcttcatctgccagaagggtacagacccctcactgagtccgtctccggcagcactgcctcctgcccctggtaccgagctctcttacctgaacgggacctttcggttgttacagaaaccacttcggtggcatgatgccctgctcctgtgtgagtctcggaatgcttctctggcatacgtgccagatccctatacgcaagcttttctaacacaggccgcccgaggcctgcgcacacccctctggatcggtctggcaggcgaggaaggcagccgccgttacagttgggtgagcgaggaacccctgaactacgttggttggcaggatggtgagccacagcagcctggtggatgcacttatgtcgacgtagatggtgcttggcggaccaccagctgtgatacaaaactgcagggcgcggtctgcggcgtctctagtggaccccctccgcctcgccggatttcataccacgggagctgtcctcagggcctcgccgattcggcatggatcccgtttagagagcattgctattcgtttcacatggagctgctgctgggtcacaaggaggccaggcagcggtgccagcgcgccgggggcgcagtgctgtcaattctggatgagatggaaaatgtgtttgtgtgggaacaccttcagtcatacgaagggcagagtaggggagcctggctgggcatgaatttcaaccccaagggggggactctcgtctggcaggacaatactgccgttaattatagtaactggggtccccccgggctgggaccatctatgctgagccataacagctgctactggatccagagcaactcgggcttgtggcgccccggtgcatgcaccaatatcaccatgggagtagtatgtaaattgcctagggcagagcagtcatcattttctccgtccgcccttccggagaatcctgcggcacttgtggtggtccttatggccgtgctcctcctactagccctgttaaccgctgcactcatactgtatagacggcggcagagcattgagcgcggcgcttttgaaggcgccaggtacagccggagttcctcctcccctacagaggctacggagaagaatattctagtgtccgatatggaaatgaacgagcagcaggaatag

SEQ ID NO: 194111 - DNA, 1038 bp, Artificial Sequence
  Description of Artificial Sequence: Synthetic coding sequence
atgcccaccggccacctgggcagccccctggccctggccctgctgcctgttgccaccaaccggcccgcagttcaatggtcatgtactgccccccagcctacatccctcgccgccggcaccatcggcgccgcacgaaggaggcctatggcctccagcgcccgccgggcaagaggcagccgtaggtattcctgggtctcagaggagcccctaaactatgtgggatggcaggacggcgagccccagcagccaggcggctgtacctatgtcgatgtcgacggagcctggaggacgaccagctgcgacaccaaacttcagggagccgtttgcggagtatcaagcggtcccccacctccgagaagaatctcatatcacggctcctgtccccaaggtttagccgactctgcctggatcccctttagggagcactgctactcttttcacatggagctgctgctgggtcacaaggaagctcggcaaagatgtcagagagctggaggggctgtgttgtcaatcctcgatgagatggagaacgtatttgtgtgggaacatctgcaatcctacgagggccagagccgtggtgcgtggctcggtatgaactttaaccccaagggcggaaccctcgtgtggcaggacaacacagcagttaattactcaaactgggggccacccggattaggtcccagcatgcttagccacaacagttgctactggatacagagcaacagcggtctctggcggcccggcgcttgcaccaatattacgatgggcgttgtgtgcaagcttcctagggccgaacaaagcagtttcagccctagcgcactacccgagaaccctgccgcgctggtggtagtgttaatggccgtcttgttactactggctctccttaccgcagctctcattttatatcggagaaggcagtcaatagagagaggggccttcgaaggagcccgctattcccgctcaagctcttctcccactgaggcaaccgagaaaaacatcttggtgtctgacatggaaatgaacgaacaacaggagtag

SEQ ID NO: 194112 - DNA, 834 bp, Artificial Sequence
  Description of Artificial Sequence: Synthetic coding sequence
atgttccccttctacagctgctggcggaccggcctgctgctgctgctgctggcagtggcagtacgcgaatcatggcagaccgaagaaaagacctgtgacttggtcggcgagaaggggaaagaaagcgagaaggagctggctctggttaagagattaaagccactcttcaacaagtcttttgagagcacagtggggcagggatcagatacatacatttacatttttcgggtatgccgcgaagcaggaaatcacacttccggcgctggcttagtgcagatcaacaagtctaacggaaaggagacagtcgtagggaggttaaacgaaactcatatatttaatggctccaattggattatgctgatttacaagggcggagatgaatacgataaccactgcggaaaagagcagagaagggcggtcgtcatgatttcatgcaatcgacataccttggccgataacttcaatccagtctctgaggagcgtggcaaagtgcaggattgtttttacttgttcgaaatggattccagtcttgcgtgctccccagagatctctcacctgagcgtgggctcaatcctcctggtcaccttcgcttcattggtggcagtgtatgtggtcgggggatttctgtaccaaagactggtcgtgggggcaaaagggatggaacagtttccccatctggcattctggcaagatttagggaacctcgtggcagatggctgcgactttgtgtgtcggtctaaaccccggaacgtgcccgctgcataccggggtgtaggagatgatcagctgggggaggaatcagaagagcgggacgatcacttgctcccaatgtag

SEQ ID NO: 194113 - DNA, 279 bp, Artificial Sequence
  Description of Artificial Sequence: Synthetic coding sequence
atgttccccttctacagctgctggcggaccggcctgctgctgctgctcctggccgtcgctgtaagggagtcctggcagaccgaggaaaaaacatgcgacctggtcggagagaagggtaaggaatccgaaaaggagttagcgcttgtgaaaaggctgaagcctcttttcaataaaagcttcgagtcgaccgtgggacaggggagcgatacctacatatatatctttcgcgtatgcagggaagcaggcaaccatacttccggagccggcttagtgcagtag

SEQ ID NO: 194114 - DNA, 330 bp, Artificial Sequence
  Description of Artificial Sequence: Synthetic coding sequence
atgttccccttctacagctgctggcggaccggcctgctgctgctgcttctcgccgtcgccgtgagggagtcgtggcagactgaggaaaaaacttgcgacctcgtgggtgagaagggaaaagagtcggagaaagaactggccctggtgaaaagactgaagcccctatttaacaagagttttgagagtaccgtggggcaggggtctgatacctacatctatattttccgtgtctgccgtgaggcaggcaaccacacaagtggggcagggttggttcagatcaacaagtccaacgggaaggagactgtagtgggacggctgaatgagacctag

SEQ ID NO: 194115 - DNA, 747 bp, Artificial Sequence
  Description of Artificial Sequence: Synthetic coding sequence
atgagcctgttccccagcctgcccctgctgctgctgagcatggtggccgcttcttactctgagactgtcacctgtgaggacgcacagaaaacatgtcccgcagtgattgcatgcagctccccgggaattaatgggtttcctggaaaggacgggcgcgacgggactaaaggcgagaaaggtgagcctggacagggattgcgcggactccagggaccacccggaaaattgggccctccaggtaacccagggccaagtggatctcctggccctaaaggccagaaaggggatcccggaaaatcccccgacggtgactcttccttggcagcatccgagcgcaaggccctccaaacagagatggcccgtatcaaaaagtggttgacattttccctgggcaagcaggtggggaacaaatttttcctgaccaatggggagataatgacatttgaaaaagtaaaggctctctgcgtcaagtttcaggctagcgtggcaactcctcggaacgctgcagagaacggagcgatacaaaacctcatcaaggaggaggcctttcttggcattacagacgagaaaacagagggtcagttcgtggacctaactggcaatagactgacatatactaactggaacgagggagaacctaacaatgccggctctgatgaggattgtgtcctgctgctgaagaatggacagtggaacgatgtcccttgtagcacttcgcatttagcggtatgtgagtttccaatttag

SEQ ID NO: 194116 - DNA, 744 bp, Artificial Sequence
  Description of Artificial Sequence: Synthetic coding sequence
atggccgccgaggccgacggccccctgaagcggctgctggtgcccatcctcctgcccgagaaatgttatgaccaactgttcgtgcaatgggatctgcttcacgtcccttgcctgaaaattttgctaagcaaaggactgggtctgggcatagtggcagggtccctgctggtcaaactgccgcaggtgttcaagatcttgggggccaagagcgccgagggcctatcgttgcagagtgtgatgcttgagctggtggcactaacgggcacaatggtgtactcaatcactaataactttccattcagcagctggggggaagccctgttcctgatgctgcaaactattacaatctgcttcctggtgatgcactacagaggtcagactgtgaagggggtggctttcctagcctgctacggcctcgtcttgttggtgctgctgtccccacttacacccctcaccgtcgtgaccctgctccaggcaagcaacgtgcccgcagtcgtggtgggccgattactccaggccgcgactaattaccacaacggacataccggtcaattgtctgctatcacagtgttcttactgtttggcgggtcccttgcacgtatcttcactagtatccaggagaccggagacccccttatggccgggacctttgtagtgtccagtctgtgtaatggtctgattgcagcacaacttcttttttattggaacgccaagccgccacataaacaaaagaaagctcaatag

SEQ ID NO: 194117 - DNA, 381 bp, Artificial Sequence
  Description of Artificial Sequence: Synthetic coding sequence
atggccgccgaggccgacggccccctgaagcggctgctggtgcccatactcctgccggagaagtgttacgaccaattgttcgtccagtgggatctgcttcacgtcccctgcctgaaaatactacttagcaagggccttggcttgggcatagttgccggctctctcttggttaagctgccacaggtcttcaagattttgggggctaagtctgcggctggcctgaagaaggaagatgaggccagaccagtacgctccgctagcatgagagttagaggcggactgggcgcttggggccatcagcagggggaagggtgcatggagtgggagagccagggggcgggttccggctaccgctgggccgcagtgccccccggagcttag

SEQ ID NO: 194118 - DNA, 900 bp, Artificial Sequence
  Description of Artificial Sequence: Synthetic coding sequence
atggccgccgaggccgacggccccctgaagcggctgctggtgcccatcctcttacccgaaaagtgttacgatcagctctttgtccagtgggacctgctccatgtgccctgcttgaaaattttgctgagcaagggcctagggcttggcattgttgcaggctcactgttggtgaaactcccacaggtctttaagatccttggggcaaaatctgcggagggcctcagcctccagtccgtcatgctggagttagtagcactgaccgggacaatggtgtacagtatcacaaacaattttccattctcttcatggggggaagccctgttccttatgctgcagaccatcaccatttgcttcttggttatgcactataggggccagaccgtgaaaggggttgccttcttggcttgttatggattagtgcttctggtcctgctctccccactcacacctctcacagtggtcccctgtagcgggctgcagtgcgcatgctgtggcgggggagaggcatctcccggatcgcatcagctgccccagcgggcgcaccggccagcattatctcatcactctcttcccgctgtttggggattaccaggtcctaacctgcattttcattcggggaacaggcgaagccccgatggctgggacctttgtggccttctctcccttcaaaggccacatagaaggccagccgcccttttgctcgaatgtaaagcttcccctcaggccgaaaaaggggccgttgagcccgccacaggggtaattccctttcccctgatccaccccacttccgggtttagtccttcggagccagcatgttggtgtgaccttcttatattgcactcttctgccttggccgatttcctgtctcagggattcctgttggtcgaaacgaatggctag

SEQ ID NO: 194119 - DNA, 636 bp, Artificial Sequence
  Description of Artificial Sequence: Synthetic coding sequence
atggccgccgaggccgacggccccctgaagcggctgctggtgcccattctgctccctgagaagtgctacgaccaattgtttgtccagtgggatctgctccacgtgccctgtcttaagattctgctttccaagggtctgggactgggcatcgtggccggatcactgctagtgaaattaccacaggtgttcaagatcctgggagctaaatctgccgagggtttgagcctccagtccgtcatgctggagttggtcgctctgaccggaacaatggtgtacagcatcaccaataacttccccttcagttcatggggcgaagcgttattccttatgctccagacaattactatctgcttcctggtgatgcattacagaggacagaccgtcaagggggtcgcctttctggcttgctatggcctcgtgcttctggtgctgttaagccctctaacgcccttaacagtcgtgaccctactacaggcctcaaatgtgccggcagtagttgtgggcagactgttgcaagctgccactaacactacgactggaacacaggcctcctcccaaccgagtcagagtagctgctgccttggcgccccctggcctgagtcatccctgccatttcggaagcccgaaattccttag

SEQ ID NO: 194120 - DNA, 561 bp, Artificial Sequence
  Description of Artificial Sequence: Synthetic coding sequence
atggccgccgaggccgacggccccctgaagcggctgctggtgcccattctgcttccggaaaagtgctacgatcagttgtttgtgcagtgggatctcctacacgtgccatgcttgaagattcttttgtccaaggggcttgggctgggtatagtggccgggagtttgttagtgaagctgccccaggtctttaaaatcttgggcgctaagtcagccgaggggctcagcctgcagagtgtaatgcttgagctcgtggcccttactggcactatggtgtattcaataactaataacttcccttttaggtgccgctttccacgcctgctgcggcccggcccagccggagcgagtctgacgagcgatgccttggactgctcccacccagcccccgggctgcagtgcgcctgctgcggcggcggtgaggctagtcccgggtctcaccaactgccgcagcgcgcacatcgcccagcacttagccatcactccctgccggctgtctggggactgcccgggccaaatttgcactttcactccggagtgtctattccctttagccaactctag

SEQ ID NO: 194121 - DNA, 2826 bp, Artificial Sequence
  Description of Artificial Sequence: Synthetic coding sequence
atggccgccgcccccgccctgaagcactggcggaccaccctggagcgagtggagaagtttgtcagtccgctttactttactgattgtaatctgcgggggcggctttttggggccagctgccctgtcgccgtgctgtcttcctttctaaccccggagagactcccttatcaggaagccgtgcagcgcgatttcaggcccgcccaggttggagactcatttggcccaacctggtggacttgttggttccgcgtggagctgactatcccagaggcctgggtcggacaggaggttcatctctgttgggaatcagatggtgagggattggtgtggcgggatggggagcccgttcagggccttactaaggagggagagaagactagttatgtgcttacggatagactgggcgaacgtgacccacgctcgctcacactgtacgtcgaggtagcctgcaatgggctactcggtgcaggaaaaggatcaatgatcgcagctccggaccccgaaaaaatgttccagctgagccgcgctgagttggccgtgttccatcgcgacgttcacatgctcctggtggatttggagttgctgcttggtatcgcaaaagctcagcagctggagtgggtgaaatcacggtacccaggcctctactcacggattcaggaattcgcatgtagaggccagttcgttcctgtgggggggacatgggtggaaatggatgggaatctgccatctggagaagcaatggtgagacagttcctgcaggggcagaacttttttttacaggaattcgggaaaatgtgttctgaattttggcttccagatacatttggatattccgcacagttgccgcagattatgcatgggtgcggaatacgaagattcctcactcagaagctatcctggaacctggttaactctttccctcatcacacttttttctgggaggggctggatggctccagagtgctggtccacttccctcccggggactcatacggtatgcagggctccgtcgaggaggtcctcaaaaccgtagccaacaacagggacaaggggagagccaaccatagtgcatttcttttcgggttcggggacggaggcggagggcctacgcagaccatgctggatcgcctgaagagattaagcaacactgacgggttgccccgggtgcagctttccagcccaaggcagttgttcagtgcactggaatctgattccgaacagttgtgtacttgggtgggggaactatttctcgagctgcacaacggtacgtatactacacatgcccagatcaaaaaagggaaccgagagtgtgaacggattctgcatgacgtggagctgctgtcctctctcgctctggcccgttccgcacaattcctataccccgccgctcagctgcaacacctgtggaggttactgctgttaaatcaattccacgacgtggtcactggttcctgtattcaaatggtagctgaggaggcgatgtgccattacgaagacatacgcagccacggtaataccctgctgagtgcagctgctgcagcgctgtgtgccggcgagcccggacctgaaggactgctgattgtgaatacactaccgtggaagcggatcgaggtgatggctttgcctaaaccgggaggagctcatagcctggctctcgtgacggtgccctctatgggttacgccccagtccccccccccacaagcctccagcctctgctgccacagcagcccgtctttgttgtccaggagacagatgggagtgtgacattggataacgggatcattcgagtcaagctggatccaactgggagattgacatcactggttctcgtcgccagcggacgggaggcgatagctgagggcgcggtgggtaaccagttcgtgctattcgatgacgtgcccctgtactgggacgcctgggacgtgatggactatcatctcgaaacacgaaagcccgtgctgggccaggctgggaccctcgccgtgggcacggaggggggcctacgtggatctgcatggtttctcctccagatctcaccgaactcgcgcctgagccaggaagtcgtcctggatgttggttgtccatatgtgcgctttcatactgaagtgcactggcatgaggcccataagttcctaaaagtggaattcccggcaagagtcagaagtagccaagcgacatacgaaattcagtttggacacctacaaaggccaactcactataacacctcgtgggactgggcccgatttgaagtctgggcccatcgatggatggacctcagtgaacacgggttcggcctcgcactcctgaacgattgcaaatacggggccagcgtccgtggctctatcctgagtctttccctgcttagggctcccaaagcccccgatgctactgccgacaccgggcggcacgagtttacctatgcgcttatgccgcataaggggtcattccaagatgcaggagtaatacaggccgcctacagtctgaattttccactgttggccctgcctgcaccatccccagcacctgccacaagctggtccgcattttccgtttccagccccgcggttgtcctcgagacagtcaagcaagctgaatctagtccgcagagacgatccttagtgctgcgtctgtacgaggcgcacggatctcatgtggactgttggctgcacctgtctctacctgtccaggaggctatcctgtgtgaccttctggagcggcctgatcccgctggacatctgaccctgcgagataatcggctgaagctgacatttagcccctttcaagttctctccctcctcctggtccttcagcctccacctcactag

SEQ ID NO: 194122 - DNA, 3174 bp, Artificial Sequence
  Description of Artificial Sequence: Synthetic coding sequence
atggccgccgcccccgccctgaagcactggcggaccaccctggagcgggtggaaaagttcgtgtcgccactgtacttcactgactgcaatctgaggggaagactgttcggcgcttcgtgtccagttgctgtgctgtcctccttcctgactcctgagcgactcccctatcaagaggccgtccagcgggacttcaggcccgcacaggtcggagattcttttgggccaacctggtggacctgttggtttagagtggagctcactatcccagaggcctgggtggggcaggaggtccatctctgctgggagtccgatggggaaggacttgtatggcgcgatggagaaccagtgcagggcctgaccaaggaaggggagaagacgtcctatgtgctgacagataggctgggagagagagacccccgctcactgacactctatgtcgaagtggcctgcaacggattactgggcgctggcaaagggtccatgatagccgccccagatcctgaaaagatgtttcagctgagtagagccgaactggccgtgttccatagagacgtgcacatgctactcgtggacctggagctcttattaggcattgctaagggacttggaaaggataatcaacgcagtttccaggccctgtacaccgcaaaccagatggtaaacgtatgtgatcctgcgcaacccgaaacattccctgtggcccaggcactcgctagcagattctttgggcagcatggcggagagtcacaacataccatacatgcgacaggacactgccatatcgacaccgcctggctgtggccctttaaagaaacagtaaggaagtgcgcccggagttgggttacagccctccagctgatggagaggaaccctgagtttatctttgcctgctcgcaggcccaacaattggagtgggtcaagtcccgctacccaggcttgtactccaggatccaggagttcgcctgccggggccaatttgtgcccgtgggaggaacttgggtggagatggatggaaacctcccaagtggagaggcaatggtgcgccagtttctgcagggacagaacttttttttacaggagttcggtaaaatgtgctccgagttctggttgcctgacactttcggatacagcgcgcagttgcctcaaatcatgcacgggtgcggaatacggcgattcctaacacaaaagcttagctggaatttggtaaacagctttccccaccatacgtttttctgggagggcctagacggctctagagtgctggttcactttcctcccggggacagctacggaatgcagggcagcgtggaggaagtgctgaagacagtcgccaacaaccgcgacaaaggcagggctaatcacagcgcttttctcttcggcttcggggatggcggaggcggcccaacgcagactatgctggacaggctgaagcgtctttcaaatactgacggactgccacgagtgcaactctcctcgcctcgtcagctgttcagcgctttggagtcagattcagagcagctgtgcacctgggtgggcgaactgttcttggaattacacaatggcacgtatacaacccatgcccagatcaaaaaaggcaacagggagtgtgaacgaattcttcatgacgtggagctgcttagtagccttgcgctggcccggagtgcccagttcctttatcctgctgcgcaactgcagcacctgtggcgcctcctgctgcttaaccagttccatgatgtggtgacagggagttgcatccagatggtagcagaggaggccatgtgccactatgaggacatccgatcacacggcaacacgctcttgtcggccgcagctgccgcgctgtgtgcaggtgagccgggaccggagggactgcttatcgttaacaccctcccatggaagcgtatcgaggtgatggcccttcctaaacccgggggggctcacagtctggggcttacgccatccccaggagacagcgctcaacacgggctttgcagctgttctagcccccacttaactgccgcgccagccgctcctgcagcatgcgtgcgaagtgcccgcgctccaaccgactcagcgagccggccgccccctaccaaaactgatgggtctgtaacactagacaacggcattattcgagttaaattggatccgactggtcgcctcactagcctggttctggtggcctcaggaagggaggcaattgcagagggtgcagtgggcaaccaatttgtcctcttcgacgatgtacctctgtactgggacgcctgggacgtaatggactatcacttagagacacggaagccggtgctggggcaggctggaacccttgctgtgggaactgaaggtggactgcggggaagcgcctggttccttctacagatctccccgaactccagacttagtcaggaggtcgtgctggatgtcggctgtccgtacgtacgctttcacaccgaagtgcactggcacgaagcccacaaatttcttaaagttgagttccccgccagagtgagatcctcccaggctacttatgagatccagttcggccacttgcagcgaccaacccactataatacttcctgggattgggccagatttgaagtgtgggcccaccggtggatggaccttagcgagcacgggttcgggctggccctgctcaacgattgtaagtacggagctagtgtaagggggagcatcctgagcctaagcctgctgagagctccaaaagctccagacgcaactgccgatactggccggcacgagttcacatacgccttgatgccacataaggggtcttttcaggatgccggggtgatccaggctgcttactccttgaactttcctttacttgcactgcccgcccccagtcccgcaccagccacctcctggtctgctttctcagtgtcttctcccgccgtcgtgctggaaacagttaagcaggccgagtcttccccacagaggagatcacttgtccttcgcctttacgaggcccatggttcccacgtggattgctggctccatctcagcctgcctgtgcaggaagctatcctgtgcgatctgctggagagacccgacccagccggccatctgacattgcgcgataaccggcttaaactgaccttttctccctttcaggttctctcgctgctcctggtgctacagcctccccctcactag

SEQ ID NO: 194123 - DNA, 3054 bp, Artificial Sequence
  Description of Artificial Sequence: Synthetic coding sequence
atggccgccgcccccgccctgaagcactggcggaccaccctggagcgggtggagaaatttgtttctccactgtattttaccgactgcaacttacgagggaggttattcggggccagctgtcctgtggcagtgttgtcctccttccttacacccgagcggttaccctatcaggaggcagtacagcgggattttcggccagcccaggttggtgactcatttggacccacttggtggacctgctggtttagagtcgaactaacaattccagaagcttgggttggccaagaggtgcatctgtgttgggagagtgatggagagggcctggtgtggcgcgacggagaacccgttcagggcctcacgaaggagggcgagaaaacctcatacgtcctcacagacaggctgggcgagagagacccccggagtttgacattatacgtagaggtggcttgcaacgggctgttaggtgcaggaaagggttccatgatcgcagcgcccgaccccgagaagatgttccagctctccagagcggagttggcagtgttccaccgggatgttcacatgctgctggtcgatcttgaactgctgctcggcatcgccaaagggctaggtaaagacaatcagagatcttttcaagccctctatacagcaaatcagatggttaatgtgtgcgatcctgcgcagcctgaaacatttcctgtggcccaggccctggcgagtcgcttctttggccagcatgggggtgaatcccagcacacaatacatgccacaggccactgccatatagacactgcctggttatggcccttcaaggagaccgtgaggaagtgtgcccgctcttgggtcactgcactgcaattgatggagagaaatccggaattcattttcgcctgtagtcaggcgcagcagctggaatgggtgaagtctaggtacccaggactgtactcgcggatacaggagtttgcatgccgcggccagtttgtgccagtggggggtacatgggtcgagatggatggcaatttaccatctggcgaggcgatggtccggcagtttcttcagggacagaattttttccttcaggaattcggaaaaatgtgttctgagttttggctgcccgacaccttcggatactctgctcagttgccacagatcatgcatgggtgtggcattagacgattcctgacacagaagctgtcttggaaccttgtgaactcctttccgcaccatacatttttttgggaaggccttgatgggagtcgtgtgctcgttcacttccccccaggagactcttacggaatgcagggtagtgtggaggaggtgctcaaaaccgtcgccaataatagggataaaggccgcgccaaccacagtgccttcctgttcggattcggagacggcggtggggggccgacacagaccatgctggatagacttaagaggttgtcaaatacagacggactgcctagggtacaactgagctcgccccgccagctattcagcgcgttagagagtgactcagagcagctctgcacttgggtgggtgaactcttccttgaactacataacggaacttacaccacccatgcccagattaagaagggaaacagagagtgcgagaggattctgcatgacgtggagctccttagctctctggccctggccagaagtgctcaattcctctacccagccgcccagctgcaacacctgtggcgacttctactgctcaaccagttccacgacgtggtcaccggatcatgtatccagatggtcgcagaagaggccatgtgccattacgaggacatcaggagtcacgggaatacactcttgagcgctgctgccgccgcactgtgcgcaggcgaacccggacccgaaggcctcctcattgtcaacacactgccatggaagagaatcgaggttatggcgcttcctaagccaggcggcgctcatagcttggcattagtcacagtgccgtccatgggctatgcacctgttccccccccaaccagcctccaacccctacttccacagcagcctgtcttcgtcgtacaggagacagatggctctgtgacactagataatgggatcatacgggtgaaacttgatcccacgggcagactgaccagcctcgtcctcgtagcctctggcagggaagcaatcgccgagggcgctgtaggcaaccagttcgtactttttgacgacgtgccattatattgggatgcatgggatgtgatggactaccatctcgaaacccggaaaccagtcctggggcaggccggtacactcgctgtaggaactgaggggggacttcgtgggagcgcttggttcctcctgcagatttcgcctaactctagactgtcccaggaggtggtactcgatgtcggatgcccctatgtgcggtttcacacagaggtgcattggcacgaggcccacaagtttttgaaagtggagttccccgccagagtgagatccagccaagccacttacgagatccaattcggacacttgcagagaccgacccattataacacctcttgggattgggcgcgattcgaagtgtgggcccatcggtggatggatctcagcgagcacggattcgggctggctttgctgaacgactgcaaatatggagccagcgtccgcggtagcatcctaagcctatcgctgcttcgggctcctaaagctcctgatgccaccgccgacacaggtcggcacgagtttacatacgctctgatgccgcacaaagccccatcacctgcccccgccacctcatggagcgccttttccgtgtctagtccagcagtcgtactcgagactgtgaagcaggctgagagtagtccacagcgcagaagcctcgttctaaggctctatgaagcccatggttcgcatgtggactgctggctgcacctgagtttgcctgtgcaggaggcaattctatgtgacctgctggagaggccggacccggccggccacctaaccctgagggacaatagacttaaactgaccttttcgcccttccaggtgctgtctctgctactggtgctgcagcctcccccgcactag

SEQ ID NO: 194124 - DNA, 1104 bp, Artificial Sequence
  Description of Artificial Sequence: Synthetic coding sequence
atgcccgtgggcggcctgctgcccctgttcagcagccccgccggcggcgtcttgggcggaggcttaggcggcggaggtggtagaaaaggtagtggccctgcggcgttacgcctgaccgagaaattcgtgctcctgcttgtgttttcagctttcattactctttgttttggggctatctttttcctccccgactcttccaagctgttgtccggggtgctctttcactcaagtcctgcgctgcagcctgcggcagaccacaagcccggccccggcgcacgagccgaagatgccgcggaggggcgcgctaggaggagggaggagggtgcacccggtgaccccgaggcagctttggaggataacctggctagaattagagagaatcacgagcgagccctgagggaggccaaggagactctgcagaagctgcccgaggagattcaaagagacatcttgctggaaaagaagaaagtagcccaagatcagttacgcgacaaagctccttttcgggggctgccccctgtcgactttgttccgcccataggggtcgagagccgtgagccagccgacgctgccattcgtgagaaaagagccaaaataaaggaggagatagaggcaagaaaggggcaggccaactgtcccggcagctccagctcttgtgaggtcgagattcagatgatgaaacacgcctggaacaattataaaggctacgcatggggcctgaacgagttgaagccgatttcaaaaggggggcattcttcttccctattcggaaatatcaaaggggctacgattgtcgatgccctcgatacccttttcataatggagatgaagcatgaatttgaggaggctaaatcgtgggtggaagagaatctagacttcaatgttaatgcagagatttccgtgtttgaggttaatatacgttttgtcggaggcctattgtcggcctattacctatccggagaagaaatcttcagaaaaaaggctgtggaactgggcgtgaagttgctccctgcgtttcacactccaagcggtattccttgggctctgctcaacatgaagcgctggatgtgcaacattccacgagccatggaagccacaatttag

SEQ ID NO: 194125 - DNA, 1962 bp, Artificial Sequence
  Description of Artificial Sequence: Synthetic coding sequence
atgcccgtgggcggcctgctgcccctgttcagcagccccgccggcggcgtattaggtgggggactgggaggaggaggagggcgaaaaggctctggcccagctgctctgaggctgaccgaaaaattcgtgctactgctggtgttcagcgcgtttattacactgtgcttcggtgcgatcttctttttgcctgattcctccaagctgttaagcggcgtgctgttccattccagcccggctctgcagccagcggccgaccataaacctggaccaggcgctagggccgaagatgcagctgaagggcgcgcgaggcgccgcgaggaaggggctccaggggaccccgaggctgcgctagaggacaatctggcccggatccgcgaaaatcacgagagggctctgagagaagccaaggaaacattacagaagctgcccgaagagattcaacgcgacatcttgctggagaaaaaaaaagtcgcacaggaccagctcagggataaggcccccttccggggtctcccacctgtggacttcgtccctccgatcggcgttgagagcagggagcccgctgatgccgccatcagggagaaaagagcaaaaataaaagaaatgatgaagcacgcgtggaataattacaaaggctatgcctggggtttgaacgaactgaagccgatcagcaagggaggacacagttctagtctgtttgggaacatcaaaggagccacaattgtggatgccctggacaccctgtttattatggaaatgaaacacgaattcgaagaggccaaaagttgggtcgaggagaaccttgactttaatgtaaatgcagagataagtgttttcgaagtgaatatcaggttcgttggtggactgctttccgcatactacctgtcgggtgaagagatatttagaaagaaggcggttgaactcggggtaaagttgctgccagccttccatacaccctccggtatcccatgggccctgctaaatatgaaatctgggattggaagaaactggccatgggcatccgggggctctagcattctcgctgaattcgggactctccacttggagtttatgcacttgtcacacctgtcgggcaaccccatctttgcggaaaaggtgatgaacatccgtacagtgcttaacaagttggagaagccccagggattgtatccaaactatcttaacccctcttctgggcagtggggacaacaccatgtctcagtgggcggcctcggggacagcttttatgagtatctactcaaagcatggctcatgtctgataagacggatctcgaggctaaaaaaatgtattttgacgcagttcaggccatcgagactcatttgattagaaagagctcgtcgggcttaacttatattgccgagtggaagggaggacttctcgaacataaaatgggacacctcacttgcttcgcaggtggcatgttcgccctaggagcagatgccgcccccgagggcatggcccaacattatttggagctaggagctgaaatcgcccgcacatgccacgagtcatacaaccgaacattcatgaaactgggacctgaagcctttcgtttcgatggcggcgtggaggcgatcgccaccagacagaatgaaaagtactatattctgcgccctgaagtgatggaaacctacatgtacatgtggcgactgactcatgaccccaaatatcggaaatgggcctgggaggctgtggaagctttagagaaccattgtcgggtgaacggcgggtattccgggctccgagatgtgtacctgctgcatgaaagctatgacgacgtgcagcagtcttttttcctggcagagactctgaagtatctgtatttgatcttctctgatgatgatttactgcctctggagcattggatcttcaacagcgaagcacatcttctgccgattctgccaaaagacaagaaagaagttgagatccgagaagaatag

SEQ ID NO: 194126 - DNA, 579 bp, Artificial Sequence
  Description of Artificial Sequence: Synthetic coding sequence
atgttcgccctgggcgccgacggcagccgggccgacaaggccggccattacctggaattaggcgccgaaattgcaagaacctgccatgagtcctacgaccgaacagccctgaagctaggcccagagtccttcaagttcgacggtgctgtggaagcggttgccgtcaggcaggccgagaagtactatatattgagacctgaagttattgagacatactggtatctgtggcgtttcactcatgatcccagatatcggcaatggggctgggaagctgctcttgcgattgagaaatattgtagagtgaacggtggattttcaggtgtgaaggacgtgtatagcagcacccccacacatgatgatgtgcaacagagcttttttctcgccgaaacacttaagtacttataccttctttttagcggggacgacttactaccattggaccactgggtttttaatacagaggcgcatccgctgccggtcttgcatctagctaataccaccttgagcggaacatcccaggggatgcgaaggcaaaatccttacttccaggtgctctacctgtactatcctgatgattag

SEQ ID NO: 194127 - DNA, 1926 bp, Artificial Sequence
  Description of Artificial Sequence: Synthetic coding sequence
atgaccacccccgccctgctgcccctgagcggccggcggatccccccactgaacttaggccccccatcttttccccatcatcgcgccacactgagattgtcagagaaatttatcctactgctcattctgagtgcttttatcactctgtgctttggtgcattcttcttcctaccggactctagcaagcacaaaaggttcgatctggggcttgaggacgtattaatccctcatgttgatgcgggaaaaggagcgaaaaatcctggcgttttcctgatacacggccctgatgagcaccgacatcgagaggaagaggagcggctgagaaacaagatccgcgccgaccatgagaaggcgcttgaggaagctaaagagaagttgcgaaaatcacgcgaagagatccgggctgaaatccagacagagaagaataaggtcgtccaggaaatgaagattaaagaaaataagcccctgcctccagtaccaattccgaacctcgtcggtatcagaggaggagacccggaagacaacgacatccgagaaaagagagagaaaattaaagaaatgatgaagcacgcctgggacaactacagaacttatgggtggggccataatgaactgcgtcctatcgctcggaaagggcatagtccaaatatattcggttcatcccagatgggggccaccatcgtagacgctcttgacacgctgtacatcatgggattacatgacgagttcttggacggccaaagatggatagaggacaacctggattttagcgtcaattcagaggtgtccgttttcgaggtgaacattagatttattggggggctgctggccgcctattatctcagcggcgaggaaattttcaagataaaggccgtgcaactggctgagaagctattacctgccttcaacaccccgacaggaattccttgggccatggtgaatctgaagtctggcgtgggccgtaattgggggtgggccagcgcaggatcttctatcttagccgagttcgggaccctgcacatggaatttatccacctctcctatttgacaggtgacttgacatactacaaaaaggtgatgcatattagaaaactgctgcaaaagatggatcgcccaaatggactgtaccccaactacctgaaccccagaaccggtagatggggtcagtatcacacctcagtcggaggactgggagactccttttacgaatatctgctgaaggcctggctgatgagcgataaaacagaccacgaagccaggaagatgtacgacgatgccattgaggcaatcgagaaacacctcattaagaagtccaggggtggcctgacttttataggggagtggaaaaacggacacctggaaaaaaaaatgggccacctggcctgtttcgctggcggaatgttcgcactgggcgctgacgggtccagggcggacaaagccggacactacctggagttgggggcagagattgccagaacttgccatgagagctatgacaggactgcactgaagctaggccccgagtctttcaagtttgacggggctgtagaagccgttgcagttcggcaggctgaaaagtattacatccttcggcccgaggtgattgaaacatattggtacctgtggaggttcactcacgatccccgctatcgccagtggggatgggaggcggctttagcgatcgagaaatactgtcgagtgaacggggggtttagcggcgtgaaggatgtctatagctcaacccccacccatgatgatgtacagcagagcttcttcctcgcagaaaccctcaagtatctttacctccttttctccggcgacgatctgctgcccctggatcactgggtgttcaatactgaggcgcatcctctgcccgtgcttcacctggctaacaccacgttaagcgggaacccagctgtgagatag

SEQ ID NO: 194128 - DNA, 1128 bp, Artificial Sequence
  Description of Artificial Sequence: Synthetic coding sequence
atgggcctgcacgacgagttcctggacggccagcggtggatcgaggacaaccttgatttctccgtgaatagtgaggtttctgtgtttgaggtaaacataagatttattggtggtttactggctgcatactatctttctggagaagaaattttcaagatcaaggcggtgcagctggctgaaaaactactccctgccttcaacacccctaccggaatcccctgggctatggtgaatcttaagtccggggtcggaagaaactggggctgggcctccgctggatcgtccattctagcagagtttggcacccttcatatggagtttatccaccttagctacctgacgggcgatctaacctattataaaaaagtaatgcacatacgcaagcttctacaaaagatggaccggcctaacggactgtatcctaactacctgaacccccggacaggccggtggggccagtatcatacctcggtgggcggtcttggcgacagcttctacgaatacctgctcaaggcctggctaatgagcgacaagaccgatcacgaggctcggaagatgtacgacgacgccattgaggcgattgagaagcatctgattaaaaagagccgcggggggttgacattcatcggagagtggaagaacggacatttagagaagaagatgggtcacctggcatgtttcgcaggcggcatgttcgccctaggtgctgatgggtcgagggccgataaggcaggccattatcttgagttgggcgcagagatcgctagaacatgtcatgagagttatgatagaaccgcacttaagcttggacccgagagtttcaagtttgacggagcggtggaggcggtcgcggtccgccaagcagagaagtactacattctgcgccccgaagtgattgagacgtactggtatttgtggcgatttacccatgaccccaggtaccggcagtggggctgggaggccgctctcgccattgaaaaatactgcagagtcaacggcggttttagcggtgtgaaggatgtatattcctccaccccaacgcatgatgatgtgcaacagtccttttttctggccgaaactttaaaacttgccagctaccatgaacgcaccgtatttcccgcgggttag

SEQ ID NO: 194129 - DNA, 615 bp, Artificial Sequence
  Description of Artificial Sequence: Synthetic coding sequence
tgaatcaagaagagccggggcggcctgaccttcatcggcgagtggaagaacggacacctcgaaaaaaagatgggccacctggcatgcttcgcaggcgggatgttcgcattgggtgccgacggcagtcgcgcagataaggccggacattatctggaacttggcgccgagatcgctagaacatgccatgaatcctatgacaggaccgctcttaagttaggtcccgagagtttcaaattcgatggagcagtagaagcggttgctgtgcggcaagccgaaaagtattacatattacgcccagaagtgatcgaaacctattggtatctgtggagattcacccacgatccacgttatcgtcaatggggctgggaagccgcgctggctatcgagaaatactgcagagtgaacggtgggtttagtggcgttaaggacgtgtactcttccactcccacccacgacgatgtacagcaatcttttttcctggccgagacactcaaatacctttacttgctgttctcaggagatgatctattgcccctggaccattgggtctttaatacagaagctcacccactgcctgtgctccatcttgctaacaccactctttccgaatcctag

SEQ ID NO: 194130 - DNA, 294 bp, Artificial Sequence
  Description of Artificial Sequence: Synthetic coding sequence
gagaagtactgccgggtgaacggcggcttcagcggcgtgaaggacgtgtactcttccaccccgactcatgatgacgtgcagcagagttttttcctggccgagacgctcaaatatctgtatctgctcttctctggagacgacttgctacccctggatcattgggtgtttaacacagaggctcaccccttgcccgtacttcatctcgcaaatactactctgtcaggaacttcacaaggcatgcgcaggcagaatccctattttcaggtgctgtacctgtattaccccgatgactag

SEQ ID NO: 194131 - DNA, 1035 bp, Artificial Sequence
  Description of Artificial Sequence: Synthetic coding sequence
tgaatccggttcatcggcggcctgctggccgcctactacctgagcggagaggagatctttaaaatcaaggccgtacagctggccgagaagctacttcccgcattcaacaccccaaccggaattccatgggcaatggtgaacctgaaatctggggtcggcaggaattggggatgggccagtgccggctcctcgatacttgctgagttcgggacactgcacatggagttcatacatctgtcgtacctcaccggggacctgacgtattacaaaaaagtaatgcacatccgaaagcttctacagaagatggatcgtcctaacggattatacccgaattacttgaacccccgaacgggccgctggggtcagtatcataccagcgtgggtggcctcggcgattcattctacgagtacctacttaaggcttggcttatgtccgacaaaacagatcatgaggccagaaaaatgtatgacgatgcgattgaagccatcgaaaaacatctgattaagaaaagtaggggagggctaacctttataggagagtggaagaacggacacctcgagaaaaagatggggcatctggcctgtttcgccggcggcatgttcgctctgggggctgatggtagtcgtgccgataaagccggccattaccttgaattaggcgccgaaattgcaagaacatgccacgaaagttacgacaggactgcacttaagctcggacccgaatcttttaaattcgatggtgccgtggaagcggtggccgtgcggcaggccgagaagtattacatcctgcgacctgaggttatcgaaacatactggtacctgtggcgatttacacacgatcctagatatcgccaatggggatgggaggccgctctggcaatcgaaaagtattgtcgggtcaacggaggcttctcgggggtcaaagatgtctactcctctaccccgacccacgatgacgtgcagcagagtttcttcctagcagagacattgaagctcgcttcctaccatgaaaggacagtgttcccggccggatag

SEQ ID NO: 194132 - DNA, 2100 bp, Artificial Sequence
  Description of Artificial Sequence: Synthetic coding sequence
atggccgcctgcgagggccggcggagcggcgccctgggcagcagccaaagtgactttctaactccccctgttggaggtgccccatgggctgttgccacaactgtagtgatgtatccaccgccgcctcctccccctcaccgcgacttcatttcggtcaccctgagttttggagaaaattacgataactccaaatcatggagaaggagaagttgttggagaaaatggaaacagctgagtcggctgcagagaaatatgatactgtttctgctggcattcctcctcttctgtggcttgctcttctatataaacctcgccgatcactggaaggcccttgcatttcgcctcgaagaggaacagaaaatgaggcccgagatagcgggcctgaaacctgccaatccccccgtgctgccagcccctcagaaggctgacactgaccctgagaatcttccagaaatctcttcccagaagacacagcgtcatatccaacgcggccctcctcacttacaaatacggcctcctagccaagatttgaaggatggtacccaagaagaggcaacaaaacggcaggaggcccccgtggaccccaggccagaaggagacccccagaggaccgttatctcctggcgaggggctgtcatcgagccagaacagggcacagaacttccgtcaagaagggctgaggttcccaccaagcctccattgccccctgctagaacccaggggactcctgttcatctgaactataggcaaaaaggagttatcgacgtcttcctgcacgcctggaaaggttacaggaagtttgcttggggacacgacgaactgaagcccgtgtccagatcctttagcgaatggtttgggctgggcctgaccttgatcgatgcacttgacacaatgtggatcctgggcctgcgcaaggagtttgaggaggcgagaaaatgggtcagcaagaaactgcattttgagaaggacgtggacgtgaatctcttcgagtctacaatccggatccttggcgggctgctgtccgcatatcatttaagcggtgactctttgtttctgaggaaggccgaggatttcggcaaccgcctcatgcctgcattccgcaccccctccaagataccatactccgatgttaatatcgggactggggtcgcccacccgcctcggtggacgagtgacagcacagtcgccgaagttaccagtattcaattggagttcagggaactatcacgcctgaccggcgacaaaaagtttcaggaggccgtagagaaagtgacacagcatatacacggcctgtctggcaagaaagacgggctggtgcccatgttcatcaacacgcatagcggactgtttactcatctgggcgttttcaccctgggcgccagggctgacagctattatgaatacctgctgaagcagtggatccagggggggaaacaagagacccagttgcttgaggattacgtagaggccatcgagggtgtccgcactcacttgcttcgccatagcgagccttctaagctcacatttgttggagagcttgcccacgggcgtttttccgccaagatggatcacctggtgtgcttcctgccagggacactcgcattgggagtctatcacggcctccccgccagccatatggagctcgcacaagaactgatggagacctgttatcagatgaatcgccagatggaaacgggcttgtccccggagatcgtccactttaacctgtaccctcagcccggcaggcgcgatgtagaggttaagccggcagaccggcataacctgcttagacctgagacggtggagagtctgttttacctgtatagagtgactggagataggaagtaccaagattggggctgggagatcctgcagtctttcagcagattcacacgggtaccctctgggggatatagttctatcaacaacgttcaggatcctcagaagcccgaaccccgagacaaaatggaaagctttttcctaggggagactctcaagtacctgtttctcctctttagtgatgacccaaacttgctaagcctcgacgcctacgtttttaatactgaggctcacccgctccctatatggactcctgcctag

SEQ ID NO: 194133 - DNA, 1209 bp, Artificial Sequence
  Description of Artificial Sequence: Synthetic coding sequence
atgtggatcctgggcctgcggaaggagttcgaggaggcccggaagtgggtgtcgaaaaagcttcatttcgagaaggatgtagacgtcaatctgtttgagtctactatccggatcctgggtggcctgctgtccgcctaccatctcagcggagattccctctttctcaggaaagccgaggattttggcaatcgcctgatgcccgcctttagaacccccagcaaaatcccatacagcgatgttaacattggaactggcgttgcacatcccccccgctggacttccgactcaacggtggccgaggttacaagcatacaacttgaattccgggaattatcccgcctcactggcgataaaaagttccaggaagcggttgaaaaagttacccagcacatccacggcctctccggaaagaaggatggacttgtaccgatgttcattaacactcattctgggctgtttacccatttaggcgtgttcacccttggcgcaagggctgattcgtattatgagtatttgctgaagcaatggattcagggcgggaagcaagaaactcagctgctggaagactatgtcgaggctattgagggggtacggacccacctgttgaggcattccgagccaagtaaattgaccttcgtgggggagctggctcacggcaggttctctgcgaaaatggatcacctggtgtgtttccttccaggaacccttgctttaggcgtgtaccatgggctgcccgcctcacacatggagttagctcaggagctcatggaaacctgttaccagatgaatcgtcagatggaaacgggattgagtccagagatcgtacactttaacttatatccgcagccaggccgcagagatgtggaggtgaaaccagctgatcgtcataacctcttaagacccgagaccgtggagtctttgttctatctgtacagggtgacaggcgaccgaaaataccaagactggggttgggagatcctgcagtccttcagcagatttacacgcgtgccatcagggggctactctagcatcaacaacgttcaggacccccagaagcccgaaccaagggataaaatggagagcttcttcttgggggagacgcttaagtacctttttcttctcttcagtgatgaccccaacctgttgagtctggatgcttatgtattcaatactgaggctcaccctctccccatatggacacctgcctag

SEQ ID NO: 194134 - DNA, 2118 bp, Artificial Sequence
  Description of Artificial Sequence: Synthetic coding sequence
tgaccctgggccgtggccaccaccgtggtgatgtaccccccccccccgcctccaccccatcgcgatttcatctctgtgaccttatcatttggagaaaattatgataactcaaagtcttggcggagacgcagttgttggcgcaaatggaagcagctgagtcggctgcagaggaatatgatcctattccttctggccttccttctgttctgtggtttactcttctacatcaacttggccgatcattggaaagctttggccttcaggctcgaggaggagcagaaaatgagacccgagatcgcgggactgaagcctgccaatccaccggtgctgcccgccccccaaaaggccgacacagatcccgagaacctaccggagatctcatctcagaaaacacagcgccatatacagaggggaccaccccacctacagatacgcccgccttcacaagacctgaaagacggcacacaagaagaggcgaccaagcggcaggaggctcctgttgatccccgacccgagggggacccccaacgcacagttattagctggaggggggcagtgatagaaccagaacaagggacagagctgcctagcaggcgcgccgaggttcccaccaaacctcccctccctccagcaagaacacagggaaccccagtgcaccttaattacagacagaagggcgtgattgacgtgtttctgcacgcatggaaaggttacagaaaattcgcatgggggcatgatgagctcaaacctgttagtaggagcttttccgagtggtttggcctcggcctgacattgatcgacgctctcgacacaatgtggattctgggactgcggaaggaattcgaagaagcccgcaagtgggtcagcaagaaacttcattttgagaaggacgttgatgtgaacttattcgagagcaccatacggatcctaggcggactccttagtgcttaccatctgagcggggactctctctttctgagaaaggctgaggatttcgggaaccgcctgatgccagcgtttagaaccccctccaagatcccatatagtgatgtgaacataggaactggcgtagcacatccaccacggtggacatcagactccaccgtggctgaggtcactagcatccagttggaatttcgggagctgagccggctgactggagacaagaaatttcaggaagcagtcgaaaaggtgacccagcatatacatgggctgtcaggaaaaaaggacggcctggtgccgatgttcattaatacccattccggcctattcacgcacctgggggtctttaccttaggcgcccgtgcagactcctactacgagtacctgcttaagcagtggatacagggaggtaagcaagaaactcagttgctcgaggactatgtggaggctatcgaaggagttcgcacccatcttctacgtcactccgagccatctaagctgacctttgtaggcgaactcgctcatggaaggttctcggcaaagatggaccacttggtgtgcttcctgcccggcactctcgcgctgggggtttatcacggtctgccggcatcccatatggagctggcccaggagctgatggaaacatgttaccagatgaacaggcagatggagacaggactgtccccagaaattgttcattttaatctataccctcagcccggaagacgagacgtggaggtgaaaccggcagatcgccacaatttattaaggcccgaaacagtagaatccctgttctatctgtacagggttactggtgaccggaagtaccaggattggggctgggaaatcctgcaaagcttctcccgatttaccagggtcagcacgtgccctaggccagcttggtcgcgcccacccggccatcggcacggctgggcagttgggctcagactggctcccttattagttgttgctgtcacttggattcgcgagggacgagcctgcagatccttgggcgtcgccacactacagttggggggtcccggaattcctatcccaaccgaactgcacggctgtggtactcaatccacatggcgtgggtgggcaccactcattttcatctcccaggggctgagcagagaagggctgtgctgcgggccaagtatccccccagtctag

SEQ ID NO: 194135 - DNA, 3435 bp, Artificial Sequence
  Description of Artificial Sequence: Synthetic coding sequence
atgaagctgagccggcagttcaccgtgttcggcagcgccatcttctgcgtggtaatcttctccttatatttgatgctggataggggtcacctggactacccacggaacccccggagagagggttcatttccccagggacagttaagtatgttacaggagaaaatcgatcacctggagcgcctccttgcggagaataatgaaatcatctcgaatatccgcgacagtgttattaacctttctgaatctgtggaagacggccccaagtccagccagtctaacttctctcagggcgctgggtctcacttgctgccttcgcagctatccctgagcgtagacactgccgattgcttgttcgcgagccagtccggcagccataactctgacgtgcagatgctggacgtctattccttaataagttttgataacccagatgggggcgtctggaagcagggatttgatatcacttatgaatctaatgaatgggatacagagccgctgcaggtatttgtcgtgccccattctcacaacgaccccggttggctgaaaacatttaatgattactttcgcgacaaaacccagtacatattcaataacatggtgctcaaactcaaagaggacagtaggcgtaaattcatctggtctgagatctcctatctgagcaaatggtgggatattatcgacatccagaagaaggatgcagtgaagagccttattgaaaatggccagcttgaaattgtcacaggcggttgggtaatgccggacgaggccacccctcattatttcgccctcatagaccaactaattgagggccaccagtggctcgagaataacataggggtgaagccccgttcaggatgggccattgatccattcggtcattctcccaccatggcctacctactcaacagggcaggtctgtcgcatatgctgatacaacgagtgcactacgcagtcaaaaagcattttgctctccacaagaccctcgagtttttttggcgccagaattgggatttaggttcagtgacggatatcttatgccatatgatgcctttctattcgtatgacattcctcatacctgtgggcctgacccaaagatctgttgtcagtttgatttcaagagactccccggcggacgattcgggtgcccttggggagtgcccccagaaacaatccaccccgggaacgtgcagtctagagcgaggatgttattggatcagtataggaaaaaatctaagctgtttcggacgaaagtgttactggcaccactgggcgacgatttcaggtactgtgagtatacagagtgggatctgcagttcaaaaattatcagcaactcttcgattatatgaactcccagagcaaattcaaggtcaagattcagtttggaacgctgagtgacttcttcgacgcacttgacaaggccgacgaaacccagcgcgataaaggacaatcaatgttccccgtcctgtcaggtgactttttcacttatgccgatcgcgatgatcattattggagtggatactttacttctagacctttttacaagcggatggatcgaataatggaaagtcatctgagggccgcggaaattttatactacttcgccctgcgacaagcccacaaatataaaattaacaagtttctcagttccagcctgtacacggctctgaccgaggccaggagaaacttggggctgttccaacatcatgacgcaataacagggactgctaaggactgggtggtcgttgactatgggacaaggctctttcacagcctgatggtgctggaaaagatcatcggcaattcagcgtttctcctgatcctgaaggacaaattgacctacgattcctactcgcccgacaccttcctggagatggacctcaaacagaaatctcaggatagcctccctcagaagaacatcatacgcctgtccgccgaacccagatatctcgtcgtgtataatcccctcgaacaggatcggatctccctggtgtcagtttatgtgtctagcccaactgttcaagtcttcagtgctagcggaaagccagtagaggtgcaggtttccgcagtctgggataccgccaacaccatctcagagacagcatatgaaatctccttccgcgctcatataccgccactaggcctcaaggtgtacaaaatactagagtcagctagctccaatagtcacctcgcagattatgtactgtacaagaataaggtggaagacagtggcattttcactatcaaaaacatgatcaatactgaggagggtatcacattggagaactcgttcgtcctcctccgcttcgaccagacaggtttaatgaagcaaatgatgaccaaagaggatggtaagcaccatgaagtgaatgtgcagttcagttggtatgggacaactatcaaacgggataaatccggcgcttaccttttcctgcctgatggcaatgctaaaccatacgtgtatacaacccccccttttgtgagagtgacccatggtagaatttactcagaggttacttgtttctttgaccacgtaacacaccgggtccgtctgtatcacattcagggcatcgagggccagagcgtggaggtgagcaatatagtggacattaggaaggtgtataatcgggagattgccatgaagatttccagcgatatcaagtctcagaaccggttctacacagatctgaacggataccaaatacagcctcgaatgacgctgtcgaaactgcccctgcaggccaatgtgtaccccatgaccaccatggcatatatccaagatgcaaagcatcggctaaccctgcttagcgcgcaaagcctcggggtgtcatcactgaacagcggccagattgaagttatcatggatcggaggctaatgcaagacgataaccggggactcgagcagggaattcaggacaataaaatcactgccaacctgttcagaatcctgctggaaaagaggtcagccgtgaacaccgaagaagaaaagaagagcgtgagctatccttctctgctgtcccacatcaccagtagtctgatgaatcatcccgtaattcccatggccaataagttctcttctcctaccctagaattgcaaggcgagttttcgccgctgcagagttcgctaccctgtgacatccatttggtgaacctgcggactatccagagtaaggtcggcaatggccactcaaacgaggctgcactgattctgcacagaaaaggattcgattgtcggttttcctccaaaggcaccggcctgttttgctccaccacacaaggaaagatactagtgcagaagttgcttaataaatttatcgtggagagcctgacccccagctcgttgagccttatgcattctccaccaggaacccagaacatttccgagatcaatctgagtcccatggagatttccacgtttaggatccagctgcggtag

SEQ ID NO: 194136 - DNA, 3453 bp, Artificial Sequence
  Description of Artificial Sequence: Synthetic coding sequence
atgaagctgaagaagcaggtgaccgtgtgcggcgccgccatcttctgtgtggccgttttcagtctatacctgatgctggaccgggtccagcacgatccaaccagacaccagaatggtggcaacttccctcggtcccaaatttcagtgttgcagaatcggattgagcagctagagcaactcctggaggaaaaccacgagattatttctcacattaaggattctgtgcttgaactcacagctaacgccgagggccccccagccatgctaccttattatacggttaatgggtcttgggtggtaccacccgagccccgtccctcatttttcagtatctccccccaagattgtcaattcgccttgggtggacggggtcaaaagcctgagctgcagatgctcaccgtttccgaggagctgccttttgacaacgtagacgggggcgtgtggagacaggggttcgacatctcttatgaccctcacgattgggacgctgaggatctccaagtcttcgttgtccctcattctcacaatgatccagggtggataaaaaccttcgataagtactatactgagcagactcagcatatacttaatagcatggtctctaaactgcaagaagacccacgccgtcgttttctctgggccgaagttagtttcttcgccaaatggtgggacaacattaacgttcagaagagagccgctgtgcgcaggctggtggggaacgggcagctcgagatcgcaactggcggctgggtaatgccagatgaagcgaattcacattattttgctctgattgaccaattgatcgaggggcaccagtggctagaaagaaatcttggggccacccctcgtagcggctgggctgtcgatccctttggctattcctctactatgccttatctacttcgcagagctaatctaacatcgatgctcatccagcgagtccactacgcaattaaaaaacacttcgcagcaactcactcactggaatttatgtggaggcagacgtgggactctgactcctctaccgacattttctgtcatatgatgcccttctactcatacgatgtgccacatacttgtggacctgaccccaagatatgctgtcagtttgacttcaaaagacttcccggaggtcggattaactgcccgtggaaggtacctccgcgtgcaatcacggaagccaatgtggccgagcgggctgcccttctgcttgatcagtatagaaaaaaaagccagttattcaggtccaacgtgctgctggtccccctgggagatgactttagatacgacaaaccgcaggagtgggatgcccagttcttcaattaccagagactatttgatttctttaattcaagaccaaacctccatgtccaggcccagttcggcacactgtcagactatttcgatgcactgtacaaacgaacgggagtcgaaccaggtgctcgcccacccggtttccccgttctgtccggcgactttttcagttatgcggaccgggaagaccactactggactggctactacactagccggcctttctacaaatcgctggacagggtgttggaggcccacctgcgcggcgccgaggtcctgtatagcttggccgccgctcatgctcgccgctccggcctggccggccgctatccattatctgatttcaccctgctaactgaagctcgtcggacacttggattgttccaacaccatgacgctatcacggggactgcgaaggaagcggtggtcgttgattacggggtgaggttgcttcggagtctggttaacctgaagcaggtaattattcacgccgcacactatctggtacttggagacaaagaaacataccatttcgacccagaagcaccattccttcaggtggacgatacccgcttgagccacgatgctctgcctgagagaactgttatccagttggatagctccccgcgattcgttgtgctgttcaacccactggagcaggagcgattctccatggtttccctgctcgttaactcgccccgtgttcgggtcctgagtgaagagggccaacccttggcagtgcagatttctgcccattggtctagcgcgacagaggcagtcccggatgtataccaggtatcagtgccagtgagacttccagccctcgggttgggcgtgctgcaactgcagctgggtctagacggacacaggacactcccgagctcggtgcgcatctatctgcatggcagacaactctccgtcagccggcacgaagctttcccgttgagagtcatcgactcaggcacgtctgattttgctctctcaaaccggtatatgcaagtgtggttcagcggtctgaccggactgctcaaatccataagaagggtggatgaggagcatgaacagcaggtggatatgcaggtgctggtatacgggacccggacgtctaaagacaaatctggagcttacctgtttctgcctgacggcgaagccaaaccctatgttcctaaggaaccccccgtactgagagtgactgagggaccctttttcagtgaagtggtggcctactatgaacatattcaccaagccgtgcggctatataatctccccggtgtagagggactatccctggacatctcttcattggtcgacatacgcgattacgtgaataaggaactggccctgcacatccatacggatattgattcacagggcatttttttcacggatttgaatggcttccaggttcagcccagacgatatctgaagaagctccccctgcaagcaaacttctaccccatgcccgttatggcctacattcaggacgctcagaagcgcctgacactgcacacggctcaggctctcggagtgtcttctctgaaggatgggcagctcgaggtcattctcgatcgtcggctgatgcaggatgataataggggtctgggccaagggctgaaagacaataaaagaacatgtaatcgctttcgcctccttcttgaaaggcgaacagtggggagtgaggtgcaagatagccactctacctcatatcctagtctgctttctcacctgaccagtatgtatctcaatgcgccggctctagccctgcccgtggctagaatgcagctccccggacctggcctgcgcagctttcacccattggcctcttcactaccatgtgacttccacctgttgaatctaagaactctccaggctgaagaagataccctcccgtccgccgagacagctttgattctacacagaaaagggttcgattgcggcttggaggctaagaatctgggtttcaactgtaccacttcccagggaaaggtcgcccttggatcgctgtttcacggactggatgtggtcttcctgcagcccacctccctgaccctcctctatcctctggcctccccatccaactccaccgacgtgtatctcgaacctatggagatcgccacatttcgcctgagacttggctag

SEQ ID NO: 194137 - DNA, 1023 bp, Artificial Sequence
  Description of Artificial Sequence: Synthetic coding sequence
atgcaggtgtggttcagcggcctgaccggcctgctgaagccctacgtacctaaggaacctcctgttttgcgcgtgaccgagggcccctttttttctgaagttgtcgcttactatgaacatattcaccaagctgtgagactgtacaatctgcccggtgtcgagggcctgtctctggacatttccagtctggtggacataagagactacgtgaataaagaacttgctctgcacatacacaccgacattgattcacagggcatttttttcaccgatcttaacggtttccaggtgcagccccgacggtatctgaagaagctaccactgcaggccaatttctacccaatgcccgtcatggcctatattcaagacgctcagaaaaggttgactcttcataccgcccaggcactgggcgtgtccagcttgaaagacggccagctggaagtgatcctcgataggagattaatgcaggacgacaaccgcgggctggggcaggggttgaaggataataagaggacctgtaatagattccgcttgttgctggagcggcgcaccgtaggtagcgaggtacaggattctcactcaacgtcctatcctagcctgctctcacacctcacctccatgtatttgaatgccccggctctagcgctaccggtggccaggatgcagttgcctggaccagggttgcgctccttccacccattggcaagtagcctgccgtgtgactttcatttactcaatctgaggacactgcaggctgaggaggacacactgccctctgcagagacagctttgattctccacagaaagggtttcgattgtgggctcgaggctaagaacctcggttttaactgcacaacctcgcaggggaaagttgctttgggcagcctgttccacggcctcgatgttgtgttcctccagcctacttcattgaccttgctctaccctctcgcttctccttctaattcaacagatgtatatttagagcctatggaaatcgctacctttcgccttcggctgggttag

SEQ ID NO: 194138 - DNA, 1977 bp, Artificial Sequence
  Description of Artificial Sequence: Synthetic coding sequence
atgaccagcgacatgaccagcccccggagcggcatgcccagcagctcaaccactaacggctcactgacatcctctaccgctgggcttacgagcatgtgccgtggggccgaagtgctttacagcctggcagccgcccacgccaggagatcagggttggccggaaggtatcctctttccgattttacactcttgacagaagcccgccggactcttggtctcttccagcaccatgacgcaattaccggcaccgccaaagaggcagttgtggtggactacggtgtgcgactattaagatcactcgtcaacctgaaacaagtaataatccatgctgcccactatctagttctgggggataaggagacataccatttcgacccggaagctcctttcctgcaggtggatgacacgcgactttctcacgacgctctgcccgaacgtactgtgatccagctggattcctctccgcgatttgtcgtgttgtttaatccacttgaacaggaacggttcagtatggtttctctgttggtgaactctcccagagtgcgcgtcctgtcggaggaggggcagccacttgccgtgcagatcagtgcacactggagtagtgccaccgaagccgtacccgacgtctaccaggtgtccgttccggtcagacttccggccttagggttgggtgtgctccagctccaactgggcctagatgggcaccggactttgcccagcagtgtacggatctatctgcatggaaggcagttatctgtgtcccggcacgaggccttccccctgcgcgtgattgacagcggcacctctgactttgccctgagcaaccgctacatgcaagtctggttctctgggttgaccggcctgctcaagagcattcgtcgcgtggacgaggagcacgagcaacaggtggacatgcaggtgctggtgtacggcactcgaacgagtaaagacaagagcggcgcatatctgttcttgcccgatggagaagctaagccttacgtgcccaaagagcctcccgtcctgcgcgtgacagaaggtccgttcttctctgaggtggttgcatactacgagcatatccaccaggctgtcaggctctacaacttgcccggagtggaggggcttagccttgatatcagttccctcgtcgacattcgggattatgtgaacaaggagctggcacttcatatccacacagacatcgactcccaggggattttcttcacggacctgaatggcttccaggtgcagccacgcaggtaccttaagaaactgcctctgcaagcaaacttttatcccatgccagtaatggcctacatccaggatgcccagaagagactgaccttacacacagctcaggccctcggggtctccagtttaaaagacggacagcttgaggtcatcctggaccgccgactaatgcaggatgataacaggggactgggccaaggattaaaggacaacaaaagaacttgtaaccgtttcaggcttctcctagagcgcagaaccgttggttcggaagtgcaggattcacattccacctcgtatccctccctgctgtctcaccttacctcaatgtacctgaacgccccagcattggcacttcccgtagcccgcatgcagctacccgggccaggacttaggagcttccacccgcttgccagttcgctcccctgtgatttccatctcttgaatcttaggaccttacaggcagaggaggatactctgcccagcgccgagacggctctgattctgcaccgcaaggggtttgattgcggacttgaggctaagaatctcggatttaactgtaccacctctcagggcaaggtggcgctaggatccctgttccacgggctggacgtggtcttcttgcagcccacctccttaacactcttgtaccctctggcttccccatcaaatagcaccgacgtctatctggaaccaatggaaattgcaacattcagactgagactggggtag

SEQ ID NO: 194139 - DNA, 219 bp, Artificial Sequence
  Description of Artificial Sequence: Synthetic coding sequence
atgaagctgaagaagcaggtgaccgtgtgcggcgccgccatcttctgcgtggcagtttttagcctgtatctaatgcttgaccgtgtgcagcatgaccccacgcgacaccagaacggtggtaatttcccacggagtcagatctccgttttacaaaacagaattgagcaactggaacagcttctggaagaaaaccacgaaattatctcgcatataaaatag

SEQ ID NO: 194140 - DNA, 153 bp, Artificial Sequence
  Description of Artificial Sequence: Synthetic coding sequence
atgaagctgaagaagcaggtgaccgtgtgcggcgccgccatcttctgtgtggcagtgttttcgctgtatttgatgcttgaccgggtgcagcatgatcccactaggcatcaaaatggtggcaattttccgcgttcccagatcagcgtgctttag

SEQ ID NO: 194141 - DNA, 3192 bp, Artificial Sequence
  Description of Artificial Sequence: Synthetic coding sequence
atgctgccctactacaccgtgaacggcagctgggtggtgccccccgaaccgcggccctctttcttttctataagccctcaggactgccagtttgccctgggcggccggggtcagaaacctgaactgcagatgctcaccgtctcagaggagttgccctttgataacgttgacggcggcgtctggaggcagggcttcgatatctcctacgatccgcatgactgggacgccgaggacttgcaggtttttgttgtgccccacagccacaatgatcccggttggatcaagacctttgacaagtactacaccgaacaaacacagcacattttgaacagcatggtcagcaagctgcaggaagatcccagacgtcgcttcctctgggctgaggtatctttctttgccaaatggtgggacaatatcaatgtacagaagcgggctgccgtgcgccggttagttggcaacggacaattggaaattgcaactggtggctgggtgatgcctgacgaagctaactcccattacttcgccctgatagaccaactgatcgaggggcatcagtggttggaacggaacttgggcgccacgccacgttctggttgggcggtcgacccctttggctatagtagcacaatgccttacttactccgccgagcgaatctcacctctatgcttatccaaagggtccattacgcaatcaagaagcacttcgctgctacccatagtttggaatttatgtggcgccaaacatgggacagcgatagtagtactgacatcttctgtcacatgatgccgttctactcttatgatgtcccccacacatgcggtcctgatcccaagatctgttgccagttcgactttaagcggctgcctggaggacgcatcaactgcccatggaaggtaccgcctcgtgccataactgaggccaatgtggctgaaagagcagccctgttactagaccagtaccggaaaaagtcccagctgttccggtccaatgtgcttctggtgcccctcggcgatgactttagatacgacaagccacaggagtgggacgcacagttcttcaattaccagcgcctattcgacttctttaatagtcgcccaaacctccatgtgcaggcccagtttgggaccctgagcgactactttgacgccttgtacaaacggacaggggtagaacccggagcccggccgccaggatttccagtactgtccggcgatttcttcagctacgcagaccgggaagaccattactggacaggttactacacgtcacgaccattctacaagtcgctggaccgcgttctggaggcccatttaagaggagccgaggtgctctactctctggccgccgctcacgcacgccgctcgggattggccgggcgataccctctgtccgatttcaccctgctgaccgaagcccgtcgcactttaggactgttccagcatcacgatgccatcaccggaaccgccaaggaagcggtcgttgtggactacggcgtgcgcctgctgaggtccctggtcaacctcaaacaggtcatcatccacgccgcgcattacctcgtactgggggacaaggagacataccatttcgaccctgaggcgccatttctgcaagtcgatgacacccggttatcccacgacgcgctgcccgaaagaaccgtgatccagttagacagttcccctcgattcgttgtgttgttcaacccactggaacaggaacggttctccatggttagtctgctggtcaacagccccagagtgagggtcctcagcgaagaggggcagccgctggctgtgcagatttccgcccactggtcatccgctacagaggccgttccagatgtttaccaagtttctgtaccagtacggcttcccgcactggggctgggcgtgctgcagctgcagttaggacttgatggacatcggaccctgccctcgtcggttagaatctatctgcatggccggcagctgagcgtgtcaaggcacgaagcgtttcctttacgggtgatcgattctggcactagtgatttcgccctgagcaacaggtacatgcaagtatggttctccggccttaccggactgctgaagtcgatcaggcgcgtggacgaagaacacgaacagcaggtggatatgcaggtgctcgtatacggcaccaggacctctaaggataagtctggagcatacttatttcttccagatggagaggcaaagccatatgtgcccaaggagccacccgtcctgagagtaaccgaggggcccttttttagcgaagttgtcgcttattatgaacacatacatcaagccgttcgactgtataacttgccgggcgtagagggtctttcgctagacatatcttccctggtggacatcagagattacgtcaacaaagagttagcacttcatattcacacggatatcgacagccagggcatcttttttaccgacctgaacggttttcaggtacagcctcgaaggtatctgaagaagctaccactgcaggcaaacttttaccctatgcccgtgatggcatacatccaagatgcccaaaaacgtctcaccctccataccgcccaggcgctgggcgtctcatccctaaaagatggccaactcgaggtgatcctggaccggcgcctgatgcaggatgataacagggggctgggccaaggcttgaaggacaataaacggacatgtaacaggttccggctgttgcttgagcggcggaccgtcgggtccgaggtgcaggattcccactctacctcctatccaagtcttttatcacatctgacttccatgtacctgaacgccccagcactcgctctgccggtggcccggatgcagctgcccgggcctggcctgcgctctttccatcctttggcatcttcactgccgtgtgacttccacttgcttaaccttcgcacattgcaggctgaggaagatactcttccctctgcagaaacagctcttattctgcacagaaaaggatttgactgcgggctggaggcgaaaaacctagggttcaattgtactacatcacagggtaaagtcgcccttggctccttatttcatggactggatgtcgtgtttcttcagccgactagcttgactttactctacccactcgctagtccttcaaattctacagacgtatatttagagcccatggagatagccactttcaggctgaggcttgggtag

SEQ ID NO: 194142 - DNA, 231 bp, Artificial Sequence
  Description of Artificial Sequence: Synthetic coding sequence
atgaagctgaagaagcaggtgaccgtgtgcggcgccgccatcttctgcgttgctgtctttagcctctatctcatgctggatagggttcagcacgaccctacgagacaccagaacggtggaaactttccacgctcgcaaatcagcgtgctccagaatagaattgaacagctggagcagctgctggaggaaaatcacgaaattattagccatatcaaagacagcgtcctttag

SEQ ID NO: 194143 - DNA, 363 bp, Artificial Sequence
  Description of Artificial Sequence: Synthetic coding sequence
atgaagctgaagaagcaggtgaccgtgtgcggcgccgccatcttctgtgtggccgtgtttagtttatatcttatgctggacagagtgcagcacgaccccacccgtcatcaaaacgggggcaatttcccccggagccagataagcgtgctccagaacaggattgagcagttggaacaattactggaggagaaccatgagataattagtcacatcaaagacagcgtcctggaactcaccgctaacgcagagggccccccagctatgctgccttattatacagttaacggaagctgggtagtgccgcctgaacctagaccttcctttttcagcatatccccacaggactgtcagttcgctctatag

SEQ ID NO: 194144 - DNA, 3123 bp, Artificial Sequence
  Description of Artificial Sequence: Synthetic coding sequence
atggccgccgcccccgccctgaagcactggcggaccaccctggagagagtggagaagttcgtttctccactctactttactgactgcaacctcagaggaaggctgtttggcgcttcctgcccagtggccgtccttagttcattcctcaccccagagcggctcccttaccaggaggccgtacagcgagactttcgacccgcacaggtgggtgacagcttcggacctacttggtggacctgctggtttagggtggaactaaccattcctgaggcctgggtagggcaggaggttcacctgtgttgggagtcggacggggaggggctggtttggagggatggagagccagtgcagggcttaacgaaggaaggtgaaaaaaccagctacgttctgaccgaccgactgggggagagggatccgagatcccttaccctatacgtcgaggtggcttgcaatgggcttcttggcgctgggaaaggctccatgatcgcagcacccgatcccgagaagatgttccagctatctcgcgctgagctggccgtgtttcacagagacgtgcacatgttactagtagatctggaactgctccttggaattgccaaaggattgggtaaggataatcagagaagcttccaggctctgtataccgcaaaccagatggtcaatgtctgcgaccctgcgcagccagaaaccttcccggtagctcaggctctggcctccagatttttcgggcaacatggtggggagtcccagcataccatacatgcaactggtcactgccacatcgacacggcctggctgtggccctttaaagagaccgtgcgcaaatgtgccagatcgtgggtgaccgcactccagttaatggagcgaaatcctgaattcattttcgcctgttctcaggcccagcaattggagtgggtgaagtctaggtaccccggtctctattctagaatccaggaatttgcttgcagaggtcagtttgtacccgtcggaggtacctgggtggaaatggacggaaacctgccttcaggcgaggcaatggtccgacagtttcttcagggacaaaattttttcctgcaggagttcggcaagatgtgctccgaattctggttgcccgacacttttggatactccgctcagcttccacagatcatgcacggttgcggaattcggaggttcctgactcagaaactgtcttggaacctggtgaactcctttcctcaccacacgttcttttgggaaggactcgacgggtcaagggtgctcgtccacttccccccaggtgatagttacggcatgcagggaagcgtggaggaggtattgaagacagtggccaacaatcgggacaaaggtagggccaaccacagcgcgttcttgttcggattcggcgacggaggaggaggccccacccagactatgctggataggctgaagcgactgtcaaacaccgatgggctgccccgagttcagttgtcatcccctcgccagctttttagcgctctggagtcagattccgaacagctatgcacctgggtgggcgagctgttccttgaactccacaacggcacctacaccacccatgctcaaatcaagaaagggaatcgggagtgtgagcgaatcctgcacgacgtggagctcttaagcagcttggccctggcacgatcagcccagtttctgtatcccgctgctcagctccagcatttgtggcgcctccttctgttgaatcaattccacgacgtagttacaggatcctgcatccagatggtggcagaagaagccatgtgtcattacgaggacatcagatcacacggaaacactctactgtcagcagccgcagccgccctgtgtgcgggagaacccggcccagagggcttgctgattgtcaataccctgccttggaagcggatcgaggtcatggctttacccaagcccggcggagctcacagcctagcattagtgaccgtccctagcatgggctatgcacccgttccgcctccaacctccttgcaaccgctgctgccccaacagcctgtgtttgtggttcaggagactgacggaagcgtgactctggacaacggcataatcagagtgaagctggatccaacgggcagactgacatccctggtcttagtcgcaagcggcagagaggccattgccgagggcgctgtcggaaaccaatttgtgctgttcgacgatgtgccattgtattgggacgcttgggacgtgatggactatcatcttgagacgcggaaaccggttctcggccaggctggcacgctggctgttggcacagaggggggtctccggggatcagcatggtttttactccagatcagtcctaatagtcggctttcccaggaggtggttttggacgtcggatgcccctatgtgcgattccacaccgaggttcattggcacgaagcacacaagtttctgaaagttgagtttcccgccagggtcaggagttcgcaggccacttatgagatacagtttggacacctccaacgccctactcactacaacaccagctgggactgggcacggtttgaagtctgggcacaccggtggatggacctttccgagcatggtttcgggctggccctgctgaacgattgtaaatacggtgcatcagtccgtgggtcaatcctgtcactgtcattacttcgggccccaaaggcgcctgacgcaacagccgataccggacgccacgagtttacttatgccctcatgcctcacaaaggtagtttccaggacgctggggtaattcaggccgcgtactctctcaatttccctctccttgctctgccagctccaagccccgcaccagcaacctcctggtctgcattcagcgtgtcgtcccctgctgtggtgctggagacagtcaagcaggctgaatcttcgccgcagaggaggagtcttgttttgagactgtacgaggcacatggttcacacgttgattgttggttgcacttgtccctgcctgtgcaggaagccatcctgtgtgacttgctcgaacggccagatcccgccgggcacctcacactgagagataatcggcttaaacttaccttcagcccctttcaggttctgagccttctacttgtactgcagccgcctccacactag

SEQ ID NO: 194145 - DNA, 630 bp, Artificial Sequence
  Description of Artificial Sequence: Synthetic coding sequence
atggccgccgcccccgccctgaagcactggcggaccaccctggagcgggttgagaagtttgtcagccccctatacttcacagattgtaacctgcggggtcggttgttcggggcctcgtgccctgtagcagtcttgtcctcatttctcacgcccgagcggcttccctaccaggaggccgtgcaacgagacttccgccctgcgcaagtcggggactcctttggccctacttggtggacatgttggtttcgcgtcgaactgactattcctgaagcttgggtaggccaagaagtgcacctatgttgggaaagcgatggcgaaggcctggtgtggagagacggcgagcctgtccagggcttgacaaaggaaggtgagaagacgtcctacgttcttactgatcggctcggggagagagatccgcgatcgttgactctctatgtagaagttgcgtgtaatgggctcctgggagcagggaaggggagcatgattgccgcccctgatccagagaagatgtttcagctcagtcgagccgaactggctgtatttcaccgagatgtgcacatgcttctggtggacctggagctgctcctcggcatagctaaacccggctttgggccatccaagagactgtag

SEQ ID NO: 194146 - DNA, 2910 bp, Artificial Sequence
  Description of Artificial Sequence: Synthetic coding sequence
atggccgaggacgacccctacctgggccggcccgagcagatgttccacttagaccccagcctgacccataccatatttaaccctgaggtgtttcaacctcagatggcactgcctacagcagatggaccttatttgcagattctggagcagccaaagcagaggggtttcaggttccgctacgtctgtgagggcccaagccacggagggttgccaggagcttccagcgagaagaacaagaaaagctacccacaggttaagatctgcaattacgtggggcccgcaaaggtgattgtgcagctggtgacaaacgggaagaatatccacttgcatgcccattctttagtgggaaagcattgcgaagatggaatttgcactgttacagcaggccccaaggacatggtcgtgggcttcgccaacctcggaattctgcacgtgactaagaaaaaggtttttgaaacactcgaagcacgcatgacggaggcatgcattcggggctataatcccggcctgcttgttcacccggatctggcctacctgcaagctgagggaggaggtgaccggcagctgggtgaccgcgaaaaagaattgattcgccaggccgcgcttcagcagaccaaagaaatggacctctccgtcgtgagactgatgttcaccgccttcttacccgacagcactggaagtttcactcgccgactggagcctgttgtatctgacgctatctacgatagtaaggccccgaacgcctccaatcttaaaatcgtcagaatggatcgcacggcagggtgcgtcactggaggcgaggagatatacctcttgtgtgacaaggttcagaaggacgatatccagatccgtttctacgaggaggaggagaacggtggcgtctgggagggattcggcgattttagtcctacggatgtgcaccggcagttcgcgatcgtgtttaaaacacccaagtacaaagatatcaatataactaaacccgcaagcgtgttcgtgcagctgaggagaaagagtgatctggaaacttccgagcccaagccatttctgtattaccccgaaatcaaggataaggaggaggtgcaaaggaagcgccaaaaactgatgccaaactttagcgactcctttgggggcggctctggcgccggagctggcgggggcggcatgtttggctcgggggggggcggcggcgggactggttccaccggccccggctacagcttcccccattatgggttcccaacttacggcggcattacatttcatccaggcactacgaaatccaatgccggaatgaagcatggaacaatggatacagagagcaaaaaggatcccgaaggatgcgataaaagcgatgataagaacacggttaaccttttcggcaaggtgatagagacaaccgagcaggaccaggagccatccgaagctacggtgggcaatggggaagtaaccctaacttatgctacggggactaaagaagagtcagccggcgtccaggataatctgttcctcgaaaaagctatgcagctggccaagcggcacgccaacgccctgttcgattacgctgtgaccggagacgtcaaaatgctcctggcggtgcagcgccatttgaccgcggtgcaagacgagaacggtgactccgtgttacatctcgccattattcacctgcactctcaactggttcgcgatctgctggaggtaactagcgggctgatttctgatgacatcattaatatgcgcaacgatctgtatcaaacacccctccacctggccgtgatcaccaagcaggaagatgtggttgaggacctgctgagggccggggcagatttaagcctacttgatcggttaggaaattctgttctgcatctagcagcaaaggaagggcacgacaaggtgctgtctatcttgcttaaacataagaaagcggccctgctcttagaccaccccaacggcgacggtctgaatgccatccacctggcgatgatgagcaattcccttccctgcctgcttcttctggttgctgcgggggcggatgttaatgcacaagagcagaaatccgggcgtaccgcactgcatctcgctgttgaacatgataatatttcactggcagggtgcctacttttagagggtgatgcacacgtcgactcgaccacatacgatggtacaactcccttgcatatcgcagccggcagggggtcaaccaggctggccgctttactcaaggcagcaggcgccgatcccctcgttgaaaacttcgagcccctctatgacctggacgatagttgggagaatgccggggaagacgagggagtggtccccggcactacccccttggatatggccacctcgtggcaagtttttgacattctgaatggaaagccgtacgagcccgaatttacaagtgacgacctcctggcacagggggatatgaagcagctagctgaagatgtgaaactacagctgtacaagctcctcgaaatccctgatcccgataagaattgggctaccctcgcccagaagctgggcctgggcattctcaataatgcatttagactaagtcctgcacctagtaagaccctgatggataactacgaggtgtccggcggcactgttcgcgagttagtagaagccctgaggcaaatgggttacactgaggccatcgaggtaattcaggcagcctctagccctgttaagaccacctcacaggcccattcgctgcccctgtcaccagcttcaacacggcagcagattgatgaattaagagactcagactccgtatgcgacagtggcgtcgaaacctcgtttcggaaactttccttcaccgagtcacttaccagtggggcctccttgctaacgctgaacaagatgccgcatgactacgggcaagagggcccgttggagggaaaaatttag

SEQ ID NO: 194147 - DNA, 1389 bp, Artificial Sequence
  Description of Artificial Sequence: Synthetic coding sequence
atggccaagttccggcggcggacctgcatcatcctggccctgttcattctgtttatattttccctgatgatgggattaaaaatgctgcggccgaatacggctacctttggcgcacctttcggactagatcttcttcctgaactgcaccagcgtaccatccacctcggcaagaacttcgacttccagaaaagtgataggataaactctgaaaccaacaccaaaaacctcaagtccgtggagatcaccatgaagccttcaaaagcaagcgagttaaacctcgacgagttaccacccttgaacaattacttgcacgtcttttactattcctggtacggtaaccctcagtttgacggcaaatacatccactggaaccatccagtgctggagcactgggatccccgtatcgccaagaattacccccagggacgacacaacccgcccgatgacatcggaagttccttttatccagaactcggctcttatagttcacgcgatccttcggtgattgagactcacatgaggcagatgcgcagtgcctccatcggtgttctcgctctgtcttggtatcctcccgacgttaatgatgagaatggcgagcctaccgacaacctcgtgcctactatcctggacaaggctcacaagtacaatctaaaagtgacgttccatattgagccctattctaacagagatgatcagaacatgtataagaatgtgaagtacatcattgacaagtacggaaaccaccccgctttttatagatataagacgaagactggaaacgcactgcccatgttctacgtttacgacagttacattactaagccggagaagtgggccaatctcctcacaactagcgggtcaaggtccatcagaaactcaccctatgatggactcttcattgctctgctggtggaagaaaaacacaaatatgacattctccagtcgggatttgacggaatttacacctatttcgccaccaacggttttacgtatggttcctcacaccagaactgggcgagtttaaagctgttttgcgacaagtataatcttatctttatcccctctgtgggcccaggctatatcgatacctcaatccggccttggaacacccagaatacaagaaaccggattaacggtaaatactacgaaattggactctctgcggcgctgcagacccgccctagcctgatcagtataacaagtttcaacgagtggcatgagggtacacagatcgaaaaggcggttccaaaaaggaccagcaataccgtttatctcgattacagacctcataaacccggactgtatctggagctaaccaggaagtggtccgagaaatatagcaaggaacgtgccacatacgcactggatcgacagctgcccgtgtcatag

SEQ ID NO: 194148 - DNA, 597 bp, Artificial Sequence
  Description of Artificial Sequence: Synthetic coding sequence
atggccaagttccggcggcggacctgcatcatcctggccctgttcattctcttcatcttctctctgatgatgggtctgaagatgctacgccccaacacagctacattcggcgccccgttcgggttggacctgctccctgagttgcaccaacggacgatacacctaggaaaaaattttgatttccagaaatctgatcgcatcaactctgaaacaaacacgaagaatcttaagagtgtggaaatcacgatgaagcctagcaaggcgtccgagctgaacctggatgaactgcctccactgaacaattacctccatgtgttctactactcctggtatggtaatccccagttcgatggcaagtacattcactggaaccatcctgtgctcgaacactgggatcctcgcattgccaagaactatccccaaggtcggcacaaccctccagatgatattggatcctccttctatcccgaattaggatcatactcaagtcgcgatccttctgtaattgaaacacacatgagacagatgagatccgcatcaattggaaactattgtatttacatctacgtgtgtctgtgcctgtatatctgcatttag

SEQ ID NO: 194149 - DNA, 624 bp, Artificial Sequence
  Description of Artificial Sequence: Synthetic coding sequence
atggccaagttccggcggcggacctgcatcatcctggccctgttcatcctgtttatcttctccttgatgatgggcctaaaaatgctgagaccaaatacagcaacatttggcgcaccattcggactggatttactcccagagctccatcagcggaccattcaccttggcaaaaattttgattttcagaagagcgatcgtatcaacagcgagacgaacacaaaaaaccttaaaagcgttgagatcactatgaaacccagcaaagcttcagaacttaatctggatgagttaccaccactaaacaactaccttcatgtattctactactcctggtacggcaatccacaattcgacggtaagtatattcattggaatcatccagtgctggaacactgggacccccgcatcgccaagaactacccccaaggccgacataatccccccgacgatatagggtctagcttttatcctgagctggggagttactcttcccgcgacccctctgtcatcgaaacccatatgagacagatgcggtctgcatctattgggaattattgcatctatatctgcgtattcgtctcggtgtatatgcatatcaacgatttcctatgcaattttaccagttag

SEQ ID NO: 194150 - DNA, 2379 bp, Artificial Sequence
  Description of Artificial Sequence: Synthetic coding sequence
atgatcaccgtgaaccccgacggcaagatcatggtgcggcggtgcctcgtaacactgagaccgtttagactcttcgttctaggtattggcttctttactctatgcttcctgatgacctcgttaggcggccaattctcagcgcgccgactgggagactcgcctttcaccattcgaacggaggtgatgggcgggcccgagagtagaggagtgctccgcaagatgagcgatctgcttgagctgatggtaaaacgtatggacgccctcgctagactcgagaatagctctgaactccatcgggccggaggcgatcttcattttcctgccgacaggatgccccccggggccggtctcatggaaaggattcaagccatcgcacagaatgtttccgacattgcggtgaaggttgatcaaatattgcgccattctctcctgttacatagcaaggtcagcgagggccgacgggatcagtgcgaagccccctcggatccaaaattccctgactgttccggaaaagtggagtggatgagggcccgatggacttcggacccctgttatgctttctttggagtggacggtaccgaatgctcattcctcatttatctgtccgaggtggagtggttttgccctcctctgccctggcgaaaccagaccgctgcacagcgcgcacccaagcccctgcccaaagtgcaggccgtatttagatccaacctttctcacctcttggacttgatggggtctggtaaagagagcttgattttcatgaagaagaggaccaagcggctgacagcgcagtgggcactggctgcccagaggctggcccaaaagctgggggctacccagagggaccagaagcagatattggtccacataggtttcttgacagaggaatctggggacgtgttctccccaagagtcctaaaaggcggccctctcggcgagatggtgcagtgggctgatatcctgaccgcactctacgtgctgggccatggccttagagttacagtgtccctaaaggagctccagagtaacctgggtgtgcctcccggcaggggaagctgcccactgacaatgcccctgccttttgacttgatctacactgactaccatgggctgcagcagatgaaacggcacatgggattatctttcaagaagtaccggtgcaggattcgcgtgatcgatacgttcggaaccgaacctgcatacaaccatgaggaatacgcaacacttcacggctatcgaaccaattggggatactggaatctcaaccccaagcagtttatgactatgttcccacatacgcctgacaactcatttatgggattcgtgagtgaggaactgaacgagactgaaaagaggctcatcaagggtgggaaagcttccaatatggccgtggtttatggcaaggaagcatccatttggaaactgcagggaaaggaaaaatttctggggatccttaataaatatatggaaattcatggaacagtatactatgagtcacagcggccccctgaagtgccagcatttgtgaagaaccatggcctgctaccccagcctgagtttcagcagctgttacggaaggccaagctcttcatcgggttcggctttccgtatgaaggcccagctcctttagaggctattgctaacggatgcatattcctgcagagcaggttctcaccaccgcactcaagtttgaaccacgagtttttccgggggaaacccacctcacgagaggtattttctcaacacccttatgccgagaactttatagggaagcctcacgtttggacagtggattataataactcagaggaatttgaggccgccatcaaggccatcatgcgtacacaagttgatccttacctcccttatgaatacacctgtgaagggatgcttgagaggatccacgcctacatccaacaccaggatttttgtagggctcccgaccctgctttacccgaggctcacgcccctcaatctccattcgtcctcgcccccaacgcaacacatctggagtgggctaggaacaccagcctcgctcccggagcctggcccccagcccacgctcttcgggcctggctggccgtgccaggtagggcttgcactgacacctgtcttgatcatggtctgatctgtgagccatcttttttcccattccttaacagtcaagacgccttccttaaacttcaggtgccttgcgatagcaccgagtcagagatgaaccatctgtaccctgcgttcgctcagcctggccaggaatgctacctgcagaaggaacctctgctgttcagttgcgccggcagcaacacgaagtatcgcagactatgcccttgtcgggactttcggaagggccaggtagcactgtgccaggggtgtctttag

SEQ ID NO: 194151 - DNA, 1338 bp, Artificial Sequence
  Description of Artificial Sequence: Synthetic coding sequence
atgctgaagaagcagagcgccggcctggtgctgtggggcgccatcctctttgtcgcctggaatgctctactgctgctttttttttggactcggccagcccccggcagacccccatcagttagtgccctcgatggagacccggcaagccttacgcgggaagtaattcggcttgcccaagatgcggaggtggaattggagcgccagagaggcctgctgcagcagatcggggatgccctgagctctcagaggggacgtgtcccgactgcggcgccaccagctcaacccagagtccccgtgactcccgccccagccgtgatccccatccttgtgatcgcttgcgacaggtcaaccgtgcgccggtgcctggataagctgttgcactacagaccctccgccgagctgtttccaataatcgtgtctcaagattgcggccacgaggagacggcacaagccatcgcctcttacggaagtgcagtgacacatatccgccagcccgatctgtcctctatcgccgtgcctcccgatcaccgtaaattccagggctattacaaaatcgctcgccattaccggtgggccctggggcaggtcttccgacagtttcgatttcccgctgctgttgtggtggaggatgatctcgaggtggcccctgatttttttgaatacttccgggctacctacccactgttgaaggccgacccaagcctatggtgtgtttctgcttggaacgacaacggaaaggaacagatggtggacgccagccggcccgaactgttgtatcggaccgactttttccctggcctgggatggctgttgctggcagagttgtgggccgagctggagcctaaatggccaaaagcattctgggacgattggatgcgccggcctgagcagcgccaaggccgagcctgtatcaggccggagatctccagaaccatgacttttggacgcaagggagtctcccatggacagttcttcgatcagcacttaaagttcatcaagttgaatcagcagttcgtgcactttacccagctggacctgtcctacctgcagcgagaggcctacgatagagatttccttgctcgagtctatggcgcgccacaactgcaggtggagaaagttaggactaacgatagaaaagagttaggggaggtgcgcgtgcagtacactggtagagacagtttcaaagccttcgcgaaggctttgggagtcatggacgacctgaagtctggagtgcctcgggcgggttacaggggcattgtaacatttcaatttaggggccgccgagtccacctggccccaccactgacttgggagggatacgatccttcttggaattag

SEQ ID NO: 194152 - DNA, 1338 bp, Artificial Sequence
  Description of Artificial Sequence: Synthetic coding sequence
atgctgaagaagcagagcgccggcctggtgctgtggggcgccatcctcttcgtggcttggaacgctctactgctgctttttttttggacacgaccagccccaggccgtcctccgagcgtctcagcattggacggtgatcctgcgtctcttacacgcgaggtcatcaggctggcccaggacgccgaagtggagctggagaggcagcggggactactccagcagattggagatgctctttcttcccagcggggacgagtccccaccgcagctcctcctgcacagccccgcgtccccgtaacccccgcccctgcagtgattcccatcctggttattgcttgtgacagaagcaccgtgcgcaggtgcttggacaagttgttgcattaccgcccctctgcagagttgttcccaattatcgtatctcaggattgcggccacgaagaaaccgctcaagccatcgcctcctacggaagcgccgttacccatattaggcagcctgatctgagttctatcgccgtcccccctgatcacagaaagttccaggggtattataaaatcgcccgacattaccgctgggcgctcggtcaggtatttcgtcagttcagatttcctgctgccgtagtggtggaggacgacctggaagtggccccagatttctttgagtactttcgcgctacatatcccctgctgaaggcagaccccagcttatggtgtgtgtctgcatggaacgataatggtaaggagcagatggtggacgcctcccgccctgaacttctctatcggactgatttttttcctggccttggctggctattgttggcagagctatgggccgaactcgaacctaaatggcccaaggcattctgggacgactggatgaggagacctgagcaaagacaaggacgagcatgcataaggcctgaaataagcaggacgatgacattcggaagaaagggcgtgtcccatggacagtttttcgatcagcacctcaagttcatcaaactcaaccagcagtttgtccactttacgcagcttgatctctcctatctccagcgggaggcctatgaccgtgactttctggcacgcgtctacggtgccccccaactgcaagtggagaaggtgagaacgaatgacaggaaggaactgggggaagtgagagtccagtacaccggacgtgattcttttaaagccttcgctaaagcccttggtgtcatggacgacctgaaatccggtgtgcctagggcaggttatcgggggatcgtcacgtttcagtttagagggcgccgggtgcatctggcaccacccttgacctgggaggggtacgatcctagctggaattag

SEQ ID NO: 194153 - DNA, 1338 bp, Artificial Sequence
  Description of Artificial Sequence: Synthetic coding sequence
atgctgaagaagcagagcgccggcctggtgctgtggggcgccatcctgttcgtggcatggaatgcactgcttctgttattcttctggacacgccccgctcccggccgaccgccttccgtgtcagcactggacggcgaccccgcatctctgacaagagaagtgatacgactcgcacaagacgccgaggtggagctggagcgacaaaggggcttgcttcagcagatcggggatgccctatcctctcaaaggggacgggtgccaaccgcagccccacccgctcagccacgggtccccgtgacgcctgcccctgccgttatacccatcttggtgatagcctgcgaccggagtacagtacgaagatgtctggacaagttgcttcactaccggccgtctgccgagctgttcccgatcattgtgtcacaagattgcggacacgaggaaaccgcccaggccatagcatcctacggctcagcggtgactcatattcggcagcccgacctaagttccattgcagttccacccgaccatcggaaatttcaaggctattataaaattgctcgccactatcggtgggccttaggccaggtgtttaggcagtttaggttccctgcagccgttgtcgtcgaggatgacctggaggttgcccccgacttttttgagtatttccgagcgacataccccttattaaaggctgacccaagcctctggtgcgtgtccgcctggaacgacaacgggaaagagcagatggttgatgcttccagaccagagctgctttaccgtacagatttcttcccgggactgggctggctgcttctggccgaattgtgggcagagctcgagcctaaatggcctaaggcgttctgggacgattggatgaggcgcccagagcagcggcaaggacgcgcctgtattcgccctgaaattagcagaacgatgaccttcggccggaagggggtgtcacacggccagttttttgatcagcacctaaagttcatcaagttgaatcaacagtttgtccacttcacccaactcgatctcagctacctccagcgcgaggcttatgaccgcgactttcttgcacgagtctacggtgccccacaactccaagtagagaaggttaggactaatgaccggaaggagctgggcgaagtgagagtgcaatatactggcagggacagttttaaggcctttgccaaggctttgggtgtgatggatgatctcaagtctggcgtcccaagagcaggctaccgcggaatcgtgacgtttcaatttcgaggaagacgggtgcacctggcccctcctctcacttgggaaggatacgatccttcttggaactag

SEQ ID NO: 194154 - DNA, 1338 bp, Artificial Sequence
  Description of Artificial Sequence: Synthetic coding sequence
atgctgaagaagcagagcgccggcctggtgctgtggggcgccatcctgtttgtcgcatggaacgcccttcttctgttgtttttttggactaggcccgcccctggtcgcccaccatccgtgtctgcactggacggcgatccggcctcgttgactcgcgaagtgattcgcctggctcaggatgccgaagtggagctcgagcggcagagaggattgttacaacaaatcggcgacgcactgtctagccaacgcggacgggtcccaactgctgctccccccgctcagccccgtgtgcccgtcacaccggcccctgctgtgatccccattctggtgatcgcatgtgatagaagtaccgtgagacggtgcctcgataaactgctccactaccggccaagcgccgaactgttccccatcatcgtgagccaggactgtggacacgaagaaactgcacaggctattgcctcgtacgggagcgcagtcacacatattcgccagcccgacctcagctctattgctgtgcccccggaccatcgaaaattccagggctattataagattgccagacactaccgctgggccttgggccaggtgttccgacagttcagattccccgcagcggtggtggtggaggacgacctggaagtcgccccggacttcttcgagtactttcgtgccacatatcccctgctgaaggccgacccatctctgtggtgcgtgagtgcttggaacgataacggtaaagagcagatggttgacgccagccgtcccgaactgctgtaccgcacagactttttccccgggttaggctggcttctcttagcggagctctgggccgaactggagcccaaatggcctaaagccttctgggacgattggatgcgacgccctgagcagcgacagggacgcgcatgcatccgtccggagatttcgcggacaatgacattcggaaggaaaggggtttcccatgggcagttctttgatcaacatctcaagttcatcaaactcaatcagcagtttgtccactttacacagctggatttgtcctatcttcagcgcgaggcttacgatagggactttcttgcacgggtgtatggcgctccccaacttcaagtggaaaaggttaggacaaatgatcgtaaggagttgggggaggttcgggtgcaatacacaggaagagatagtttcaaggctttcgctaaagccttgggggtaatggatgacttaaagtccggagtgccccgcgcgggataccggggcatcgtgacgtttcagtttcgcggaagacgggtgcatctagcacctcctttgacctgggagggttacgacccatcgtggaattag

SEQ ID NO: 194155 - DNA, 1338 bp, Artificial Sequence
  Description of Artificial Sequence: Synthetic coding sequence
atgctgaagaagcagagcgccggcctggtgctgtggggcgccatcctttttgtggcctggaacgcgctgcttttgctctttttttggacaaggcccgccccagggcgcccgcccagcgtttccgccctggatggagatccagcaagtctcactagagaggtgatacgactcgcgcaggacgcagaagtggagctggagaggcagaggggcctcctgcagcaaataggagacgccttgtcgtcacagcggggtcgcgtcccaacagcggccccacctgcccagcccagagtccccgttacaccagcccccgccgtgatccctatcctcgttatcgcgtgtgaccgcagtaccgtaagacggtgcttagataaactcttgcactaccgacctagtgcagagctgtttcccataatcgtgtctcaggactgtgggcacgaggagacagcccaggcaatcgcttcttatggctccgcagtcacgcacattcgccaaccagacctttcctctatcgctgttcctcctgatcaccgtaagtttcaggggtattacaagatagctagacattataggtgggccctaggccaggtgttccgccagtttcgtttccctgccgcggttgtggttgaagacgacctggaggtggctcctgattttttcgagtacttcagggctacgtacccacttttgaaggctgacccatccctttggtgtgttagcgcatggaacgacaacgggaaggaacagatggtggatgcatccaggcctgaactgctgtaccgcaccgacttcttccccggactcggttggctcttgctggcagagctttgggccgagctagaacccaagtggccaaaggcattctgggacgactggatgcgtcgtcctgaacaacgccagggtagggcgtgtatcaggccagagatctcccggacaatgaccttcggcagaaagggcgtttcgcacggacagttctttgaccaacatcttaagtttattaaactcaaccagcagttcgtccattttactcagttagacctctcttatctccaacgagaggcctatgatcgcgactttctggcacgggtctatggggccccccagttgcaggtagagaaggtgcgtaccaatgaccgaaaggagctcggggaagtgcgagtccagtacacaggacgggattcttttaaggctttcgccaaggcgttaggcgtcatggacgatctcaaaagtggcgtcccccgagccggctatcgaggcatcgtgacttttcagttccgtggccgtcgggtgcatctggccccaccactgacatgggagggttacgatccctcctggaactag

SEQ ID NO: 194156 - DNA, 909 bp, Artificial Sequence
  Description of Artificial Sequence: Synthetic coding sequence
atgctgaagaagcagagcgccggcctggtgctgtggggcgccatcttgtttgtcgcgtggaacgctctgctgctgttgtttttttggacaaggcctgctcctgggaggcccccctccgtctccgcactagacggtgatcctgccagcctcacaagggtttttcgtcagtttcggttccctgctgccgtagttgtggaggacgatctagaggtagcacctgactttttcgagtatttccgggcgacttacccactacttaaagcggacccttctctgtggtgcgtcagcgcttggaacgataatgggaaggaacagatggtggacgcttctcgcccagagttgctctatcgcaccgatttcttccccggcttaggctggcttctcttggccgagttatgggcggaactggaaccaaaatggcctaaggctttttgggacgattggatgcgacgtccagaacaacgccagggccgcgcctgtatccgccctgagatcagtcgcactatgaccttcggccggaagggagttagtcacggtcagttttttgaccagcacctcaaattcattaaactgaaccagcaattcgttcactttacacagcttgatctttcatatctccagcgcgaagcctatgacagggatttcctagcccgagtttacggggcacctcagttacaggttgagaaggtcagaaccaacgacagaaaggagctgggtgaagtgcgagtacaatatacaggaagagacagcttcaaggcttttgcgaaggccctgggcgtaatggacgacctgaaaagcggcgtcccccgggcaggataccgaggaattgtgactttccagtttaggggtcgacgggtgcacctggctccccccctgacctgggaggggtatgatccaagttggaactag

SEQ ID NO: 194157 - DNA, 312 bp, Artificial Sequence
  Description of Artificial Sequence: Synthetic coding sequence
atgctgaagaagcagagcgccggcctggtgctgtggggcgccatcctattcgtggcctggaatgcccttcttcttcttttcttctggacacgccctgccccggggagacccccgtcagtgtcagcacttgacggcgaccccgcctccttgactcgggaagtaatcaggctagcacaggacgctgaagtagagttggagcggcaaaggggattactgcaacaaatcggtgacgctttatccagccagagaggcagagtgcccaccgcagccccccctgcccagccaagagtcccagttactccagcaccttag

SEQ ID NO: 194158 - DNA, 600 bp, Artificial Sequence
  Description of Artificial Sequence: Synthetic coding sequence
atgctgaagaagcagagcgccggcctggtgctgtggggcgccatcctgttcgttgcttggaatgctcttttgctactgttcttctggactaggcccgcccccgggcggcccccctcggtctccgccctggacggtgaccctgctagtctcacacgcgaagtcatccgactggcacaagatgccgaggtggagctggagcggcagcggggcctactacagcagatcggggacgccctgtcttcccaaagaggacgcgtgcccacagccgcacctcccgcacagccaagagttccggtcacccccgcacctgctgtgatcccaattctagtgattgcctgtgacagatccacagttaggaggtgcctggacaagctgttgcattaccggcccagcgctgaactgttccctatcatagtatctcaagattgcggccatgaagagacggcacaggccatagcatcttacgggagcgccgtcactcacattcggcagcctgatctctcctcaattgccgttccgccggaccatagaaagttccagggctactacaagatagctcggcattataggtgggccctgggacaagtgttcaggcagtag

SEQ ID NO: 194159 - DNA, 336 bp, Artificial Sequence
  Description of Artificial Sequence: Synthetic coding sequence
atgctgaagaagcagagcgccggcctggtgctgtggggcgccatcctgttcgtggcctggaacgccttgttgcttttattcttttggacccggccagcccccggtcgccctccctctgtcagtgctctggatggagacccagcgtcgctgacccgggaagttatccgcctggcacaggatgctgaggtggaactcgaacgacaacgcggcctgctgcagcagattggagacgctctctcctctcagcgaggccgggtgcccacagctgcccctcctgcacagccaagagttcctgtgactcctgctcctgccgttatcccaattctggtgatttag

SEQ ID NO: 194160 - DNA, 465 bp, Artificial Sequence
  Description of Artificial Sequence: Synthetic coding sequence
atgctgaagaagcagagcgccggcctggtgctgtggggcgccatcctctttgtggcctggaatgccctgctgctcctgttcttctggacacgccccgctccaggtcgtcctccgtcagtgtcagccttagacggggaccctgcttctctgaccagggaagtcattagactcgcacaagacgccgaggtcgagctggagagacaaaggggcctcctacagcagattggcgatgcattgtcctcccagcggggccgcgtaccaacggcagcaccgcctgcacagccaagagtgcccgtgactcctgcaccagctgtgataccgatactagtgatagcttgtgatcgatcgacggtgcgcaggtgcctggataagctgctacactaccgcccatcagccgaactcttcccaattatcgtgtctcaggactgtggacacgaagaaaccgcccaggcgatcgccagttag

SEQ ID NO: 194161 - DNA, 105 bp, Artificial Sequence
  Description of Artificial Sequence: Synthetic coding sequence
atgctgaagaagcagagcgccggcctggtgctgtggggcgccatcctgttcgttgcatggaatgcactgttgctgttattcttttggacacgccccgcaccttag

SEQ ID NO: 194162 - DNA, 348 bp, Artificial Sequence
  Description of Artificial Sequence: Synthetic coding sequence
atgctgaagaagcagagcgccggcctggtgctgtggggcgccatcctgttcgtggcctggaatgctctgctgctcctatttttttggacaagaccagccccagggcgacctcctagcgtctcagctcttgatggtgatcctgctagtttgactcgggaagtgatcagactggctcaggacgccgaagtggagttggagcgccaacggggcctgctacaacagatcggagatgccctatcaagtcaacgaggccgtgttccaacagcggcacctcctgcgcagccccgggtgccagtaacaccggcccctgcagtgatcccaatcttagtgatcgcctgtgatcgatag

SEQ ID NO: 194163 - DNA, 288 bp, Artificial Sequence
  Description of Artificial Sequence: Synthetic coding sequence
atgctgaagaagcagagcgccggcctggtgctgtggggcgccatcttgttcgtcgcttggaacgcgctgcttctactcttcttctggacccggccggccccagggcgccctcccagcgtatctgccctggatggagacccagcatctctgactagagaggtgatacggctggctcaggatgccgaggtggagctggagcgccagagaggactcctgcagcagattggggacgctctcagtagccagcggggtagggtaccgacggccgctccccctgcccaaccttag

SEQ ID NO: 194164 - DNA, 384 bp, Artificial Sequence
  Description of Artificial Sequence: Synthetic coding sequence
atgctgaagaagcagagcgccggcctggtgctgtggggcgccatcctgttcgtcgcctggaatgccctgctcctgttgtttttttggactcgccctgctcctggacgccccccatcagtgtcagccctggacggtgatccagcatctttgacaagggaagttataaggttggcacaagacgccgaagtagagctagaaagacagcggggcctcctgcaacagattggggatgcactgagcagccagcgaggacgtgtgccaacggctgctcccccagctcagcctagagtgccggtgacgccagcacccgccgtgatccccatcctggtgattgcatgcgaccggagcactgtgcgccgatgtttagacaagcttcttcattag

SEQ ID NO: 194165 - DNA, 318 bp, Artificial Sequence
  Description of Artificial Sequence: Synthetic coding sequence
atgctgaagaagcagagcgccggcctggtgctgtggggcgccatcttgttcgtcgcgtggaacgcactcctgttacttttcttctggactcgacctgccccaggaaggccccccagcgtgagcgccctagatggtgacccggcatctctgacccgcgaagttatccgtcttgcccaggacgcggaagtggaattggaaaggcaacggggattacttcaacagatcggagatgccttgagcagtcaaagagggcgcgtaccaaccgccgccccacccgcccagcccagggtgcccgttacccccgcgcctgctgtttag

SEQ ID NO: 194166 - DNA, 1608 bp, Artificial Sequence
  Description of Artificial Sequence: Synthetic coding sequence
atgcggctgcggaacggcaccgtggccaccgccctggccttcatcacctctttcctcaccctcagctggtataccacctggcagaacggcaaggagaagcttatagcctatcagcgtgaattccttgcgttgaaggagagattgcgtattgcagagcacaggatcagtcagcggtctagtgaactgaataccattgtgcagcaatttaaaagagtcggcgctgaaacaaatggatcgaaggacgccctcaacaagttctctgacaacaccctgaaactgctaaaggagctcaccagcaagaaaagcctgcaggtgccttcgatctactatcatctgcctcacctgctgaagaacgaaggctcgctacagcccgccgtacagatcggtaacggacggaccggcgtgtctatcgtgatgggtatccccactgtgaagagggaagttaagtcctacttgatcgaaaccctgcattcacttatcgataatctgtaccctgaagaaaagctagactgtgttatcgtggttttcattggggagactgatattgactacgtgcacggggtggttgcgaacttggaaaaggaattcagtaaagagatatcctccggactggtggaagtcatctctcccccagagtcatactaccctgatctgaccaatctgaaggaaacctttggcgattccaaggagagagtacgctggagaactaagcagaacttagactattgcttcctgatgatgtacgctcaagagaagggcatttactacatccagctggaagacgatatcatcgtcaagcagaattactttaatactatcaagaatttcgctcttcagttgtcctctgaggagtggatgatcctggaattcagtcagttgggcttcattggtaagatgttccaggctccagatcttactttgattgttgagttcatcttcatgttctataaagagaaacccatcgattggctcctggaccacatcttatgggtcaaagtttgcaatccggagaaggacgcaaagcattgtgaccggcagaaagctaatttgcgcattcgcttcaggccttcgctcttccagcacgtcggtcttcacagctcactcagcggcaaaattcagaaactgaccgacaaggactatatgaagcccttgctgctgaagatccacgtgaaccctcctgcagaagtcagtactagcttgaaagtgtaccaagggcacacactggaaaaaacttatatgggcgaggatttcttctgggctattactccgattgcgggcgattacattctgtttaagttcgataagcctgtgaatgtggagtcttacctgttccactccgggaatcaggagcatccaggcgatatcctgttgaacactaccgttgaggtgttgccctttaagagcgaaggcctcgagatcagcaaagagaccaaggataagcggctggaagatggatattttcgtatagggaaatttgagaacggagtggctgagggtatggtcgatcctagcctgaaccctatcagcgccttcagactaagtgttatccaaaacagcgccgtctgggctatcctgaacgaaattcacatcaagaaggccaccaactag

SEQ ID NO: 194167 - DNA, 1608 bp, Artificial Sequence
  Description of Artificial Sequence: Synthetic coding sequence
atgcggctgcggaacggcaccgtggccaccgccctggccttcatcacttcctttctgacgctctcctggtacaccacgtggcagaatggaaaggaaaagcttattgcctatcagagggagtttcttgctttaaaagaacggctcagaatagccgagcatcgcattagccagcggagttctgaactgaatactatcgtgcaacaattcaaaagggtgggcgccgagaccaacggttccaaagacgcactcaacaaattttcagataacaccctcaaactcctcaaggagctcacctcaaagaaaagcctgcaggtccccagcatttactatcatctcccccatttgctgaaaaacgagggttcactgcagcctgctgtacagattgggaatgggagaaccggggtatcgatcgttatgggaattcctacggtgaagcgggaagtgaagagctacttaatcgaaacattgcatagcctgatcgacaacctctacccagaggagaagctcgactgcgtgattgtcgtctttattggtgagacagacatcgactatgttcatggagttgtggctaacctggagaaggagttcagtaaggaaatatcaagcgggctcgtagaggtgattagcccccctgaatcttattacccagatctcacaaaccttaaagagaccttcggcgactctaaagagagggttcggtggcggactaagcagaatctcgattactgctttctgatgatgtacgcacaagagaaaggaatatactatattcaattggaagatgatattatcgttaaacagaattacttcaacactattaagaacttcgccctgcaactgtccagtgaagagtggatgattctggaattctctcagttggggtttataggtaaaatgtttcaggcgccggacctgaccctcattgtggaattcatcttcatgttttacaaggagaagccaattgattggctcctagaccatattctctgggtgaaagtgtgtaatccagaaaaagatgctaagcattgtgatcgtcagaaggcaaatctgagaattaggtttcgcccctcactcttccagcacgtgggactacattcttccctctccgggaagatccagaaactgaccgacaaggactatatgaagcctctgctgctgaagattcatgtgaaccctcctgctgaagtgtccaccagtctcaaagtgtatcagggccataccctcgagaagacgtatatgggcgaggactttttttgggccattactcctatcgcaggagattatattttgtttaaattcgacaaacccgtgaatgtggagagctacctcttccacagcggcaaccaagagcaccccggggatatcctcctgaatactaccgtagaggtgctgcccttcaagtctgaagggctggaaatcagtaaggagacaaaggacaagcgccttgaagacgggtacttccggatcgggaagttcgaaaacggtgtcgcagaaggtatggtggacccttccttgaaccccatttcggccttcaggttatccgttatccagaactctgctgtgtgggctatcctcaacgagatccacatcaagaaagctacaaactag

SEQ ID NO: 194168 - DNA, 1608 bp, Artificial Sequence
  Description of Artificial Sequence: Synthetic coding sequence
atgcggctgcggaacggcaccgtggccaccgccctggccttcatcacctctttcctgaccctctcatggtacactacttggcagaatggcaaggagaagctgattgcctatcagagggagtttctggcactgaaagaaagactgcgaattgcggaacatagaatatctcaacgctcctcagaactgaatacaatcgtgcagcagtttaaaagagttggcgccgagactaatggttccaaagacgccctgaataagttttcagacaacaccctcaaactgttaaaagagcttactagcaagaagtccctccaggtgccctcaatttactatcatttgccacacctcctgaagaacgagggttctctgcaaccggcggtgcagatcggcaatggcagaacgggggtgagcattgtaatgggtatcccaactgtaaagcgtgaagttaagtcatatctgatcgaaacactgcacagcttgattgataatctgtatccagaagagaaactggattgcgtcattgtggtgtttattggggagacagatatagactacgtgcatggtgtggtggcgaatctcgaaaaagaattctcaaaagagatctctagtggactggtagaagtgatctctccccccgagtcatactaccctgacctcaccaacctcaaggaaacgtttggcgactccaaggagcgtgtacgctggagaacaaagcagaacctggactactgctttttgatgatgtacgcacaagaaaaggggatttattatattcagcttgaggatgatattatagttaagcagaattattttaataccattaaaaatttcgcgttgcagttgagcagtgaagaatggatgatcctcgaattttcccagcttggctttatcggaaaaatgtttcaggccccagatttgaccctcatcgttgaattcattttcatgttttacaaagagaagccgattgattggctcttggaccatattctgtgggttaaggtgtgcaatccagaaaaggatgcaaagcattgtgacagacaaaaggcaaatctgagaatacgatttaggcctagtctattccaacacgtgggcctgcactcctccctgagtggcaagattcaaaagctgacggacaaagattatatgaaaccactgcttctgaagatccatgtgaatccgcccgctgaggtgtctactagcctgaaggtctaccagggccacacactggaaaaaacctatatgggggaggactttttctgggctattaccccaatagcaggagactacattcttttcaagtttgacaagccggttaatgtggaaagttacctctttcattccggcaatcaggagcatcccggagacatcctgttgaacaccacagtggaggttctaccgttcaaaagcgagggactcgaaatttccaaagaaacaaaagataagcgactggaggatggatactttaggattggcaagtttgagaacggggtagccgaaggcatggtagacccatctttaaatccaatttccgcttttcggttgtcagtgattcaaaattctgccgtgtgggccatactgaacgagatccatatcaagaaggccaccaattag

SEQ ID NO: 194169 - DNA, 1272 bp, Artificial Sequence
  Description of Artificial Sequence: Synthetic coding sequence
atgaactacagcatcaccgtgagcatcgtgatgggcatccccaccgtgaagagggaggtaaagagttacctgatcgaaactctccactctctgatcgacaatctctatcctgaggagaagctagactgcgtgatagtggtctttattggcgagacagacatcgactacgtgcatggggtcgtcgcaaacctggagaaggaattttccaaagagatatcctccggtctcgtcgaggtgatctccccacccgagtcctattacccagacctgacgaatctaaaggagacctttggcgattccaaggaaagggtgaggtggcggaccaaacagaacctggactattgcttcctgatgatgtatgcccaggaaaaaggaatctactacatccagctggaagatgatatcattgtgaaacaaaactactttaacaccatcaagaattttgcgttacagttatccagcgaggagtggatgattctcgagttcagtcagttagggttcatcggaaagatgttccaggcaccggacctcactctgatagtcgagttcatcttcatgttctacaaagaaaagccaattgactggctgctggatcatattctgtgggttaaggtgtgcaatcccgaaaaagatgcgaagcactgtgaccggcagaaggccaacctgcgtattagatttcgtccaagcctgttccagcacgtgggcctccactcatcactgtcaggaaagatccagaagttgacagacaaagattatatgaagcccctcttactcaagatccatgtgaaccctcctgctgaggtatccacttccttaaaggtgtatcagggacataccctggaaaaaacatatatgggcgaggacttcttttgggccattaccccaattgctggcgattacattctctttaaattcgataagcccgtgaatgtggagtcctacctgtttcatagcggaaatcaggagcaccctggagacattctgctgaatacaacggtcgaagtcttgccattcaaatctgaggggctggaaattagtaaagaaaccaaggacaaacggttggaggatgggtatttcaggattggcaagtttgaaaacggggtggccgaaggaatggtggatccgtcactaaaccccataagtgccttcagactgagcgtcatccaaaactcagcagtttgggcaatcttgaacgaacaacgcgtgttttcaggatggtggcagaaatcaagggataaggcggagggaccacaggctcctttactgttctag

SEQ ID NO: 194170 - DNA, 1647 bp, Artificial Sequence
  Description of Artificial Sequence: Synthetic coding sequence
atgcggctgcggaacggcaccttcctgaccctgctgctgttctgcctgtgtgcctttctttccctgtcctggtatgctgcactgagcggacagaagggtgacgtggtggatgtttaccagagggaattcctggctctgagagacaggctgcacgccgctgagcaagaatcactcaagcggagtaaggagctcaatctggtgctagatgaaatcaaacgcgccgtttcagagcggcaggccctgagagacggcgacggaaacaggacctggggtcggctcacagaagatccacgacttaagccatggaatggtagtcaccgtcatgtacttcacctgccaacagtatttcaccacctgccccacctcttggccaaagaaagttcattgcagcctgccgtccgtgttggtcaaggtagaactggcgtcagcgtggtaatgggtattcccagtgtgaggcgagaggtgcactcctacctgacagatacattacattctttaatctccgaattatctccgcaagagaaggaggattctgttattgtggtgctaattgcagaaaccgattctcagtatacctcagcagttaccgagaatatcaaggcacttttccccacagaaatccattccggcctcctcgaagtgatcagcccttccccccacttttacccagactttagcaggctacgagagtcatttggggatcctaaggagcgcgtgagatggcggacgaaacaaaatcttgattattgctttctcatgatgtatgcacagagcaaaggcatctactatgttcagctggaggacgacatagtggctaagccgaactacctgtcaacgatgaaaaatttcgccctgcagcaaccatccgaagattggatgattttggagttttcacaactggggtttattggaaagatgtttaagtctctagacctcagcttgatcgttgaattcattctaatgttttaccgtgacaaacctattgattggctgctcgatcatattttatgggtgaaggtttgcaatcccgagaaagatgctaaacattgcgatcgccagaaagccaatctgcggatccgttttaagccctctttgttccaacacgtaggtacgcactcaagtcttgcaggcaagattcaaaaattgaaggacaaagatttcggcaagcaagccctgaggaaagaacatgtaaacccacccgccgaggtatcaacatccctgaagacctaccagcacttcacacttgagaaggcttatctgcgggaggattttttttgggctttcacccccgccgcaggggatttcattcgttttcgcttcttccagccactaagactggaaaggtttttctttcggagtgggaacatcgagcaccccgaggataagcttttcaacaccagtgtagaggtattgccctttgataatccacagagcgacaaggaggctctacaggaaggcagaactgccacccttagatatccacggtctcccgacgggtacttacagattggatctttttacaaaggcgtcgccgaaggggaggtggatccagcttttggacccctcgaggcattaagactcagtatccaaaccgacagtccagtgtgggtgatactgagcgagatcttcttgaagaaagccgactag

SEQ ID NO: 194171 - DNA, 1692 bp, Artificial Sequence
  Description of Artificial Sequence: Synthetic coding sequence
atgagccgggtggccggcacccggaccgacgtgaacgagctgctgcagagatggacaccccgctgtgtaaggtggcacaccggtggagcccggcgcgtggctcttgacagacccctggttacggcttgcctgcccccagccggcgacgtggttgacgtgtaccagagggagttcctggctctgagagataggctgcacgccgctgaacaggaatcccttaaacgatcaaaagagttgaatcttgtgctagacgaaatcaaacgagccgtgagcgagcgccaggcactgagggatggtgatggtaatcgaacctgggggcggctgacagaggatccaagattgaaaccctggaacggttcgcaccgccacgtgctgcacctcccaacagtttttcaccatctaccacatctgctcgcgaaggaaagctcactccagcctgccgttcgggtcggacagggaaggactggggtttcggttgttatggggattccaagcgtgcggagggaggttcacagttacctaactgacactttacactcactgatctcggagctctccccgcaggagaaggaagattctgtgattgtcgtgctgattgcagagaccgattcgcagtatacttcggctgtgaccgagaatatcaaagccttgtttccaactgagattcactcaggcttgctggaagttatctctccctcacctcatttttaccctgacttctctcgcctcagggagagtttcggggaccctaaggagcgggtccgctggcggaccaagcagaatctagactactgtttcctgatgatgtacgcccagtcgaaaggaatctactatgtgcaattagaagacgacatcgtcgcaaaacctaattatctttctacaatgaaaaacttcgctctccagcagccttccgaggactggatgatcctagagtttagtcagctaggtttcataggcaaaatgttcaagtctttggaccttagtcttatcgtggaattcatactgatgttctaccgtgacaaacccattgactggctgctggatcacatattatgggtgaaggtgtgtaatccagagaaggatgcgaaacactgtgatcgacagaaagcgaatctgcggattaggtttaagccttctctgtttcaacacgtgggcacgcatagctctctggctggaaaaatacagaagctgaaggacaaagattttggaaagcaagccctgcgtaaagagcacgtgaatccacccgccgaggtgagtacttctcttaaaacttaccagcacttcactctggagaaagcgtacttgagagaagatttcttttgggctttcacacccgcagcgggagacttcatcaggttcagatttttccaaccactgcgtctggagagattctttttccggtctgggaatatcgaacaccctgaggacaaattatttaataccagtgtcgaggttcttccgtttgacaatccgcagagtgacaaggaggccctccaagaaggccgaactgctaccctgagatacccaaggagtccagatggatacctgcagattggaagtttttataaaggcgtagcagaaggtgaagttgaccccgccttcggcccattggaggcactgcggttgtcaatccagaccgattcacccgtttgggtgattttgtccgagatatttttaaagaaagcagactag

SEQ ID NO: 194172 - DNA, 1344 bp, Artificial Sequence
  Description of Artificial Sequence: Synthetic coding sequence
atgcggttccggatctacaagcggaaggtgctgatcctgaccctggttgtcgctgcctgcggattcgttctatggagcagcaatggccgccagagaaagaatgaagcattggccccacctctcctggacgctgaaccagcaagaggagccgggggaagaggcggggatcatccctccgtggctgtcggcatccggagagtaagcaacgtcagcgccgcctccctggtgcctgcggttccgcagccggaggccgacaatctgactttgcgctaccggtcattagtgtaccaactgaatttcgaccagactctccgtaatgtggacaaagcagggacttgggcccctcgcgaactggtattggtggtgcaggtgcacaatcggccggaatacttaaggcttttgctggactccctcaggaaggcacagggaattgataacgtactggtgatcttcagtcacgacttttggtctacagagatcaaccaactgatcgccggggtcaacttttgtcccgttcttcaggtctttttcccattctcaatccaactgtatcccaacgagttcccgggctcggacccacgggactgcccaagggacctgcctaagaacgctgccctcaaactgggttgcatcaatgccgaatatccggattcatttggccactatcgagaagccaaattctcacaaacgaagcaccattggtggtggaagttgcatttcgtgtgggagcgagtaaaaattctacgggattacgcgggcctcatcttgttcctagaggaggatcactacctggcgcccgatttttatcatgttttcaagaaaatgtggaaactgaagcagcaggagtgccctgaatgcgatgtcctatcactggggacctacagtgcttcgaggtccttttacgggatggcagacaaggttgatgtaaagacgtggaaatcgaccgagcataacatgggccttgcactgacaaggaatgcctaccagaagctgattgaatgcacagataccttttgcacttacgacgactataattgggattggactctccagtatttaactgtgtcttgcctgcccaagttttggaaggtgctggtgccccagatcccccggattttccatgccggggattgtggaatgcaccacaagaaaacatgtcgcccgtcaacccaaagtgctcagatcgaatcgctgctcaataataacaagcagtacatgtttcccgagacactgactatctccgagaaatttaccgtcgtggcaatcagcccccctcgcaagaatggtggttggggcgacatccgggaccacgaattatgtaagagttatcggcgattgcagtag

SEQ ID NO: 194173 - DNA, 1362 bp, Artificial Sequence
  Description of Artificial Sequence: Synthetic coding sequence
atggagcggaccgagaccatgcggttccggatctacaagcggaaggttctcatccttactcttgtagtcgccgcgtgcggatttgtgctgtggagtagtaacggtaggcagagaaagaatgaagcactcgctccccctctgctagacgccgagcccgcccgcggggctggtggtcgtggcggagatcacccttctgtggcggtgggcatcaggagggtgtccaacgtgagcgctgcgtcacttgtgccggcggtaccccagcctgaggctgataatctgactctcagataccgtagcctggtctatcagctgaatttcgatcaaacattgcgcaacgtcgataaggcgggcacatgggccccgcgcgaactggtcctcgtggtgcaagtgcacaaccgccctgaatatttgcggttgctcctggattccctccgtaaagctcagggcatcgataacgtattggtcattttttctcatgacttttggtcaacagagatcaaccagctcattgccggcgttaacttctgccccgttttgcaggtcttttttccattctcaattcagctgtaccctaatgaattcccgggaagcgatccccgagattgccctagggatctgcccaagaatgcggccctcaagttgggctgcatcaacgcagagtacccagacagcttcggccattacagagaagcaaagttctcgcagaccaagcatcactggtggtggaaattacacttcgtgtgggagcgagttaagatcctccgggattacgccggtctgatccttttcctcgaggaggatcattatctggctcctgacttctaccatgtattcaagaaaatgtggaagctgaagcaacaggagtgccctgagtgtgacgtgctcagcctgggcacgtacagcgcctcacgaagcttttatggcatggctgacaaggtggatgtaaaaacctggaaaagtaccgaacacaatatgggcttggccctcacccgcaacgcatatcaaaaactcattgaatgcaccgacactttctgtacttacgatgattacaactgggactggacactccaatacctaacggtgtcctgcctgcccaaattctggaaggtgcttgtgccgcagataccgagaattttccacgcaggcgattgcggtatgcatcacaagaagacctgccgtcctagcacccagtcagctcagattgaaagtctgttgaataacaataagcaatatatgtttcccgagactttgaccatcagtgagaagttcactgtggtggccatttctccaccgcgcaaaaatggaggatggggagacattagagatcatgagctgtgcaaatcttataggcgcctgcagtag

SEQ ID NO: 194174 - DNA, 2373 bp, Artificial Sequence
  Description of Artificial Sequence: Synthetic coding sequence
atgatcaccgtgaaccccgacggcaagatcatggtgcggcggtgcttagttactctccgtccctttagactcttcgtgctcgggattggtttttttaccttgtgctttcttatgaccagcctgggagggcagttcagtgcccgtagacttggggattccccattcactatccgaaccgaagtgatgggcggtccagaatccaggggggttctgaggaagatgagcgatctcttagagttaatggtgaagcgtatggatgccctggcaaggctggagaactcgtccgagctccatagggccggcggggacttacattttccagccgacagaatgccaccaggcgcaggcttgatggaaagaatacaagctatagcgcaaaacgtctcggacatcgcagtgaaagttgatcagatcctccggcacagtttgctgctgcattccaaggtatctgaaggccgtcgcgaccagtgcgaggcgccctcggatcccaagttccccgactgttctggcaaggtcgagtggatgcgagccaggtggaccagcgacccatgctacgcttttttcggcgttgacggtaccgagtgctcctttctgatttatttgagcgaggtggagtggttctgtcccccacttccttggaggaatcagacggctgcccaaagagcgccgaaacctttgcccaaggtccaggcagtgttcaggagtaatctttctcatctgttggacttgatgggcagcggtaaggaaagcttgatattcatgaagaagcgaacgaagcgactgaccgctcaatgggccctggccgcacaacggctggcacagaaacttggggccactcagagagatcagaagcagattctggtccacatcggctttctaactgaagaaagcggggatgtgttctctcccagggtgctgaagggtggacccttgggagagatggttcagtgggcagatatcctgactgccctctacgtcttgggccacggcctccgagtgaccgtttcccttaaagaactccagagcaacctgggagtgccccccggtagaggttcgtgcccactgaccatgccactgcccttcgatctaatatacactgactatcacggtctgcagcagatgaagcgacatatgggcctttcattcaagaaataccggtgtcgtatcagagtgatcgatacttttgggacagagcccgcttataatcacgaagagtacgcaacattgcacggttacaggacgaactgggggtactggaatcttaaccccaagcagtttatgacaatgttcccacacactccagacaatagctttatgggatttgtcagcgaggagctcaatgagacagaaaaaaggctcatcaaaggaggcaaggcatctaacatggcagtcgtctacggtaaggaagccagcatatggaagggtaaagagaagtttctcggcattcttaacaaatatatggaaattcacgggacagtttactacgagtctcagcgtccacccgaggtgcccgcattcgtgaaaaatcacggcctgctacctcaacccgaattccaacagctgttacgtaaagccaaactcttcatcggttttgggttcccttacgaaggaccggcgccacttgaagctatagctaacggctgcattttcttgcagagtaggttttcacctcctcatagctccttgaaccacgaattcttccgcggaaaaccaacctccagagaggtgttcagtcagcacccctatgccgagaattttataggtaaaccacatgtttggacggtagactacaataacagtgaagaattcgaagccgcgatcaaagccatcatgagaacacaggtggatccctacttgccatatgagtacacctgtgagggcatgctcgagaggattcatgcatatattcaacaccaagatttctgtagagctccggatcccgctctgcccgaggcccacgccccacagtctccgttcgttctcgccccaaacgccacccaccttgagtgggcgcggaacacttccctggcgcccggagcctggcctcccgcccacgcgctgcgggcctggctcgctgtgcctgggcgggcctgtaccgacacatgtctcgaccacggcttgatttgcgagccctcctttttccctttccttaacagtcaagacgcattcctgaagctgcaggtgccatgtgactcaactgaatctgagatgaatcatctgtaccctgcttttgcacagcctgggcaagaatgctacctccaaaaggaaccgcttctgttcagttgcgccgggtctaatacaaagtaccgcagactgtgtccatgccgggatttccgcaagggccaggtggctctgtgccaggggtgcctttag

SEQ ID NO: 194175 - DNA, 1185 bp, Artificial Sequence
  Description of Artificial Sequence: Synthetic coding sequence
atgatcaccgtgaaccccgacggcaagatcatggtgcggcggtgcctggttactttgcggcccttccggctgttcgtgctgggcattggattttttacattatgctttctgatgaccagtttgggtggtcagttctccgctcgtcgccttggagacagcccgtttacaatcagaactgaggttatgggaggccctgagagtcgtggtgttcttcgaaagatgagtgacttactggagttgatggttaaaaggatggatgcactggcccgactggagaactcctctgaactgcatcgggctgggggcgatctgcacttccctgcggataggatgcccccgggagcaggccttatggagcgtattcaggctatcgcgcaaaatgtcagtgacatcgctgtaaaagtggaccagatccttagacatagtcttcttcttcactctaaggttagcgagggacggcgtgatcagtgcgaggctccatccgatcccaagtttccagactgttcaggcaaggtcgaatggatgcgggcaagatggacttcagacccatgctacgctttcttcggcgtggatggcaccgagtgctcatttcttatctatctgtccgaggtcgagtggttttgtcctccactgccttggaggaaccagacggcagcccaacgcgctcctaaaccacttccaaaagtgcaggcggtttttaggtctaacctgtctcatctgctagacctcatgggaagcggaaaagagtctttaatcttcatgaagaagcggacaaagcggctgacagctcagtgggccctggccgcccagcgcctggcccagaagctgggtgccacccagagagaccagaagcaaatcctggtccatatagggttcctcactgaagagagcggagacgtcttctcaccacgggttctcaagggcggccccctgggagaaatggtgcagtgggcagatattctgacagccttatacgtgctaggtcacggcctcagagtcacggtcagcctgaaagaactgcagagacaacgaagactccggtcgagccaggaacaagccaggtgcggggtgatgggagcatgcgagaagatgcttttggagggagatgtggctagcaatacactattgattgaaaagccttctaaaaaggagactgagaagtgtcccaagaatttagtaacttag

SEQ ID NO: 194176 - DNA, 2406 bp, Artificial Sequence
  Description of Artificial Sequence: Synthetic coding sequence
atgcacagcttcgtgaagcacctgtgcagccggtacgtggtggagcgtcaggggacaatggccctgccggcgcttctgacgcgcctgctgcctctccgcagacttttcgttcttggaattggcttttttacactctgttttttgatgacatcactcggcgggcaatttagcgcccgtcgactgggagactctccttttactattcgcaccgaagtgatgggtggccctgagtctcgaggcgtgctgcgaaagatgtccgacctgttggagctgatggtcaaaaggatggatgccctcgctagactagagaatagctccgagctgcacagagcaggtggcgatctccattttccggctgaccgaatgcctcccggagccgggctgatggagcgaattcaggcaatcgcgcagaatgtgtctgacatcgctgtgaaggtagatcaaatcctgcgacatagtctgctcctccacagtaaagtgtctgagggcagacgtgaccagtgtgaagccccgagtgatccaaagttccctgactgcagcggcaaggttgaatggatgagagcgagatggacatcagacccttgctacgccttctttggggttgatggaaccgagtgctctttccttatctatttgagcgaggtggagtggttctgtccaccactcccctggagaaaccaaacagccgcccagcgtgctcccaagcccctgcccaaggtgcaggctgtatttaggtccaatctctcacatttgctggatctcatggggtctggtaaggaatccctaattttcatgaaaaagcgcactaagaggctcacagcccagtgggctctcgcagctcagcgtcttgctcagaagctgggcgctactcagcgcgatcaaaaacagatactggtacatattggattcttgaccgaggagtccggagacgttttttcccccagggttctaaaaggaggcccattaggagagatggtacagtgggcagacatactgactgccttgtacgtattggggcacgggctcagggtaacagtaagcctgaaagagcttcagtctaacctcggtgttcctcccggacgcggatcttgccccctgactatgcctctaccgttcgatttgatctatactgactaccatggtctgcagcagatgaaacgacacatgggactatccttcaaaaaatatcggtgtcgaatcagggtcatcgataccttcgggaccgaacctgcatacaatcatgaggaatacgctactctgcacgggtatcggacaaactgggggtactggaatttgaatccaaaacaatttatgacgatgtttccacacacccctgataatagcttcatggggttcgtgagtgaggagctcaatgaaacggagaaacgcttaatcaagggcggtaaggctagtaacatggcagtggtgtacggtaaggaggcctctatttggaaggggaaggaaaaattccttgggatactgaacaaatatatggagatccacgggacagtttactatgaatcccaaaggccacccgaggttcccgccttcgtgaaaaatcacggactgcttcctcagcctgagttccagcagttgttgcgcaaggccaagttgtttattggttttggttttccatacgaaggccccgccccactggaggcaattgcaaatggctgtattttcctccaatctcgcttttcaccaccgcacagctcgctgaaccacgagttttttcgcggaaaaccaacaagccgagaagtgttcagccagcacccttatgcggaaaactttataggtaagccccatgtatggactgtggattataacaattcagaggagtttgaggctgctattaaggctattatgcggacccaagttgatccgtatttgccgtacgaatacacatgtgagggcatgctggagcggatacacgcctacatccagcatcaggatttttgccgcgctccagaccctgcgttgcccgaggcccatgctccccagtctccatttgttttggcccctaacgccacacatctggaatgggcgcgtaatacctcgctggcacccggagcctggccccctgcccacgccctccgagcttggcttgccgtgccaggtcgtgcttgtaccgacacatgtcttgaccacggactgatctgtgagccctcctttttccccttccttaactctcaggatgctttcctgaagttgcaggtcccatgcgattccaccgagtccgaaatgaatcatctgtaccccgccttcgcccagcccggtcaggaatgttatctacagaaagagcctcttttgttttcttgcgccggcagtaatacaaaataccgccggctctgtccctgcagggatttcagaaaaggccaggtcgcactgtgtcaaggctgcctatag

SEQ ID NO: 194177 - DNA, 1602 bp, Artificial Sequence
  Description of Artificial Sequence: Synthetic coding sequence
atgaagatgcggcggtacaagctgttcctgatgttctgcatggccggactgtgtctgattagctttttgcactttttcaagaccctcagttacgtaactttccctcgcgagcttgcgagcctgtctcctaatctggtgagtagctttttctggaacaatgctcccgtgactccccaagcaagccccgagcccggcggacccgacctgttaagaacgcccctctacagtcactcaccgctgctccaaccactacctccatctaaagccgccgaggagcttcaccgcgttgacctcgtgctgcctgaggatactactgaatacttcgttagaaccaaagccgggggcgtgtgttttaagccaggaaccaagatgctcgagaggccacccccaggcaggccggaggaaaaacccgagggagcgaatgggtcctccgcccgccggccaccccgttacctactcagtgcaagggagcgaaccggcggccgtggcgctagacgcaaatgggttgagtgtgtgtgtctgccaggctggcatggccctagctgcggcgtccctaccgtagttcaatacagcaatttgcccaccaaagaacggctggttccccgggaagtgccacgccgagttattaatgcgattaatgttaaccacgagttcgacttgctcgacgtgaggttccacgagctcggtgacgtggtcgatgcctttgtagtgtgtgagtctaattttaccgcatacggagagcctcggcctctgaaattccgtgagatgctaactaatggaaccttcgaatatatccgacataaagtgctgtacgtgttcctggatcactttcctcccggaggcagacaggatggatggatcgccgatgattatctgcgaactttcctgacacaggatggggtcagcaggctccggaatctgcgtcctgatgatgtgttcatcatcgacgacgccgacgagatccccgctcgggatggggtgctgtttcttaagttatatgacgggtggaccgagccgtttgcctttcacatgaggaagagtctctacggattcttttggaagcagcccggtacactggaagttgtaagtggatgtactgtggacatgctccaagccgtctacggcttggacggaatacggctgcgccgccgtcagtactatacgatgcctaattttcggcagtacgaaaataggaccggccatatcctcgttcagtggagtctcggatcccccctgcactttgcaggttggcattgctcttggtgtttcacaccagaagggatatactttaagctggtatcagctcagaatggagacttcccacgatggggcgattacgaagacaagcgggatttgaactatatccgggggctcataagaactggcggttggttcgacggcacccagcaagagtatcccccagcagatccctctgagcatatgtatgctccaaagtatctgctgaagaattatgatcgtttccactatctgttagataacccttaccaggaacctcggtccacagctgcaggaggctggaggcaccggggccctgaaggtaggcccccagcccgcggaaaactggacgaggcagaggtctag

SEQ ID NO: 194178 - DNA, 327 bp, Artificial Sequence
  Description of Artificial Sequence: Synthetic coding sequence
atggagagctgcagctgccaccccggcagcggcgtgcagtggcgggatcatggcagtctccagcttcccccacccgggtttaagatgaagatgcgccgatacaagctgtttctgatgttttgcatggcgggtctgtgcctcatttctttcctacacttttttaagacactgagctatgtgacctttccccgcgagctcgcctctctgtcccctaacctcgtctcttcctttttttggaacaatgccccggtcacccctcaggctagccccgagccaggtggtccagacctcttgcggacacccttatatagccacagccccctgtag

SEQ ID NO: 194179 - DNA, 486 bp, Artificial Sequence
  Description of Artificial Sequence: Synthetic coding sequence
atgaagatgcggcggtacaagctgttcctgatgttctgcatggccggtttatgtctcatctcattcctgcattttttcaaaacattgagctatgtaaccttccctagggagctcgctagcctctctccaaacctggtgagctccttcttctggaacaatgcacctgtgacaccacaggcatcgccggaaccaggaggccccgatctcttgaggacacctctgtatagtcacagccctctgcttcagcccctaccacccagcaaagctgcagaggaactgcatagagtcgacttggtcctgcctgaagatacaacagaatactttgttaggaccaaagcaggaggcgtgtgctttaagccgggaacaaagatgctcgaaaggcctcctcctggtaggccagaggaaaagccagaaggcgcgaacggctcctctgccaggcggccaccccgttacctcctgagcgctagggaacggaccggggggtag

SEQ ID NO: 194180 - DNA, 1044 bp, Artificial Sequence
  Description of Artificial Sequence: Synthetic coding sequence
atggtgagcagccagaagctggagaagcccatcgagatgggcagcagcgagcccctgcccatagctgatggcgaccgccggcgtaaaaaaaaaaggagaggccgcgctactgacagcttgcccggtaaatttgaagatatgtacaagttaacaagcgaacttctgggagaaggggcgtatgccaaagttcagggcgccgtgtcgttgcaaaacggaaaagagtacgcagtgaagattatcgaaaagcaggccggccattcaagatccagagtctttagagaggttgaaaccttgtaccagtgtcaaggtaataaaaacatcttggaactgattgagttttttgaagatgatacccgcttctatctggtgttcgaaaagctgcagggaggaagcatattggcccacatccagaaacaaaaacatttcaacgagcgtgaggcaagcagagtggtgagagatgtggccgctgcactggattttctgcataccaagggtatagcgcacagagatctgaaaccagagaatatactgtgtgagtcccccgagaaggtctcaccagtgaaaatttgtgatttcgacctcggttctggcatgaaactgaataactcctgtactccaatcacaacaccagaactaacaacaccatgcgggagcgccgagtacatggcacccgaggtggttgaggtattcaccgaccaggcaaccttctatgataagcgttgcgacctgtggtctctgggagtggttttatacataatgttgtcaggctatcctcctttcgtggggcattgtggggctgactgcggatgggatcggggggaagtttgccgtgtgtgccagaataagctcttcgaatctatccaggagggaaagtatgaatttcctgacaaagactgggcgcatatcagtagcgaggccaaagatctgatctctaaattgctcgtgagggatgcaaagcaacgcctgtctgccgctcaagtgcttcagcatccatgggttcaaggcgagcaacaacacaacggtccagacgcgcttcgtagttag

SEQ ID NO: 194181 - DNA, 990 bp, Artificial Sequence
  Description of Artificial Sequence: Synthetic coding sequence
atggccaagagcatgcccagcaagagcagccggaacaagcagggcactgtgggggttggttgtttcgaacgatggcggcgttgcatcagtgtgcgagaaacctctagtatcctcgcacacattcaaaaacagaaacactttaacgaaagagaagcctcccgcgttgttcgggacgtggccgccgctctggactttctgcatactaaaggcatcgctcaccgcgatttaaagcctgaaaacatcctctgtgaatctcctgaaaaggtgagcccagttaaaatttgtgatttcgatttggggtcagggatgaaactcaacaactcctgtaccccaatcactacgccagagttgaccacaccttgcggcagcgcagaatatatggctcccgaggttgtcgaggtgttcaccgaccaggccaccttctatgataaacgatgtgacctgtggtcattgggcgtcgtcctgtacatcatgctttcgggatatcctccatttgtcggccattgcggggccgattgcggctgggaccgcggcgaagtgtgtagggtgtgccaaaataagctctttgagtccattcaagagggaaagtacgagtttcccgacaaggattgggcccacatcagcagtgaagctaaagacctcatctccaagcttctagtgcgcgacgctaaacagaggttgtcagctgcccaggtgctccaacacccttgggtgcaagggcaggcaccagagaagggactgcccacacctcaagtactgcaaaggaactcatccaccatggacctgactctgtttgctgctgaagccatcgccttaaacaggcagctgtcccaacatgaggagaatgaactggcagaggagcccgaagcactcgctgacgggctttgtagtatgaagttatcccctccatgcaagagcaggctagctagaaggcgcgcccttgcccaggctgggagaggggaagataggagcccaccgaccgcgttgtag

SEQ ID NO: 194182 - DNA, 1275 bp, Artificial Sequence
  Description of Artificial Sequence: Synthetic coding sequence
atggtgagcagccagaagctggagaagcccatcgagatgggcagcagtgagcctctgcccattgccgatggggacagacggcggaagaaaaaacgcagaggaagggcaactgactctctcccgggcaaatttgaggacatgtataagctgacctctgaactgctcggcgagggggcttacgcaaaggtgcagggcgcagtatccttacagaacggcaaggaatatgctgtgaagatcattgaaaaacaggcagggcacagcagatcgcgggtgtttcgggaagtagagaccttgtaccagtgccagggcaataagaacatactggaacttatagaattcttcgaggacgatacccgcttctaccttgtgttcgaaaagctgcaaggtggttctatactggcgcatatccagaagcagaagcactttaacgagcgggaagctagcagggtggtgagggatgtggctgctgcattagattttctccacacaaaggggattgcccatagggatctgaagcctgagaatatcttgtgcgagtctccagagaaagtatctccggtgaagatttgtgattttgaccttggaagcgggatgaagttaaataactcctgcactccgataactacacccgaacttacgacaccttgcggcagcgccgagtacatggctcccgaggtcgttgaggtgttcaccgatcaagcaacattttatgacaagagatgcgacctgtggtcacttggagtagtcctctacatcatgttatccgggtacccaccgttcgtgggacactgcggagcagactgtgggtgggataggggggaagtttgccgagtgtgccagaacaagctgttcgaatccatacaagaggggaaatatgagtttccagataaggactgggcccatatttcttcagaggcgaaagatctgatttctaaactgctcgtcagggacgccaaacagcgtctctctgcagcccaggtactgcagcatccgtgggtgcagggccaggctccagagaagggactcccaactccccaagttttgcagcggaattcttcaacgatggacctgaccctgtttgccgccgaagccatcgctctgaacaggcagctgagccagcacgaggaaaatgagctagccgaagagccagaagccctggctgatgggttgtgttccatgaagctgagcccaccctgcaagagcaggctcgcccgtaggagagctctggcccaggccggacggggcgaggatagaagtcctcccaccgccctgtag

SEQ ID NO: 194183 - DNA, 1398 bp, Artificial Sequence
  Description of Artificial Sequence: Synthetic coding sequence
atggtgagcagccagaagctggagaagcccatcgagatgggcagctccgagcctctgccaattgcagacggtgaccggaggcgcaaaaagaagcgccgaggacgtgccacagattccctccccgggaaattcgaagatatgtacaagttgactagcgagttacttggcgagggggcctatgctaaagtgcagggtgctgtgtccctgcagaatggaaaggagtacgcagttaaaatcattgagaagcaagccggacacagccgaagccgagtgttcagagaggtcgagacactgtaccaatgtcagggcaacaaaaatatcctggaactcattgaattcttcgaagatgacacacggttctatctggtgttcgaaaagttgcaaggtggcagtatcctggcccatattcaaaagcaaaaacacttcaatgagcgggaagccagccgagtggtgagagacgtggctgctgcactcgattttctgcataccaaggataaagtgagcctctgtcatctcggctggtctgcaatggcacctagtggactgaccgctgcccccacctcactggggtcaagcgacccccccacatcagccagccaggtggccggaactactggaattgcccaccgggatctgaaacccgagaacatcctgtgcgagagtcccgaaaaggtcagccctgttaagatttgtgattttgatctgggttctgggatgaaactcaataacagctgcactcctattacgactccagaattgactaccccatgcggttccgctgagtacatggccccggaggtggtggaggtgtttaccgaccaagctacgttctatgataagagatgcgacctgtggtctttgggtgtggtattgtacatcatgctctccgggtatccaccctttgttgggcactgcggcgccgactgtggctgggatcgaggtgaggtgtgcagagtgtgccagaacaagctctttgaatcaatacaggagggtaagtacgaattcccagataaggactgggcacacatcagtagtgaggccaaagaccttatctcaaaattactggtgcgtgacgccaagcaacgcctgtcagccgctcaagtcctccagcacccttgggtccagggccaggctcccgagaagggcctacccacacctcaggtacttcagagaaattctagtaccatggacctcactctctttgcagccgaggccattgcccttaaccgccagctatctcagcatgaggagaacgagctggccgaggagccggaggcacttgccgatggcctgtgttcgatgaagttgagccccccttgcaaatcccggctcgccagacgacgtgccctggcgcaggccggccggggggaagatagatcgcctcccacagccctctag

SEQ ID NO: 194184 - DNA, 1044 bp, Artificial Sequence
  Description of Artificial Sequence: Synthetic coding sequence
atggtgagcagccagaagctggagaagcccatcgagatgggcagcagcgaaccacttcccatagccgacggggatcgcaggcggaagaaaaaacgcagaggaagagccacagatagccttccagggaagtttgaggacatgtacaaactaacctccgagcttctcggtgagggcgcttacgccaaggttcagggagcggtctccttgcagaacgggaaggagtatgcagtcaagatcattgaaaagcaagccggccatagtcgttcaagggtcttccgggaggtggagaccctgtatcagtgtcagggaaataagaacattctggaattaatcgaattctttgaggatgatactagattctacctggttttcgaaaagttacagggtgggagcatcctcgctcacatccagaaacagaagcattttaatgaacgggaagcatcccgcgtggtaagagacgttgccgcagctctggacttcttgcataccaaaggcatcgcccaccgggatttaaagcccgaaaatatcttgtgcgagagcccagagaaggtctcacccgtcaagatctgcgattttgatctcgggtctggcatgaaactaaacaattcctgcacaccgatcactacccctgagcttaccacaccctgcgggagcgccgaatatatggcgcccgaagtcgtggaggtttttacagatcaggccaccttttatgacaagcggtgcgatctgtggtcgttgggtgtggtgctgtatattatgttaagcggttatccgccctttgtaggccattgcggggccgattgtggctgggatagaggcgaggtgtgtagggtgtgccaaaacaagctattcgagagcatacaggaaggcaaatatgagtttccggacaaggactgggcacacattagttccgaagcaaaagacctgatctccaagctactcgttagagatgctaaacaacggctgtccgctgcacaggtgcttcaacatccctgggtgcagggggagcagcagcataacggtcctgacgccctgagatcttag

SEQ ID NO: 194185 - DNA, 537 bp, Artificial Sequence
  Description of Artificial Sequence: Synthetic coding sequence
atggtgagcagccagaagctggagaagcccatcgagatgggcagcagcgagcctctgcccattgccgatggcgacaggcgtagaaagaagaagaggcggggacgagcaaccgactccctgcccggtaaattcgaagatatgtataaacttacttccgagctgctgggagagggtgcctacgccaaggtacagggggccgtgagcctgcagaatgggaaagagtacgctgttaaaattatcgagaaacaggccggacacagtagaagccgggtgtttagggaggtggagaccttgtatcagtgccaaggtaacaaaaacatcctggagcttatcgaattctttgaagatgataccagattttacctcgtgtttgagaaactccagggaggctccattctagcccacattcagaaacagaagcactttaatgaacgggaagctagccgcgtcgttagagatgttgctgcggccttagatttcttacataccaagggtatagcccaccgtgacctcaaacccgaaaatatcctatgctag

SEQ ID NO: 194186 - DNA, 306 bp, Artificial Sequence
  Description of Artificial Sequence: Synthetic coding sequence
atggtgagcagccagaagctggagaagcccatcgagatgggcagctcagagcccctgcctattgctgatggtgatcggcgacgaaagaagaaaaggcgcggacgcgccactgactcactacccggcaagttcgaagatatgtataaattaacttccgaactacttggggagggggcctatgccaaggtccagggggctgtttcgcttcagaatggtaaggaatatgcagtgaagattatcgaaaagcaggcagggcacagtcgtagcagagtgtttcgggaggtggagacactgtatcagtgttag

SEQ ID NO: 194187 - DNA, 303 bp, Artificial Sequence
  Description of Artificial Sequence: Synthetic coding sequence
atggtgagcagccagaagctggagaagcccatcgagatgggcagcagcgaacccctgcctattgcagacggcgaccgacgcagaaagaagaaacgccggggtcgcgccactgactctctccccgggaaattcgaggatatgtataagctgactagcgagcttctcggagagggtgcctacgcgaaggtgcaaggagccgtgtctctgcaaaacggcaaggagtacgcagtcaagatcattgagaagcaagccggccattctcggagtcgcgtcttcagggaggtggaaaccctttatcagtag

SEQ ID NO: 194188 - DNA, 402 bp, Artificial Sequence
  Description of Artificial Sequence: Synthetic coding sequence
atggtgagcagccagaagctggagaagcccatcgagatgggcagctccgagccactacctatcgcagatggcgatcggcggagaaaaaaaaagcggcgggggcgcgctaccgactcgctgcccgggaaattcgaggacatgtataagttgacttcggaactgcttggagaaggggcgtatgcaaaggtgcagggcgccgtttccctgcagaacgggaaagagtatgccgtgaagattattgagaagcaagctggccatagtcggtctagggtttttagggaggtagagaccctgtaccagtgccagggaaacaaaaacatccttgaactgatcgagtttttcgaggacgacacgagattctacctggttttcgaaaagctccagggcggaacatatagatag

SEQ ID NO: 194189 - DNA, 1398 bp, Artificial Sequence
  Description of Artificial Sequence: Synthetic coding sequence
atggtgcagaagaagcccgccgagctgcagggcttccaccggagcttcaaaggccagaatcctttcgagctggcattcagcctggatcagcctgaccacggggacagcgacttcggcttgcaatgcagcgcgcgcccagacatgcctgcctcgcagcccattgacattccggatgcaaagaagagggggaaaaaaaaaaagaggggcagggccaccgattctttctcgggccggtttgaggacgtgtaccagttgcaggaggacgttctgggcgaaggcgcacacgcaagagtgcagacatgcatcaacctgataactagccaggaatacgccgttaagatcattgaaaaacagcccgggcatatccggtctagggtgttcagggaagttgaaatgttatatcagtgccaaggtcatagaaacgtgctggagctgatagaattttttgaggaggaggaccgcttttacctggtatttgaaaagatgcggggtggatccattctgagtcatattcacaaacggcgccattttaacgaactcgaggcttctgtggtcgtacaggatgttgcaagcgccctggacttcctgcacaacaagggaatcgcccaccgggacctgaaacccgagaacattttgtgcgagcaccccaaccaggttagccctgttaagatctgcgatttcgatctcggttcaggaattaaactgaacggagattgttcaccaatctccacaccagagctgctgaccccttgtggatcggccgagtacatggctcccgaggtcgtagaagcattctctgaggaggcctccatctacgacaaaaggtgtgacctgtggtctctcggagttattctatatatactcttgagcggatacccaccttttgtgggcagatgcgggtctgattgcggatgggatagaggggaggcctgcccggcttgtcaaaatatgctatttgagtcgattcaggagggaaagtacgagttccctgacaaggactgggcacacatctcttgcgccgctaaggacttgatatctaagttactggtcagggatgcgaaacaacggctttcggcagctcaggtgttacaacacccctgggtacagggctgtgctcccgagaacacactgcccacaccgatggttttacagcgaaacagctgcgcaaaggatctgaccagttttgcagcggaggcaattgccatgaatcggcaactggctcagcacgacgaggatctggccgaagaggaagcggcgggacagggtcagccagtgctcgtgcgggcaacttctcgatgtctccagctttcacccccctcacagagcaagttagctcagaggagacagcgtgcctccctcagctccgcccctgtagtgctcgtcggcgatcatgcctag

SEQ ID NO: 194190 - DNA, 1245 bp, Artificial Sequence
  Description of Artificial Sequence: Synthetic coding sequence
atggtgcagaagaagcccgccgagctgcagggcttccaccggagcttcaagggccaaaatccattcgagctggcgttcagtctagaccagccggatcacggcgattctgacttcggtctccaatgttcagctagacccgacatgcccgccagtcagcccattgatatcccagacgctaagaaacgtggaaaaaagaaaaaacgcggtagggccaccgatagcttcagcgggcgatttgaggacgtgtatcagctccaggaggacgtactaggtgaaggagcgcatgcaagagtgcagacctgtatcaatctcatcacaagtcaggagtacgccgtgaagatcatagagaagcagcctggtcacatcagatccagagtgtttcgcgaagtcgaaatgctttatcagtgtcagggacaccgcaacgtgctggagctgattgaattctttgaggaagaagacagattctaccttgtgtttgagaaaatgcgcggcgggtcgatcctctctcacatccacaagaggcgccactttaatgagctcgaagcttcggtcgtcgtgcaggacgtggcgtctgctctggactttctccataataaggggatcgctcatcgggatctgaaacctgagaatatcctgtgtgagcatccaaatcaagtgtctccagtgaagatctgcgactttgatctgggaagtggaatcaagctgaatggcgactgttccccaataagcacccccgagcttctcacaccctgcggcagtgccgagtatatggctcccgaggtcgttgaggcattcagcgaggaggcatccatctacgataaacgctgcgatttatggagcctaggggtcatattgtatattctcctgagcggttaccccccattcgtcggcagatgtgggtctgactgcggttgggaccgcggtgaagcatgccctgcctgtcaaaacatgctgtttgaatcaatccaggaaggcaaatatgaatttccggacaaagactgggctcacataagctgcgccgctaaggacctcatctcaaagctgctggtgcgcgatgcaaaacagcggctcagcgccgcccaggtactgcagcacccttgggtccagggttgcgctccagagaacacacttcccaccccgatggtcctccagagatgggatagtcatttcctgctgcccccccacccttgccgaattcacgtacggccaggaggactggttaggactgtgactgtgaacgagtag

SEQ ID NO: 194191 - DNA, 1005 bp, Artificial Sequence
  Description of Artificial Sequence: Synthetic coding sequence
atgctgtaccagtgccagggccaccggaacgtgctggagctgatcgagtttttcgaggaggaagatcggttttatctcgtgtttgagaagatgcgcggcggaagcatcctctcccatatccataaacggcgacatttcaacgaactagaagcaagcgtggttgtccaggatgtcgcttctgcactggacttcctccacaacaaaggcattgcccaccgggatttgaagcccgagaatatcctgtgcgagcacccgaatcaggttagtccagtgaaaatctgcgactttgacttagggtcagggataaagcttaacggcgattgctcaccaatttcgactcccgagttgctgacgccttgcggcagcgccgagtacatggcacctgaggtggtggaggcattctccgaggaggcttccatctatgataagcgttgcgacctctggtcacttggagtgatcctttacatattgctcagcgggtatcccccatttgtggggcggtgcggctctgactgtgggtgggatcgcggggaggcctgtccagcttgtcaaaacatgctttttgaaagcattcaggaaggtaaatatgaatttcccgacaaggactgggcacacattagctgcgccgcgaaggatctgattagtaagctcttggtacgcgatgctaagcagagactttcagccgcacaggtcctgcagcatccttgggtacagggttgtgctccagaaaacacactgccaacccctatggtactccaaaggaactcatgcgccaaggatttgacgagcttcgctgccgaggccattgccatgaataggcaacttgcccagcacgatgaggatttggcagaggaggaagcagccggccagggacagcctgtgcttgtgagggccacatctaggtgcttgcagctgtctcctccttcacagtccaagttagcccaaagacggcaacgcgcgtcactctcatccgctccggtggtactggtgggagaccacgcctag

SEQ ID NO: 194192 - DNA, 1218 bp, Artificial Sequence
  Description of Artificial Sequence: Synthetic coding sequence
atgcccgccagccagcccatcgacatccccgacgccaagaagcgggggaagaagaagaagagaggtcgcgcaacagacagcttttcaggtcgcttcgaagacgtgtaccagctgcaggaggatgtcctgggcgaaggggcccacgcgagagttcagacctgcattaaccttatcacaagccaggagtacgctgtcaaaattatagagaagcagcctggacatatccggagccgtgtctttagggaggtcgaaatgctctaccagtgtcaggggcatagaaatgtgctcgaactaatcgaaaagatgcggggtggctccattctctcccacattcataaaaggcgccactttaacgagttagaggccagcgtggtcgttcaggatgtggcctctgcgcttgacttcctccacaataaagggattgcacatagagatctgaagcccgagaacattctgtgtgagcacccaaatcaggtgtcacccgttaagatctgcgactttgatctaggatctggaatcaaactcaatggggattgcagtccaatatctacccccgaacttctgacaccttgtggcagcgccgagtatatggcaccagaggtggtagaggctttctcagaagaggcctcaatctacgataagaggtgtgacctgtggtcactgggagttatactctatatcctcttatccggatatccccctttcgttgggcggtgtggtagcgactgcgggtgggatcgaggggaggcttgcccagcgtgccagaacatgctgtttgagtcaatccaggagggcaaatatgaatttcctgacaaggactgggcccacatcagctgtgcagctaaggaccttattagcaaattgctcgtgagggatgctaagcagaggcttagtgctgcccaggtgctgcagcatccctgggtgcagggctgcgcccctgagaacacacttcctactcccatggttctgcagaggaatagttgtgccaaagatctgacctcctttgctgccgaagcaatcgctatgaaccgacagttagcgcaacacgacgaggacctggccgaggaggaagccgcaggtcaagggcagcctgtcctcgtccgggccacctctaggtgcctgcaactaagtcctcccagtcagtccaaacttgcacagagacgccagagggcctcactttctagcgcccccgtcgtactggtaggtgaccatgcgtag

SEQ ID NO: 194193 - DNA, 2388 bp, Artificial Sequence
  Description of Artificial Sequence: Synthetic coding sequence
atgagcgcccggacccccctgcccaccgtgaacgagcgggacaccgagaaccacacctctgtcgatggatatacggaaccccatatccagccaacaaagagctcaagcagacagaacatccctcgctgccgtaattctattacctccgctaccgatgagcagccccacatcggcaactatcgcctgcaaaagacaatagggaaggggaactttgccaaggtcaagttagccaggcatgtgcttactgggagggaggtcgctgtcaagatcattgataagacccagttaaaccccacatccctgcagaaacttttcagggaggtccgaatcatgaagatactgaaccatcctaacattgtgaagctcttcgaagttatcgagactgagaaaactttatatttagtcatggaatacgctagtgggggagaggtgttcgattatctagttgcgcatggtcggatgaaggagaaagaggcaagagctaagtttcggcagatcgtgtccgccgtgcaatattgccaccagaaatatattgtgcatagggacctcaaggcggagaatctacttctggacggcgatatgaacataaagatcgctgattttggctttagtaatgaattcactgtggggaacaaactggatacattttgcggatctccgccttatgccgctccagagctatttcagggtaaaaaatatgatggacctgaggtggatgtgtggagtctgggagttatcctgtacactctcgtctcaggatcattgccttttgatggccagaatctaaaggagctcagggagagggtgttgcgcggaaagtacaggattccattttacatgagcacagactgtgagaatctgcttaaaaagctgctggtgttgaatcccattaaaaggggtagcctcgagcagatcatgaaggaccggtggatgaacgtcggccatgaggaagaggagctaaaaccatatactgaaccagaccctgactttaacgacaccaagcgcattgatatcatggtcaccatggggttcgcccgggatgagatcaatgacgcgttaatcaaccagaagtacgacgaggttatggccacctacatactcctggggaggaagccccctgaattcgaagggggcgaatctctctcatcgggaaatctctgtcaacgttcccgaccaagtagcgacctgaacaatagcactctacagagccccgcacatctgaaagtccagcggtcaattagtgcaaatcaaaaacaacggagatttagtgatcatgcagggcctagtattccacctgcggtgagctataccaaacggccccaggccaattcagtggaatcagagcagaaagaggagtgggataaagatgtggctcgaaaattgggatctacgacagttggcagtaagtctgagatgacagccagtcctctcgtgggtccggagcggaaaaaatcaagcacaatccccagcaacaacgtgtacagtggggggtctatggctcgaagaaacacttacgtgtgcgagagaacaacagatagatacgttgcgctgcagaacgggaaggactcttccttgacagaaatgtctgtgtcttctatttcttctgcaggttccagcgtcgcaagcgccgtaccttcagcacgtccacggcatcagaaatccatgtcaacatcaggacaccccatcaaggtcacactgccgactatcaaggacggtagcgaggcatataggcctggaactacccagcgcgtgccagccgcatcaccctcagcccacagcatttccacagctacacccgacagaactcgcttcccacggggatcttcttctcggtccacatttcacggtgagcagctgcgggaaagaagaagtgttgcttacaacggcccccctgcatcccctagtcatgagacaggggctttcgcacacgcacgccgaggcacctccacgggcatcatttctaaaatcactagcaagtttgtgcgccgtgaccccagcgaaggggaggccagtggccgcactgacacatctcggtccaccagtggcgagccgaaagagcgggataaagaagaaggtaaagactccaagcccagatccctaaggttcacttggtctatgaaaactacaagttctatggaccccaacgatatgatgagggagattcgcaaggtcctggacgctaataactgcgactatgagcagaaggagcggtttttgctcttttgtgtgcatggagacgccagacaagactccctggttcagtgggagatggaggtgtgcaaactgcctcgcctgtccctcaacggtgtgaggtttaagagaatcagtggaacttcaatcgccttcaagaacattgctagcaaaatcgcgaatgagctcaagctgtag

SEQ ID NO: 194194 - DNA, 2277 bp, Artificial Sequence
  Description of Artificial Sequence: Synthetic coding sequence
atgagcgcccggacccccctgcccaccgtgaacgagcgggacaccgagaaccacacctccgtggatgggtatacagagccccatatccagccaaccaagagttcctctcgccagaatattccgaggtgcaggaactccatcacaagcgcaaccgacgagcagccccatatcggaaactacaggcttcagaagactattggtaaggggaacttcgcaaaagtgaaacttgcccgtcatgtgctgactggacgtgaggtcgctgtcaagatcatcgacaagacacagctcaacccaactagcctccaaaagctgttccgagaagtgcgtattatgaaaatcctgaatcatcccaatatcggagaggtctttgattacctagttgcacacggcagaatgaaagaaaaggaagctagagctaagtttcgccaaatcgtgtctgccgtccagtactgccatcaaaaatacatcgtccaccgcgacctgaaagccgagaacctcctattggacggggacatgaatataaagatcgccgatttcggcttctctaacgaatttactgttgggaacaagctggacacgttctgcggctcaccaccttatgccgctcctgagttgttccagggaaagaagtacgacggcccagaggtggacgtatggagccttggcgtgattctctataccctggtgtcaggctcattgccgtttgatgggcagaatttaaaggaactgagagaacgcgtgctaagggggaaatatcgaatccctttttatatgtcaacggattgtgaaaatctgcttaaaaaactcttggtccttaaccccatcaagcgcggctccctggaacagattatgaaggaccgatggatgaatgttgggcacgaggaagaggagctgaagccttatactgaaccggacccagacttcaatgatactaagaggatcgacataatggtaacaatgggattcgcccgggacgagattaatgacgccctgattaatcaaaaatacgacgaagtaatggccacttacattttattgggccgcaagcctcccgaatttgaaggcggtgagtcactgagcagtggcaatttgtgccagcggagcaggccatcatcagacttgaacaactcaactctccagagccctgctcacctgaaagtccaacggtctatttcggccaaccaaaaacagaggcggttttccgatcacgcaggcccgagcatacctcccgcagtatcatatactaaaagaccacaggcaaactctgttgaatctgagcagaaagaggaatgggacaaagatgtcgcccgcaagctgggatccacaaccgtgggcagcaagtccgaaatgacggcaagcccattagtgggccccgaacgcaagaaatcctcaacgatcccctccaacaatgtctattcgggaggcagtatggcccgaaggaacacctatgtttgtgaaagaactaccgatcgatatgtggcgctgcaaaatggaaaagactcatcactgactgagatgagcgtcagtagcatcagctccgctgggtcctcagttgcgagcgctgtcccatcagcacgccccaggcatcagaagagtatgtccacctcgggtcacccaatcaaggtaacccttcccaccataaaggacggaagtgaagcctacagaccagggaccacccagcgcgttccagctgcgtccccctctgcccatagcatatcgacggcaacccccgacagaacacgcttcccacgaggctcctcatcccgcagtacatttcatggcgagcagttaagagagcggcgaagtgttgcctacaacggccctccagcttccccatcccatgagaccggggcctttgcacacgccaggcggggtacatctaccggcattatctccaagatcacgtcaaaattcgtgagacgcagtacctcaggtgagccaaaagagagagataaagaggagggcaaggactcaaaaccacggtctttgcggtttacgtggagcatgaaaactacctcctctatggaccctaacgatatgatgagggaaattcgaaaggtcctggacgctaacaattgtgattatgaacaaaaggagcgctttctcctgttttgcgtgcatggtgacgctaggcaggatagcctcgttcaatgggagatggaggtttgcaaactaccaagactgagtttgaatggcgttaggtttaagcgcatctccggcacatccatcgccttcaaaaacatcgccagcaaaattgccaatgagctcaaattgtag

SEQ ID NO: 194195 - DNA, 1938 bp, Artificial Sequence
  Description of Artificial Sequence: Synthetic coding sequence
atggagtacgccagcggcggcgaggtgttcgactacctggtggcccatggcagaatgaaggagaaggaggcccgagctaagtttcggcagattgtctcagctgtgcaatattgtcaccaaaaatacatagttcatcgcgacttgaaagctgaaaatttgcttctcgacggcgacatgaatatcaagattgcagatttcggtttctccaatgagttcacggtgggcaataagctggacactttctgtgggtcaccaccttacgcagcccccgaactctttcagggcaaaaaatatgatgggccagaggtggatgtgtggtctctgggagtaatcctttacactttggtgtcagggtctctgccctttgatggccagaatttaaaagagctgcgtgagcgtgtcctgcgtggcaagtaccgaatccccttttacatgtctacagactgcgaaaacctgttgaaaaagttactggtgcttaatcctattaagcgaggctccctggaacagatcatgaaagaccgctggatgaacgtgggacatgaagaggaggagctgaaaccttatacggaacccgatccagattttaacgatacgaagagaatcgacattatggtaacaatggggtttgcgcgcgacgagattaatgatgcgctgattaatcagaagtacgatgaggtcatggccacctacatcctgcttgggagaaagccacctgagtttgaaggcggagagagcctgagcagtggcaacttgtgccagaggtctagaccaagttctgatttgaataactcaaccctgcagtcacccgcacacctgaaggtgcaacgctcaattagcgcgaaccagaagcagagacgcttttccgaccacgctggacctagtatacctcctgctgtcagttacactaagcgtcctcaggccaactctgtggagtccgagcaaaaagaagagtgggacaaagatgttgcgcgcaaactgggatcgactacagtaggaagcaaatcagagatgactgccagtccactcgtcggccccgagcgtaaaaagtctagtacaatcccttctaacaacgtctattctggaggctctatggcccgcagaaacacctatgtctgtgaacggactacagataggtacgtggctcttcaaaacggaaaagattcctctctgaccgagatgtcagtcagtagtatttcttctgctggctcttccgtggccagtgctgtgccatctgccagacctcgacaccagaaaagcatgtccacctcaggccacccaataaaggtgactctccccacaatcaaagacggatcagaggcgtacaggcctgggaccacccagcgtgtgccagctgctagcccatctgcgcatagcatttccacagcaaccccagatcgcactcggtttcctagggggtcctcctcccgctcaactttccacggggagcagctccgcgaacggcgttctgtggcctataacggacccccagccagcccttcccatgagaccggagcctttgcacatgcacggaggggcaccagcacagggatcattagcaagatcacctcaaaatttgtgcggagatccacctccggcgagcctaaagagcgggataaggaggaaggaaaggactctaaaccacggtcactgaggttcacctggtccatgaagacgacctcctccatggatcctaatgacatgatgagggaaattaggaaggtgttagacgctaataactgcgattatgagcagaaggagcgcttcctgcttttttgcgtgcacggggatgcaaggcaagacagccttgtgcaatgggagatggaggtgtgcaagttaccccgcttaagcctgaatggcgtgcggtttaagagaatttcaggcacgtcgatcgcatttaagaacatcgcttcgaagattgcaaacgaattgaagctgtag

SEQ ID NO: 194196 - DNA, 2340 bp, Artificial Sequence
  Description of Artificial Sequence: Synthetic coding sequence
atgagcagcgcccggacccccctgcccaccctgaacgagcgggacaccgaacagcccactttgggtcatctggactcgaaaccctcatctaaatcaaatatgatcagaggacggaattccgccaccagcgctgatgaacaaccccatattggtaattacaggttgctaaagaccattggtaagggaaactttgccaaagttaagttggcaaggcatatactaaccgggaaagaggtggccgtgaaaatcatagataaaacccagttgaacagctcttctcttcagaagctgttcagagaagttcggatcatgaaggtgctcaaccatcccaatattgtgaaactgttcgaagtgatcgagaccgaaaaaaccctttacctggttatggagtacgccagcggtggcgaagtctttgactatctggtcgcccatggacgaatgaaggagaaggaggctcgagccaagtttcggcagattgtgagcgcagtgcagtactgtcaccaaaagttcatagtgcatcgggatctgaaggctgagaacctgcttctggacgctgacatgaatataaagatagcggactttggcttttccaacgaattcacatttggaaataaactggacactttctgtgggagtccgccatatgcggcccccgaactgtttcagggcaagaagtatgatggtcccgaagttgacgtgtggtctctcggcgtgatcctgtacaccctggtaagtggctcgctgcctttcgacggtcaaaacctgaaggagcttcgagaacgcgtcctccgcgggaagtacaggatccctttctacatgtccacggattgcgaaaacttactgaaaaaattcctgatcctcaatccaagtaagagagggactcttgagcagatcatgaaagaccggtggatgaatgtgggacatgaagacgacgaattgaagccttatgtggaacccctcccagactataaagaccctcgtcgaacagagctgatggtgtcaatgggctatactcgcgaagagatccaagactcattggtgggacagcgctacaatgaagtgatggccacatacctgctcctgggctacaaatctagtgaactggagggagataccatcactctcaaaccaaggccaagcgctgatttgaccaatagttccgctccttcccctagccacaaagtacagaggtcagtgtccgcaaatccaaagcaacggagattcagcgaccaggctgcgggtccagctatccccactagcaacagctatagtaagaagacccagagcaacaatgccgagaataaacggcccgaagaagaccgcgagtccggaaggaaagctagttctactgccaaagtgcccgcaagccccctgccaggcttggagcggaaaaagactacacctactccctcaactaactctgttctatctacttcaactaatcggtcccggaacagcccactgctagaaagagcctctctaggccaagctagtattcagaatgggaaggactcactgaccatgccagggtcccgggcttccaccgcaagcgcctctgccgctgtgtctgctgcaaggcccaggcagcaccagaagtctatgtcggcttctgtgcatcccaataaagcgtcaggcctcccgccaacggaatcaaactgcgaggtacctcgaccatccaccgccccgcagcgggtgcccgtggcttctcctagcgctcataacattagtagctcaggcggagccccagaccgcactaacttccccaggggcgtcagcagccggtccacctttcacgctggccagctgcgccaagtccgcgatcagcaaaacctaccttacggggtgaccccagcgagccccagcggtcacagccagggtcgccggggcgccagtgggtcgatcttctccaagttcacttcaaaatttgtgcgaagaaatttaaatgaacctgagtctaaagatagagtggagacactgagacctcatgtggtcggatcaggcgggaacgataaggagaaagaggagtttagggaggccaaaccacgcagtctccggttcacatggagtatgaagaccacatcctcaatggagcccaacgagatgatgcgcgaaattcgcaaggtgctggatgcaaatagttgtcaatctgagctccatgagaagtatatgctgctctgtatgcacggtacccccggacacgaagatttcgtgcagtgggaaatggaagtgtgcaaactgccccggctcagcctaaacggcgtgcgctttaagagaatttccgggacttccatggctttcaaaaatatcgcgagcaagattgccaacgaacttaaattgtag

SEQ ID NO: 194197 - DNA, 2130 bp, Artificial Sequence
  Description of Artificial Sequence: Synthetic coding sequence
atgagcagcgcccggacccccctgcccaccctgaacgagcgggacactgagcaacctaccctgggccatctggatagtaagccttcatcaaagtctaatatgatccgaggcagaaactccgctacctctgcagacgaacagcctcatatcggaaattacaggctcttgaagacaatcgggaagggaaactttgctaaggtgaaactggcaaggcacatcctgaccggcaaggaggtggccgtgaagattatcgataaaacgcagctcaactccagcagtttgcagaagctgtttcgcgaggtgaggattatgaaagtgttaaaccatccaaacatcgtgaagctctttgaagtgattgaaacggagaaaacactgtatttggttatggaatatgcctccggtggagaggtattcgactacctggtggcgcacgggcggatgaaagagaaggaagctcgtgccaaatttcgccagatcgtgtcagcagtgcagtattgccaccagaagtttatagtgcatagagacctgaaagctgagaacctgcttcttgacgcggatatgaatatcaagattgccgatttcggattttcaaatgaattcacatttgggaacaaactcgatacattttgcggctctccaccatacgcagctccggaattattccagggtaagaaatacgatgggccagaggtggatgtatggagcctgggggtgattctatatacactcgtgtccggtagtcttccattcgacggccagaacttaaaggagcttcgtgaacgggtgctgcgtggcaagtataggatccccttttatatgtctaccgactgcgagaaccttctgaaaaaatttctgattctgaaccctagcaaacgcggaaccctggagcagattatgaaggaccggtggatgaacgtcggacatgaagacgacgaactgaagccgtacgtggagccgcttccagactacaaggatccacggaggaccgagctgatggtgagcatggggtatacccgggaggaaatccaggattctctcgtgggccagcgatacaatgaagtgatggctacctacctgttactcggatataagtccagcgagctcgagggcgatacaatcacactgaaaccaaggccttcagcagacctgaccaattcctcagccccttccccaagccacaaagttcagaggtccgtctctgctaaccctaagcagaggagattcagcgaccaggctggcccggcgatacctactagtaatagttattccaagaagacccaatcgaataacgccgagaacaagagaccagaagaagacagagagagcgggcgtaaggcctcgtcaacagctaaggtgcccgcatcacccctcccggggttggaacgaaaaaagacaacccccaccccctctacgaatagcgtcctaagcacatccactaatagatctagaaattcacccctgctggaacgcgcctctctcggccaggcctcaatccagaatggtaaggactctacagctcctcagcgcgtgcctgtggcaagcccgtcggctcacaatatttccagctctggcggcgcacccgatagaacaaatttcccaaggggcgtctcatcccgctcaacctttcacgccggacagctgaggcaggtccgcgatcaacagaacctaccctatggggtgaccccagcatctcctagcggtcattcacaaggaaggagaggggcttcagggtcaatcttttcaaagttcacctccaagttcgttcgacggcctcatgtggtcggcagtggcgggaacgacaaagagaaggaggagtttcgagaagctaaaccgcgttcactcagattcacctggagtatgaagacgacttccagcatggagcctaatgaaatgatgcgggaaatcagaaaagtgctggatgccaactcctgccaatccgagttgcatgaaaaatacatgctgctctgtatgcacggaaccccgggtcacgaggatttcgtccagtgggaaatggaggtgtgcaaactcccacgcttgtccctgaacggggttagattcaaacggatcagcgggacgtcaatggcattcaagaatatcgcttctaagattgccaacgagctcaaactctag

SEQ ID NO: 194198 - DNA, 2160 bp, Artificial Sequence
  Description of Artificial Sequence: Synthetic coding sequence
atgagcagcgcccggacccccctgcccaccctgaacgagcgggacaccgagcagcccaccctgggtcatctggatagcaaaccttcgagtaagagtaacatgattaggggcaggaactccgctacctctgcagacgaacagccgcacatcgggaactacaggctgctgaagacaatagggaagggcaatttcgctaaggttaaactagcccgccacatcctcaccgggaaggaagtggccgtgaaaataatcgataagactcaactgaattcaagctcgctgcagaagctgttccgtgaagttcgaataatgaaggtcctgaaccaccccaacattgttaagctcttcgaagtgatagaaacagaaaaaaccctgtatctcgtgatggaatatgcctctggaggagaggtgttcgactacttagtggcccacgggagaatgaaggagaaagaagctcgggctaagttcaggcagatcgtatcagcagtccaatactgtcaccagaagtttattgtccaccgagatctgaaggctgagaaccttctactcgatgccgatatgaacattaaaatcgcagacttcggctttagcaatgagttcactttcggtaacaaactcgacaccttttgtgggagtcccccgtacgccgccccagagcttttccaaggcaaaaagtacgatggcccggaggtagacgtctggagtctcggggtgattctatatacgctggtgagtgggtctctcccttttgacggccagaacctgaaggaactgcgtgagcgggtgctccgaggcaaatacagaatcccattttacatgtctaccgattgtgagaatctgctgaagaagttcctcatcttgaacccgtcgaagagagggaccctcgagcagattatgaaagatcggtggatgaacgtgggccacgaagacgacgagcttaaaccctacgtggagccactccctgattacaaggacccgaggagaacagagctgatggtgtcaatggggtatactcgcgaggaaattcaggattccctggtgggtcaacgctacaatgaggtaatggcaacctatcttctgctgggttacaagtcctcagaactagagggggatacaatcactctcaagccccgtccaagtgcggacttgactaattcgtccgccccgtctccatctcacaaggttcagcgctccgtgtccgccaatcctaagcagcggcggttttccgaccaggccgccggacccgccatcccaaccagtaattcatactcaaagaaaacccagtctaacaacgcagagaacaaacgaccagaagaggaccgggagtccgggcgtaaagcctcaagtacggccaaagtccctgcctcccctctgccggggctggagaggaagaaaacaacccctacccctagtacaaatagtgtcttaagcacatctacaaaccgatcacggaactcacctctgttggagagagcaagcctcggacaggccagtatacagaatggaaaggacagtactgcgccgcagcgggtgcctgtggcttcacctagtgctcacaatatttcctccagcggcggagcacctgatagaaccaactttcctcgcggagtttctagccgcagtacgttccacgcaggacagctcagacaggttcgggatcagcagaatttgccgtatggagttacccccgcttctcctagtggtcactctcagggaaggaggggagctagtggcagcatcttctctaaattcacatcaaaatttgttagacggaatctgagttttaggtttgccagacgcccccacgtagtcgggtctggcggcaacgacaaagaaaaagaagagttcagagaagcaaagccccgcagcctccgctttacttggagcatgaaaaccacaagtagcatggagcctaacgagatgatgcgagagatccgcaaggtattagatgcaaacagttgtcaatcggaattgcacgaaaagtatatgcttctgtgtatgcacggtaccccaggccatgaggattttgtacagtgggaaatggaggtgtgcaagttgcccaggttatcattaaatggcgttcgctttaagcgcattagcggtactagcatggcatttaaaaacatagcaagcaaaatcgcaaacgagctcaaattgtag

SEQ ID NO: 194199 - DNA, 2322 bp, Artificial Sequence
  Description of Artificial Sequence: Synthetic coding sequence
atgagcagcgcccggacccccctgcccaccctgaacgagcgggacaccgagcagccaacccttggccacctggactctaagccgtcatcaaaaagtaacatgatccgtgggagaaacagcgccacctctgcggacgaacagcctcatatcggaaattatcgcctgttgaaaactataggcaaaggcaattttgccaaggttaaactggcccgccacattctcactggcaaggaggtggccgtgaagatcatcgacaaaacccagctgaattcaagctccctccaaaaactgtttagagaggttagaatcatgaaggtgctcaatcaccctaacattgtgaagctgtttgaagttatcgaaaccgaaaaaactctgtacctggtcatggaatacgcctcagggggggaagttttcgactacctggttgcccatgggagaatgaaggagaaggaggccagagcaaagttccgccaaattgtgagcgccgttcagtattgccaccaaaaatttatcgtgcatcgcgacctgaaagccgagaacttgcttttggatgcagatatgaacatcaaaattgctgatttcggcttttccaacgaatttaccttcgggaataaactcgataccttctgcgggagccctccatatgccgcaccagagctgttccaggggaaaaaatacgacggaccggaagtggatgtgtggtcgcttggagtgatcctttacacccttgtcagcggaagtctcccttttgatggacagaacttgaaggaactgagagaaagagtcctgcggggcaagtaccggatccccttttacatgagtaccgattgtgagaaccttctaaagaagtttctgatcctcaatccatctaagcgaggaacactcgaacagattatgaaggaccggtggatgaacgtgggccatgaagatgatgaactgaaaccatacgtcgagcctctgcctgactacaaagatccaagaaggacggagttgatggtcagcatgggatacactcgcgaggagattcaggattctctggtcgggcagaggtacaacgaagtgatggcgacctatctgctgctcggttacaaatctagcgaactagaaggcgacactatcaccctgaagcctcgcccgtcggctgatctgaccaacagctctgccccctcgccctcacataaagtccagcgctccgttagtgccaaccccaagcagcggcgtttctccgaccaggccgccgggcccgccatccccactagcaattcttactcaaagaagacccaaagtaacaatgccgagaataaaagacccgaggaggatcgggaatccgggcgcaaagcctcctccactgctaaagttccggccagccctctgcccgggcttgaaaggaagaagaccacccccactccgtccaccaactcggtgctgagcacttccactaacaggagtaggaactcccccctgctggaaagagccagtctgggtcaagcatcaattcagaatgggaaggattcgctcaccatgccaggttcacgagccagtactgcatctgccagtgctgccgtcagcgctgcccgtccacggcagcatcagaagtctatgagcgcaagcgttcatccaaataaagcttccggtttacctccgacagagagcaactgtgaggtcccacgcccaagcacggcaccccagagagtgcccgtagcatcgccaagcgcccataatatctcatcctctgggggtgcccccgaccggactaattttcctcggggagtatcctcccggagcacctttcatgcagggcagttacgacaggtgcgggatcagcaaaatctgccgtacggggtgacccccgccagcccatctggacacagccaggggcggcgcggtgccagcggttccatcttttcaaagtttacgtcaaagttcgttcgcaggaacctgagttttcggtttgcaagacgcccacacgttgtgggctcaggaggcaatgacaaggaaaaggaggagttccgagaagccaagccgcgttccctgcgctttacatggtccatgaaaacaacctcgagcatggagcctaacgagatgatgagagagatccggaaggtactggacgccaactcctgccagtctgagttacacgaaaagtacatgctgttgtgcatgcacggaacaccaggtcacgaggacttcgtccagtgggagatggaagtctgtaagctgcctcgcctgtccctgaatggcgtgagatttaaacgcatctctggaacctctatggccttcaagaacattgcctccaaaattgcaaacgagctgaaattgtag

SEQ ID NO: 194200 - DNA, 2076 bp, Artificial Sequence
  Description of Artificial Sequence: Synthetic coding sequence
atgatccggggccggaacagcgccaccagcgccgacgagcagccccacataggcaactatcggctcctgaagacaatcgggaagggcaattttgccaaagtgaagcttgcccgccacatactcaccggtaaagaggtagccgttaaaatcatcgacaagacacagcttaactcatcgagcctccagaagctgttccgtgaggttcgtatcatgaaggttctaaatcaccccaatatcgtcaagctgttcgaagttatcgagactgaaaaaaccttgtatcttgtcatggaatatgcgtctggcggagaagtgtttgactacctggtggctcatggcagaatgaaggagaaggaggccagggcgaagttccggcagattgtctcggcagtacaatattgtcatcagaagttcatcgtccatcgggatctgaaggctgagaacctgcttttggacgccgatatgaatatcaaaattgccgattttggcttctctaacgaattcactttcggtaacaagttagacaccttctgcggcagcccaccttacgctgcccccgagttattccagggaaagaaatacgacggacctgaagtagatgtgtggagcttaggagtgatactttacacattggtgtccggaagtttgccattcgatggacagaacctaaaggagttgcgcgagcgcgtgcttagagggaaatacaggatccccttttatatgagcaccgattgtgagaacctgctaaaaaaattcctaatcttgaacccctctaagcgggggactctggagcagattatgaaagatcgctggatgaacgtcggacacgaggatgatgaactcaagccctacgtcgagcccttgcccgattataaggatccgcggcggactgaactaatggtgtccatgggctacacacgggaagaaatccaagactccttagtgggacagcgttacaacgaagtcatggccacctatcttttactcggttacaagtcatccgaattggaaggggacaccatcaccttaaaaccacggccctcagcggacctgacgaatagttctgccccctcgccatcccacaaagtacaacgatcagtgtcagctaacccaaaacaacgccggtttagtgaccaggctgggcccgcaatacccacctcaaactcctacagcaaaaagactcagagcaacaacgcggagaataagaggccagaggaagatcgcgaaagcgggaggaaggcttcgagcaccgcaaaggtgcctgcctctccgcttcctggattggagcgcaagaaaacgactcctacgccaagcactaattcagtgctctcgacttctaccaataggtccagaaattcccctctgttggaacgggctagcctggggcaggcgtccatccagaacggtaaggacagcacagctccacaacgcgtgcctgtagcatcccctagcgctcataatatttcctcttccggcggagcacccgataggactaactttcctaggggggtgagctctaggtccaccttccatgctggtcaactcaggcaggttagagaccagcaaaatctaccctacggagtgactcccgcctctccttcagggcacagccaggggcggcgcggggcctctggctcaatctttagcaaatttactagtaagtttgtgagacggaacctgaatgagcccgagtctaaggaccgggtagagacactgaggcctcacgttgtgggaagcgggggcaatgataaggaaaaggaagaattcagggaagccaaaccacggagcttgcggtttacctggtccatgaagaccactagttccatggagcccaatgagatgatgcgcgagatccgtaaagtgttagatgcgaacagctgccagtctgaactccacgagaaatatatgctgctttgtatgcacggcacgcccgggcacgaggattttgtgcagtgggagatggaggtctgtaagcttccacgtctgtctctgaacggtgtgcgcttcaaacggatcagcgggacttctatggcattcaagaatatcgctagtaagatagcaaacgagctgaagctgtag

SEQ ID NO: 194201 - DNA, 2367 bp, Artificial Sequence
  Description of Artificial Sequence: Synthetic coding sequence
atgagcagcgcccggacccccctgcccaccctgaacgagcgggacacagagcaacctacactgggtcaccttgattccaaaccgtcttccaaaagcaacatgatccgcggcaggaacagcgctactagcgccgacgaacagccacatatcgggaactacaggctcttaaagactattgggaaaggtaactttgccaaagtgaagcttgctcggcacatcttgacaggcaaggaggtggcagtgaagattattgacaagacccagctaaattcttcgagcttacagaagctgtttcgggaagttagaataatgaaggtgctgaaccacccaaacatagtaaagctttttgaggtgatagaaacagaaaagacactttatctcgtcatggaatacgctagcggcggcgaggtgttcgattacttggtggctcatggccggatgaaggagaaggaggcgagagcgaagtttcgacagattgtcagcgccgtccagtattgtcaccaaaagttcatagtccacagggatcttaaggccgaaaatctgctgctggacgctgatatgaacatcaaaatagcagactttggctttagcaacgagttcacatttgggaacaaacttgataccttttgcggttcccccccatacgctgctcccgaattgttccaggggaagaaatatgacggccccgaggtggatgtctggtcgctcggcgtcattctgtacaccctggtatctgggtctcttcctttcgacggccagaacttaaaagaactgagggaaagagtgctccgtggcaaatataggatccccttctacatgagtactgactgcgagaatctacttaagaagttcctgatactcaaccccagcaaacgaggtacactggagcaaattatgaaagaccgctggatgaatgttgggcacgaggatgacgaactgaagccctatgtcgaacccttgcccgattacaaggaccctcggagaactgaactgatggtttccatgggatatacgagagaggagatccaggattctctcgtcggacagagatataatgaggtgatggctacctacctgctgctgggctacaaatctagtgagctcgagggggacaccattactctgaagcctaggcccagtgcggatcttaccaattcgtcagcacccagcccttcacacaaggttcagaggtctgtgtccgcaaatcctaaacagagacggttctcagaccaggccgcgggacctgctataccgacgagtaactcttacagcaagaagacacagtctaataatgccgagaacaaaaggcccgaagaggaccgcgagtctggacggaaggctagctcaactgcaaaggtcccagcaagtcccctccccggactggaacggaagaaaacaactccaacccctagcaccaactcagttttgtctacgtctacaaacagaagccgcaactcccccttactggaacgggcatccctgggacaggcatccattcagaacggaaaagattccctgaccatgcccggttccagagcgtctactgcaagcgcttcagctgccgtgtctgcggcccgcccccgtcaacatcaaaagagcatgtctgccagtgtgcatcccaacaaggcctccgggctgcctcccaccgaatccaattgcgaagtccctaggccatcgactgctccccaacgggtccccgtggcaagcccaagtgcacacaatatcagtagctctggcggtgcgccagaccgtaccaactttccccgcggggtgtcctcgaggtcaacattccacgccggacagttgcggcaggtgcgtgaccagcagaatctcccctatggagtgacacccgccagccccagcggccatagccaaggccggcgtggtgcctccggctcaattttcagcaaatttacaagcaaattcgtgcggcgcaatctgtcttttagattcgcccgacgcaacttgaacgagcctgaatcaaaagaccgggtagagacgcttaggccccacgttgttggctcaggtggtaatgacaaagaaaaagaggagtttcgagaagcaaagcctaggtcactacgattcacctggtccatgaagactaccagtagtatggagccaaacgagatgatgcgcgaaatccgcaaggttctggacgccaactcttgccagtcggagcttcatgaaaaatatatgctcctatgcatgcacgggacaccggggcacgaggacttcgtccagtgggagatggaggtctgtaaattgcctcggctctctcttaatggggtacgcttcaagcgaatcagtggcacaagtatggcattcaaaaatatcgcaagtaaaatagcgaatgaactgaagctttag

SEQ ID NO: 194202 - DNA, 2076 bp, Artificial Sequence
  Description of Artificial Sequence: Synthetic coding sequence
atgatccggggccggaacagcgccaccagcgccgacgagcagccccacattgggaattatcggcttttaaagactattggcaaggggaattttgcgaaggtgaaattggcccgtcacatccttactggcaaagaagtggctgttaaaatcatcgataaaacacagctgaatagttcctctctccagaagctctttcgagaggtccggattatgaaggtactaaaccacccaaacattgtgaaactttttgaagtgattgagacggaaaagaccctttaccttgtgatggaatacgcaagcggtggcgaagtttttgattacctcgttgctcacgggcgtatgaaggagaaggaggctagggccaaatttaggcagatcgtgagtgccgtccagtactgtcatcaaaagttcattgtacaccgggatttgaaggcagaaaacctcctgctggatgccgacatgaacatcaagatcgctgacttcgggttttcgaacgagtttacattcggtaataagctcgataccttctgcgggagtccaccttatgcagctccagagttgtttcaggggaaaaaatatgatggccccgaagtggatgtttggagcctcggtgtcatcttgtataccctggtctctggatctctgcctttcgacggccaaaacttgaaagaattaagggaaagggtgctcagaggcaaatatcgtattcctttctacatgagcactgactgcgagaacctcttgaaaaagtttttaattctgaacccctccaagcgggggactctcgagcaaatcatgaaggaccgatggatgaacgttggccacgaggacgacgaattaaaaccatacgtcgagcctctgccggattacaaagatccaaggagaactgagctgatggtgtccatgggctacacacgggaagagatccaggacagccttgtagggcagagatataatgaagttatggccacatacctgttgctggggtacaagtcttctgaactagaaggagatactattaccctaaagccgagaccttccgccgacctgactaacagctcggccccatcgccgtcacataaggttcaacgcagtgtctctgctaatcccaagcaacgccgattcagcgaccaagctgggcccgccattcctacctccaattcatatagtaaaaagacacaatccaataatgcagaaaataaaagacctgaggaagacagagaatccggacggaaggcctcctccaccgccaaagtgccggcttccccactgccagggttggagcggaagaagaccactcctacaccctcaaccaattctgtcctgagcacctctaccaatcgaagccggaactctccgcttctggagcgggctagcctcggacaagcgtcaatccaaaacggaaaagactccactgctcctcaacgcgttcccgtggcaagcccttctgcccataacatctcttcaagtggcggtgccccagaccgcaccaattttccgaggggcgtgagttcaaggagcactttccatgccggacagctcagacaggtgagagatcagcagaatttaccttatggagtgacgcctgccagcccatctgggcactcccagggtcgcagaggagccagcgggtctattttttccaagtttacatccaagtttgtgcggcgcaatttaaatgagcctgaatcaaaagaccgggtcgaaacgctgagaccccacgtggttggctccgggggaaacgataaggaaaaagaagagttccgtgaagcaaagccaagatctcttcgctttacctggtctatgaagaccacgtcgagcatggaacctaacgaaatgatgcgcgaaataaggaaggttctcgacgccaattcttgccagtctgagctccatgaaaaatacatgctgttgtgtatgcacggaacacctggtcatgaggatttcgtgcagtgggagatggaagtctgcaaacttcccagactatcactgaatggagtgcggttcaagaggatatctggcactagtatggcctttaaaaatatcgcaagtaaaatagccaacgagctaaaactctag

SEQ ID NO: 194203 - DNA, 2205 bp, Artificial Sequence
  Description of Artificial Sequence: Synthetic coding sequence
atgagcagcgcccggacccccctgcccaccctgaacgagcgggacacagagcagcccacactaggtcatctcgacagcaagccgtcctctaagagcaatatgatcagaggacgcaacagcgcaactagcgctgatgaacagccccatatcggaaattaccgcttgctgaagaccatcggaaaaggtaacttcgcaaaggttaagctagcaaggcatatcctgacgggaaaggaggtggctgtgaaaatcattgataagactcagcttaattccagtagccttcagaaattgttccgtgaggtgcgaatcatgaaagttctgaaccacccgaacatcgtgaaactgtttgaggtgattgagacggagaagacgctgtacctcgtcatggagtacgccagcggcggggaagtgtttgactacttagttgcgcacggtcgtatgaaggagaaggaggccagagcgaagtttcgacagatcgtgtccgcggtacagtattgtcaccaaaagtttatagtgcaccgggacctgaaagcagagaatctcctgctggatgccgacatgaacatcaaaattgccgatttcggttttagtaacgaattcacttttggaaacaagctggacacattctgcggcagccctccttacgctgcgcctgaactcttccagggcaaaaaatatgacggcccagaggtagatgtttggtcactaggcgtcatcctctacacactggtttctggctccctgccctttgacggacaaaacctcaaggagctgagagaacgtgttctcagggggaaatatagaatccctttctacatgagtacggattgcgagaacctcctgaagaagttcctgatactgaacccgagcaagcgtggcacacttgagcagataatgaaggatagatggatgaacgtgggacatgaggatgacgagctaaagccatacgtcgaaccactgcccgactataaggatcctcgaaggactgaactaatggtgtctatggggtacacccgcgaagagatccaagatagcttagtcggtcagcgttataacgaggtgatggcgacgtatttactgctgggctacaaatctagtgaactggagggggacacgattaccctgaaacctagacctagcgccgatctcaccaatagtagcgccccgtccccctcccataaagtccagagaagtgtctcagccaacccaaagcagaggcgattctccgaccaggccgctgggccagctatccctactagtaacagttacagtaaaaaaacccaatctaacaacgcggagaataaacgacctgaagaggaccgtgaatcaggccggaaagccagttccactgcaaaagtgccagcctctccattgcctggactggagcgaaagaagactacgcctaccccctctacaaactcagtactatctacaagcaccaatcggagcaggaactctccactgctggagagggcgtctcttggccaggcttccattcagaatgggaaggacagcaccgctccccagagggtgcccgtggctagtcctagcgcacacaacatttcaagcagcggaggcgcccccgatcgaacaaatttccctagaggggtgagcagcagatcgacgttccatgccgggcagctgagacaggtgagggatcagcagaacttaccatatggggtgaccccagctagtccttctggacacagtcaaggaaggaggggtgcctctggctccatattttctaaattcacgagtaaattcgttaggcgaaacttgagtttccgttttgctagacgcaatttgaatgagcccgaatcaaaggacagggttgaaacattgaggccccacgttgttggttctggcgggaatgataaagagaaggaggaatttcgggaagctaaaccaagatcgttacggttcacctggtcaatgaagactacaagcagtatggagccaaatgaaatgatgagagagatacggaaagtgctggacgccaatagctgtcagagcgagctccatgaaaaatacatgcttctctgcatgcacggtacgcccggtcacgaagacttcgtacagtgggagatggaggtttgtaagttaccccgccttagtcttaacggggtgaggttcaagcggatcagtggaacctcaatggccttcaaaaacatcgcaagcaagatcgccaacgagctgaagctgtag

SEQ ID NO: 194204 - DNA, 2343 bp, Artificial Sequence
  Description of Artificial Sequence: Synthetic coding sequence
atgagcagcgcccggacccccctgcccaccctgaacgagcgggacacagagcagccaacactcggacacctcgattctaaaccctcatctaagtccaatatgattcgcgggcgcaactccgccaccagtgccgacgagcagcctcatatcggcaactataggttgctcaagacgattggcaaggggaactttgcaaaggtgaagcttgcacgacacatcttaactggtaaagaggtggccgtgaagattattgacaagacacagctcaattcatcatcgttgcagaaactgtttcgggaagttaggatcatgaaggttctgaaccacccaaatatcgtcaagcttttcgaagtgattgagacagaaaaaacactttacctggtgatggaatatgcctcaggaggcgaagtgtttgattacttggttgcacacggcagaatgaaggagaaggaggcacgtgccaaatttaggcaaattgtaagcgccgtgcaatattgtcaccaaaagtttatcgtccatagagatctcaaagccgagaatctgctcctggatgccgatatgaatatcaagatcgccgactttggcttctccaatgaatttacctttggcaataagcttgacaccttctgtgggtccccaccatatgccgccccagaactgtttcagggaaaaaagtatgacggccccgaagtggatgtttggtcgcttggggtgatcctgtacaccctcgtgtctggcagccttcccttcgacggccagaatcttaaggagctgagagagcgcgtgctcagggggaagtatcgcatcccgttctatatgagcacagattgcgagaacctacttaagaaatttctgattctgaatcccagcaagagaggaaccctggaacagatcatgaaggatagatggatgaatgtcggtcatgaggacgatgaactgaaaccttatgtggagcccctgcctgattacaaagacccacgccgcactgaattgatggttagcatgggatacacacgcgaggagatccaggactcactggtcggccagagatataatgaagttatggcaacatatctgctattgggctacaagagctctgaactggaaggggatacaataacactaaagccacgcccatccgccgacctgaccaacagttccgctccctcaccaagccataaagttcaaaggtcagtgtctgccaatcccaagcagagacgctttagcgaccaggccggtcctgccatccccacctcaaacagctattctaaaaaaacacaatctaacaacgccgagaataaaagacctgaggaggatcgcgagtctggtcgaaaagcttcctccacagccaaggtgcctgcgagccccctgcctggccttgagcgcaagaagacgactcccacacctagtacgaactctgtcctgtccactagcacaaacaggagtcggaattctcccctgctcgaacgagcctccctggggcaagccagcattcagaatgggaaagattcactgactatgcctgggtcaagagcctccaccgcgtcagcctccgccgcagtatcggccgccaggcctcgtcagcatcagaagtctatgtcagcaagcgtgcacccgaacaaggccagtggcctgccaccaacagagagcaattgtgaggtcccacggcctcgtcaggtgacagctcctcagcgggtgcctgttgcctctccttcggcgcacaacatctcttccagcggtggggcgcccgacaggaccaacttcccaagaggcgtctcaagtagatcgaccttccatgctgggcagctgagacaggttcgcgatcaacagaatctgccatatggcgttacaccggcctctccaagtgggcattcccagggtaggaggggggctagcggcagcatcttttctaagtttacaagcaaatttgtgaggcgcaacctcaacgaaccagaatccaaagatcgggtggagaccttgcggcctcatgtcgtgggttctggaggcaacgataaggaaaaggaagaatttagagaggccaaaccacgtagcttgcggtttacttggagtatgaagacaacctcctcgatggagcccaacgaaatgatgcgcgaaatcagaaaggtgctcgatgctaattcatgtcaaagcgagctgcacgagaaatatatgcttctctgtatgcatggaactcctggccacgaggactttgtgcaatgggagatggaggtctgcaaactgccgagactgtctttgaacggggtacggtttaaacgcattagtggcacgtcaatggcctttaagaacatagcttccaagattgctaacgaactaaaattatag

SEQ ID NO: 194205 - DNA, 126 bp, Artificial Sequence
  Description of Artificial Sequence: Synthetic coding sequence
atgagcagcgcccggacccccctgcccaccctgaacgagcgggacactgaacagccaactttgggtcatctggactccaaaccctccagcaaatctaacatgatacggggacggaatagtgcttag

SEQ ID NO: 194206 - DNA, 2175 bp, Artificial Sequence
  Description of Artificial Sequence: Synthetic coding sequence
atgagcagcgcccggacccccctgcccaccctgaacgagcgggacaccgaacagccgacactgggccatttagattccaagccgagttctaaatcgaatatgatacgtggccgtaattctgccacaagtgctgacgaacaacctcacatcggcaactacagattactgaagaccataggaaaaggcaactttgcaaaggttaagctcgcgaggcacatcctgacgggcaaggaggtggccgttaaaatcatagacaaaacccagctcaatagcagctcactccagaaattatttcgcgaagtcaggattatgaaagtattaaatcacccaaatattgtgaagctctttgaggtaatcgagactgagaaaacactgtacttggtcatggagtacgcctctgggggtgaagtatttgattaccttgtggcacacgggcgcatgaaggagaaggaagctcgtgccaagttcagacagattgtatccgccgtacagtattgccaccagaaattcatcgtccaccgggatctgaaggccgagaatctccttctagacgccgacatgaatataaaaatcgccgacttcggcttttcaaatgaattcacattcggcaacaagctggatacattctgtggatccccgccctatgccgcccccgaactgtttcaggggaaaaaatacgacggccccgaagtggatgtgtggagtctcggggtcatcctgtatactctggtcagcggatcattaccgttcgacggccaaaacctcaaagaacttagagagagggtcctccgggggaagtacagaatcccattttacatgtccactgattgtgaaaacctgctcaagaagtttctgatcttaaatccaagtaaaagaggaaccctggaacagatcatgaaagataggtggatgaatgtcgggcacgaagatgatgagctcaagccctacgtggaaccactacctgattataaggatccacgccggacagaattaatggtaagtatgggatacactcgagaggagatccaagacagtttggtgggacagcggtacaacgaagtcatggcaacatatctcctcctgggctataagagttccgagctagagggcgacaccataacattgaaacctcggccaagcgcagatctcacgaacagttcagcaccatcaccgtcccacaaagttcagagaagcgtctctgcaaacccaaaacagcggaggtttagcgatcaggccggcccagcaataccaaccagtaactcctatagcaagaaaacccagtctaataatgccgaaaacaaaagacccgaggaagaccgagagtccggcaggaaagcctccagcacagcaaaggtgccagcttctccgctgccggggctcgaaagaaagaagacaacccctactccctctactaattccgtgctttccaccagcacaaaccgttctaggaactcaccactgctggagcgggcttccctggggcaggccagtatccaaaacgggaaagactctaccgcaccccagcgggtccctgtggcttctccctctgctcataatatttcctcaagcgggggggcgccagacaggaccaacttccctcgcggcgtttccagccggagtacgttccacgccggacaattgcgccaagttagggaccagcagaatctcccctacggggtcaccccggcctccccctccggtcatagtcagggccgccggggtgccagcgggtcaatctttagtaaattcacctctaaattcgtgcgcaggaaccttaacgagcctgagagcaaggaccgagtagagactctgaggcctcatgtagtgggatccggcggcaatgacaaggagaaagaggagtttagagaagccaagcccagaagcctacgtttcacttggagcatgaagactacatcttccatggagccgaacgaaatgatgagagagatcagaaaagtcttggatgcaaactcatgccagtcagaactgcatgagaaatacatgctcctatgcatgcatgggacacctgggcacgaggactttgttcagtgggaaatggaggtttgtaagctccctaggctttccttgaatggggtccgcttcaaacgaatttctggaaccagtatggccttcaagaatatcgcttctaaaatcgctaacgagttgaagttatag

SEQ ID NO: 194207 - DNA, 186 bp, Artificial Sequence
  Description of Artificial Sequence: Synthetic coding sequence
atggaggtggccggcagccccttccccttcctgcagagcgtggcctgcctgctgaccttggctcacatcccagccgtgggtaatatcctgcagcacaggcgaagaggggctgggccaacactggggcatcttgacagtaaacctagctcgaaatcaaatatgatccgggggcgaaattctgcttag

SEQ ID NO: 194208 - DNA, 339 bp, Artificial Sequence
  Description of Artificial Sequence: Synthetic coding sequence
atgatccggggccggaacagcgccaccagcgccgacgagcagccccatattgggaactatcgcctgctgaagacgatcggaaaaggcaatttcgcgaaggtcaagctcgcacgccatatcctcacggggaaagaggtcgctgtaaaaataatcgataaaacccagcttaactccagctcccttcaaaagctttttcgagaggtccgcatcatgaaagttctgaaccacccaaacattgtgaaactgttcgaggttatcgagactgaaaaaactttgtacctggtgatggagtatgcgtcaggaggggaggtctttgattatctggtcgcccacggctag

SEQ ID NO: 194209 - DNA, 486 bp, Artificial Sequence
  Description of Artificial Sequence: Synthetic coding sequence
atgatccggggccggaacagcgccaccagcgccgacgagcagccccacataggcaactaccggttgctcaaaaccattggaaagggcaatttcgccaaggtcaaactcgccaggcacatccttacgggtaaagaagtggccgttaagatcatcgacaaaacccaactcaactcctctagcctgcaaaaactgttccgggaggtgcggatcatgaaagtcctgaaccaccccaatatagtaaaactgttcgaagttattgagactgaaaaaacgttgtacctcgtgatggagtacgctagtgggggggaggtttttgattacctggtagctcatggacgaatgaaagaaaaggaggcaagggccaaatttcgccagatcgtctcagccgtgcagtactgccatcagaaatttattgtgcatagggatctgaaggcagaaaacctgctgctcgatgccgacatgaacataaagattgcggatttctag

SEQ ID NO: 194210 - DNA, 276 bp, Artificial Sequence
  Description of Artificial Sequence: Synthetic coding sequence
atgggcggccagcggaacaccagcgtgggcaacatcgtgcagcggtggcgcgaccatgtggtatgccagaaggcaggcgtgatttattccggccgcaaggcccaggaacatgggactgggcgaacagacttcactcctgcccagcggctcatgatgccaacactgggacacttagactctaagccaagctcaaagagcaacatgatcaggggccgcaacagcgctacgtcggccgatgaacaacctcatatcggcaactaccgactgctcaagtag

SEQ ID NO: 194211 - DNA, 2238 bp, Artificial Sequence
  Description of Artificial Sequence: Synthetic coding sequence
atgatccggggccggaacagcgccaccagcgccgacgagcagccccacatagggaattatcgcttgttaaagacgatcggcaaggggaatttcgctaaggtgaaactcgcaaggcacattttaaccggcaaggaggtggctgtcaaaattattgacaaaactcagctgaattccagtagccttcagaagctgttccgggaagtaaggattatgaaagtgctgaaccaccccaacattgtgaagctgttcgaggtgattgagactgaaaagactctgtatctggtcatggagtacgcttccgggggggaagttttcgattacctggtggcccacggtcggatgaaggagaaagaagcccgggccaagtttcggcagatcgtgagtgccgtccagtattgccaccaaaaatttattgtgcatagggatttgaaagccgaaaatttgctgttggatgccgatatgaatatcaaaatcgctgacttcgggttctccaatgaattcaccttcggtaataagctcgacacgttctgtgggtcaccgccctacgctgcgcctgaactgttccagggtaagaaatatgacgggccggaggtggatgtgtggagtctcggcgtgattctgtacactctggtttctgggagtctccccttcgacgggcagaatttgaaggagctcagagagagggtgctgaggggaaagtaccggattcctttttacatgtccactgactgcgagaatctgctcaaaaagttcttaatcctgaaccctagcaaacggggaacactggaacaaattatgaaagacaggtggatgaacgtgggccacgaggacgatgaacttaaaccctacgtggaaccccttcccgattataaagatcctaggaggacagagctgatggtgtctatgggttacaccagggaggaaattcaggattcacttgtgggacagaggtataatgaagtcatggccacatatcttctattaggctacaagtcctccgagctcgagggcgacaccatcaccctaaaaccaagaccttcagccgacttaacaaacagcagtgcccccagcccctcacataaggtccagcgctccgtgagcgccaatcctaaacagcggaggttcagtgaccaggccggccctgccatcccaactagcaatagttatagtaagaaaactcagagcaacaatgccgagaataagcggccagaagaggacagagagtctggtagaaaagcctcctccacagccaaagtgccagcatctccgctgcctgggctcgagagaaagaaaaccactcctactccatccacgaattccgtgctctccacctctactaacagaagccgcaactcccccctgcttgaaagggcttctttagggcaggcttccatccagaatgggaaggactcccttaccatgccagggtctcgcgcctccaccgcaagcgcctccgctgccgtttctgcagcgcgaccgagacagcaccaaaagtcaatgtccgcctccgtacatcctaataaggcctcgggcctcccgcctaccgaaagcaactgtgaagtgccgcggccatcgactgctccacaacgagtaccagtggcctcaccatcagcccacaacatttcctcctcagggggcgcgccagataggacaaatttcccaaggggagtcagtagtagatcgacctttcacgctggacagttacgccaagtgcgtgatcagcagaacctgccctatggcgtaaccccagcctcaccaagcgggcattcacagggccggaggggagccagtggcagcattttcagcaaatttacctctaaatttgttcgtcggaacttgaatgagccagaatctaaggaccgagtggagacactgcgccctcatgtggtcgggtccggcggcaacgacaaggagaaggaagaattcagagaggccaagcctcgtagtctgaggtttacatggtcaatgaaaactacatcatccatggagcctaacgagatgatgcgcgaaatcagaaaagtgctcgacgcgaatagctgccagagtgaattgcatgagaagtacatgctgctatgcatgcacgggactcctggacacgaggacttcgtgcaatgggaaatggaggtgtgcaagctgccccggctttcccttaatggggttcgttttaagagaatttctgggacgtcaatggcatttaagaacatcgccagtaaaattgccaatgaattaaagttgtag

SEQ ID NO: 194212 - DNA, 4128 bp, Artificial Sequence
  Description of Artificial Sequence: Synthetic coding sequence
atggagggcgaccgggtggccggccggcccgtgctgagcagcctgccagtgctactgttgttgcctctgctgatgctgcgtgccgctgcacttcaccccgatgagctgtttccacatggggagtcatggggggatcagctccttcaggagggggacgatgagagctcagctgtggtcaagctggcgaatcctctccatttctatgaggcaagattctctaacctctacgtaggaacaaacggtattatctctacacaggatttcccaagagagacacagtatgtcgattatgacttccctacagactttcccgcaattgcccccttcctggccgatatcgacacctcccacggccgtgggcgggttttgtaccgcgaggatacctctccagcggtgctggggttggccgccaggtacgtccgagcagggtttccaaggtctgcacgctttacaccaacccatgcattcctggcaacctgggagcaggtaggagcatatgaggaggtcaaaagaggcgccctacctagtggggaactcaacacttttcaggctgttttggcgtcggacgggtctgacagctatgcgctgtttttatacccggctaatggcctgcaatttctagggacccggccgaaggagagctataacgttcagctccagctcccagcacgcgtaggattctgcagaggagaagctgacgacctaaagagtgaagggccttacttttcactaacaagcactgaacagtcagtgaagaacttgtaccagctgtctaatctgggaatccccggtgtctgggcgttccacatcggttccactagcccactagacaacgtccgacctgctgcagtgggagacctctcagctgcccatagctctgtcccccttggccgcagcttctcacacgccacagccctggaaagcgactacaatgaagacaatcttgattattatgatgtgaatgaagaagaagctgaatatctccctggcgagccagaggaggctttgaacgggcattcctctattgatgtgagctttcaaagtaaggtggacacaaagcccttggaagagtccagcactttggatccacatactaaagagggcaccagtctgggcgaggtggggggaccagatcttaagggccaggtggagccctgggacgaaagggaaacacggtctcccgcaccccctgaagtggacagggacagtctggcgccaagttgggaaacgccacctccctatcccgaaaatggatcaattcagccttaccccgacggggggccagtcccaagcgagatggatgtgcccccggcccacccggaagaagagattgtcctgagaagctatccagcctcaggtcatactaccccgctgagccgggggacctacgaagtcggcctggaggataatattggttcaaacacagaggtgttcacctacaacgctgctaataaggaaacctgcgagcataaccatcgtcagtgttctaggcatgctttttgcacagattatgccacaggcttttgttgtcactgccagagcaaattctacggaaatggaaaacattgcctgcctgagggggctcctcatcgtgttaacggcaaggttagtggtcacttgcatgtgggccacactccggtccattttacggacgtggacctgcacgcctacatcgtcggtaacgatggtcgggcttacaccgccatttctcacatcccccagccagcggctcaggcgttactccctctcaccccaattggcggactgttcgggtggctctttgctttggaaaagccagggagtgagaacgggttcagccttgcaggagccgcctttactcatgatatggaagtcacattctacccaggtgaggagacagttcgaattacacaaacagccgaaggtctcgacccagaaaattacctgagcatcaagacaaatatacagggccaggtcccgtacgttagcgcgaattttactgcacacatttctccatataaggaactgtaccactacagtgatagcactgtgacatccacgtcttcccgggattactctttgacattcggagccatcaaccagacgtggtcttacaggattcatcagaacattacttaccaggtgtgcagacacgctccaagacacccgagtttccctacaacccaacagcttaatgtggacagagttttcgccctttataatgatgaggagcgggtgttacgctttgcagtgaccaatcagattgggcccgtaaaggaagattctgacccaacacctggaaacccatgctacgatggatctcacatgtgtgacaccaccgctaggtgccacccagggactggagttgactatacttgtgaatgcgcctcaggttaccagggagacggcaggaactgcgtcgacgagaatgaatgtgctaccgggtttcaccgatgcggtcccaattctgtttgtataaaccttcccggcagttacagatgcgagtgtagatccggttatgagttcgccgacgaccgccacacatgcatcctgatcaccccacccgcgaatccctgtgaagacggatctcatacttgtgctccagctgggcaggcgagatgcgtccatcatggtgggagtactttctcttgcgcatgcctcccaggctacgcgggagatggtcaccaatgcacagacgtggacgaatgcagcgagaataggtgtcacccggccgcgacttgttacaatactcccggtagcttctcgtgtcgctgccagcctggttattatggtgatggctttcaatgcatcccagactcaacctcatccttgaccccctgcgagcagcagcagagacatgctcaggcacagtacgcctatccaggtgctcggtttcacatcccacaatgcgatgagcagggcaattttctacccttgcagtgtcatggctctactggattctgctggtgtgttgacccagacggacacgaggtgcctggaacccagacaccaccagggagcacacccccacattgcggaccatcacctgaaccaacgcaacggcccccaactatttgcgagagatggcgggaaaacttgctggagcactacggggggacaccccgagatgaccagtatgtcccccagtgcgacgacctggggcattttatcccactgcaatgtcacggaaagtccgacttttgctggtgtgtcgataaggacggtcgcgaggtgcaaggaacacggagtcagcccggaacgacacctgcttgtatcccaacagttgccccaccaatggtgcgccctaccccgcgccccgacgtgacacccccatctgtagggacctttctgttgtacactcaggggcagcagatcggttatctgccactaaatggcaccaggttacagaaagacgctgctaagaccctactctcacttcacgggagtattatcgttggcatagactatgattgtcgagaaaggatggtctattggactgatgtcgcggggcgcacaatcagcagagcaggcctggaactgggcgctgagcccgaaactatcgttaattcaggccttatctcgccggaggggctggcaatcgatcacatccgacgtactatgtactggaccgactcagtgttggacaagatcgagtctgccctgctggatggatccgaacggaaagttctgttttacactgacctggtaaaccccagagccattgccgtggaccccatccggggtaacttatattggaccgactggaaccgggaggccccaaaaatcgagacttcaagtctcgatggtgaaaatcgtagaatcttaatcaacacagatatcggtttgcctaatggactgacgttcgaccctttcagcaagttgctgtgttgggcagatgctggcactaagaagttagagtgcactttgccagatgggacaggcagacgggtgattcagaacaacctgaaatatccgttttctatagtaagctatgctgaccatttttaccatacagattggagaagggacggagtcgtttctgtaaacaaacacagtggccagtttacagacgagtacttgcctgaacagcgcagtcacttgtatgggatcacagcggtgtatccctactgccccacagggagaaagtag

SEQ ID NO: 194213 - DNA, 2190 bp, Artificial Sequence
  Description of Artificial Sequence: Synthetic coding sequence
atgagcacccggacccccctgcccaccgtgaacgagcgggacaccgaaaatcacacaagccatggtgacggtaggcaagaagtcacttctagaactagcaggagcggtgctaggtgtagaaattctatagccagctgcgctgatgaacaacctcatattggaaactacagactgctaaagacgattggcaaggggaactttgcaaaagtgaagttagcccgccatatcctgacaggccgagaagtcgctataaagattattgacaaaacccagctcaatccaacgtctctgcagaagctgttccgagaggtgaggatcatgaaaatcctcaatcatcctaacattgtcaaactgtttgaagtaatagagaccgagaaaactctttacctgattatggagtatgcctctggaggcgaagtgtttgattatcttgtggctcatggccgcatgaaggagaaagaggctcgctccaagtttcgacagattgtaagcgccgtgcagtactgtcatcagaagagaattgtgcacagggatttgaaagcagaaaacctgctgctcgacgctgacatgaacatcaaaatcgctgactttggtttcagcaacgaatttaccgtgggaggaaagctggacactttttgtgggagtccaccttacgctgcccctgaacttttccagggaaagaagtacgacggccccgaagtggatgtctggagtctgggtgtgattctctacacattggtgagcgggagcctccctttcgacggccaaaatttgaaggaactgagagaacgcgttctgcgtggtaaatacagaattcccttctacatgtccacagactgcgaaaacctccttaaaagattcctagtgctgaaccctatcaagcgcggtactctggagcagatcatgaaggaccgatggatcaatgccggccacgaggaggatgagttgaagcccttcgttgagcccgagcttgacatttcggaccagaagcggatcgacattatggtgggaatgggttatagccaggaagagatccaggagtctttaagcaagatgaagtatgacgagatcacagccacctacctgctcctcggacggaaaagcagcgagctggatgcaagcgactcctcctcatcgtctaacctttctttagcgaaggtgaggccctctagtgatctaaacaacagcaccgggcagagcccccatcacaaggtgcaacggtctgttttttcttctcaaaaacagcgccgttattcggaccacgcaggcccagcaattccatctgtagtggcctatccaaagcgcagccagacaagcaccgcagacagcgaccttaaagaagatggaatttccagtcgaaaatcatctggctctgccgtcggcggcaaaggcattgctcccgcgtcgccaatgttaggcaacgcgtctaacccgaacaaagcggacatccctgagagaaaaaagtcatctaccgtcccatcatcgaacacggcctcagggggcatgaccaggagaaatacgtatgtttgcagtgagaggacaaccgcagataggcacagcgtgattcagaatggcaaagagaattctacgatccctgaccagcggactccagtagccagcactcacagcatttcatcagcggcgaccccagaccgcattaggtttccgagagggaccgccagccgctccacgtttcacgggcagccacgcgaaagacgcacagcaacctataacggcccgccggcttccccgtccctctcgcatgaagccacacccctgtcccagacaaggagtcgggggagtacaaacctgttttccaagctgacctcaaagctcaccagatctcgcaacgtgtctgccgagcagaaggatgaaaacaaagaggctaagccgaggagcttgcgctttacttggagcatgaagaccacatcgtctatggaccccggagatatgatgagagaaattagaaaggtgctggatgccaataattgcgattacgagcagagagaaagatttctgctgttttgtgtccacggggacgggcacgccgaaaacttggttcagtgggaaatggaagtgtgcaagctgccgaggctttcgctcaatggagtgagatttaagcgtatctctgggacctcaattgcgtttaaaaatatcgcctccaagatcgctaacgagttgaagctgtag

SEQ ID NO: 194214 - DNA, 1338 bp, Artificial Sequence
  Description of Artificial Sequence: Synthetic coding sequence
atgaagtacgacgagatcaccgccacctacctgctgctgggccggaaatcttctgagttagacgctagtgactctagcagttcttctaatctgtcgctggcaaaagtgagaccatccagtgacctgaataactctaccgggcagtctccacatcataaagtgcagaggtctgtattttcgagccaaaagcagaggcggtattcagaccatgccggtcctgcaatcccttcagtggtggcctatccaaagcgctcgcagacatccacggctgattccgacctcaaggaggacgggatctccagtcgtaagtctagcgggagtgctgttggcggtaagggaatcgcccccgcttctccaatgctcggtaatgcatcaaaccccaacaaagccgatatccccgaaagaaagaagtcatccaccgtgcctagctccaacaccgcttccggcggtatgaccagacgtaacacgtacgtgtgctctgagaggacgactgcagatcgtcattctgttatacagaacggcaaagagaatagtctcacggaaatgtttgcctatgcggcatcacccgcttctgtttgcaccagtacctgtagactccggcaccaaaaaagcatgtcaatgtccgcaagtggccaccctaaaatgatgctgcctccaattgattccgagggcgacaattttaaggctattaccatccccgaccaaagaacaccagtggcctcgacccactcaatcagctcagccgcaaccccagataggattcgctttcctcgaggcactgcctcccggagcactttccacggccagcctagggagcggagaactgcgacgtacaatggtcccccagctagccctagtctctctcatgaggccactccactgtcacaaacacgctctaggggttcgacgaatctcttttccaagctcacatccaagctcacacgccgcctgcctactgagtatgagaggaatggcaggtatgaggggtcctcccgcaacgtatcggccgaacagaaggacgagaataaagaagctaagccccgttccctgcgttttacgtggtccatgaagaccacgtcctctatggaccctggcgacatgatgagagagataaggaaggtgttagatgccaacaactgcgattatgagcagcgcgagcggttcctcctattctgtgtgcatggcgatggacatgccgagaatctcgttcaatgggagatggaagtgtgcaaacttcctcgactttctctgaatggagttcgattcaagcggattagtggtaccagcatcgccttcaaaaacattgctagcaaaatcgctaacgaactcaagctgtag

SEQ ID NO: 194215 - DNA, 2259 bp, Artificial Sequence
  Description of Artificial Sequence: Synthetic coding sequence
atgagcacccggacccccctgcccaccgtgaacgagcgggacaccgaaaaccatacatcccacggagacggacgtcaagaggtgactagcagaacctcaagatccggcgcccggtgtcgtaactcaatcgcttcttgtgctgacgagcagcctcacatcggaaactaccggctcctgaagaccattggcaagggaaattttgctaaggtgaaactggccaggcacattcttaccggcagggaggttgccattaagattattgataagacgcaactgaacccaacctccttgcaaaagcttttccgggaggtccgcatcatgaaaattctcaatcacccgaacatcgtgaagctctttgaagtgatcgagaccgagaagactttgtacctaattatggaatacgcttccggaggcgaagtgttcgattacctagttgcacatggcagaatgaaggagaaggaggcacgctcaaagttccgccagggctgccaggccggacagactatcaaggtgcaggtgtccttcgatctgctgagcctcatgttcacctttatcgtttccgctgttcaatattgccaccagaagagaattgtccatagagatttgaaggcagagaacctcctcctggacgccgacatgaatattaaaattgccgattttgggttcagtaacgaattcaccgtagggggaaagcttgataccttttgtgggagtcccccctacgctgcaccagaactgttccagggcaaaaaatatgacgggccagaagtggatgtatggtctttgggggtgatcctgtacaccctagtgagcggttcattgcccttcgacggacaaaacctgaaagagctgcgcgaacgagtcctgcggggcaagtataggattccattctacatgagcactgattgcgaaaatcttctgaaacgattcctcgtccttaacccgatcaagagaggaactctggagcaaatcatgaaagatcgctggattaatgctggacacgaagaggatgagctcaagccattcgtagagccagaattggacatcagcgaccaaaaaaggattgatattatggtgggcatgggatactcacaagaggagattcaagaaagcctatcaaagatgaagtacgacgagatcacggccacgtatctcctgttgggaaggaagtcaagcgaactcgacgcctctgacagcagtagttcgtcaaacttaagtttggccaaggtgaggccgagctctgatctgaataattccactggacagtctccgcaccacaaggtacagaggtcggtgtttagtagccagaaacagaggaggtattcagaccacgctggccccgccatcccttccgttgtagcttacccaaagcgctcacagacttcaacagccgattccgacctcaaagaagatggcattagcagcagaaaatcctcaggtagtgcagtcggtgggaaaggaattgcaccggcaagtcccatgttgggaaacgccagcaacccaaataaagcggatatcccagagaggaaaaaaagtagcacagttccatcttctaacactgctagcggaggcatgacccgtagaaatacttacgtctgctcagagcggaccacagcagatcgccactctgtcatccaaaacggcaaggagaactcgaccatccctgaccaacggacacccgtggcctccacacactcaatcagcagcgccgcaaccccggacaggattcgttttcccagaggaactgcttctcgcagcacctttcatggccaacccagggaacgaaggacagccacatacaatgggcctcctgcaagtccgtctctctctcacgaagccactcctctctctcagacaagatctcgcgggtcaacaaatttgttcagcaagctaactagtaaactgactagaagtcgaaatgtctctgctgaacagaaggacgagaacaaggaagcaaagccacgtagccttaggttcacatggagcatgaaaactacttccagcatggacccaggtgatatgatgcgggaaatacggaaggtccttgatgcaaacaactgtgactacgagcagagagagcgctttctgctgttctgcgtacacggggatggtcacgcagagaatcttgtgcagtgggaaatggaggtgtgcaagctgccgcgcctaagtctgaacggggtaagattcaagcgcatttccgggacttcaatcgcttttaagaacattgcaagcaagattgcaaacgagttgaagctgtag

SEQ ID NO: 194216 - DNA, 2262 bp, Artificial Sequence
  Description of Artificial Sequence: Synthetic coding sequence
atgagcacccggacccccctgcccaccgtgaacgagcgggacaccgagaaccatacctctcatggagatgggcggcaagaggtaacgtcccgaactagtcgttcgggagcccgctgcagaaactctattgcatcctgtgctgacgagcagcctcacatcggcaattatcgcttgctgaagacgatagggaaagggaacttcgcgaaggtgaagctcgcacgtcacatcctgactggccgggaagtggcaatcaaaatcattgacaaaactcagttaaaccccacctctttgcaaaagctgtttagggaggtgaggattatgaaaatactgaatcatcctaatattgtcaagctgttcgaggtgatcgagacggagaaaacactctatcttatcatggagtatgcatctgggggagaggtcttcgactatcttgttgcccacggtcgcatgaaagaaaaggaggcccggtctaagtttaggcagattgtatccgcagtccaatactgccaccaaaaacggattgtgcatcgtgatttgaaagcagaaaaccttctgctggacgctgatatgaatattaagatcgccgacttcggtttctctaatgaatttacagtcgggggtaagcttgatacattctgcgggtcacctccctacgctgcccccgagctgttccagggcaagaaatatgacgggcccgaggtggatgtgtggtctctgggagtaattttatatacactggttagcggcagtctgccgttcgacggacagaatttaaaagagcttcgagagcgcgtcttgcggggcaagtaccggattcccttttatatgtcgactgattgcgaaaacctgctgaagagattcctcgtgctgaatccaattaagcgtggaacattggagcagataatgaaggacaggtggattaatgccggtcatgaggaggacgagctgaagccgttcgtggaaccggagctagacatttcagaccagaaacgtatcgacatcatggtgggtatgggatattcacaggaagagatccaggagtccctgagtaagatgaagtacgacgaaataacagcaacatatctgctactgggtcggaagagcagcgagctcgatgcttccgatagctcatctagctcgaatctgagcctcgccaaggtccgaccaagttccgatctcaacaactccaccggccaatcacctcatcacaaagttcagagatctgtgttctcatctcaaaagcagcgcaggtatagtgatcatgccggcccagcaataccgagcgtagtggcctatcctaagcggtcccagacttcaaccgctgactcagatctcaaagaagacggaatctccagccgaaagagtagcggaagcgcggttggcgggaaaggaatcgcgcctgcctctccgatgctggggaacgcatctaatcctaataaggctgacattcctgaaagaaagaagtcaagcacggtgccaagctcaaatacagctagcggaggcatgacccgccgaaacacctacgtgtgtagtgaacgcaccacggccgataggcattctgttatccagaacgggaaagagaatagcacaatccccgaccagcggacccctgtcgcatcaacacactccatcagttctgccgctaccccagatcggattcgattcccacgaggaacagcatcaagaagcactttccatgggcaacctcgggagcggcgaactgctacctacaacggtccgcctgcttctccatccttgtcacacgaggccaccccactatcacagaccagaagcagagggtctacaaatctatttagtaagttgacatcaaaattgactcgcagaaacatgtcatttcggtttattaagcgcctgcccacagagtatgaacgaaacggccggtatgagggatcatctcgtaacgtgagcgccgagcaaaaggatgagaacaaggaggctaagcccagatcgctacggttcacttggagcatgaaaacaactagcagtatggatcctggtgatatgatgagagagatcaggaaagttctcgacgcaaacaactgtgactatgagcaacgggaacgcttcttgcttttttgtgtgcatggagacggacacgccgaaaatctcgttcagtgggagatggaggtgtgtaagctgccccgtctcagccttaacggagtgcgtttcaagaggatctccggcacaagcatcgcctttaagaacatcgcctccaagatcgcgaacgagcttaagctgtag

SEQ ID NO: 194217 - DNA, 1980 bp, Artificial Sequence
  Description of Artificial Sequence: Synthetic coding sequence
atgagcacccggacccccctgcccaccgtgaacgagcgggacaccgagaaccatacgagtcacggagacggtcgacaggaagtcacttctagaacttcgagatccggcgcgcggtgtaggaactcaattgccagctgcgccgacgagcaacctcacatagggaactataggctgctgaagactatcggcaaaggaaattttgcgaaagtaaagctcgcgcgtcatatcttgaccggaagagaggtcgccattaaaatcatcgacaagacccaactgaatcctaccagtcttcaaaagttatttcgggaagtcagaatcatgaaaatcctcaatcaccctaatatcgttaagctgttcgaagtgatagaaaccgagaaaacgttgtatctcatcatggagtacgccagcggaggcgaggtgttcgattacctggtggcacacggcagaatgaaagagaaggaggcccgctcaaaattcagacaaatcgtatctgccgttcagtactgtcaccagaagcggatcgtccaccgggatcttaaagagctaagggagcgggttctgcgaggaaagtataggatccccttctatatgtctaccgactgtgagaacctgctcaagcgctttttagttttaaatcctattaagcggggtaccctcgagcagatcatgaaggatcgctggatcaatgcaggtcatgaggaggacgagctgaaaccattcgtcgaaccagaattagatatatccgaccagaaacgcatcgacatcatggttgggatgggctacagccaggaggaaatacaggagtcactgtcaaaaatgaagtacgacgagatcacagctacttatctgctcctaggtagaaaatcttccgaactagatgccagcgattccagctcttcgagtaatttatccctggctaaggtgaggccctcgtccgaccttaacaactcaaccggacagagccctcatcataaggtgcagaggagcgtgttttctagccaaaagcagcgcagatacagtgatcacgcgggacctgcaatacctagcgtagtggcctatcctaaacgtagccaaaccagtacggccgactccgacctcaaagaagacggcatatcctctagaaagagcagtggaagcgccgttggcggtaagggaatcgcgccggcctctcccatgctggggaacgcgagtaatccaaacaaggctgacatccccgaacggaaaaagagtagtacagtgccttccagcaacactgctagcggaggtatgacccgccgcaatacttacgtgtgctctgagcggaccaccgcggaccggcactcggttattcagaacggcaaagagaacagtacaattccagatcagcgcacccctgtcgcttctacacactctattagcagcgctgccacaccagatagaattcgcttcccacgcggaactgcaagcagatctaccttccacgggcagccacgggagaggcgcacagccacctacaatgggccgcccgcctcacccagtctttcacacgaagcaactccactgtctcagactcgttcccgaggatctaccaatttattcagcaagctgaccagcaaactcaccagaaggaacatgtcgtttcgcttcattaagagccggaatgtctccgctgagcagaaggatgaaaataaggaggccaagcccaggagcctgagatttacgtggtcaatgaaaactacctccagcatggaccccggggatatgatgcgagagatcagaaaggtactcgatgccaataactgtgactatgaacaacgcgaaagattcttgttgttttgtgtgcacggcgacggtcatgccgaaaacctggtgcagtgggaaatggaagtgtgcaaactgcctagactgtcactgaatggcgtcaggtttaaaagaatttccggtacgagcattgcattcaaaaacatagctagtaagatcgcaaacgagctcaaactttag

SEQ ID NO: 194218 - DNA, 2235 bp, Artificial Sequence
  Description of Artificial Sequence: Synthetic coding sequence
atgagcacccggacccccctgcccaccgtgaacgagcgggacaccgaaaatcacacgagccacggcgacggaagacaggaagtcacgagcagaacttcacgttccggcgctcggtgccgcaatagtatcgcctcatgtgctgacgagcagccccatatcggtaattatagactcttgaaaactattggtaagggcaacttcgcaaaagtgaagctggcaagacacattctgacgggaagggaagtggccatcaagatcattgataaaacacaattgaacccgacctctctccagaaactgttcagagaggtgcgtatcatgaagatcctgaaccatccaaacatcgtgaaactattcgaggtcattgaaaccgagaagaccctatacttgattatggagtacgccagtgggggcgaggtcttcgactatctggtcgcgcacggtagaatgaaggagaaagaagcccggagcaagttcaggcaaatcgtctctgcggtgcagtactgccaccagaagagaattgtccatcgagacttgaaggccgaaaatttgctgctggatgcggatatgaacataaaaatcgctgatttcggtttctccaacgagtttacagtcggcgggaaacttgacaccttctgcggaagccctccatacgcagcaccagagctgtttcagggaaaaaagtatgacgggccagaagtggacgtctggtctctgggagtgattttatacactttggtctccgggtctctgcctttcgacggacaaaatctgaaggagctacgtgagcgggtactccgtggaaaataccggattcctttttatatgagcacggattgtgagaacctcctgaaacggttcctcgttctgaatccaattaaaagaggcactctggaacaaattatgaaagaccggtggattaatgctggccacgaggaggatgagctgaagcctttcgttgagccagagctcgatatctctgatcagaagcggattgacattatggtgggcatgggttactcccaggaagaaatacaggaatcactttctaaaatgaaatatgatgagattaccgccacttacctactgctgggtcggaaatccagcgaactcgacgcgagtgactcctccagtagcagtaatttgagtctcgctaaggtgagaccatcaagcgacctcaacaattccaccggtcagtcccctcaccataaagtgcagaggtctgtgttctcatctcagaaacagcgcaggtattccgatcacgccggccctgctatcccaagcgttgtggcttacccaaagagatctcagactagcaccgccgactccgatctgaaggaggacggaatcagcagtaggaagtcctcaggctccgctgttggtggcaaaggaatcgcacctgcttcgcctatgctggggaatgcctctaacccgaacaaggctgacatccctgagaggaagaaaagcagtactgtcccctcttcaaacactgcgagtggcggtatgaccagacggaatacatacgtatgttctgagcggacaactgcagaccggcatagcgtgatacagaatggcaaggagaatagcacaatacctgaccaacgcactcctgtggcctccacacatagcatatctagcgctgccacccccgataggattcgcttccctcggggtaccgcctctagatctaccttccatggacagccaagggaacgacgcacagctacttacaatgggcctcctgcaagtccttcactgtctcacgaggccacaccattatctcaaaccaggtctagaggttctactaatctgttcagcaagttgacctccaagttgactagacgactgccaactgagtacgagcgcaatggcagatatgaagggtcctcacggaacgtgtcagcagagcagaaggatgaaaataaagaggccaagccacggtcgttaaggtttacatggagcatgaagactacaagtagcatggatccgggcgacatgatgcgtgagattagaaaggtgctagatgccaataactgtgactatgaacagcgggagcgattcctgttattttgcgtacacggagatggtcacgctgagaaccttgtccaatgggaaatggaggtgtgcaagctaccacgtctcagtttgaacggagtccggttcaaacgcatttcgggtacaagcatcgcatttaaaaatatcgctagtaagatcgctaacgaattaaaactctag

SEQ ID NO: 194219 - DNA, 1518 bp, Artificial Sequence
  Description of Artificial Sequence: Synthetic coding sequence
tgagtggacgtgtggagcctgggcgtgatcctgtacaccctggtgagtggaagcctccctttcgacgggcaaaatctcaaggagttacgcgagagagtgctgcgggggaagtataggatccccttttacatgagcaccgactgtgaaaatctgctgaagagattcctcgtgctaaatcccatcaagagagggacattggaacagataatgaaggatcgatggatcaatgctggacacgaagaggacgagttaaaacccttcgtggagccagaattggatatctctgaccagaaaaggatagacattatggtgggaatgggatattcccaggaagagattcaagagtcactgagcaaaatgaaatatgacgaaatcaccgccacataccttcttctcggccgcaaatcgtccgaagttaggccctcatccgatctcaataacagcaccggtcagagtccccaccataaagtgcagcgctctgttttttccagtcagaaacagcgcaggtacagcgaccacgccggccccgccatcccaagtgtggttgcttaccccaaacgatcacagactagcaccgcagactccgacctgaaagaggacgggatctctagcagaaaatcgagcgggtcagctgtagggggtaaggggatcgctccagccagccctatgctcggcaacgcgtccaacccgaataaagccgacattccagagaggaagaagtccagcaccgtgccttcaagtaatacagccagcggaggtatgacacgccgtaacacctatgtatgcagcgagcgaaccacagcggaccggcacagcgtgatccagaatgggaaggaaaactctacgatccctgatcaaaggactcccgtggcaagtactcactcaattagctccgcagcaacaccagaccggatccggttccccagagggacggctagtcgcagtacctttcacgggcagccccgggagcggagaacggcaacctacaatggtcccccagctagtccctccctgtcccatgaggccactcccttgagccagacacgctccaggggttcaaccaatttgttctcgaagctgacaagtaaactcactaggaggaatatgtcctttaggtttatcaaaaggctccccaccgaatacgagcggaacggaagatatgaaggcagctcacgcaacgtctctgccgagcaaaaggacgaaaacaaggaggccaagcccaggtccttgcgctttacctggtcgatgaagaccactagcagcatggacccgggcgatatgatgagggaaattaggaaggtcctggatgcaaataactgtgattacgagcagcgggagcggttcctcctattttgtgttcacggcgatggacacgccgagaatctggtccagtgggagatggaagtatgtaaactaccaaggctgtccctcaatggagtgcggtttaaacgcattagtggtacgagcattgctttcaagaacattgctagcaaaattgcaaacgaacttaaactctag

SEQ ID NO: 194220 - DNA, 2259 bp, Artificial Sequence
  Description of Artificial Sequence: Synthetic coding sequence
atgagcagccggaccgtgctggcccccggcaacgaccggaacagcgatacacatggcactctcggttcaggccgcagcagtgacaaagggccttcatggagttctaggagcttaggggccagatgccgtaactctatcgcatcctgtcctgaggaacaaccccacgtaggtaattacaggcttctccgcactatcgggaagggcaacttcgccaaggtgaaactcgcgcggcacatcctcacaggtcgggaggtggcaatcaaaataatagataagacacaactgaatcctagcagcctgcaaaagctgtttcgggaagtgagaatcatgaaaggcctcaatcaccctaacatagtcaaactatttgaggtcatagaaaccgagaagactctgtacttagttatggagtatgcttccgccggcgaggtctttgactacctcgtgagtcacggtcggatgaaggagaaagaggcaagggcgaaatttcggcagatcgttagtgccgtgcactattgtcatcaaaaaaatatcgtccacagagacttaaaggccgagaatctgctgcttgatgctgaagccaacatcaaaattgccgatttcggcttctctaacgagtttaccctgggttccaaactcgatactttttgtggcagccctccatacgcagcacccgagctctttcaaggtaagaagtacgatggaccagaagttgacatttggagtctgggagtgatcctgtataccctggtatcagggagcctgcccttcgatggtcacaatctgaaggaactgcgggaaagggtgctgcggggtaaatatcgggtccctttctacatgagcacagactgtgagtcaatcctacgcaggtttctagtgctcaatccagctaaacgttgcacgctggaacagataatgaaggacaagtggatcaacataggctatgaaggcgaggagctgaaaccttacaccgaacctgaggaagattttggagataccaagagaattgaggtcatggtcgggatgggttacacccgcgaggagattaaagaatccctgacctcccagaagtacaatgaggtgaccgcaacatacctgctgctcggccggaaaacagaggaggggggcgaccgcggagcgccaggcctggccctagctcgagtgagggctccatctgacacaactaatgggacgagcagtagcaagggcacaagtcatagtaaaggacaacggagttcaagtagcacgtaccaccgccagcgtcggcactctgacttttgtggcccgtcccccgctcctctgcaccctaaacggtcacctacctccacaggtgaagctgaactgaaggaggagaggctccctgggcgaaaggccagctgctctacagctgggagtgggtcaagggggctgccccccagcagccctatggtgtcctccgcccataacccgaacaaggccgaaattccggaacgtcgtaaggatagcacaagcacgccaaacaatctacctccgtctatgatgacgcgccgcaatacatatgtgtgcaccgagagaccaggggctgagagaccgtccctgctgccgaacgggaaagagaactcctcaggaactcctagggtgccgccggcttctccaagctcgcattctctggccccgcccagcggcgagcgaagccgtctggcacgaggcagtacgattaggagtaccttccacggcggccaagttagggaccggcgggccggtggaggaggcggcggaggagttcagaatggacctcccgctagcccaaccctggcccatgaggcagctccactaccagcagggcggccccgacctacgaccaatctgtttacaaagctgacttcaaagcttacacggcgtgtcgccgatgagcctgaacgcataggaggccccgaggtgacctcttgccacttgccatgggaccagactgagacagcccctaggctgctccgattcccttggagcgtgaaactgacatcctccagacctcccgaagcacttatggccgccctccgccaggccactgcggccgctcggtgcaggtgcagacagccccaaccctttttgctggcttgtttacacggcggtgctggggggcccgagccgctgtcccactttgaggtagaagtctgtcaattgccccggcctggcctgcggggggtgttgttcaggagggtggcggggactgccctggcttttagaaccctcgtaactcggatatctaatgatctggaactctag

SEQ ID NO: 194221 - DNA, 1389 bp, Artificial Sequence
  Description of Artificial Sequence: Synthetic coding sequence
atgagcagccggaccgtgctggcccccggcaacgaccggaacagcgacacacacgggacactgggctccggcaggtcgagcgataagggcccgtcttggtcatcccgcagcctgggcgctcggtgccgcaactctatcgcgtcctgccctgaggaacagccacatgttggaaattaccgacttcttcgtacaataggtaaggggaactttgctaaggtgaaactcgcccggcacattcttactggaagggaggttgctataaagattatcgataaaacacagcttaatccaagcagtttacagaagttattccgagaagtccgaataatgaaggggttgaatcaccccaatattgtgaaattatttgaagtaattgaaaccgaaaaaactttgtatctggtaatggaatacgcgagcgcaggagaaccacccactctgtccgccctgcctctctgtcacctccccctgcccctccatctcacactcaccccactgggtctgtgccccgccggcgaagtgttcgactaccttgtctcacacgggagaatgaaagagaaggaggcacgggcaaaattcagacagattgtgagcgcggtgcattactgtcatcagaagaatatcgtgcacagagacttaaaggcagagaacctccttctcgacgcagaggccaacatcaaaatagcagacttcgggttttccaatgagttcacattgggctcgaagctggatactttctgcggtagtcccccgtatgcagctcccgagctcttccagggtaagaaatacgatggcccagaggttgacatctggagtctgggcgtaatcttatatacgctcgtgagcgggagcctgcctttcgatggccacaacctcaaggagctgcgagagagagtgctgcgcgggaaatacagagtgcccttttatatgtccactgactgcgagtctattctgagaaggtttctggtcttaaaccccgccaagcggtgtaccctggagcagattatgaaggataagtggatcaacatcgggtacgagggagaagagctgaaaccgtacaccgagcccgaggaagacttcggcgacacaaagaggatcgaagtgatggtaggaatgggctataccagagaggaaatcaaagaatccctcacctcacagaagtacaacgaggtgactgctacatatctgctactcggtcgcaaaacagaaccagatgaacacggaggaggcggtgcagagggaggtgcagctgcgcgacccgagggagaactgcagcaccgaggcgagtgggagagccgggcagcaccactgcagccccatggacagcagcggccacagcctcagcagggaagagatcctcgcgccgctgaagggcaacacgagcatccttag

SEQ ID NO: 194222 - DNA, 2067 bp, Artificial Sequence
  Description of Artificial Sequence: Synthetic coding sequence
atgagcagccggaccgtgctggcccccggcaacgaccggaacagcgacacgcatgggactctcggcagtggtcggtctagcgataaaggaccgagctggtcttcccgctctctgggcgcccgttgcagaaactcgatcgcatcatgcccagaagaacagcctcacgtggggaattatcgactgttgcgaacgattggaaagggtaactttgccaaagttaaattggcacggcatattcttacaggtcgcgaagtcgccattaagattatcgataagacacagctcaatccgtcctctctacagaaattgtttcgggaggttagaataatgaaaggtctaaaccatcctaatatagtcaagctctttgaagtgattgagactgaaaaaacgctctatctggtaatggaatacgcctctgcgggagaggtattcgattatttagtttcacacggccgcatgaaagagaaggaggctagagctaaattccgccagatagtttccgccgtgcactattgccatcaaaagaatatagtgcaccgtgatctaaaagctgagaacctcctactggacgctgaggccaacattaagattgcagacttcggcttctctaatgagtttactctcgggagcaagctcgataccttttgcgggagtccgccttacgctgcccccgagcttttccagggcaagaaatacgatggccctgaggtggatatctggtccttaggtgttatattgtacacgctcgtgagcggctctctgcccttcgacggacacaacctgaaagagctgcgcgagcgggtccttagaggaaagtacagggtgcccttctatatgagtaccgactgtgagtctattctgagacgattcctagtcctaaacccagcaaagaggtgcacccttgagcagatcatgaaagataaatggatcaatatcggctacgagggcgaggagctgaaaccttatacagagccagaggaagattttggcgacactaagaggattgaggtgatggtcggaatgggctacactagggaagagatcaaagaatccctgacatcccagaagtacaacgaggttacggccacatacctgctgctggggagaaagacagaggaaggaggcgatagaggagctccaggcctcgccctcgcaagagtccgggccccgagcgacactacgaatggcacttcctcatcaaagggaacctcccactcaaaagggcagcggtccagcagcagcacatatcatagacagaggcgtcacagcgacttctgcggcccatcacccgcacctctgcatccgaagaggagtcctactagcactggtgaagctgaactgaaagaagaacgattgcctggaaggaaggccagctgtagcacagctggcagcggcagccgtggcctccctccatcttccccaatggtgagctccgcccataatccgaataaggctgagattcccgagcgccggaaagattcaacatccacacctaataatctgcctccatcaatgatgacgcgtagaaacacctacgtgtgtactgagaggcccggggccgagcggccatcactcttaccgaatgggaaggagaactcctctgggacaccaagggtccctcctgcctcaccctcctctcactccttggcgccccctagcggggaaagaagccggctggctcgcggctccaccattcggtccaccttccacggaggccaggtgagagataggcgagccggagggggaggcggcggcggggtgcagaatggaccgcccgcctcccctaccctggcacatgaggccgccccactaccggctggcaggccgcggcctacaaccaatctcttcactaagctaacctcgaaactcaccagacgtgtgactctcgacccctctaagcgacaaaattctaatcggtgtgtatctggcgcctctctgcctcagggtagtaaaatccggtcacaaaccaatctgcgcgagagcggtgatctgcgctcacaagtggctatctatcttggtatcaagcgcaaacccccccccgggtgctccgattcacctggggtgtag

SEQ ID NO: 194223 - DNA, 240 bp, Artificial Sequence
  Description of Artificial Sequence: Synthetic coding sequence
atggccgccctgcggcaggccaccgccgccgcccggtgccggtgccgccagccacagccgtttctgctggcgtgtctgcatggaggcgccggcgggcctgagccactgagtcattttgaagtcgaagtctgccagttgccaagaccaggattaagaggcgtcctcttccggcgtgtcgctggcactgcactcgcttttaggactctcgtgacaagaatctccaatgatctcgagctctag

SEQ ID NO: 194224 - DNA, 1032 bp, Artificial Sequence
  Description of Artificial Sequence: Synthetic coding sequence
atggccgccgccaccgagctgaaccggcccagcagcggcgaccggaatcttgagcgaagatgccgaccaaatctgtctagagaggtgctgtacgagatttttaggtcccttcacacattggttgggcagctcgacctacgggacgacgtggtgaagattactatcgactggaacaagctccagagtctgagcgcctttcagcctgccctgctgttcagtgccttggagcaacacatcctgtaccttcagccattcctggcaaaactgcagtctcctataaaagaggagaatacaaccgctgtagaagaaatcggaagaacggagatgggcaataagaacgaggtcaatgacaaattcagcatcggcgatctgcaggaggaggaaaagcacaaagaatctgatttaagagacgttaagaaaactcagatccacttcgatccagaagtcgtgcaaatcaaggctggcaaagcagagattgacaggcgaatctcagccttcattgaaaggaagcaagccgaaattaacgagaataacgtgagagaattttgcaatgtgattgattgtaatcaagagaatagctgcgccagaacggacgccattttcaccccttacccaggctttaaaagtcacgtgaaggtctctagggtcgttaatacttatgggccacaaaccagacccgaaggcataccggggtccggccataagccaaacagtatgctcagggattgtggtaaccaagcagtggaagagcggctgcaaaacattgaggcacatctacgcctgcagaccggagggcctgtgccaagggacatctaccaacgaatcaaaaagctggaggacaagatcttagagttggaagggatctcaccagagtattttcagagcgtcagtttctccggcaagcggcggaaggtgcagcccccacagaattactcgttggctgaactggatgaaaaaattagcgctttaaagcaagcattgctccgcaaatctagggaggcagagagcatggccactcaccaccttccatag

SEQ ID NO: 194225 - DNA, 1035 bp, Artificial Sequence
  Description of Artificial Sequence: Synthetic coding sequence
atggccgccgccaccgagctgaaccggcccagcagcggcgaccggaatctcgagcggcgctgccgtcctaacctgtccagggaggtcctctatgagatcttcaggtcactacataccctggtgggacaactggaccttagggacgatgtcgtcaagattaccatcgactggaataaactacaatctctgagcgccttccagcccgccctgctgttctctgctctggaacagcacatcttgtacttacagccttttttggctaagctccagtcacccattaaagaggaaaatactacagcggtcgaggagatcgggaggacagaaatgggcaataagaatgaggtaaacgataaatttagcattggggacctgcaggaggaggaaaagcacaaggaatccgatctgcgggatgtcaaaaaaacccaaatacactttgatcctgaggtggttcagatcaaagctgggaaggcagaaatagatcgccgcattagcgcctttatcgagaggaagcaggcagagattaacgaaaacaatgtacgcgaattctgcaacgtaatcgattgcaatcaggagaacagctgtgcccgcacggatgccatattcaccccttatcctggctttaaatcccatgtcaaagtgtcccgggtggtcaatacgtacgggccacagaccagaccagaaggaatccccggcagcgggcataagccaaacagcatgctccgcgactgcggtaaccaggcagtggaagaaagactgcagaatatcgaagcgcacctgcgactacaaaccggcgggcctgttcctcgcgatatctaccaaagaataaagaagcttgaggacaaaatcctggaactggaaggcatttcaccagagtactttcagtcagtatccttttcaggcaagaggcgcaaagttcagcccccacaacagaactattccctagccgagctggatgagaagatctctgccctgaaacaagcgctcctgcggaagtccagggaggctgagtctatggcgacacaccacctgccgtag

SEQ ID NO: 194226 - DNA, 4944 bp, Artificial Sequence
  Description of Artificial Sequence: Synthetic coding sequence
atggtgcagaagaagaagttctgcccccggctgctggactacctggtcattgttggggcccgccatccatcctcggattcagtcgcacagaccccagagctgcttagacgataccctcttgaagaccatactgagtttccccttcctcccgatgtggtgttcttctgtcagccagagggatgcttgtcagttaggcagagaaggatgtctctgagagatgataccagcttcgtttttaccctgaccgacaaggacaccggagttacaaggtatgggatctgtgtcaacttttaccgtagttttcagaaaaggattagtaaggagaaaggggaggggggtgccggtagtcgcggaaaagaggggactcatgcaacctgcgcatctgaagagggtggcacggagtcttcagagagcggcagtagcttgcagcccttgtctgcagacagtactccagatgtgaatcaatcccctaggggaaagcgcagagcaaaggcgggctctagatccaggaattccaccctgaccagcctatgcgtcttgagccactatccctttttctcaacatttcgagaatgcctatataccttgaagcgactggtggactgctgctctgagaggttactcggcaaaaagttgggcatacccagaggggtgcagagggatactatgtggagaatatttaccgggagcctgttagtggaagagaagtccagtgccctcctgcacgatctcagagaaattgaagcttggatctaccgcctgctgaggtcacctgtgcccgtaagcggacagaagcgtgtggatatagaggtcctgccgcaggaactccagccggccttaacttttgccctgcccgatccgtcccggtttacgctggtcgattttccgctccatctccccttagaattgttaggtgttgacgcctgtctgcaagtactgacctgtattctgctggaacataaggttgtattacagagtcgcgattataacgcactgagcatgtctgtgatggccttcgtcgctatgatctacccattggaatacatgttcccggttatacctcttctgccaacttgcatggcgtctgccgaacagctgcttctggcacccaccccatatattatcggggtcccggcaagtttcttcctctacaagctggactttaagatgccagacgacgtttggcttgtggacctggacagtaatagggtcattgcgcctactaatgcggaagtcctgccgatcctgcccgaacctgaatccctggagctgaagaagcatctgaagcaggccctggcaagtatgagtctgaatacacagcccattcttaacctggagaaatttcacgaaggccaagagatacctttgctcttgggacggccctccaatgacctgcagtctacaccgagcacggagtttaatcccctgatttatggaaatgacgtcgattctgtggacgtagccacccgggtggcaatggtccgcttcttcaactccgcaaatgtcttgcaagggttccagatgcacacacgtacactgcggttgttccctaggcctgtagtggcttttcaagctggatcttttctggcctctagaccaagacagacccccttcgcagaaaaactagctagaactcaggcagttgaatattttggcgaatggatcttgaacccaactaattatgcattccagaggatccacaacaatatgtttgaccccgcgttaattggagataagccaaaatggtatgcacaccaattgcagcctatccactaccgagtctacgattccaactctcaactggctgaggccttgagtgtacctccagaaagagactcggattccgaacctactgacgactctggctcagattccatggactacgatgacagttccagttcatattcttctttaggcgatttcgtgagtgagatgatgaagtgtgatatcaacggtgatactcctaacgtggacccgctgactcacgctgcactgggcgatgcgtcagaggtagaaatcgacgaactgcagaaccagaaagaggcggaggagcccggcccagactccgagaacagccaggagaatccaccgcttcgtagcagctctagtactacagcttcttcctcaccaagcacggttatccacggagctaattctgaaccggctgactctacagagatggatgacaaagctgccgtcggcgtgagcaagccgttgccgtctgttcctccttctattggtaagagtaacgtggaccggagacaggcggaaatcggagaagggagcgtgaggcgtaggatttacgacaacccctacttcgaacctcagtacggctttccccctgaagaagacgaagacgagcagggtgagagctatactccccgcttcagtcaacacgtatccggaaaccgggcacagaaactgcttagaccaaacagcctgagactcgcaagcgactccgacgccgaaagtgactcaagggctagcagcccaaattctacagtaagcaatacaagtaccgagggctttggtggaataatgtccttcgcgagctctctgtaccgcaaccattcaaccagcttctctctgtcgaacctgactctgccaacgaagggtgcccgggagaaagctactccatttcccagcttaaaggtgtttgggcttaatactctcatggagattgtgaccgaggccggaccaggttcaggggaagggaatcggagagctctggtggaccaaaagagctcagtgattaaacacagcccaactgtgaagagagagcctccatccccccagggccgctcatccaactcaagtgagaaccaacagttcctcaaagaggtggtgcacagcgtgctcgatgggcaaggcgttgggtggctcaatatgaagaaggtgaggagactgttggagtcagagcagctccgcgtgttcgtcctgtctaagctaaataggatggtgcaatctgaggatgacgcgcggcaggacatcattcctgacgtagagatctccaggaaagtgtataaaggaatgctggacctactcaaatgtacggtgcttagcctggagcaatcatacgcacatgccgggctggggggcatggcctcgatctttggattgctcgaaatagctcaaacccactattattcgaaggaaccagataaaaggaagcggtcccccacagaatcagtgaacaccccagtcggaaaggatccaggcctggctggtaggggagacccgaaagccatggcacagctgcgggtccctcagctgggaccccgagctcccagtgctacaggaaaaggacctaaggaactggacacacgttccctcaaggaagaaaattttattgcttcaatcgaattgtggaacaagcaccaagaggttaagaaacaaaaggccctcgaaaaacagagacccgaggtgattaagcctgtctttgacctgggtgagacagaagagaagaagtcccagatcagtgctgacagcggcgtatcccttacatcctcctctcagcggactgaccaggacagcgttatcggagtctccccagctgtcatgatacgcagctcaagtcaggatagcgaagtttcaactgtcgtttccaattcatccggcgaaacactcggcgccgactctgatttatcctctaatgcgggggatggccccgggggcgaaggatcagttcacttagcatcttctaggggtacgctaagcgactcggaaatcgagacaaactctgcaacatccacgatctttggaaaagcacattctctcaagccaagcatcaaggagaagctggcgggatctcctattcgcacatccgaggatgtgtcccagcgggtgtacttatacgaaggcctgctaggccgcgataaagggtctatgtgggatcagctggaagatgccgcgatggagacattttccatctcgaaagagcggtccactctctgggaccagatgcagttctgggaggatgcatttcttgatgctgtcatgctagaacgcgaaggcatgggtatggaccagggcccccaagagatgatcgaccgctatctgtcactgggcgaacacgacagaaagcgtttagaagacgacgaggaccgccttctggccaccttgctgcataacctgatctcttatatgctgcttatgaaagtgaataaaaacgatatccgaaaaaaggttaggagacttatgggaaaaagtcatatcggcctggtgtacagtcaacaaattaatgaagtcctggaccagctagctaatttgaacggtagggatttgtctatatggtcctctggaagtcggcatatgaaaaaacagacctttgtcgtgcacgcaggtactgataccaacggggacattttctttatggaggtgtgtgacgactgtgtcgtccttcggtctaacatcggcacagtctacgagcgctggtggtacgaaaagttgataaacatgacttattgccctaaaacaaaagtgctgtgcctgtggcgcagaaacgggtctgaaacacaattgaataaattctataccaaaaagtgtcgggagttgtactactgcgttaaagacagcatggaaagggccgcagcacgacaacagtccatcaaaccaggtcccgagctggggggggagtttccagtgcaggatctcaagactggggagggtgggctgcttcaagtgactcttgaaggtattaacctgaagtttatgcacaatcaggtgttcatcgaactgaaccacattaagaagtgtaatacagtccgcggagtttttgtcctagaggagtttgtcccggagatcaaggaggttgtgtcacataagtacaagacccctatggcccatgaaatatgttattccgtcctgtgtctgttctcatatgtggcggcagtgcatagctcagaggaagacctgagaactccaccacgtccagtaagctcatag

SEQ ID NO: 194227 - DNA, 4767 bp, Artificial Sequence
  Description of Artificial Sequence: Synthetic coding sequence
atggtgcagaagaagaagttctgcccccggctgctggactacctggttatcgtaggggctagacatccctcctccgacagcgtggcccagactccggagttgttaaggaggtaccccttagaggatcacactgagtttccactccccccagatgtggtgtttttctgtcagccagagggatgcctttctgtccggcagaggcgcatgagccttcgggatgatactagcttcgtcttcactctgacggataaagacactggcgtgaccagatacgggatctgcgtcaatttctatagaagcttccaaaagaggatctctaaggagaaaggggaaggtggagcggggagtagagggaaggagggcacccacgccacttgtgcatctgaagaaggtggcacggagagttcagagtctggttcctctctacagcccctttctgctgattccactccagatgtcaaccagagtcctagggggaaacgaagagcaaaagccggcagccgttcccgaaacagcacactgacatctctctgtgtgctttcccactatcctttttttagcacgtttcgtgaatgcctgtatacactgaagcgtcttgtggattgttgtagtgagagactcctgggcaagaaattaggcataccgcgaggagtacagagagatacaatgtggagaatcttcaccggcagcttattggtcgaggaaaagtccagcgccctgttgcacgatctgagagaaattgaggcatggatctaccgcctgctgcggagcccagtgccagtttctgggcaaaaaagggtcgacattgaggttttgccccaggaactgcagccagctctcacgtttgcgctaccagatccttcaaggtttaccctggttgattttcctctgcacttgccacttgaactcctgggggtggatgcctgtctgcaggtccttacctgcattttgctcgaacacaaagtcgtcctacagtctagagactacaacgctctgagcatgagcgttatggctttcgtggcaatgatctatcctctggagtatatgtttcctgtgataccactgctgcctacctgcatggcttctgccgagcaactcctgctggctcccactccttacatcattggggtaccagcatccttcttcctttacaagctagatttcaaaatgcctgacgacgtgtggctcgtggacctagactctaatagggtgatagcccctacaaatgctgaggtgctcccaatcctgcctgaaccagaatcactcgagctgaagaaacacctgaagcaggctctggccagtatgagccttaacacacagccgatcctcaatctggagaaattccacgaagggcaggaaattcccttactccttgggaggccctctaacgatctgcagtcaactccaagtaccgaattcaatccactaatatacgggaacgacgttgattccgtcgacgtggcaacaagggtggccatggttcgattcttcaattctgcaaacgttctgcaaggatttcagatgcatactagaactttgcgactctttcctcgtcccgtcgtggcgttccaggcagggtcttttctggcgtcccgcccccgccagacaccctttgcagagaagcttgctaggactcaagcggtagaatatttcggtgagtggatcctgaaccccacaaactacgcctttcaacggatccacaataatatgtttgacccagcactcattggcgacaagcccaaatggtatgctcaccagcttcagcccattcattatcgcgtgtatgacagcaattcacagctcgcagaggcattgtctgtgcctccagagagggattccgactccgaacccacggatgatagtggcagtgattccatggactacgatgactcctccagctcctattctagccttggggacttcgtttccgagatgatgaaatgcgacattaatggcgacacgccaaacgttgacccacttactcacgccgcactgggggacgcgtcagaggtggagatagacgagctgcagaaccagaaggaggcagaagagcccggtccagacagcgagaactcccaggagaatcccccccttcggagtagctcctccactaccgctagctccagtccatccacagtgattcatggggccaactcagagcctgcagactccaccgaaatggacgacaaagcagccgtcggagtttcgaagccacttcccagtgtgcctccttctatagggaaaagcaacgtcgaccgaaggcaggcagagataggagaggggtctgtcagacgtcgtatttacgacaatccatattttgaacctcaatacgggttcccccccgaggaggatgaagatgagcagggggagtcttacaccccacggttttctcagcacgtgagtggcaaccgcgctcagaagttgctccgccccaattcattacggctcgcaagcgacagtgacgcagaatctgatagtagggcttctagccctaattcgacagtctccaacacttccactgaggggttcggcggcatcatgagcttcgctagtagtctataccgaaaccacagcacctcctttagtctttcaaacctcactctgcccacaaaaggtgcccgagagaaagcaaccccttttcctagcctgaagggcaatagacgagctctcgtagaccagaagtccagtgtgatcaaacattcacctaccgtcaagcgcgagcctccatcaccccagggtcgaagttcaaacagtagcgaaaaccagcagtttctcaaagaggtcgtgcactctgtactcgatggtcaaggggtggggtggctcaacatgaaaaaagtccgccgcttgttggagtcagaacagctcagggtgttcgtactttccaagctgaatcgtatggttcaatcagaagatgatgcacggcaggacataatccccgatgttgagatcagccggaaggtttacaagggaatgctggacctcctgaaatgcaccgtgttatcactagagcaatcctatgcacatgcggggctcggcggcatggcctcaatcttcgggctactggagatcgcccagactcattactacagcaaagagcctgataaacgcaaacggtcacccacggagtctgtcaacactccagtaggcaaggatccaggactggccggccgtggcgatccaaaggccatggcccagttacgggtgcctcagctcggtccccgagccccaagcgccaccggaaagggccctaaggaacttgacacgaggtctttgaaggaagagaacttcattgcaagtatcgggcctgaagttatcaagccggtgtttgacctgggtgagaccgaagaaaagaagtcacagatcagcgcagacagcggtgtgtccctgacctccagtagccagagaacggatcaggacagcgttattggggtctcacctgccgtgatgataagatcgtccagtcaggactctgaggtgtctactgtggtctccaatagctcgggtgaaactcttggcgctgatagcgatttgtcctccaacgctggggatggtccaggaggggagggcagcgtgcacctggcttcatcaaggggcaccctgtccgactccgaaattgagacaaactctgctacgagcaccatctttggcaaggcccacagcctaaagcccagtatcaaagagaaactagcaggttccccaattcgtacttccgaagacgtttctcaacgggtctatctgtatgaggggctgctaggcaaggagcgatcgactctgtgggatcagatgcaattctgggaggacgccttcttggatgctgtaatgctagagagggaagggatggggatggatcagggcccccaggaaatgattgatcgatacctcagcctgggggaacacgatagaaagcggcttgaagatgacgaggacagattgctcgctacgcttctgcacaatctgatctcttatatgctgttaatgaaagtgaataaaaatgatattagaaaaaaagtccgcaggttaatgggtaaatcacacattggactcgtgtactcacagcagatcaatgaagttcttgatcagcttgctaacctgaatggtcgtgatctcagcatttggagtagcggaagtagacacatgaagaagcagaccttcgtggttcatgccggaaccgatactaacggcgatatcttcttcatggaggtgtgcgacgactgcgtagtgttgagatccaacataggcactgtgtatgaacgctggtggtacgagaagcttataaacatgacctactgccctaagaccaaagtgctgtgcctgtggagaagaaacggtagcgagacccagcttaacaagttttatacaaaaaagtgtagggagctgtactactgcgtgaaggacagcatggaacgcgctgccgctcgacaacaatctatcaaacccggaccagagctcggaggagaattccccgtacaagacctcaaaactggagaaggcggtctgctgcaagtgacgcttgaggggattaaccttaaatttatgcataaccaagtatttatcgaattaaatcacattaagaagtgcaataccgtgcggggagtttttgtcttagaggagttcgtgcccgagattaaagaggtggtgagccacaagtacaagactccaatggcgcacgagatctgttactctgtcctgtgcctgttctcctatgtcgcagccgtgcatagctccgaggaggatctgcgaaccccaccacgacccgttagctcctag

SEQ ID NO: 194228 - DNA, 4827 bp, Artificial Sequence
  Description of Artificial Sequence: Synthetic coding sequence
atggtgcagaagaagaagttctgcccccggctgctggactacctggtgatcgtgggcgcaaggcacccttccagcgattctgtcgcccagacccctgagctgctccgacgatatcctctggaggaccatactgagttccccctgccccctgacgttgtatttttttgccaaccagaggggtgcctctcagtgcggcaaaggcggatgtcactccgggacgatacgagcttcgtgttcactctcaccgataaggacacaggcgtgactagatacggcatttgtgtgaatttttatcgatccttccagaagcgcatcagcaaagaaaaaggagagggcggcgcgggctctaggggtaaggagggaacacatgccacttgtgcctcagaagaaggaggcaccgaaagctctgaatccgggtccagcctccagccactgtccgcagattcgacacctgacgtcaaccagagcccccgagggaaacgccgggctaaggctggttcgaggagccgcaactccactctcacctcactgtgcgtcctctcccattatcccttcttttccacatttagagagtgtctctacactctgaagaggctcgttgactgttgttcggagcggctgcttggaaaaaagcttggcatccccaggggagtgcagagagataccatgtggaggatcttcaccggtagcctcttagttgaggaaaaaagctcagccttgctacacgatcttcgagaaatcgaggcttggatttaccggctgttaagatctccagtgccagtgagcgggcagaagcgggtcgatattgaggtgcttcctcaggagctccagcctgcactaacatttgctctaccagaccccagccgatttaccctagtggatttccccctccatctgccactggagctgctcggagtggacgcctgcctgcaggtgctcacgtgtatcctcctggaacacaaggtggtcttgcaatcaagagactacaacgctttatccatgtcagttatggcgttcgttgctatgatttatccactggagtacatgttccccgtgatcccattgctgcctacctgcatggccagcgctgaacagttgttgttagctccaaccccatatattattggagtgccagcttccttctttctgtacaaactagacttcaaaatgccggatgatgtatggctggttgacctggactcgaacagagtgatagcccccaccaacgccgaagtgctacctattttgccagaacctgagagtctggaactaaaaaagcacctgaagcaggctctggcaagcatgtccctaaacactcagcccatacttaatctagaaaagtttcacgaaggacaggaaattcccctcctgcttgggaggccgagtaatgacctgcaatctaccccgtccactgagttcaatcccttgatttatggaaacgacgtagactccgtcgatgttgcgaccagggtagctatggtcaggttcttcaatagcgccaacgtgctgcagggttttcagatgcacacacgtactttgcgtttgttcccaagacctgtggtggctttccaagcgggcagctttctagccagtaggccccgccagacgccattcgctgagaaattggcccgcacacaggctgtggaatacttcggcgagtggattttaaaccccaccaactatgcctttcagagaatccacaataatatgttcgaccccgctctgattggagacaaacctaaatggtacgctcaccaactccagccaatccattacagggtgtacgatagcaacagccagctagcagaggcactgtcggtgccacctgagcgtgacagcgactcagagcctacagatgattcaggctcggactcaatggactatgacgattccagcagctcttatagcagtctaggggattttgtctctgagatgatgaaatgcgacatcaatggggacacgcccaacgttgacccacttactcatgccgcactgggagatgctagtgaggtggaaatcgacgagctgcagaaccagaaggaggctgaggagccgggacctgactctgagaattcccaggagaatcctccgcttcgctccagttctagcacaaccgcctcaagctcacccagcactgtgattcatggagctaactcagagcctgccgatagtacagaaatggatgacaaggccgctgtgggtgtaagtaaaccgttgccttctgtccccccctccatcgggaaaagcaacgtggaccggcggcaggccgaaatcggtgagggctctgtccggaggagaatctatgataatccgtatttcgagccccaatacggcttccccccagaagaagatgaggatgagcagggagaatcttacacaccccggttcagccagcacgtttcaggtaatcgcgcgcaaaaactgctgcgcccaaattcccttcgactcgccagcgattctgacgccgaaagcgattctcgtgcgagctcgccgaacagtacggtctcgaacaccagcaccgaagggtttggaggaattatgtcctttgcctcgtctctgtatagaaatcactccacttcgtttagcctttctaatctaacactgcctaccaagggtgctcgggaaaaggccacaccgtttccttctctcaaagtgttcgggttaaacacacttatggagatcgtcaccgaggctggccctggatctggtgagggaaacagacgcgctttggtggatcaaaagtcaagtgtgataaagcattcccccacagtaaagagggaaccccccagcccacaagggaggtcttccaatagcagcgagaatcagcagtttcttaaagaggtggtgcactccgttctggatggccagggcgtgggctggttaaatatgaaaaaggtgcgaaggttgcttgagagcgaacagttgcgcgtattcgtgctgagtaagctgaaccggatggtacagagcgaagatgacgcaagacaggacattatcccagatgtggagatttctaggaaagtgtataagggaatgctggatttgctgaagtgcaccgttcttagccttgaacagagctatgctcacgctggcctggggggcatggcctctatcttcgggctgctggaaatagcccaaacccattactactccaaagaacccgataagagaaagaggagcccaacagagagcgtcaacacgccagtcggtaaggaccccgggctcgccggaaggggagaccccaaggcgatggcacagctgcgtgttccgcagctagggccacgcgctccatccgcaaccggaaaaggccctaaagaacttgacacacggagtctaaaagaggaaaatttcattgcgtcgattggcccagaggtcataaaaccagtgtttgacttgggagaaactgaggagaagaagtctcaaatcagcgccgacagtggagtgtccctgacttcaagctcccagagaacagaccaagatagcgtgatcggcgtgagcccagccgttatgatcagatccagttctcaggattctgaggtgtccaccgtggtatcaaacagcagcggcgagacactaggagccgatagcgacctgagcagtaacgccggggatggaccggggggcgaagggagtgtgcatctcgcatcaagtcggggcacactgagcgattcagagattgaaacaaatagcgctacctccactattttcggtaaagcacactctctgaaaccgtcaatcaaagagaagttagcaggcagtccaatacgcacgtcggaagatgtgtcccaacgggtgtatctatatgaaggacttttaggtaaggaaagatcaacgctgtgggaccagatgcagttttgggaagatgcgtttctggatgccgtgatgttggagagggagggcatggggatggaccagggcccccaagagatgatagacagatatctctcacttggagaacatgaccgcaagcggctggaggatgacgaggacagacttctagctactctgctccacaatcttatctcttacatgctgctcatgaaagttaacaagaatgacatacgcaaaaaggtgcggagattgatgggtaaaagccacatcgggttggtgtacagccaacagattaacgaggtgcttgaccagctggcgaacctcaacggcagagatctcagcatatggagctctggctcaaggcacatgaaaaagcagaccttcgtcgtgcatgctgggactgacaccaacggggatatcttcttcatggaagtgtgcgatgattgcgtagtccttagatcaaacattggcacggtctatgaaagatggtggtatgaaaagcttatcaacatgacctattgtcctaaaaccaaggtgctgtgcttatggaggagaaatggtagcgagacccaattaaacaaattctatacaaagaaatgtagggaattgtactactgcgtgaaggattctatggagcgagctgctgcgcgtcaacagagcattaagcccggaccagaacttggtggagagttccctgtccaggacctcaaaactggggagggaggacttttacaagtaaccctggaagggattaatctaaagttcatgcataatcaggtgtttatagaactgaatcacatcaaaaagtgtaataccgtgaggggtgtttttgtgctggaggaatttgtgcccgagattaaagaagtggtcagtcataagtacaaaacacctatggctcacgaaatctgttattcagtgttgtgcttgttttcatatgtggctgctgtgcactcaagcgaagaggatctccggactccccctagacctgtaagcagttag

SEQ ID NO: 194229 - DNA, 4746 bp, Artificial Sequence
  Description of Artificial Sequence: Synthetic coding sequence
atggtgcagaagaagaagttctgcccccggctgctggactacctggtgatagtcggggctagacatccatccagcgattcagtggcccagactcccgaattgctgcgtcgctatccactcgaggaccataccgaattcccgttgcctcccgatgtcgtcttcttttgtcagccggaggggtgcctgtcggttagacagaggaggatgagcctccgggacgacacatcctttgttttcacattaaccgataaagacacaggcgttacaagatacggaatctgtgtgaatttttaccgaagtttccagaaacgcatatctaaagagaagggggagggcggcgcgggcagccggggcaaggaggggacacatgccacatgcgccagtgaagaaggaggcaccgaatcatcagaatctggttccagcctgcagccgctttccgctgacagcactccagatgttaaccagagccccaggggtaagcggcgggctaaagctggtagcagaagcaggaacagtacgctgacctcactttgtgttcttagccactacccctttttttcaacgtttcgagaatgtctttacactctcaaacggttggtggactgttgctccgaacggctactgggaaagaagctggggatcccacggggtgtgcaaagagacactatgtggaggatctttacaggatccctcctagtggaggagaagagcagcgccctgttacacgatctacgggagattgaggcctggatttataggctgctgcgttcacccgtgcccgtgagtgggcagaagcgggtggacattgaagtgttaccccaagagcttcagccggctcttacctttgcgctgcccgaccccagccgcttcacgctcgtggacttccctctacatttgccgcttgagcttctcggcgttgacgcttgtctccaggtgttaacgtgtatattgctagagcacaaggtggtcctacagtcacgagattacaatgcccttagtatgtcggtgatggccttcgtggcgatgatttaccccctggagtacatgttcccagtgatccccctcctaccaacctgcatggccagcgccgaacagctcctgttggctcctactccatacatcattggcgtgcctgcatcatttttcctatacaaactggacttcaaaatgcccgacgatgtgtggctggtcgacctcgactccaatagagtcatcgctcccacaaatgcagaagttcttccaatcttaccagagcccgaatcccttgagctgaaaaaacatctgaagcaagccctggcctccatgtccctgaatacccagccgatcttgaatctggaaaagttccacgaaggccaagagatccccctcttactcgggaggccgagcaatgacttacaaagcacccctagcactgaatttaaccctcttatctacgggaacgacgttgactctgtggacgtagccacaagagtggccatggtgcggttcttcaactctgcaaacgtacttcagggatttcagatgcacactcgcaccctaaggctttttcctagaccagtggtagcctttcaggccggctcattcctggcatctcgtcccaggcagactccgttcgccgaaaaactcgctaggacccaagctgtcgagtatttcggcgagtggatcctcaacccaacaaattacgcatttcagagaatacacaacaacatgttcgatcccgcattgattggagacaagccgaagtggtatgcccatcagttgcagcccatccactacagagtatacgacagtaactcgcagctggcagaggcactctcagtgccacccgagcgcgacagtgatagtgagcccaccgatgattctgggtctgactcaatggattacgatgattcctcctcaagttatagctccctgggcgactttgtgagcgagatgatgaaatgtgatatcaatggcgacacaccgaacgtggatcctctgacccatgcggccctgggcgatgctagtgaagtggaaatcgacgaacttcaaaaccaaaaagaggccgaggagccagggcccgacagcgagaatagccaggaaaatccacccctgcgaagttcatctagtaccactgcctcctctagtccctcaacggttatacatggagccaattccgaacccgctgattcaaccgagatggatgataaagccgctgtgggggtgagtaaacccctgccatccgtccctccctcgataggcaagtcaaacgtagacaggcgtcaagcggaaatcggcgaaggttctgtgcgtagacggatctatgacaatccctacttcgagccccagtatggttttccacctgaagaggacgaagacgaacagggtgagtcctacacccctcgtttctcgcaacacgtctctggaaatcgagcacagaagctgttgcggcccaattcattgagactcgcaagcgactcagacgccgagagcgattctcgggcgtcgtcccccaattctacagtttcaaatacctctaccgaaggttttggcggcattatgtcattcgcatcttccttgtacagaaaccacagtacttcattcagcctaagcaacctgaccctgcccacaaagggggcacgagaaaaggcgacaccttttccaagcctgaaagtcttcggactaaataccctgatggaaatcgtgactgaagcgggcccaggtagtggcgaggggaaccgacgggctctggtggatcagaagagtagcgtcattaaacacagccctaccgttaaacgggaacctccgtccccgcaaggccgatcatccaacagcagcgaaaaccaacaatttctaaaggaggtcgttcatagcgtgctggacgggcagggggtgggatggttgaatatgaaaaaagtccgacggctcctggagagcgagcagctgcgggtatttgtactgagtaagctgaatagaatggttcagtccgaagacgacgctagacaagacatcatccccgatgtggagataagccgaaaggtgtacaagggaatgctcgatctgctgaagtgcaccgtgctgtcgctcgagcagtcttacgcacacgccggcttaggcggaatggcctctatctttgggctgcttgaaattgctcaaacacattattattccaaagaaccagataagcgcaagaggtccccaactgagtctgtaaacaccccagttggaaaagatccaggccttgccgggagaggcgaccccaaagctatggcccaattgagagttcctcaactaggaccgcgcgcaccatctgccaccggcaaaggtcctaaggaactggataccagaagcttaaaggaagaaaactttattgcaagtatcgagctttggaacaaacaccaggaagtgaagaaacaaaaggctctcgaaaagcaaaggcccgaggtgatcaaacctgttttcgacctcggcgaaaccgaggaaaaaaagagtcaaatctctgccgactcaggcgtatcactgacatcatcttctcagagaacagatcaggattctgtcattggagtatcacctgccgtgatgattcggtcaagttctcaagacagcgaagtctccaccgtcgtcagcaattcgagcggtgagacattgggagccgactccgacctaagttctaacgctggagacggccccgggggtgaaggttccgtccatttggcctcaagccgcgggaccctgtctgactctgaaatcgagaccaactccgcaacctccaccatcttcgggaaagctcacagcctgaaaccttctatcaaagaaaagctagccgggagccccatccggaccagcgaggacgtatctcaacgcgtttacctctacgagggattgctgggtagagataaaggctcaatgtgggatcagttggaggatgcggcgatggaaacattctctatctctaaagaacggagcactctgtgggaccagatgcagttctgggaagatgcatttcttgacgctgtgatgctggagagagagggaatgggcatggaccaggggccccaggagatgattgatcgctacctgagcctgggagaacatgatagaaagcgcttggaagacgatgaggacagactgctggcaactcttctgcacaacctgatctcatacatgctcttgatgaaagtgaacaagaacgacattcgcaagaaggttagacgcctaatgggaaaatctcatatcgggctggtctatagtcagcagattaatgaggttctggatcaactggccaatttgaatggtagagatctgtccatatggtcatccggaagcagacatatgaagaaacagaccttcgttgtacatgccggaacagatactaacggagatatcttcttcatggaagtctgcgatgattgtgtcgtgctccgtagtaacattggcaccgtgtatgagaggtggtggtatgaaaagctgattaacatgacgtactgccctaagaccaaagtgctgtgtctttggaggcgcaatggtagcgaaactcagttgaacaaattttatacaaagaaatgtcgggaactttactactgcgtcaaggacagcatggagcgcgccgctgctcggcagcagagtatcaaacccggccccgaactcggtggagaatttccagtgcaggatcttaaaaccggtgaggggggccttctgcaggtgacactggaggggatcaatctgaaattcatgcacaatcaattccttaagctaaaaaagtggtag

SEQ ID NO: 194230 - DNA, 4440 bp, Artificial Sequence
  Description of Artificial Sequence: Synthetic coding sequence
atggtgcagaagaagaagttctgcccccggctgctggactacctggtgatagtcggcgccagacatccttcatccgatagcgtcgcccagacacccgaattgttacgccgatatcctttggaagaccacacagagttcccgttgcctcctgatgtcgtttttttttgtcagccagaggggtgtctgtccgttcggcagcggagaatgagtctgagagacgatactagcttcgtgtttactcttacagacaaagacactggagtcaccagatacggcatctgtgtaaatttctaccgttcatttcagaaaagaattagtaaggagaaaggagagggaggagccggtagccgcggtaaagagggaacacacgctacttgtgcctccgaggaaggtggcaccgagtcatctgagtccggcagcagcctgcagccgctgtcagccgatagcacacccgacgtcaaccagtcccctagaggcaaaagaagggccaaagccggaagtaggtcaagaaatagcactcttacctccttgtgcgtgttgagtcactacccgtttttttccacgtttagggaatgcttatacaccctgaagagattggtggattgttgcagtgaacgattgttgggaaagaagttgggcatcccaaggggtgtccagagagacaccatgtggcgaatcttcaccgggtctctgctcgtcgaggaaaagtcgtccgccctcctacacgacctaagggaaatcgaggcctggatctatcggctgctgcggagccccgtgcccgtctcgggccaaaaacgggtggatattgaagtgctgcctcaggagctccaacccgctctgacctttgcgcttccagatccttcacgatttacgctggtggacttccccttgcacctgccactagagctgctcggggttgatgcgtgtctgcaggtcctcacatgcatactgctggagcacaaagtagtgctgcaaagtcgtgattacaatgccttgagcatgtctgtgatggcttttgttgctatgatctaccccctggaatatatgttccccgttatacccttactgcccacttgtatggcttcggctgagcagctgctgcttgcccctactccgtatatcatcggcgtgcccgccagtttcttcctgtacaaacttgactttaaaatgcctgacgacgtttggctcgtggacttggacagtaaccgcgtgatcgcccctacaaatgctgaagtccttcctatcttgccagaacccgagagtctagagctgaagaagcatttgaaacaggcactggctagtatgagtctcaacacccaacccatcctaaatctggaaaaatttcacgaggggcaagagatccctcttttgctgggtcggccgtccaacgacttacagagcacgccttccacagaattcaatccattgatctatgggaacgacgtcgactccgtagatgtagccacgcgggtggccatggtgcggttcttcaactctgcaaatgtgttgcaggggttccagatgcacacacgcactttaaggttatttcctagaccggtggttgctttccaggcagggagtttcctcgcctcacgcccgcgacagaccccctttgccgaaaagctcgcccgcacccaggccgttgaatactttggcgagtggattcttaaccctactaactatgcctttcagcggattcacaacaatatgttcgatcccgccctgattggcgacaagcctaagtggtatgcgcatcagttgcagcccatccactaccgcgtgtatgattcgaacagccagctcgcagaggcactctctgtccctccggaacgcgattctgactctgagccgacggacgatagcgggagcgatagtatggattatgatgattcctcctcttcttattcgagtcttggcgattttgtgagtgaaatgatgaagtgtgacatcaatggtgacacccccaatgtcgacccactgactcacgcagcccttggcgacgcctctgaggtggagattgacgaactgcagaaccagaaagaagcggaggagccgggcccggactctgagaattcgcaagaaaatcccccattacgctctagctcctccaccactgcctctagctccccatccacagttattcacggggccaactccgaacccgctgacagcaccgagatggacgacaaggccgcagtgggcgtgtctaaaccactgcccagtgtgccacctagcattggtaagtctaacgtggacagacgacaagctgaaataggggagggggcccagaaactgctccggcccaactccctccgccttgcctcagatagtgacgctgagagtgacagccgggctagcagccctaacagtaccgtcagcaacaccagcactgagggattcggtgggatcatgtctttcgcctccagtctctaccgaaatcactctacctcattctcattaagtaacttgactctgccaacaaagggagcaagggagaaggccacccccttcccctcactgaagggaaaccggagggctctcgtagatcagaagagttctgttattaagcacagtccaacggtcaagagggaaccacccagccctcaggggaggagtagcaacagctcagaaaaccagcagttcctcaaggaggtggtccatagtgtcctcgacgggcaaggggtcggctggctcaatatgaagaaagtacgcaggcttctagagtcagaacagctgagggttttcgtgcttagcaagctgaacaggatggtccagtccgaagacgatgcccgccaggatatcatacctgacgtggagatctctcgaaaagtctataagggaatgctcgacttgcttaagtgcacagttctttcactggaacagagctatgctcacgctgggctgggagggatggcaagcatttttggactgctggagatcgcccagactcattattactccaaagagcccgataaacgtaaaaggtcacccactgagagcgtcaatacacccgtgggaaaagatcccggcctcgccggccgaggagaccccaaggctatggcccagctgcgcgtgccgcagctgggtccaagagcaccgtcagctaccggcaaggggcccaaagaactcgatacacgttcgcttaaggaggagaatttcatcgccagcattggaccagaggtgattaaaccagtatttgatctgggggagacagaagagaaaaaatcacagatcagcgccgattctggagtaagtttgaccagctcctcacaacgtaccgaccaagatagtgtcatcggggtcagccccgcggttatgatacgatctagttcacaggattccgaagtgtcaactgtcgtgtctaattcctccggcgaaaccttgggcgcggactccgatctgtcttccaacgccggggacggacccggcggagagggctctgtgcatctggcctcatctcggggaacactcagcgacagcgagattgagactaacagcgcaacctctacaattttcggcaaggcccattctctaaaaccctctataaaagagaagctagctggcagcccaatccgcacctccgaggacgtgagccagcgagtctatctgtacgagggattgcttggtaaggaacggtctacactatgggaccagatgcaattctgggaggacgcctttctggatgccgtcatgctggaacgggagggaatgggtatggaccagggcccccaggaaatgatcgacagatacctgtcactgggcgagcacgatcgtaaacgactggaggatgatgaagaccggttactggccactctgcttcacaacctaatctcttacatgctcctgatgaaggtgaacaagaatgatatcaggaagaaagttcggcgactaatgggtaaatctcacattggactagtttattcccaacaaattaacgaggtgcttgaccagctggccaacctcaatggccgagatcttagtatctggagttccggaagccgacatatgaagaagcaaacatttgtggttcacgccggcaccgataccaacggggatatcttctttatggaggtatgtgacgactgcgtcgttttgcggagcaatatcggcacagtttatgagcgctggtggtatgagaagctgatcaacatgacctactgccccaaaaccaaagtattgtgtctgtggcgacggaatgggtcagaaactcagctaaacaagttttataccaagaagtgtcgggagctttactactgcgtgaaagacagcatggagcgggcggcagcacgccagcagagtattaaacccggtcctgaactcggaggagagttccccgtgcaggaccttaagaccggagaaggcggactgctccaggtcacactcgaaggcatcaatcttaagtttatgcacaaccaattacttaggcggcttcggtggtag

SEQ ID NO: 194231 - DNA, 4626 bp, Artificial Sequence
  Description of Artificial Sequence: Synthetic coding sequence
atggtgcagaagaagaagttctgcccccggctgctggactacctggtcattgtaggggcccgccacccatcctccgactcagtggctcaaaccccagagctactgcgaaggtacccgctcgaggaccacactgaatttccgctcccccccgatgtcgtattcttttgccagccagagggctgcttaagcgtgcgacagcgccgtatgagcctccgggacgacacaagctttgtatttacgttaacagacaaagacaccggagtaactaggtacggaatctgcgtcaacttctaccgcagcttccaaaaaaggatctccaaagagaagggagaggggggggcaggcagcaggggcaaagaaggcacacacgccacttgtgcttcggaagaaggcggcacggaatcatcagagtctggctcgtccctgcaaccgctgtcagcagatagcactccggatgttaatcagagcccgcgggggaagcgacgggccaaagctgggtctagatctcgtaactctaccctgaccagcctgtgcgtcctgtcacattatccttttttttctacattccgcgagtgtttgtacacactcaaacggcttgtggattgctgttcagaacgattactgggcaagaagctcgggattccgcgaggcgtgcaacgcgacacgatgtggaggatcttcaccggcagcttgctcgtcgaggagaaaagcagtgcccttctgcatgatctacgcgagatcgaagcgtggatttatcggctgctgcgaagccccgtcccagtctctggtcaaaaaagagtagacatcgaagtgctgccgcaggaactgcagcctgccctgacctttgcactgcctgatccatcgaggtttacattggttgattttcctttacaccttcccttagaactgctgggcgtcgacgcctgcctccaagtgctcacctgtatcctcctcgagcataaggtggtgttgcagtcgcgcgactacaatgccctgagtatgtcagtgatggcttttgttgcaatgatctatcctctagagtatatgtttcctgttatccctctgctgcccacatgtatggcaagtgccgagcagctgttactggctccaaccccatacatcatcggagtgccggcgagtttttttttgtataagctggattttaagatgccagatgacgtgtggctggttgatctcgattcaaatcgcgtgatcgctcctacaaatgctgaggtcctccccatcctcccagaaccagaaagccttgagctcaaaaaacatctgaagcaggctctcgcctccatgtcccttaacacacagccaatactgaacctagagaagttccacgagggtcaagaaattccactgcttttaggtcgtccatccaacgacttgcagtccacaccgtccacggagtttaatccactgatttatggaaatgacgttgactctgtggatgtcgcaacgagggtggctatggtccggttctttaactctgcgaatgtgctccagggtttccagatgcacactcgcactcttagactatttccccgtcctgtagttgcctttcaggctggttcgttcctggcctccagaccccggcaaacaccctttgccgaaaaactggcaaggacccaggccgtggagtattttggcgagtggattcttaatccaacaaactacgcttttcagcggattcacaacaacatgttcgacccagctctcattggagataagcctaagtggtatgcgcatcagctgcagcctattcactatcgagtgtacgattcgaatagtcagctggccgaagcactgagcgtgcctccagagagggactcagattcggagcctaccgacgatagtgggtccgactccatggactacgacgactcaagttcatcttactcaagcctgggagattttgtttcagagatgatgaagtgtgacattaacggtgacaccccgaatgtcgacccactgacacacgccgcccttggtgacgctagcgaagtcgagattgatgagctacagaatcagaaggaggctgaggagccaggcccagactctgagaactcacaggagaacccccccctcaggagttcttcttcgacgacagcctcttcatcaccatcaacggtgatacacggagccaactctgagcctgctgatagtactgaaatggatgacaaggcagccgtcggggtaagcaaaccactacctagtgtgcccccatccataggcaaatcaaatgttgatcgaagacaggccgaaattggggagggagcacagaaactgcttcgtccaaattctttgcggctcgcctctgattccgatgccgagtcagacagtcgagccagttctcctaattccactgtgtctaatacctcaacggaggggtttggagggatcatgtcttttgccagttctttatatagaaatcatagcactagcttcagcctttctaatctgaccctccccaccaagggtgcaagagagaaggccacccctttcccttctttgaaggggaaccggagagcattggtggaccagaagtcaagcgtcatcaagcactccccaactgtgaaaagggaacccccctcgccgcagggacgctccagcaatagttccgagaatcaacagtttttgaaggaggtcgtccacagcgtgctggatggccaaggggtcgggtggctcaatatgaaaaaggtccgtcgtttacttgaaagcgagcagctgagggtgtttgtgttgtctaaattaaacagaatggtccagtccgaggacgatgctcgacaagacatcatccccgacgtggaaatctcccgaaaagtgtacaaggggatgctggatctactcaagtgcaccgttttgtcactggagcagtcctacgcacatgctggcctgggtgggatggcatctatcttcggcctgctggagattgctcagacccactattattcaaaggagcctgacaagcgcaagaggagtccaacagagtctgtgaacacaccagtgggaaaggatcctgggttggcagggaggggcgatccaaaggccatggcgcaactgcgcgtgccacagctgggaccccgtgccccctctgcgacagggaaggggcccaaagaactggatactcgctcccttaaagaagagaacttcatcgccagcattggtccagaggttatcaaacctgtctttgacctcggcgagaccgaggaaaagaaatctcagatctccgccgacagtggggttagcctgaccagtagcagccagcggactgatcaggatagcgttatcggtgtaagccccgccgtgatgattcggtctagtagccaggacagcgaggttagcaatagctcaggcgagacccttggtgctgacagtgacctgtcttccaatgctggagatggtcccggaggagagggcagcgtgcatcttgccagttcaagaggtactctgtctgatagcgagatcgaaaccaattcagccacgtccactatctttggaaaagcccactcacttaagccctccattaaggaaaaattagctgggagcccgatcagaaccagtgaggacgtaagccagcgcgtctacttgtacgaggggctgttggggaaggagcgaagtactctgtgggatcagatgcaattctgggaagatgcattcttagacgctgtcatgttggagagagaaggaatggggatggaccagggaccccaagagatgatcgatcggtacttaagcctcggtgaacacgaccggaagaggctggaggacgatgaggatagacttctggccacgctgcttcataacctgatttcctatatgctcctgatgaaggtcaataaaaacgatatccggaaaaaggtgcggaggctgatgggcaaatcacacattggcttagtgtattctcaacagatcaacgaggtgcttgatcaactcgccaacctgaatggccgggatctgtccatctggagttctgggtcaagacacatgaagaaacagaccttcgtggtgcacgctggtacagatacaaatggcgatatcttcttcatggaagtgtgtgatgattgcgtggtcctcagaagcaacatcggcaccgtctacgaaaggtggtggtatgagaaactcatcaacatgacttattgcccaaagacaaaggtgctgtgtctgtggcggcgtaatggctccgagacccaactaaacaaattttatacaaaaaaatgtagagagctatactattgcgtcaaagacagtatggagcgggctgcagctcgccagcagtccatcaagccaggacctgagctggggggagagttccccgtccaagacctcaaaacaggcgaggggggactcctccaggtgacactggaagggatcaatcttaagtttatgcataaccaggtgttcattgagctgaatcacatcaagaagtgtaacacggtgcgcggcgtgttcgttcttgaagagttcgtgcctgaaattaaggaagtggtgagccataaatacaaaactccaatggcccacgagatctgttactccgtgttatgtttgtttagctacgtggccgctgtacattcatcagaggaggatcttcggactccccctagacccgtctcctcttag

SEQ ID NO: 194232 - DNA, 4764 bp, Artificial Sequence
  Description of Artificial Sequence: Synthetic coding sequence
atggtgcagaagaagaagttctgcccccggctgctggactacctggtgatcgtgggggcccgccatcccagttccgattctgtggcccaaacacccgaactgctccgacggtatcctttagaagatcacacagagtttcctttaccacctgacgtcgtgttcttttgtcagcctgaaggctgtctgagtgtgcggcaacggcgaatgtccctgcgggatgataccagtttcgtgtttacgctgaccgataaggacaccggagtcactcggtatggcatatgtgtaaacttttataggtcatttcagaaacgaattagcaaggagaagggggaaggtggggccggatccaggggcaaggagggaacacacgctacttgtgctagcgaagaggggggcacggaaagcagcgaaagtgggagctcactacagcctctcagcgccgattcgaccccggacgtgaatcagagcccccggggcaagagacgagccaaagcaggatcaaggtcacggaatagcactctgacctctctgtgtgtgctgtctcactatccattcttcagcacattccgggagtgtctgtacacgctgaaacgcctcgtggattgctgttcagagcggctgctgggaaagaaactgggaataccgcgtggagtgcaaagggacaccatgtggagaatcttcacgggaagtctactagtggaagagaaaagctccgctctgctccacgacctgcgtgagattgaggcatggatatatcgcctcttacggagccccgtgcccgtgagtggacagaagcgtgttgatatcgaggtcctcccccaagaactgcagcccgctcttacatttgcactccctgaccccagccggtttactttagtcgatttccccctgcatctgccgctagaactcttgggtgtcgacgcatgtctgcaggtgctgacttgcatacttcttgagcataaagtggtcctgcagagcagagattataacgctttgtcaatgtccgtgatggctttcgtcgcaatgatatatcctctcgagtacatgttcccggtaatacctctactcccaacgtgcatggcctctgctgaacagctgctactggcacctactccctatattatcggagttccagcaagtttttttctctacaagctggatttcaaaatgccagacgatgtatggctcgtggacctggattctaatcgcgtcatcgctcccaccaatgccgaagttcttcccatattgcctgagccagagtccctcgagttgaaaaaacatctgaagcaggcactggcttctatgtctctgaatacccagccaatattaaacttagaaaagttccatgagggtcaggaaattccactcttattaggccggccctctaatgacctgcaatcaacgccttccactgaattcaaccccctgatatatgggaatgacgtcgatagcgtggatgttgcgactcgagttgcaatggttagattcttcaactcggcaaacgtgctgcaggggttccagatgcatacacgaacactcaggctttttccccggccagtagttgccttccaagccgggtcttttcttgcgtcacgtccccgtcaaacaccctttgccgaaaagctggcaaggacgcaggccgtggaatatttcggagaatggatccttaatccgacaaattatgccttccagcgtattcataataacatgttcgacccagcgctgatcggtgataagcccaagtggtatgcacaccagctccagcctatccactacagagtatatgactccaacagtcagctcgccgaagcactgtccgtcccacccgagagagactccgattcagaacctactgacgacagtggctccgattcaatggactacgacgacagttcctcatcttactcctctctgggggatttcgtcagcgaaatgatgaagtgcgatattaacggtgacaccccaaatgtggacccgctgactcatgcggccctaggggatgcttccgaagtggagatcgacgaactgcaaaaccagaaggaagccgaggaaccagggccagactcagagaattctcaggagaaccctcctttacgaagctcttcttccactactgccagctcgtccccatctacagtgattcacggtgccaattccgaacccgccgattctaccgaaatggacgataaagccgcagtgggcgtgtctaagcctctcccgagcgtgcccccatcgataggcaagtccaatgtcgatcgtagacaggcagaaataggcgagggttctgtgcggagaaggatatatgacaacccatatttcgaaccacaatatgggttcccccccgaagaagatgaagacgagcagggagaaagctacaccccccgcttcagccagcatgtgtctggaaatcgcgcccaaaagcttctgaggccaaatagcctgcgactggcatctgatagcgacgccgagtctgactctcgcgcctcaagtccgaatagtactgtttccaatacgtccactgagggttttgggggcatcatgtccttcgccagctctctgtatcgcaatcacagcacttcctttagtctaagcaatctgaccctgccaaccaagggcgcccgcgaaaaagctacgcccttcccttccctcaaggggaacaggagagccctagtggatcaaaagtcgtctgtgatcaagcattcacccaccgtgaaaagggagcccccatctccacagggcagatcaagcaatagtagcgagaaccagcaatttctgaaggaagtggtccatagcgtacttgatggccagggagttggctggctcaacatgaagaaagtgagaagactcctggagtctgagcagctgcgggtgtttgtattgagcaaactcaataggatggttcaatccgaagacgacgctcgacaagatatcattcctgatgtggaaatcagccgaaaggtgtacaaggggatgcttgacctgcttaagtgcacagtgctatctttggagcaatcatacgcccatgcgggcctcgggggaatggcaagcatcttcggtctcctggagattgcccaaacacactattactcaaaagagccggacaaacggaaacgctcacctacagagtcagtgaacactcctgtaggaaaggatcctggactcgctggccggggcgatccaaaggccatggcccagctgcgggttccccagctgggccccagagcgcccagtgccacagggaagggtccgaaggagttggacacacgcagcctgaaggaagagaattttatcgccagtataggccccgaagtgatcaagccagtctttgatctgggcgaaacagaagagaagaagtcgcaaatttcggctgattccggcgtgtctctgacctcctcttcccaacgcacagatcaagactctgtaataggtgtgagcccggccgtaatgatcaggtctagcagtcaggattccgaggtctcaactgtatccaattctagcggggaaacactcggtgctgactcagacctcagcagtaatgcaggggatggccccggcggagagggctcagtgcacttggcctcatctcgcgggactttgtcagactcggagattgagaccaactccgcgaccagtaccatttttggaaaggcgcatagcctgaagccgtcgatcaaggagaagctcgctggttcccctatacgcacctcagaggatgtatctcagagggtgtatctgtatgagggcttgctgggcaaggaacgcagcaccctttgggatcaaatgcagttctgggaagatgcgtttttggatgcagtcatgcttgagagggaaggaatggggatggatcagggtccccaggagatgatcgaccgttacctatcattaggcgagcacgaccgaaaacgactcgaggacgacgaggataggcttttagctactctgctgcacaatctgattagttacatgctactcatgaaagtaaataaaaacgacataaggaaaaaggtgcgaagactcatgggcaaaagccacatcgggctggtatacagtcagcagattaacgaagtcctggatcagctggcgaacctgaacggccgggatctgagcatttggtctagcggcagcagacacatgaaaaagcagacatttgtcgtacacgccgggaccgatacaaatggcgacattttcttcatggaggtttgtgacgattgcgtagtgttgcggtctaatataggcactgtttatgagaggtggtggtatgagaaacttatcaatatgacctactgcccgaagaccaaggtgctgtgtttgtggcgacgcaacggttcggaaactcagctcaacaagttctacactaaaaaatgtcgggaattgtactattgcgtaaaggatagcatggaacgtgctgcggctcggcagcagtcaataaaacccggacctgaactgggcggagagtttccagtccaggatttgaaaaccggggaaggtggactgctacaggtgaccttagaaggcatcaacctcaagtttatgcacaaccaggttttcattgagttgaaccacatcaaaaaatgcaacacagttaggggcgtgttcgtgctggaagaatttgtacccgaaattaaggaggtcgttagccataagtacaagacccctatggcccatgagatttgctattcagtgctgtgcctgttctcctatgttgctgccgtgcactcctcagaggaggatctcagaacccccccaaggccagtgtcctcatag

SEQ ID NO: 194233 - DNA, 4638 bp, Artificial Sequence
  Description of Artificial Sequence: Synthetic coding sequence
atggtgcagaagaagaagttctgcccccggctgctggactacctggtgatagtcggagcccgccatccttcctccgactctgttgcacagacccccgagctgctgagacgatatcccttggaggatcacacagaattcccactgccccccgacgtcgtgtttttttgccagccagaaggctgcttaagcgtccgccagcggagaatgtctcttcgcgatgacaccagcttcgtatttactctgaccgataaagacacaggcgtcaccaggtacggcatctgcgttaacttttatagaagcttccagaaacgaatctctaaggaaaagggagaggggggcgcaggtagcagggggaaagaagggacacacgctacgtgcgcaagcgaggaaggagggacagagtcatctgagtcaggctccagtctgcaacctctcagcgctgattccacacctgatgttaatcagtctccccggggaaagcgcagggcaaaggccgggtcccggtctaggaattctactctgacctctttgtgtgtgctgagccattacccatttttctcaaccttcagagaatgtttgtataccttgaagcgcctggtcgactgctgctccgaaaggcttctcgggaaaaagttagggatcccacggggtgtacagagagacacaatgtggcgaatttttacagggtccctgctcgtggaagaaaaaagcagtgccttattacatgatctgcgcgagatcgaagcctggatatatcggttgctgcgatcgcccgtgcccgtttcagggcaaaagagagtggatatagaagtgcttccccaggagttgcaacccgcactcacttttgccctgccagacccctcaagattcacactggtggactttcccctccatttgcctctggaacttttgggggtcgacgcgtgccttcaggtacttacttgtatcctgctggaacataaggtcgtcctccagtctagggactataacgcattgagcatgtccgtgatggctttcgtggcaatgatttatcctttagaatatatgttcccagtgattcctcttctaccaacatgcatggcatctgcagagcagctcttacttgctccaactccttacatcatcggagtgccagccagcttcttcctgtacaagctggattttaaaatgccagacgatgtgtggctggttgacctcgacagcaacagggtgatcgctccaacaaatgcggaagttctgcccatcctgcccgaacccgaaagtttggaactgaagaagcatctgaaacaggccctcgcaagcatgtcccttaacactcagcctatcctgaacttagagaaatttcatgagggtcaagagatcccgctccttttaggcaggccttcaaacgatctgcagtccaccccctccaccgaattcaatccgctgatctatggcaacgacgtcgatagcgtcgacgtggcgacgcgcgtcgccatggtcagatttttcaattcagcaaacgtcttgcagggcttccagatgcatacccgcacacttcgactgtttccaaggcctgttgttgctttccaagctggcagcttcctggctagccgccctagacagacgccctttgccgaaaagttggccaggacacaggccgtcgagtatttcggagagtggatcctgaacccaactaactatgcctttcagaggattcacaataatatgtttgaccctgccctaattggggacaagcctaaatggtacgctcaccaactccagccaatccactaccgcgtttatgacagtaatagccagcttgcagaggccctgagtgtgcctcccgagcgggactcagacagtgagcctactgacgatagcggctctgatagtatggactatgacgattcttcctccagttattcctcactgggcgattttgtgtccgagatgatgaaatgtgacattaatggggatactcccaacgttgaccccttgacacacgcagctctgggtgacgctagtgaagtggagatcgatgaactgcaaaatcagaaggaggcagaggagccaggcccggactccgagaattcccaggagaaccctccgttgcgcagttccagctctactacagcctctagttcaccaagtaccgtgattcatggagctaacagcgagcccgctgactcgaccgagatggatgacaaggctgccgtcggggtgtcaaagcccctgccttccgtccctcctagtataggcaaatctaatgttgaccgccggcaggcagaaatcggagagggggcccaaaaattgttgcgccccaatagtcttagactcgcgtcggacagcgatgctgagtctgactctcgagcttctagcccaaatagcacagtgagtaacacctcaacagagggcttcgggggaattatgtccttcgcttccagtttgtacaggaaccacagcacctcgttctccctgtccaaccttactctaccgacaaaaggggctcgcgaaaaggctactccttttcccagtctcaaagggaatagaagggctctagtcgaccagaagagttccgtgatcaaacactcccccacagtgaagagggagcccccgagtccacagggtcggtcctccaattccagcgaaaaccagcagtttcttaaggaggtggttcactccgtgctcgatggccagggcgtgggttggttgaacatgaagaaggtaaggaggctgctggaaagcgagcagctgcgcgtattcgtgttgtctaaactgaacaggatggtgcaaagtgaagatgacgcgcgccaggatataattcctgacgtcgagataagcaggaaggtctacaaggggatgttagacctgctaaagtgtaccgtcctatcactggagcagtcctatgctcacgctggtctgggcggcatggcttccatctttggtctcctcgagatcgcccagacgcattattattccaaagaacccgacaaacggaagcggagcccaacagaaagtgtaaacactcctgttgggaaagatcctggcctggcaggaaggggcgatcctaaggccatggcccaactgcgggtgcctcagcttggcccccgcgcacctagtgccactggaaaagggcccaaggagcttgatacacgatccttgaaggaggaaaacttcatcgcgtcaattgggccagaggtgattaaacctgtgtttgatctgggagagacagaggaaaaaaaatcccagatttccgccgactccggcgtctctctgacctccagttcacagcgcacagatcaggactctgtgataggcgtctcaccggcggtgatgatcagatcttcttcgcaagatagcgaggtctcgacggtagtatccaactcatcgggggaaactttgggcgccgactccgatttaagtagtaacgccggcgatgggccaggtggagaggggtcagtgcacctggcatcttcacgcgggaccctatcagacagcgagatcgaaacgaactcagccacatcaacaatcttcgggaaagcccatagtctcaaaccaagtattaaggaaaaactggcaggatccccgatcaggaccagtgaggacgtaagccagcgcgtgtatttgtatgaggggctgctcggtaaggaaaggagtaccctgtgggaccagatgcagttttgggaagacgctttcctggacgctgtgatgctcgagagagaaggtatgggaatggatcaggggccccaggagatgattgaccgctacctgtcgctgggggagcatgacagaaaacgtctcgaagacgatgaggatcgtttgctagcgactttgctgcacaatctcatatcctacatgctactgatgaaggtgaacaaaaatgacataaggaagaaggtgcgccgcctgatgggaaagtcacacatcggcctggtctacagccagcagattaatgaagtcctggatcagttggccaaccttaatggcagggatctgagcatctggtcatccgggtctagacacatgaagaaacaaactttcgtcgtgcacgctggtacagatactaatggtgacatcttctttatggaagtatgcgatgattgcgttgtgttacgctctaatatcgggacagtgtacgagcgttggtggtatgagaagctgattaatatgacatactgccccaagacaaaggttttatgtctgtggcgccgtaacggttccgagactcagcttaacaaattctatacgaagaaatgccgagaactgtattattgtgtgaaagatagcatggagcgggccgccgcaagacagcaatcaattaaaccgggcccagagttggggggtgaatttccagttcaggacctcaaaactggcgagggggggctcctccaagtgacgctcgaagggatcaacttgaaattcatgcataaccaggtttttatcgaattgaaccatatcaagaaatgcaacactgtcaggggtgtgttcgttctggaggagttcgttccagaaatcaaagaggtggtgtcacacaagtacaaaactcctatggcccatgaaatttgctattctgtcctgtgtctgttcagctacgtagctgcagttcattcctcggaggaagacctccgaacgcctcctaggccggtgtccagctag

SEQ ID NO: 194234 - DNA, 4440 bp, Artificial Sequence
  Description of Artificial Sequence: Synthetic coding sequence
atggtgcagaagaagaagttctgcccccggctgctggactacctggtaatcgtgggtgctaggcacccatccagtgactcagtggctcagacccctgagctgctgcggcggtatcctctggaggatcatacagaatttccactgcctccagacgtagtattcttttgtcaacccgagggatgcctatctgtacggcagagacgcatgtctctccgagacgatacatcgttcgtgtttaccctaaccgataaagatactggcgtaacccgctatgggatctgtgttaacttctacagatcgttccaaaagagaatttctaaggagaagggcgagggcggtgccggctcaagaggaaaagaagggacccatgcaacgtgtgcaagcgaggagggtggaactgaatcctccgagagcggaagctccttgcagcctttgtccgccgatagtaccccagacgtcaatcagtcaccgcgcggcaagcgacgggccaaggccggatctcgctctcgcaactccaccctgactagtctgtgtgttctaagccactatcccttcttctctacttttcgggagtgtttatatactcttaaaaggttggttgattgctgcagcgagcggctgctgggcaagaagctaggcattccccgcggagtacagagggacacaatgtggcgtatatttacaggctcgctgcttgtggaagagaagtcaagtgctctcctgcacgatttgcgggagattgaagcttggatatatcggctgcttcggtcccccgtgcctgtgagcgggcaaaaaagggttgatattgaagtgcttccgcaggaactccaacctgcgctcacattcgctttgcctgatccatctagatttacattggtggacttccccctccacctccccttggagctgctcggggtggatgcttgtctgcaggtgctgacctgcattttacttgagcacaaggttgtgctgcagtcccgagattacaatgcattatcaatgagcgtaatggcatttgtagccatgatctatccgttagaatatatgtttcccgtcatccctctcctgcctacatgtatggccagtgccgaacaactgcttttagcgcccacaccttatataatcggcgtgccagctagtttttttctgtataaattggactttaaaatgccggacgacgtttggctggtcgatctggacagcaatagggtgatcgcaccgaccaacgccgaagtgctgccaattcttccagagcccgagagcctagagctgaagaaacaccttaagcaggcactggcctcaatgagcttaaacacacagcccatactaaacttggaaaaattccatgaggggcaagaaatccctttactacttggaagaccttctaatgatctgcaaagcaccccatccaccgaatttaacccacttatctacggaaacgatgtggacagtgtagatgtggcgacccgggttgctatggtcagattctttaatagcgcaaatgttctgcaggggttccagatgcatacccggaccttgcgattgtttcctcgccccgtagttgcttttcaagccgggagttttctggccagtagacccagacagacaccattcgccgaaaagcttgccagaactcaggcagtagaatactttggagaatggatcctcaaccctactaattacgcatttcaaagaatccacaacaatatgttcgatccggcattaattggagacaagccaaagtggtacgcacatcaacttcagcccattcattaccgggtgtacgatagtaacagccaactggcggaggccctgagcgtaccccccgaacgcgattcagattccgaacccacagatgactcaggatctgatagcatggattatgatgacagctcatcaagttacagcagtctcggcgatttcgtctcagagatgatgaaatgcgacataaacggagacacaccgaacgtggacccactgacgcatgctgcattaggtgatgcttccgaggttgagattgacgaattacagaatcagaaggaggcagaggagccagggcccgatagcgaaaacagccaggagaaccccccactccgcagttcatcatctactactgcctcatccagcccctccactgtgattcacggagcaaactccgaacccgcagactcaaccgagatggatgacaaggctgccgtgggcgtcagtaagccgctgccgagtgtgccgccgtctattggtaagagcaatgtggacaggaggcaggccgagatcggggagggggcacagaaactcctccgcccaaacagcctcagactcgccagcgactcggacgcagagtccgactctcgcgcgtcaagccccaattcaacagtgagtaatactagtacagagggattcggagggataatgagtttcgcaagttctctttaccgtaatcacagcacttccttctcactaagcaacctaacgctgcccactaagggtgccagggagaaggccacacctttcccttctctcaagggtaacagaagggctcttgttgatcagaagagtagtgtgattaagcactctccaacagtaaaacgcgaacccccttcacctcaaggaaggtcatccaatagttcggaaaaccagcagttcctgaaagaggtggtgcactctgtactggatggtcagggcgtgggttggcttaacatgaagaaggtcagacgcctcttggagagtgaacagctcagggtctttgttctgagcaaacttaacaggatggtgcagagtgaagacgatgctaggcaggatattattccagatgtggaaatttcacgtaaagtgtacaaggggatgcttgatctgctcaaatgcactgtcctgagcctcgagcagagctatgcgcatgctggcctagggggtatggctagcatcttcgggctcctcgagatagcacagacccattactacagcaaagagcccgacaaaaggaagaggtccccaaccgaaagcgtaaacaccccggtggggaaggaccctggcttggcgggaaggggtgatcccaaggctatggcccagcttcgcgtgccgcagcttggcccccgcgcgccatccgctacaggaaagggccctaaagagctagatacaagatctcttaaggaggagaacttcatagccagtattggtcctgaagtgatcaagccagtgtttgatctcggtgaaacagaagagaagaaatcacagatttctgcagatagcggagtatctctcacaagctcgtcccagcggaccgaccaggactcagtcataggggtaagccctgccgtgatgatcaggtcctcctctcaggactccgaggtaagcaccgtggtgtctaattcctcgggggagactttgggagctgatagcgacctgtccagtaacgccggtgatggtcccggcggagaagggtcagtgcatctcgcctcttcgcgcggaaccctatcagatagcgaaattgagactaattctgccacctctaccatctttggtaaggcacactccctcaaaccatccataaaggaaaagctcgctggcagccccatccggacatctgaggacgtcagtcaacgggtttacctgtatgagggtctcctcggaaaagagcgttccaccctgtgggatcagatgcaattctgggaggatgctttcctcgacgcagtgatgctcgagcgagaagggatgggcatggatcagggcccgcaggaaatgatcgatagatacctgtcgctgggtgagcatgatcgcaagcggcttgaggatgacgaggaccggcttcttgctactctgctgcacaaccttatctcctatatgctgctgatgaaggtcaacaaaaatgatatacgtaaaaaagtacggcggctaatgggcaagagtcacatcggtttagtctattcacagcaaattaacgaagtcttggatcagttagcaaacctcaacgggcgggatctgtccatatggtcaagcggctctaggcacatgaaaaagcagaccttcgtggtgcatgctggaactgacacgaatggagacatctttttcatggaagtctgcgatgactgtgtggtgctgcggagtaatattggtacagtttatgaacgctggtggtacgaaaaactgattaacatgacttattgcccaaaaaccaaggttttgtgcctctggcgccgcaatgggagtgagactcagttgaacaaattttacacaaagaagtgcagagaactgtactattgtgtcaaggactcaatggagcgggctgccgcaagacagcagtccatcaaacccgggcccgagcttggaggcgaattccctgtgcaggatttgaaaaccggggaaggtgggctcctccaggtgaccctcgagggcataaacctgaaattcatgcacaatcagttccttaagctgaagaagtggtag

SEQ ID NO: 194235 - DNA, 4698 bp, Artificial Sequence
  Description of Artificial Sequence: Synthetic coding sequence
atggtgcagaagaagaagttctgcccccggctgctggactacctggttatcgttggagcgcggcacccaagctctgattccgtggcccagacccccgagctcctgcgcagatatcccctcgaagaccatacagagttccccctgccacctgatgtggttttcttctgccagcccgaaggatgtctcagcgttcggcagcggcggatgagcctgcgcgacgacacttctttcgtgttcactctcactgacaaagacaccggcgttactagatatggcatctgcgttaacttttataggtctttccaaaagcggatttctaaggaaaaaggcgaaggtggagctggttctaggggtaaagaaggcactcacgcgacctgtgccagcgaagagggtggtaccgagagtagcgagagcggaagcagccttcagcccctctctgcagattccaccccagacgtgaatcagtcaccacgggggaagcgccgtgccaaagctgggagccgttcccgcaactctacgttgaccagcctctgcgtgctcagtcactaccccttcttttccacattcagagagtgtttgtacaccctgaagagactagtggactgctgctctgaacgcctgttaggcaagaagctgggcatcccccgtggcgtgcagcgggacaccatgtggcggatattcacaggatcccttttggtggaagaaaaatcctctgcattgctgcacgacctgagggagatcgaggcatggatttatcgattactgcgctcccctgtgccggtgtccggccagaagagggtggatattgaggtgctcccccaggaactgcagcctgcccttacatttgccttacccgatccctcgagatttactttagtggacttcccactgcacctgccattggaactgctgggggtggacgcttgcctgcaggttctgacctgcatcttactggaacataaagtcgtcctccagtctcgagattacaatgcactctccatgtctgtcatggcgtttgtcgccatgatttatccccttgaatacatgttccccgtcataccccttctccccacctgtatggcgagcgccgagcagctgctgctcgccccgaccccgtacatcattggagtgccagctagcttcttcctgtacaaactcgactttaaaatgcccgacgacgtgtggctcgtggacttagattcaaatagagtgatcgctcctactaatgctgaggttctccctatccttcccgaaccggagtccttggagctcaagaaacacctcaagcaggcactggctagtatgagtttgaacacgcaacccatcctcaacctggagaagtttcacgagggccaagaaatacccttattgctgggccgaccatccaacgatttgcaatccacgccgagcaccgagttcaatcccctaatctatggaaatgacgtggacagcgtagatgtggccacaagagttgccatggtgaggttctttaattcagctaatgtgttgcaggggtttcagatgcacacgcgcactctgcggctcttcccaagaccggtggtggcatttcaggctggctcgttcctggcgtccagaccccgtcagactccttttgcggaaaagctggcccggacccaggctgtggaatactttggtgagtggatcctgaaccccaccaattatgcctttcagagaattcataacaacatgtttgaccccgcccttattggcgataaacctaagtggtacgcccatcaattacagccaatccactatagagtctacgacagcaattcccagctggctgaggccctctcagtcccacccgagagggactctgacagcgagccaactgacgactcaggtagtgacagtatggactatgacgactcttccagctcctacagttcgttgggtgatttcgtaagcgagatgatgaaatgtgacattaatggtgatacacctaacgttgatccattgacacacgcggcattgggggatgccagtgaggtggagatcgatgaacttcagaaccagaaggaagcagaagagccgggtccagattcggagaactctcaggagaaccctccactccgcagctcctcctccaccactgcttcaagcagtcccagtaccgtgattcacggagccaacagtgaacctgccgactctactgagatggacgataaggcagctgtgggggttagtaagcctttgccttcagtaccccctagcattggaaaaagcaacgttgataggaggcaagcggaaatcggagagggtgcccaaaaactgctgcggcccaattcactgcgccttgcaagtgatagcgacgcggaatctgactctagggccagtagtcctaattctaccgtgagtaacaccagcacagaaggctttggcggcattatgtctttcgcttcaagtctatataggaaccacagtacttccttcagtctgtctaacctgacacttcccactaaaggagcacgagaaaaggcaacgccctttccttcattgaaggtgttcggcttgaataccctgatggagatagtgacggaggccggccctggatctggcgaagggaaccgaagggccctcgttgatcaaaagtcctcggtgattaaacactcccccaccgtcaagagagagccaccatccccacaaggtcgcagtagtaattcaagcgaaaatcagcagttcctaaaagaggtagtccacagtgtgctagatggccaaggagtagggtggctaaacatgaaaaaggtgaggcgcttgctggagagtgagcagctgagagttttcgtactgagtaagctcaacagaatggtgcagagtgaggatgatgctcggcaggatatcattccagatgtcgaaattagtaggaaagtttacaagggaatgttggacctcctcaagtgtactgtgctctctctagagcaatcatatgctcacgcaggtctcggcggcatggcaagcatctttggccttctcgagattgcacaaacacattactatagcaaagaaccggacaagcggaagcgctccccaactgaatcagtcaatacgcccgtcgggaaggaccctggccttgccggcaggggtgaccctaaggccatggctcagctacgagtacctcagctaggtccaagggccccctctgcaaccggaaagggcccaaaagagttagacacgcggtcccttaaagaggaaaatttcatcgccagtattggtccagaagtcattaagcctgtcttcgatctcggggagaccgaagagaaaaaatctcagatctccgccgatagcggagtcagtctcacatctagttcacagcggaccgatcaggactcagtgataggggtcagtccagcagtcatgatccgcagctcctcgcaggattctgaagtctcgacagtcgtcagtaactcctcgggagagaccctaggtgcagattctgacctctcttctaacgctggagatggaccagggggagagggtagtgtgcacctggcctctagtaggggaacattgagcgatagcgagatagagacgaattccgccacctctacaattttcggaaaagcacactctctgaaaccttccataaaagaaaaacttgccggaagccctattcggactagcgaggatgtctctcagcgcgtgtatttatacgaagggttactcggtaaagaacgatccacactatgggaccagatgcaattctgggaggacgcttttctcgacgccgtcatgcttgaacgcgagggaatggggatggatcagggaccacaggagatgattgatcggtacttgagcctgggcgagcatgatagaaagaggctggaagacgacgaggataggttgctagccaccctcttgcacaatctgatttcctatatgctgttgatgaaagtcaacaagaatgatatccgcaagaaggtgcgacggctgatgggtaagtcccatatcggattggtgtattctcagcagatcaacgaggttctggatcagctggccaacctgaacggtagagacctctccatatggagctccggcagtcgccacatgaaaaagcaaacgttcgtggttcacgccggtacggatacgaatggcgatattttttttatggaagtttgcgacgactgcgtagtcttaagatcaaacattggcacagtgtatgagcgttggtggtatgagaaactgattaacatgacgtactgtccaaaaactaaggtgctgtgcctctggagaagaaacgggtcagagacgcagctgaacaagttttacacaaagaaatgtagagagctatactactgcgtgaaggatagcatggagcgagcagcagcaaggcagcagtctatcaaacccggaccagagctgggtggcgaatttccagtacaggacctgaaaaccggtgagggtggcctcctgcaggtcaccttagaggggattaatctaaagttcatgcacaaccaagtattcatagagcttaaccatatcaaaaagtgtaacactgtcagaggagtgtttgtgctcgaggagtttgtacccgaaattaaagaggtggtgagtcataagtataaaacccccatggcccacgaaatctgttactcagtgctgtgcctctttagctatgtggccgccgttcattcgagcgaagaggatttacggaccccgcctcggcccgtcagcagctag

SEQ ID NO: 194236 - DNA, 588 bp, Artificial Sequence
  Description of Artificial Sequence: Synthetic coding sequence
atgggcagccagagcagcaaggccccccggggcgacgtgaccgccgaagaggccgctggtgctagcccggcaaaggccaacggccaggaaaatgggcacgtaaagagcaacggggatctgagtccaaaaggggagggagagtctccccctgtaaatggtaccgatgaagcggccggagccaccggcgatgctatcgagcccgccccaccgagtcagggcgcagaagctaagggagaggtgcctcctaaggaaactcctaagaagaagaaaaagttttcctttaagaagcccttcaaactgagcggcctcagttttaagagaaataggaaagaaggtggcggtgactctagcgccagtagcccaacagaagaagaacaggaacagggcgagattggagcttgctcggatgaaggcacggcacaggaggggaaagctgccgcgacgccggagagccaggaaccccaagctaagggcgccgaagcttctgctgccagtgaagaggaggcaggcccccaagcaactgaaccaagcaccccttccggcccagaatctggccccacccctgcctctgccgaacagaacgaatag

SEQ ID NO: 194237 - DNA, 1377 bp, Artificial Sequence
  Description of Artificial Sequence: Synthetic coding sequence
atgagcaacgacggccggagccggaaccgggaccggcggtacgacgaagtaccatccgacttaccttaccaggataccactatccgcactcaccccactttgcacgacagcgagcgcgctgtctctgcagacccactgccaccaccacctcttccactccagcctcctttcggacccgatttttattccagtgataccgaagaacctgccattgctccagacttgaagccagtgagacggttcgtgcccgactcctggaagaacttttttcggggaaagaagaaggatccagagtgggataagcccgttagtgatatccgctatatttctgatggcgttgagtgttcacctccagcctctcctgctcggccgaatcaccggtctccgctgaactcatgcaaggatccatacgggggtagcgaagggacattcagtagtcgaaaagaagctgacgccgttttccccagggacccctacggatcattggatcgccacactcagaccgtacgaacctactccgaaaaggtggaagaatataaccttcgttatagctatatgaaaagctgggccggactgctgagaattctgggagtggtggagctgctcctgggggcgggggtgttcgcttgcgtcactgcctacatccataaggattctgaatggtacaatctgtttggctacagtcagccgtacggaatgggaggcgtgggcggcctggggtccatgtatgggggctactactacactggccccaagacaccctttgtgctcgtggtggctgggcttgcctggataacgaccataatcatcttagtattgggaatgagcatgtattacaggactatccttctagattccaactggtggccattgaccgagttcggaatcaatgtcgcccttttcatcttgtatatggctgccgctatcgtttacgtcaacgatacgaataggggaggcctgtgctactatcccctgtttaatacacccgtaaacgcagtgttctgtcgtgtcgaaggcggacaaatcgcagctatgattttcctgtttgtaactatgattgtgtacctgatcagcgcgttggtgtgcttgaaactgtggcgacacgaggccgctcggcgacatcgggagtacatggaacaacaggaaatcaacgagccaagcttaagcagcaaaagaaaaatgtgcgagatggcgacctccggggaccgacaaagggattccgaagtcaattttaaggaactgagaacagccaaaatgaagcctgagctcttaagcgggcatatccctccaccacggccagccaacttctttgtttttctggtggaaatgggctttcaccgggtgagccaggacgatctcgatcttttgacgtcatag

SEQ ID NO: 194238 - DNA, 1677 bp, Artificial Sequence
  Description of Artificial Sequence: Synthetic coding sequence
atgagcaacgacggccggagccggaaccgggaccggcggtacgacgaagtgccctccgatttgccttatcaagataccacaattagaacccacccgactctgcacgattccgaaagagccgtttcagccgaccccctgccccccccccctttgccacttcaacccccctttggccctgacttttactcctctgatactgaggaacctgctattgcccccgacctgaaacctgtgcgccgtttcgtcccagattcctggaaaaattttttccgaggcaaaaagaaggaccccgagtgggataagccagtgtcagacatcagatacatcagcgacggggtggagtgtagtcctccggcatcccccgctcgcccaaaccataggtccccactcaatagctgcaaagatccctacggcggcagtgagggcacatttagtagccgtaaggaggcagacgccgtatttccgcgcgatccctacgggagcctagacaggcacacacagaccgtaaggacatacagtgaaaaggtggaagagtataaccttaggtactcctacatgaagagctgggcgggtctactgagaatcttaggtgtggtcgaactactgttgggcgccggcgtcttcgcatgcgtgactgcctatatccataaggacagcgagtggtataatctattcgggtattcccagccttatggcatggggggggtgggagggctagggtccatgtacggaggttattattacactgggcccaagacccctttcgtgcttgtggtagccggtcttgcatggatcacaaccattataattctggtgctgggcatgagcatgtattatcgaacgatattgctggactctaactggtggcccctcaccgaatttggcatcaacgtggccctcttcattctatacatggcagcggcaattgtatatgttaatgacacaaatcgtggcggtctgtgctactaccctctttttaacactccagttaatgcagtgttctgtagggtagaagggggccagattgccgcgatgatcttcctgttcgtgactatgattgtctacctgatctccgcgcttgtatgtttgaagctctggcgccacgaggcagctcgaaggcatcgcgaatacatggagcagcaggaaatcaatgagccatccctgtcctctaaaaggaaaatgtgtgaaatggccacttccggagacagacagagagatagtgaagtgaacttcaaagaactgaggacagcgaagatgaagccagaactgctctcggggcacatccccccaggccacatccccaagcctatagtgatgcctgactacgtcgcaaagtaccccgtgatacagacagatgacgagagagagcggtacaaggcggtgttccaggaccagtttagcgagtataaagagctcagcgccgaggttcaggcagtcctacggaaatttgatgagctcgacgccgtaatgagtaggctgcctcaccactcagagtctcggcaggagcatgaaaggatcagcagaatccacgaggagtttaaaaagaagaaaaatgaccccacatttttggaaaaaaaagagagatgcgactatttaaaaaacaagcttagccacatcaaacagcgcatccaagagtacgataaggtgatgaattgggatgttcaaggctattcatag

SEQ ID NO: 194239 - DNA, 1329 bp, Artificial Sequence
  Description of Artificial Sequence: Synthetic coding sequence
atgagcaacgacggccggagccggaaccgggaccggcggtacgacgaggttccatctgaccttccctatcaggataccaccattcgcacacaccctactttgcacgactccgagcgcgctgttagcgctgatccgctcccgccaccccctctgcccttgcagccaccgttcggccctgacttttactccagtgacactgaggagcccgcaattgcacctgatctcaaacctgtgcgacgattcgttccagatagttggaaaaatttcttcagagggaagaagaaggatcccgaatgggataaacctgtatccgatatcaggtacatatcagacggggttgagtgttcacctccagcctcacctgccaggcctaaccacaggtcgccccttaacagttgtaaggacccctatggaggatccgagggcacttttagctctaggaaagaggccgacgcggtgtttcctagggacccctacggctccctggaccggcacactcagacagtccgtacgtactctgagaaagttgaagaatacaacctccgttattcttatatgaagtcctgggcgggactgctgaggattctcggagtggtcgagctgttactgggcgccggggtgttcgcatgcgttaccgcatacattcacaaagacagcgagtggtacaacctgttcggatactctcagccctatgggatggggggcgtaggcgggcttgggagcatcgccttggtgtgcctcaaactgtggaggcacgaggctgcgcggagacaccgggaatacatggaacagcaggagatcaacgagccatccctgagcagcaaacgtaagatgtgtgagatggctacgagtggagatcggcaaagagatagtgaagtgaacttcaaagaattgagaactgctaagatgaagccggagctgctgtccggccacattccccctgggcatatccctaaacccatcgtgatgcccgattacgtggctaaatatccagtgattcagactgacgatgaacgagaacggtacaaggccgtgttccaggatcaatttagtgaatacaaagagttgtccgcagaagtgcaagccgtgctgagaaagttcgatgagctggatgccgtcatgtcaagacttccgcaccacagcgaaagccgacaagagcatgagaggatctctcggatccacgaggagtttaaaaaaaagaaaaacgatcccacgttcctcgagaaaaaggagcgctgtgattatttgaaaaacaagctctcgcatattaaacagagaattcaggaatatgacaaagtcatgaactgggacgtgcagggctactcgtag

SEQ ID NO: 194240 - DNA, 1641 bp, Artificial Sequence
  Description of Artificial Sequence: Synthetic coding sequence
atgagcaacgacggccggagccggaaccgggaccggcggtacgacgaagtgccatcagacctgccataccaagacaccaccattaggacacaccctacacttcacgactccgagcgtgccgtgtctgcggacccacttcctcctccgcctctccctctgcagcccccgtttgggcccgacttttattcctccgacaccgaagagcccgcgatagctccagatctcaagcctgtgcgccgctttgtccccgactcttggaagaactttttccggggaaagaagaaggaccctgagtgggataagccagtgagtgatatccggtacatcagtgatggagtggagtgttcgcccccagctagccctgcccgacccaaccatcggagccccttgaacagttgcaaagatccctacggaggctctgagggtaccttcagctcccgaaaggaagctgatgccgtgttcccacgagacccatacggatctctggatagacacactcagaccgtccggacatactccgaaaaggtggaggagtataacctgagatactcatatatgaagtcatgggctggtctgctgcgcatacttggcgtagtggagttattattgggcgcaggggtctttgcatgcgtaacggcttacattcacaaggattccgagtggtataacctgttcggatatagccagccctatggcatgggtggcgttggggggctcggaagcatgtacggtgggtattactatactggcccaaagaccccttttgtcctggtcgtggcgggactggcctggattacaacgattatcatcctggtgcttggaatgagcatgtattatagaaccattttgctggattccaactggtggccactgactgagtttgggattaatgtggccctattcattctctacatggcagccgccattgtttatgtgaacgacactaatagagggggcctgtgttactatcctctgtttaataccccagtgaatgcggtattttgtcgtgtggagggcggacagattgccgccatgattttcctgtttgtgaccatgatagtctacctcatctctgcactcgtgtgtctcaagctgtggagacacgaggccgcacgaaggcacagggagtatatggaacagcaagaatgtgagatggccacctcaggcgaccgtcagcgcgacagcgaggtcaatttcaaggagttgaggacagccaagatgaagccggagctgctaagcggacatattcctcccggtcatatccctaagcccatcgtgatgcctgactatgttgccaaatacccagttatccagacagatgacgagcgggaacggtacaaggcggtgttccaggatcagttctctgagtataaagaactgagcgcagaggtccaggctgtgcttcgaaaattcgacgagctggatgcagtcatgtccagactgccgcatcacagcgagtctagacaggagcacgagagaatatctagaattcacgaggagttcaagaaaaagaaaaatgatcctaccttcctggagaagaaagagcgctgtgactatttgaaaaataaactctcgcatatcaagcagcggatccaggagtatgataaggtgatgaattgggatgttcaaggatacagctag

SEQ ID NO: 194241 - DNA, 1551 bp, Artificial Sequence
  Description of Artificial Sequence: Synthetic coding sequence
atgagcaacgacggccggagccggaaccgggaccggcggtacgacgaagttccatctgatctgccttaccaggacaccaccatccgcacacaccctacactgcacgattccgagagagcagtgtccgcagatccactcccccccccccctttaccgttgcaacccccattcggtcccgatttttactcttccgacaccgaggagcccgcaatagctccggacttgaaacccgtgcggcgtttcgtgccagattcttggaagaattttttcagaggcaagaagaaggatcccgagtgggacaagcccgtctccgatatcaggtatatcagcgacggtgtggagtgtagtccaccagctagtccagcccggcccaaccacagaagcccattgaattcctgcaaagatccctacggcgggtccgagggcactttctcctcacgcaaggaagccgacgcagtcttccctcgggacccctatgggtccttggaccgtcacacacagaccgtcagaacgtattcagaaaaggtggaagagtacaatttaaggtatagctacatgaagtcatgggccggtctactgcggatcctcggtgttgtggagttgttgcttggtgcaggagttttcgcttgcgtcactgcctatatacacaaagatagcgaatggtataacctgtttggctacagtcagccgtacgggatgggtggcgtggggggcctggggagcatgtatggcggctattactacactggacctaaaacccccttcgttctggtggtggctggactggcctggataacaaccattatcattcttgtcttgggcatgagcatgtattatcgcactatattgctggatagtaactggtggccattgactgaatttggtattaatgtagctttattcatcttgtacatggccgccgctatagtctacgtcaacgataccaaccgcggggggctgtgctactaccctctgtttaacactccggttaatgcggtgttttgtagggtggaaggaggacagattgcagcaatgatctttctgtttgtgaccatgatcgtctacttgatctccgcgctcgtatgcctgaaactgtggcgccacgaagctgccaggcgccatcgcgagtatatggagcaacaggagatcaatgaaccttcactgtccagtaagcggaagatgtgcgagatggccaccagtggagatagacagagggactccgaagtgaattttaaggagctcaggacggccaaaatgaaaccagaattgttatcagggcacattcccccagggcacatacctaaaccaatcgtgatgcccgattacgtcgcaaagtacccggtgatacagaccgacgacgagagggagagatataaggctgtgtttcaggatcagttttcagaatataaagagctgtccgccgaggttcaggctgtactacggaagtttgatgagctcgacgctgttatgtcacgcctgcctcaccactcagagtcccgccaggagcatgaacgtatcagtaggattcatgaggagtttaagaagaagtag

SEQ ID NO: 194242 - DNA, 438 bp, Artificial Sequence
  Description of Artificial Sequence: Synthetic coding sequence
atgagcaacgacggccggagccggaaccgggaccggcggtacgacgaagtcccatctgatttaccttatcaggacaccaccatccggactcaccctactcttcatgattctgaaagagccgtctccgcagaccctctccctcctcctcctctcccccttcagccacctttcgggcctgacttttattccagcgatactgaagagccagccatcgccccagatcttaagcctgtgcgccgattcgtgcccgactcttggaagaacttcttcaggggaaaaaaaaaagacccagaatgggataagcctgtatctgatatcaggtatattagcgatggagttgaatgtagtcctccggcgagtccagcccggcctaaccacagatcaccacttaactcctgcaaggacccctatgggggatctgaaggcacatttagttag

SEQ ID NO: 194243 - DNA, 1206 bp, Artificial Sequence
  Description of Artificial Sequence: Synthetic coding sequence
atggaggaccccagcggcgcccgggagccccgggcccggccccgggagcgagaccctggtaggcgtccacaccccgaccagggtagaacccacgataggccccgggaccggccgggagaccctcgtcgcaagcgctcgagtgatggcaacaggcgtcgagacggcgaccgtgatccggagagagaccaggagcgggatgggaatcgagacaggaacagggacagggagcgcgagcgtgagagagagcgggaccccgaccgcgggcctcgaagggatacacatcgcgacgcgggaccaagagctggcgagcacggagtgtgggagaagccccggcagtccagaactcgtgatggcgcacggggcttgacttgggacgctgctgcaccaccaggcccggccccttgggaggcccctgagcccccacagcctcagcggaaaggagacccgggccgcaggcggcctgagagcgagcccccttccgaacggtatcttcctagcacgccacgcccagggagagaagaagtggagtactatcaaagcgaggccgaaggtctgcttgaatgtcacaaatgtaagtatttgtgtactggacgggcttgctgccagatgcttgaagtgctcctgaacctgctaatcctggcttgctcttcagtgtcctattcgtccacgggaggatacacggggatcacctcccttggagggatctattattatcagttcggaggagcgtattccggcttcgacggggccgacggtgagaaggcacagcaactggacgtacaattctaccaactgaagctgccaatggtgaccgtcgcgatggcgtgttcaggcgccttgacagccctgtgttgcttgtttgtggcaatgggcgttctgcgagtgccatggcactgtcctctcctgctcgttactgaagggttgcttgacatgttaattgccggcggatacattccagctttgtatttctactttcactacctgtccgccgcctacggctcacctgtgtgtaaagagaggcaggccctgtaccagagcaaggggtactctggatttgggtgctctttccatggagctgacatcggggctggtatatttgctgctcttggcattgttgtgttcgcactcggagccgtgctcgcaataaaaggatacagaaaagtacggaagttaaaggagaagccagctgaaatgtttgagttctag

SEQ ID NO: 194244 - DNA, 1233 bp, Artificial Sequence
  Description of Artificial Sequence: Synthetic coding sequence
atggaggaccccagcggcgcccgggagccccgggcccggccccgggagagggatccagggcgccgcccgcaccctgatcaggggaggacccacgaccgcccacgagaccgtcctggggacccccggcggaaacgcagttccgatggaaataggaggagagatggtgacagggaccctgagagggaccaggagagggacggaaacagagatcgaaacagagaccgggaacgcgagagggaacgcgaacgcgatccagataggggtcccaggcgggacacccaccgggatgcgggacccagagcaggagaacacggcgtttgggaaaagcccagacaatcgcgtacgcgagacggtgcccgaggtctgacatgggacgctgccgccccccccgggccggctccttgggaggccccagaaccgccacagcctcagaggaagggagaccctggtcgacgtagacccgagtctgagcccccctccgagaggtatctcccatcaacccctcgcccaggccgcgaagaggtggagtactaccagtcagaggccgaaggtctgctggagtgtcacaaatgcaagtatctgtgtacggggcgcggcgtcgttcagatcgttgaagtggtgctgaatggtatggtcctgatttgcattgtggcctcctacttcgtgctggctgggttctccgcctctttcagctccggaggagggtttggaaataactattatagccccttcgaaggcaccgagctggagcaggtgcggcagctcgatcagcaatatacaattttgcgctcgcctctgatctacggcggagtggccgtgtctctggggctcggcgtgctgacgatgggcgttttactccagggtgcaaaatctcggacgatgctgtccggaaagtggctactcacagaggccgcattttctctcctcgctgcagtaggatactgcacaggtatcggggtatacctgcacgtggccttacagattaacagtaccgacacatgcaagacaagggaacggctatacgccagaaaaggcctgacatggatggattgccaactcgcaggaaccgacggcgccgcagcgactttcgcctgtctgctagtaatcatgtacggtgcctcagttgtcctagcactcagatcctacagagaacaaaagcgatataaagggtcccgagagcaacccggatcttactcagacgcacctgagtacctttggagcggtaccttgtag

SEQ ID NO: 194245 - DNA, 978 bp, Artificial Sequence
  Description of Artificial Sequence: Synthetic coding sequence
atggacggcagcaacgtgaccagcttcgtggtggaggagcccaccaatatttccactggacggaatgcctctgtcggcaatgcgcacagacagatccctatcgtgcactgggtcattatgagtataagtcctgtgggttttgtggagaatggtattctgctctggtttttgtgctttagaatgaggcgcaatccctttactgtctacatcacgcatctctccattgctgacatctctctgctgttttgtatattcattctttccatcgactatgccctagattatgaactgagctccggtcattactacactattgtgacattgtctgtgacatttctatttggatacaataccggtctatacctgcttaccgccatttccgtcgagcgttgcttaagtgtgctttacccaatatggtacagatgccaccgccccaagtaccagagcgcactggtatgcgcccttctgtgggccctctcttgtctggttaccacaatggagtacgtgatgtgcatcgaccgagaggaagagagccacagccgtaacgattgtcgagccgtgatcatcttcattgcgattttgagctttctcgtgttcacccccctgatgctcgttagtagcaccatacttgtggtgaaaatccgtaagaatacctgggccagccatagttccaagctgtacattgttatcatggtgacgataatcatttttctgatctttgccatgcctatgagactgctctatctcctttattacgagtattggagcacatttggtaatcttcatcatatctctttgctgttctctactatcaattcctctgcaaaccccttcatttatttcttcgtcggctctagtaaaaagaagagattcaaagaatccctcaaggtcgttctcacacgggccttcaaggatgaaatgcagcctagaagacaaaaggacaactgtaacactgtgaccgttgagactgtggtctag

SEQ ID NO: 194246 - DNA, 1137 bp, Artificial Sequence
  Description of Artificial Sequence: Synthetic coding sequence
atggtgtggggcaagatctgctggttcagccagcgggccggctggactgtgttcgcggaaagtcagatctcattgagttgcagcttgtgcctgcactcaggagatcaggaggctcagaaccctaacctggtttcccagctgtgcggtgtttttcttcaaaacgagacaaacgagaccatacacatgcagatgagcatggcagtgggtcagcaggctcttccccttaacataatagctccaaaagccgtactagtcagcctgtgcggcgtattgctgaacggcacagtgttttggttgctgtgttgcggagccacaaacccttacatggtctacattttgcatctggtcgcagccgacgttatctatttgtgctgctccgccgtaggatttttgcaggttactctgctgacataccatggcgtggtgtttttcatccccgacttcctggccattctgagccccttttctttcgaggtttgcctatgcctgctggtagccatttcaactgagagatgcgtctgtgtgctattccctatttggtatcggtgccatcggccaaagtataccagtaacgtggtctgcaccctgatctgggggttgccattttgcatcaatattgttaagtcgctctttctgacttactggaaacatgttaaagcctgtgtgatctttctgaagctctcaggcctgtttcatgctattttatctcttgtcatgtgcgttagcagtctgacgcttctcattcgattcctttgctgtagccagcagcagaaagcgacacgcgtctatgctgtggtacaaatcagcgcacctatgtttctgttgtgggccttaccactgtccgtcgctccactgatcacagattttaaaatgttcgtcacaacaagctatctgatttcactctttctgatcattaatagctccgcaaaccctatcatctatttcttcgtaggcagtctgcgcaaaaagagactcaaagagagcttgcgagtaatactgcagagagcccttgccgataaacctgaggttggcaggaacaagaaagccgcaggtattgacccaatggagcaaccacatagcacccagcatgtcgaaaacttactccccagagagcatagggtggacgtagagacttag

SEQ ID NO: 194247 - DNA, 1137 bp, Artificial Sequence
  Description of Artificial Sequence: Synthetic coding sequence
atggtgtggggcaagatctgctggttcagccagcgggccggctggacagtatttgcagagagccaaatctccctgtcttgctcattgtgcttgcactccggagatcaggaagcccaaaaccccaatctagtgtctcaattatgtggtgtttttttacagaacgagactaacgaaacgatacatatgcagatgtctatggctgtcggccagcaagcgctccctttaaacatcattgcccctaaggctgtgctcgtcagtttgtgcggagtgctgcttaatggtacagtgttctggcttctgtgttgtggagccacaaacccatatatggtgtacatcttacacttggtggccgcagacgtgatctacctgtgttgcagcgccgttggtttcctgcaggtgaccttgctgacctaccatggcgtggttttcttcatacctgactttcttgcgatcctgtctcccttttccttcgaggtgtgtctatgtctattagttgctatttccacagaacgctgcgtctgtgtgcttttccccatatggtatcgctgtcacagaccgaaatataccagtaacgtcgtgtgcacactgatctggggccttcccttctgcatcaacatcgttaaaagtctctttctcacttattggaagcacgtaaaggcatgtgttatcttcctcaagctgagtggactcttccatgctatcctgagccttgtgatgtgtgtatctagtctgacgctgttgataagatttctgtgttgctctcagcaacaaaaggctactcgtgtctacgcagtggtccagatttccgctccgatgttcctgctttgggctttacccctgagtgtggctcccttgattacagacttcaaaatgtttgtaacaacgtcatatctaatcagcctcttcctgatcatcaactctagtgcgaaccccattatctattttttcgtaggttctctgagaaagaagagactcaaagagtcgctgagagtgatcctgcaaagagccctggccgacaaacccgaggtcggccgaaataagaaggccgctggcattgatcccatggaacagccacatagcacacagcacgtggagaacctcctgccacgcgagcaccgtgtggacgtggaaacctag

SEQ ID NO: 194248 - DNA, 1137 bp, Artificial Sequence
  Description of Artificial Sequence: Synthetic coding sequence
atggtgtggggcaagatctgctggttcagccagcgggccggctggaccgtgtttgccgagagtcaaatcagtctctcctgctcactgtgcctgcacagcggagatcaagaagcccagaatcccaatctggtaagccaactttgtggcgtgttcttgcagaacgagacaaacgaaacgattcatatgcagatgtccatggcagtgggccagcaggccttacctctaaatatcatcgcccctaaggcggtccttgtatcgctttgcggagtcttactcaacggaactgtgttttggttgttatgctgtggtgcaactaacccttacatggtgtacatcctgcacttggtggccgccgatgtgatttatctgtgctgctcggccgttggatttctgcaggtcaccctgctgacttaccacggagtagtgttcttcatacccgatttcctcgccattctttcgccgttttctttcgaagtgtgcctatgtctgctggtcgccatctcgacggaacgttgcgtgtgtgtcctgttccccatctggtacagatgtcatcgccctaaatacacatccaacgtggtttgtacacttatatggggacttccattctgcattaatatcgtgaagtccctgtttctcacttactggaagcacgttaaggcctgtgtgattttcttaaaactctccggactgttccacgcaatcctgagtcttgtgatgtgcgtgtcctcacttaccctcctcatccggttcctgtgctgttcccagcagcaaaaggcaaccagggtgtatgccgtggtgcagatttctgcacctatgtttctgctctgggctctgccactcagcgtagccccactgatcactgactttaaaatgtttgtgaccacctcctacctgatctcgctctttctcattataaattcatccgcaaacccaatcatttatttcttcgtgggatcccttcgcaaaaagcgcctcaaggagtccctgagagtgatcctccagagagcactcgccgacaaaccagaggtgggtaggaacaaaaaagcggccggcatcgacccaatggagcagccacactccactcagcatgtagagaacctgctgccaagagagcatcgggttgatgtggagacatag

SEQ ID NO: 194249 - DNA, 1137 bp, Artificial Sequence
  Description of Artificial Sequence: Synthetic coding sequence
atggtgtggggcaagatctgctggttcagccagcgggccggctggacggtcttcgccgagagccagatttccttaagctgttcgctctgtctccacagcggcgaccaggaggcccaaaatccgaacttagtgagtcagctttgcggagtctttctccaaaacgagactaacgaaacgatccatatgcagatgagcatggcagtgggacagcaggcactcccactcaacataattgcccccaaggctgtcctcgtgtcattgtgcggcgtgcttttgaatggaaccgtgttttggctgctgtgctgcggcgccaccaatccatacatggtgtacattctgcaccttgtggcggccgatgtaatctatttgtgctgttccgcggtgggattccttcaggtaacattactgacgtatcatggagtggtttttttcatccctgactttttagcaatactgtctcccttttcttttgaggtgtgtttgtgcttactcgtggctatttcaaccgaacgatgtgtctgcgtgctgtttccaatctggtacagatgtcacaggcccaagtatacttctaatgtggtctgcactctcatatggggcctgcctttctgcataaatatcgtgaaatccttatttctgacatattggaagcacgtaaaggcttgtgtcatttttttaaaattaagcggcttgttccacgcaatcctgtcccttgtgatgtgcgtaagctctttgacactcctgatcagatttctctgctgttcgcagcagcagaaggccactcgcgtgtacgccgttgtgcagatctcagcccctatgtttctgttgtgggccctcccactctctgtggcccctctgatcactgacttcaaaatgttcgtgacgacatcttacctgatctccctcttcctcattatcaattcttccgccaatccgataatctacttctttgtgggctccttacgaaagaagaggctgaaagagagcctgagggtgattctgcagcgggcccttgcagataaacccgaggtcggacgtaacaagaaggctgccggcatcgatcctatggaacagccacacagcacacagcacgtggaaaatctgctgccaagggagcacagggtcgatgtggaaacttag

SEQ ID NO: 194250 - DNA, 1137 bp, Artificial Sequence
  Description of Artificial Sequence: Synthetic coding sequence
atggtgtggggcaagatctgctggttcagccagcgggccggctggacagttttcgctgaatcacagatcagcctgtcttgcagcctttgtctgcattccggggaccaagaagcccaaaaccccaatttggtatctcagctgtgtggggtgttccttcagaatgagacaaacgagacaattcatatgcagatgagtatggccgttgggcagcaggctctgcccctcaacattattgctcctaaggccgttttggtctccctctgcggcgtgctgcttaacggcaccgtcttctggctgttatgctgcggtgccacaaacccttatatggtttacatcctgcatctggtggccgctgatgttatctacctctgctgcagtgctgtcggattcctgcaagtcaccctactcacctaccatggagttgtctttttcatcccagactttctcgccatccttagtccattttcctttgaggtatgcctgtgcctcttggtcgccataagcacagagcgttgcgtgtgtgttctgtttccaatatggtacagatgccatcgcccaaagtatacgtcaaatgtggtctgtacacttatatggggcctgcctttttgtattaatattgtgaagagcctcttcttgacttattggaagcacgtgaaagcttgcgtgatttttcttaaacttagtggactgtttcacgccatcctcagtctggttatgtgcgtgagcagcttgaccctgcttattcgctttctatgttgtagtcaacagcaaaaagcaacaagggtctacgccgtcgtccagatttcagcaccaatgttcttgctgtgggcactgccactttcggtggcgccgctaataaccgacttcaagatgtttgtcacaacttcatacctgatttctcttttcctgatcatcaatagctccgcaaaccccattatttacttcttcgttggcagtctgcgaaagaagaggctgaaggagtctctaagggtaatactacagcgagcattggccgacaagcccgaagtgggccgaaacaagaaggctgcaggcatcgaccccatggaacagccccatagcacccagcatgtggaaaatctcttgcctcgggaacatcgggtggatgtagagacctag

SEQ ID NO: 194251 - DNA, 1137 bp, Artificial Sequence
  Description of Artificial Sequence: Synthetic coding sequence
atggtgtggggcaagatctgctggttcagccagcgggccggctggaccgtgtttgctgaatcccagatctctctttcctgtagtttgtgtctccactctggcgatcaagaggcccagaatccaaatttagtgagccagctctgcggagttttccttcagaatgagactaacgaaactatacacatgcagatgagcatggcagttggtcagcaggcgttgcctctcaacatcattgcacccaaggccgttctcgtatccttgtgtggggtgttgctgaacggtacggtgttttggctcctatgttgcggcgccaccaatccatacatggtttacatactccatcttgtcgccgctgatgtaatctacttatgctgcagcgccgtcggcttcttgcaggtgaccctgcttacctatcatggggtcgtcttctttattcccgactttctggccatcttgtctcccttcagtttcgaggtttgtttatgcctcctcgtcgcaatctccacggaacgttgcgtttgcgtactatttcccatttggtaccgatgccacaggccgaaatacacatcaaatgtggtgtgtacactcatttggggtctccccttctgcatcaatattgtcaagagtctatttctcacatactggaagcatgtgaaagcgtgcgttatcttcctgaagctgagcggcttgtttcacgcgatactctctctggtcatgtgtgtaagttcgcttacactgcttattcggttcttgtgctgctcccagcagcaaaaggctacaagggtgtacgccgtcgtgcagatctccgcaccaatgtttctcctctgggccctgcctctcagcgtggcacctctgatcaccgacttcaagatgtttgtaacgacatcctacctgatctccctcttcctgattattaacagcagtgcaaaccccataatttactttttcgtagggagcctgaggaaaaagaggctgaaggaatccctgagagtgatactgcagcgcgctctggcagataaacctgaggtgggacggaataagaaagcagccggaatagacccaatggagcagccccatagcacccagcacgtggagaatctgcttccacgggaacacagggtggacgtggagacctag

SEQ ID NO: 194252 - DNA, 1137 bp, Artificial Sequence
  Description of Artificial Sequence: Synthetic coding sequence
atggtgtggggcaagatctgctggttcagccagcgggccggctggacagttttcgctgagtctcagatctctttaagctgctctctgtgcctgcactctggggaccaggaagcccagaacccaaatttggtgtcccagctctgtggcgtcttcctgcagaatgaaaccaacgaaacaatccacatgcagatgtcgatggctgtgggacagcaggctttgcccctgaatattattgctcctaaagcagtgctggtttctctctgtggggtgctcctgaacggaactgtgttttggcttctgtgttgtggcgcaactaatccttatatggtgtacatccttcacctggttgctgccgatgttatctatctctgctgctcggccgttggctttctgcaagtaactcttctgacttatcacggagtcgtgttttttatccctgacttcctcgctattttatcacctttctcatttgaggtatgcctgtgtttactggtcgctatatcaacagaacggtgcgtgtgcgtgcttttccccatctggtataggtgccataggcctaaatataccagcaatgtggtctgcactttgatttggggacttccattctgcatcaacatcgttaagtcactgtttctgacttactggaaacacgtgaaagcctgtgttatcttcctgaagctcagcggattatttcacgcgatcctgagtcttgtaatgtgcgtgagctcactgacactactgattcgtttcctctgctgcagtcagcagcaaaaagccactcgcgtgtacgccgtggtccagattagcgccccaatgtttcttctttgggctctgccgctatcagtcgcgcccttgataacagatttcaagatgttcgtcacaacaagctacctgatctccctcttcttaatcattaacagctccgctaatccaatcatctattttttcgtgggctctttgcgcaagaagcgtttgaaggaaagcctccgggtcattctacagagggctcttgctgataagccagaggttggtcggaataaaaaagccgccggcatcgatccaatggaacagccacacagtacgcagcatgtggaaaaccttctccctcgcgagcaccgggtagacgtggagacttag

SEQ ID NO: 194253 - DNA, 1137 bp, Artificial Sequence
  Description of Artificial Sequence: Synthetic coding sequence
atggtgtggggcaagatctgctggttcagccagcgggccggctggacagtgttcgcggaatcccagatcagtctctcctgtagcctctgcctgcacagcggggaccaggaagcacaaaatccgaacttagtatcccagttgtgtggagtgtttttacaaaacgaaactaacgaaactattcatatgcagatgagcatggcggtggggcagcaggccttacctttaaatattatcgcacccaaagcagtgttggtgtctctctgcggggtgttgctgaatgggactgtgttctggctgctgtgctgcggggctaccaacccttacatggtgtacatcctgcacctcgtcgctgcagacgtcatctacctctgctgctccgccgtgggttttctgcaggtcactcttctgacgtaccatggggtggtcttctttatcccagactttctggctatcctgtctcccttttccttcgaggtgtgcctgtgtttgctggttgctatcagtactgagagatgcgtatgcgtgctttttcctatatggtaccgatgtcatcggccaaaatatacgtccaacgtggtttgcaccttgatctggggcctccccttctgcattaatatcgtgaagtctctgttcctcacatattggaaacacgtgaaggcctgcgtgatcttccttaagctgtccggcttatttcatgcaattctaagcctggtcatgtgcgtctcaagcctgactttattgatccggttcctgtgttgcagccaacagcagaaggccacacgggtgtatgccgtggtccaaatcagtgcaccaatgtttcttctgtgggccctgccactatctgttgcccctctgataacagacttcaaaatgtttgttactacttcatacctaataagcctgttcttaattatcaatagcagcgctaatccaataatttatttcttcgtgggctccctacggaagaaacggcttaaggagagtctgagagtgatactccagagggccctcgctgacaagccagaggtcgggaggaataagaaagcagctggaatagatcccatggaacaacctcactccacccagcacgtcgagaacctactcccaagggagcacagggtggacgtcgaaacctag

SEQ ID NO: 194254 - DNA, 966 bp, Artificial Sequence
  Description of Artificial Sequence: Synthetic coding sequence
atgaaccagaccctgaacagcagcggcaccgtggagagcgccctgaattattcacggggctcaacggtccacaccgcttacttggtgcttagctctctggcaatgtttacttgcttgtgcggaatggctgggaatagcatggtaatttggctgctaggcttccgcatgcatagaaacccattctgcatctatattctaaatctcgcagccgccgatttactgttcttgttctcgatggcaagtacactgagcctcgaaacacagccactggtgaatactactgacaaagtgcacgagctcatgaagcggctgatgtattttgcctacactgttggactgagtctgctgactgcaataagtacccagaggtgcctgtctgtcctgttccccatatggtttaagtgccaccgccctcgtcatctttcggcctgggtgtgcggactgttgtggacactttgcttactaatgaatggcctgactagcagcttctgttcgaagttcctgaagttcaacgaggatcgctgctttcgggtcgatatggtgcaggccgcccttataatgggagtactgacccctgtgatgacactgtcttccctcaccttgttcgtttgggttcggcgttcatcacagcagtggagacgacagccgacccgtctcttcgtggtcgtactcgcgagcgtcctcgtctttctgatttgcagccttcccctgtctatctactggtttgtcctgtattggctatccctgccacccgaaatgcaggtactgtgtttctccctgtcacggttgagttcttctgtatccagttcagccaatcctgtgatctactttctggtcggttctcgcagatctcatagattaccaacccggtccctggggactgtattacaacaggctttgagggaggagcccgaacttgaaggcggcgagaccccgacggtggggaccaatgagatgggggcctag

SEQ ID NO: 194255 - DNA, 936 bp, Artificial Sequence
  Description of Artificial Sequence: Synthetic coding sequence
atggagccccgggaggccggccagcacgtgggcgccgccaacggcgcccaagaagatgtggcttttaatctgatcatccttagcctgacagagggtctgggactcggcggactgttgggaaatggcgctgtgctgtggctgctgagttcaaatgtgtataggaatccgtttgcgatatatcttctggacgtcgcctgtgccgacctgatttttctgggctgccacatggtagctattgtgcctgaccttctgcaggggcgcttagattttccgggtttcgtgcagacttccctcgctactttgcggtttttctgttacatcgtaggcctctcattgcttgccgcagtcagcgtagaacagtgccttgccgccttgttcccagcatggtacagttgtaggcgccccagacacttaaccacctgcgtttgtgccctgacatgggcactgtgtcttctgctccatttattactgagcggagcttgtactcaattctttggtgagccctccagacacctatgcaggactctgtggttagtggccgccgtactgttggctttactctgctgtacaatgtgtggtgcctctcttatgttgttgctccgtgtggagaggggaccccagaggcccccaccccgcggctttcctggtctcattctcctgacagtcctcctcttcctcttctgcgggttgcccttcggtatttactggctgtcacggaacctcttgtggtatattccgcactacttttatcacttctctttcttgatggccgctgtgcattgcgccgccaagcccgtggtgtatttttgcctagggtccgcacagggccgcagacttccgctgaggttagtcctccagagagcactcggtgatgaggctgaactgggggctgttcgcgaaacaagccgccgcggtcttgtcgatatagctgcctag

SEQ ID NO: 194256 - DNA, 939 bp, Artificial Sequence
  Description of Artificial Sequence: Synthetic coding sequence
atgatggagccccgggaggccggccagcacgtgggcgccgccaacggcgcccaggaggacgttgccttcaacctcatcattttgtctctcacagagggcctgggcttaggcggacttctgggcaatggcgcagtgctgtggcttctaagcagcaacgtataccggaaccctttcgccatctacttgctggacgtggcatgtgccgatttaatttttctcgggtgtcatatggtggcgatcgtgcctgacttgctacagggacgacttgatttccccggctttgtgcagacctccctggctacactgcggttcttctgctacattgtgggattgagcctgctggcagctgtcagcgtagaacagtgcctggccgcactcttccccgcatggtattcatgtaggagacccagacacctcacaacctgtgtatgtgccttgacgtgggccttatgtctgttactgcatcttctcctgagcggtgcgtgcacacagttttttggcgagccatctaggcacctgtgcagaaccctgtggctagtggcggcggtcctgctggcccttttgtgctgtaccatgtgtggggcatcacttatgttgctcctccgcgtggagagaggcccacagcggcctccccccagaggatttcccggcctgatactgcttaccgttctgttgttcctgttctgtgggctcccctttggcatctactggctttcacgaaacctgctgtggtatattccccactacttctatcatttttccttcctcatggctgctgtccactgtgctgctaaaccggtggtatatttctgcctgggaagcgcacaaggccggagacttccactgaggctggttctccaacgagcattgggagatgaggccgagcttggcgccgtacgggagacttcaagaaggggcctggtcgatattgccgcttag

SEQ ID NO: 194257 - DNA, 1032 bp, Artificial Sequence
  Description of Artificial Sequence: Synthetic coding sequence
atggccggcaactgcagctgggaggcccaccccggcaaccggaacaaaatgtgtccgggactgagcgaagctccggagctgtactctaggggctttttgacaatcgagcagatcgcgatgctacctccaccagcagtcatgaactatatattcctgctcctctgcctatgtgggctcgttggcaatggcctcgtgctatggttttttggatttagtataaagcgtaatccgttctcaatttatttcctgcatctggcctccgcggatgtcggctatctgtttagcaaggctgttttttcgattctgaatacaggtggatttctcggtacatttgccgattatattcggtcggtgtgcagagttctgggcttgtgtatgtttctgacaggcgtttccctgttaccagccgtatcagccgagcgctgtgcctccgtcatttttcccgcatggtattggagacggaggcccaagcgcctgagcgctgttgtatgcgctcttctctgggtcctctcgttattggtaacatgcctccataactacttttgcgtcttcctgggcaggggggcccccggcgccgcttgcagacacatggatatctttctcggaatcctcctcttccttctttgttgtcctctgatggttctgccttgcctggcactcattctccacgtcgagtgccgagccagaaggcgacagcgatctgccaaactcaaccatgtaatccttgccatggtgtccgtttttctcgtctcaagtatctacctgggaattgattggtttctattttgggtttttcagatcccagcccccttcccggaatatgtaacagatctgtgtatctgcataaactcatctgctaagcccatcgtttatttcctggctggaagggataagagccagcgcctgtgggaaccattacgggtcgtcttccagcgggctctcagggacggcgctgagttgggcgaagctggcgggtctactccaaacacggtcacgatggaaatgcagtgcccccccggtaacgctagttag

SEQ ID NO: 194258 - DNA, 948 bp, Artificial Sequence
  Description of Artificial Sequence: Synthetic coding sequence
atggccggcaactgcagctgggaggcccaccccggcaaccggaacaaaatgtgccccggtctgagcgaagcacctgagttgtattcaaggggctttttaacaatcgagcagattgctatgttgccgccacctgctgtgatgaactacatctttctactattgtgcctgtgcggtctcgtggggaacggtcttgtgctctggttttttgggttctctatcctgaatacaggaggttttttgggtacctttgctgactatattcgttctgtgtgccgggtgctgggtctctgtatgtttcttactggcgtgtcactgttgccagctgtttccgctgagcgctgcgcctctgtgatttttcctgcctggtactggcggcggcgtcctaaacgactctccgcggtcgtgtgtgctctcctgtgggtgctgagcctactcgtgacgtgtctccacaattatttctgcgttttcctgggcaggggcgcaccaggcgccgcctgtagacacatggatatctttctcggcattcttctgttcttactgtgctgcccactaatggtgctgccatgccttgccctcatactccatgttgagtgccgagcacgacgtcgtcagcgtagtgccaaactgaatcatgtgatcctagccatggtcagcgtattcctggtgtcttccatttacctcggtatagattggtttctgttttgggtgtttcagattccagcgccatttcctgagtacgtgactgacctgtgtatctgtatcaatagcagcgctaagcccattgtttacttcctggccggacgagataaaagtcagagactgtgggaacccctgcgcgttgttttccagcgagcccttcgcgacggcgcggagctcggggaagccggagggtcgacgcccaacaccgttacaatggaaatgcagtgccctcctggaaacgcctcctag

SEQ ID NO: 194259 - DNA, 1032 bp, Artificial Sequence
  Description of Artificial Sequence: Synthetic coding sequence
atggccggcaactgcagctgggaggcccaccccggcaaccggaacaaaatgtgcccagggctgtcagaagcaccggaactatactcgcgcggcttcttgacaatcgaacagatagctatgctgcctccccctgccgtaatgaattatatttttctcctgctctgcctttgtggactcgtgggtaacgggttggtgctttggttcttcgggttcagcatcaagcgcaacccgtttagtatttactttctgcacctggcatctgcggacgttgggtacttattctccaaggccgtcttctctatcctcaacaccggggggttcctaggcacattcgcagattatattagatccgtgtgcagagtactgggcctgtgtatgttccttaccggggtcagcttgctaccagcagtgagcgctgaaaggtgcgcatccgtgattttccccgcgtggtactggcgccgcaggcctaagcggctgagcgcagtcgtgtgtgcactactgtgggtgttgtcactgttggtaacatgtctgcataattacttctgcgtgttcctcggtcgtggggcgcccggcgcagcttgtaggcacatggatatatttctcggcattctcttgtttctgctctgttgcccccttatggtgttaccctgcctggccctcatcctgcacgtggaatgtagagctagaagacgccaaaggtccgctaaactcaaccacgtgattctggccatggtctctgtcttcttagtgagctccatttacctggggattgactggttcttgttctgggttttccaaattccagcgcccttcccggagtatgtgactgacctgtgcatatgtatcaacagtagtgccaagccaatcgtgtacttcttagctggccgggataagtcccagagactgtgggagcctctgagagtggtcttccagcgggccttgcgcgatggggcggaactcggggaagccggcgggagcacacccaacactgtgacgatggagatgcagtgccctccaggcaacgcttcatag

SEQ ID NO: 194260 - DNA, 870 bp, Artificial Sequence
  Description of Artificial Sequence: Synthetic coding sequence
atgttcggcctgttcggcctgtggcggaccttcgacagcgtggtgttctatttaactcttattgtgggactcggagggccagtgggtaacgggcttgtgctatggaatctgggattccgcattaaaaaggggccattctctatttacctcctgcacctggcggccgctgactttttattcttaagctgtcgagtgggctttagcgtggcccaggcagccctgggcgcacaggatacattgtactttgtgctcacgttcctttggttcgcggtaggactgtggcttctggcggccttcagcgtcgagcggtgtctgagtgacctctttcccgcctgctaccagggctgtcgtcctaggcatgcttctgccgtgctgtgtgccttggtgtggacacctacactacctgccgtgcctctgcctgcaaacgcctgcggcctcctgaggaactccgcatgccctttggtctgcccccgatatcacgtggccagcgtgacctggtttctagttctggctcgagtcgcctggaccgctggagtggtgctgttcgtgtgggtaacgtgctgctctacccggccacgaccccgcttatacggcattgtgctaggggcccttctgctgttgttcttttgcggtctccccagcgtattctattggtctcttcagcccttactgaactttctgcttcctgtcttctctcctctagcaacactcttagcgtgtgtgaactcttctagcaagcctttaatttattccgggctaggacggcagcctgggaagagagagcctctaaggagtgtccttcgccgcgctttgggggagggagccgagctcggggcaaggggccagagtttacccatgggactcctgtag

SEQ ID NO: 194261 - DNA, 969 bp, Artificial Sequence
  Description of Artificial Sequence: Synthetic coding sequence
atggaccccaccatcagcaccctggacaccgagctgacccccatcaatggtactgaggaaacgctgtgctacaagcagaccttaagtctcaccgtcctaacttgtatagtgtccttggttgggctcacaggcaatgccgtggtactgtggctgctcgggtgccgtatgcggcgtaacgccttcagtatctacattctcaatctggccgccgcagactttctgttcctgtccgggagactgatatactcactgctgtcgttcatctcaatccctcacaccatttccaaaatcctctatccagtgatgatgttcagttattttgcgggattgtcctttctatctgctgtttccactgagcgctgcctctctgtcctctggcccatttggtacagatgccataggcctactcatctttctgcagtggtatgtgtgctgctgtgggccctctcactgttgcgatctatcctggagtggatgctgtgtggtttcctgttcagcggggctgactctgcatggtgccaaacgtcagattttatcactgtggcttggcttatattcctttgtgttgtgctctgtgggtcttcccttgtgcttcttatccgcatcttgtgcggcagtaggaagattcccttaacccgcctgtatgtgacgattttgctgactgtgctcgtattcctcctttgcggcttgcctttcggcattcaatttttcctctttctatggatacatgttgaccgggaagtcctcttctgccatgtgcatctcgtgtctatctttttgtcagccttaaacagtagtgccaaccccattatttacttttttgtgggaagttttcgtcagagacagaaccgacagaatctgaaattagtgttgcagagggctctgcaggatgcctcagaggtcgatgagggcggcgggcagctgcccgaagagattcttgaactatcagggagtaggctcgaacagtag

SEQ ID NO: 194262 - DNA, 993 bp, Artificial Sequence
  Description of Artificial Sequence: Synthetic coding sequence
atggaccccaccacccccgcctggggcaccgagagcaccaccgtgaatggaaacgaccaggcactcctcctattatgcggaaaggaaacactcatccctgtcttcttaattctgtttatagcccttgtcggcctagtcggcaacgggttcgtgctctggttgctgggtttcagaatgcgtcgtaacgccttttccgtgtacgtgctttccctcgcaggagccgactttcttttcctgtgtttccagatcattaactgcctggtgtacctgagcaattttttctgctcaatctctattaacttcccatccttcttcacgaccgtgatgacctgtgcatacttagcaggactgagtatgctctcaactgtttctaccgagcggtgtcttagcgttctgtggcctatctggtacagatgcaggagaccacgtcatttgagtgcagttgtgtgcgtgctcttatgggccctctcactgctgttgtctatcttggagggaaagttttgtggcttcctgtttagcgatggtgattctggatggtgtcagacattcgattttatcacagccgcctggctgatatttctgttcatggtcctttgtggtagcagtctcgccctgctcgtgcgaattctctgcggctccagaggactgcctttaactcggttgtatcttaccattttattgaccgtcctggtcttcctgctttgtggactcccttttgggatacagtggtttttgattctctggatctggaaagatagcgatgtgcttttctgccacatccatcctgtgtcagtggtgctgagctccctgaactccagcgcgaatccaataatctatttctttgtagggtcttttaggaagcagtggagacttcagcaacctattctgaagctggcattacaaagggccctgcaggacatagccgaagtggaccattcagaaggctgcttccgccagggaactcccgaaatgtcacgttcatcacttgtttag

SEQ ID NO: 194263 - DNA, 969 bp, Artificial Sequence
  Description of Artificial Sequence: Synthetic coding sequence
atggacagcaccatccccgtgctgggcaccgagctgacccccatcaacgggcgagaggagaccccctgttacaagcagaccctgagttttacgggccttacttgtatcgtgtcgctggtggccctgaccggtaacgccgtcgtgctgtggttgctgggttgcaggatgcgtaggaacgctgtgtccatatatattctgaacctggtggctgcagattttctgttcctaagcggacacataatttgctcaccacttcgtcttatcaatattcggcatcctatctcgaagattctgtcaccagtaatgacctttccttactttattggactgtccatgttgagcgccatttctacggagagatgcctatccattctgtggccaatctggtatcactgcaggcgtcctagatacctttcctcggtaatgtgcgttttgctgtgggcactgagcctgctccgaagtattctggaatggatgttctgtgactttctgtttagcggcgcgaattcagtatggtgcgagacctctgattttataactattgcctggctggtatttctgtgtgtggttctttgtgggtccagcctggttctgttggttcgcattctatgtggaagccgaaaaatgcccctcaccagactgtatgtgaccatcttgctcacagtgctggtgtttttattatgcgggcttccattcggtatccaatgggccctgttcagtcggatccacctggactggaaagtgctgttctgtcatgttcacctcgtctcaatctttctttccgctctcaatagcagtgccaaccctataatttattttttcgtgggtagctttagacagagacaaaaccgtcaaaatctgaagttagtactccagagagcattgcaagacacccccgaggtcgacgagggcggcggctggctcccacaagagactctggagctctccggaagtagactagaacagtag

SEQ ID NO: 194264 - DNA, 741 bp, Artificial Sequence
  Description of Artificial Sequence: Synthetic coding sequence
atggacagcaccatccccgtgctgggcaccgagctgacccccatcaatggccgcgaagaaactccctgttacaaacaaactctcagcttcaccgggcttacctgcatcgtgtctctggtcgcactgaccggcaatgctgtcgtcctgtggctgttaggctgccggatgcgccgtaacgccgtctcgatctacatattaaacctggtcgccgcagattttttgtttctgagcggtcacatcatatgtagccccctgcgcctgatcaacatccggcatcccatcagtaaaattctgtccccagtcatgaccttcccatatttcatcggcctctctatgctgtccgccataagtacagagaggtgtctaagcatcctgtggccgatctggtaccattgccgcagacccagatatctgtccagcgtgatgtgcgtgctgctgtgggccctgtccctcctgcgaagcattctggagtggatgttttgtgatttcctgttttccggcgctaatagtgtctggtgcgagactagtgatttcattactattgcttggctggtattcctttgcgttgtcctgtgtggctcaagcctcgtgctgctggtacggatactttgtggcagcagaaaaatgccactgaccagactgtatgttaccatcctgctgactgtgttggtattcctgctatgcggcttgccttttggtatccaatgggctctgttcagcaggatccacttagattggtag

SEQ ID NO: 194265 - DNA, 969 bp, Artificial Sequence
  Description of Artificial Sequence: Synthetic coding sequence
atggaccccaccgtgcccgtgttcggcaccaagctgacccccatcaatggcagagaagagaccccatgttataaccagacactcagctttactgtgctgacatgcataatatcccttgtcggtcttactggaaacgcagtggtcttgtggctgttgggatacaggatgcgacggaacgcagttagcatttatatactgaatctggccgcggccgattttttattcctttcatttcaaattattcgactcccattgagactgatcaacatctctcacttgatacgcaaaatactggtttccgtaatgaccttcccctattttaccggcctgagtatgcttagcgccatttccacggaaagatgtctgtcggttctgtggcctatctggtatagatgtcggcggcctacacatctgagcgcggttgtgtgtgtactcctgtggggactgtccttattgttttctatgctcgagtggcgtttctgcgatttcctcttcagcggggccgatagctcctggtgtgagacttccgatttcatccctgtggcatggcttatattcctgtgcgtggtcctttgcgtgagcagtctcgtgttattggtgcggatcctctgcggctccagaaagatgccattaactagactatacgtcactatcctgcttaccgtgctcgtcttccttctctgcgggctaccctttggaatcctgggcgccctgatataccgcatgcatctgaacttggaagttttatattgtcacgtgtatctcgtctgcatgtccctcagcagcctgaatagttccgccaatcctattatctactttttcgtcgggtccttccggcagaggcagaatagacaaaaccttaagctggtgctgcagagagcccttcaggacaagccagaagtggataagggggaagggcagcttcccgaagagtcactggaactgagcggcagccgactggggccgtag

SEQ ID NO: 194266 - DNA, 3051 bp, Artificial Sequence
  Description of Artificial Sequence: Synthetic coding sequence
atggtgctgcccacctgccccatggccgagttcgccctgccccggcatagcgcggtgatggaaagattacggcggaggatcgagctgtgtcggcggcaccatagtacttgcgaggctcgttatgaggcggtaagccctgaacgccttgagctggagagacagcatacctttgctctacaccagcgctgtattcaggccaaggcgaagagagctgggaaacatcgacaacccccagcagccactgcacccgcaccggccgcgcccgcccccagactcgatgctgcagatggccccgaacatggtagacccgcaacgcacctgcacgacacggtcaagcgcaacttggattcggccacatcaccccagaatggagaccaacagaacggttacggcgacttgtttccaggacataagaaaacacggagagaagccccactcggagtcgctatctccagtaacgggctgccccctgctagcccactaggccagagtgacaagccttccggagctgacgcgctgcagagttccgggaagcatagcctaggcttagattcgctgaacaagaagcgcctcgcagattcttccttgcacctcaacggaggctccaatccgagtgagagttttccgttatccctcaataaggagctaaagcaagagcctgtggaagacctgccttgcatgatcaccggtacagttggcagcataagccaatcaaaccttatgcccgacctaaatctgaatgagcaagagtggaaggaactgatagaggagcttaatcgtagtgtgcccgatgaagatatgaaagatctcttcaacgaggatttcgaagagaagaaggacccagagagttcaggatccgccacccagactcctctggctcaggatataaatatcaaaactgagttctcccccgcagcttttgagcaagagcaactaggaagccctcaggttcgagctggtagtgccgggcagaccttccttggcccctcgtctgcacccgtgtctactgattcaccatcactagggggttcgcagactctgttccatacttccggacagccccgtgccgacaacccctcaccaaacctgatgccagcgtccgcgcaagcccagaacgctcagcgtgctctagctggggttgtcttacccagccaaggacccggaggagcgtccgagctgagcagcgctcaccagctgcagcaaatcgcagcaaaacaaaagcgtgaacagatgcttcagaacccccagcaagccacgcctgcaccagcccccggacagatgagtacttggcaacagactggcccgtcccatagttccctggatgtgccataccctatggagaagccagctagtccttcctcctataagcaagatttcacgaattctaaactcttgatgatgccttcagttaataaatccagcccgcgtccgggagggccctatttacagccctcccatgtgaatttgttaagccatcagcctcctagtaatcttaatcagaatagtgccaacaaccagggatcggtcttagattatgggaacacaaaacctctgtctcattacaaagcagattgtgggcagggttctccaggctccggtcaatccaaacctgcactgatggcctacctcccccagcagctgagccatatcagccacgagcaaaattcactctttctaatgaaacctaaacccggaaacatgcccttccgaagcctcgttccgcccggccaggagcagaacccatccagcgttccggtgcaggctcaggctacctcagtgggcactcagcccccagccgtatctgtagcttccagccacaattcttcaccttatttgagtagccagcaacaggctgcagtgatgaagcagcatcaactgctgctggaccagcagaaacagcgggagcagcaacagaagcatctgcagcagcagcaattcttacaacgccagcagcatttgttggcagaacaggagaaacaacaatttcagcggcatctcacaagacctccgcctcagtaccaggaccccacccagggctcctttccccaacaagtgggccagtttactgggtcttccgccgccgtgccaggtatgaacactctgggcccctccaacagctcatgtccgcgtgtatttccccaggctggcaatctgatgcctatgggccccgggcacgcctcagtgagtagcctgccaacgaactctgggcagcaggatcgcggagtcgctcagtttccaggaagccaaaacatgccccaaagttcactgtatggaatggcatccgggatcacgcagattgtcgctcaaccaccccctcaggccaccaatggccatgctcacattccgcggcagaccaatgtcggacaaaacacatctgtgtcggccgcatacggtcagaattctctgggatcttcgggactgtcacaacaacataacaagggcacccttaatccgggactgacgaagccccctgtgccccgagtgtcccctgccatggggggacagaacagctcctggcagcaccaggggatgcctaacctcagcgggcaaactcctggcaattccaacgtttcaccatttacggctgcctccagtttccatatgcagcagcaggcccacctgaagatgtcctcaccccaattctctcaggcagttcccaaccgccctatggctcctatgtcaagcgcggccgccgtcggtagcctgttaccgcccgtttccgctcagcagcgcacctctgcccctgcccccgcgcctccacctaccgcccctcagcaaggtctgcccggactgagtcctgccgggcctgagctgggtgccttctcccagagcccggcctctcagatgggcgggagggccggtttacattgtacgcaggcatacccagtccggacagcagggcaggagctgccgtttgcttattcgggccagccaggggggtcaggattatcctcagtggccggtcatacagacctgattgattcccttctcaagaaccggacctcggaggagtggatgagtgaccttgacgacctcttaggcagccaatag

SEQ ID NO: 194267 - DNA, 2286 bp, Artificial Sequence
  Description of Artificial Sequence: Synthetic coding sequence
cggggcaagcagtggggccggggcggcggcgagcggccccggctggaagtgggatctaagaggcggttaggagtgggaccctctggggccgggggaaagcctgcagccgcgcgcgagccagctccactgccatccggggcctggagaggccgcgaggctgaacgcggctcccgcggtgagagaagccctcagtgccagccggcaccccgcggtcctgcacctggccccgcacgagctgccagaggaccctggtgttgtcccccagccccttggaggtcctcacggtgtagaggaacagccaggagctggtcggctttcgcaggcgctagctcttgtgccggcgcaactaccgcccctgcgcgccccgccgcccctgccccacggttggatgcagccgatggtccagaacatggccgacctgcgacacacctgcacgacacagtgaagagaaacttggatagcgcaaccagtcctcagaatggagaccaacagaatggctacggtgaccttttcccagggcataagaaaacacgccgggaggcgcctctgggcgtggcgatttcctccaatggactgccccccgcctcccccttggggcagtccgataaacccagtggggccgacgcactccagagctcaggcaagcattccctgggccttgattctctaaacaagaaaaggctggccgattcgagcttacaccttaacggcgggtctaacccatccgaatcctttccgttgtcactcaataaagaactgaagcaggaacctgtggaggacctgccatgcatgattacgggcactgtgggctccatcagccaaagcaacctgatgccggacctgaatctcaacgagcaagaatggaaggagctgatagaagaattgaataggagtgtcccagatgaggacatgaaagacctgttcaacgaggatttcgaggagaagaaagaccctgagtcctctggtagcgccacgcagactccactggcccaggacattaatataaagactgaattctcgccagccgctttcgagcaggagcagctgggcagcccgcaagtacgggctggttcggcagggcaaacattcctcgggcccagttcggcgcctgtcagcactgactcgccatccctcggcgggtcccagacactcttccatacgtccgggcagccccgtgccgacaacccaagccccaacctcatgccagccagtgctcaggctcagaatgcacagcgcgcgctggcaggagtggtgctgcccagccaaggacccgggggggccagcgagttatcctcagcccaccagctgcagcagatagccgccaagcaaaaacgggagcagatgctgcaaaatccacagcaggcgaccccagcacctgctcccggccagatgagcacctggcagcagaccggaccctcccacagttcactggatgtgccatatcctatggaaaagccagcgagtcccagctcctataaacaggactttactaatagcaaattgcttatgatgccgagcgtgaataagtcctccccaaggccaggaggcccctacctgcagccttctcatgtgaacttactcagtcaccagccaccatcgaatctcaatcagaattccgcaaacaatcaaggctccgttctggactacggcaacacaaaaccactctcccactataaggcggactgtgggcagggaagccccggtagcggtcagtcaaagcccgccctgatggcatatcttccacagcaattgagccatatatcccatgagcaaaatagtttgttcctgatgaagccaaaacctggtaatatgccattccggtcgctggtgccgccagggcaggagcagaatccaagttctgtcccagtccaggctcaagcaacttctgtgggaactcagccccccgccgtgagcgttgcctcttcccacaactcttccccgtacctctctagccagcagcaggccgcggtcatgaagcagcatcagctgctgttggatcagcagaagcagcgggaacagcagcagaagcacctgcagcagcagcagttcctacaacgtcagcagcatttgctagcggaacaggagaagcaacagttccaaagacacctgacccgaccccctccacagtatcaggatcccactcagggaagctttcctcagcaggtgggacaattcaccgcccaggggctcagttgcgccctgcctatgattcatagtacggaggtgctgatctcaagtctttgcaacgggagtgctggcctgtctgccgcccagcggtcatggtag

SEQ ID NO: 194268 - DNA, 3471 bp, Artificial Sequence
  Description of Artificial Sequence: Synthetic coding sequence
atgggcgacaccgcccccccccaggcccccgccggcggcctgggcggggccagcggagccggcctgcttggaggaggtagtgtgacgccacgggtccattcagctatcgttgagagattgagagctcgcatagcggtttgtcggcagcatcatttgtcatgcgagggaaggtacgaaaggggccgcgccgaatcttctgatcgggagcgcgagtcaaccctccagctactgagcctagtccagcatggtcaaggcgccagaaaggccggtaaacacacaaaagcaactgccaccgctgccactacaacggcccctcctccgccacccgctgccccccctgcagccagccaggccgcggcaaccgcagctcccccccctcctccagattatcatcaccaccaccaacagcatcttttgaactcctccaacaacggcggctctggtggaatcaatggcgagcagcagccccctgctagcaccccgggtgaccagaggaatagcgcacttatcgctctgcaaggcagcctgaaaaggaagcaggtggttaacctgtctccagctaactccaagcgcccaaatgggttcgtcgataactccttcctcgacatcaagaggattcgggttggggaaaatctgtctgcagggcagggtggccttcagattaacaacggccaaagccaaattatgagcggtacactaccaatgtctcaagctcctctgcgtaagaccaacacactgccaagccacactcactctccaggtaatggcctgtttaatatgggccttaaggaggtgaagaaagagcctggagagacactgtcatgtagcaagcacatggacggccaaatgacccaggagaacatattccccaaccgctatggcgacgatcccggtgagcagctgatggatcccgaactccaggaactgttcaatgagctcaccaacatatctgtcccccccatgtccgatttggaactggaaaacatgatcaatgcaacgataaaacaagacgacccttttaatatcgatctgggacagcagagccagagatctacccctaggccgagtctgcccatggagaagatagtgatcaaatccgagtactcacctgggctgacacagggaccgtccggatccccacagctcagaccgccaagcgctgggcctgcgtttagcatggcaaatagcgcgctgagtacatctagcccaattccttctgtgcctcaatcccaggctcagccgcaaaccggctctggtgcgagccgcgcgctcccctcctggcaggaggtgagccacgctcaacagctaaaacagattgcagcgaatagacagcagcatgccagaatgcagcagcatcaacaacagcaccagccaacaaattggtccgcgctaccatcctctgcaggaccctctcccgggccatttgggcaggaaaaaatcccaagtccttcgttcggacagcagaccttctccccacaaagttcccctatgcccggggtagccggcgggtccggacagagtaaagtaatggcaaactacatgtacaaagccggcccaagcgcccaggggggacatttagatgtgttaatgcaacaaaaaccccaggatctatctaggtcgttcattaacaatccacatcccgctatggagcctcgccagggcaacacaaagccactgttccatttcaactccgaccaagcaaaccaacagatgccatccgtgcttccctcccagaataagcctagtttgttgcactacacccagcagcagcagcagcagcagcagcaacaacagcagcagcagcagcagcagcaacagcagcagcagcaacagcagcagcagcagcagcaacagcagcaacagtcctctatctcagcccagcagcagcagcaacaacagtcaagtatctccgctcaacagcaacaacagcagcaacagcagcagcagcagcagcagcagcagcaacagcagcagcagcagcagcagcagcaacaaccatcgtcccagccagctcagagcctcccctcccaacccctgttacgatctcccttgccactacagcagaaactattgcttcagcagatgcagaaccagccaatcgctggcatgggctaccaggtgagccagcagcagaggcaggatcagcattcggtggtcggacagaacacggggcctagtcccagccccaatccttgttccaatcctaatacagggtcaggatatatgaattcacagcagagcctcctgaatcagcagcttatgggtaaaaagcagaccctgcagcggcagatcatggaacagaagcagcagttactcctccagcagcaaatgctagcagacgctgagaagattgcccctcaggaccagattaatagacacctgtctcgcccgccaccagattacaaagatcaaagacgcaacgtcggcaatatgcaacctacggctcagtactctggtggcagttccactatttccctcaattccaaccaagccctcgccaatccagtcagcacgcataccatcctcactcctaacagcagcctgctttccacaagtcacgggacaagaatgccctccctctcgactgcggtgcagaatatgggcatgtatggcaacctgccgtgcaatcagcccaacacatattccgtaacaagcggcatgaaccagttaacccagcaaaggaacccaaaacagctcctggcaaaccagaacaatcccatgatgccaagacccccgacactcggccccagcaataataataatgttgctaccttcggtgccgggtctgtggggaatagtcagcagctgcggcccaacctgacccacagcatggctagcatgccgcctcaacgtacaagtaacgtaatgattacatctaatacaacagcacctaactgggccagccaggagggaacttccaagcaacaggaagctctcacctctgccggagtacggtttccaacaggcacacctgccgcatatacgccaaaccaatccttgcagcaggcagtgggctcccagcagttctcacagagggctgtggcccccccgaaccaactgacacctgctgtccaaatgcggccaatgaatcagatgagtcagacattgaacggacagacgatgggaccactgcgggggttgaaccttcgccctaatcagctctctacgcagatcttgcctaatctgaaccagtctggtacaggtctgaatcagtccaggacgggcattaaccagcctccttcgctgacccctagcaatttccctagcccaaatcagagttccagagcctttcagggtactgaccactccagcgatctcgcgtttgactttctgtctcagcagaatgataacatgggccctgccctgaacagtgatgcagacttcatcgattccctacttaagaccgagcctgggaatgacgactggatgaaggacattaacctcgacgaaatactcgggaataacagctag

SEQ ID NO: 194269 - DNA, 3471 bp, Artificial Sequence
  Description of Artificial Sequence: Synthetic coding sequence
atgggcgacaccgcccccccccaggcccccgccggcggcctgggcggtgcgtccggtgccggcttattaggcgggggctccgtgactccacgggtacactccgccatcgtggaacgcctgcgggccagaatcgcagtgtgccgtcaacatcacctgtcatgtgaaggccgttacgagagaggtagagccgagagctccgacagagagcgagagagcaccctgcagttgctgtctctggtgcagcatggccagggagcccgcaaggccggtaaacatactaaggcgacagcgactgcagctaccactacagcccccccccccccccccgccgctccccctgccgcgtctcaggctgctgccactgcagcgccccctccgccacctgattatcatcaccaccatcagcagcacctgctgaactcatcaaataatggaggctcagggggcatcaacggagagcagcagcccccagcttccactcccggggaccagagaaattcagcactcattgcgctgcaaggatcccttaagcggaaacaagtagtgaacctctctcccgctaattctaaaagacccaatggtttcgtggataattcttttctggacataaagcggatcagggtcggagagaacttgagcgctgggcagggtggcttacagatcaacaacgggcagtcccagattatgagcggaaccctgcctatgtcgcaggccccactccgcaaaacaaatactctgccgtctcatacccactccccagggaatggactgtttaatatggggctaaaggaggtcaagaaggagcccggcgagactttgagctgttccaagcacatggatggacaaatgacacaggagaatatttttccgaacagatatggtgacgacccaggtgagcagctgatggaccctgaattacaggaactcttcaatgagttaacgaacatttcagtacctccaatgtcagatttggagttggaaaatatgatcaacgcgactatcaagcaggacgaccccttcaacatcgacctcgggcaacaaagccagaggagcacaccacgacctagtctccctatggaaaaaattgttatcaaatcagaatactccccaggcctcacccagggtccctccggcagtccacaactgaggcctcccagcgcaggcccagcattctctatggcgaacagcgcgttgtccaccagtagtcccatcccatcagtccctcagagtcaggctcagccacagacagggagcggagcatcgcgtgctcttccttcctggcaggaagtctctcatgcacagcaacttaagcaaatcgccgcaaaccgacagcaacacgcacgaatgcagcaacaccagcagcagcatcagcccactaattggtccgccttaccctcctcggccggaccctccccaggaccatttggtcaggagaagattccgtctcccagttttggtcagcaaactttttcaccacagtctagtccaatgccaggcgtggcggggggcagtggccagtccaaggtgatggcaaattatatgtacaaggcaggaccctccgcgcagggtggacatctggacgtgctgatgcaacagaagccccaggatctcagtcgcagttttattaacaaccctcatcctgccatggagccacgtcagggcaataccaagcctcttttccactttaatagcgaccaggcaaatcaacagatgcccagcgtgctgcctagccaaaataagccttcactgttgcattacactcagcagcagcagcagcagcagcagcagcagcaacagcagcagcagcagcagcagcagcagcaacagcagcaacagcaacaacagcagcagcagcagcagcagtcaagcatatctgctcaacagcagcagcagcaacagtcgtccatttccgctcaacagcagcaacaacagcaacaacagcaacagcagcaacagcagcagcagcaacagcagcagcaacagcagcagcagcagccctcatcccagccagcgcagtctcttcccagccagcccctgttgagaagtcctcttccactccagcagaagttgctcctccagcagatgcaaaaccagccaatagccggcatggggtaccaggtatcccagcaacagcggcaagaccagcactcggttgtgggacagaatacaggtccaagcccatcacccaatccttgtagcaatcccaacacaggtagtggatatatgaactcccagcagtccctgctcaatcagcagctgatgggcaaaaagcagacactccagagacagatcatggaacagaaacagcagcttctccttcagcagcagatgcttgccgatgccgaaaagatcgcgccacaggaccaaatcaaccgacacctgtcacgtcccccaccagactacaaggaccagaggcgcaatgtaggcaacatgcagcctaccgctcagtattctggtggctcctccacaatcagtctgaactccaatcaggccctggccaaccctgtctctacacacacaatccttactcccaactccagcctgttgtctacatctcacggtacgagaatgcctagcctcagcaccgctgtgcagaatatgggcatgtacggaaacttgccttgtaatcagcccaatacctactccgtaacatcaggtatgaatcagcttactcagcagagaaatccaaagcagttactggccaaccaaaataatcctatgatgccgcgtccacctacgttgggacctagcaataataacaatgtagccacatttggcgctggttctgtgggaaattcacaacagctgcggcctaatcttacccatagtatggcgagcatgcctccacagcgcacttctaatgtgatgatcacctcaaacactacagctcctaactgggcatcacaggaaggcaccagcaaacagcaggaagccctcactagcgcaggagttagattccctaccggcactcccgccgcatacactccgaaccaatcactgcaacaggccgtgggctcacaacagttttctcagcgagcagtggcgccgccaaaccaactcacaccagccgtgcagatgcgccctatgaaccaaatgagtcagactctaaatggccagacaatgggacccctacgcggcctcaatctgagacctaaccagcttagtacccagatcctcccaaatctgaaccaaagcggcacaggtttaaaccaatcacgaactggtattaatcagcccccgtctctgacaccttccaacttcccctctccaaatcagtcctctagagctttccaaggcacagaccactcctctgacctcgcctttgacttcttatcgcagcagaacgataacatgggccccgctctgaactcagatgccgactttatcgactcacttttgaagactgaacccggcaatgacgattggatgaaagatattaaccttgacgagatccttggaaataatagttag

SEQ ID NO: 194270 - DNA, 1632 bp, Artificial Sequence
  Description of Artificial Sequence: Synthetic coding sequence
ctgcaggagaccgtgaagcggaagctggagggcgcccggagccccttgaatggagatcaacagaacggcgcttgcgacggcaacttctccccaacatcaaagcgcatcaggaaagacatttcagccgggatggaagctataaacaacctgcccagtaacatgcctctgccatccgcttcacctctgcaccagctagatctgaagcccagtctgcccctacaaaactcgggcacccacaccccaggattactggaggatctttctaagaacgggcgtttacctgagattaaactgccagtgaatggctgctctgacttggaggattcttttaccattctccagagcaaagatttgaagcaagagcctctggacgacccgacctgcatcgatacatctgagacatcactctcaaatcagaacaaactgttctccgacattaatctgaacgaccaggagtggcaggaattgatcgatgagttggcgaacacagtgcctgaggacgatatccaggacttgtttaacgaagattttgaagagaaaaaagaaccagagttctctcagcccgccactgagactccgttgagtcaggaaagcgcttctgtgaaaagcgaccccagtcactctccattcgcccatgtcagtatgggctccccccaggcccgaccctcctcatcaggtccccctttctctaccgtttcaactgccaccagtcttcccagcgtggcatctacacccgctgcacccaaccctgctagttctcccgcaaactgcgcggtacaatccccgcagacccccaatcaggcccacaccccagggcaggctcctccgaggcctggcaacgggtatctactcaacccagcagcagtgactgtcgctggatccgcatccggccccgttgccgttccctcctcggatatgagcccagctgagcagttgaagcagatggccgcacagcagcagcaacgcgccaagctgatgcaacaaaagcagcagcagcaacagcagcagcaacagcagcagcaacagcagcaacagcaacagcagcagcagcaacagcagcagcattccaaccaaacaagtaattggtcgccacttggccccccaagcagtccttatggagccgctttcacagcggaaaaacccaattccccaatgatgtacccccaagccttcaacaaccagaatcctatcgttccccccatggctaataatttgcagaaaactacaatgaataattatctaccccagaatcacatgaacatgattaaccagcagcctaataacctggggacaaactctctgaataagcagcacaatattttgacttatgggaacacaaagcccctgactcattttaacgccgacctgtctcagagaatgacaccaccagtcgcaaatcctaacaagaaccctttgatgccctatatccaacaacaacaacagcagcagcagcagcagcagcaacagcagcaacaacaacagcccccccccccccagctacaggccccccgcgcacacctcagtgaggaccagaagcgcttgcttttaatgaaacagaagggcgtgatgaaccagcctatggcttatgcggcactcccttctcacgggcaggaacagcagcccgttggttag

SEQ ID NO: 194271 - DNA, 831 bp, Artificial Sequence
  Description of Artificial Sequence: Synthetic coding sequence
atgagccccgccgagcagctgaagcagatggccgcccagcagcagcagcgcgcaaaactcatgcaacaaaagcagcaacagcaacagcagcagcagcaacagcagcaacaacagcatagcaaccaaaccagcaactggagccctctaggtcccccatcctctccctacggggccgcattcacagcagagaaaccaaactccccaatgatgtatccacaggccttcaataatcagaatccaattgtgcctcctatggccaacaacctgcagaagacaactatgaacaactacctaccacaaaatcatatgaacatgatcaatcagcagcctaacaacctgggcaccaattcacttaataaacagcacaatatcttgacttatggcaatactaaacctttgacccactttaacgccgatctaagccagcgcatgaccccgcccgtggcgaatccaaataaaaatccactgatgccgtatatacaacaacaacaacaacaacagcagcagcagcagcagcagcagcagcagcagcaacctccccccccacaactacaagctccaagagcccatttatccgaggatcagaaacgcctgctcctaatgaagcagaaaggagtcatgaatcagcctatggcatatgctgctctgccctcccacggccaggtcagcgtaaaggtcacgcacagctctagctcttcttgcggggcctttgactgccggtgtgttatgttttataagtctactgttgttggctccaactgccttcagaaaacctctctgcacccccaggtggtagccagattcggcgtgttcttttttcattttagttag

SEQ ID NO: 194272 - DNA, 3417 bp, Artificial Sequence
  Description of Artificial Sequence: Synthetic coding sequence
atgggcgacttcgccgcccccgccgccgccgccaacggcagcagcatatgcatcaacagtagtctgaattctagtctgggtggcgcagggatcggcgtcaacaatactcctaattctactcccgctgcccccagctctaatcacccggcagccggaggttgcgggggaagtggaggccctggtggcggaagcgctgccgtccctaagcatagtactgtcgtagaaagactgcgccaaaggatcgaaggttgtcgaaggcaccacgttaactgtgagaatagatatcagcaggcgcaggtagagcagctcgagctggagcgccgggataccgtctcgctctatcagagaactcttgagcaacgtgctaaaaagtctggcgctggtacgggcaagcagcagcatccgagcaaaccgcagcaggacgcagaggccgcatcagccgagcagaggaaccacacccttatcatgctgcaagaaaccgtgaagaggaagctggagggcgcccgcagtcccttgaacggagaccagcagaacggggcttgcgacggcaatttcagccccactagtaaacgtattaggaaagatatttccgccggcatggaagctattaataacctgccatctaacatgcccttaccaagtgcgtctcctctgcaccagctcgatttgaagccatctcttcccctgcagaattctgggacccacacgcccggtttgttagaggacctcagtaagaacggccggcttcctgagattaagttgcccgtaaatggatgttctgacctggaagactcatttactatcctgcagagtaaggacctgaagcaagaacctctggatgacccaacgtgtatcgacactagtgagaccagtctttcaaatcaaaacaaactgtttagcgacatcaatctgaatgatcaggaatggcaggaactcattgatgagctggcgaatactgtccctgaagatgatatccaggatttgtttaacgaagacttcgaagagaagaaggaaccagaattctcccagcccgccacagaaacaccactgagtcaggagagcgcttcagtgaaaagtgaccccagccatagcccgtttgcccacgtttcaatgggatctcctcaggcccggccctcaagttccggtccccccttcagcactgtgagcaccgcgacatcactgccaagcgtggccagcactcccgccgcacccaaccccgccagcagtccagccaactgcgcggtccagtcccctcagacccctaaccaggcccacactcctgggcaagcgccccctcgccccggaaacggctaccttctgaaccccgcagctgtaaccgtggcaggttccgcctcaggacctgtggcagttccatccagtgacatgagccctgctgagcagctgaaacagatggccgcccagcagcagcaacgtgccaagcttatgcagcagaagcagcagcaacagcaacagcagcagcagcagcagcagcaacagcagcaacagcagcaacagcaacagcagcagcagcactctaatcagactagcaactggtctcccttaggaccaccatccagtccatatggcgctgcttttacagcagagaaacctaactctcccatgatgtacccgcaggcatttaacaaccagaacccgatcgtgccaccgatggcaaacaacctgcaaaagaccacgatgaacaactacctaccacaaaatcacatgaatatgataaatcagcaacccaacaacctgggtacaaattcactcaacaagcagcataatattcttacctatgggaacactaagccactcactcatttcaacgcggacctgtcccagcgtatgacacctcctgtggccaacccgaataaaaaccccttaatgccttatattcagcagcagcagcaacagcagcagcagcagcagcagcagcaacaacagcagcagccaccccccccgcaactgcaggctcccagggcacacctcagcgaggatcagaagcgcctcctgctcatgaaacagaagggggtgatgaaccaaccgatggcatacgcagcgctgccgagccacggtcaagaacaacatcctgtcggactgccccggactacaggacctatgcagtcctccgttccaccaggttctggtggaatggtctctggagcatcccccgcgggcccagggtttcttggctcccaaccccaggcagccattatgaaacaaatgctgatcgatcagcgggcacagcttattgagcagcaaaagcagcaattcctccgcgaacagcgccagcagcagcagcagcagcagcagcagatcctggctgagcagcagcttcagcagtctcacttaccgcggcaacacttacagccccagcgtaatccataccccgttcaacaggtcaaccagttccagggttccccgcaggacattgccgccgtcaggtcacaggctgcgttgcagtcaatgagaacttcacgcctgatggcacaaaatgcgggcatgatgggcatcggcccgagccagaatcccggcacaatggccacagccgctgctcaatctgaaatgggactggcgccatattccacgacaccaacttcccagcccggaatgtacaacatgtcgactgggatgacacaaatgctacagcatcccaaccaatctgggatgtccattactcacaaccaggcccagggtcctcgacaaccggccagtggacagggagtcggaatggtttcggggttcggccagtcaatgctggtcaactctgccattacgcagcagcacccacagatgaagggcccagtcggccaggccctgcccagaccacaagccccaccgaggctgcaatcactgatgggcaccgtgcagcaaggagcccaatcatggcagcaacgctccctccaaggcatgcctggaagaacatccggggagctggggccttttaacaatggcgcttcgtatcctctgcaggccggccagccacgactgacaaagcagcattttcctcaaggcctgtctcagagcgtcgtggatgctaatacaggcactgtacgaacgcttaaccctgccgccatgggccgtcagatgatgccctctctgccaggccaacagggcacgtcccaggcccgcccaatggtgatgagcgggctctctcaaggcgtgcctgggatgcccgcattcagccagcctcctgcccaacaacagatcccctccggttctttcgccccgagttctcagtctcaggcatacgaacggaacgccccacaggacgtgtcttataattactctggcgatggagctggtgggtcatttcccggactgcccgatggtgctgacctggtagatagcattatcaaaggaggccccggggacgagtggatgcaagagctggacgaattgttcggcaacccatag

SEQ ID NO: 194273 - DNA, 1338 bp, Artificial Sequence
  Description of Artificial Sequence: Synthetic coding sequence
gagcagcaccccgtgggcctgccccggaccaccggccccatgcagtccagcgttcccccaggatccgggggcatggtctctggcgcctctccagcgggcccgggcttcctgggctcacagccccaggctgcaattatgaaacagatgctcatcgaccagagagctcaactgattgaacagcagaagcagcaatttttgcgcgaacaacggcagcagcagcagcagcaacagcagcagatcctggccgagcagcaattacagcagtctcatctgcctcgacagcacctgcagcctcagagaaatccttatcccgtgcaacaggtcaatcaattccagggatccccacaggatatcgccgctgtccgatcgcaggctgccctccagtcgatgcgcaccagccgcctcatggcacagaatgccggcatgatgggcatcggaccctctcagaatcctggcacaatggcaaccgccgccgcacagtcagagatgggattggctccgtacagcactacccccactagccagcctggcatgtataatatgtctacaggaatgactcagatgctacagcaccctaaccagtctggaatgagtatcacgcataaccaagcccaggggcctcgtcagcctgcttccggacagggtgttggaatggttagcggcttcggacagagtatgttagtgaacagcgccatcacacaacagcatccacagatgaagggcccagtgggacaagccctgccacgtcctcaggctcccccaagacttcagtcactcatgggcaccgtgcagcagggcgcccaatcttggcagcagagaagcctccagggaatgcccggcaggacttcgggcgagctggggccgtttaataatggggcatcctacccgcttcaagccgggcagccccgattgaccaagcagcattttccacagggcctaagccagagcgtagtggacgccaacactgggaccgtccggacgctcaacccagcagcaatgggaagacagatgatgccgagcctgccaggccagcagggaacgtctcaggcgagacctatggttatgagcggcctcagccagggggtccccggcatgcctgcgttttcgcagccccccgctcaacagcagatcccttcggggtctttcgcaccatcaagccagtctcaggcctatgagagaaatgcaccccaggatgtctcatataattactctggcgatggagccggagggtcgttccccgggctgccagatggggccgacctagtagatagcatcattaagggaggccccggggatgagtggatgcaagaactcgacgaactttttggaaatccgtag

SEQ ID NO: 194274 - DNA, 2325 bp, Artificial Sequence
  Description of Artificial Sequence: Synthetic coding sequence
atggacgactggaagagccggctggtgatcaagagcatgctgccccactttgctatggtaggcaatcggcaagaaccccggaaacttcaggaaagcggaaaaaagcccagctggatggaggaggaagatctgtcttttctgtacaaatcctctcccggccgtaagcaccagggcaccgtgaaacggcggcaagaggaagatcacttccagttccccgatatggcagacggaggctatccaaataaaatcaaaagaccatgtttggaggacgtcactctggcaatgggacccggtgcccacccttcaacagcctgcgccgaactccaagttcctcccctgaccatcaatccaagtccagccgccatgggggtggccggtcagtcattgctgcttgaaaataaccccatgaatgggaatattatgggatccccctttgtggtacctcagacgactgaagtgggtcttaagggccccacggtcccgtactatgaaaagattaacagcgtgcccgcggtggatcaggaattacaggagctcctcgaggaactcacaaagattcaggacccctcgccaaacgagctggacttggaaaagattttgggaaccaaacctgaggaacctttagtgctggaccaccctcaggccactctctctactacccctaagccttccgtgcaaatgagtcatctggagtcactggcgtcttccaaggagttcgcatcatcatgtagccaggtcacagggatgtcacttcaaatccctagctcctccacaggtatcagctattcgatcccctcaaccagcaaacagattgttagcccatcttccagcatggcccagagtaagagtcaagtgcaagcgatgttacctgtggccctacccccccttcccgtgccacagtggcatcacgcccatcaactgaaggccctggccgccagcaagcagggaagcgcaaccaagcagcagggccccactccctcttggtctggtctcccccctcccggcttaagtccaccatatcgcccagtcccatcaccacatccccccccacttcctctgcctccacctccgccgcctttcagcccccaatccctcatggtctcctgcatgtcgtcaaacacactctctgggtccacactgaggggatcccctaacgcccttctgagctctatgacctcttcaagtaacgctgcactgggtccagcaatgccatatgcccctgagaaactaccatcacctgctctcacgcagcagccacaattcgggccccagtcaagcatcctagccaacctgatgtcttcaacaattaagacccctcaaggacacctcatgtcagccctccctgcatctaaccccggtccttcacccccgtatcgtcccgaaaagctatcatcacccggcttacctcagcagagttttaccccacagtgctccttaattcgaagtctcaccccaacctccaacttgctttcacagcagcagcagcaacagcagcaacaacagcaggccaatgtgatttttaagcctattagttccaacagctctaagacactgtcaatgatcatgcagcagggaatggcctcttcatctcccggggccactgagcccttcacttttggcaataccaaacctctttcccatttcgtttccgaacctggcccgcagaaaatgcctagtatgcctacgacttccaggcagcctagtctgcttcattacctgcagcagcccactcctactcaggcgtccagtgctactgcttcctcaaccgccaccgcaacactccaattgcaacagcagcagcaacagcagcaacagcaacctgaccacagcagctttctcttgcagcagatgatgcagcagccgcagagattccagcgctctgtggctagtgattctatgcccgctctaccccgacaggggtgctgccacctgttcgcatggacttcagcggcttcatcggtgaaaccccagcaccagcatggcaactctttcacgtcccggcaggaccctcagccgggagacgtgtctccctcaaacataacccatgtggataaggcctgtaagctgggagaggcgcgccacccccaggtgagcctgggaagacagcctcccagttgtcaagcactgggatcggagtccttcctccctggttcatctttcgcccatgagctcgcccgagtaactagctcatacagcaccagtgaagcggcaccgtggggaagctgggatcccaaagcttggcgccaggttccagcccctttattgccttcatgcgatgctaccgcaagggggactgaaattcgcagctatggtaatgatccttag

SEQ ID NO: 194275 - DNA, 411 bp, Artificial Sequence
  Description of Artificial Sequence: Synthetic coding sequence
atggacgactggaagagccggctggtgatcaagagcatgctgccccactttgccatggtcggtaacagacaagagcccaggaagttacaggaaagcgggaagaagccttcttggatggaagaggaggatctttcattcctgtataaatcttcccctggccgcaaacatcagggaactgtcaagagacgacaggaagaggaccatttccaattccccgacatggcagacggcggttaccccaacaaaattaagcggccatgtcttgaggacgtcacattggccatgggtcctggagcccatccatccactgcttgcgccgaactacaggtcccgcccttaacaattaatccatccccggcagcaatgggtgtggcaggccagagcctgctgctggagaataacccaatgtag

SEQ ID NO: 194276 - DNA, 2325 bp, Artificial Sequence
  Description of Artificial Sequence: Synthetic coding sequence
atggacgactggaagagccggctggtgatcaagagcatgctgccccacttcgcaatggtgggcaataggcaagagccacgcaagttgcaagaaagcggcaagaagccgtcttggatggaagaggaagatttgtcatttctttacaagtcgagccccggacgaaagcaccagggtaccgtcaagagaagacaggaagaggaccattttcagttccccgacatggctgacggcggctacccaaataaaatcaaaaggccatgtctggaggacgtgacactcgcaatgggacccggagcgcatcccagcactgcctgtgcagagttgcaagtgcccccactgaccataaacccgagccctgcggccatgggagtagctgggcagtcgctgctcctcgagaataaccccatgaatggcaacatcatgggcagcccctttgtggtcccccagacgacggaggttggattaaaggggccaactgtcccatactacgaaaagatcaattccgtgcctgccgtggaccaggaattgcaggaactgctggaggagctcacaaaaatacaagacccgagccctaatgagcttgacctagaaaagattctgggaacaaagccagaagagccattggtcctggaccacccccaggcaacgctgtccacgacacctaaaccaagtgtccagatgtctcacttggagtcgttagccagctcaaaagaattcgctagctcttgttctcaggtgacagggatgtcactccaaatccccagctcctctaccggtatttcgtacagtattccaagcacttccaagcagatcgtgagccccagcagctccatggcccagagtaagagtcaagttcaggctatgttgcctgttgctctccctcccctgcccgtgcctcagtggcaccatgcccaccagctgaaggccctggccgccagtaagcaggggtccgcaaccaagcaacagggaccaaccccgagttggtctggtcttcccccccccgggctatctcccccctaccggcctgtgcctagcccccacccacctccccttccactgccaccccccccaccaccctttagccctcagtcgctcatggttagttgcatgtcgtcaaacacactctccggtagcactctacgagggagcccaaacgccctgttatccagcatgactagctcttcgaatgcagctctggggcccgccatgccctatgcacccgagaaactgccgagccccgcgcttactcagcaaccccagtttggaccacagtcctcgatcctggcgaacctcatgagcagtactatcaagacacctcagggccatctgatgtctgcgcttccagccagcaatcccggcccttcacccccttataggcctgaaaagttatccagtcccggtttacctcagcagtctttcacaccccagtgtagcttgatcaggagcctcaccccaacttccaacctgctctctcagcaacagcagcagcaacagcagcaacagcaggccaatgtaatcttcaagcccatatcctccaattcctctaagacgctctcaatgataatgcagcagggaatggcttcttcaagtcccggcgcgacagagcccttcacatttggtaataccaagcccttaagtcacttcgtttccgagcctggtccacaaaagatgccttctatgcccactacgtctcgtcagccttccttactccactatctgcagcagcctacgccaacacaggcgtcaagcgccaccgctagcagtaccgcaacggctaccctccagttacagcagcagcaacagcagcaacagcagcagccagaccactcttcatttcttctgcagcagatgatgcagcagccccagagatttcagaggtcggtcgcttcggattccatgccagctctcccgcgacaaggctgttgtcacctatttgcctggacttcggccgctagcagtgttaaaccccagcatcagcatggaaacagctttacttcccggcaagatccccagccaggagatgtgtctcccagcaacataacacacgtggataaggcctgtaagctcggagaagcccgtcatccccaggtctctcttgggaggcagcccccaagttgccaggctctgggcagcgagtccttcttacccggttccagttttgctcacgaactggcccgggtgacctcctcttactctaccagcgaagcagccccgtggggatcttgggacccgaaggcctggcggcaagtccccgccccactattgccttcatgtgacgcgacagcacggggaacggaaatccgaagctacggaaacgatccgtag

SEQ ID NO: 194277 - DNA, 2250 bp, Artificial Sequence
  Description of Artificial Sequence: Synthetic coding sequence
atggacgactggaagagccggctggtgatcaagagcatgctgccccacttcgcgatggtgggcaacagacaagaacctcgaaagctgcaggagtccgggacagtaaaacggcgccaagaggaggaccacttccaatttcctgacatggctgacggagggtacccaaacaagatcaagcggccctgcctggaagacgttacgcttgctatgggtcctggggcgcacccctctactgcctgcgccgagctgcaagtgcctcccctcactataaaccctagtcctgcagccatgggggtcgccgggcagtccttgctcttagagaataatcctatgaatgggaatatcatgggtagcccctttgttgtgcctcagactacagaagtgggactgaaggggcccacggtgccctactacgaaaaaataaacagtgtcccagccgtagaccaagagctgcaggaacttctggaagagctcaccaaaattcaagatccaagtccgaacgagctggatctcgagaagatcctgggcacaaagccagaagagccactagtgctggaccatccccaggctaccctgagcactacacctaagccctcagtccaaatgagccatctggaaagtttagcaagctctaaggagttcgcctcatcttgtagccaggtgacaggaatgagcctacaaatcccgtcaagttccacgggcataagttattccattccctccacaagtaagcagatagtgtcacctagcagctctatggcacaaagtaaaagccaagtccaagccatgctccccgtcgccctgccccctctccccgtgcctcaatggcaccatgcacatcagttaaaagccctggcagcatccaaacagggctcggctaccaagcagcagggccctaccccttcatggagcggtttgcccccgcccggactcagccccccgtaccggcctgtgccatctcctcacccaccacccttgcctctgcctccacctccccctccattcagcccacaaagcttgatggtatcatgcatgagctccaacacacttagcggctccacccttcgggggtcccccaacgctcttctcagcagtatgacctcaagcagcaacgctgccttgggcccggcaatgccatacgcacctgaaaaactgcccagccccgccctcacacagcagccacagttcggccctcaatcgtctattctcgctaaccttatgtctagtaccattaagaccccgcaaggccacctgatgtcagctcttcctgcgtctaatcccggcccaagcccgccatacagacctgagaagctctcatcgccgggtctaccccaacagtctttcactccgcagtgcagtctgatccgaagccttactccaactagcaacctgctaagccagcagcagcagcaacagcagcagcagcaacaggccaacgtcatctttaagccaataagtagcaatagcagtaaaacactgtcaatgattatgcagcagggaatggccagcagctccccgggagctaccgaacccttcacatttggcaatactaagccgttgagtcactttgttagtgagccgggcccacagaaaatgccatcaatgccgactaccagccgccagccatcactgctgcactatttacagcagcccactccaacccaagcgtcaagcgccaccgcttcctctaccgccacggccactctgcaactgcagcaacaacagcagcagcagcagcaacagcctgatcacagcagctttctgttacagcaaatgatgcagcagccacagcggttccagcgcagtgtggctagcgacagcatgcctgcgctccccaggcagggctgctgtcatctgttcgcctggactagcgcagcctcgagtgtgaagcctcagcaccagcacggtaactcctttactagccgtcaggatcctcagccaggggacgttagtccatctaacattactcacgtcgataaggcttgtaagttgggtgaggctagacacccccaggtgagcctgggtcggcaacctcctagttgccaggccttggggagtgaatccttcctccctggcagttccttcgcacacgagctggcgcgggtcaccagttcatactcaacatcggaggccgcaccgtggggttcttgggaccctaaagcatggaggcaggtgcctgcaccactgttgccaagctgcgatgcaacggcgagggggactgaaatcaggtcgtatggcaatgatccctag

SEQ ID NO: 194278 - DNA, 2997 bp, Artificial Sequence
  Description of Artificial Sequence: Synthetic coding sequence
atggacgactggaagagccggctggtgatcaagagcatgctgccccacttcgccatggtaggcaaccgtcaggagccacggaaacttcaggagtccggaacagtgaaaagacgccaggaggaagaccatttccaatttcccgacatggctgatggcggatacccaaacaaaattaaacgaccttgccttgaagacgttacactggcaatgggccctggtgcacatccctccaccgcatgtgctgagctacaagtgccgccattgacaataaacccgtcaccagctgcgatgggggttgcaggacagtccctactgctcgagaataatccaatgaatggaaacataatgggaagcccctttgtcgtgcctcagactacagaggtgggtctcaaggggccaacggtgccatactatgaaaaaatcaactcagtcccagccgtcgatcaggagctgcaggaactactcgaggaacttacgaaaatccaagacccctctccaaatgaacttgatctggagaagattctgggcaccaagcccgaagaaccccttgtgcttgatcaccctcaggctactctaagcactacgcccaaaccttctgttcagatgagtcatctcgagagcctggcctcatcaaaggagttcgcttccagttgtagtcaggttacaggcatgagtctccagatcccgtcttcctctaccgggatttcttacagtatcccaagcaccagtaagcagatcgtatcacccagcagctcaatggctcagagtaagagccaggtgcaggctatgctgccagtcgcactgccgccactcccagtcccccaatggcaccacgcgcaccagctgaaggccctggcggcgtccaagcagggctctgctaccaaacagcaaggccctactccttcatggagcggcctgccgccgccgggactgtcaccgccgtatcgacccgtaccaagccctcaccccccaccccttcctcttcccccccctccccctcccttctctccacaatctttaatggtctcatgcatgtccagcaatacgctctcgggcagtactttgcgcggttcccctaacgcactgctcagtagtatgacgtcaagcagtaacgcagcattgggccccgcaatgccgtatgcccctgagaagttgcctagccccgccctcacccagcagccccagttcggaccccagagctcaatactagcaaacttaatgtcttctactataaagaccccccaaggccatctgatgtcggcactcccagctagcaatcctggaccctctcctccgtatcgccctgagaaactctcaagcccaggcctcccccaacaaagtttcacacctcagtgttccctgattaggtctctcacccctaccagtaacttactgtcgcagcagcaacaacagcaacagcagcaacagcaagctaatgtgatctttaaacccatttctagcaattcatccaaaacgctgagcatgattatgcagcaggggatggccagctcctctccgggggccacagaacccttcacttttggtaacaccaagccactgagccatttcgtgtctgagcctggtcctcagaaaatgccttctatgcctaccacgtcgcgacagccatccctcctccactacctacagcagccaaccccaacccaggcatcttcagccacagccagctcaaccgctacagccacactgcagctccagcagcagcaacagcagcagcagcaacaacctgaccactcttctttcctacttcagcagatgatgcagcagccccagagattccagcgctccgtcgcatccgattctatgccagccctgcctagacagcaggaagaacagagatccggactgatggccatgacacctgaaagacagaatgcctacattagtcagcaaatgtccccatttgaagcagtgcaggagcaagtgacaagcaagtgctctcgcatcaaggcaagtccaccatcaagcaaacaccttatgcctccgaggacgggtcttctgcaaaacaacttaagccccggcatgatccccttgacccgtcaccagtcatgtgagggaatgggggttatctccccaaccctgggaaaaaggcaaggcatttttacctcgtcaccacaatgtccaatcctgtcgcactcagggcagacccccctgggaaggctcgactccgtttgccagcatatgcaaagtcccaaagcaaccccccctgaggtgccactgccgggtttttgtccttctagccttggcacccagagcctgtcgccacaccagttgcgacgaccctccgtacctcgcatgccaactgcgttcaacaacgccgcctgggtgacagcagcagcggctgtgactacggctgtaagcgggaaaaccccactcagccaagtcgataacagtgttcaacaacactcaccgtctggccaggcctgcttacaacgcccctccgattgggaagcacaggtacctgccgctatgggaacccaggtgcctctggctaacaatccatctttcagcctgttaggctcccagtctttacggcagagtccagtgcagggtccggtgccggtcgccaacaccacgaaatttctgcaacagggtatggcttccttcagccccctcagtcccatccagggcatagagccgcccagttacgtggctgccgccgctactgcggctgccgcctccgcggtggcagcgtcccagttccccggtccattcgaccgaacagatattcctcctgagctgccgccagccgacttccttaggcaaccacagcctccccttaacgatttgatctcaagtcctgactgtaacgaagttgactttattgaagccctgttaaagggaagttgcgttagcccagacgaggattgggtttgcaatctgcggttgatagacgacattcttgaacagcatgcagccgcacaaaatgcgacagctcaaaacagtgggcaggtcactcaggacgcaggcgccctctag

SEQ ID NO: 194279 - DNA, 1941 bp, Artificial Sequence
  Description of Artificial Sequence: Synthetic coding sequence
atggaggaggaggacctgagcttcctgtacaagagcagccccggccgaaaacatcagggaaccgtcaaacgcagacaggaagaggatcactttcagttccctgacatggccgatggtggatacccaaataaaataaagaggccctgtctcgaagacgtgacgcttgcaatgggtcctggggctcatccttcaaccgcatgtgccgaacttcaggtcccgcctctcacaataaaccctagtccagctgccatgggggtcgcgggacagagcctgctcctcgagaacaatcccatgaacggtaatatcatgggctccccgtttgtggtgccccagacgactgaagttgggctcaagggcccaacagtgccttactacgagaagataaatagcgtccctgccgtcgatcaggaattacaggaattgttggaagagctgaccaaaattcaggacccctccccaaatgagttagacctcgagaaaattctcggaacgaaaccggaggagccactggtgcttgaccaccctcaggctaccctttccacaacccccaagccctccgtgcagatgtcacacctggaatccctggccagctctaaagaattcgctagtagctgttctcaggttactggtatgtctttacagatcccatcttcctcgaccgggatttcctattcgataccctctacatccaaacagatcgtaagccccagtagcagtatggcacaatcaaaaagtcaagttcaagcaatgttgcccgttgctctgcctcccctccccgttccccagtggcaccatgctcaccagctgaaggccctggcagctagtaaacagggaagtgccactaaacagcagggccctacaccatcttggagtgggctgcccccccccggtctctctccaccctatcgaccagttccttcgccacacccacccccactgccacttccccctccccccccgccattcagtcctcagtccctcatggtgtcctgtatgagcagtaacaccctgagtggatcaaccctccgcgggagtccaaacgccctgctttcatccatgaccagctcctccaacgctgcactgggaccagcgatgccctacgctccggaaaaactgccctcaccagcccttacccaacagccccagttcggacctcaatcttccatcctggccaacctgatgtcctcaactatcaagacgccacaggggcatttaatgtcagccctgccggcctccaatcccgggcccagtcctccataccgtcctgaaaaacttagctccccaggcttgccccagcagtcatttacaccacagtgttccttactgcattacctccagcagcccacgcccacacaggcaagcagtgccaccgcctcgagtacagcgaccgccacactccaattacaacaacaacagcagcagcagcaacagcaacccgatcatagctcctttctgcttcagcaaatgatgcagcagccacagcgttttcagcgttccgtggcctctgactctatgccagccctgccccgtcaaggatgttgccacctgttcgcctggacatccgccgcaagttcagttaagccacaacaccagcacggcaatagctttacttcgagacaggatcctcaacccggcgatgtcagcccctcaaacatcactcatgtcgacaaagcctgcaagctgggagaagctcggcatcctcaggtgtcactgggccggcagcctcctagttgtcaggcactgggttctgaaagtttcctgcccggctcaagtttcgcccacgaactcgctcgggtcacaagctcttacagtactagcgaggccgctccctggggcagttgggaccctaaagcctggcggcaagtacccgcgccccttttgccatcttgtgatgcgaccgctagaggcaccgagatacggagttacggcaacgatccatag

SEQ ID NO: 194280 - DNA, 645 bp, Artificial Sequence
  Description of Artificial Sequence: Synthetic coding sequence
atgatcatgcagcagggcatggccagcagcagccccggcgccaccgagccgttcacttttggcaacactaaacccctaagccactttgtaagcgaacccggcccccagaaaatgccttccatgccaacaacttcccgtcagcccagcctactgcattatcttcaacagcctactccaacccaagcctctagtgccaccgcttcttccaccgcaacggcaaccttacagcttcagcaacagcagcagcagcagcagcagcaaccagatcactccagcttcttgttacagcaaatgatgcagcaaccccagagatttcaacgatcagtggcctccgatagcatgcctgcactcccacggcagacccatgtggataaggcgtgcaaactcggggaggcccgacatccacaggtgagtctgggaaggcagccccctagctgtcaggcgctgggatctgagtccttcctcccgggaagctcgtttgcccacgagctggccagggtgacaagctcttactcgacctcagaggctgctccctggggcagctgggaccccaaagcttggcggcaggtgcctgcaccgctccttccctcatgcgacgccacagcccgggggaccgagatacgtagctacggcaacgacccctag

SEQ ID NO: 194281 - DNA, 1956 bp, Artificial Sequence
  Description of Artificial Sequence: Synthetic coding sequence
atgaaggactacgacgagctgctgaagtactacgagctgcacgagaccattgggaccggaggcttcgccaaagttaaactggcgtgccatatccttactggcgagatggtcgctatcaagataatggacaaaaacactctaggctccgacctgccaagaatcaaaaccgagattgaagctttgaaaaatctgcgccatcagcacatctgccagctgtaccatgttctggaaaccgcaaacaaaatatttatggtgctcgaatactgtccagggggagagctgttcgactacattatctcacaggatcggctgagcgaggaggagacaagggttgtgtttcgccaaattgtctccgccgttgcttacgttcacagccagggttacgcccatagggacctaaaacccgagaacctgctattcgacgaataccacaaattaaaattaatcgatttcgggctctgcgctaaacccaagggtaacaaggactaccacctacagacctgttgtggttcacttgcatacgctgcccccgagctgatccagggaaagtcatacctcggcagcgaggccgatgtgtggtctatggggatcctgctgtacgtcttgatgtgtggctttctgccttttgacgacgacaatgtcatggccctttataaaaaaattatgaggggcaagtatgacgtccccaagtggttgtcaccaagctccatcctgctgctgcagcagatgcttcaggtcgacccgaaaaaaaggataagcatgaagaatctgctcaatcatccttggattatgcaagactacaattaccctgtggaatggcagagcaaaaatccctttattcatctggacgacgactgtgtgaccgagctgtctgttcaccaccggaataaccggcagaccatggaagatctgatatcgctttggcagtatgatcacttgactgccacgtacttgcttcttcttgccaagaaagctagggggaaacccgtacgactgcggttgagctcattctcgtgtggccaggcttccgcgactccattcactgatatcaagagcaacaattggagcctggaagacgtcacagcatccgataagaactatgtggcagggctgatcgactacgattggtgtgaagacgatttatctacaggtgccgcaacgcctcgaacctcccagttcacgaaatactggacagagtcaaatggcgtcgaaagtaaaagcttaacgccagctctgtgtcggaccccagcaaataagctaaaaaataaggagaatgtatacacacctaaatcagctgttaagaacgaagagtattttatgttccccgagccaaaaactcctgtgaataagaatcaacacaagcgggaaatccttacaactccgaaccgttacactaccccgagtaaggcccgtaatcaatgtctgaaagaaacacccatcaagatacctgtcaatagtactggcacggacaaactgatgacgggcgttatctcacctgagcgcagatgccgtagtgtggaactggacctgaaccaggcgcacatggaggagactcccaaacgcaagggcgcaaaggtcttcggctcactggaaagaggcctggataaggtgattacggttctgacccggtccaaacgcaaaggaagcgctcgagatggtccccgccgcttaaagctgcactacaacgtaacaacaacaagactggttaaccctgaccaactcttaaatgagattatgtcaattctcccaaaaaaacacgtggacttcgtccaaaagggatatacactcaaatgccagacccagtcagattttggaaaggtgactatgcaattcgagctggaggtgtgtcagctccagaaaccagacgtggtgggaatcaggcgccagcggttgaagggcgacgcttgggtctataagcgattggtggaggatatcttgagctcatgtaaagtttag

SEQ ID NO: 194282 - DNA, 1743 bp, Artificial Sequence
  Description of Artificial Sequence: Synthetic coding sequence
atgatgaacttcagcaacatcatgaactacatgaagctgctgggccaatactgcccaggaggcgaactgttcgactacatcatctcccaggaccgcttgagcgaggaggaaactcgtgtggttttcagacagattgtctctgctgtggcttacgtccatagtcagggctacgcacatagagacctcaagccagagaacctgttattcgacgaatatcataagctgaagctgatagacttcggactgtgtgctaaacccaaaggcaacaaggactaccacttacaaacttgttgtgggagtctggcatacgctgcacctgagttgattcaaggtaagtcctacctggggtccgaagctgatgtgtggagcatgggtattcttctctacgtgctcatgtgtggcttcctgccatttgatgacgataacgtgatggctctgtataaaaaaataatgcgaggtaaatatgatgttcccaaatggctgtcaccctcaagcattctgctcctacagcagatgctgcaagtagaccctaagaagaggatcagtatgaagaatttgctgaaccatccctggataatgcaagactataactatcccgttgagtggcagtccaagaatccctttatccaccttgacgatgattgcgtgacggagttaagtgtccatcatagaaacaataggcagacaatggaagacttgatatcattatggcagtacgaccatttgacagcgacctatcttcttttgctggctaaaaaagctcgcgggaagcctgtgcgattgcgcctgtctagtttttcttgcggccaggcgtccgctactcccttcaccgatatcaaatccaataattggtccctggaagacgtaacagctagcgataaaaactacgtggccggactgattgactacgattggtgcgaggatgatctttccaccggtgcggcaacaccccgcactagtcagtttactaaatactggactgaaagtaacggagtggagagcaaaagtctcacaccagccttgtgtcgaacccccgcaaacaagttgaaaaataaagagaacgtctatacccctaagtctgctgtgaagaatgaggaatacttcatgttccctgaaccaaaaactcctgtgaataagaatcaacacaagcgggaaatccttaccaccccaaatagatacactaccccaagcaaggcgaggaaccagtgcctaaaagagactcctattaagattcctgttaactctaccgggaccgacaaactaatgactggggtgatctcacccgagcgacgttgtcgcagcgtggaactggatcttaaccaggctcacatggaggaaacaccaaaacggaagggcgctaaggtgttcggttccctcgagcgagggctagataaggtgattaccgtactgactaggagcaagagaaaggggtccgctcgggacggtccaagacggctgaagcttcattataatgttactactacaagattagtcaacccagatcaactgctgaacgaaataatgtctatactcccaaaaaaacacgtagattttgtgcagaagggctacacactgaagtgccagacccagtcggatttcggaaaggttacgatgcaattcgaactcgaggtctgccagctccagaagccagatgtggttggaatacgccggcagcggttaaaaggggatgcctgggtttacaagcggctcgtggaagacatcttgtcttcatgcaaggtgtag

SEQ ID NO: 194283 - DNA, 1812 bp, Artificial Sequence
  Description of Artificial Sequence: Synthetic coding sequence
atgaaggactacgacgagctgctgaagtactacgagctgcacgagacaataggcacaggcggctttgctaaggtcaagctggcgtgccacatcctcactggcgaaatggtggccattaaaattatggacaagaacacccttggttccgaccttccacggattaagacagaaatcgaggccctgaagaacctgagacaccagcatatttgccagttgtatcacgtcctcgaaactgccaataagatctttatggtgttagaagagaaccttctgtttgatgagtatcacaagctgaagctgattgacttcggactgtgcgccaagcccaaagggaacaaggactaccaccttcagacctgctgtggttcgctggcgtacgccgctcccgaattgatccaaggaaagtcatacctcggttccgaggccgatgtttggagcatgggtatcctcttgtacgtcctgatgtgcgggtttctgccatttgatgatgacaatgtaatggccctgtacaagaagattatgcgcgggaaatacgatgttcccaagtggttatcgccgtcatcgatcctcctcctccagcagatgctccaggttgatccgaaaaagagaatctccatgaaaaacttgctgaatcatccgtggataatgcaagactacaactatcctgtggaatggcaatctaagaacccatttatccacctggatgacgactgcgtaacagagcttagtgtgcaccaccgtaacaacagacagacaatggaggacctcatttcattatggcagtatgatcacctgacagctacatacttattgctgttggctaaaaaagcaagggggaaacccgtgcgcctgaggttgagttcgttttcctgcggccaggcaagtgctactccgttcactgatatcaagtcgaataattggtcactggaagatgtaacagctagtgataagaactatgtggccggcttgattgactatgactggtgtgaagatgatctatcaacaggcgctgccaccccccgaacctcccaattcactaagtactggaccgagtctaatggagttgagagtaaaagccttacacccgccctgtgccggactcccgcaaataagttaaagaataaagaaaatgtctacacccccaagtcagcagttaaaaacgaggaatattttatgtttcctgaacctaagactccggtcaacaaaaatcagcataagagagagattctgacaacccctaacaggtacactaccccttctaaagcaagaaatcaatgcctgaaggaaacccccataaagattccggtaaacagcactggcacagacaagctgatgactggtgtgatctcaccggaacggcggtgtcgctctgtggagctagatctgaatcaggcccatatggaggagactcccaagcgaaagggagccaaggtgttcggctcgctggagaggggccttgacaaggtcatcactgtgctgacccgcagcaagagaaagggcagcgctagagatggacccagacggctgaagttgcactacaatgtcacaaccaccagattggtgaatccagaccagcttcttaatgagattatgtccatcttgcccaagaaacacgttgacttcgttcaaaaaggctacactcttaagtgccagacccagagtgattttggaaaggtgacgatgcagtttgaattagaggtttgccagttacagaagcctgacgtcgtgggcatccgcagacaaaggctcaagggagacgcctgggtgtataaacgcctagtcgaagatattctttctagttgcaaagtgtag

SEQ ID NO: 194284 - DNA, 1563 bp, Artificial Sequence
  Description of Artificial Sequence: Synthetic coding sequence
atggtgctggaggagaacctgctgttcgacgagtaccacaagctgaagctgatcgatttcggtctgtgtgctaagcccaagggtaacaaagactatcacttgcagacctgctgtgggtccttagcttatgccgctcctgagttgattcaagggaaatcttacctgggatcagaagctgacgtctggtccatgggcattctcctgtatgttctgatgtgtggtttcctcccattcgatgacgacaatgtgatggccctctacaagaaaattatgcgcgggaagtatgatgtgcctaaatggctgtccccatcttcgatactcctgttacaacagatgctgcaggttgatccaaaaaagagaatttccatgaagaatctactgaaccatccatggatcatgcaggactataattaccccgtggagtggcagtccaagaacccgttcatccacctggacgatgactgcgtcaccgagctgtcggtgcatcatagaaacaacagacagacaatggaagacctcataagcttgtggcagtacgatcacctgacagcaacctacctgttacttctcgccaagaaagcaagagggaaaccggtcaggctgagactgtcatcgttttcctgcggccaggccagtgcgacaccgttcacagacatcaaatctaacaattggagcctggaagatgtgactgcctcggataagaattatgtggcaggtctcatagattacgactggtgtgaagatgatctctctactggcgccgcaacccctcgcacttcccaattcacaaaatattggaccgagtccaacggggtcgagagcaagagcctgacccctgcactctgccggactccagctaataaactcaaaaataaggagaatgtgtacacccctaagtccgcggtaaaaaatgaggagtacttcatgttcccagaacctaaaacccccgtgaataagaatcaacacaaacgtgagatcctgactacgcctaataggtacaccactccctctaaagcaagaaaccaatgtttgaaagagacccccatcaagattccagtgaactccaccgggacggacaaattgatgacaggggtcattagcccagagcgacgctgcaggagcgttgagctggacttgaatcaggcccatatggaggagacgccaaagagaaagggagccaaggtgttcggctctttggaaagaggactggataaagtaatcaccgtgctgacgcggtcgaagaggaaagggtccgcgagagatggccccaggaggctcaaactacattataacgtgaccacgacacggttggtgaaccctgaccagctactgaatgaaataatgtcgatacttccaaagaagcatgtggacttcgtgcagaaaggttacactctcaagtgtcagacacagagtgacttcggcaaagtgaccatgcaatttgagctggaggtctgtcaattgcaaaagccagatgtagtgggaatcaggagacagagacttaaaggggatgcttgggtctataaaagactcgtggaggacatactgtcatcttgcaaggtttag

SEQ ID NO: 194285 - DNA, 1374 bp, Artificial Sequence
  Description of Artificial Sequence: Synthetic coding sequence
atgggcatcctgctgtacgtgctgatgtgcggcttcctgcccttcgacgacgacaacgtgatggctctctataagaaaattatgcgcggaaaatatgacgtgcctaaatggctgagcccctctagcattctgctgctgcagcaaatgttacaggtggaccctaaaaaacggatcagtatgaagaatttgctcaaccatccctggatcatgcaagattataattatcccgtggagtggcagagcaagaacccttttattcacctggacgatgattgtgtcaccgagctttcagtacaccataggaataacagacagacaatggaggacctaatcagcctgtggcagtacgaccatctgacagctacgtacttgctgctgctggcgaaaaaagcccggggcaagccggtacggctgaggctttcttcatttagttgcggccaagcctctgccacccctttcacagatatcaagtcaaataactggtcgctcgaagacgtgacagcgagtgacaagaactacgtggccggtctcatagattacgactggtgtgaggacgaccttagcacaggagctgcaactccaaggaccagtcagttcacaaagtattggaccgagtccaatggagtggaatccaagtcactaacacccgctctgtgtcgtacgccagcgaataagttaaagaacaaagaaaatgtctacactcccaaaagtgccgtaaaaaatgaggagtattttatgtttcctgaacctaagaccccagttaataaaaatcagcacaaaagagagatcctgactacgcccaaccgctacaccaccccgagtaaggccaggaatcagtgcttgaaggagactccaattaagatcccggtgaactccactgggaccgataagctcatgaccggagtgatttcccccgaacggcggtgtcgttccgtggaactggacctcaaccaggctcatatggaggaaacacccaagcgtaagggggcaaaggtttttggatccctggagagggggctggataaggtaattaccgtgctgactcggtccaagcgcaaggggagtgcgagggatggtccccggcgcttgaaactgcactacaacgttaccaccactaggctggtcaaccccgatcagctgctcaatgagataatgagtatccttccgaagaagcacgttgatttcgtacagaagggctacacactgaagtgtcagacgcaatccgatttcggtaaagtaaccatgcagttcgagttggaggtgtgccagttgcaaaaaccagatgtcgtcggaattaggcggcagaggttgaaaggtgacgcctgggtgtataagcggctggtggaggacattctgtcctcctgtaaggtctag

SEQ ID NO: 194286 - DNA, 1833 bp, Artificial Sequence
  Description of Artificial Sequence: Synthetic coding sequence
atgaaggactacgacgagctgctgaagtactacgagctgcacgagacaatcgggacaggcggctttgctaaggtcaaattggcatgtcacatcttaaccggagaaatggtggctattaaaatcatggacaagaacacactcggttcagacctgccacgtatcaagaccgaaattgaagccctgaaaaatctacgacaccagcacatttgccagctgtatcatgtgctggaaactgccaataaaattttcatggtccttgaatattgtcccggcggcgagctgtttgactatatcatttcccaggataggctgtctgaggaggaaacccgtgttgtattcaggcagatagtatcggctgtagcttatgtgcactcgcagggctatgcacaccgcgacttgaaaccagagaatctactcttcgacgaataccacaaactcaaacttatagacttcggcctgtgtgccaagccaaagggcaataaggattaccaccttcagacctgctgcgggagcttggcatatgctgcccccgaactaatacagggaaagtcatacctgggtagtgaggccgacgtttggtcaatgggcattctcctttacgttcttatgtgtggtttcttgccattcgatgatgataatgtgatggccttgtataagaagattatgcgcggcaagtatgacgtgcctaagtggctcagcccctccagcatcttactactccagcaaatgcttcaagtcgatccaaagaaaaggatctctatgaagaacttactaaaccacccctggattatgcaggattacaactaccccgtggagtggcagagcaaaaacccttttattcacctggacgacgactgcgttacagaactgtctgtgcatcaccggaataacaggcagactatggaagatctgatcagcttgtggcagtatgaccatttaactgctacgtacctgctattgcttgcaaagaaggctagaggcaagcctgtccgcctccgcctgagctcattctcgtgtgggcaggcgtccgccacaccctttacagacattaagttcactaaatactggactgaatccaatggagtggaatcaaagtcactgaccccagccctgtgccggacaccggcaaataagctgaagaacaaagagaacgtgtacacccccaaaagcgcagtcaagaacgaagagtattttatgttccccgagccaaagacacctgttaacaagaaccagcataagagggagatcctgaccacccctaaccggtatacaacaccaagcaaagcacgcaaccagtgcctgaaagaaacacccataaaaatacctgtaaattctacgggcaccgataaattgatgaccggcgtgatcagcccagagaggcggtgcagatcagtggagctcgatctgaatcaggctcatatggaagagacccctaagcgcaagggcgccaaagtcttcggctctctcgaaaggggcctggacaaagttattaccgttctgacacggagcaagcgtaagggaagcgcgagagacggcccgagacggctgaagctgcactataatgtaactaccaccaggctagtgaatccagaccaactcttgaacgaaattatgtccatccttccgaagaaacatgtggacttcgtgcagaagggctatactcttaaatgccagacacaatccgatttcggcaaagtcacgatgcagttcgaactggaagtttgtcaacttcagaaaccagatgtggttggtattcgcagacagcggctaaaaggcgacgcttgggtctacaaacgcctcgtggaggatattctgagctcatgtaaagtctag

SEQ ID NO: 194287 - DNA, 1860 bp, Artificial Sequence
  Description of Artificial Sequence: Synthetic coding sequence
atgatgaacttcagcaacatcatgaactacatgaagctgctgggccagtctgacctcccaagaataaagacggagatcgaggctctgaagaacttgcggcaccaacacatctgccaactataccatgtactggagactgccaacaagatcttcatggttctggaatactgccctgggggtgagcttttcgactacatcatctcccaggatcggctgtccgaagaggaaacccgggtagtattccgccagatcgtgtctgccgtggcctacgtgcatagtcaggggtacgcccacagagatcttaagcccgagaacttgttgttcgatgaatatcacaagctgaagctgattgatttcggcttgtgtgctaaacccaagggcaacaaagactatcacctgcagacatgttgtggttcccttgcatatgcagcacctgagcttattcaaggcaaatcgtatctcgggtctgaagccgatgtttggtctatgggcattctgctgtacgtcctcatgtgcgggtttcttccgttcgatgacgataatgtgatggcactgtacaaaaagattatgcgtggcaaatatgacgtccccaagtggctcagtccaagttcaatactcctgctgcaacagatgttgcaggtcgacccaaagaagagaattagcatgaagaatctcctaaaccatccgtggattatgcaggactacaattaccccgtcgagtggcagtcaaaaaatccattcattcacctcgacgatgattgtgtcaccgaacttagcgtacaccatagaaataatcggcagacaatggaagacctgatttcactgtggcagtatgaccacctcacagcaacatatcttttgctcctggccaagaaggctcgcggaaagccagttcgcttgcgactgtcttcctttagttgtggccaagcatccgccaccccctttacggacatcaaaagcaacaattggagcctggaagacgtcaccgcaagtgacaagaactacgtcgcgggattgattgattacgattggtgtgaggatgacctttcgaccggcgccgctactcccagaacctctcagttcacgaagtactggaccgaatccaacggggtggaaagcaagagtctgactccggcattgtgcaggactcccgccaataaactgaagaataaagaaaacgtctatacgcccaagtctgcagtgaagaatgaggagtattttatgtttcctgaacctaagacccccgtcaataagaaccagcacaagcgtgagatccttaccacgccaaacagatatacgacgccctccaaagcaagaaaccagtgtcttaaggaaactccaattaaaatcccagtgaacagcacaggaacagacaagctcatgacaggagtgatctctcccgagaggcgctgccggtccgtcgagcttgatctgaaccaggctcacatggaggagacccctaagcgcaaaggcgctaaggtgttcgggtccctggagaggggattagataaggtgattacagtgttgacgaggtcaaaaaggaagggctctgctcgcgacggtccccgccgccttaagctgcactataacgtgaccactaccaggctggtgaatcccgatcaactgctgaatgaaattatgtctattctgcccaagaagcatgtggacttcgtgcaaaaggggtatacactgaagtgccagactcagtctgactttgggaaggtaacaatgcagttcgagcttgaggtttgtcaactgcaaaaacccgacgtggtgggcatcagacggcaacggctgaaaggggacgcatgggtgtacaaacgccttgtggaggacattttaagctcttgtaaggtgtag

SEQ ID NO: 194288 - DNA, 1743 bp, Artificial Sequence
  Description of Artificial Sequence: Synthetic coding sequence
atgaaggactacgacgagctgctgaagtactacgagctgcacgagacaatagggaccgggggattcgccaaagtgaagttagcctgccacatcctaaccggggagatggtggccattaaaatcatggacaagaacacattgggctccgatctacccaggattaaaaccgagatagaagccttgaagaacttgcgtcaccagcatatctgccagctctaccacgtcttagaaacagcgaataagatattcatggtccttgagggtaataaagattatcacctgcagacttgctgcgggagcctagcctacgcagcgccagagcttattcaggggaaatcatacttgggctctgaagctgacgtgtggagcatgggaattctgctatacgttctaatgtgtgggttcctacccttcgacgatgacaatgtgatggccctttacaagaagatcatgagaggcaagtacgatgttcctaagtggttatctcccagctcgatcttgctcctccaacagatgctgcaggtcgacccaaaaaaacgcatctctatgaagaatctgctcaatcatccttggattatgcaggactacaactaccccgtggaatggcaatccaagaacccatttatccatttggacgatgactgtgtcactgagctgtctgttcaccacagaaacaatcggcagaccatggaggatctcattagcttatggcagtacgaccacctgaccgcaacatacctgcttttactagccaagaaggccaggggcaagcccgtgagactgcggctgagcagcttttcctgcgggcaagcctccgcaacccccttcactgatatcaaatccaacaactggagcctcgaagacgtgaccgcctcagacaagaattatgtggctgggctgatcgattacgattggtgcgaggatgacctgtccaccggagcagccacccctaggacgtctcagttcacaaagtattggaccgaatccaacggagtcgagtctaaatccctcacacctgccctttgtcggaccccagcaaataagctcaagaacaaagaaaacgtgtacacacccaaaagcgccgttaaaaacgaggagtatttcatgttccctgaacccaaaacacctgtcaataagaaccagcataagcgtgagatcctcactactccgaatagatacactactccttccaaagcgcggaatcaatgcctaaaggaaacccctattaagatcccagtcaattctactggcaccgacaagttaatgacaggggtcatctcccccgaacgacggtgcagatccgttgagctcgatctgaaccaggcacacatggaagagacccctaagaggaagggcgccaaggtatttggcagcttggagcggggcctcgataaagttataaccgtgctcactagatcgaagcgcaaaggctccgcccgagatgggcctcgtagactcaagctgcactacaacgttacgacaacccggctcgtgaaccctgaccaactccttaacgaaataatgagcatcctaccgaaaaaacatgtggattttgtacagaaagggtacaccctgaaatgtcaaacacaatctgatttcggaaaagtcaccatgcagtttgagctggaagtgtgtcagttacagaagcccgatgtcgtcggcattcgtagacagcgcctgaaaggtgatgcctgggtttataagcgcctggtggaagatatcctgtcaagttgtaaagtctag

SEQ ID NO: 194289 - DNA, 1491 bp, Artificial Sequence
  Description of Artificial Sequence: Synthetic coding sequence
atgcgggtgctgagcggcaccagcctgatgctgtgcagcctgctgttgttactccaagccctgtgcagtcctgggctggcccctcagagcagagggcacctttgccgtactcggcccacagatcttgttttcgtcgtagattcctctcgctcagtgagaccagtcgaattcgagaaggttaaggtgtttctgtcacaagttatcgaaagtctggatgtgggacccaacgcaacacgtgtggggatggttaactacgccagcacagttaaacaggagttctcacttcgagctcacgtcagcaaagccgctctcttgcaggctgttcggagaatccagcccctttccacagggacgatgaccgggttggcaatccagttcgcaattaccaaggcctttggggatgccgagggcggaagaagcaggtcacccgatatcagcaaggtggtcatagtggtcaccgacggccgccctcaggattccgtgcaggacgtctccgcaagagctcgggccagtggcgtggagctctttgcaattggcgtgggatccgtggataaagccaccctgcggcaaatcgccagcgagcctcaagacgagcatgtggactacgtggaatcttattctgtgatcgagaaacttagtcgcaagtttcaagaggccttctgcgttgtttccgacctctgcgctactggcgaccacgattgcgagcaggtctgcatttcctctcctggatcttatacttgcgcctgtcacgaaggttttaccttaaactccgacggaaagacttgcaacgtgtgctctggaggaggaggctccagtgcaactgacctggtctttctgatcgatggcagtaaaagtgtcaggccagagaacttcgaactcgtgaaaaagtttatcagccagatcgtggacaccctggacgtgtctgataagctggctcaggtggggctggtccaatactccagcagtgtacgccaagagtttcccctgggaagatttcacactaaaaaggacattaaggctgcagtccgtaacatgagttacatggagaaaggcaccatgacaggcgccgccttgaagtatcttatcgataactcatttaccgtgtcttccggagctaggccgggcgctcaaaaggttggcatcgtatttactgatgggcgctcacaagattacataaacgatgcggccaaaaaagcaaaggacttgggattcaagatgttcgcggttggcgtcggaaatgccgtcgaagatgagctccgggaaatcgctagcgagccagtggccgaacactatttttacaccgccgacttcaaaaccattaatcaaatcggcaagaaactccaaaagaaaatttgtgtcgaggaggacccttgcgcctgcgaaagcctagtcaaattccaggccaaggtcgaaggcctgctgcaagcgctgacccgcaaactggaggcagtgagtaaacgtctcgccatcttggagaatacggtggtatag

SEQ ID NO: 194290 - DNA, 2874 bp, Artificial Sequence
  Description of Artificial Sequence: Synthetic coding sequence
atggagaagatgctggccggctgcttcctgctgatcctgggccagatagtgctgttgcctgcagaggcccgcgagaggtcgagaggacggagcatatcccgagggcgacacgctcgaacccatccccagaccgcccttttggaaagctcatgcgaaaataagagagcagatcttgtgttcattatcgacagttccagatcagtgaacacacatgactatgctaaagtcaaggaattcatcgtggacattctgcagtttctcgatatcggtcctgacgttacaagagtcgggctgctgcaatatggcagtacagtaaagaatgaattttcactgaagactttcaaaagaaaaagcgaagtcgagagagcagtcaaacggatgagacacctctcaacggggacaatgaccgggcttgctatccagtatgccttgaacattgcctttagcgaagcagaaggagccagaccccttagagagaatgtaccccgagtgattatgatcgtgactgacggccggccccaggactctgtggctgaagtcgctgcaaaggcccgtgacactggcatacttatattcgcaataggggtggggcaggtcgacttcaatacattgaaatctattggaagcgaacctcacgaagaccatgtctttttggtcgccaacttcagccaaatagagacactgacatctgtctttcagaaaaagctgtgtacagcccacatgtgtagtaccttagagcacaactgcgcccatttctgcataaacataccaggcagctatgtgtgccggtgtaaacagggctatatactaaactcagatcagaccacttgtcggattcaagacttatgtgccatggaggaccataactgtgaacagctttgcgttaacgttccagggtcatttgtgtgtcagtgttactccggatatgcactggcagaggatggcaagcgctgcgttgcagtggactactgcgcgtctgaaaaccatggatgcgagcatgaatgtgtgaatgcagatggctcgtacctgtgtcagtgtcacgaggggtttgcccttaaccctgacaagaaaacttgtaccaagatcgactactgcgcaagcagtaatcacggctgccaacatgagtgtgtgaacaccgacgacagctacagttgccactgtctgaaagggttcacactcaatccagataaaaaaacctgtcgccggataaattactgcgcacttaacaagccgggctgcgaacacgaatgcgtcaacatggaggagtcctattattgtcgctgccataggggctataccctcgaccctaacggaaaaacttgctctagggtggatcactgcgcccagcaggaccatgggtgcgagcaactgtgtctcaacaccgaagattcctttgtgtgtcagtgttccgagggttttctcataaacgaagaccttaagacatgctctagagtggattattgcctcctgtctgaccatggctgtgagtactcgtgcgtgaacatggatcgctccttcgcttgtcagtgtccagagggccatgttttgcgctccgacggaaaaacctgtgcaaaactggattcttgcgctctgggggatcacggttgcgaacacagttgcgtgtccagcgaggatagcttcgtttgccagtgtttcgaagggtatattctgcgtgaagatggcaagacttgtcgccgcaaggacgtttgtcaggcaattgaccacgggtgtgagcacatctgcgtcaactctgacgactcatatacctgcgagtgtctagaaggcttcagactggccgaagatggcaaaaggtgccgaaggaaggacgtctgtaaatcaactcatcatggatgcgaacatatctgtgtcaataacggcaattcatacatatgcaagtgcagtgaggggttcgttctcgcagaagatgggcgaagatgcaagaagtgcaccgaaggtccaattgatctggtgttcgtgatcgatggaagtaagagtctgggggaggaaaatttcgaggtggtgaaacaattcgttaccgggatcatcgactccctgactatttccccaaaggctgctagagttggtctcctgcagtacagcacccaggtccatactgagttcactttacggaacttcaattctgcaaaggatatgaagaaagcagtggctcatatgaagtatatggggaaggggagtatgaccggactggcacttaagcacatgttcgagcgaagcttcacacagggggagggagctcggcccctctccacacgcgtgccgagagctgcaattgttttcactgatggacgcgcccaggacgatgtgtctgaatgggcctcaaaggcaaaagctaatggcattaccatgtatgccgtgggcgtcgggaaagcaatcgaggaggaactgcaggagatagcgtcagaaccgacaaataaacacctgttctacgccgaggacttttctacaatggacgaaatctccgaaaagttaaagaagggcatatgtgaggccctggaggacagcgatggaagacaggattcgcctgccggcgagctacccaagaccgttcagcagcccacagaaagtgaacccgtgactattaacatacaggacctgctcagttgttcaaactttgccgttcaacatcggtacctgtttgaggaagataatttgctgcgctctactcagaaactcagccattccacaaagcctagcggctctcctctggaggagaaacacgaccagtgtaagtgtgagaacctgatcatgttccagaacttagctaatgaggaggtccgtaagctgacgcagcgactgctggaagagatgacacagagaatggaggcgttggagaatcggctgagataccgttag

SEQ ID NO: 194291 - DNA, 2754 bp, Artificial Sequence
  Description of Artificial Sequence: Synthetic coding sequence
atggagaagatgctggccggctgcttcctgctgatcctgggccagattgtactgttgccagccgaagcccgggaacgatcgcggggccgctccatctcgcgagggaggcacgccaggactcaccctcaaacggccctgctggagtcttcttgtgagaacaagagggcagacctcgtctttattattgacagtagcaggagcgtgaatacccacgactacgccaaagttaaagagttcatcgtggacatcctccaattccttgacatcggaccagacgtgaccagggtgggtctacttcagtatggatctaccgtcaaaaacgaatttagcctgaagacattcaaaagaaaatccgaggtagagagggcagtaaaacgcatgaggcacttatcaaccggaacgatgactggcctcgcaatccagtatgcattaaacatagcattcagcgaggcggaaggagcgaggccgctgcgcgagaacgtacccagagttatcatgatcgtgacagacggaaggcctcaagattctgtggctgaagtggccgcaaaagctagggacactggtatactcatcttcgccattggcgtgggccaagttgattttaacacacttaagagcattgggagtgagccccacgaagatcacgtgtttctggtcgcaaacttcagtcaaatcgagaccttgaccagtgtattccagaaaaagctgtgcacagcccacatgtgttcgactttggaacataattgtgcccacttttgcataaatatacccgggagttacgtgtgtcgttgcaaacagggctacattttgaatagtgatcagaccacttgtaggattcaggacctgtgcgccatggaggatcacaactgcgagcaactgtgtgtcaacgtgcctgggtcttttgtttgtcagtgttactctgggtacgccctcgccgaggacgggaagagatgtgtcgctgttgattactgcgcgagtgagaaccatggttgcgagcatgaatgtgttaatgccgatgggagctacctgtgccagtgtcacgaaggatttgccctcaatcctgacaagaaaacctgcaccaggatcaactactgcgcactaaacaagccaggatgcgagcacgaatgcgtgaatatggaagagagttattattgcaggtgccatagggggtacactctcgatccaaatggaaaaacctgcagtcgggtagaccactgcgcgcagcaggatcatgggtgtgagcagctctgcttaaacactgaagacagcttcgtttgccagtgctccgagggcttcctgatcaacgaagatctaaagacctgttccagagtggattattgtctgctatcagaccacgggtgcgagtatagttgtgtcaatatggaccgttcctttgcctgccagtgtcctgagggccatgtgttgaggtctgatggtaagacctgcgctaaactcgattcttgcgccttaggggaccatggctgtgaacactcctgcgtatcctctgaggactccttcgtgtgccaatgttttgagggctatatcctgcgagaggatggcaagacttgccgaaggaaggatgtgtgtcaggcaatagaccacggatgcgagcacatttgcgtgaacagtgacgattcttacacatgtgagtgtctcgaaggattcaggttggccgaggatgggaagcgatgccggaggaaggacgtgtgtaagtcaactcaccacggatgtgagcacatttgtgtcaacaacggaaacagttatatatgtaagtgcagcgagggctttgtattagccgaggacggaagacggtgtaaaaaatgcaccgaagggcctattgacttggtctttgtcatcgatggaagtaagtcactgggggaggaaaatttcgaagtggtgaagcagttcgtaactggcatcatagattcattgacaattagccctaaagcagcccgagtaggactcctccagtattcaacacaagttcacactgagtttacactaaggaatttcaattctgcaaaagacatgaaaaaagccgtggcccatatgaagtacatgggcaaaggcagcatgacaggtttggctctaaagcacatgttcgagcgttccttcacacaaggcgagggggcccgccctttgagtaccagagtgcctcgggcagctatcgtatttacggacgggagggcacaggacgacgtgagtgagtgggcgtccaaagccaaggccaacgggatcactatgtatgcagtaggagtgggtaaagccatcgaggaagaacttcaggaaattgcctcggaacccactaacaaacatctgttctacgctgaagacttttcaacaatggatgagatttccgaaaagctcaagaagggcatttgcgaggctctggaagactcggatggccgtcaagattcacctgcgggcgagctgcccaaaaccgtgcagcaaccaactgagtccgaacccgtgaccattaatattcaggatctgctgtcatgcagcaacttcgctgtccagcaccggtatttattcgaagaggataatctgttgcgctccacccagaagctatctcactcaaccaagccttctggttcccccctggaggagaagcacgatcagtgcaagtgtgaaaaccttatcatgttccagaaccttgccaatgaagaagttcggaagctaactcaacgatatttactggaagagatgacacagcgcatggaagctctggaaaaccgcctcaggtacagatag

SEQ ID NO: 194292 - DNA, 348 bp, Artificial Sequence
  Description of Artificial Sequence: Synthetic coding sequence
atggaggaccacaactgcgagcagctgtgcgtgaacgtgcccggcagcttcgtgtgtcagtgctatagcggctacgcactggctgaggatgggaagaggtgcgttgctgtggactattgcgcaagtgagaatcacggctgtgaacacgaatgtgttaatgcggacggctcctacctgtgtcaatgccatgagggattcgccttgaatcctgataagaagacatgtacgaagatagattactgcgcaagtagcaaccacggctgtcagcatgagtgcgtcaatactgatgacagctactcatgccattgccttaaggggtttacgttgaaccctgataagaaaacttag

SEQ ID NO: 194293 - DNA, 2871 bp, Artificial Sequence
  Description of Artificial Sequence: Synthetic coding sequence
atggagaagatgctggccggctgcttcctgctgatcctgggccagatcgtgctactgcctgccgaggctagggaaagaagcagagggcgctctattagtcgggggagacatgctcggacccacccacaaacggcgctgctcgaaagctcatgcgagaataagcgggctgacttggtgttcattattgatagttctcgctcagtgaatactcatgactacgctaaggtgaaggaattcattgtggacattctgcaattcttagatattggccctgatgtcactagggtggggctcctccagtatggatccactgtgaaaaatgaatttagcctcaaaacctttaaaaggaaatctgaagtcgagagggccgtcaaacgcatgcgccacctctcaacgggaaccatgaccggactagctattcaatatgccctgaacattgccttctctgaggccgagggagcacgacctttacgggaaaatgttccccgcgtaatcatgatcgttaccgatggccgaccacaggatagcgtcgctgaggtcgccgccaaggcgcgagacacaggtatcctgatatttgccataggcgtggggcaggtggatttcaacacgctcaagagtataggaagtgaaccacacgaagaccacgtttttctagtagccaatttcagccaaatcgagacgttaacctcggtcttccagaaaaagctttgcacagctcacatgtgttcaaccctcgaacataattgcgcgcacttttgcatcaatatacccgggagctacgtgtgtcgttgcaaacaaggttatatattgaactctgatcagactacttgccggatccaggatctctgtgcaatggaggaccataactgtgagcaattgtgcgtcaatgtccctgggagtttcgtgtgccagtgttactctggctatgcgctggcagaagacggcaaacggtgcgtggccgtggattactgcgcttccgaaaatcatgggtgcgagcacgagtgcgtcaacgccgatggttcttacctgtgccaatgccatgaaggctttgccctgaaccccgataagaagacatgtactaaaattgattattgtgcttcctccaaccacgggtgccaacacgagtgtgtcaacaccgatgattcttactcttgccattgcctcaagggctttactttaaatcccgacaagaaaacttgtcgccgcattaattactgcgctctgaacaaacctggctgcgaacacgagtgtgtgaatatggaggagtcctactactgccgatgccaccgaggttacactcttgatcctaatgggaaaacatgcagccgggtggatcactgcgcccagcaggatcatggctgtgagcaattatgcctgaacactgaagatagtttcgtgtgtcagtgcagcgaaggcttcctgatcaacgaagacctaaagacctgtagtagagttgattactgtctgctgtcagaccatgggtgtgagtacagctgcgtcaatatggatagatcattcgcatgtcaatgcccagaagggcatgtgctaaggtccgacgggaagacctgcgccaagctcgattcctgcgccctgggcgaccatggttgcgagcacagctgcgtaagcagtgaggacagtttcgtttgtcagtgctttgaaggctacatactcagagaggacggcaaaacgtgtagaaggaaagacgtgtgtcaagcaattgaccacggttgcgagcacatatgcgtgaacagtgatgacagttacacatgcgaatgcctggagggatttcgcctggcagaagatgggaaaaggtgtagacggaaggacgtgtgcaagtctactcaccacggttgtgaacacatctgtgtcaacaatggcaatagttacatctgtaagtgctccgagggcttcgtgcttgctgaagatggtagaaggtgtaagaagtgtactgagggaccaattgaccttgtgttcgtaatcgatggatcgaagtccttaggagaggagaatttcgaagtcgtgaagcaattcgttaccgggataattgactctcttactatctcccccaaggccgcaagagtgggcctgctccaatactccactcaggtgcacaccgaattcacattgcgtaatttcaatagtgctaaggacatgaagaaggctgtggcccacatgaagtacatgggcaaagggagtatgacaggtctggcccttaagcatatgtttgaaagatcttttacgcaaggcgaaggagcacgtcccctttccaccagggttccgcgggccgctatcgtgtttaccgacgggcgggcacaggacgatgtctctgaatgggcttcaaaagcaaaggctaatgggattactatgtacgcggtcggcgtcggtaaagcgattgaagaggagctacaggagatcgcgtcggagcctaccaacaagcacttgttttacgccgaagacttcagcactatggatgagatatctgaaaaactgaaaaagggaatttgcgaagcgctggaggactccgatggcaggcaggatagcccagcaggcgagctcccaaaaactgtccagcagcccacagagtctgagccggtcaccatcaatatacaggacctccttagctgtagcaactttgccgtacaacacagatatctgttcgaagaagacaatctattacggagtacgcagaagttgtctcactcaactaagccttctgggtcacctctggaggagaagcatgaccaatgcaagtgtgagaatttgatcatgtttcaaaacctggccaatgaggaggtcaggaaactcacacagcgcctggaagagatgacacagagaatggaggccctcgaaaaccgtcttcgctacaggtag

SEQ ID NO: 194294 - DNA, 2814 bp, Artificial Sequence
  Description of Artificial Sequence: Synthetic coding sequence
atggagaagatgctggccggctgcttcctgctgatcctgggccagattgtgttactgcctgccgaggcaagggagcgaagtcgagggagatccatttccagaggaagacatgcgagaactcacccacaaacagctttgctcgaaagcagctgtgagaataaaagggcagacctggtgtttatcatcgatagcagccgcagcgtgaacacgcatgattacgcaaaagtcaaagaatttatagtagatatactgcagttcctggatattggacctgatgtaacccgcgtcggtcttttacagtatggctccacagtcaagaacgaattctctctcaaaaccttcaaacggaagtcagaggtagagagggctgttaaacgtatgagacacctgagtacgggcaccatgactggcctagctatccagtacgctctcaacattgcgtttagcgaggccgaaggcgctcgacccctgagagagaatgtgccgcgagtgattatgatcgtgactgatggtagaccccaggacagcgttgccgaggttgcagcaaaggctcgcgataccggcatactcatcttcgctattggcgtgggtcaggtggatttcaataccctgaaaagtatcggctccgaaccacacgaggatcatgtctttctggttgcaaatttttcacagatagagacccttacctcagttttccagaaaaaactgtgtacagcacatatgtgctctaccctggagcacaactgcgcccatttctgcataaacattcccgggtcctatgtgtgcagatgcaagcagggctatatcctgaattcagatcaaaccacatgccggatacaggacctctgtgcaatggaggaccacaattgtgaacagctgtgcgtcaatgtcccagggtctttcgtctgccaatgctatagcggttatgcactggccgaagacggtaagcggtgcgtggcagtggactactgcgcctctgaaaatcatggttgtgagcacgagtgcgtgaacgccgacggaagttacctgtgtcaatgccatgagggctttgcactgaatcctgataagaagacatgcacaaagatagactactgtgccagctccaaccacggctgccagcatgaatgcgtgaacactgacgattcctatagctgccactgcttgaaggggttcacattgaaccctgacaagaaaacctgtcgcagaattaattattgcgcattaaacaaacctgggtgtgaacacgaatgtgtcaacatggaggaatcctactactgccgctgccaccgaggctacactctggacccaaacggaaagacctgttcacgagtggaccactgtgcccagcaggaccacggctgcgaacagctctgcctgaatacagaggacagtttcgtctgccagtgttccgaaggctttcttatcaacgaggacctcaagacttgtagccgcgtcgactactgtttattgagcgatcatggatgcgagtatagctgtgttaatatggacagatcatttgcttgccagtgccccgagggccacgttctcagaagtgacggaaagacatgcgcgaagctggactcgtgcgcgctgggtgaccatggatgtgaacacagttgcgtgagttccgaagacagcttcgtttgtcaatgctttgaagggtacatcctccgcgaagacgggaaaacatgccgccggaaggatgtttgtcaggccatcgaccatggctgcgagcatatttgtgtcaattccgacgacagttacacgtgcgaatgcctcgaggggtttcggttggccgaagacggcaagagatgtaggcggaaagatgtgtgcaagagcacccatcatggttgcgaacacatctgcgttaacaacggcaactcttatatttgtaaatgctcggaggggtttgtcctggcagaggatggccgcagatgcaaaaaatgtaccgaaggccccattgacctcgtttttgtaattgatgggagcaagagcctgggtgaagagaactttgaagtggtaaaacagtttgtgacaggaattatagatagcctgaccatctctcccaaagcggccagagtcggcttgctgcagtattccactcaggtgcacacagagttcacccttcgtaactttaattctgccaaagatatgaagaaagctgtcgcccacatgaagtacatgggcaagggatctatgactggacttgccctgaagcatatgttcgaaaggtcctttactcaaggcgagggtgctaggcctctgtccacccgcgttcccagagctgccatagtattcactgatgggagggctcaggatgacgtgagcgagtgggcttccaaagccaaggcaaatgggataaccatgtatgccgtcggtgtgggcaaggctattgaagaagaactgcaggagatcgcttccgaacccacgaacaagcacttgttctatgctgaggatttcagcactatggacgaaatttctgaaaagctgaagaagggtatctgcgaagccttagaagactccgatgggcgccaggacagtcccgctggggagttacccaagacagttcagcagcctactgtgcagcaccgatacctattcgaagaggacaatctgctgcgctctacgcaaaagctgagccactctaccaaaccttctggcagccctttggaagagaagcatgatcagtgcaaatgcgagaacctaatcatgttccaaaacctggccaacgaagaggttcggaaactcacccagcggctggaggagatgacacagcgtatggaggcattagagaatcggctgcgataccggtag

SEQ ID NO: 194295 - DNA, 2019 bp, Artificial Sequence
  Description of Artificial Sequence: Synthetic coding sequence
atggaggaccacaactgcgagcagctgtgcgtgaacgtgcccggctcctttgtctgccagtgttactccgggtacgcactggctgaagacgggaagcggtgcgtggcagtggattactgtgctagcgagaaccacggctgtgaacacgagtgtgtcaacgccgatgggtcctatctgtgccagtgtcatgagggttttgccctaaatccggacaagaaaacttgcactaagatcgactattgtgcctcatccaaccatggctgtcaacatgaatgcgtcaacacagacgattcatattcttgccactgccttaaaggcttcacgctcaaccctgacaagaagacctgccgccgcatcaactactgcgcactgaacaagcccgggtgtgagcacgagtgtgtgaatatggaggagtcatactattgtcgctgccaccggggctataccctagaccccaacggcaagacatgcagcagggttgatcattgtgcccagcaggatcatggctgcgaacagttgtgcctgaacactgaggactcgtttgtgtgtcagtgttcggaaggctttcttataaacgaggacctcaaaacctgttctagggtcgactattgcttgctcagcgaccacgggtgcgagtattcttgtgtcaatatggaccggtccttcgcttgccagtgtcccgaaggtcacgtcctgaggagtgacggcaagacctgcgccaaactcgatagttgtgctttgggcgatcatggatgcgagcactcctgtgtctcaagtgaggattccttcgtgtgtcagtgctttgaaggatacatcctcagagaagacgggaaaacctgcaggagaaaagacgtatgccaggcaattgaccatggatgcgaacacatatgcgtcaatagcgacgatagctatacatgcgagtgtctggaaggtttccgactggccgaggacgggaagaggtgccgccgcaaagacgtgtgcaagtccactcaccacggatgcgagcacatttgcgtgaataacggcaacagttatatttgtaaatgctccgagggctttgttctggccgaggacggtcgccggtgtaaaaaatgtacggagggccccattgatttggtgttcgtcattgatggctctaagtccttgggggaagagaacttcgaggtggttaagcaattcgtgacaggtataatcgactctctgaccatttcgccgaaagctgcccgagtagggctcctgcaatattctacacaagtacacactgagtttacattacggaattttaattcagcaaaggacatgaaaaaggccgtggcccatatgaaatatatgggtaagggctccatgactgggttggccctgaaacatatgtttgaacgctcatttacccaaggcgagggggcacggcctctgtccacccgggtcccaagggccgccatcgtgttcacagacggaagagctcaggatgatgtgagtgagtgggcctccaaagctaaggctaatggcatcacaatgtacgctgtcggtgtgggaaaggctatcgaggaggagctacaggaaatcgcttcagagccaacgaataaacatctcttttatgcagaggacttctctaccatggacgagatctctgaaaaactgaaaaaaggaatttgcgaggcgctggaggatagcgatggacggcaagattcccccgcaggggagctgcctaagactgtacagcagccgacagagtctgaacctgtgaccataaatatccaggacctactgtcttgcagcaattttgctgttcagcatcgttatctatttgaagaagacaacttgctgagatcaacacagaaactgtcccacagcactaaaccttctggctctcctcttgaggagaagcacgaccaatgcaagtgtgagaacctaattatgtttcagaatctggcaaacgaggaggtgcgaaagttaacgcagaggttagaagaaatgacccagaggatggaggctctggagaatcggctgcgatataggtag

SEQ ID NO: 194296 - DNA, 2748 bp, Artificial Sequence
  Description of Artificial Sequence: Synthetic coding sequence
atggagaagatgctggccggctgcttcctgctgatcctgggccagatagttctcctgcctgcagaggcgagagagcggtcacggggaagaagcatctcccgcgggagacacgctagaactcaccctcagaccgccctgctcgagtcttcatgcgagaataagcgagccgatctggttttcatcattgactctagccgaagtgttaacacccacgactacgcaaaagtcaaggagttcatcgtggacatattacagttcttagatattgggcctgatgtgaccagggtcggcctgctacaatacggaagtaccgtcaagaatgagtttagcctgaagaccttcaaaagaaagtccgaagtggaaagggccgtaaagagaatgaggcatctgtccactggaacaatgactgggctggcaatccagtatgccctgaacattgctttctctgaagctgagggcgccaggccactgcgtgagaatgttccgagagtgattatgattgtgacggacgggagaccccaggactccgtggccgaagtcgcagccaaggccagagataccggtatcctgatctttgccattggcgtggggcaggtggattttaacaccctcaaaagcatcggatccgaaccgcacgaagaccatgtgtttctggttgcaaacttctcacagattgagaccctgacaagcgtgttccagaagaaactgtgtactgcgcatatgtgtagcaccttagaacacaactgtgctcacttttgcatcaacattcctggatcttacgtatgccgctgtaaacagggatatattctcaattcggaccagaccacatgtcggatacaagatctatgcgctatggaagatcacaattgtgaacagctgtgcgtgaacgttcctggtagtttcgtgtgccagtgctatagcgggtatgccttggccgaggatggcaaacgatgcgtggccgtggattattgcgcttctgaaaatcatggctgcgaacacgagtgcgttaacgctgatgggagctacttgtgtcagtgccatgagggcttcgctctcaacccagataaaaaaacatgtactcgcattaattactgcgcactcaataaacccggatgtgaacacgagtgtgtgaatatggaggaatcatattactgccggtgccacagaggttataccctcgatcccaacggcaagacatgctctcgggtcgatcactgcgctcaacaggaccacggatgtgagcagctttgcttgaatacggaggattctttcgtatgccaatgttctgagggcttcttgatcaacgaagacctcaagacttgttctagagttgactactgtctcttgagcgaccacggatgcgaatacagttgcgtaaatatggaccggagcttcgcctgtcagtgtccagagggccacgtgctgcggagtgatgggaaaacttgtgcaaagctggattcctgcgcattaggtgaccacggctgcgaacattcttgcgtctcttcagaagactcgtttgtttgtcagtgtttcgaaggctatatcttgagggaagacgggaagacatgcaggaggaaagacgtctgccaggcaattgaccacggctgtgagcacatttgcgtcaattcagatgattcttatacctgcgaatgcctcgaagggttccgcctggctgaagacggaaagcggtgtcggcgcaaagatgtttgcaagtctacgcatcatggctgtgaacacatttgcgtcaacaatggtaactcgtacatctgcaaatgtagtgaggggtttgttctggcagaggatggaagacgctgcaagaagtgtaccgaagggccaatagacttggtatttgtcattgacgggtcaaagagccttggggaagaaaacttcgaagtagtcaagcagtttgtcacgggcatcattgattcactaacaatctcgccgaaggctgctcgggtggggctgctgcagtacagtacccaagtgcacacggaattcaccctgaggaatttcaattccgccaaagacatgaaaaaggctgtcgcccatatgaagtacatgggcaaaggctcgatgacgggactggcactaaaacatatgtttgagaggtcattcactcaaggggaaggtgcccgccccctgtcaaccagggtgccccgcgccgctatagtttttaccgatgggcgggcccaagatgacgtgagcgagtgggcttcgaaagcaaaagcaaatggcatcacaatgtatgcagtgggggtgggcaaggcaatcgaagaggaacttcaggagatcgcctccgagcctacaaataaacatctcttctacgccgaggatttcagcacaatggacgaaatatcagaaaaactgaagaagggcatctgcgaggccctggaagattctgacggtcgccaggactctcctgccggtgaacttccaaagacagtgcagcagccgactgagagcgagcccgtgacgataaacatccaggacctgctcagctgctcaaatttcgctgtgcagcaccgttatctcttcgaggaggacaacctccttaggtctacacagaaattgtctcattctaccaaacctagcggctctccacttgaggagaagcacgatcagtgtaaatgcgaaaatcttattatgttccaaaacctcgcaaacgaagaagtgaggaaattaactcaaaggctggaagagatgacccagcgcatggaagccctcgaaaaccgcctgcgatatcggtag

SEQ ID NO: 194297 - DNA, 1461 bp, Artificial Sequence
  Description of Artificial Sequence: Synthetic coding sequence
atgccccggcccgcccccgcccggcggctgcccggcctgctgctgctcctgtggcctctgctgcttctgccaagcgccgcaccagacccagtagctaggccaggcttcagacgcctggaaacacggggaccgggcggcagccctggccgtagaccatctcctgcagctcccgacggggcccctgcgtcagggacatcagagccagggagggctcggggtgccggggtgtgtaagagtcgaccattagacctcgtgttcataattgattcatccagaagcgtgcggccccttgagtttaccaaggttaagacctttgtttccaggatcatcgacaccctggatatcggccccgcggataccagagtggccgtggtaaactatgcgagcacggtgaaaattgagtttcagttgcaagcctatacagataaacagtcactcaagcaggccgttggccgaatcaccccattatcaaccgggactatgtctggcctcgctatccagactgctatggacgaggcgttcactgtagaggccggcgcaagggaacccagttccaatattccgaaggtggccataatcgtgaccgacggccggccacaagaccaggttaacgaggtggctgctagggcgcaagcaagtggtatcgaactttatgcagtgggcgtcgatcgggctgacatggctagtctgaagatgatggcaagcgaaccactcgaggaacacgttttctacgtggagacatatggcgtgattgaaaagttatccagccggttccaggaaacattttgcgccttggatccctgcgtcctggggactcaccagtgccagcatgtgtgtatatcagacggtgaaggcaaacaccactgcgaatgtagccaaggctacacgcttaatgccgacaagaaaacatgcagtgctctagacaggtgcgccctgaatacccatggatgtgaacacatttgtgtaaacgacaggagcggatcctatcactgcgaatgctatgagggttacaccctcaacgaagacaggaagacctgcagtgcgcaagacaagtgtgcactggggactcacggttgtcagcacatttgcgtgaatgaccgcaccgggtctcatcactgtgaatgctatgaagggtataccctaaacgccgacaagaaaacatgcagcgttcgggacaaatgcgcgcttgggagccatggatgccagcatatttgtgtctctgacggtgccgcgtcataccactgcgactgctaccccggctacactctgaatgaggacaaaaagacatgctcggccacagaagaggctagacgcttagtctcaacagaagatgcctgtggatgcgaggcaacactggcttttcaggacaaagtaagtagttacctgcagcggctgaacacaaaacttgacgatattctggaaaagctcaaaatcaacgaatacggccaaattcaccggtag

SEQ ID NO: 194298 - DNA, 1335 bp, Artificial Sequence
  Description of Artificial Sequence: Synthetic coding sequence
atgccccggcccgcccccgcccggcggctgcccggcctgctgctgctcctgtggccattattactcctcccatctgccgcccctgaccccgtggcacgaccgggatttagacgactcgaaactagaggcccgggggggtcaccaggtaggagacctagcccagccgctcctgacggcgcaccagcctccggaacaagcgaaccaggccgcgcccgcggcgccggggtatgtaagtccaggccacttgatctcgtgtttattattgattcctctaggagcgtgaggccattggagttcaccaaagtgaagacattcgttagcagaattattgatactttggacatcggcccagcggatacacgggtggcagttgtgaattacgcaagcactgtaaaaattgaattccagctccaggcttatactgacaagcaatccctcaagcaggccgtcggtagaatcacccctctgtccacaggtacaatgagtggtttggccatccaaaccgcgatggatgaggcatttaccgtcgaggccggagcccgtgagccctcctctaatatacccaaagtggctatcatcgtgaccgacgggaggccgcaggatcaggtcaatgaggtggcggctcgagcccaagcttctggaattgagctttacgctgtaggggttgatagggccgatatggcctccctcaagatgatggccagcgagccattagaggagcatgtgttttacgtcgaaacatacggcgtcatcgaaaagttatctagcaggttccaagagacgttctgcgctctcgatcgatgcgcgctcaacacccacggctgcgagcatatctgtgtgaatgatagatccggtagctatcactgtgaatgctacgagggatacaccttaaacgaggatagaaagacttgcagcgcgcaggacaaatgcgccctggggacacacgggtgccaacacatctgtgtcaatgacagaactggttcacaccattgcgaatgttatgagggatacactctgaacgccgataaaaaaacctgctctgtccgggacaaatgcgcactaggcagccacgggtgccagcacatctgtgtttctgatggagcagcctcctaccactgtgactgctacccgggatacactctcaacgaagataaaaagacctgttcagcgactgaggaggctagacgtctcgtgtctacagaggatgcctgcggctgcgaggcgactctagcctttcaggacaaggtatctagctacctccagcgcttaaacactaaactggacgacattttggaaaagcttaagattaacgaatatggtcagatccatagatag

SEQ ID NO: 194299 - DNA, 1869 bp, Artificial Sequence
  Description of Artificial Sequence: Synthetic coding sequence
atgcggggcctgctgtgctggcccgtgctgctgctgctgctgcagccctgggagacacaattgcagttaaccggccccagatgccacaccggaccgctggacctagtatttgttatcgacagttctaggtcagttagaccatttgagttcgaaacaatgagacagtttctcatggggttgctgagagggttaaacgtggggccaaatgcgacacgtgttggtgtcattcagtacagttctcaagtacaaagtgtatttccacttagggctttctcgaggcgcgaggatatggagagggcaatcagggacctagttcccctggctcaggggacaatgactgggctggctatccaatacgccatgaacgtggctttcagcgtggcggaaggcgctagacccccagaggaacgtgtcccccgggtcgccgtcattgtgaccgacggccggcctcaagaccgagtggcagaggtagccgctcaagctagagcaagaggaatcgaaatctatgcggttggagtccagagagccgacgtcggctcgctgagagccatggcctccccgcctctcgacgaacatgtgtttcttgtagagtccttcgacttgattcaggagttcggactgcagtttcagagcaggctgtgcggcaaggaccagtgtgccgaggggggccatggctgccagcatcagtgtgtgaacgcttgggctatgttccactgcacttgcaatcctggttacaagttggctgctgataacaagtcatgtctggctatagatttatgtgctgaaggaacccacggctgcgagcatcactgtgtgaattcacccggcagctacttctgtcactgtcaggtggggtttgttctgcagcaagaccaacgatcttgtagggctattgactactgtagtttcggcaaccattcctgccagcacgaatgcgtttctacccctggcggaccaagatgccactgtcgcgagggtcatgacctgcaacccgacggtcgcagttgtcaagtgcgggacctgtgcaatggggtcgatcatggatgtgaattccagtgcgtgtctgagggcctgagttacaggtgcttgtgccccgaaggcaggcagctgcaagctgatggcaagagttgtaatagatgtagggagggacacgtcgatctagtgctgctggtcgacgggtctaagtccgtgagaccccagaacttcgagttggtgaagaggttcgtcaaccagatcgtggatttcctggacgtcagcccagaaggcacgcgcgttgggctggtgcagtttagtagtcgggtgaggactgagttccccctgggccggtacggaacagcagctgaagtcaagcaggctgttttggccgtggagtacatggagcgcgggactatgacaggactggcattgcgacatatggttgaacatagtttctcagaagcccagggagctcgcccccgggccttgaatgtacctagagtgggattggtcttcacagacgggcgaagtcaggatgacatcagcgtgtgggccgcaagggcgaaagaggaaggaattgtcatgtacgcggtcggcgtcggcaaggctgtggaagctgagcttcgggaaattgccagcgagcctgcagagttgcacgtgagttatgcccccgacttcgggacgatgacccatctcctcgaaaatctaagaggctcaatctgtccagaagagggtatctctgccggaactgagctaaggtccccctgcgaatgcgagtcattggtcgagttccagggcaggacgctcggtgccctggagtccctgaccttgaacctggctcagcttacagctcgcctggaagaccttgagaatcagcttgcgaaccagaagtag

SEQ ID NO: 194300 - DNA, 1746 bp, Artificial Sequence
  Description of Artificial Sequence: Synthetic coding sequence
atgcggggcctgctgtgctggcccgtgctgctgctgctgctgcagccatgggaaacacagctccagttaaccggtcctaggtgccataccggccctctggatcttgtctttgtgatcgactccagccgcagcgtcaggcctttcgagtttgagaccatgagacagtttctcatgggacttctcaggggccttaatgtgggcccaaacgcaacacgcgtaggggtgattcaatatagcagtcaggtgcaatctgtgtttccactacgggccttcagccgcagagaggacatggaacgggctatccgagacctggtcccccttgcccaggggaccatgaccggcctggctatccagtacgctatgaacgtcgccttcagtgttgccgaaggggctcgccccccagaagagcgtgtccctcgcgtggctgtgattgtgactgacggcagaccccaggatcgggttgctgaggttgccgcccaggctagagcccgaggaatagaaatttacgcagtgggcgtccaacgggccgacgtcgggtccctgcgcgcgatggccagccctccactggacgaacacgtcttcctggtggagtcgtttgatctgatacaggagtttggcctgcagttccagtcccgactgtgcgccatcgacctctgcgcagagggcacccacgggtgcgaacaccactgtgtcaattcacctggctcatatttttgccactgccaggtggggtttgtgttgcagcaggaccaaaggagctgccgggccatcgactattgttcttttggcaaccattcatgccagcacgagtgtgtcagcacacccggaggacctcggtgtcattgtcgcgaaggacatgatctccaacccgacggcaggagctgccaggtaagagacctgtgtaacggagtagaccacggttgcgaattccagtgtgtttcagaagggctgagctatcgatgcttgtgccctgaaggcaggcagctgcaggccgacggcaaatcttgcaaccggtgtcgggaaggccacgttgatttggtgctgctggtagatggatctaaatcagttaggccccaaaactttgaactcgtcaaaagatttgtgaaccagattgtggactttttggacgtgtctccagaggggacacgcgtcggattggtacagttctcgagtcgggtgagaacagagtttccccttgggagatacggaacagctgccgaagttaaacaggccgtcctggctgttgagtacatggagcggggcacaatgacaggactggctctgcgccatatggtggaacattcattcagcgaagcccagggagccaggccacgcgctctaaacgttccgagagtcgggttggttttcacagacggccgaagtcaggatgacatcagcgtgtgggccgcccgcgctaaagaggagggcatcgtgatgtacgcagtcggagttggcaaggcggtggaggccgaattgcgcgaaattgcgtctgagccagccgaacttcacgtgagttatgctccggactttggaacaatgacgcatctcctcgagaacctgcgaggttccatctgtcccgaggaaggcatctcagctgggacagaactgagaagcccttgtgagtgtgaatccctggttgagttccagggacggacactgggggcccttgaatcgctcaccctgaacctggcccaactgactgcaagactggaagacctggaaaatcagctggctaaccaaaagtag

SEQ ID NO: 194301 - DNA, 1500 bp, Artificial Sequence
  Description of Artificial Sequence: Synthetic coding sequence
atgcggggcctgctgtgctggcccgtgctgctgctgctgctgcagccgtgggaaacccagctgcaactgaccggcccccggtgtcacacaggacccctggatctggtatttgtaatagacagctcacgctccgtgaggccatttgagtttgagaccatgaggcagttcttgatggggctcctgcgtggcctcaatgtggggcctaatgctacacgggtgggtgtcattcagtactcgtcacaagtccagtccgtttttccgttgcgggcctttagtaggagagaggacatggagcgggccattagggacctcgtccccctggcacagggaaccatgactggactggccatacagtatgccatgaacgtggccttttctgtcgcagagggagctcgaccacccgaagaaagagtgcctagagtcgctgtgattgtaaccgacggacggcctcaggaccgcgttgcagaagtggcggcacaggccagggctagggggattgaaatctatgctgttggagttcagagggccgatgtgggcagtctgcgagcaatggcttcgcccccgctcgacgaacacgtgtttctagttgagtcgtttgaccttattcaggaatttgggctacagtttcagagcagactgtgtgtgagggacctgtgcaatggggtggaccatggatgtgaattccagtgtgtgtcagagggcctgtcctatcgttgcctgtgccccgagggaaggcaattgcaggctgatggtaagtcttgcaatcgatgccgagagggacatgttgacctagttcttctcgtggatggctctaagtccgtgaggccccagaactttgagctagtgaaacgctttgtgaatcagatagtcgactttctggatgtgagccctgaggggacgcgagtgggactggtccaatttagttctcgggtacgaacagagtttccactcggacgctatggcactgctgccgaggtaaaacaagccgtgctggccgtggaatacatggagcgggggactatgaccggactggctttgcgccatatggtggagcactccttctcagaagcccagggtgcaagaccccgcgcactgaatgtccctagagtgggcctggtctttactgacggacgctcacaggacgatatttcagtctgggcggccagggctaaggaggaggggatcgtgatgtacgccgtgggagttggcaaggctgtggaagcagaactgagagagatcgcctccgaaccagccgaactgcatgttagttacgcgcccgacttcggcactatgacacatttgctcgagaacctgaggggatccatctgtccggaggaaggaatctcagcaggtaccgagctgcgaagcccgtgcgaatgcgaatccctggttgagtttcaggggaggactctcggtgctctagaaagtctgactctgaatcttgcccaactgaccgcacgcctggaagatttggaaaaccagctggctaaccagaagtag

SEQ ID NO: 194302 - DNA, 1623 bp, Artificial Sequence
  Description of Artificial Sequence: Synthetic coding sequence
atgcggggcctgctgtgctggcccgtgctgctgctgctgctgcagccctgggaaacccagctgcaattgacaggtccccgttgccataccggacctctggatctagtgtttgtcattgattcctcacgatccgtgcgtccgtttgagttcgaaactatgcggcagttcctaatgggcttactacgagggctaaacgtagggcccaatgcaactcgggtgggagtgattcaatactccagtcaggtgcagagcgtattccccctgagggccttctctaggcgcgaggacatggaacgcgcgattcgagacctagttccgttagcacagggtacgatgaccggactcgccatacaatacgctatgaatgttgccttttctgtggcagaaggggcgcggccacccgaggagagagtgcctcgagtggctgtgatagttacggacggccggccccaggaccgtgtcgctgaggtggcagcacaagcccgggcccggggcattgagatttacgctgttggggtccagcgtgcggacgtcggatcattaagggctatggccagtcccccactggatgagcacgtgttcctagtggaaagctttgacctgatccaggaattcggactccagttccagagtagattgtgcgcaatcgattattgttctttcggcaaccactcctgtcagcacgaatgtgtgagcactccaggagggcctcgttgtcactgtcgtgaagggcacgacctgcagccggatggccggtcgtgccaggtgagggacctttgcaatggcgtggaccacggttgcgaatttcagtgcgtctcagaaggcctctcttaccggtgtctctgcccagaaggcagacagttgcaggccgatggaaagtcttgcaaccggtgtcgcgaaggacacgtcgacctagtcctgctggtcgatgggagtaagagtgttcggccccagaatttcgagctggtcaaacgttttgtcaatcagatcgtggactttctggacgtgtccccggaaggaacgagggtgggtctggtccagtttagttcccgggtgagaactgaattccctctgggaagatacggcaccgcagccgaagttaagcaggcggtcttagccgtggaatacatggaacgaggcacaatgacaggcctggctctgcggcacatggttgaacattctttctcagaggcacagggtgctaggccacgggcattgaatgttcctagagttgggttggtctttactgatggcaggtctcaggacgacattagtgtttgggccgctcgagctaaggaagaaggtatcgtgatgtacgctgttggcgtggggaaggccgtagaggcggagctccgagaaattgcctcggagcctgcggagcttcatgtatcatacgcgcctgactttggcaccatgacccacctgttggagaacctgaggggcagtatttgcccagaggaagggatctccgccgggactgaactccgctccccttgtgagtgtgagagtcttgtggagtttcagggtcggactctgggcgctcttgaaagcctcacactgaatctggcccagctcacagctcgcttagaggatctcgaaaatcagcttgccaaccagaagtag

SEQ ID NO: 194303 - DNA, 1299 bp, Artificial Sequence
  Description of Artificial Sequence: Synthetic coding sequence
atgcggggcctgctgtgctggcccgtgctgctgctgctgctgcagccatgggaaacccagctccagcttaccgggaaggaccagtgcgctgaggggggccacggctgccaacaccagtgtgttaatgcctgggccatgttccactgtacttgtaacccaggctacaagctggctgccgataataagtcttgtctcgcaattgacttgtgcgccgagggcacacatggctgcgagcatcactgcgtgaactcgccagggagctacttttgccactgccaagtcggcttcgtgctacagcaggatcagcgtagctgtcgggctatcgattattgttcatttggaaaccattcgtgccagcacgaatgtgtaagcaccccgggagggccacgttgccattgtcgcgaaggccacgacctacaacctgatggaagatcatgtcaggttcgtgatttgtgcaacggcgtcgatcacggatgcgaattccagtgcgtatctgaagggttatcttacaggtgcctgtgtccagaaggcagacagcttcaggctgatgggaagagctgcaatcgttgcagggagggccacgtcgatcttgtgcttctagtcgacggcagcaaatccgtccgcccacagaactttgagctggtcaaacgcttcgtgaaccagatcgtggatttcctggatgtgagccccgaggggacaagggtggggctggttcaattctcatcaagggttcggaccgagtttccgctgggccgctacgggacagctgctgaggtcaaacaagccgtcctggccgtggagtatatggaacgaggaacaatgacagggctcgccctgcgccacatggtagagcacagctttagtgaagctcaaggcgcgaggcctcgggcgcttaatgtgccacgagtcggcttggtttttacagacggccgcagccaggacgatatttctgtgtgggccgcgagagcaaaggaggagggcatcgtcatgtatgccgtgggagtgggaaaagccgtcgaagcggagttacgagagatcgcctctgaacccgccgagttgcacgtgagttacgcaccggacttcggtacaatgacccatctgcttgaaaatctccgaggcagcatttgtcccgaagaaggaatttccgcaggaactgaactgaggagtccatgcgaatgtgagagtctcgtggagttccaagggaggactctcggcgccctcgaaagtctcacgctgaatctggctcagttgacggccagacttgaagacctcgagaaccagctagcaaaccagaagtag

SEQ ID NO: 194304 - DNA, 1299 bp, Artificial Sequence
  Description of Artificial Sequence: Synthetic coding sequence
atgcggggcctgctgtgctggcccgtgctgctgctgctgctgcagccttgggagactcaactccagctgaccggaaaagatcagtgtgccgaaggcggacacggctgtcaacatcagtgcgttaacgcttgggctatgtttcactgcacgtgcaacccaggctacaagttggccgcagacaataaatcatgtttggctatagatctctgcgcagaaggcacccacgggtgcgagcatcactgtgttaacagccctggaagctacttttgccattgtcaggttgggtttgtgctgcagcaagatcagcgttcatgccgtgcaattgactattgtagtttcgggaaccattcatgccagcacgagtgtgtctctactcccggcggtccacgatgtcactgcagagagggacacgaccttcagccagacggccgctcatgccaagtgagggatttgtgcaatggtgttgaccatggatgtgaattccagtgcgtctccgaaggtctgtcataccgatgcttatgtccagaaggaagacagctccaagcagacggtaagtcatgcaatcggtgtagggagggacacgtagatttagtgctgctggtggacgggtccaaatcagtgaggccccagaatttcgagttagtgaaaagattcgtaaatcaaattgtggacttcctcgacgtgtcccccgagggcacgcgtgttggcctggtgcagttttcgagcagagtgcggacagaattcccactcggacggtacgggactgccgccgaagtgaaacaggctgtgttggcagttgaatacatggagagagggaccatgacgggtttagccctgcggcatatggtcgaacatagcttctcagaggcccagggtgcaaggccgcgtgcactaaatgtgcctagggtgggtctagtatttaccgatgggcgttcccaggacgacatatccgtctgggccgcaagagctaaggaggaaggaattgtgatgtacgcagtgggagtgggtaaagctgtggaagcagagttgagggagatcgcaagtgaaccagctgagctgcatgtgtcctatgctcccgattttggtactatgactcacctgctggagaacttgagagggagcatctgccccgaggagggaatttcggcggggactgaactccgatccccatgtgaatgtgaaagcctggtcgaatttcagggtcggacgctcggggcgctggagtcccttacactgaacttggcacagctgaccgcccgactggaagatctggagaaccagctggccaatcagaaatag

SEQ ID NO: 194305 - DNA, 1869 bp, Artificial Sequence
  Description of Artificial Sequence: Synthetic coding sequence
atgcggggcctgctgtgctggcccgtgctgctgctgctgctgcagccctgggagacacagctgcagctgaccggcccgaggtgccatactgggccactcgatctggtcttcgtgattgattcttcccgcagtgttcgaccttttgaatttgagacgatgagacagttcttaatgggactcttgcggggattaaatgtaggcccaaatgccacacgcgtgggagtaatccaatattcctcccaggttcaaagtgtcttccccctgcgcgcgttcagtagacgcgaagatatggaacgcgccataagggacctggttccgttagcccagggtacaatgaccgggcttgccattcaatacgctatgaatgtcgccttttctgtggcggaaggggcccggccaccggaggagcgcgtgccccgcgtggcagtgattgtgaccgacgggagaccccaggaccgcgtcgcggaggtcgcagctcaggctcgggctcggggcattgagatctacgctgtcggtgtgcagagagccgatgtcggctccctcagagccatggctagtcctcctctggacgaacacgtgttcttagtcgagagctttgaccttatccaggaatttggcctgcagttccagtcccgcctttgcggaaaggatcagtgcgccgaggggggacacgggtgccagcatcagtgtgtgaatgcttgggccatgttccactgcacttgtaacccagggtataagctcgctgccgataataagagctgtctcgccatcgacctgtgtgcagagggcacccatggttgtgagcaccactgcgtcaacagtcccggtagctatttctgccactgccaggtgggcttcgtgttgcagcaagatcagaggtcctgcagagcgatcgactactgttccttcggtaaccacagttgtcagcatgagtgcgtttctacacctggcggccccagatgtcattgccgggagggccacgatctgcagcccgacggcagatcctgccaggtcagggacctgtgtaacggcgtggaccatggttgtgagtttcagtgcgtgagcgagggactgagctatagatgtctctgccccgagggccgccaactgcaggccgacgggaaatcatgtaaccgatgccgcgaaggtcatgtcgacctggtgttactagtagacggttccaagtctgtacggccacagaactttgagctagtaaaaaggtttgtgaatcagatcgtggacttccttgatgtgtcaccagaaggaacgagagtcggattggtccagttcagttccagggtcaggaccgagttccccttaggtcggtatgggactgctgcagaggtcaaacaagcagtactggctgtggaatacatggagcggggcacaatgacaggcttagcattgaggcatatggtggagcactctttctccgaagcccagggagccaggcccagagcactgaacgtgccgagagttggtcttgtctttactgacggccgcagtcaggatgatatttcggtttgggctgcccgtgctaaggaggagggaatcgtaatgtacgccgtgggggtggggaaggcagtggaagcagaacttcgcgaaatcgcttcggaacctgctgagctacatgtgtcctatgcgcccgactttggaacaatgacccacttgcttgagaatctcagaggcagcatatgccccgaagaaggcatttcagccggaaccgagctaaggagcccatgcgagtgtgaaagcctggttgagtttcagggcagaaccctgggcgctctagaatccttgacactgaacctcgcccaactcaccgccagactagaagacctagagaaccagctggccaaccagaagtag

SEQ ID NO: 194306 - DNA, 1746 bp, Artificial Sequence
  Description of Artificial Sequence: Synthetic coding sequence
atgcggggcctgctgtgctggcccgtgctgctgctgctgctgcagccttgggaaactcagctgcagctgacaggaccacgatgtcataccggcccacttgaccttgtgtttgtgattgactcatctagaagcgtgagacccttcgagtttgaaaccatgaggcagttcctcatgggcctcctgcgaggattgaacgtcggccccaacgcgaccagagtcggcgtgatccaatattcttcacaggtccagtcggtcttccccctgcgagccttctcccgcagagaggatatggaaagagcgatcagagatctggtccctctggcacagggcacaatgactgggttggcgatccagtacgccatgaacgtagcttttagcgtggcagaaggcgctaggccaccggaagagagagtgcccagagtggccgtgatagtcacagatggccgtccccaggaccgagtggcagaagtcgccgctcaggctagagcccgaggcattgagatctatgccgtgggtgttcagcgggctgacgtaggctccctgcgggctatggcttcaccgcccctggatgagcacgtcttccttgtggaaagttttgacctcatccaggagttcggactgcagttccagagtcggctgtgcgccattgatctgtgtgcagaggggacacatgggtgcgaacaccactgtgtaaattctccaggctcttatttctgccactgtcaggttggattcgtcctccaacaggaccagcgcagctgccgtgccatcgattattgttcctttgggaatcatagttgtcagcacgagtgcgttagcactccgggaggccctcgatgccactgtagggaaggtcacgacctgcagccagacggcagatcctgccaggtcagggatctgtgtaacggcgtggaccacggatgcgaattccaatgcgtgagcgagggcttgtcatatagatgcttgtgcccagaggggcgacagctacaggccgatgggaaatcttgtaacaggtgcagagagggccatgtcgacctggtactgcttgttgatggatcgaagtccgtgcgacctcagaactttgagttggttaaacggttcgtgaatcaaatcgtggactttctggacgtgtcccccgagggcactcgggtgggcctcgtgcagttctcttccagggttagaacagagttcccgcttggccgttatggaactgcggctgaggttaaacaagcggtgctggctgtggagtacatggagcgcggcacaatgacaggcctggccctgcgacatatggtagagcacagctttagtgaagcccagggagcccgccctcgcgccctcaacgtgcctcgtgttggcttggtgttcacggacggccgctcacaagacgacatcagcgtgtgggctgctagagcaaaagaggagggcatcgtgatgtatgctgtgggggtcggcaaagcggtggaggccgaactaagagaaattgcatccgagccagccgagcttcacgtcagctacgcacccgattttggtaccatgactcacctgctggaaaatcttcgcggcagcatctgtcccgaagaaggtattagcgccggtaccgaactccgatcaccatgcgagtgcgagagcttggtcgaatttcaaggcaggacattgggggccctggaatcacttactcttaacttggctcaactaaccgcccgcctcgaggacctcgaaaaccagcttgccaaccaaaagtag

SEQ ID NO: 194307 - DNA, 852 bp, Artificial Sequence
  Description of Artificial Sequence: Synthetic coding sequence
atgagcaagagcttccagcagagcagcctgagccgggacagccaggggcatgggcgggacctgagtgctgccggtattgggctcctcgccgcagccacacagtcactctcaatgttgttagagtctgaagatgaactcttagtagacgaggaggaggcggctgctctgctggagtccggatcctctgtcggtgatgagactgacctggcgaacctcggggacgttgccagcgatggcaaaaaggagccgtccgacaaagcagtaaaaaaagacggatcagcctctgccgcggccaaaaaaaaactgaagaaacgaaggtttccgggtagcatggagggcttcgtgaccctggacgaggtgggagacgaggaggacagcgaattgcaaaaactgaggaagtccgggatggcgttcaagtccggggataaaaacgacgacgggctggtggaaattaaggttgataaaatagaggagctggatcaagagaatgaggccgctctggagaacggcatcaagaatgaggagaacacggaaccaggcgctgaatcctccgagaatgctgatgacccaaacaaagacacttcagaaaatgcagatgggcagtctgatgaaaacaaagacgattacactattccagatgagtatagaataggtccttaccagccaaacgtgcccgtcggcatcgactatgtgataccaaagaccggattttactgcaaactgtgttctctgttctataccaatgaagaagttgccaaaaacactcactgctcatccctgcctcactaccagaaactgaagaagttccttaataagctcgcagaggaacgtcgccagaagaaggagacttag

SEQ ID NO: 194308 - DNA, 2544 bp, Artificial Sequence
  Description of Artificial Sequence: Synthetic coding sequence
atgagcaagagcttccagcagagcagcctgagccgggacagccagggtcatggcagagacctgtccgccgcagggatcggactactcgccgctgcaacccagtcgctgagcatgcccgcttccctgggaaggatgaaccagggaactgcaagactcgcaagcctgatgaaccttggcatgtcgtcttccctgaatcagcagggtgctcattctgctctcagcagcgccagcacctcctcccacaacttgcaaagcatctttaatatcgggagcagggggcccttaccgctttcgtcccagcatagaggcgacgcagaccaggcttccaacatcctggcgtcttttggcctgtcagcaagagacctggatgaattatctcggtatcctgaagataaaataaccccggagaatctgccacaaatattgttgcagctgaaacgtcgcagaactgaggaaggcccgaccctgagctatgggcgcgacggcagatctgctactcgcgagcccccctaccgcgtgcctagggacgactgggaggaaaagaggcacttcagacgggactcttttgatgatcgcggtccgtccctcaatcctgttctggattacgaccatggctccagatcccaggaaagcggatattacgataggatggactacgaagacgaccggctgcgggatggcgagaggtgccgggacgattctttttttggcgagacatcccacaattaccacaagtttgattccgagtacgaaagaatggggcgcggcccgggccctctccaggagcgttcactgttcgaaaagaaacggggagctcctcctagtagcaacatcgaagactttcatgggctcctgcccaaaggttatcctcacctgtgttcaatctgtgatctgccagttcactccaataaggagtggagccagcacatcaacggagcttcacatagtcggcgctgtcagctgctgttggagatctaccctgaatggaacccagacaatgataccgggcacacaatgggagaccctttcatgctgcagcagtctaccaatccagctccaggtattctgggaccccctccacccagcttccacctcgggggccctgcagttggtccgcgcgggaatttgggggccggcaatggcaatctgcagggccctaggcatatgcagaaggggcgggtggagacaagcagggtggtgcacattatggattttcagcggggtaagaacctccggtaccagctgctccagttagtagaacccttcggtgtaatctcgaaccatttgatcctcaacaagatcaatgaggcttttatcgaaatggccacaacagaagatgcacaggccgcagtggattattatactaccacacccgcgctcgtgttcggcaaacctgtgcgggtccatctttcccagaaatataaacggatcaagaagcccgagggcaagccagatcagaaattcgatcaaaagcaagagctcggcagagtgatccacctgtcaaacttgccacacagcggctattctgacagcgctgtgttaaagttggccgagccatatgggaagattaaaaactatattttgatgaggatgaaaagccaggcctttatagagatggaaacccgggaggatgctatggctatggtcgatcactgcctgaaaaaagccctgtggtttcagggaagatgcgtgaaggtagatctgagcgagaaatacaagaaacttgtcttgaggatccctaatcggggcattgatctcttaaagaaagacaagtcccgcaaaaggtcgtacagtccagatggcaaggaaagccctagcgacaaaaaatcgaagacggacggctcacagaaaacagaatcttccacagagggcaaggaacaggaggagaagtccggtgaggacggggagaaggatacaaaggacgatcaaacagagcaggaacccaacatgctcctggagagcgaagacgagctcctcgtggacgaggaggaagccgctgcgctgctggaaagtggatcctcggtgggcgatgaaaccgatctcgctaaccttggtgatgttgcatctgatggtaagaaggaaccatcagacaaagcagttaagaaagatggcagcgcctctgcggccgccaagaagaagttaaagaaggtcgataagatcgaggaattggatcaggagaacgaagctgcactcgaaaacgggattaaaaatgaggagaatactgagcctggcgcagagtcatcagagaatgccgatgatcccaataaggacacatccgaaaacgcagatgggcagtccgatgaaaataaagacgactatactataccagatgaatatcggatcggaccctatcagcctaacgtcccagtggggattgattatgtaatacctaagaccgggttctattgcaagctgtgtagcttattttacaccaatgaagaggttgcaaagaatacacattgctcttcactgccccactatcaaaagctgaaaaaatttctgaataaactggctgaagaacgacgccagaaaaaggagacgtag

SEQ ID NO: 194309 - DNA, 2544 bp, Artificial Sequence
  Description of Artificial Sequence: Synthetic coding sequence
atgagcaagagcttccagcagagcagcctgagccgggacagccagggtcacgggagagatctgtctgccgctgggataggattgctggcagctgcaacacagagcctgagcatgccagcctcccttggccggatgaaccagggcactgcaaggctggcctcgcttatgaacctgggaatgtctagctctcttaatcagcagggggctcactctgcattgagttccgccagcactagcagtcacaacctgcagtccatttttaatattgggagccgtgggcctttacctctcagcagtcagcatcgtggagacgccgaccaggcgtctaacatcttagcctcttttggactctcagctcgcgatctggatgaactcagcagatatcccgaggataagatcacccccgaaaacctcccacagatactgttacagctgaagagaaggaggaccgaggagggccctaccctgagctatggaagggacggtcggtctgccacccgagagcccccctacagggtgcctcgcgacgattgggaggagaagcgccactttcgcagagacagctttgacgataggggaccgtcactcaatccagttctggattatgatcacggcagccgctcacaggagtcaggctattatgaccggatggactatgaagacgataggttgagagatggcgagcgatgtcgcgacgactctttttttggagagaccagtcataactaccacaagtttgactcagaatacgaacggatgggccgggggccaggtcccctgcaagagcgctcactgttcgagaaaaagcggggggcaccaccatccagcaatattgaggactttcatggccttttacctaaaggctaccctcacctgtgttccatttgtgatctccccgtgcacagcaataaagaatggtctcagcatataaatggtgcctctcacagccggcggtgtcagttgctactggagatttacccagaatggaatcctgataatgacactggtcatacaatgggtgatcctttcatgcttcagcagtcaaccaatccagctccaggaatactaggcccaccccctccatcgttccacctcggtgggccagctgttggcccacgcgggaatctgggcgctggaaatggcaatctgcagggcccaaggcatatgcaaaaaggacgcgtagaaacctctagagtggtgcacataatggactttcagcgcggaaagaacctgagataccagctgctgcaattggtcgaaccctttggtgtcattagcaaccacctaatcttgaacaagatcaatgaagcattcattgagatggctacaacggaggacgctcaagccgccgtagactattacacaactaccccggccctagtgtttggcaagcctgtgagagtccacctgtcccagaagtacaaaaggattaaaaagcctgaggggaagcctgaccagaagtttgaccaaaaacaagagctcggtcgggtcatccacctttctaatcttccacactctggctactcagactctgccgtcttgaaactggcggagccctatggtaaaatcaagaactacattcttatgcgtatgaagtcgcaggccttcattgagatggagactcgcgaagacgcaatggccatggtggaccactgcttaaaaaaagcactgtggttccaagggcgatgtgttaaagtggacctgagtgaaaaatacaaaaagttagtgctgcgcatccctaatagggggatcgatctactgaagaaggataaatctcgcaaaaggtcttattcaccggacgggaaggagagtcctagtgataagaaaagtaagacagatggtagtcagaagacagaaagttcaactgaagggaaagagcaagaggagaagtctggcgaggatggggagaaggatactaaggatgaccagacagaacaagaacccaatatgttgctcgagtctgaggatgaacttttggtagacgaagaggaagccgccgctctcctcgagtcaggttcatctgtaggcgatgaaacggatcttgccaatctcggcgatgtagctagtgatggcaagaaggagccatccgacaaggctgtgaaaaaagacggatctgcgagtgccgcagccaaaaagaaactaaagaaggttgacaaaattgaggaattggatcaagaaaacgaggcagctctggaaaatggtatcaaaaatgaggagaacactgagcctggagcagaatcgtctgagaacgccgatgaccccaacaaggacacgagcgaaaatgccgacgggcaatccgatgagaataaggacgattataccatcccggacgaatatagaatcgggccttatcagcctaatgtccccgtgggcatcgattatgtaattccgaaaactggcttttattgcaaactttgctcccttttttatacaaacgaggaggtcgctaagaatacacattgttcctctctcccccattaccagaaactaaagaaattcctgaacaaactcgctgaggaaaggcggcagaagaaggagacctag

SEQ ID NO: 194310 - DNA, 300 bp, Artificial Sequence
  Description of Artificial Sequence: Synthetic coding sequence
atgagcaagagcttccagcagagcagcctgagccgggacagccagggtcacggacgcgacctatccgctgcggggatcggtctcctggccgcggccacacagagtctgagcatgccagcgtctctcggacggatgaatcaggggaccgcccgtttggcgagcctgatgaaccttggaatgtccagttctctgaaccagcaaggtgcccattctgccctgagcagtgctagcaccagtagccataacttgcagagtatttttaatattggctcacgcggacccctgcctctttcgtcctag

SEQ ID NO: 194311 - DNA, 1530 bp, Artificial Sequence
  Description of Artificial Sequence: Synthetic coding sequence
atgggcgaccccttcatgctgcagcagagcaccaaccccgcccccggcattctcggtccccctccgccctcttttcacctaggcggaccagccgtgggccctcgcggcaacctgggcgcaggtaatggaaacctccaaggccccagacacatgcagaaagggcgcgtggagacctcacgtgtggtgcacatcatggactttcaacgtggtaagaatcttcgttatcaacttttacagctggtggagccattcggggtgattagtaaccatctcatcctcaacaagattaatgaggcttttattgaaatggccacaactgaggacgctcaggcagcggtggattattatacgacaactcccgccctggttttcggaaaaccagtaagagtgcatctgagccagaagtacaaacgaatcaagaagcccgaggggaaacccgaccagaagttcgatcaaaagcaagagctgggacgtgtgatacacctgtcaaatctacctcacagcggctacagcgatagcgctgtgctgaagctggccgagccctatggcaagattaagaactatattctgatgcgaatgaaatcacaggcgttcatagaaatggagactagggaggacgcaatggctatggtcgaccattgcttgaagaaggccctgtggttccaaggcagatgtgtcaaggtggatctgtcagaaaaatataaaaagctggtcctccggatcccgaatcgagggatcgacttattgaaaaaggataagtccaggaaacggtcctattcgcctgacggtaaagaatcaccgtctgacaagaagagcaaaacagatggctctcagaaaactgagtcttcaactgagggaaaggaacaggaggagaagagtggagaggacggggagaaggacacaaaggacgaccagaccgaacaggagcccaacatgctcctcgagtccgaagacgagttgctggtcgatgaggaggaggcggctgctttgctggaatccggcagttccgtaggtgacgaaacagatttggcaaatttaggtgatgtggcaagtgacggaaaaaaagagcccagcgataaagctgtgaagaaagacggaagtgcctctgccgctgccaaaaagaagcttaaaaaggtggacaagattgaggaattggaccaggagaacgaagccgcactagaaaatgggattaaaaacgaggagaacacagagccaggcgctgaaagctccgagaacgccgatgaccctaacaaggacacctctgagaacgcagacggccagtcagacgaaaacaaggacgactatactatccctgatgagtaccgaatcggcccctatcaaccaaatgtcccagttggaattgactatgtgattccaaaaacagggttctactgtaaactttgctcacttttttatacaaacgaagaagttgccaagaacacccattgcagctctctgccacactaccagaaactaaaaaagttcctgaataagctggcggaagagcggaggcaaaaaaaggaaacgtag

SEQ ID NO: 194312 - DNA, 264 bp, Artificial Sequence
  Description of Artificial Sequence: Synthetic coding sequence
atgagcaagagcttccagcagagcagcctgagccgggacagccagggacatggacgcgatctgtcagccgccggcatagggctcctggcagccgcaacacagagcctgtcaatgccagcgtctctggggcgaatgaaccaagggaccgcaaggctggcttccctgatgaacttgggcatgagtagttcacttaaccaacagggcgctcactctgctctcagtagtgctagcactagctcacataatctccagtctatattttag

SEQ ID NO: 194313 - DNA, 1680 bp, Artificial Sequence
  Description of Artificial Sequence: Synthetic coding sequence
atgctgggcgcccagtggcggcggaaccagcccagccgggccgccgaggagtggtctcaacacatcaacggcgcatcgcacagtcgtcggtgccaactgctcttagaaatttatcccgagtggaatcctgacaatgatacaggtcacacgatgggtgatcccttcatgctccaacagtcaactaaccctgcacccggcatcctgggacccccccctcctagttttcacctgggaggacccgccgtcggcccacgcggtaatcttggagccggtaatggcaacctccagggtccccgccacatgcagaaaggccgcgtggagaccagccgagtcgtccacattatggacttccagcggggcaagaatctgcggtaccaactgctgcagctggtggagcccttcggagtaatctccaatcacctgatactgaataaaatcaacgaggcctttatcgagatggccactaccgaagacgctcaagccgccgtggattactacaccaccaccccggctctggtattcggcaagcccgtccgggtgcacctgtcccagaagtataagcgcattaagaagcctgagggcaagcctgaccagaagttcgatcagaagcaagagctcggacgcgtgatacacctcagcaatctgccacattccgggtatagcgactcagccgtactgaagctagccgaaccctatggcaaaatcaaaaattacattttaatgcgcatgaagtcccaggctttcatagaaatggagacccgagaagacgcgatggctatggtagaccattgcctgaagaaggccctgtggtttcagggtagatgtgtcaaagtggatctttctgagaaatataaaaagttggttcttcggattccaaaccgcggaatcgatctgctgaagaaggataagtcgcgaaaaagatcttatagcccagacggcaaagagagccccagcgacaaaaagtctaaaaccgatgggtcgcagaaaaccgaaagttcaacggaagggaaggagcaggaagagaagtcgggcgaggatggtgaaaaggacacaaaggacgatcagaccgagcaggaaccgaacatgctgttggagtcagaagatgaactgctggtggacgaagaagaggccgcagccctgctggaatctggtagcagcgtgggcgatgagacagacctagccaacctgggagacgtcgcttctgacgggaaaaaggagccatctgataaagctgtaaagaaagacggtagcgctagcgcagcggcaaaaaagaaactgaaaaaggtcgacaagatcgaggaactggaccaggagaacgaggcagccttggagaacggcatcaaaaatgaagagaacactgagcccggagccgagtctagcgagaacgctgatgatcccaataaggacacctcagagaacgccgacggccagagtgatgagaacaaggacgattacacgatccctgatgagtacagaatcggcccctatcagccaaatgtcccggttggcatcgactacgttattcctaaaacaggcttttattgtaagctgtgcagtctgttctataccaatgaggaggtggccaagaacacccactgttccagcctgccgcactaccaaaagctcaagaagttcctgaacaaactcgctgaagaaagacgccagaaaaaagagacttag

SEQ ID NO: 194314 - DNA, 237 bp, Artificial Sequence
  Description of Artificial Sequence: Synthetic coding sequence
atgagcaagagcttccagcagagcagcctgagccgggacagccagggccatgggcgcgacctgagcgccgctggcattggtctgctagctgccgccacccagagcttgtctatgcccgcctccctggggcgaatgaaccagggaaccgctaggctggcttcgctaatgaatcttgggatgagctccagtctcaaccagcaaggcgcccactcagcactctcctctgcgtccacatag

SEQ ID NO: 194315 - DNA, 1302 bp, Artificial Sequence
  Description of Artificial Sequence: Synthetic coding sequence
atgagcaagagcttccagcagagcagcctgagccgggacagccagggacatggccgggacctgtcagctgcaggcataggtctccttgctgcagctactcaatcgctgtccatgcccgcttcgttaggacggatgaaccagggcacagctaggcttgcgagtttgatgaatcttggaatgtctagctcccttaaccagcaaggcgcgcactctgctttgagctcggcctccacatcatctcacaatttgcagtccatctttaatattggcagccgcggccccctccccctgtcatcccagcatagaggcgatgccgatcaggcctccaatattctcgccagcttcgggctgtccgccagagatctggatgagctgagtcgctatcctgaggacaagatcactcctgagaatctacctcagatactgctacagctgaagcgtcgaaggacggaggaaggaccaactttgagctatgggagagatggtaggtcggctactcgtgaacccccctaccgagtccctcgtgatgactgggaggagaagcggcacttccgccgggatagctttgacgatcggggacctagtttaaacccagtgctcgactatgaccatggctcaagatcgcaagagagtggctactacgacaggatggattacgaagatgaccggttgcgggatggcgagcggtgccgagatgactcgtttttcggtgaaacttcccacaattaccacaaattcgatagcgaatacgagagaatgggccgtggccccgggcccctgcaggaacgctcattgttcgaaaaaaagcgcggtgcccccccttcaagcaatatcgaagactttcatggactcctccctaaggggtacccacacctctgctcgatctgtgacctcccagtccactccaataaggagtggtctcagcacatcaacggagcctctcacagtcgacggtgccagttgctgctcgaaatatacccagagtggaaccctgacaatgacaccggccacacaatgggggacccattcatgctgcaacagtcaactaatccggcacctggcattctggggccacccccgccatcattccacctcggggggcctgccgttggacccaggggaaacctgggtgcgggcaatgggaacctacaggggccacggcacatgcaaaaggggcgggtcgagacatctcgggtggtccacattatggatttccagcgagggaaaaatcttcgataccagcttctgcagctcgtggagccgtttggagttatcagtaaccacctcatcttgaataagtag

SEQ ID NO: 194316 - DNA, 1530 bp, Artificial Sequence
  Description of Artificial Sequence: Synthetic coding sequence
atgggcgaccccttcatgctgcagcagagcaccaaccccgcccccgggattctcggcccacccccaccaagctttcacttgggcggcccagccgtaggtcccaggggcaatctcggagctgggaatggaaatctgcagggccctcgacacatgcagaaaggtagggtggaaacaagccgcgtagtgcacatcatggatttccagcgcggtaagaacctccgctaccaactgctgcagcttgttgagcccttcggcgtaatcagcaaccatctcattttgaacaagattaatgaagcctttattgaaatggccactaccgaggatgctcaggcagcggtggactactacaccaccacgcccgccttagttttcggcaaacctgtgagggtgcacctgtcccagaagtataagaggatcaagaagcctgaaggaaaaccggatcaaaagtttgaccaaaagcaagagttgggccgtgtcattcacctgagcaatctgcctcacagcggctactcggattctgccgttctgaaactggccgagccgtatggtaaaatcaaaaattacattttaatgaggatgaagtcccaggcttttatcgaaatggagacacgggaagatgccatggcaatggtggaccattgtctgaaaaaagcgctgtggtttcaaggaaggtgcgtcaaagtggacttatcagagaaatacaagaaactggtgttgcgcataccaaatcgcggcattgatctgctcaaaaaagacaaaagccgcaaacggagctattctcctgacgggaaagaaagtcctagtgacaaaaagagcaagaccgatggctctcagaagaccgagtcctccactgaaggtaaggaacaggaagaaaaatcaggcgaggacggcgagaaggacaccaaagacgatcagacagagcaagagcccaatatgttgctcgagtctgaagacgagctgctggtggacgaggaggaggccgcagctctacttgagagtggctcatcagttggcgatgaaaccgatctggctaatctgggggatgtggcgagcgacggcaagaaagagccaagtgacaaggccgttaagaaggacgggagcgctagtgcagcagctaagaaaaaacttaaaaaggtggataaaattgaagaactggaccaggagaatgaggccgctttggaaaacggaataaaaaacgaagaaaacacggaacctggcgccgaatcaagtgagaacgccgacgatcccaataaagatacttctgaaaacgctgacggccagtccgacgagaataaggacgattacacgatcccagatgaatacagaattggaccctatcagcccaacgtgcctgtgggtatagattacgttatccccaaaacgggcttctattgtaaattgtgtagccttttctatactaatgaagaggttgccaaaaatacccattgttctagcctaccacattaccagaaactcaaaaaatttctgaacaaactcgcggaggagagacggcagaagaaagaaacgtag

SEQ ID NO: 194317 - DNA, 144 bp, Artificial Sequence
  Description of Artificial Sequence: Synthetic coding sequence
atgagcaagagcttccagcagagcagcctgagccgggacagccagggacatggccgcgacctgagcgcggctgggatcggtctgctggccgccgcaacccagtcactgtcaatgccagctagtttaggacgtatgaaccagtag

SEQ ID NO: 194318 - DNA, 237 bp, Artificial Sequence
  Description of Artificial Sequence: Synthetic coding sequence
atgagcaagagcttccagcagagcagcctgagccgggacagccagggccacggaagagacctctccgctgcagggatcggcctcctggccgctgctacccagtccctgagtatgcccgccagcctcggaaggatgaaccaggggaccgccaggttggcatctttaatgaacttgggcatgtcctcatccctgaaccagcaaggtgcccatagcgccttatcttcagctagtacctag

SEQ ID NO: 194319 - DNA, 2544 bp, Artificial Sequence
  Description of Artificial Sequence: Synthetic coding sequence
atgagcaagagcttccagcagagcagcctgagccgggacagccaggggcacggcagggatttgagcgctgccggaatcggactcttggctgccgccacacaatcactttctatgcccgcctctttggggcgcatgaatcagggtacagcccggctggcctctttgatgaatctaggtatgtccagcagcctaaaccaacagggcgcacattcagcccttagcagtgcgagtacctctagtcataacttgcagtcaattttcaacatcggaagccggggtccgttgccacttagctctcagcaccgaggggacgccgatcaggcatccaacattcttgcaagttttgggctcagcgctagggacttggacgaactgtccagataccccgaggacaaaatcaccccagaaaacctgccccagatactactccagcttaaaaggaggcgcacagaggaaggccctacattatcctatggacgggacggccgttctgctaccagagaacccccctacagagtacctcgcgacgattgggaggaaaaacgccacttcagaagggattcttttgacgacagggggccttctctcaaccccgttcttgactacgatcatgggagccgcagccaagagtcaggatactatgacagaatggattacgaggatgatagactgagggacggggaacgctgtagggacgactcttttttcggtgagacatcccacaattatcacaaatttgacagcgaatacgagaggatggggagaggccctggacctctccaagagcgctctctgttcgagaaaaaacggggggctcccccgtcctcaaacatagaggacttccacggactgttgccgaaaggataccctcatttgtgtagtatttgcgacctgcctgtgcattccaacaaggagtggagtcagcacataaacggggcttcccactcaaggcgctgccagctgttactggagatctacccagaatggaatcctgataacgacactgggcacaccatgggtgatccatttatgctgcagcagtcaacgaatccggcccccggcatactgggaccaccaccgcctagttttcatctcggtggccccgccgtcggtccccggggcaaccttggagccggaaacggcaacctgcaaggtccgagacacatgcagaaaggtcgcgtagagactagcagggttgttcacatcatggactttcagcggggcaaaaatctccgatatcaattgctgcagttggttgagccttttggcgtgatttctaaccaccttatcctcaataaaattaatgaagcgttcatcgaaatggctacaaccgaggatgcccaggcagcagttgattactacacgactaccccggccttggtgtttggaaaacctgtgcgggtacatctgtcccagaagtataaacgaataaaaaagccagagggcaagcctgatcagaagttcgaccagaaacaggaactaggccgcgtaatccatctgtccaatctgcctcactctgggtactctgatagcgccgtcctaaagctcgctgaaccgtacggaaagattaagaattacatcctgatgcggatgaagtcacaggcattcatcgagatggagacccgcgaggacgccatggcaatggttgaccactgcctgaagaaggctctctggttccaaggccgatgtgtaaaggtggatctcagcgaaaagtacaagaagctggttctaaggataccgaaccggggcatcgaccttttgaagaaagataagagccgcaaacgctcgtatagcccagatgggaaagaatcccccagtgataaaaagtcaaaaacagacggttcgcagaagacagaaagcagtactgaaggtaaagaacaggaggagaagtcgggagaagatggagagaaggacaccaaggacgaccagaccgagcaggagcctaatatgctcctcgaaagcgaggacgaattactggtggacgaagaggaggctgccgccctgctggagtcaggctcctctgtgggcgacgaaaccgacttggccaacctgggggacgttgcttcagacggaaagaaagaaccaagtgacaaggcggtaaagaaggatggctccgcatctgcagcagctaaaaagaaacttaagaaggttgataaaatcgaagagttggaccaagaaaatgaggcagccctggaaaacggcatcaagaatgaggaaaacaccgaacccggagccgagtcttccgagaatgctgacgacccaaacaaagacacttcagaaaacgccgacggccagtctgacgaaaataaggatgactataccatacccgatgagtataggattggaccttatcaacctaatgtccccgtgggtatcgactacgtgatcccgaaaactggattttattgcaaactgtgttctctgttctacacgaacgaggaggtagctaaaaacactcactgctcttctctcccacactatcaaaagctgaagaaattcctgaacaaattagccgaggaaagaaggcagaagaaagagacatag

SEQ ID NO: 194320 - DNA, 30 bp, Artificial Sequence; identical to SEQ ID NO: 88126
  Description of Artificial Sequence: Synthetic coding sequence

SEQ ID NO: 194321 - DNA, 303 bp, Artificial Sequence
  Description of Artificial Sequence: Synthetic coding sequence
atgagcaagagcttccagcagagcagcctgagccgggacagccagggtcacggtcgagatttaagtgcggcgggaatcgggctcctggcggccgctactcagtcacttagcatgccagcatctttggggcggatgaatcagggcacagcacggctagcctccctgatgaacctgggcatgagctcttcactgaatcaacagggagctcacagcgccttgtctagcgcctctacatcaagtcacaaccttcagagtatctttaacattggatcccgtggacctctaccactaagctcccagtag

SEQ ID NO: 194322 - DNA, 324 bp, Artificial Sequence
  Description of Artificial Sequence: Synthetic coding sequence
atgagcaagagcttccagcagagcagcctgagccgggacagccagggccatggcagagacctctctgccgctggaattggacttctggcagcagccacccagagcctttccatgcctgcaagccttggaaggatgaaccaaggaactgcgagactggcgtccctcatgaacctgggaatgagctcctccctaaatcagcagggggcccacagcgccctgtcgtctgcttccacatcgtctcacaatctgcagagtatctttaacatcggatctcgtgggccactgccactgtcctctcaacacagaggtgacgccgaccaatag

SEQ ID NO: 194323 - DNA, 1578 bp, Artificial Sequence
  Description of Artificial Sequence: Synthetic coding sequence
atgcgggtgttctgcgtgggcctgctgctgttcagcgtgacctgggcggctcccaccttccagccacagacagagaaaaccaaacagtcgtgcgttgaggagcagaggcaagaggagaaaaataaggataatattggattccaccaccttggaaaacggatcaatcaagagctctcaagcaaagaaaatattgttcaagagcggaaaaaggatttgtcactgagcgaggcgagcgagaacaaaggctcatcaaaatcccaaaactactttaccaatagacagcgcctgaataaagaatatagtataagcaacaaggaaaacactcataacggcttgcgcatgtcgatctaccccaagagcaccgggaataaaggattcgaggacggagacgatgctatcagcaaacttcatgaccaagaagaatacggcgctgctcttataagaaataacatgcaacacattatgggccctgttacagcaatcaagctgttaggcgaagagaacaaggaaaatactccccggaacgtgctaaacattattcctgcatctatgaactatgcaaaggcccattcgaaagataagaagaaaccccagcgagactctcaggcccagaaatctcctgttaagagcaaatccacgcatagaatccaacacaacattgattacctgaaacacctctctaaggttaaaaagatcccttcagactttgagggctctggctacaccgatctgcaagaacggggtgacaatgacatcagccccttctccggcgatggtcagccattcaaggacattcccgggaagggcgaagctaccggtcctgatctggaaggcaaggacatacagaccggcttcgccggcccctctgaagctgaatctacgcacttagatacgaagaaaccaggctataacgagattccagagagagaggagaatgggggaaatacaatcggaaccagagacgaaacagccaaggaggccgacgccgttgatgtatccctggtggagggaagcaatgatattatggggtccactaatttcaaagagttgcctgggcgtgaaggcaatcgcgttgacgctggatcccagaacgcccaccaggggaaagtcgagttccattacccgcccgccccttccaaggagaaaagaaaagaagggagctcagacgccgccgaaagtaccaactacaatgagatcccgaaaaacggtaaagggagtacacgcaaaggcgtggaccacagtaatagaaatcaggccaccttaaacgagaaacagcgcttcccttcgaaggggaagtctcaagggcttccaatcccctcccgaggactggataacgagatcaaaaacgaaatggacagttttaacgggccatcccacgagaacatcataacccacggtcggaagtaccattatgtgccccaccgccagaataacagcacacgtaacaagggcatgccacagggtaaaggctcttggggacgtcagcctcacagcaaccggaggtttagctcgagaaggagggacgatagcagtgaaagcagtgactccggttcctctagcgaatctgatggggactag

SEQ ID NO: 194324 - DNA, 1578 bp, Artificial Sequence
  Description of Artificial Sequence: Synthetic coding sequence
atgcgggtgttctgcgtgggcctgctgctgttcagcgtgacctgggcggccccaactttccagccacaaaccgaaaaaaccaagcaatcttgcgtcgaagagcagcgacaggaggagaagaataaagacaatattgggtttcaccacttgggcaaaaggatcaaccaagaactgagctcaaaagaaaatatcgtccaggagaggaaaaaggatttgtctctgagcgaggcatccgaaaataagggttcttcaaagagccagaactactttaccaacagacagcggctgaataaggaatattccattagcaacaaggaaaatacccacaatgggctgcgaatgtctatttaccctaagagtaccgggaacaaagggtttgaggatggggatgatgcgatcagtaaactgcacgaccaggaggagtacggagctgccctgattcggaataatatgcagcacatcatggggcccgtgactgccattaaactgttgggtgaggagaacaaagagaatactccccgcaatgttcttaatatcattcccgcgtccatgaactatgccaaggcacatagtaaagacaagaaaaagcctcaaagagattcccaagcgcagaagagcccagtgaagagcaaatcaacccatcgaatccaacacaacatagattacctgaagcatctgtctaaagtcaaaaagattccctctgattttgaaggcagcgggtataccgatctgcaggagcgcggtgataacgacattagtcctttctctggcgacgggcagcccttcaaggatatccctgggaagggggaagcaactggccccgatcttgaaggtaaggacatccagactggctttgcaggcccttctgaagcagagtccacccacctggacaccaagaagcctggttacaacgaaattccggagcgcgaagaaaatggcggcaacactatcggcactcgggacgagaccgccaaagaggcagatgcggtggatgtaagcctagtggagggctccaatgacatcatgggctccactaacttcaaagagctgcctgggagggaaggcaacagggttgacgccggatcacaaaatgctcatcagggaaaagtggaattccactatcccccggcccctagcaaggaaaagaggaaggaaggctcctctgacgccgcagagtctacaaactacaatgagatacctaagaatggaaagggatccacaaggaaaggagtggaccactctaacaggaatcaggctaccttgaatgagaagcagcgcttccccagtaaggggaaatctcagggcctgcccattccttctagaggtctggacaacgaaatcaaaaatgagatggatagctttaacggaccctctcacgaaaacattatcacccacggcagaaagtaccattacgttccccaccgacagaacaattccactagaaacaagggaatgccacagggcaagggaagctggggccgccagccccactctaatagacgcttctcctcccgtcgccgcgatgattctagtgaatcctccgactctgggtccagttctgagtctgacggggactag

SEQ ID NO: 194325 - DNA, 828 bp, Artificial Sequence
  Description of Artificial Sequence: Synthetic coding sequence
atgcgggtgttctgcgtgggcctgctgctgttcagcgtgacctgggctgcccccacctttcagccacagactgaaaaaaccaaacagagctgtgttgaggagcagcgccaggaggagaagaacaaggacaacattggattccaccatctcgggaaacggataaatcaggagctgtcctctaaagaaaatattgttcaggaaagaaagaaagatctttctctttccgaagcttccgaaaataagggctccagtaaatctcagaattatttcaccaacaggcagagactcaacaaagagtacagcattagtaacaaggaaaatacccacaacggcctgcgaatgtctatataccccaagagcacagggaataagggtttcgaagatggcgacgatgccatcagtaagctccatgatcaagaggagtacggcgcagccctgatccgaaataacatgcaacacattatgggacccgtgacggccatcaagctgctgggagaggaaaataaggagaacactccccgcaatgtgcttaacattataccagcctccatgaactacgcaaaggcccactctaaggacaaaaagaaacctcagcgggactcccaagctcagaagagccctgtaaaatcaaagtcaacacaccgaatacagcataacatcgactacctgaagcatctgtctaaggtgaagaagattccttctgattttgagggctcagggtatacggacttacaagagcgcggggataatgatatttccccctttagtggcaccgccaaccttctccggacattcctcgtcaaggaaaagctgttggtgctgacctag

SEQ ID NO: 194326 - DNA, 1239 bp, Artificial Sequence
  Description of Artificial Sequence: Synthetic coding sequence
atgagcatctaccccaagagcaccggcaacaagggcttcgaggacggcgacgatgccatttcaaagctccacgatcaggaggaatacggcgcggctctaatcagaaacaacatgcagcacattatgggtccggtgaccgctatcaagctgctcggcgaggagaacaaggagaacacgccaagaaatgtcctcaatataatccccgctagtatgaactatgccaaggcgcactctaaggacaaaaaaaagcctcagagggattctcaagcacagaagagcccagtgaaatccaaatccactcaccgcattcagcataatattgactaccttaaacacctgtcaaaggtcaagaaaattccctctgactttgaaggatctggatataccgatctgcaagagagaggagacaacgacatttcaccttttagcggggacggtcagccattcaaggacattcctgggaagggagaggctacagggcccgacctggaaggcaaggacatccagaccggcttcgcaggaccttccgaagcagaatctacccacctggacacgaaaaaacccggttataacgaaatcccggagcgtgaggaaaatggcgggaacactatcggcacacgggacgagaccgctaaagaggcagacgcagtagacgtttcgctcgtcgagggctctaacgatattatgggctcgacaaacttcaaagaactacctggcagggagggcaaccgcgtggatgccgggagccaaaatgcccatcaaggaaaggtggagtttcattatccaccagcaccttcgaaagagaaacggaaagaaggcagttccgacgccgctgagtcaacgaattataacgaaattcccaagaacggcaagggtagcaccaggaagggggttgaccactccaaccgcaaccaggcaactctgaacgaaaaacaacgttttccatcaaaaggcaaatctcagggcctgcctattccaagccgaggactagataatgaaattaagaatgagatggatagtttcaacgggccttcccacgaaaacatcatcacgcacggccgtaagtatcactatgtgccacacaggcagaacaactctacccgtaataagggtatgccacagggcaagggcagctggggcagacagccacattccaacaggcgattctcctcccgcagaagagatgacagttctgagagctcagatagcgggtcttcatccgagtcagatggagactag

SEQ ID NO: 194327 - DNA, 1239 bp, Artificial Sequence
  Description of Artificial Sequence: Synthetic coding sequence
atgagcatctaccccaagagcaccggcaacaagggcttcgaggacggcgacgatgccatttccaagctgcatgatcaggaagaatatggagccgcgttaatacggaataatatgcagcacatcatgggtccggttacagccattaaattactgggtgaggagaacaaagagaatacgccgcgcaacgtattaaacattatccccgcgtcaatgaactacgctaaggcccactcaaaagacaaaaaaaaacctcaaagggactctcaagcgcagaagtcccccgtgaaaagcaagagcacacatcggatccagcataacatagattatctaaaacatttgtcaaaggtaaagaagatcccttcagacttcgagggtagcgggtataccgatctccaggaacgtggggataacgacatcagcccattctcgggcgacggccagccgttcaaggacattcctggaaaaggtgaagccacaggccccgacttagaaggcaaggacattcagacaggcttcgccggcccctcagaggcggaatcaacacacctggacaccaagaagcctggctataacgaaattccagagagggaagagaacggggggaataccataggaactcgggacgagacagctaaggaggccgacgccgtcgatgtttccctggtggagggcagtaacgatatcatgggatccactaactttaaagagctcccaggtcgggagggcaatcgggtcgacgccggtagccagaatgcccatcaaggcaaggtggagttccactatcctcctgcacctagcaaggagaaaaggaaggagggctcatccgatgcagccgaaagtacgaactataacgagataccaaagaacggcaagggttccacccgcaaaggcgtcgaccattctaatcgaaaccaggccacccttaacgaaaagcaacgatttccaagtaagggaaaaagccagggcctcccaatccctagtcgagggttagacaatgagattaaaaatgaaatggattcctttaacggaccaagtcatgagaatatcattacacacggccggaagtatcactacgtgccacacaggcaaaacaatagtacccgtaacaagggcatgccacagggtaagggctcttgggggagacaacctcatagtaatcgccgctttagctccagacgcagagatgatagcagcgaatcaagcgattcaggctccagcagcgagagcgatggggactag

SEQ ID NO: 194328 - DNA, 312 bp, Artificial Sequence
  Description of Artificial Sequence: Synthetic coding sequence
atgaagagcctgatcctgctggccatcctggccgccctggccgtggtgaccctctgctatgagtcacatgagtccatggagagctacgaactcaatcccttcattaacaggcgaaacgccaatacgttcatttcaccgcagcagaggtggagagctaaagtccaggagcggattcgcgagaggtccaaacctgtgcacgagctgaatcgtgaagcatgtgatgattatcgcttgtgcgagcgctatgccatggtttacggctacaacgccgcctataatcgctattttcgcaagaggcggggtactaagtag

SEQ ID NO: 194329 - DNA, 945 bp, Artificial Sequence
  Description of Artificial Sequence: Synthetic coding sequence
atgggccccctgatcaaccggtgcaagaagatcctgctgcccaccacagttccacctgcaacaatgcggatttggctgctgggaggcttgctgccttttctgcttttgctgagcggccttcagcgcccaacagaagggtcagaggtcgccattaaaatcgacttcgactttgctccagggtcctttgacgatcaataccagggctgttcgaaacaggttatggagaagctgacacaaggagactatttcacaaaagatatcgaggcccagaaaaactactttcgcatgtggcagaaggctcatcttgcctggctgaatcagggcaaagtcttgccacagaatatgaccaccacccatgccgtagcgatcttattttatacattaaatagcaatgtacactcagacttcacacgggctatggcttctgtcgccaggacgccacagcagtatgaacgcagcttccacttcaaatatttacattattatctgacttcagccatccagttgctgcggaaagactccattatggaaaatggaacattgtgttacgaagtgcactacaggaccaaggacgttcacttcaacgcttatacgggtgccacaatccgctttggacagtttctgtccactagcctgctcaaagaggaggcacaggaattcgggaaccagacactctttaccatattcacgtgcctcggtgccccagtgcagtatttcagcctgaaaaaggaagtactgatccccccttatgaacttttcaaggttatcaacatgagctatcacccccgaggcgactggctgcagctccgatcaaccggtaatctgtccacttacaactgtcagcttctaaaagcaagtagcaaaaaatgcatcccagacccaatcgcaattgcaagcctttcatttctcacatccgtgattatatttagcaaatcacgagtctag

SEQ ID NO: 194330 - DNA, 1749 bp, Artificial Sequence
  Description of Artificial Sequence: Synthetic coding sequence
atgagcatcgagaccctgctggaggccgcccggttcctggagtggcaggcacagcagcagcagcgcgcccgagaggagcaagaacgcctgaggctggagcaggagagggagcaagagcagaaaaaagccaattcgttggctaggctcgcccataccctgccagtcgaggaacctaggatggaagctccaccgctcccccttagccctcccgcaccacccccagcgccccctcctcctcttgccactccagcaccactgactgttattccaatacctgtagtgaccaattccccccagcccctccctccacctcctccgctgccagctgcggcccagcccttgcccctggcaccccggcagcctgctctggtgggcgcaccaggtctctctattaaggaacccgccccactcccaagtaggcctcaggtgcccactccagcgcccctgttaccggactcaaaggccactatcccaccaaatggcagtcctaaacctctgcagccattgcccactcctgtgctcactatcgccccccacccaggagtgcaaccccagttggccccgcagcaacctccgccacccaccttgggaacactcaagttagcccctgctgaagaagtgaaatcttccgagcaaaagaaacgccccggcgggattggaacaagggaggtgcataacaaacttgaaaagaatcggagggctcacttgaaagagtgcttcgaaacgctgaaacgtaatattccaaatgtggacgacaagaagacatctaatctttccgtcctgcgcacagcccttcgatatattcagtcccttaagagaaaagagaaggagtatgagcacgaaatggaaagactggcaagagagaaaatcgccacacagcaaagactggccgaactcaaacatgagttatcacagtggatggatgttttggaaatcgatagggtgcttagacagaccggacagcctgaagatgatcaggcttctacatcaacagcctctgaaggtgaagataacatagacgaggacatggaggaggacagagccgggttagggccgccgaaactgtcacatagaccccagcccgagctcttgaagtccacactacctccaccaagcactactccagcacctctacctcctcacccccacccacacccacactcagtcgcgttgccccctgcgcacttacccgtacaacagcagcagccacagcagaagaccccacttccagcccccccccccccacccgcggccccagctcagacactggtcccggcacctgctcacctcgttgctacggcaggaggtggttcgactgtgattgcccacacagccactacccacgccagtgtaatccagactgtgaaccacgttctccagggcccaggcggaaagcacattgcacatattgcaccttccgcaccttcacctgccgttcagttagcccccgcgaccccaccgataggacacatcaccgttcatcccgccacactcaatcacgtggctcatctgggttcccaactccccttataccctcaaccggtggcagttagccatatcgctcacacccttagtcaccagcaagtgaatggaaccgctggactggggccccccgctacagtgatggcaaagccagccgtcggggctcaagtcgttcatcatccacagctggtgggccagacagtactgaaccctgtgacaatggtgacgatgccttccttccccgtgtcaaccttaaagctggcctag

SEQ ID NO: 194331 - DNA, 1749 bp, Artificial Sequence
  Description of Artificial Sequence: Synthetic coding sequence
atgagcatcgagaccctgctggaggccgcccggttcctggagtggcaggcccaacagcagcaaagagctcgagaagaacaagaacggctccggctcgagcaggaacgcgaacaggagcaaaagaaggcaaactctctcgcccggttagcccacacgctccccgtcgaggaacctcgaatggaggcacccccactccccctctcccctcctgctccacccccagctccgcccccacctttggctactcctgccccactcactgtaatccctatacccgttgtgaccaactccccccagccacttccacccccaccccccctaccagcggccgctcagcctctgcctctggccccgaggcaacccgcactggtgggcgcacccgggttgtccatcaaagagccagcccctttgccctcgcgcccacaagtgccaaccccagcccctctgctgcctgacagcaaagcaacaatacccccaaatggtagccctaagcccttacagcctttacccacgcctgtgctgacgattgccccacaccctggcgtccagccgcagctggccccccagcagccccccccacctaccctgggcacattgaagctggcgcccgcagaggaggtgaagtccagcgaacagaaaaaacgacccggcggcataggcaccagagaggttcacaacaaactggagaaaaaccgaagggcccacctcaaggagtgttttgaaaccctcaaaaggaatatacctaatgtcgacgataagaaaacatccaaccttagtgtcttacgcaccgctctgcggtatattcagtcattgaaacgtaaggaaaaagagtatgaacatgaaatggaacgattggcacgcgagaagatcgctacccagcaacggctggctgaattaaaacacgaactgtcacaatggatggacgtgctggagatcgaccgcgtcctgagacagaccgggcagccagaagacgatcaggccagcacttccactgccagcgagggcgaggacaatatagatgaagatatggaggaagatcgcgccggtctgggtcctcccaaactgtcgcatagaccgcaacccgaactgctgaagagcaccctgcccccaccatctactacccccgctcctctgccaccgcatcctcaccctcacccacacagcgtggccctcccacccgcgcacttgcccgtacaacagcaacagccccagcagaagactcctttaccagcccctccccccccccctgcagcccccgcccaaaccctggtgccagcgcctgcccatctggtcgccaccgctgggggggggtctacagtgatcgctcataccgctacaacgcatgctagtgttatccagactgtgaaccacgtactgcagggcccaggtggcaagcacatcgcccatatcgcaccctcagcccctagtcctgctgtgcagctggcacctgcgacaccgcccatcgggcacatcactgttcacccggccacacttaatcacgtggcgcacctggggagtcagctgccattgtaccctcaacctgttgcggtctcgcacattgctcatacgctatcacaccaacaggtaaatggtactgccggcctgggcccacctgcaaccgtgatggcaaaaccagccgtgggggcgcaggttgtgcaccatcctcagctagtgggccagacggtgctgaatccggtgacaatggtgaccatgccgagctttcctgtgagcactcttaagctggcctag

SEQ ID NO: 194332 - DNA, 594 bp, Artificial Sequence
  Description of Artificial Sequence: Synthetic coding sequence
atggagcccctggccagcaacatccaggtgctgctgcaggccgccgagtttctggagagaagggaaagagaagctgaacacggctatgcctctctttgcccccatcgctctcctggcccaatacaccgccggaaaaagaggcctcctcaggcacctggtgcgcaggattctggccgatggagggcgcagttgaagcggtgcctcgagagactgaaacaacagatgcctctgggggcagattgcgcaagatatacaacactctctctgcttcggagggctagaatgcatatacagaagctggaagaccaggaacagcgggcacggcaacttaaggagaggctcaggtcgaagcaacaatcactgcaacgccaactggaacagttgcgaggactggcgggagcggcggagagggagagacttagggccgatagccttgatagctctggcctgtcttcagaacggtccgatagcgatcaagaggaactggaggtggacgtagaatcgctggtcttcggcggggaagctgaactgctaaggggattcgtggctggccaggagcactcttacagccatggcgggggcgcctggctttag

SEQ ID NO: 194333 - DNA, 1167 bp, Artificial Sequence
  Description of Artificial Sequence: Synthetic coding sequence
atggagcccctggccagcaacatccaggtgctgctgcaggccgccgaatttcttgagagaagggagcgggaggcagaacacggttatgcatctctttgtccccaccgcagccctggaccgatccatcgaagaaaaaaacgacctcctcaggccccaggagcccaggatagtgggaggtccgtgcataatgaactggaaaaacgccgaagggcgcaactcaagaggtgcttggaacgtctgaagcagcaaatgccactcggagcagactgcgcacgatacactacactctcattactgcgaagggctcgtatgcatatacaaaaactcgaggaccaggaacagagagccaggcagctgaaggaacgtctgcggtccaagcagcagagcctgcagcggcaacttgagcaactcagagggttagcgggagcagccgaaagggagcgcttacgcgccgacagtctggacagttccggactgagcagcgaaaggtccgattcagatcagggagagtgcccagaggctgaggggctatgcggaccaaggggcgagcccgggctactgaccggaccgttgccagctcagcggagttggaggtggatgtggagggcatggtgcctgggcgtacgccctagctgttgcggagcttcttctcctgcccgctccacggcaacaagaactgccgccgcccctggttacgatgtgcctcacccaggcagagccagcgctttatattcgtgtcaggcacatctgcccggaaggtctccccctcaggcctttagagccgcccgatcacatctcttagagtggactaaacgtactctcgtgtgggagcaggtcctgccaaaacatccagcagccggttgccaggctgggccccttgagggcaagggccaggattctagcggccccccatggacacccgcaggccaggctgcctgggcacgcgctcaagccttcggctccgcagctcctaagggcaccggatccctgttgggtctgttcccctcctggactcggcctcccgcctttgccagccataaactgtatagcatatttattaaatcactatttcataattttccgtccattgttttgcctaacgagaatggcggaactcccaatcaccggcctaccggaaggggtaataacatcagtagtcatcattag

SEQ ID NO: 194334 - DNA, 582 bp, Artificial Sequence
  Description of Artificial Sequence: Synthetic coding sequence
atggagcccctggccagcaacatccaggtgctgctgcaggccgccgagttcctggagagacgcgagcgggaggccgaacacggatatgcctccctgtgtcctcatagatcccccggcccgattcatcggcggaagaaacgccctccacaggcgcccggtgcgcaggactctggacggtcggtgcataatgagctcgaaaaacgacgacgggctcagttaaagaggtgtcttgagagactcaaacagcagatgccgctcggagctgactgtgctaggtacacaaccctctccctcctcaggcgagccaggatgcacattcagaaactggaagatcaagaacagagagcaaggcagttaaaagagaggctcagatcaaaacaacagagcctgcagcggcaactcgagcaactgaggggtctggccggagcagctgaacgagaacgcctgcgcgctgacagtttggattcctcaggcctgtccagcgagcggtccgactccgaccaagtcctgccgaacgaaaatggcggcactcctaatcataggccgaccggtcgcgggaacaatatttcttctcatcactag

SEQ ID NO: 194335 - DNA, 621 bp, Artificial Sequence
  Description of Artificial Sequence: Synthetic coding sequence
atggagcccctggccagcaacatccaggtgctgctgcaggccgccgagtttcttgagcgccgagagagagaggccgaacatggatacgccagtctatgcccgcaccgctccccgggtcctattcataggagaaagaaacgccctccacaggcgccgggggctcaagactccggtcgctccgttcataatgagctcgagaagaggcgtcgtgcgcagctgaagcggtgtctggaacggctgaaacagcagatgcccctgggcgccgattgcgcgcggtatacaacacttagtcttttaaggagagctaggatgcacatccaaaaactggaagaccaggagcagagagcgagacagcttaaggagagactacgcagcaagcagcaaagtctgcagcgacagctggaacagctgcgaggattagcaggcgcagccgagcgcgagcggttgcgggcagatagtctggattcctccgggctgtccagcgagaggtcggatagcgatcaagaagagcttgaagttgacgtggaatctctggtctttggaggtgaagcagagctcctccgtggattcgtggcgggtcaggaacactcttacagccacggaggaggcgcttggctttag

SEQ ID NO: 194336 - DNA, 621 bp, Artificial Sequence
  Description of Artificial Sequence: Synthetic coding sequence
atggagcccctggccagcaacatccaggtgctgctgcaggccgccgaattcctagagcgaagggagagggaggccgagcacggatatgccagcctgtgcccccaccgaagcccagggcccattcatagacgaaagaaacgaccgccccaagccccaggtgcccaggacagtggccggagcgtccacaacgaactggaaaagcgcaggcgtgctcaactaaagcgctgtttggagcggttaaaacaacagatgcccctgggcgcagactgtgctaggtacaccacactgagtttactaaggagggcacgcatgcacattcaaaagttggaagaccaggagcaaagggcgaggcagctgaaggaacggctcagatccaagcagcagtctctgcagagacagctggagcaactccgaggtctggcaggcgcagccgagcgcgagagacttcgagctgatagtctggactcaagcggcctgtcatctgaacggtccgattcggaccaagaggaactcgaagtggacgttgaatcattagttttcggcggcgaggccgaactacttcgtgggtttgtagcaggccaggagcactcctactcccatggcggtggggcttggctgtag

SEQ ID NO: 194337 - DNA, 768 bp, Artificial Sequence
  Description of Artificial Sequence: Synthetic coding sequence
atgatccaggccatccaggtgctgcggttccacctgctggagctggagaaggtccatgaactttgcgataacttctgccacaggtatattagttgccttaagggcaagatgccaatcgatctggttatcgatgaaagagacggctcttccaagtctgaccacgaggagctcagcggatcatcaactaacctggcggatcacaaccctagttcctggagagaccatgacgacgcaaccagcactcattcggccgggaccccaggcccttcttccggcggtcatgcctctcagagtggcgacaatagctcagagcaaggagatggcttggacaattctgtagcctctcccgggaccggtgatgacgacgatccagataaagataagaagagacagaagaaacgcggcatcttccctaaagtggccacaaatatcatgcgcgcatggctgttccagcacctgactcacccttatccttcggaagaacagaaaaagcaactagctcaggacacgggcttgaccatactgcaggtcaataattggtttatcaacgcaaggaggaggattgtgcagcccatgatcgatcaaagcaatcgcgccggattcctgttagatccttccgtcagtcagggtgccgcttactcaccagagggccagcccatgggatccttcgtcttagacggccagcagcacatgggcatccgccccgctggtcctatgtctggtatggggatgaacatgggcatggatggtcagtggcattatatgtag

SEQ ID NO: 194338 - DNA, 9081 bp, Artificial Sequence
  Description of Artificial Sequence: Synthetic coding sequence
atggaggagaagcagcagatcatcctggccaaccaggacggcggcaccgtggccggggccgcccccacattcttcgtgattctcaagcaaccaggaaatggcaagaccgaccaagggattctcgtgactaaccaggacgcttgcgccctagcttcctctgtttcctcaccggtaaaatccaaggggaaaatatgcctgcctgcggattgcaccgtcggcggcatcacagtcacactggataacaactctatgtggaacgaattctatcaccggtctaccgagatgatccttacaaagcagggacggcggatgtttccttactgcagatattggataacaggcctggattccaacctcaagtacatcctggtgatggacatcagccccgttgacaatcacagatacaaatggaacggcaggtggtgggagccaagcggcaaagccgagccccatgttttaggacgcgtctttattcatccagaatccccttctactgggcactactggatgcatcaacctgtcagtttctataagctaaagctcaccaacaatactctcgatcaggagggccacataatactccattcaatgcatcggtacctgccacgcctgcacctggtccctgccgagaaagcggtggaggtcatccagctgaatggtccgggtgtgcataccttcacttttcctcagaccgagttcttcgctgtgacagcgtatcaaaatattcagataacccagctgaagatcgattataatcctttcgccaagggctttcgggatgacgggctcaacaacaaacctcaacgcgatgggaagcagaaaaacagttccgaccaggaaggtaataatattagcagctcgtctgggcacagagtgagactcaccgaaggtcaggggtctgagatacagccaggggatcttgaccctcttagcagagggcacgagacaagcggaaaaggactggaaaagaccagtctgaatatcaaaagggactttctcggtttcatggatactgacagcgcactaagtgaggttccgcagctcaagcaggagatctcagagtgtctcatcgccagctccttcgaggacgactccagggtcgcgagccctcttgatcaaaacggttcgttcaatgtggttataaaggaggagcctctggatgactacgattacgaactgggggaatgtcccgaaggcgtgaccgttaagcaggaggagaccgacgaggagactgacgtgtactcaaattcagacgacgacccaattttggagaaacagctcaagaggcacaataaagtcgacaacccagaggctgaccatctctctagcaagtggctcccctccagcccttctggggtagctaaggcgaagatgttcaagctcgatactgggaagatgcccgtggtctacctggaaccatgcgccgttactaggtccaccgtaaagatctcagagttacccgataacatgctttctactagcaggaaagacaagtcctccatgctggcagagttggagtatttgccaacatatattgaaaactccaatgaaaccgccttttgcctggggaaagaatccgagaacggcctgagaaaacacagccctgacctgagagtggtgcaaaagtaccccctgttgaaggagccacagtggaagtatcctgatatcagtgactccataagcaccgagaggattttagatgattctaaggattccgtgggcgactctctttcagggaaagaagacctcggccgtaagcgtaccaccatgctgaagatcgccaccgcagccaaggtggtcaatgctaaccaaaatgcttctcccaatgtgcccgggaaacgcggcaggcccagaaagctgaaactctgtaaggcagggcgcccccccaaaaatactggaaagtcgctgatctcgacaaagaataccccagtgtctccaggaagcaccttcccggacgtcaagcccgacctggaggacgttgacggagtgctgtttgtttctttcgagagtaaggaagcccttgacatacatgccgttgacggaactacagaagaatcatcttctcttcaggcatccacgactaacgacagcgggtatcgagctcggatttcccagctggagaaagagttgattgaagacctgaaaacactgcgccacaagcaggtgatacaccctggcctccaagaggttgggcttaaactcaatagtgtggatccaactatgtctatcgacctgaaatatcttggagttcagctgcccttggctcccgccacaagctttccattctggaacctaactggaaccaacccggcgtctcccgacgctggttttccattcgtttccaggacaggaaagacaaacgacttcaccaagataaaaggttggcgggggaagttccactcagcgagcgctagccggaatgaaggaggcaactccgaatccagtttgaaaaatcgttctgccttctgctcagacaagctggacgagtatttggaaaacgaaggtaaattgatggagacgagtatgggcttttcttccaacgcccccacaagtcccgtcgtctaccagcttcctactaagtcaacctcctacgtcagaacacttgacagcgtcctgaaaaagcagtccactatttcaccctccaccagctattctcttaaaccccacagcgttcccccagtctcccgaaaggccaagtcccagaatagacaggcaacgttttcgggccgcaccaagtcaagctacaaatccatccttccctacccagtcagccctaagcagaaatactcccacgttatactcggtgataaggtcaccaagaacagttcaggtatcataagcgaaaaccaggccaacaactttgtcgttcccaccctggacgagaacatctttccaaagcagattagtttgaggcaggcccagcagcagcagcagcaacaacaggggtccagaccacccgggctcagtaagagccaagttaagctcatggacctcgaggattgtgccctctgggagggcaaaccacggacctacatcacggaagaacgcgcggatgtaagtctgaccaccctgctgaccgcccaggcgtcactgaagaccaaacctattcacaccattatcagaaaacgcgcccctccttgtaacaacgatttttgcaggttggggtgcgtgtgctcttcgttggccctggaaaagaggcagcccgctcactgcaggagaccagattgtatgttcggctgtacatgcctcaaaagaaaagtggtgctcgtgaaaggaggctcgaaaaccaaacacttccagcggaaggctgcacaccgggatcctgttttttacgataccttaggggaggaggctcgcgaggaagaagagggaataagagaagaagaagagcagctgaaagagaaaaaaaaacgcaaaaaattggaatacactatctgtgaaactgaacccgaacaaccagtccgccattaccccttatgggtgaaggtggagggcgaagtcgatcccgaaccagtctatatccccacaccctccgtgatagagcctatgaaacccttgttactaccgcaaccggaggttctgagcccgactgtgaaggggaaactgcttacgggcatcaagtcgccacgcagctacacacccaaaccaaaccccgtgatccgcgaagaggacaaggatcccgtgtacctctattttgaatctatgatgacctgtgcgagggttcgagtctacgaacgcaaaaaagaggatcagcgccaacctagttcctcatcttccccctccccaagcttccagcagcagacttcctgtcatagctcccccgagaaccacaacaatgctaaggagccagatagtgagcagcagccgcttaaacaactgacatgcgatctggaggatgattccgacaaattgcaagagaagtcctggaagagttcatgtaatgagggggagtcaagtagcacaagctatatgcaccagcggagccccggagggccgacaaagctgatcgagatcatttccgactgcaactgggaagaggacagaaataaaatcctctccatactttctcagcacattaactctaatatgccacaatccctcaaagtgggttccttcatcattgagctcgcatcccagaggaaatccaggggggaaaagaatccccccgtctatagtagccgcgtcaagattagcatgccttcttgccaagatcaggacgatatggccgagaaatctggttctgagacgccagatgggccactatccccaggaaaaatggaggacatcagcccagtgcagaccgatgccctggatagcgtgagagaacggctacacggcgggaaagggttgcctttctacgctggactgtctccagccggcaagcttgtagcctacaagcgaaagccatctagtagcacttccggccttattcaggtggccagtaacgctaaagtggcagcctcgcggaagccccggacactgctcccatcaacctccaatagtaagatggcctcaagcagcggcacagcaactaatcgccctggtaagaaccttaaagccttcgtgccggcaaagcgtcctattgctgccagaccctctcccggtggagttttcactcaattcgtgatgtccaaggttggtgcactacagcaaaagatccctggagtctctacaccccagactctggccgggacacaaaagttctcgattaggccgtcgcctgtgatggtggtgaccccagtcgtgtcttctgaaccggttcaggtgtgctcgcctgtaacagccgctgtgaccaccaccaccccacaggtgtttctggagaacacgaccgccgtcacacctatgaccgccatctcagatgttgagaccaaggaaacaacctatagttccggagccaccactactggtgtggttgaagtgagcgaaacaaataccagcacctccgttaccagcactcagtccactgccacagtgaacctgaccaagacaaccggcattacgacccccgttgcctccgttgccttccctaagtccttggtagccagtccgtcaaccatcactctgccagttgcctctactgcctcaacttcgctggtagtcgtcaccgccgccgcaagctcaagcatggtgacgacccctacctcctctctgggctccgtgcctattattctgtccggaatcaacggatcccctccagtgtcccaacgcccagagaatgcggcccagattccagtagccacccctcaagtgtcccccaatacagtgaagagagcaggccctcgtttactccatcccaatggccagatcgtgcagctgcttccactgcaccagctgaggggctccaatactcagcctaacctccagccagtaatgtttagaaatcctggcagcgtcatgggcatccggttgccagctccgtcaaaaccgagcgagaccccaccaagctcaacctcgtcatctgcttttagtgtgatgaatcccgtgatacaagccgtgggctccagctctgcggtcaacgtgataacacaagctccctcattactgagtagtggcgcctccttcgtgtctcaggccgggacattaacgcttcgcattagcccaccagaaccacagtcgttcgccagcaagacgggttctgagaccaaaattacctatagctctgggggacagcctgtgggtacagcctccttgattccgcttcagtcagggagcttcgccttgcttcagctgcccgggcaaaaacccgtcccatctagcattctacagcatgtggcctctttacaaatgaagagagaaagtcaaaacccagatcaaaaggatgaaactaattcaataaaacgagaacaggaaacaaaaaaggttttacagtcagaaggcgaggcagtagatccagaggcaaatgtaatcaagcagaatagcggcgcagccacctcagaggaaactctgaacgattccctcgaagacagaggggatcatctggatgaggaatgcctgccagaggagggctgtgccaccgtcaagccatcagagcactcctgtataaccggctctcacacagaccaagattacaaagacgtgaatgaggagtatggtgctagaaatcgcaagtccagtaaggagaaagtggccgtgctggaggtcaggactatttctgaaaaggcttccaacaaaacagttcagaacctttccaaggtgcagcatcaaaaactgggagatgtgaaggtagaacagcagaaaggctttgacaatcccgaggagaactcatcagagttccctgtcacttttaaagaggaatccaaatttgagctgtctgggagcaaggtgatggagcagcagagtaacttacaacccgaggctaaagaaaaggaatgtggagactcgttagagaaggatcgcgaacggtggagaaaacatctaaaaggacctttgaccagaaagtgtgtaggggcatcccaggaatgtaaaaaagaggctgatgagcaactgatcaaggaaaccaaaacgtgccaagagaactccgacgtttttcaacaggagcaagggatctctgacttgttaggaaagagcggcatcaccgaagatgccagggttttaaaaactgagtgcgattcctggagtagaatctctaacccctcagcatttagcattgttccaagacgggccgctaagtctagcagaggtaatggccactttcaggggcacctgctcttgcctggcgagcagattcagcccaaacaggaaaaaaaaggcggtcggtcatccgctgattttacagttctggacctggaggaggacgacgaagacgataacgagaagacggatgactccattgacgaaatcgttgatgtggtctcggattaccagagcgaggaagtggatgacgttgagaagaataactgtgtggagtacatagaagacgacgaggaacacgtcgatatcgagactgtggaagaactgagcgaggagattaatgttgctcacttaaagactacggccgcacatactcagtcattcaagcaacctagctgtacacatatatcagccgatgagaaagcagccgaacgttcccgcaaggcgcctcctattcctctgaagctgaagcctgattactggtccgacaaactacagaaagaagcagaagcctttgcttactatcgtcgtacacataccgctaacgagcgaaggagacgtggtgaaatgcgcgacctttttgagaagttgaaaattacgctcggcctcctccacagctccaaagtatccaagtcgctgatactcacacgagctttttcagaaatacagggactgactgatcaggctgataaactgatcggccagaaaaacctgctgacacgcaagagaaacattctgataagaaaggtctcttctctgagcggcaaaaccgaagaggtggtgctcaaaaagctggagtacatctacgccaaacagcaagcactggaggctcagaagcgaaaaaagaaaatgggcagtgatgagttcgatataagtccacgtattagcaagcaacaggaaggttcctcagcctcttcagtggacctcggtcaaatgttcattaacaatcgacgcggcaaacccttaatcctgtcacggaaaaaggatcaggccaccgagaacactagtcccctcaatacacctcacacgtcagcgaacctagttatgaccccccagggtcagctgctaaccctgaagggacccctcttcagcggtccagtggtggccgtgtcacccgacctactggagtccgatttaaagcctcaggtggcaggcagtgccgtggctctgcccgagaacgatgacctgttcatgatgcctagaatagtgaacgtgacttccctcgctacagagggcggcctggtagatatgggaggatccaagtaccctcacgaggtgcctgacagcaagccctctgatcaccttaaggatacagtcaggaacgaggataacagtctggaggataagggcagaataagttcccggggtaatcgggatggccgagtcacacttgggcccactcaagtgtttctggcaaacaaggattcggggtacccgcaaatcgtggatgttagcaacatgcaaaaagcacaggagtttctgcccaagaagattagcggagatatgagaggcattcagtacaagtggaaggaatctgagtctcggggagagcgcgtgaagtctaaagattcgagcttccataaactgaagatgaaggacctcaaagattcatctatagaaatggagctgagaaaggtcacctcagcaatagaggaggcagccctggatagttctgagctgctcactaatatggaggatgaggacgatacggacgagacactgacctctctgctcaatgaaatcgcattcctcaaccagcaactgaacgacgatagcgtgggtctggccgagctgcccagcagtatggatacggagtttccaggcgatgcgagaagagcttttatctccaaagtgccaccaggcagcagagccactttccaggtcgagcaccttggcactgggctcaaagaattaccggatgtgcaaggtgagtccgatagcatctcccctctgctgttgcaccttgaagatgacgacttctctgagaatgaaaaacagctcgcggaaccagcctccgagcctgatgtgctgaaaatcgtgatcgacagtgagatcaaggactcactgctgagcaacaagaaggccattgacggcggcaagaacacctcaggcctcccagcggaacccgagagcgtttcatcacccccaactcttcatatgaaaacagggttagagaactccaactcaactgatacactctggcgccccatgcccaagctagccccccttggtttaaaggttgcaaacccatcaagcgacgcggacggtcaaagtctaaaggtaatgccgtgcctagccccgatcgccgccaaagtaggctctgtggggcataagatgaacctgacaggcaacgaccaagagggccgcgagagcaaggttatgccgactctggcacctgtggtggctaaattgggcaactccggggcatcgcctagcagcgctgggaagtag

SEQ ID NO: 194339 - DNA, 8571 bp, Artificial Sequence
  Description of Artificial Sequence: Synthetic coding sequence
atggaggagaagcagcagatcatcctggccaaccaggacggcggcacagttgcaggggccgccccaacattttttgtgatcctgaagcagcccggaaatggcaagaccgaccagggcatactcgtgaccaatcaggatgcttgcgcactcgcctcatctgtgagcagccctgtaaagtctaaggggaagatctgtctgcctgccgattgcactgtaggcggcatcactgtcactctagacaacaattcgatgtggaatgagttttatcatcggtccacagagatgatattgacaaaacagggaaggcgaatgttcccttattgccgatattggatcaccggtctggattccaatttaaaatatatcctcgtaatggacattagccctgttgataatcaccggtacaaatggaatgggcgatggtgggagccatccggtaaggccgagccgcacgtgctaggcagggtctttatccatcctgaatcaccctctactggtcactattggatgcaccagcctgttagcttttataagttaaaactcacaaataatacattggatcaagaggggcacatcatcttgcatagcatgcatcggtacctgccacggctgcacctcgtccccgcagagaaagccgttgaagtcatccagcttaacggacccggcgtgcacaccttcacatttccgcagaccgagtttttcgctgtcactgcataccaaaatatacagattacccagctcaagatagactataacccatttgccaaaggctttagagacgatggcctcaataataagccccagagggatggcaagcagaagaactcttcagatcaggagggtaataacatctccagctcaagtgggcacagagtccggcttaccgaaggccagggaagcgaaatccagccaggcgacttagaccccttatctcggggccatgagactagtgggaaaggcctcgagaaaacctctctaaatataaaacgcgacttcctcggatttatggacacagattcggctttgtccgaggtcccacagcttaagcaagaaatctcagaatgtctgatcgcctcatcattcgaggatgatagtagagttgccagtcccctggatcagaatggcagcttcaatgttgtgattaaggaagaaccccttgacgactacgactatgagctgggggagtgtccggagggggtgacggtcaaacaagaggagaccgacgaggaaaccgatgtgtacagtaacagtgacgatgacccgatcctggagaagcaactaaagaggcacaataaggtggataaccccgaggcagatcatttaagctctaaatggttaccgagcagtccgagcggggtggccaaagctaaaatgttcaagctcgataccgggaagatgccagtggtttacttggagccctgcgccgtgacccgctctactgtgaaaatatcagaactccctgacaacatgctatcaacctccaggaaggataagtcttcaatgcttgctgagctagaatacctaccgacctacattgagaattccaatgagaccgctttctgtttgggaaaagaatcagagaacggcctacggaaacactcccctgatctcagagtcgtacaaaagtatccgctgctgaaggaaccgcagtggaaatatcctgatatctctgactcgatttctaccgagaggatcttagatgattcgaaggacagcgtaggcgatagcctcagtggtaaggaagatctgggccgtaaacgaaccaccatgctgaagatcgccactgccgccaaagtagtgaacgcgaaccagaacgcctcccccaacgtgccgggaaagaggggcagacctcgcaaactgaaactgtgtaaggccggccgcccccccaagaatacgggcaaaagcctcatttcgaccaagaacactcccgtaagtccaggtagcactttccccgatgtcaagccagatcttgaggatgtggatggcgtcttgtttgtgagttttgaatcaaaagaagccctggacattcacgcagttgatggaaccacggaagaatcatcctccctgcaggcatccaccacgaatgactctggctatcgagcgaggatcagccaacttgaaaaagaattgatagaggatctgaaaaccttacgtcataaacaggtcattcaccccggactgcaagaggtagggctgaagctgaacagcgtggaccctactatgagcatagatcttaagtatctgggcgtgcaattacctctggcccctgctacatcttttcccttctggaatttgacgggcactaatccagcttcccccgatgcggggtttcctttcgtgagccgcactggcaagactaacgacttcacaaagatcaagggctggcggggaaaattccattctgcttccgcctctaggaatgaagggggcaactccgaatcctccctcaaaaatcggtctgccttttgttctgataagttggatgaatacctggagaacgagggtaagctgatggagaccagcatgggctttagctccaatgcacctacgagccctgtggtctaccagctgcccacaaagagtacatcttacgtgagaacgctcgactctgtgttgaagaagcaatccaccatctctcccagtacctcatattccctgaagcctcactccgtaccaccggtgtctcgcaaggcgaagtcccaaaatagacaagcgacgttctcaggaagaacgaagtctagttacaaatccattttaccttaccccgtgtcaccgaaacagaaatacagccacgtgatactgggagacaaagtgacaaaaaatagttctgggattatttctgagaatcaggctaacaatttcgttgtgcccacacttgatgagaacatcttccccaaacagatctccttgcggcaggctcagcagcagcagcagcagcagcagggatcacgacctcctggcctctcaaagagccaagtaaagttaatggatttggaagattgcgccctctgggaaggtaaaccaagaacttacataactgaggagagagccgatgttagcctgactactttgttgactgcgcaggcttcattaaagaccaaacctatccacaccatcatcaggaagagggcacccccctgcaacaacgacttttgtcgactgggatgtgtatgctcctcactggccctggagaagagacagcctgcacactgcaggcgccccgattgcatgttcgggtgcacatgtctgaaacggaaggttgtcctcgtcaagggcggcagcaagactaagcacttccagcggaaggcagcccaccgcgatcccgtgttctacgatactcttggggaggaggcacgggaggaggaggaaggcattcgggaggaggaggagcagctgaaggagaagaagaagaggaagaaattggagtatactatttgcgagaccgaacctgagcaacctgtgaggcattacccactgtgggtgaaagtggaaggggaggttgatccggaacctgtgtatattccgactccatcagtgatcgagccaatgaaaccactgctccttccgcagcctgaggtgctgagccctacagtgaagggtaagctcttgacaggcattaaatctccacgttcttataccccgaagcccaaccctgtgatcagggaggaggacaaagatcctgtgtacctgtatttcgaatctatgatgacttgcgctcgcgtgagagtctacgaacggaaaaaggaggatcaacggcagccttctagctcctcttcaccgagcccctcttttcagcagcaaacaagctgccatagctcaccagagaatcacaataatgcgaaggaaccagacagtgagcaacaaccactgaagcagctcacctgcgatctggaagatgactcagacaagctgcaggagaaatcttggaagagttcctgcaacgagggtgagtcctcaagcacctcgtatatgcaccagcgcagtcccgggggtccgaccaaactcatcgagatcatttccgactgcaattgggaggaggatcgcaataagatactatctattctaagccagcatatcaattcaaacatgcctcagtctctaaaggttgggtccttcatcatcgagctggcatcccaacgaaaatccaggggagaaaagaatcctccagtctactcctctcgtgtcaagatatcgatgccgagctgccaggaccaagacgatatggcggagaaatccggtagcgagacgcctgacggacccctatcgccagggaaaatggaggatatctcacccgtccagacggacgcactcgactccgtcagggaaagactccatgggggcaagggactccccttctacgccggcctttccccggcaggtaagctcgttgcatacaaaagaaagccatcaagttcaactagcggattaattcaggtggccagtaatgctaaagttgctgcatctaggaaaccccgtacactgcttccctctacgtccaactcaaagatggcgagttccagcggaaccgccactaatcggcctgggaagaacctcaaggcattcgtgcccgccaaacgcccaatcgaaaatgccgctcagatccccgtagccactcctcaggtttctcccaacaccgtgaaaagggcaggcccaagacttctgttaatcccagtccagcagggatcccccaccctgagacctgtctccaacacccaacttcagggccacagaatggtgctccagccggttcgctctccatcgggcatgaacctcttccgccatcccaatggtcagatcgttcaattgctgcctcttcatcagctgcggggctccaacacccaacccaatctgcagcctgtgatgttccgaaatcctggcagcgtgatgggcatcaggctgcctgcacctagcaaaccctcagagacccccccttcatcgaccagcagtagtgctttttcagtgatgaaccctgtgatccaggccgtaggtagtagctctgcagtgaatgtgatcacccaggcgccatccctgctgtcgagcggcgccagcttcgtttctcaggctggcactctcaccttgaggattagccctccagagcctcagagcttcgcatccaaaaccggctccgaaactaaaattacttactccagtggaggccagccagtcggaacagccagtttgattccgctacagagtggaagtttcgccctgttacaactccccggacagaagcctgtcccctcaagcatcctgcagcacgttgccagtttgcaaatgaaacgagagtctcagaatccagatcagaaggatgaaaccaactctatcaagagggaacaggaaaccaagaaagtgctccaatcggagggcgaagccgtggaccctgaggctaacgtaatcaaacagaacagtggcgctgcgaccagcgaagaaaccctgaacgatagtctcgaagacaggggagaccaccttgacgaggagtgccttccggaggaaggctgcgccaccgtaaagcccagtgagcactcctgtattaccggaagccacacggaccaggattataaggacgtaaacgaagaatacggcgcaaggaatcgcaaaagctcaaaggaaaaggtagcggtcctggaagtgagaaccatcagtgagaaagcttccaataagacagtccagaatctgtccaaagtccagcaccagaagttgggtgacgtcaaagtggagcagcaaaagggattcgataaccctgaagagaatagctccgaattccccgtaactttcaaggaagaatccaaatttgaactttctggcagcaaggtgatggaacaacaatctaatttacagccagaagccaaagagaaagaatgtggcgactcgctggaaaaggatagagaaaggtggaggaaacacctcaaagggcctctcacacggaagtgcgtcggggcttcccaggaatgcaagaaagaagccgatgagcagctgataaaggagacaaagacgtgtcaagaaaactccgatgtcttccagcaagagcaaggaattagcgacctgctcggaaagtctggcatcacagaagacgctagggtgttgaagacagagtgtgactcttggagtcggattagtaatccttcagccttcagcatcgtaccgcggagagccgccaaaagctcccggggcaatggacattttcagggccacctccttctcccaggcgagcaaatccagccaaagcaggagaagaaagggggaagatccagtgctgactttaccgtcctcgacctagaggaggatgacgaagatgataacgaaaagacagacgattccattgacgagattgtggatgtagtttcagactaccagtcagaagaagtggacgatgtggagaagaataactgtgtggaatatattgaggacgatgaggagcatgtagatatagagactgtggaggagctcagcgaagaaataaacgtcgcacaccttaaaaccaccgcagcccacacacagtcatttaagcagccatcgtgcacccacataagtgcagacgagaaggccgccgagaggtcacgcaaagcccctcctatccccctcaaactcaaacccgattactggagcgataagcttcagaaagaggccgaggccttcgcctattaccgccgcacccacaccgcgaacgaacgacggagacgaggggaaatgagggatctattcgaaaaattgaagatcactctagggcttctgcacagctctaaggtgtccaagtcactaatcttgacccgcgctttcagtgaaatacaggggctcaccgaccaagccgataagcttattgggcagaagaacctgttgacgaggaaacgaaatattttgatccgcaaagtgtcttcattgtccggcaagacggaagaagtagtgctaaaaaagctcgagtacatctatgctaagcagcaagcactcgaagctcagaagcgtaaaaagaaaatgggatccgatgaatttgatatctcccccaggatatctaaacagcaggaagggagcagtgcgtcctccgtggacctcggtcagatgttcataaacaaccgaaggggaaaaccgttaatcctgtcccggaaaaaagatcaggccacagagaatacttcccccctgaacaccccgcacacgtcagccaatctggttatgactcctcagggtcagctgctcacccttaaagggccgctgttctcaggacctgttgttgctgtgtccccagacttattagagtctgacttgaagccacaggtcgccggatccgccgtcgctctgccagaaaatgacgatctgttcatgatgccccgaattgtcaacgtgacatcactcgctaccgagggagggttggttgatatggggggcagtaagtatccccatgaggtcccagattccaagccgagcgaccatctgaaggataccgtaaggaatgaggacaattcactggaggataagggccgaatatctagccgggggaatcgagatggtcgcgtcaccctggggcctacccaggtgttcctagctaataaggacagtggctacccccagattgtggatgtgtccaatatgcagaaggcacaggagttcctccctaagaaaatttctggagacatgcgagggattcagtataagtggaaagaaagtgagagcaggggtgagcgggtgaagtccaaggacagcagttttcataagttgaagatgaaggacttgaaagactccagcatcgaaatggagcttagaaaagtgacttcagccattgaggaagctgccctcgatagcagcgagttactcaccaatatggaggatgaggatgacacagacgagaccttaacatctctcctcaacgaaatagcatttctgaaccagcagctgaatgatgactcagtgggcctagccgagttgccctcatcaatggatactgagtttcccggtgatgctagacgcgccttcatatccaaggtgcctcccggctccagagctacgttccaagtcgagcacctgggcaccgggctgaaggaacttcctgatgtgcagggagagtccgatagcatttcgcctttgctgctgcatttagaggatgacgatttctcagagaacgagaaacagttagccgagcccgcaagcgaacccgacgtactgaagatagtgattgactcagaaatcaaggattccttattgtctaataagaaagcaatcgacggcggcaagaacacatccgggctccccgcagagccagagtccgtgtccagccctccaaccttacatatgaaaaccgggctcgagaattcaaacagtactgataccctctggagacctatgcctaagctcgcccccctcgggttaaaagtggccaacccaagctcagatgccgacggacagtctctaaaagtaatgccatgtctcgcccccatagccgccaaggtggggagtgtgggacataagatgaatctgacagggaacgaccaggaaggcagggagtcaaaagtgatgccaaccctcgcgcctgtggtggccaagctggggaattccggcgcttctcctagctccgccggcaaatag

SEQ ID NO: 194340 - DNA, 687 bp, Artificial Sequence
  Description of Artificial Sequence: Synthetic coding sequence
atggagcgggtgaagatgatcaacgtgcagcggctgctggaggccgctgagtttttggagaggcgggagcgggagtgtgagcacgggtacgcatcctcgttcccctcgatgccgagtcctcggctgcagcactcgaaacccccacgtcgcctgagccgtgcccagaaacattcaagcggctcctccaacacttcaaccgccaaccggtccacacataatgaattggaaaagaatcgtcgggcccatctgagactctgtttagaacgtttgaaagtgctcatcccccttggcccagattgcacaaggcacaccactctaggcctgctcaataaggctaaggcccacataaagaagcttgaggaagctgagcgaaaatctcaacaccagttggagaaccttgagcgcgagcagaggttcctaaagtggcgcctagagcagctgcaggggccacaggagatggaacgtattcggatggattccattggctcaacaatcagttcagaccgatccgactctgaaagagaagagattgaagtggacgtcgagtcaaccgaattttctcacggtgaagtggacaacattagtaccacctctattagtgacattgacgatcattcaagcctcccctctattgggagcgacgaagggtactcttctgcctctgtcaaactcagttttacatcttag

SEQ ID NO: 194341 - DNA, 888 bp, Artificial Sequence
  Description of Artificial Sequence: Synthetic coding sequence
atgggcaagcggggccggccccggaaggaggcccggtgcgagggcgccggactggcaccagctgctccccccgcggtgccacccgccgtggccgctccacagcctcccgctctccccgaggaccccgctggagcaaagcctaggtgtcccttttctgatatttttaatacaagtgagaattccatggagaaacatatcaatacattccttcagaatgtacagattctcctggaggctgcttcatacttagagcaaatcgagaaagagaataagaaatgcgagcatggatatgctagtagctttccctccatgccgtctccgcgactccagcatagtaagcctccacggagattgagcagggcccaaaagcacagtagcggcagttccaacacaagcacagcgaatcgaagcactcataacgagttggagaaaaatagacgcgcgcaccttagactgtgtctagaacgcctcaaagtcctgataccactgggaccagattgtacccgccacaccaccctcggattactgaacaaggccaaggctcatatcaagaagctggaggaggcagagcgcaagagccaacaccagttggagaacctcgaaagagagcagagattcctgaaatggcgccttgaacagttgcagggaccccaagagatggaacggatccgcatggactctataggatctacgataagtagcgaccgctcagattccgagagagaggagatcgaggtggacgttgagtccactgagttcagtcacggcgaagttgataacattagtaccacgagtatttcggacatcgacgaccactcctcacttccatctatcgggtccgatgagggatacagctcggctagcgtcaaactgtcattcacttcctag

SEQ ID NO: 194342 - DNA, 549 bp, Artificial Sequence
  Description of Artificial Sequence: Synthetic coding sequence
atgcccagcccccggctgcagcacagcaagcccccccggcggctgtctagagctcaaaagcattctagtggctcctccaacaccagcaccgcaaaccggcgtgctcaccttagactgtgcctagagagattgaaagtgctgatccctctgggaccggattgcactaggcatactaccctgggtttactgaataaagccaaagctcatatcaaaaaactggaggaagctgagaggaagtctcaacaccagttggagaatctcgagagagaacagaggtttctgaaatggcgcttagagcagctacaaggaccacaggagatggaacggatccgtatggacagcatcggctccacaatatcatccgaccggtcagactccgaaagagaggaaatcgaggtggatgtggaatcaacagagttttctcatggagaggtcgacaacatctccactacaagcatctctgatattgatgaccacagcagtctgccgtccatcggcagtgatgagggctactcctcggccagcgtcaagctgagcttcacaagttag

SEQ ID NO: 194343 - DNA, 579 bp, Artificial Sequence
  Description of Artificial Sequence: Synthetic coding sequence
atgcccagcccccggctgcagcacagcaagcccccccggcggctgtcccgagcacagaaacattcgtccggcagctccaatacctctaccgcaaaccgctccacacacaacgagttagagaagaaccgaagagcacacctaagattgtgtctagagagactgaaggtgctgatccctctcggtcctgactgtacccgacacactacacttggtctgcttaacaaagccaaggcacacatcaaaaaactcgaagaggcagaacgcaaaagtcaacatcagttagagaacttggaacgcgagcagagattcctaaagtggaggctggaacaattacagggcccccaggaaatggaaagaatcaggatggatagcataggtagcacgatatcctctgatcgctccgattcggaacgcgaggagatcgaagtggatgtggaatcaaccgaattctctcacggcgaagtcgataatatcagtacaaccagcatctccgatatcgatgatcactccagccttccaagtattggttccgatgaaggctacagcagcgcgtcggttaaactgtccttcacctcctag

SEQ ID NO: 194344 - DNA, 579 bp, Artificial Sequence
  Description of Artificial Sequence: Synthetic coding sequence
atgcccagcccccggctgcagcacagcaagcccccccggcggctgtcacgagcacagaagcatagttccggttcctccaacacctcaaccgccaaccgaagcactcataacgagctggagaaaaatcgccgtgcacacctgagactgtgtctggaacgtctcaaagtcctgattccactcggcccagactgtacaaggcacactacgctaggtttactgaacaaagctaaagctcacatcaagaaactggaagaagccgagagaaaaagtcaacaccagcttgaaaatctcgagagagagcagaggttcctgaagtggagacttgagcagcttcaggggccacaagagatggaacgaatacgcatggatagcattggatctacaatttcgtccgaccgcagcgacagtgaaagggaggagatcgaagttgacgttgagtccactgagttcagccacggagaagtagacaacataagcaccacttctatctccgatattgacgaccacagctccctgcccagcattgggagtgacgaggggtacagttccgcttctgttaagctgtctttcacatcatag

SEQ ID NO: 194345 - DNA, 579 bp, Artificial Sequence
  Description of Artificial Sequence: Synthetic coding sequence
atgcccagcccccggctgcagcacagcaagcccccccggcggctgtctagggcccagaaacatagcagcggctcctcaaacacatccaccgccaatcggtcgacccataatgagctcgagaaaaaccggcgtgctcacctgcgcctgtgtctggagagacttaaggttcttatcccgttgggtcctgactgtacccggcacaccaccttaggactgcttaacaaagccaaagcacacattaagaagctggaggaagcggagagaaagagtcagcatcaactcgaaaacctggaacgcgagcagcggttcctaaaatggcgtctcgaacagctccagggcccccaggaaatggaacggattcgaatggactccattgggtcaaccatttcgtccgatagatccgattcagagcgcgaggaaatcgaagtcgatgtggagtctaccgaattttctcacggggaggtagacaacatctcaaccacgagcatctcggacatcgacgaccatagtagtttaccgtccataggcagtgatgaaggatatagcagcgccagcgtaaaactatcttttacctcgtag

SEQ ID NO: 194346 - DNA, 657 bp, Artificial Sequence
  Description of Artificial Sequence: Synthetic coding sequence
atggagcgggtgaagatgatcaacgtgcagcggctgctggaggccgcagaattcctggaaagaagggaaagagagtgcgaacacgggtacgcctcctccttcccatcaatgccttcccctaggctgcagcattccaagccaccccggcgtctatccagggcacagaaacactctagtgggagctctaacactagcaccgcaaatcggcgcgcccacctcaggctctgccttgaacgactcaaggtgttgatcccactgggtcctgattgtacccggcataccaccctcggcctgctcaataaggccaaggcacacataaaaaagctcgaagaagccgaaagaaaatctcagcaccagctggaaaatctggaacgcgaacagcgcttcttaaaatggcggctggagcaactgcagggaccccaggaaatggagcggatacgcatggactccattggctctaccatttccagcgataggtcagatagtgaacgggaggagatcgaagtcgatgtggagagcactgagttctcccacggggaagtcgacaatattagtactacttcgatatccgacatagacgatcatagctccttgcccagcattggatccgatgagggttatagctccgccagcgttaaactgagcttcactagctag

SEQ ID NO: 194347 - DNA, 657 bp, Artificial Sequence
  Description of Artificial Sequence: Synthetic coding sequence
atggagcgggtgaagatgatcaacgtgcagcggctgctggaggccgctgagtttctggagagacgggaaagagagtgcgaacatggctatgcttcttcctttccctctatgccctccccgcgactgcaacacagcaaaccccctcgccgactgtcccgggctcagaaacattccagcggatcctccaatactagtaccgccaataggcgagcgcacctgaggctctgtctggagaggctgaaggtcctgattcccctgggccctgattgtactagacacaccacccttggactcctgaataaggcgaaggctcacatcaagaagctcgaagaagcagagcgtaagagtcaacatcagctggaaaatcttgagagggagcagcgatttttgaaatggagattggagcagttgcaggggccacaggagatggagcgaatacgtatggactccatcgggagcacaatcagcagcgataggtctgattccgaacgagaggagatcgaggtggatgtggaaagtactgagttctcccacggtgaagtcgataacatttctacgacaagcattagtgatattgatgatcactcatcccttccctctattggctctgacgagggatacagtagcgcaagcgtgaagttgagttttacctcctag

SEQ ID NO: 194348 - DNA, 357 bp, Artificial Sequence
  Description of Artificial Sequence: Synthetic coding sequence
atgcccagcccccggctgcagcacagcaagcccccccggcggctgtccagggcccagaaacactcaagtggctctagtaatacatctaccgctaatagaagcacacataatgagctcgagaagaaccgacgcgcacacttaaggctgtgcctggaacgactcaaggtgttgattcccctgggccctgactgcacaagacacactacgctcggtctgttgaacaaagctaaagcccatatcaagaaactggaagaggctgagcggaaatcccaacatcagcttgaaaatctcgagcgggaacagaggttccttaagtggagattggagcagctccagggacctcaggaaatggagtag

SEQ ID NO: 194349 - DNA, 681 bp, Artificial Sequence
  Description of Artificial Sequence: Synthetic coding sequence
atgggcaagcggggccggccccggaaggaggcccggtgcgagggcgccgggctggcgccggcagccccgcctgctgtccctcccgccgtcgctgctccccagccacctgcccttcccgaggatccagctggcgcaaagccccggtgccctttctcagatattttcaataccagcgagaacagcatggaaaagcacattaacacctttctccagaacgtgcagatcctcctggaggccgccagctatctagaacaaatcgagaaagagaacaaaaaatgtgaacatggttacgcttcttcgttcccttccatgccatctcccagattgcaacatagcaaaccacctagaagactgtcacgagcccagaagcactcaagcggatccagtaacacatcaacggccaatcggcgtgcccacctgaggttatgtcttgagcgccttaaggtgctgatcccactggggccggactgtacccggcataccaccttgggcctgctgaataaagccaaagctcatattaagaagcttgaggaggcggagcgaaagagccaacaccagctagagaacctcgagagagaacagagattcctgaagtggcgcttagagcagctgcaggggccgcaggaaatggaacggatcagaatggacagtatcggcagcactatctccagtgatcggtag

SEQ ID NO: 194350 - DNA, 897 bp, Artificial Sequence
  Description of Artificial Sequence: Synthetic coding sequence
atgaccgagcccggcgccagccccgaggacccctgggtgaaggcctctcctgttggggctcacgccggggaggggagggctggtagggctagagcacgtaggggggctggtagaaggggagcgtccctgctatccccaaaatcacctaccctgagcgtgcccagaggctgtagagaagacagcagtcaccctgcctgcgccaaggtcgagtacgcttacagcgataattctttagatcccgggttattcgtcgagagcacacgaaaaggcagcgttgtgtcaagagcaaattcgatagggtcgacatctgcgtcctcagttcccaataccgatgatgaggacagtgactatcatcaggaggcttataaggaatcctacaaagatcgccgcagacgcgcgcatacccaggctgagcaaaagaggcgggacgcaatcaaaagagggtacgacgatttgcaaacaattgttccaacctgtcagcagcaggatttctccattggttcgcagaagctttccaaggccatcgtgctccagaagactattgattacatccagtttctgcacaaggaaaagaaaaagcaggaagaggaagtctcgacattgagaaaggatgtaaccgcactgaagattatgaaagtgaattacgagcagattgttaaagctcatcaggacaatcctcatgagggagaggatcaagtgtccgaccaggttaaattcaacgtattccaaggaataatggactccttgttccagtccttcaacgcatccatttccgtggctagcttccaggagctgtctgcctgtgtctttagttggatcgaagaacattgcaaaccacagacccttagagagatagtgattggagtgcttcaccagctcaagaaccagctgtattag

SEQ ID NO: 194351 - DNA, 645 bp, Artificial Sequence
  Description of Artificial Sequence: Synthetic coding sequence
atgaccgagcccggcgccagccccgaggacccctgggtgaaggtggaatacgcctattccgacaatagcctggatcccgacgatgaggattctgattatcaccaggaagcttacaaggagtcatataaggataggagaaggcgtgctcacacccaggcagaacagaagaggagagacgcgatcaaaagaggctacgatgatttacaaaccatagttcctacatgtcagcagcaagatttcagtatcggctcccaaaaactatctaaggcaatcgtcctccagaagactatagattacatccaattcctccataaggagaagaaaaagcaggaagaggaggtatccactctgcgtaaagatgttacagcactcaagatcatgaaagtcaactatgaacagattgtaaaagcacatcaggacaacccccacgagggtgaggatcaggtgagcgaccaggttaagttcaacgtttttcagggcattatggacagcctctttcagtcctttaacgcatctatttcagtagcaagtttccaggagctttcagcctgcgtgttcagttggatagaggaacactgcaaaccacagacgttacgtgagattgtgatcggagtgctacatcagctcaaaaatcagctgtattag

SEQ ID NO: 194352 - DNA, 735 bp, Artificial Sequence
  Description of Artificial Sequence: Synthetic coding sequence
atgaccgagcccggcgccagccccgaggacccctgggtgaaggtggagtacgcctacagcgataactccctcgacccagggctgttcgtcgaatcaacccgcaagggaagcgttgtgtccagggcaaacagcatcggtagcacaagtgcttcctccgtacccaacaccgacgacgaagacagtgattatcaccaggaagcttacaaagaaagttacaaggaccggcgccgacgggctcacactcaggcagaacagaagcgtagagatgctatcaagaggggttacgatgatctccagaccatcgtaccaacgtgccaacaacaagatttcagcatagggtctcagaaactgagcaaagctatcgtactgcagaaaactatagattacatccagttcctgcacaaagagaaaaagaaacaagaagaagaagtgagcacactgcgaaaggacgtcactgccctgaagataatgaaggtgaactacgaacagattgtcaaggcccaccaggataatcctcacgagggggaggaccaagtttccgaccaggtgaaattcaacgtcttccagggtatcatggattcactattccagagctttaatgcttcaatttccgttgctagcttccaggaactctcagcctgcgttttttcttggattgaggaacactgcaaaccccaaacactgcgcgagatagtcatcggagtgctgcatcaattaaaaaaccagctctattag

SEQ ID NO: 194353 - DNA, 2826 bp, Artificial Sequence
  Description of Artificial Sequence: Synthetic coding sequence
atggccgaggccaacccccggcggggcaagatgcggttccggcggaatgcagcaagtttcccaggaaatttacacttggtgctcgtgctgaggccaacgagcttcctccagcggacgttcaccgatattggcttttggtttagtcaggaggatttcatgcttaagctccctgtggttatgctctcatctgtcagcgatttattaacctacattgatgataagcagcttacacctgagcttggtggtaccctccagtattgtcattctgagtggatcattttcaggaatgccatcgagaatttcgccctgactgtcaaggagatggcccagatgctgcagagttttggaaccgagctggcagaaacggaactgcccgacgacatcccatccatcgaagagattctggcaatcagagctgagcgttaccacttgctcaaaaatgatattactgcggtgactaaggaggggaaaattcttctcactaatcttgaggtgcctgataccgagggtgccgtctctagccgactcgaatgtcaccgccagattagcggcgactggcagaccatcaacaaattgttaacacaggtacacgatatggaaacggccttcgatgggttctgggagaaacaccagttgaagatggagcagtatcttcagctctggaagttcgagcaggactttcagcagcttgtaaccgaggtcgagttcctgctcaatcagcaggctgaactcgccgatgtaaccggaacgatcgcccaggtcaagcagaagattaaaaaactggagaatctggacgagaatagtcaagaactactgagtaaggctcaattcgtcatcctgcatggccacaagctggccgctaaccaccactatgcactagacttgatttgtcagcggtgtaatgagctccgctatctgtccgatattctggtgaatgaaatcaaggctaagcgcatccagctcagcagaacattcaaaatgcacaagttgctccaacaggcccggcaatgctgcgacgagggtgagtgcctgttagcaaaccaagaaatagacaaatttcaatcaaaagaagatgcgcagaaggctctccaggacatcgaaaattttctcgaaatggcactgccctttatcaactacgaacccgaaacattacagtatgagtttgatgtgatcctgagccctgagcttaaggtccaaatgaaaaccattcagctcaaacttgagaatatcaggagcatatttgagaatcagcaggccggatttcggaatctggctgataaacatgtgagacccatccagttcgtggtgccgactccagagaatttggtgacctctggaacacccttcttctcttccaagcaggtgggtgtgggttattccttcttccaggcctgcaagctgttcagtaaaggcaagaagacctggagacaaaaccagagtaatcttaagattgaagttgtgcccgattgtcaggagaaaagaagtagcggtcccagctcttcactcgacaatggcaactcgctggatgtcctgaagaatcacgtgttgaatgagcttatccaaactgagcgagtatatgtcagagaactgtataccgtgctactgggctatagagctgaaatggataatcccgagatgtttgatctgatgcctcctctgttgaggaataagaaggacattctgtttggcaacatggcggagatctatgagttccacaatgacatcttcctttcttcactcgaaaactgcgctcatgcccccgaacgagtggggccttgcttcttggaaaggaaggatgactttcagatgtatgccaagtactgccagaataagcctcggtccgaaacgatctggaggaaatattccgagtgcgctttcttccaagaatgccaacgaaagctaaagcaccgccttagactggattcgtacttgctgaagcccgttcaacgcataaccaaatatcagttgctgttgaaagagctcttaaagtactccaaggactgcgagggatctgccctcctgaaaaaggcccttgatgcgatgttggacttactcaagagcgtaaatgatagcatgcatcagattgctattaacggctacattggaaatctgaatgaactggggaagatgataatgcagggagggttctccgtttggattgggcacaagaagggcgccacaaagatgaaagacttggccaggtttaagcctatgcaaagacacttgttcctctatgagaaagccatagtcttctgtaagaggcgggttgaaagcggcgagggatccgaccgctacccctcgtactcattcaagcactgttggaagatggacgaagtaggaattactgagtatgtcaaaggtgacaatagaaaatttgaaatctggtacggggagaaggaggaggtttacattgtgcaagcttcaaacgtcgacgttaagatgacctggctgaaggaaatacgaaatatacttcttaaacagcaagagctcctcactgtgaagaaacgcaaacaacaggatcaactgaccgagcgagataaatttcaaatatctctgcagcagaatgacgagaagcagcaaggagcatttattagtacagaggaaaccgaactagaacatacctccaccgtggtggaggtctgtgaggctatagcctctgtccaggcagaagccaacaccgtgtggaccgaagcaagtcaaagcgcggagatctctgaagagcccgctgaatggtctagtaactacttttatcccacctacgacgagaacgaggaggagaacaggcccctgatgagacccgtatcagagatggctttgctgtactag

SEQ ID NO: 194354 - DNA, 2583 bp, Artificial Sequence
  Description of Artificial Sequence: Synthetic coding sequence
atggccgaggccaacccccggcggggcaagatgcggttccggcggaacgctgccagctttccagggaatctgcacctcgtgcttgtactaaggcctacatcattcctccagagaacattcactgacatcgggttttggttttctcaggaagactttatgctcaagcttccagtggtcatgctgagtagcgtctccgacctcctgacttatatcgacgacaaacagttgacccccgaactaggcgggaccctgcagtactgtcattctgagtggataatatttcggaacgccattgaaaactttgctctgacggtaaaagaaatggcccagatgttgcagtcatttggaacagagctggccgagaccgaactgccagacgatatcccgtcgatcgaagaaatcctcgcaatccgagcagagaggtaccatttgctaaagaacgacattactgccgttaccaaagaaggaaagattctgctgaccaatttagaagttcccgataccgaaggcgccgtctcgtccagacttgagtgtcatagacagatttctggggactggcagaccatcaacaagctgctcacacaggttcatgacatggagacagcatttgatgggttctgggagaagcatcagcttaagatggaacagtacctgcagctgtggaagttcgagcaggatttccagcagcttgtcacagaagtggagtttctcctgaatcagcaggcagagctggcagacgtgaccggaaccatcgcacaggtgaagcagaaaattaagaagctggagaatctggacgagaattctcaggagctcctgagtaaagcccagtttgtgatccttcacggccacaaactggccgcgaaccatcattatgcactggacctcatctgtcagaggtgtaatgagctgagataccttagtgatatactggtgaatgagataaaggcaaagagaatacaactgtcacgcaccttcaagatgcacaaattattgcagcaggcccggcagtgctgcgacgaaggagaatgtctcctggctaaccaggaaatcgataaattccagtccaaagaggatgctcagaaagctctgcaagacatcgagaatttcctggaaatggcccttccatttattaattatgagccggagacattgcagtacgaatttgacgtgatcctgagtcctgagctgaaggtgcagatgaaaacgatacaactgaagctggagaatattcgcagcatcttcgagaaccaacaggctggcttcagaaatctcgccgacaaacatgtcaggccaatccagtttgtggtgcctactccggagaacttggttacaagtggcacaccttttttcagttctaagcaaggaaaaaaaacatggaggcaaaatcaaagcaaccttaagatagaggtggtgcccgactgccaggaaaagcgatcgtctgggcctagttcttcgcttgataacggaaactcactggacgtactgaagaaccacgtgctcaatgaactcatacaaactgagagggtgtacgttagggaactctacacagtcttactgggttacagagctgagatggataacccagaaatgtttgatcttatgcctcctttattgcgcaataagaaggatatcctgtttggcaatatggcagagatctatgagtttcataacgatatttttctctcctctctcgagaattgtgctcacgcccccgaaagggtcgggccctgcttcttggagcgcaaggacgatttccagatgtacgctaagtactgtcaaaacaagcctcggagtgagaccatctggcgcaaatattccgaatgcgctttctttcaagagtgccagcggaaactcaagcatcgcctgcgtctggatagctacctcctgaagcccgtgcaacgcatcactaaatatcaacttctgctgaaagaactgttgaagtacagtaaagattgtgaaggaagcgcattgctcaagaaagctttggacgcaatgcttgatctcctgaaatccgtcaatgacagcatgcatcaaatcgccatcaatggatatattggaaacctcaatgaactcgggaagatgataatgcagggaggcttctctgtctggattggccataagaaaggagctacaaagatgaaggacctcgccagatttaaacccatgcagcgccacctgttcctgtatgagaaagccattgtgttttgcaaacgtcgcgtagagtccggcgagggctccgatagatatccctcctacagcttcaagcactgctggaagatggatgaggtcgggataaccgagtatgtaaaaggagacaaccggaaattcgagatctggtacggtgagaaggaggaggtatacattgtgcaggccagcaacgtggatgttaaaatgacctggcttaaggagattaggaatatccttctgaaacagcaagaactgctcaccgtgaaaaagaggaaacagcaggaccagctaacggaacgagacaaatttcagatttctctgcagcagaatgatgaggacctatgccgtcgttggctgtcatacatagacgaggcaaccatgagtaatggaaaatag

SEQ ID NO: 194355 - DNA, 2778 bp, Artificial Sequence
  Description of Artificial Sequence: Synthetic coding sequence
atggccgaggccaacccccggcggggcaagatgcggttccggcggaatgccgccagcttcccaggcaatttacatctggtgttagtcttgagacccacttcttttttgcagaggactttcactgacattggcttttggttctcacaggaggattttatgctgaagctaccagtcgtaatgctgtcctctgtgagcgacctgctgacatacatcgatgacaaacagctgacgccagaactgggagggaccctgcagtattgtcattcagagtggatcatatttcggaacgccatcgaaaatttcgccctgaccgtaaaagaaatggcgcagatgctccagagttttggcacagagctggccgaaaccgagctaccggacgatatcccctccattgaggaaattctggcaattagagccgaaagataccaccttttgaaaaatgacatcaccgcggtcactaaagagggaaaaatccttctgaccaacctagaggttcctgacaccgaaggagctgtgagtagtaggcttgagtgtcatcggcagatttccggtgactggcagaccattaacaaactgctcacacaggttcacgacatggagacggcgtttgacggattctgggagaaacaccaattaaaaatggaacagtatctgcagctgtggaaattcgaacaggattttcagcagttggtgacagaagtggagttcctcctgaatcagcaagcggaattggccgacgttacaggcacgatagcccaggtgaagcaaaaaattaaaaaacttgagaacctagacgaaaattcccaggagttattgtctaaggcccagttcgtcatcctgcatgggcacaagttggcagctaatcatcactatgccttagaccttatttgtcagcggtgcaatgagctgagatatctctcagacatacttgtgaatgagattaaagcgaaaagaatccagttgtccaggacgttcaaaatgcataaacttctgcagcaagctaggcagtgttgtgacgaaggcgaatgcctgctggccaaccaggagatagataagttccagagtaaggaggacgcccagaaagccctccaggacattgagaatttcctggaaatggccctgcctttcatcaactatgagccggagacgcttcagtacgagtttgatgtcatactgtccccagaattgaaggtccagatgaagacaatccaacttaaactcgaaaatatcagatctatctttgagaatcagcaagccggattccggaacctcgctgataagcacgtacggcctatccagttcgtggtgccaacacccgaaaacctagtcactagcggaacaccgttcttcagctccaaacagggcaagaaaacctggcgacagaatcagtctaatctcaagatagaagtggtccccgattgtcaggaaaagagatcctctggcccaagttcttcactagataacggtaactcacttgacgtgttgaagaaccacgttcttaacgaacttatccagactgagagagtgtacgtcagagagttgtacactgtgctcctggggtatcgggccgagatggacaatccagaaatgttcgacttgatgccacctctactccgaaataaaaaggatatcctattcgggaacatggcagaaatatatgaatttcataacgatatatttttgtcctctttggagaattgtgctcatgctcctgagagggttggaccctgttttttggagcgcaaagatgatttccagatgtatgctaaatattgtcagaataaaccccgatctgaaaccatttggcggaaatacagcgagtgcgctttcttccaggaatgccagaggaagctcaaacacaggcttcggctggatagctatctcttgaagcctgtgcagagaattacgaagtatcagctgctccttaaggagctgttaaagtacagtaaagattgcgaagggtcagccctgctaaagaaggccctggatgcaatgctcgatctgctgaaatcagtcaacgatagcatgcatcaaatcgctattaatgggtacattggtaatctcaatgaactgggaaaaatgatcatgcaaggaggattcagtgtctggatcggccataagaaaggggccacaaaaatgaaagatctagcacgctttaaaccaatgcagaggcaccttttcctctacgagaaggccatcgttttctgcaaaaggcgggtggagtccggggaagggagcgaccggtatcccagttattcatttaaacactgttggaagatggacgaggtgggaatcacagaatacgtgaagggggataacaggaaatttgaaatctggtacggcgaaaaggaggaagtgtatatagtccaggcttctaacgtcgacgtcaagatgacatggctaaaggagatcaggaatatcctgctgaagcagcaggaactgctgaccgtcaaaaaacgtaagcaacaggaccagctgacggaaagagataaatttcagatctccctgcagcagaatgacgaaaagcagcagggagcctttatcagcacagaagagaccgaacttgaacacaccagcactgtcgtcgaagtctgcgaggctatcgccagcgtccaggccgaggcaaacaccgtttggactgaggccagccagtcagctgagatctccgaagagcctgctgagtggtctagcaactatttctatccgacatacgatgaaaatgaagaggagaaccggccactcatgagacctgtgtcagaaatggctcttttgtactag

SEQ ID NO: 194356 - DNA, 3213 bp, Artificial Sequence
  Description of Artificial Sequence: Synthetic coding sequence
atgccccaggccgccgccagcgccccctggaccagcgtgagctgcggtcgaattccaggcctgccccagaacccagatggttgcacattcatgccaatcgctcaggcaattcctctacaggttgacatggcaatggccctccagagagtcaggattgcagagaaatatgggaagaactacctttgcttactgcaggcagtctttgtggccgagaccgatctgcttctgcggataaaggacatcagccactttctcatgcaagacattgccttccttagcggggggcggggaaaggacaatgcttggattatcaccttcccggagaactgtaatttcaggtgcatcccagaagaggttatcgcaaaagtcctgacgtatttaaccagtatcgctcgacagaatgggtccgatagtcggtttaccatcatcctggataggagactggacacctggtcctctctcaagattagcctgcagaagatttcagcaagttttccaggcaacctgcacttagtcttagtcctgagacccacctcttttttgcagcggacttttactgacattggattttggttcagtcaagaggattttatgttgaaattgccagtcgtcatgcttagctcagtaagcgacctactgacatatatcgatgacaagcagctgaccccagaactgggcggcactttacagtactgccacagcgaatggataatcttcaggaatgcaattgagaactttgcccttaccgtgaaagaaatggcccaaatgctgcagagctttggtaccgaactcgcagagaccgagcttcccgatgacatcccatcaatcgaggagatcctggctattcgcgctgaaaggtatcacttgctgaaaaatgatattaccgcagtcaccaaagaaggcaagatcttattgacaaatcttgaggtccctgacactgaaggagccgtgtcaagtcgcttagaatgccacagacagatcagtggtgattggcaaactataaataaactattgacccaagtccacgatatggaaaccgcattcgatggcttttgggagaagcaccagttgaagatggaacagtacctgcagctttggaagttcgagcaggatttccagcagctcgtcactgaggttgaattcctgcttaaccagcaggccgagttagcagatgtcaccggaacgattgcccaggtaaagcaaaagatcaagaaactggagaacctggacgaaaactctcaggaactcctctctaaggctcaatttgtaatcttacatggtcataagctggctgcaaatcaccattacgcacttgacctcatatgccagcggtgcaacgagttgcggtatctcagcgatatactcgtgaacgagataaaagccaagcggatacaactttctcgaacctttaagatgcacaagttactgcagcaggcacgccagtgctgcgacgagggtgaatgtcttctagcaaatcaagagattgataaattccaatcgaaggaggacgcacaaaaggcactgcaagatatcgaaaatttcctggagatggccctcccattcatcaattacgagccagagaccctgcagtatgagtttgacgtgatattgagccccgaactgaaggtgcaaatgaagaccatccagctgaagttagagaatatcaggtcgattttcgagaatcaacaggctgggtttcggaacctggccgataagcatgtgcgccccatacagttcgtagtgcctacccctgagaatctggtgacttctggtacgccttttttctcgtcaaaacaggggaaaaagacgtggcgacagaatcagtccaatttaaagatcgaggtggtccccgattgtcaggagaaacgaagcagtgggccttcttccagtctggacaatggaaactcattagacgtgctcaagaatcacgttctcaacgaactgatccagacagagcgggtctacgtccgcgagctgtacacagtgttgttaggttatcgcgccgaaatggacaatcctgagatgttcgatcttatgcccccactgctgagaaacaaaaaagatatactgttcggtaacatggctgaaatctatgagttccataacgatatcttcttgagctctttagaaaactgcgcccacgctccagagagggtgggcccttgctttctggagagaaaggatgattttcaaatgtacgctaagtactgtcagaacaaaccccgctccgagaccatctggcgcaagtactcagaatgcgctttctttcaggaatgccagcggaaattaaagcaccggctgagactggacagctaccttctgaagccagtgcagaggattacaaaatatcaactgctgttgaaagagctgctgaagtatagtaaggactgtgaaggtagcgccctgcttaagaaggccctagacgccatgcttgacttgctgaaatccgtgaatgatagtatgcatcagatagcaataaatgggtatattggaaatttgaacgaattgggcaagatgatcatgcagggcgggttcagcgtgtggatcggtcacaagaagggcgcaactaagatgaaggacctagctcgtttcaagccgatgcagcggcacttgttcttatatgaaaaagctatcgtgttctgtaagcgtcgagtcgagtccggcgaaggcagcgataggtaccctagctatagctttaaacattgttggaaaatggatgaagtcggaatcactgaatatgttaagggtgacaaccgcaaattcgaaatttggtacggcgaaaaggaggaggtttacatcgtgcaagccagtaatgtggacgtgaaaatgacatggctgaaagaaatccgcaacatcctcctcaagcaacaggaactcctgaccgtaaagaagagaaagcagcaggaccagttgactgaacgagacaaattccaaatctcacttcagcagaatgacgaaaaacagcagggcgccttcatctccactgaagaaaccgaactggagcatacatcgacagtagttgaagtgtgtgaagcgatcgcaagcgtgcaggcagaggccaatacagtgtggactgaggcttcacaaagtgctgagattagcgaagaacctgctgaatggtcgagcaactatttctaccctacttatgacgaaaatgaggaagagaacaggccgctgatgagaccagtgtcagagatggcactactttactag

SEQ ID NO: 194357 - DNA, 2958 bp, Artificial Sequence
  Description of Artificial Sequence: Synthetic coding sequence
atgcaggacatcgccttcctgagcggcggccggggcaaggacaacgcatggataatcaccttccccgagaactgtaacttcaggtgcatcccagaagaggtcatagctaaggtgcttacttacctgacctcaatcgctcgccaaaatggttctgacagcaggttcaccatcatcttggatagaagactggacacttggtccagcctaaagatttctctgcagaaaatttcggcttcattccccggcaacctccatctcgttctcgtgctgcggcccacaagctttctccaacggacatttactgacattgggttctggttctcccaggaagactttatgctgaagctacccgtggtcatgctgtcttccgtgagtgacctcctcacgtatattgatgacaagcagctgacccccgaactgggtggaacattgcagtactgccattcagagtggattatttttagaaatgccattgagaacttcgcactgaccgtaaaagaaatggctcaaatgctccaaagttttgggacagagctcgcagaaaccgagctgcccgacgacattccttccattgaagaaatactggctatccgcgccgaacgatatcacctgctcaaaaatgacatcacagctgtcacgaaggagggaaaaatactacttacaaatctggaagtgcctgataccgaaggcgcggttagcagtagactcgagtgccataggcagataagtggcgactggcagacgatcaataagctgctgactcaggttcatgatatggagactgctttcgacggcttttgggagaaacaccagctgaaaatggagcagtacctacagctgtggaaattcgaacaagacttccagcagctggttaccgaggttgaatttctgctcaaccagcaggccgagttggcagacgtcaccgggaccattgctcaagtgaagcaaaaaatcaagaagctggaaaatctggatgaaaattctcaggagttgctcagtaaagcccagtttgtgattctccacggccacaaattggctgctaatcaccattacgccctggacctgatttgtcaaagatgtaacgaattgcgctatttgtccgacattcttgtcaatgagataaaggctaaacgcatccagctttcccgaacatttaagatgcataagctgcttcagcaagcccgccagtgctgcgatgaaggggagtgtctgcttgcgaatcaagaaattgataagtttcaatccaaggaggatgctcagaaagctctgcaggacatcgagaattttctcgagatggccttgccatttattaattacgaacctgagaccctgcagtacgaattcgatgtgatcctttccccagagctgaaagtgcagatgaagacaatccagcttaaactggagaatattcggtcgatttttgagaaccaacaagctggctttaggaatctggctgacaaacatgtgcggccgatccagttcgtggtccctaccccagaaaacttggtcaccagcggtacaccgtttttttcctcaaaacaggggaagaaaacatggcgccaaaaccagtccaacctgaagatcgaagtggtgccggactgtcaggagaaaaggagtagcggcccctcctcctccttggataatggaaatagcctggacgttctgaagaatcatgtgctaaatgagctgatccagacagaacgcgtgtacgtgcgggagctatacacggtgcttctggggtaccgcgcagagatggacaaccctgagatgttcgatctgatgcctcctctgttgcgcaataagaaagatatactcttcgggaacatggctgaaatctatgagttccataatgacatttttctgtctagtctggaaaactgtgctcacgcccccgagcgggtgggcccttgcttcctggaacggaaggatgactttcagatgtatgctaaatattgtcagaataaaccgaggagcgagacgatctggcggaaatatagtgaatgtgctttcttccaggaatgccaacggaagttgaagcaccggctgcggctagatagctacctcctaaagccagtgcagcgcattactaagtatcagctgttacttaaagaattattaaaatacagtaaagactgcgaaggttctgccctcctgaagaaggctctcgacgcaatgctggatcttcttaaatctgttaacgactcaatgcaccaaatcgccatcaatgggtacatcggcaacttaaacgagttagggaaaatgatcatgcaggggggcttttctgtatggataggccataaaaagggtgctacaaagatgaaagacttggctcggttcaagccgatgcagcgtcacctttttctatatgaaaaagctatagtgttctgcaaacggagagtggaaagtggagagggttctgaccgatatccctcttacagcttcaaacactgttggaagatggatgaggtcggtattaccgagtacgtcaagggcgacaaccgcaaattcgaaatctggtacggcgagaaggaagaagtgtacatcgttcaggcctctaacgtggatgtgaagatgacctggttgaaggagatcaggaacatcttactcaagcagcaggaactgcttacggtgaagaagcgcaaacagcaggatcaattgactgaacgtgacaagttccagatcagcctgcagcagaatgatgaaaagcaacagggagcattcataagcactgaagaaaccgaactcgagcacaccagcacagtggtcgaagtctgcgaggccatcgctagcgtacaggcggaggctaacacggtgtggaccgaggccagtcagtccgctgaaatcagcgaggagcccgctgagtggagctctaactacttttatcccacttacgacgagaatgaggaggaaaatcggcccctaatgcggccggttagcgagatggccctgctgtattag

SEQ ID NO: 194358 - DNA, 1290 bp, Artificial Sequence
  Description of Artificial Sequence: Synthetic coding sequence
tgacacgtgctgaacgagctgatccagaccgagcgggtgtacgtgagagaactgtataccgtgctcctggggtatcgagcagagatggacaaccctgagatgtttgacctcatgcctccattactgagaaataaaaaggacatcctgtttgggaacatggcggaaatttatgagttccacaacgacattttcctctcttcactggaaaactgcgcacatgctccagaacgggtcggcccgtgcttcctggagcgcaaagatgatttccagatgtatgcgaagtactgccagaacaaacctaggagcgagaccatctggaggaaatactctgagtgcgcattctttcaggagtgtcagcgtaagctgaagcatagactgagactagattcttacctgctcaaaccagtacagcgtattacgaagtaccagctgcttctcaaggaactgctcaagtactccaaggattgtgagggatccgccctgctgaagaaggccctcgacgctatgctggatttgttgaaatcggtgaatgatagtatgcaccaaattgcaatcaatgggtacattgggaacctcaacgagctgggcaagatgatcatgcagggagggttttccgtgtggataggccataaaaaaggggccacaaagatgaaagatttagctagattcaaacccatgcagcggcacctatttctttatgagaaggccatagtgttctgtaagagacgtgtggagtccggggagggctccgaccggtacccatcatattccttcaagcactgctggaaaatggacgaagtagggataaccgaatacgttaagggcgacaacagaaagttcgaaatttggtatggcgaaaaggaggaggtttacattgtacaggcctcaaacgtagacgtgaagatgacgtggctgaaggagatccggaatatcttgctgaaacaacaggagctcttgacagtgaagaaacggaagcaacaggaccagttaaccgaaagagataaattccagattagccttcaacagaatgatgaaaaacaacagggcgcgttcatatccaccgaggagacagaactggagcataccagtactgtggtggaggtttgtgaagctattgcatccgttcaagcagaggccaataccgtgtggactgaggcttcacagagtgcggagatctcggaagagccagctgaatggtcctctaattatttctatcccacatacgacgagaacgaagaggaaaacagaccactcatgcggcctgtgagtgagatggcccttctgtattag

SEQ ID NO: 194359 - DNA, 1587 bp, Artificial Sequence
  Description of Artificial Sequence: Synthetic coding sequence
gtgcagatgaagaccatccagctgaagctggagaacatccggagcattttcgaaaaccagcaggccggcttccgcaaccttgccgacaagcatgtacgaccaatccagttcgtggttcccacacccgagaatctggtaacttcaggaaccccatttttcagctcaaagcaaggcaaaaagacctggaggcagaaccagtccaatttaaagatcgaagtggttccagattgccaggaaaaacggtcaagcggcccttcgtcatccctggataatggcaactcactcgacgtgttgaagaaccacgttctgaacgagctgatccagaccgagagggtgtacgttagagaactttacacagtacttttggggtatagggccgagatggataatcctgaaatgtttgacctcatgccaccgttgttgagaaacaagaaggacatactatttggaaacatggctgagatctatgaatttcataatgatattttcctctccagcctggagaactgcgctcatgcgcccgaacgtgtgggcccatgttttctcgaacggaaggatgatttccagatgtatgccaaatattgccagaacaagcctagatctgagactatctggaggaaatattccgaatgcgcgttttttcaggaatgccagcgcaaactcaagcacagactaagactggacagctacctgctaaagcctgtgcagcgtatcactaagtatcagcttctgctgaaggagctgttgaaatactcaaaggactgtgaggggagtgcgctgctgaagaaagcacttgatgccatgctggatctgctgaagagcgtaaatgacagcatgcaccagatcgcgataaatgggtatatcggaaatctcaatgaactgggaaagatgatcatgcagggaggattttccgtgtggatcggccacaaaaagggcgccacaaaaatgaaggacctagcacggttcaagcccatgcagagacatcttttcctctatgagaaagcaatagttttctgtaaacggagagtggagagtggcgagggatctgatcgctaccccagctatagtttcaagcactgctggaaaatggatgaggtgggaattacagaatacgtcaaaggagacaacagaaaattcgaaatttggtatggcgaaaaggaagaagtgtacatcgtgcaggcatctaacgtggacgtgaagatgacctggttaaaagagatccggaacatactgctgaaacagcaggaactcctgactgttaagaaaagaaaacagcaggatcaactcaccgagagggataaattccagatcagtctccaacaaaatgacgagaaacagcagggtgcctttatctctaccgaagagaccgagttggaacacacatcaactgtggtcgaggtgtgcgaagcaatcgcatcagtccaagcagaggccaacacagtgtggaccgaagccagtcagagtgcagaaatatctgaggaacctgccgagtggagctccaactatttctatccgacatatgatgagaacgaggaagaaaatagacctttgatgcgcccagtttcagagatggccctgctttattag

SEQ ID NO: 194360 - DNA, 3006 bp, Artificial Sequence
  Description of Artificial Sequence: Synthetic coding sequence
atgcaggacatcgccttcctgagcggcggccggggcaaggacaacgcctggatcattacttttccagaaaattgcaatttcagatgcatacctgaagaggtaatcgccaaggtgttgacataccttactagcatcgccaggcagaatggatctgacagccgcttcaccattattctggataggcgattggacacttggagttcgctcaagatatctttacagaagatttccgcctcttttcctgggaatctgcacctggtgctcgtgctccgccccacctcttttctgcaacggacctttacggacatcggattttggttttcacaggaagattttatgctgaagttgcccgtggtcatgctctccagcgtgtcagatctcttgacctatatcgacgataaacagttaacccctgagctggggggcactctgcaatattgccactcagaatggattatttttcggaacgccatcgagaatttcgccctcaccgtgaaagagatggcgcaaatgcttcagtcgtttgggacagaattggctgagaccgaactgcccgacgatatccccagcatcgaggagatactggccatccgagccgagaggtatcacttgctgaagaatgatattactgccgtgacaaaggaggggaaaattttgctgaccaatctcgaagtgccagataccgaaggggctgttagttctcgacttgagtgccatcggcagatcagcggggactggcagacaataaacaaattgctgactcaggttcatgacatggaaaccgcctttgacggcttttgggagaaacatcagctgaagatggaacagtatctgcaactttggaaatttgaacaggattttcagcagctcgtcacggaagtggaattcctcctaaaccagcaggcagagctggcggatgtgactggcaccattgcccaggttaagcagaaaataaagaaactggagaacctggatgagaacagccaggaactgctctccaaggcccagtttgtgatccttcacggacataagttggctgcgaaccaccactatgccctcgacctaatctgccagcggtgcaacgagctcaggtacctgtcagacattttggtgaacgaaattaaggctaagaggatccagctgtccagaacttttaagatgcacaaactgctccaacaggcacgtcaatgttgtgacgagggtgaatgtctactcgctaatcaggaaatagacaaattccagtctaaggaggatgcacagaaggccctccaggacatcgaaaattttctggaaatggccttgcctttcatcaactacgagcctgagaccctgcagtatgaattcgatgtgatcctgagccctgagctcaaagtccagatgaagaccatccagctgaagctcgaaaacatccgctctatttttgagaatcagcaggccggcttccgtaacttagctgacaaacatgtccgacccattcagtttgtcgtgccgacccctgagaatctggtcacgagcggcactccattcttttccagtaagcaggtcggagtgggctattctttttttcaggcctgtaaattgttcagtaagggtaagaagacatggagacagaaccagtctaatctgaaaatagaggtcgtgcctgactgtcaggaaaaaagatcctcaggcccgagcagttccctggataatgggaacagtctagatgtgcttaagaaccatgtcctcaacgaattgatccaaacagagcgggtctatgtccgcgagctctataccgtactactaggctatcgtgctgaaatggacaacccagagatgtttgacctcatgccgccactgctccgcaacaagaaggacattctgtttggaaatatggccgagatatatgagttccataatgacatcttcttgagcagtttggagaattgtgcccacgctccggaaagagttgggccatgcttccttgagcggaaagatgactttcagatgtatgctaagtattgccaaaacaagccacgctcagagactatctggcggaaatattctgaatgcgctttctttcaagaatgccagaggaagctcaagcacagactgaggctagactcatacctgctgaaacccgtgcagcgcatcaccaagtatcaattattgcttaaggaactactcaagtactcaaaggactgtgaaggctctgcactcctcaagaaggcgctggatgctatgctggacctgctgaagtcagtgaatgactcgatgcatcagatcgccattaacggatacatcggcaatttaaatgaactggggaaaatgattatgcagggtggatttagcgtctggataggccacaaaaagggcgcaaccaagatgaaggatcttgctcgctttaagccaatgcaacgccatttgttcctgtatgaaaaagcaatcgtcttctgcaaacgcagggtcgaatctggcgaagggtccgaccgctacccatcatactctttcaaacactgttggaaaatggatgaggtaggaattaccgagtacgtcaagggcgacaaccggaaattcgaaatatggtatggcgagaaagaggaagtgtacatcgtccaggccagcaacgtggatgttaaaatgacctggctgaaggagattaggaatatcttgttgaagcagcaagagttgctcacagtgaaaaagcgtaagcagcaggaccagctgactgagcgtgacaagtttcagatatccctgcagcagaatgacgagaagcaacaaggtgccttcatctctactgaggagactgaactggagcatacttctactgtcgtcgaggtttgtgaggccatagctagcgtacaggctgaagcaaacactgtgtggactgaggcaagtcagagcgccgaaatctcggaagagccagctgagtggtcatccaactatttctatcccacttacgacgagaatgaagaagaaaaccggcctctgatgagaccagttagcgaaatggccctgttgtattag

SEQ ID NO: 194361 - DNA, 2958 bp, Artificial Sequence
  Description of Artificial Sequence: Synthetic coding sequence
atgcaggacatcgccttcctgagcggcggccggggcaaggacaacgcttggatcataacctttccggaaaactgtaacttcaggtgcattcccgaagaggtgatcgcaaaggtgctgacctatctgaccagcattgctcggcagaacggctccgattccagattcacgatcattttagacaggcgcctggatacctggtcatcgctaaagatctccctgcaaaagatctccgcaagtttccccggcaacttgcatctagttctcgttctgcggcccactagttttctgcaacgcaccttcactgacattggattctggttttctcaggaggacttcatgcttaagcttccggtcgtgatgctgtcaagcgtgtccgacttgctaacgtacatagatgataagcagctgacaccagagttgggcggtaccctccagtattgccattcagaatggattatctttagaaatgccattgagaattttgccctcacggtcaaagaaatggcacagatgctgcagtcgtttggaactgagctggcggagactgaactgcccgacgacatcccatcaatcgaagagatcctggccattcgagctgaaaggtaccacctgcttaagaacgacatcaccgcagtgacaaaggaaggaaaaatactccttacaaatctagaggtaccagacaccgaaggcgccgttagctcaagacttgaatgccaccgccagatctccggcgattggcagacaattaacaagctgctgactcaggtgcacgacatggaaaccgcttttgatggcttttgggagaagcaccagctgaagatggagcagtacttacagctttggaagttcgaacaggatttccagcagctcgtgacagaagtggaatttctgctgaatcagcaagcagagttggccgacgtgactggcacaatcgctcaggtgaagcaaaagataaagaaactcgagaacctggatgagaatagccaggaactgctatctaaagctcaattcgtcattctccatggacacaagttggccgctaatcaccattacgcacttgaccttatctgtcagcgctgtaatgagctccgctatctctccgacatattggttaacgagatcaaggccaaacgcatccagttaagtagaacgttcaagatgcacaagctcctacagcaggcgcgtcagtgttgtgatgaaggagaatgtcttctggcaaaccaagaaattgacaaattccagtcaaaagaggacgcgcaaaaggctctacaggacattgaaaatttcctggagatggccctgcctttcatcaattacgaacctgagacactacagtacgagtttgacgtcatcctatctcccgaattaaaagtccagatgaagaccatccaacttaaattggagaatatccgtagtatatttgaaaaccagcaggcgggatttcgtaatcttgcagataaacacgtccggcccattcaattcgtggtcccaactcccgagaatttggtgaccagtggcaccccgttcttttctagcaagcaggggaagaagacttggcgacagaaccaaagcaaccttaagatcgaggtagtgcccgattgtcaggaaaaaagatcgagtggaccctcaagctccctggataatggtaacagtctggatgtgttgaagaaccatgtccttaacgagctcatccagacagagagggtgtatgttcgggagctatataccgtcctcctgggatacagagccgaaatggataaccctgagatgtttgatctcatgccacctctcttaagaaataagaaagacatcctgtttggcaatatggccgagatatatgaattccataacgatatattcctttctagtttggaaaattgtgcccatgcaccggaacgagtcggcccttgttttctcgagaggaaggatgattttcagatgtatgccaaatactgtcaaaacaagccacgatctgaaaccatttggcggaaatattctgagtgcgcttttttccaggagtgccagcgaaagctgaagcatagactccgcctagacagctacttgctgaagcccgtgcagagaatcactaagtaccaactactactgaaagagctcctgaagtactccaaggattgcgagggttctgcactcttaaaaaaggccctagatgccatgttagacttgctaaaatcagtcaatgactcgatgcatcagatcgccatcaatgggtacatcggtaatctgaatgaattggggaagatgataatgcaggggggttttagtgtgtggattggccataaaaagggcgctacaaagatgaaagatttggctcgctttaaacccatgcagagacacctttttctgtacgagaaagcgatcgtgttctgtaagcggagggtcgagagcggcgaaggctccgataggtatccttcttatagcttcaaacactgctggaaaatggatgaagtggggatcacagaatacgtaaaaggggataatcgaaagttcgaaatctggtatggcgagaaggaagaagtttacattgtgcaggccagcaatgtggacgtcaaaatgacctggctgaaggaaatcagaaacatcctcctgaaacagcaggagttgttgactgttaagaaaagaaagcagcaggaccagctgactgagcgcgataaattccaaatttccctgcagcaaaatgacgagaagcaacaaggggctttcatctcgaccgaggagacggaactggagcatacctcgactgtggtggaggtgtgcgaggctattgcaagcgtccaggccgaggcaaatactgtgtggacagaagccagccaatctgctgaaatttcagaagagccagctgagtggtccagtaattacttctacccaacctacgatgaaaacgaagaagagaaccggcccctgatgcgcccggtgagcgaaatggctctgctgtattag

SEQ ID NO: 194362 - DNA, 2466 bp, Artificial Sequence
  Description of Artificial Sequence: Synthetic coding sequence
atggccgaggccaacccccggcggggcaagatgcggttccggcggaatgccgccagcttccctggcaacttacacttggtgcttgttctgcggcccacctcctttctgcagagaacattcaccgacattgggttctggttctcacaggaggacttcatgttgaaacttcctgccattgagaacttcgcactgactgtcaaggagatggcgcagatgctccaatccttcggtacggagttggctgaaaccgaacttcccgacgatatcccaagcatcgaagagatcctggcaatcagagcagagagataccatctcctgaagaacgatattactgctgtgacaaaggaggggaagattctcttgactaatttggaagtgcctgataccgaaggcgctgtatcaagtagactagagtgtcatagacagatctccggggattggcagacaataaataaactcctgacccaagtgcatgatatggagactgccttcgacggcttttgggagaagcatcagctcaagatggagcagtatttgcagctttggaagtttgaacaggatttccagcagctggtgaccgaagttgaatttctcctgaatcagcaggccgaactggctgacgtgactggcacgatcgcccaggttaagcagaaaattaagaagctggaaaacctcgacgagaatagccaggagctgctctctaaggctcagttcgtgatcctgcacggccacaaactagcagccaaccaccactacgctctggatctgatatgtcagaggtgcaatgagcttagatacttaagtgatattctggtgaacgagatcaaagccaagcgtattcaactatcccggaccttcaagatgcacaaactgctgcaacaggcacgccagtgctgtgatgaaggcgagtgcctgcttgcaaatcaggaaattgacaagttccaatcaaaggaggacgcacagaaagcccttcaggacattgaaaattttctggaaatggctctgccatttattaactacgagcccgaaacactccagtatgagttcgatgtcattctctctccagagcttaaggtacaaatgaagactatacagttgaagctcgaaaacattcgttcaattttcgagaatcagcaggcaggatttaggaatcttgcggacaagcatgtaagacctattcagtttgtggtccctactccagaaaatctggtaacctcaggcacccccttcttcagctctaagcagggcaagaagacctggagacagaaccagtccaatctgaaaattgaggtggttcctgactgccaggagaagagatcatcagggccatcatcttccctggacaatggcaattctctggatgttctcaaaaatcacgtcctgaatgaactaatccagacagagcgtgtttacgtccgggaactgtatactgtcctgctgggctatagagcggagatggataatccggagatgttcgacctgatgccccctctactgcggaacaaaaaggacattctattcgggaacatggccgagatttatgagttccataatgatatattcctttcaagccttgagaactgtgcgcacgcccctgagcgggtgggcccttgtttcctggaaagaaaggacgacttccagatgtacgccaaatactgccagaacaagccaaggtccgagactatctggcggaagtattccgagtgtgccttttttcaagagtgtcaacgaaagttgaaacatcggctccgactggactcctacttgctcaaacccgttcagcgcataaccaaataccaactccttcttaaagagctccttaagtattcaaaggattgtgaaggctcggccctactaaagaaagctctggacgccatgttggaccttctcaaaagcgttaatgactcaatgcaccagatagctatcaatggctatataggcaacctgaatgagctgggaaagatgattatgcagggcggtttctccgtctggatcggacacaaaaagggcgctactaaaatgaaagatctggcacggtttaagccaatgcaacgccacctttttctctacgaaaaggctattgttttttgcaaacgcagggtggaatctggcgagggcagcgacaggtacccaagttattcgttcaaacattgttggaaaatggatgaagtggggattaccgagtacgttaaaggtgacaacagaaaatttgagatttggtatggggagaaagaggaagtctacatcgtgcaggcaagtaatgtggatgtgaagatgacatggctaaaggagattcgaaatatactgttaaaacagcaggagctgctgaccgtgaagaaaagaaagcagcaggatcaactgaccgagcgagacaaatttcagatcagtctgcagcagaatgacgaggatctgtgccgtcgctggctgtcttacattgatgaagccactatgtcaaatgggaaatag

SEQ ID NO: 194363 - DNA, 2955 bp, Artificial Sequence
  Description of Artificial Sequence: Synthetic coding sequence
atgaccgtgcggcggctgagcctgctgtgccgggacctgtgggccctgtggcttcttctgaaggctggtgctgatgaaataatgcaccaggatatcgtcccactgtgtgctgctgacatacaagaccagcttaaaaaaaggtttgcttatctctcaggcggcaggggtcaggacgggagccccgtgattacatttccagactatcccgctttttccgagatcccagacaaggaattccaaaatgtgatgacatacttgacatccattccctccttgcaggatgccggtatcggcttcattctggtgatcgaccgcagacgcgataagtggacttctgtgaaagcttctgtgctgcgcatcgctgcctccttcccggctaatttgcagctcgtcctggtgctccggcccacaggtttcttccagcgtactctctcagatatcgctttcaaattcaaccgtgacgactttaagatgaaggtgccagtgattatgctttcaagcgtaccggacctccatggctatatcgacaaatcgcaattaaccgaagacctcggtggtaccctggattactgccactcaagatggctatgccagcgaacggccatcgagagctttgccctgatggtcaaacagacagcccagatgctgcaatcattcggcacggagctcgcagagacagagctacctaacgatgtgcagtcaacctcttccgtgctgtgcgcccacacggaaaagaaggataaggcaaaggaggacttacgactggcattaaaggaggggcatagcgtgctggagagcctgcgggaactacaagcagaaggatctgaacccagtgtcaaccaggatcagcttgataaccaagcgacggtccagaggctgttggctcagctgaatgagacagaagcagcgttcgatgaattttgggctaagcaccaacaaaagcttgagcaatgcctccagttgcgccatttcgaacagggctttcgcgaggtgaaggctatacttgatgcagcgtctcagaaaatcgccacgtttacagacattggcaatagtctcgctcacgtcgaacacctgctgcgtgatttggcatcctttgaagaaaaaagtggcgtagcagtcgaaagggcaagggcgcttagtttggacggagaacagctcatcggcaataagcactatgctgtagatagtattcggccaaagtgccaggagttgcggcatctgtgcgaccagttctctgctgagatcgctcgcaggaggggtcttctcagcaagtctcttgaactccacagacgactagaaaccagcatgaagtggtgcgatgagggcatctacctcctcgcttctcagcctgtggacaaatgccagagccaggacggggccgaagctgcactgcaggaaattgagaaattcctggaaacaggtgccgaaaataagatccaggagcttaacgcaatctataaggaatatgagtctatcctaaaccaggatctgatggagcatgtccgcaaagttttccaaaaacaagctagcatggaagaggtgttccaccggcgccaggcaagcttaaaaaagctggctgccaggcagaccaggccggtgcaacctgtcgccccccgcccggaagctctggctaaatcgccatgcccgtctcccgggatccgcaggggatcagagaacagttcatcagaaggaggggcgctgagacgtggaccttaccgcagagcaaagtctgagatgtccgagtctcgccagggcagaggttcagccggggaagaggaagagagcctggccatcttgcggcgccatgtgatgtcagagttgcttgatactgaaagagcgtacgtagaggaactcctgtgcgttctggagggttacgcagctgaaatggacaacccactcatggcgcatctgctaagcacaggtctccataataagaaagacgttttgttcggaaacatggaagaaatctaccattttcataacagaatctttttgcgggagctggagaattacaccgactgtccggagcttgttggcaggtgttttctcgaaagaatggaagactttcaaatctatgaaaagtattgccagaataagcccaggagcgagagtctgtggaggcagtgcagcgactgcccctttttccaggaatgtcagaggaaacttgaccataagctcagcctagatagctacttactgaaacccgtccagagaatcaccaaatatcagttattgcttaaggagatgctaaagtacagccggaattgcgagggtgccgaagacctccaggaggctctgtccagtatcctcggaatccttaaagccgtgaacgattcaatgcacctcattgccattacaggatatgacggcaacctgggcgacttaggcaaactactaatgcagggctcattttcggtatggacggatcataagagaggtcacactaaagttaaagagctggcgcgcttcaagccaatgcaacggcacttgtttctgcacgaaaaggctgtactcttctgtaagaaacgagaagagaacggcgaagggtatgaaaaggctccctcttactcatacaagcagtcattgaacatggcagctgtcggcattactgagaatgtgaaaggggacgctaagaagtttgaaatctggtataacgcaagagaagaggtgtacatcgtgcaggcccccacgcctgaaattaaggcggcttgggtgaacgagatcaggaaggtgctaacgagtcagctgcaggcatgtcgggaagcttcccagcaccgggcactggaacagagtcagagcctacccttacctgctcccacatctacgtccccctctaggggcaattctaggaatattaagaagttagaggaacgaaagacagatccactcagtttagaagggtacgtaagcagcgcccccttgacaaagcctcccgaaaaagggaaagagccttag

SEQ ID NO: 194364 - DNA, 3390 bp, Artificial Sequence
  Description of Artificial Sequence: Synthetic coding sequence
atggccgagaagggcgccagccggggcaccctgcggcggctgtggtctttgcctaggcgaaggcgcggaacggcaggccgcagcagaccggatgaaattatgcatcaggacatcgttcccctgtgcgcagcagacatccaggaccagcttaagaaacgattcgcgtacctatctggcgggaggggacaggacggcagccccgtcataacttttccagactacccagccttcagcgagatccctgacaaggaatttcagaatgttatgacgtaccttacgtccatcccttctcttcaagatgcgggcataggattcatactggtgattgacaggagacgcgacaagtggacgtccgtgaaggcgtccgtgctgcggatagccgcatccttcccagcaaacctgcagctggtattagtactcagacccactggcttcttccagcgtaccctgagcgacatcgccttcaaatttaaccgggacgattttaagatgaaggtacctgtcatcatgctgtcgagcgttcccgaccttcacgggtatatagataagtcccagctcactgaggacctgggcggcacattggactattgtcacagtcggtggctctgtcagaggacagccatcgagtcatttgctcttatggtcaaacagaccgcgcagatgctgcagtccttcgggacagagcttgccgagaccgagcttcctaacgacgtccaatccacctcctctgtgctgtgcgcacacacggaaaagaaagacaaggcaaaggaggatttgcgactggcattgaaggaaggacactctgtgctggaatctctgcgagagttacaggccgaaggcagcgaaccttcggtgaatcaggaccagctggacaatcaagctacagtgcagcgcctgctggcccagctgaatgagactgaagcagcttttgatgagttctgggccaagcaccagcagaaactggagcagtgcctccagctcaggcattttgaacagggttttcgagaggtcaaggcaattctagacgccgccagtcagaagatcgccacattcaccgatattggcaacagtctggcccatgtggagcacctgctgcgggatctcgcaagttttgaggagaaaagcggggtggccgtcgaacgagccagggccctgagcctggacggcgagcagctgatagggaacaaacactacgcagtggattcaatccgtccgaagtgccaggaattacgtcatctgtgcgatcagtttagcgccgagatcgcacgacggaggggcttgctgtcaaagtcattagaactgcataggagactagaaacctcaatgaaatggtgcgacgaggggatctacttgctggcttctcagcctgtggacaagtgtcagtcccaggacggcgctgaagccgcgcttcaggagattgagaaatttctcgaaacaggcgccgagaataaaatccaggagcttaacgcaatttataaggaatacgagagtatcctaaatcaagatcttatggaacatgtccgcaaagtgtttcagaaacaggcgagcatggaagaagtcttccatcggcgccaggccagtctgaaaaaactggctgcacggcaaactaggcccgtccagcccgttgccccgaggccagaagcactggcgaaaagtccctgcccaagccctggtatcagaagaggatccgaaaatagtagttccgaaggaggggctttgcggcgcggcccctatcgccgcgcaaagtccgaaatgagtgaaagcagacagggcaggggaagtgccggggaggaggaggagtccctggcaatccttcggcggcacgtgatgtctgaactcttggacaccgagagagcttacgtcgaggagcttctctgcgtgctggagggttatgcagccgagatggataatccactgatggctcatcttttgagcacggggctgcataataagaaagacgtcttgttcggaaatatggaagaaatctaccactttcacaatcggattttcctgcgtgagttggagaattacacggattgccccgagctggtggggcggtgtttccttgagaggatggaagacttccaaatctacgagaaatattgccagaataagcctagatctgaaagtctctggagacagtgctcggactgtccttttttccaggagtgtcaacgcaagctggatcataaactatccctggattcctaccttttgaagcccgtgcagagaatcactaagtatcagctactgttgaaggaaatgcttaaatattccagaaactgtgagggcgccgaagatctgcaggaggctctatctagtatcctcggaattctgaaagcagttaacgatagcatgcacctgattgccattaccggctatgatgggaacttaggcgacttggggaaacttctgatgcagggatccttcagtgtgtggaccgaccacaagagaggtcacaccaaggttaaggagctggctaggttcaagcccatgcagcgccacttgtttctccacgaaaaggcggttctattctgtaagaaaagggaagagaacggcgagggatacgagaaagcccctagttatagctacaaacagagccttaatatggctgctgtgggcattactgaaaacgtaaagggcgacgctaaaaagttcgagatttggtacaatgcccgggaggaagtttacattgtgcaggccccaacacctgagataaaagcagcgtgggtcaacgagatcagaaaagtgctgacctcgcagttgcaggcctgtcgcgaggcttctcaacaccgagcgctcgaacaaagtcagagcctgcctctgcccgcacccacgagcacttcaccttcgcgtggcaactcccgcaacatcaaaaagttggaggaaagaaagactgatcctctctcactcgagggttacgtctctagcgcccccctgaccaaacccccggagaaaggaaaaggatggtccaaaacaagtcattcactggaggcccccgaggatgatggcggttggtccagtgccgaggagcagattaattcctccgacgctgaggaggatggcgggttaggtcctaagaagttggttcctgggaagtatactgtagtagctgatcacgagaaaggcgggcctgacgcattaagagttagatctggagatgtggtggagctggtgcaagagggagatgagggactgtggtacgtcagggacccaactacgggtaaggaaggatgggtccctgcctcatccttgtcagtgaggcttgggccatccgggtccgcgcagtgcctgtcatctagcgagtcctcccccggcagcgctgtactgagcaattcaagctcttgctcagaaggcggtcaggcccccttttccgaccttcagggatag

SEQ ID NO: 194365 - DNA, 3549 bp, Artificial Sequence
  Description of Artificial Sequence: Synthetic coding sequence
atggcccgggtggagagccccgtgcccgccgcccgggccagcctgactggaagctgcgtgctcggccaggcaatgccgttgaggggaggcgccgggccctcccccgcgtcacacggccctacgcatggcccatccgaccctcgcacctgtctccctggacgcggcgccggcggcatgaggccacacgggaggggagccttgggatgctgcggattgtgctctttttacacatgccatggcgccgccggagatgagatcatgcaccaggatattgttcctttgtgcgcagctgatatccaggatcaactcaagaagaggttcgcatatctttccggtggtcggggtcaggacggaagtcctgttattacatttcctgactaccccgccttcagcgaaattccagacaaagagtttcagaatgtgatgacttatctgacctctattccatccctgcaggacgccggaatcgggttcattctcgttatagataggcggagggataagtggaccagcgtgaaggcttcggtgctgcgaatagccgctagttttccagccaatcttcagctggtgctagtcctgcgcccaactggatttttccaaagaaccctgtctgacatcgcttttaagtttaacagagatgacttcaaaatgaaggtaccagtaattatgctgtcgagcgtccctgacttacatggctacatcgacaagtcacaattaacagaagacctgggcggcaccttggattactgccacagtaggtggctgtgccaaaggacagctatcgaatctttcgctctcatggtgaaacagacagcacagatgctgcagtcatttggcaccgaactggccgaaacggaactccctaatgatgttcagtctaccagctccgtattgtgtgcacacacagaaaagaaggataaggcaaaggaggatctgaggctagccctcaaggagggacattcggtcctcgagagtctccgcgaactccaagcagagggcagcgagcctagtgtgaaccaggatcagcttgataatcaagctactgtacagaggctgcttgcccaattgaatgagaccgaggctgcattcgatgagttctgggccaaacaccaacagaaactggaacagtgcctgcagcttcgccactttgagcagggattccgggaggttaaggccatcctggacgctgcttctcagaagatcgccacgttcacggatatcggcaattctctggcacacgtggaacacctgttgagggatctggcctccttcgaggaaaagagtggagtagctgtcgagcgcgcgagagccctgtctttggatggtgaacagttgattggcaataaacactacgcagtagactctattaggcctaagtgccaggagctacgtcatctttgcgaccagtttagtgcagagattgcacgtaggcgtggtttgctgagcaagtcactagaactgcatagacgtcttgaaacctcaatgaagtggtgtgatgaggggatctatcttttagcctcgcaacccgtcgataaatgccaaagtcaagacggagcagaagccgcactgcaagagatcgaaaagtttttggagacaggcgccgagaacaaaatacaagagctcaacgctatttataaggagtatgagagtattctgaatcaggacttgatggaacacgtcagaaaggtttttcagaagcaggcgtctatggaggaagtctttcaccggaggcaggcttctctgaaaaaactggccgcgagacagacaaggcccgtacagcccgtagctccaagacctgaggccctggcaaaaagcccctgtcctagccctggtatccggagagggtccgagaatagttcttccgaaggaggcgctttaagaagaggcccatataggcgcgcaaaatcggagatgtctgagagcagacaaggccgggggtcagcgggcgaagaggaggaatctctcgctattctccgcaggcatgttatgtcggaactcttagatactgaaagggcgtatgtggaggagttgttgtgtgtgttggaggggtatgctgccgaaatggacaatcctctgatggcccacctcttgtcaaccggactgcacaataaaaaagacgtgctattcggaaatatggaagagatatatcacttccacaacagaatcttcctgagggaactggagaactatactgactgtcctgagctagtgggccggtgcttcctagagagaatggaagacttccaaatctatgaaaaatactgtcaaaacaagcccaggtctgagtcattgtggcggcagtgcagtgattgccccttcttccaggagtgccaaaggaagctcgatcacaagttatcactggatagctatctgcttaagccagtacagagaattacgaaataccagttattgttaaaagagatgttgaagtacagccgcaattgtgaaggtgctgaagatcttcaggaggctctttcttccattctcggcatattgaaagcagtgaatgacagcatgcatctgattgcaatcacagggtatgatgggaacttgggcgatctcgggaagctgttgatgcaagggagtttcagcgtatggactgaccacaaacggggacacactaaggtgaaagaacttgcccgcttcaaaccaatgcaacgacacctgttcctgcacgagaaagctgtactgttttgcaaaaagcgggaagagaatggagaaggctatgaaaaagcaccgtcctactcatataaacaatccttgaatatggctgctgtcgggatcaccgagaatgttaaaggcgacgccaagaagtttgaaatttggtacaacgccagagaggaagtctatattgtgcaggcacccaccccggagatcaaggccgcatgggtgaatgaaattaggaaggtgctgacctctcaactccaagcatgccgagaagcatcccaacatagagcactagagcaatctcagagtctgcctctgcccgcaccaacgtctacctcaccaagtcgtgggaatagtcggaacattaaaaagctggaggagcggaaaacagaccccctgtctctagaggggtacgtttccagcgccccgctgactaagccacccgagaagggcaagggctggtccaagacgtcgcactcgctagaagcgcctgaagatgacggggggtggtctagcgccgaggagcagatcaactctagcgacgctgaggaggatggaggtctcgggcccaaaaaactggtgcccggaaagtacactgtagtagccgaccatgaaaagggcgggcccgatgcactgcgggtaagatctggcgacgtggtggagttagtccaagagggggacgaagggctatggtatgtcagggatccaaccaccgggaaagagggttgggtccccgcctcttcactttccgtaagacttgggcccagtgggagcgcgcagtgtttaagtagcagcgaatcttcacctggatccgcggtgctcagcaactcttctagttgcagcgagggcggacaggccccgttcagcgacctgcaaggatag

SEQ ID NO: 194366 - DNA, 3414 bp, Artificial Sequence
  Description of Artificial Sequence: Synthetic coding sequence
atgttcgactgctggcggttcatcctgtgcaagcggcccggcagcaattcgtactctagcccacaaaggcctaacgaagctaagaaagaagagactgatcatcagatcgacgtctccgacgtgatccgattagtccaagatacaccagaagcaaccgcaatggcgactgacgagatcatgcatcaggacatagtccccctgtgcgccgcggacattcaggaccagctgaagaagcggtttgcctacttgtcaggcgggcggggccaggatgggtccccagtcattacttttccggattacccagctttctctgaaatcccagacaaagagtttcagaatgtgatgacctatctcaccagcatcccaagcctgcaggacgccggtatcggttttattctggtgattgaccggaggcgggacaaatggacgtctgtcaaagcatcagtgcttaggatcgccgctagcttcccagctaatctgcagctagtcctcgtacttcgcccaacagggttctttcaacgaaccttatcggacattgcatttaaattcaatagggacgatttcaagatgaaagttcccgtgataatgctaagtagcgtccccgacttgcacggctatattgataaatcccagttaaccgaggacctgggcggaacgctggactattgccacagcagatggctttgccagcggacagctatagagtcttttgccttaatggtcaagcaaactgctcaaatgctacagtctttcgggaccgaattggccgaaactgagctgccgaatgatgtacagagtacctcaagtgtcctgtgtgcccacaccgagaaaaaggacaaagccaaggaggatctcaggctagccttgaaagagggacactcagtgttggagtccctccgggagctgcaggccgaaggatctgagcccagcgtgaaccaagaccagcttgacaaccaggccaccgtgcaaaggctgctcgcccaacttaacgaaactgaggccgctttcgacgagttttgggcgaaacaccaacagaagctggagcagtgtctgcaactgcgccactttgagcagggatttagagaagtgaaagccatactggatgccgccagtcagaagatcgcaacattcaccgacattggcaatagtctcgcacacgtggagcacctgttaagagatttagcctccttcgaggagaagagtggcgttgccgtggagcgggcaagggcactgtccctggatggggagcagttaataggaaacaaacattacgccgttgacagcatcagacccaagtgtcaggaactgaggcatctgtgcgatcaattttccgcagaaatagcccggaggcgggggttactttctaaatccctggaactacaccggagactcgagacctctatgaagtggtgcgacgagggaatttacctgcttgctagccagccagtggataagtgccagtcccaagacggcgccgaggcagcactgcaggagatcgagaagtttcttgagaccggcgctgagaacaaaatccaggaacttaatgccatctacaaagaatacgagagcatattgaaccaagatcttatggagcacgtgagaaaagtctttcaaaagcaagcatcaatggaagaagtctttcacagacgccaggcctcacttaaaaagctggccgcgcgccagacacgacccgtacagccggttgccccccgacctgaggcattggccaaatccccatgtccttccccaggtattcgtcgcggatcagaaaattcatcatcggagggaggcgcactccggagagggccatacagacgggccaagagcgagatgagcgagtcccgacagggtcgggggagtgcaggggaggaggaggagtccctcgccattctgaggagacacgtaatgagcgagctgctggacaccgagcgcgcatatgtggaggaacttctctgcgtcctggaaggctatgccgctgaaatggataacccactgatggcccacctgctgagcaccggtctccacaacaagaaagacgtgctcttcggaaatatggaggagatctaccattttcacaatcggattttcttgagggagctggagaactacaccgactgtcctgagctggtgggccgctgttttttggagcgaatggaagacttccagatctacgaaaagtactgtcagaataagcccagatccgagtctctgtggcgccaatgttcggactgtcctttcttccaagaatgtcagaggaagctagaccacaagttgtctttggacagctatctgttaaaacccgtgcagaggattaccaaatatcagcttctgcttaaagagatgctcaaatattccaggaactgtgagggtgctgaggatttgcaggaggcgctctcctccatcctggggattctaaaggccgttaacgacagcatgcacctgatagcaatcacgggatacgatggcaacctgggagacctaggaaaattgctgatgcaagggtccttttctgtgtggacggatcacaagcggggacacacaaaggttaaagagctggctcgcttcaagcccatgcagaggcacttgtttttgcatgagaaagctgtgctcttctgcaaaaagcgcgaagaaaacggagaaggctatgagaaagcaccaagctacagctataaacagtcactgaacatggctgccgtgggcataaccgagaacgtgaagggtgacgccaagaagttcgagatctggtacaatgccagggaagaagtgtacatcgtacaggcaccgacgcctgaaataaaggccgcatgggtgaacgagatcaggaaggtactgacgagccaactccaggcctgcagagaggcatctcaacaccgtgcgctggagcagtctcagtcattaccgctgccggcacccacatccactagtccatctaggggaaactctcggaacatcaagaagcttgaggagaggaagaccgaccctctgagtctggagggttacgtgtcgtccgcaccgctaacaaaacctcccgagaagggtaaggggtggtcgaagacatcacattccttggaggcacccgaagacgacggtggctggtcaagcgctgaggaacaaataaatagctccgacgccgaagaagacggaggtcttggcccgaagaaactggtccctgggaagtatacagtagtcgcagatcacgaaaaagggggcccggatgctctccgagtgaggtccggtgacgtagtagaattagtccaggaaggcgacgagggactttggtatgtcagagatcccaccactggcaaggagggctgggttcccgcttcttctttgtctgtgagactaggtcccagcgggtcagcccaatgcttgagcagctcaggaaaagcacatgtgcccagagctcatccctag

SEQ ID NO: 194367 - DNA, 2382 bp, Artificial Sequence
  Description of Artificial Sequence: Synthetic coding sequence
tgaagccagaagatcgccaccttcaccgacatcggcaacagcctggctcacgttgaacaccttctcagggatctagctagtttcgaagagaagtccggcgtggccgttgagcgggcccgcgcactctctttggatggagagcaactgatcgggaataagcattatgcggtcgactctataagacctaagtgtcaagagctccgccatctctgcgatcagttttcagccgagatcgcccggagacgtggcttgctgtctaagtccctggaactgcaccgcaggctggagacaagcatgaagtggtgcgacgaaggcatctacctgctcgcttcgcagcccgtcgacaagtgtcaaagccaggacggagccgaggccgcactgcaggagatcgaaaaattcctggaaacgggggcagaaaacaaaatacaggagttaaacgcgatctacaaggagtacgaatcaattttgaaccaggatctgatggagcacgtgcgcaaagtcttccagaagcaggccagtatggaggaggtgttccaccgccgtcaggcatctctgaaaaagctggcagcacggcaaactcggcccgtccagccagtggcaccacgccccgaggctcttgcaaaaagcccctgtccatctcctgggattaggcgcggaagcgaaaactcttcatccgaagggggagccctgcggcggggcccttatcgccgggcgaaatctgaaatgagcgaatcaaggcaggggcgcgggtcggccggagaggaggaagagagccttgctatcctgcgtcgccacgttatgagcgagcttcttgacacagaaagagcctatgtagaggagctcctctgcgtgttggaaggttacgcagcggagatggataatccactcatggctcatctgctgtcaacaggactgcacaacaagaaagacgtgctcttcggaaacatggaggagatttatcactttcataaccggatcttcttgagggaactggaaaattacacggattgcccagaacttgtgggcagatgcttccttgagcgaatggaagactttcagatctacgagaaatactgccagaacaagcctcgctcggaatcattgtggagacaatgtagtgactgtcccttctttcaggagtgccagcgaaagctggatcataagctgtctctcgacagctacctgctaaagcccgtccaaagaattactaagtatcagctgcttctcaaagaaatgctaaaatactctcgcaactgcgaaggagctgaagacctgcaagaggctctctcgtccatcttgggtatacttaaggccgttaatgatagtatgcatttaatcgccattactggctatgacggaaacttgggggacctgggaaagctactcatgcagggctccttctccgtgtggactgatcataaacgcggacataccaaggtgaaggagttagccaggttcaagccaatgcagagacatctgttcttgcatgaaaaagcggtgctgttctgtaagaaaagggaagaaaacggcgagggctacgaaaaggcaccaagctactcgtacaaacagagtctgaacatggctgcagtggggataacagaaaacgttaaaggggatgcaaagaaattcgaaatttggtataatgccagggaggaggtttacatcgtccaagctccaacaccagagattaaggcagcttgggttaacgaaatccgtaaggtgttaacgtcgcaactgcaagcctgcagagaagcctctcagcacagggccctcgaacagtcacagagcctgccccttcccgccccaacctcgacctctcccagcagaggcaacagcaggaatatcaaaaagttggaagagaggaaaacagacccactttccctggaagggtacgtgtcaagcgcccccctgaccaaacctcccgaaaaagggaaggctagtcccacatcacctgataagaaagctaaacgccacgaggtgaagagcgaccccacacctttcggagtccggggttggagcaaaacatcccacagcctggaagcccccgaggacgatggaggttggagcagcgccgaagagcaaattaactctagcgacgctgaagaagacggtggtctagggcctaaaaaacttgtccccgggaagtatactgtcgtggccgaccacgaaaagggtgggccggacgcacttagggtcagaagtggcgacgtggttgagctcgtgcaagagggggatgaggggctgtggtatgtgagggatccaacaaccggcaaggaggggtgggtaccagcgtcctctttatcagtcaggcttggaccgagcggctccgctcagtgcctcagctcttcgggcaaggcccacgtgcctagggcacatccatag

SEQ ID NO: 194368 - DNA, 3291 bp, Artificial Sequence
  Description of Artificial Sequence: Synthetic coding sequence
atgcccctgcggggcggcgccggccccagccccgccagccacggcccaacacacggacccagcgaccctaggacatgcttacctggccggggtgccggcggtatgcgcccccacgggcggggcgcacttggctgttgtggcctttgttctttttatacctgccatggtgctgcaggcgatgagatcatgcaccaggacatagttccactgtgtgccgcagatattcaggaccaactgaagaagaggttcgcttaccttagcggcggcagaggccaggatgggagcccagtcatcactttccccgattaccccgcattttccgagattcccgacaaagaatttcagaacgtgatgacctatcttacctccatccctagcctacaagacgcgggaatcgggttcatactggtcattgaccggcgccgcgacaaatggacttcggtaaaagcctcagtgttgcggatagctgctagctttcccgcaaacctccagcttgtccttgtgcttcggcccacaggattcttccagcggacgttgtcagacatagcattcaagttcaaccgcgacgactttaagatgaaggttcctgtgatcatgctgtccagcgttccagatcttcatggttatatcgataagtcacagctgaccgaagacctgggcggcacgctggactactgtcactcccggtggttgtgccagaggacagccatcgagagttttgctttgatggtaaaacagaccgctcagatgctccagtccttcggcactgagctcgctgagacagagctccctaacgatgtccagtcaacctcttcagtactatgcgcccacaccgaaaaaaaggacaaagccaaggaagatttacgactcgcactgaaagagggacactccgtactggaatccctccgggagctgcaagccgaggggagcgagcccagcgtcaaccaggaccagctggataaccaagccactgttcagcgattgttggcacaactgaatgaaactgaagcagcctttgacgagttctgggccaaacaccagcagaaactggagcagtgtcttcagcttcgtcacttcgagcagggtttcagggaggtcaaagcgatcctcgatgccgccagccagaagattgccacgttcactgatattgggaatagcctagcccatgttgagcatctgttgagggacctggcaagcttcgaggaaaaatcgggtgtagccgttgagagggccagggcactgtcgcttgatggggaacaactcatcggcaataaacattacgctgtggattccattcgacccaaatgtcaggagctgcgtcatctgtgcgaccagttttccgcggaaatcgctcgaagaagaggtctcctgtcaaagtctctcgagctgcaccggaggctggagacatccatgaagtggtgcgatgagggaatatacctccttgcaagccaaccggtggataaatgtcagtctcaggatggggccgaggcagccttgcaagagatcgagaaattcttggaaaccggagccgagaacaagatccaggagttgaatgcgatctacaaggagtacgagagtatcttgaatcaggatctgatggagcatgtgaggaaggtgttccagaaacaggcaagtatggaggaggtgttccacaggcgccaggcctcactaaagaagttggcggctcgccaaacaaggccggtccagcccgtggctcccaggccagaagccctggctaaatctccctgtcccagccccggtattagacgtgggagcgagaactcctcttctgaggggggagctcttaggcgtggcccctacagacgggctaagagcgagatgtcagaatctagacagggtagggggagcgccggcgaagaggaggagtcactggccatcctaaggcggcacgtcatgagcgagttattggacacggagcgcgcttatgtcgaagagctgctgtgcgttttggaaggctatgccgcggaaatggataatccactgatggctcacttactctcaacgggactgcataacaagaaggatgtgcttttcggtaatatggaggaaatctatcacttccacaatcgcattttcctgcgagaacttgagaattataccgactgccctgaattggttggtcgctgctttttggaaagaatggaagatttccagatttatgagaagtattgccaaaacaagcctagatccgaaagcctgtggcgtcagtgttctgactgtcccttttttcaggaatgccaaaggaagcttgaccataaactcagtctggattcctaccttcttaaaccagttcagcgtatcacgaaatatcaactgctgctgaaggagatgctcaaatactcccggaactgcgaaggagccgaagaccttcaagaagctctgtcaagtatcttgggcatcctgaaagctgtgaatgattcaatgcatctaatcgctattaccgggtatgatgggaaccttggcgatctgggcaagttactcatgcagggctctttctccgtgtggactgaccacaaacgaggccacacaaaggtgaaggaactggccagatttaagcctatgcaacggcatctgtttttgcatgagaaggccgtgctcttttgcaaaaagagggaggaaaatggtgagggatatgagaaggctcccagctacagttacaaacagagcctgaatatggcagccgttggtattaccgagaatgttaagggggatgccaaaaagttcgagatctggtataatgcccgcgaagaagtctacattgtgcaggctcccactcccgaaatcaaggccgcctgggtgaatgagatccggaaggttctgacttcccagttacaagcttgtcgtgaagcaagccagcacagagcactcgagcagagccagtcattgccactgcccgctcctacatcaacaagcccaagcaggggaaattccaggaatattaagaaactcgaggaacggaagacggaccctttgagcctggaggggtacgtgtctagcgcacccctgacaaagcccccagagaaaggtaagggatggtctaaaacttcccactcactcgaagcccctgaggatgatggtggctggtcctccgcagaggagcagatcaattcttcggacgcagaggaagacggagggctgggtcccaaaaagctggtgcccggaaagtatacagtggtggccgaccacgaaaaaggagggccagacgctttgcgcgttaggtcaggagatgtcgtggaacttgtgcaggaaggtgatgaaggtttgtggtag

SEQ ID NO: 194369 - DNA, 411 bp, Artificial Sequence
  Description of Artificial Sequence: Synthetic coding sequence
atgcaccaggacatcgtgcccctgtgcgccgccgacatccaggaccagctgaaaaagcgattcgcatatctgtccggagggcgggggcaggacggatcccccgtcataactttcccagattaccctgcgttcagcgagattcccgataaagaattccagaacgtgatgacctatttaacgtccattcccagcctgcaggatgctggcatcggattcatcctggtgattgaccgaaggcgggacaaatggacgtccgtcaaagcttctgtcctgagaatcgcagcatcgttcccagccaatttgcagctggtacttgttctccgtccaaccggcttcttccaaagaactctgagtgacatcgctttcaagtttaacagagatgatttcaagatgaaagttcccgttatttag

SEQ ID NO: 194370 - DNA, 3372 bp, Artificial Sequence
  Description of Artificial Sequence: Synthetic coding sequence
atgaccgtgcggcggctgagcctgctgtgccgggacctgtgggccctgtggctgcttctgaaagctggcgctgacgaaatcatgcaccaggacatcgtgccattgtgcgccgccgacatccaggatcagttgaagaaaaggtttgcctacttgtcagggggaaggggccaggatgggtcacccgtaatcacttttcctgactacccagccttcagtgaaatcccagataaagagttccagaatgtcatgacatacctaacgtctatcccgagcctgcaggacgctggtattggtttcattcttgtcatcgaccgccgtcgggataaatggacctcggtgaaggcatcggtactgcgcattgccgctagctttcccgccaatcttcaactggtgctcgtgctgcgaccaacaggtttcttccagagaaccctttcggatatagcatttaaattcaaccgcgatgacttcaagatgaaggtccctgtgattatgctttccagcgtgcccgacttacatggctacatagataagtcgcagttaactgaagacttgggtggcacgctcgattactgccacagtcgatggttgtgccagaggactgctatcgaatcattcgctctaatggtgaagcagaccgcccagatgttacagtcttttggtacagaactagccgagaccgagcttccaaacgatgtacagtcaacctcatcagtgctttgtgctcatacagagaagaaggataaagctaaagaggacctcaggctggccttaaaggagggacattcagtgctggagagtctgagggaattacaggccgaaggttctgaacccagtgtaaaccaggaccagctggacaaccaagccaccgtccaacggttattggcccagcttaatgaaaccgaagctgcttttgacgaattttgggccaaacatcaacaaaagctggagcagtgcctgcagctgaggcacttcgagcaaggatttagagaagtgaaggccatactggatgcagctagccagaagatcgctacgtttactgacataggaaatagcctggctcatgtggaacacctgttgagggatttggcctcatttgaggagaaaagcggtgtcgccgtggagcgagctagggcgctgagcctcgacggcgaacagttaatcggcaataaacactacgcggtcgatagcatacggcctaaatgtcaggagctgcgccatctttgcgaccagtttagtgccgaaattgcccgcaggcgagggctcctgagcaaatctctcgaattacataggcgccttgagacgtctatgaaatggtgtgatgaaggaatttacctcctggcttcccaaccagtggataagtgccaatcgcaggacggggcagaggccgctctgcaagaaattgaaaagttcctggagactggcgctgagaacaagatccaagagctgaatgccatctataaggaatatgaatccatcctcaaccaagaccttatggaacacgtgagaaaagtcttccagaagcaagcctccatggaggaggtgttccacagacgccaggcctccctcaaaaaactggccgccagacagacccggcctgttcagccggttgctccaagacccgaagccttagctaagtctccatgtcccagtcccggcatcagacggggcagtgagaatagttccagcgaagggggtgcccttcggagagggccctataggagagcgaagagcgagatgtctgaaagcagacaggggaggggaagtgccggcgaagaggaggaatctctggctattctgcggcgtcatgttatgtctgaacttctggatacagagcgcgcttacgtcgaagagctgctctgtgtactggaggggtacgccgccgagatggacaatcctctcatggcacatctgttgtccacaggactccacaacaaaaaggatgtcctcttcggaaacatggaggagatttaccacttccacaatagaatttttctgcgggagctggaaaactataccgattgccctgagctcgtcggtaggtgtttcttggaacggatggaggattttcagatctacgagaagtattgtcaaaataagccccgctctgaatcgctgtggaggcagtgcagcgactgcccattttttcaggagtgtcagcggaaactggatcataaactgtctcttgactcatatttacttaaaccggtgcagcggatcaccaaatatcagttgcttctcaaagagatgctaaaatactcccgcaattgtgagggggccgaagaccttcaggaagctcttagcagtatccttggcattctgaaggccgtgaatgattccatgcatttaatagcaatcactggatatgatggaaatctgggtgacttgggaaagctcctgatgcagggatctttcagcgtttggacagatcacaagagaggtcacaccaaggtgaaagagctcgcccggtttaagcctatgcagcgccatctgttccttcacgaaaaggccgtgctgttttgtaaaaaaagagaagagaatggagaaggatatgagaaggcccctagctattcttacaagcagtcattaaatatggctgcagtgggcattaccgaaaacgtgaaaggagacgccaaaaaattcgaaatttggtataatgcgagagaagaagtatacattgttcaggcccccaccccagagataaaagcagcatgggtaaacgagatcaggaaagtgctgactagtcagctgcaggcatgccgagaggccagccagcacagagctttggaacagtcgcagtcgcttcccctgcctgcccctacctctacgagccccagcagaggcaattcccggaacatcaaaaaactggaggaaaggaagacagatcccctgagcctggaggggtacgtcagctcagcgccactaacgaagcccccagagaaaggcaaggggtggtctaaaacttctcatagcttggaggcgccagaggatgatggcggctggtcctctgctgaagagcaaatcaactcaagcgacgcagaggaggacgggggattgggacccaaaaagctggttcccggcaaatacacagtggttgccgaccacgagaagggtggccccgatgcgcttcgcgtgaggagtggcgacgtagttgagttagtgcaggagggcgacgagggtctgtggtatgtcagggatcctaccacagggaaagaagggtgggtgcccgcaagctctctatctgtccgactggggccttctggcagcgctcaatgccttagctcctctgaatcttcacctggctcagctgtgctatcaaattcttcgtcttgctccgagggtggccaagccccattcagcgacctccagggctag

SEQ ID NO: 194371 - DNA, 741 bp, Artificial Sequence
  Description of Artificial Sequence: Synthetic coding sequence
atgcggttctggctgcggaccgaggagatggccctggaggagatggtgcagcgtctgaatgccgtgtcaaaacatacggacgaaattatgcaccaggatatagtacctctctgtgcggctgacatccaagatcagctgaagaaacggttcgcctatctgtccggggggaggggccaggatggtagccctgtcatcactttccctgactaccctgcattttcagagattccggacaaggagttccagaatgtgatgacctatctgacgtcaataccatctctgcaggatgctggcatcggcttcattttggtaattgacaggcgccgtgacaagtggacgtcagttaaggcatctgtgctgagaatcgctgcaagctttcccgcaaacctccagctggtgcttgttttgcgacccaccgggttttttcaacgcaccctgtcggatatcgctttcaagtttaatcgggatgattttaaaatgaaggtgcccgtgatcatgctgtcatccgtgcccgacctacacggatatattgacaagagccaactgacagaggatctgggtggtaccctggactattgtcacagtagatggctatgccaaaggacagccatcgagtcgtttgccctcatggtcaaacaaacagcccaaatgctgcagtcctttggaactgaattggctgaaactgagctccccaatgatgtgcaaagtacctcttccgttctgtgtgcccacacggagtag

SEQ ID NO: 194372 - DNA, 3342 bp, Artificial Sequence
  Description of Artificial Sequence: Synthetic coding sequence
atgggcgacggcaaggccgtgcggatcagcgtggccgagatgaagagttattatctgtacagcgagtggtgcagctggcttctcagcgttgccgaggatgagatcatgcaccaggacatcgtgcctctgtgcgcagccgacatccaggatcagctcaagaagcgctttgcctatctctccggcggcagaggccaagacggctctcccgtgattacttttccagattaccccgcttttagcgagattcctgataaggaattccagaatgttatgacttatctgacaagtataccctctttgcaggacgccgggatcggcttcatcctcgtaatcgacagacgtcgtgataagtggacgagcgttaaggcatctgtgctgaggatcgctgcatcgttccccgcaaatctacagctggtgctggttctccggcctaccgggttcttccagcgtactctgtctgacatcgcattcaagtttaatcgggacgatttcaagatgaaggtgcctgtgattatgttgagttccgtcccggatcttcacggttacatcgacaagagccagttaaccgaggatcttgggggtaccctggattattgccactccagatggctctgtcaacgcaccgccatagagtcatttgccctgatggtcaagcagacagcacagatgctgcaatcattcggaactgagctggccgagacggaactacccaatgacgtacagtctacctcaagcgtgctttgtgcacatactgaaaagaaggacaaggccaaagaggatctgaggcttgcgctcaaagaggggcacagtgttctggagagcctcagagagttacaggcagaaggtagcgagccttccgtcaaccaggaccagcttgacaatcaagccacagttcagcggctgttggctcagctgaatgagactgaggctgctttcgacgaattctgggccaaacaccagcagaaattggagcagtgtctgcagttgagacatttcgaacagggatttagagaggtcaaggcaatactggacgcagcgagccaaaaaatcgccactttcacggacatagggaactcactagcacacgtcgaacacttgttgcgggatcttgcctctttcgaggaaaaatccggggttgcagtggagcgggccagggccctgtccctcgatggtgaacagctcattgggaataagcattatgccgtggactcaatccgacccaagtgccaagagctgcgccacctgtgtgatcagttttccgctgagatcgctaggaggcggggcctgctctcgaaatctcttgagttacatagacgactcgagaccagcatgaaatggtgcgacgagggaatctatcttctcgcgagtcagcccgtggacaagtgtcagtcccaggacggcgctgaagccgcactccaggagatcgaaaaattcctcgagacgggtgcggaaaacaagatacaggagttaaacgccatctataaagagtacgaaagcatcctgaaccaagacctcatggagcacgtccgcaaagtcttccagaagcaggcctctatggaggaggtatttcatagacggcaggcctccctcaaaaaattagctgcgcgccagaccaggccagtccaacctgtggcccctcgacccgaagcactggcaaaatccccgtgtccttcacctggtattcggagaggcagtgagaacagcagcagcgaaggcggtgccctgagaagaggcccctacagacgcgctaagagtgagatgagcgagtcaagacaaggaaggggttccgctggagaggaggaggagagtcttgcaatcctacggcgtcacgttatgtcggagcttctcgatactgaacgggcttatgtggaagaactgctgtgtgtgctggagggatacgcagctgagatggataacccacttatggcccatctgctgtccaccggattacacaacaaaaaggatgtgttgtttgggaacatggaagaaatttaccatttccataacaggatttttctgcgagaactagaaaactatactgactgccctgagctagttgggagatgttttctggagcggatggaggacttccagatctacgagaaatattgccagaataagccacgcagcgagagcttgtggaggcagtgcagcgactgtccattcttccaagaatgtcaaaggaagttagatcacaagctgtccctggattcttatttattgaaacccgttcaaagaattaccaagtaccagctgttgctgaaggaaatgctcaagtactcccgtaattgcgaaggggccgaggatctacaggaagcgctttcctctatactgggcatcctcaaagcggtcaacgatagcatgcacctcatagctattacagggtacgacgggaacctgggagatctcggtaagctgctgatgcaggggtcattttccgtatggaccgaccacaagaggggacacaccaaagtgaaggagctggcgcggttcaaacctatgcagcgtcacctgttcctccacgaaaaggctgttctgttttgtaaaaagcgggaagagaatggcgaaggatatgagaaggctcccagttattcatataagcagtcgctgaacatggcagccgtcgggattaccgaaaatgtgaagggagatgctaaaaagttcgagatctggtataatgctcgtgaagaagtgtatatcgttcaggcaccaaccccagaaatcaaggccgcctgggttaatgaaatccgcaaggtcctcacatctcaactgcaggcctgccgagaggcaagccagcacagagcccttgaacaaagccagagtctcccgcttcctgcccccacgtccactagcccctcacgtgggaactcccggaatataaagaaattggaagaacggaaaaccgatccattaagcctggaaggttacgtgagttccgcacccctaacgaaaccacctgagaaagggaagggctggagcaagacctcccactccctggaagctccggaggatgatggcggttggagctcagccgaggagcagatcaacagtagtgatgctgaagaggacggcgggttaggccccaaaaaactggtgcccggaaagtacacagtggtagccgaccacgagaagggcggcccagacgccctccgcgtgcggagtggtgatgttgtggagctcgtgcaggagggggatgagggcttgtggtacgtacgcgaccccaccacaggcaaggagggctgggtgccagcatcatcgctgagcgtgcggctgggacccagcggatctgcacaatgtctaagcagctccggaaaggcccatgtccctagagcacacccttag

SEQ ID NO: 194373 - DNA, 2712 bp, Artificial Sequence
  Description of Artificial Sequence: Synthetic coding sequence
ctgaagatgcccgtgatcatgctgagcagcgtgcccgacctgcacggatatatcgacaagtctcagctgaccgaggatttgggaggcacgctggattactgccatagtcgctggttatgccagcggacagccatagagtcttttgcactgatggtcaagcagactgcccagatgttgcagagctttggcaccgagcttgccgaaacagagctgccaaatgacgtccagtcaacaagttctgttttatgcgcccacactgagaagaaagacaaggccaaggaggatctgcggttggcactcaaggagggtcacagcgttctggagagtcttcgcgaattgcaggccgaaggcagcgagccctcagttaaccaggaccagctcgacaatcaggcaaccgttcagcgcctattggcccaactgaacgaaaccgaggcagctttcgatgaattttgggcgaaacatcagcagaaacttgaacagtgcctccagctgcggcactttgaacagggcttccgtgaggtgaaggctatcctggatgccgccagtcagaagatcgccacattcacggacattggtaactctttggctcacgtggagcatctcctccgcgatttggcatcgtttgaagaaaagtccggagtggccgtcgaacgagctcgtgcgctgtccctggatggcgagcagctgataggcaacaagcattatgctgttgactcgatacgccccaagtgccaggaattgaggcatctgtgtgaccagtttagtgccgagatcgcccgccgccgagggctcctttcgaagtcgctcgagctgcacagaaggctggagacatccatgaagtggtgcgacgaaggcatttatcttcttgcctctcagcccgttgacaaatgtcaatcccaagacggagccgaggccgccttacaggagatcgaaaaatttttggaaacaggagccgagaataagattcaagaacttaatgctatctacaaggaatatgagtctatattaaatcaagacctgatggagcacgtgcgcaaagtgtttcaaaagcaagcatccatggaagaagttttccacaggagacaggcttcactgaagaagctggcagcgcggcagactcggccagtgcaaccagttgccccccgccctgaagccctggctaaatcaccctgtccctccccaggaattcgacgcggaagtgaaaattccagcagcgagggcggtgccctgagacggggcccataccggcgggccaagagcgagatgtcggagagtcggcaggggcggggtagtgcgggcgaagaggaagaatctctggccatcctgcgacggcatgtgatgagtgagctgctcgatactgagagagcttacgtggaggagctgctctgcgtcctggaaggatacgcagccgagatggataaccccctgatggcccacctcctctccacgggacttcacaacaaaaaggatgtactctttggcaacatggaagaaatctatcatttccacaacagaatattcctccgggagcttgaaaattacacagattgcccggagctggtgggacggtgttttttagagagaatggaagatttccaaatttatgagaaatactgccagaacaagccacgcagtgaatctctatggaggcagtgttcagactgccctttctttcaggagtgtcaacggaagctcgatcataagttgagcttggactcatacttgctgaagcccgtccagcgaattacaaaataccagctactgttaaaagaaatgctgaaatactctagaaattgcgagggcgccgaagacctgcaggaggccctctcgtcaatcctgggaatcctgaaggcagttaatgactcgatgcacctaatagctattacaggatacgatggcaacctcggtgatctcggtaagctgctaatgcagggtagcttcagcgtgtggactgaccataaacggggccataccaaggtgaaagaactggcccgctttaagcccatgcagagacatctcttcctgcacgagaaagcagtcttattttgcaaaaagagagaagagaacggcgaggggtatgagaaagcccctagctactcctacaagcagagcctgaatatggccgccgtggggataaccgagaacgtcaagggagacgccaagaagttcgaaatatggtacaatgccagagaggaagtctacatcgtacaggcccctacacctgagatcaaagcagcctgggtgaacgagattcgcaaggttcttacctcccaattgcaagcatgtagggaggcgagccagcacagggctcttgagcagtctcaatctttacctctgccagccccaactagtaccagccccagtaggggtaacagcagaaatatcaagaaacttgaggagagaaaaacggaccccctatcattagaagggtacgtgagctcagcaccactcacaaaacctcccgaaaagggcaagggatggtcaaagacatcccattccttagaggcccccgaggatgacgggggatggtcctctgcggaggagcagatcaatagtagcgatgctgaggaagatggtggactggggcctaagaaattggttccaggaaagtacaccgtggtggcagatcatgagaagggaggcccagatgcactcagggttcggtcgggtgatgtcgtggagcttgtccaagaaggggacgaaggactgtag

SEQ ID NO: 194374 - DNA, 3414 bp, Artificial Sequence
  Description of Artificial Sequence: Synthetic coding sequence
atgttcgactgctggcggttcatcctgtgcaagcggcccggcagcaattcttattctagtcctcagcggcccaacgaggcaaaaaaggaagagacagaccatcagatagatgtctcggacgtaattaggttggtccaggatacccccgaagctacagcgatggctacagacgagattatgcaccaggacatcgtgccactctgcgctgctgatatccaggatcaactcaaaaagaggtttgcctacctgagtggcggccgaggacaggacggcagcccggtaatcacatttccagactatcctgctttttcggagatccccgacaaagaattccaaaacgtgatgacctaccttacctcaattccctcactgcaggatgccggcattggatttattctggtgatcgacagacggcgcgataaatggacatcagtcaaggcttccgtcctccggatcgccgcttccttcccagctaatctgcagctggttctcgtgcttcggcccactggctttttccaacggacactctccgacatcgctttcaagtttaatagagacgacttcaagatgaaggtgccggtgataatgctcagttctgtgcccgaccttcatggctatattgacaagagtcagctgactgaggacctagggggaactctggattattgtcacagccggtggttatgccagaggacagctatcgaatccttcgcactgatggttaaacagaccgcccagatgctccagtcatttggaacggagcttgccgaaacggagttgcctaatgatgttcaatctacttcctccgtcctgtgcgcccacaccgaaaagaaagataaggctaaagaggatcttcgactagctctgaaagaaggccacagcgtgctggaaagtctgcgagaactccaggcggagggatccgagccgtccgtcaatcaagaccagctggacaaccaggctaccgtgcaacgcctgctcgcccagctcaacgagacagaggccgcatttgacgaattttgggcaaaacaccagcaaaagcttgagcaatgcctgcagctgagacacttcgagcagggcttccgcgaagtgaaggctatattagacgctgcttcccaaaagatcgcaacttttacggatatcggaaatagcctagctcatgtggaacacctgctcagagatctcgcatcttttgaggagaagtccggtgttgccgtggaacgggcgcgtgctctgtcactggatggagagcagctcatcggcaacaaacactacgcagtagacagcatccgcccgaagtgtcaggagctccgccacctttgcgatcagtttagtgctgaaattgccaggcgcagagggctgttgtcaaaatcccttgagttacacaggagactagagacatccatgaagtggtgcgatgaggggatctatttactggccagccagcccgtcgacaagtgccaatctcaggatggagcagaagccgcactccaggagatagaaaagttcctggagacgggcgctgaaaacaagatccaggagctaaacgccatctacaaagagtacgaaagcatcttaaatcaggacctcatggagcacgttagaaaagtattccagaagcaagccagtatggaagaggtctttcatcggcgccaagcctccctcaaaaagctggcagcccgacaaacacggcccgtccagcccgtagctccccgacccgaggctctggccaaaagtccatgtccctccccaggaattcgccggggatcagaaaatagctcaagtgagggaggcgccctccggcggggcccgtacagacgagccaagagcgagatgtcggaatcaagacagggaaggggaagtgccggtgaagaagaggagagccttgctatcctgcgacgacacgttatgtccgagctgctggacaccgagagggcatacgtggaagaactgctctgtgtcttggagggctacgccgccgagatggacaaccctctcatggctcaccttttatccacaggtttacacaacaaaaaagatgtcctgtttgggaatatggaggagatctaccattttcacaatcggatctttctccgcgagctcgagaattacacggactgcccagagctggtgggaagatgctttttggagaggatggaggactttcaaatttacgagaaatactgccaaaacaagccgcggagcgaatcgctgtggcgccaatgtagcgactgcccattctttcaggagtgtcagcgcaaactggaccataaactttccctggattcttacctcctgaagcccgtacagcgtattactaagtatcagcttctgctaaaagaaatgctgaagtactcaaggaactgcgagggggccgaagacctgcaagaggcattgtcttcaatcctgggaatcctgaaagccgtcaacgactcaatgcacttgatagcgatcacaggctatgatggaaacctcggggacctgggtaagcttttgatgcagggctctttttctgtgtggacagatcataagagagggcataccaaggttaaggagctcgcccgcttcaaacccatgcaacgccacttgttcttgcacgaaaaagccgtgttgttctgcaaaaagagagaagagaacggcgaaggttatgaaaaagctcctagttattcatacaagcagagcctgaacatggcagctgtaggcatcacagaaaatgttaagggcgatgccaagaagtttgagatttggtacaatgcccgcgaagaggtgtacatcgtgcaagcacctacgcctgaaattaaggcagcttgggtaaatgagattagaaaggtgctcacctctcagctgcaggcgtgcagagaggcctcacagcaccgcgctcttgagcagtcccaaagcttgcccctgcccgcccctacttctacctcacctagtaggggcaacagcaggaatatcaagaagctggaagagcggaaaaccgatccgttgtctcttgagggctacgtgagtagtgctccgctgacaaaaccccccgaaaagggaaagggatggtctaagacctcccactccttagaagcgccggaagatgatggaggatggtcttctgccgaggagcaaatcaattcttccgatgccgaagaggacgggggtttgggcccaaagaagctggtcccaggaaaatacactgtcgtcgccgatcacgaaaagggtggtccagatgctctgcgagtacgtagcggtgacgtcgttgaattggtgcaggaaggtgacgaaggcctctggtacgttagggacccgaccaccgggaaagagggttgggttcccgcttccagcctgagtgtgagactgggacctagtggctctgcccagtgcctctcatctagcggaaaagcccatgtgccccgcgcccatccctag

SEQ ID NO: 194375 - DNA, 3378 bp, Artificial Sequence
  Description of Artificial Sequence: Synthetic coding sequence
atgcggttctggctgcggaccgaggagatggccctggaggagatggtgcagcgcctcaatgccgtgagtaagcatactgacgagataatgcaccaggatattgtgcccttgtgcgcagcagacattcaggatcagttgaagaagcgctttgcgtatctgtccggcgggcgcggacaagacgggtcccctgtcataacatttcctgactaccctgcttttagtgagatacccgacaaggagttccagaatgtcatgacgtatctgacctctatcccttccctgcaagacgccggcattggctttatccttgtaattgatcgcagacgggataaatggacgtccgttaaggcctcagttctgcggatcgccgcaagctttcctgctaatctgcaactggttctggttcttcgtcctacagggttctttcagcgcactttgtcagatatcgcctttaaattcaatcgggacgatttcaagatgaaagtgccagtcattatgctaagttcggtccccgacttgcacggctacattgataaatctcaactcacggaggacctcggcggtactttggattattgtcacagtagatggctgtgccaaaggaccgctattgagtcttttgcactcatggtcaagcagaccgcacaaatgctgcagagcttcggaaccgaactcgcggaaactgaactacccaacgacgtacagtcaacttcgtccgtcctctgtgcacatactgagaagaaggataaagcaaaagaggacttgaggttagccctcaaagaaggccacagcgtgttagagagcctgagagagctgcaggctgaggggagcgaacctagcgtgaatcaagaccagctggacaatcaagctactgtgcaacgattgctggcccagctcaatgaaacagaagcagccttcgacgaattttgggcaaagcatcagcagaagctagagcaatgcctccaattacgccactttgagcagggattccgtgaggtgaaggccatactagacgcggcctcacaaaagatagccacctttaccgacatagggaattccttggctcatgtcgagcatctgcttcgggatcttgcttctttcgaagaaaagtctggcgtggccgtggagcgcgcccgggccctgtctctggatggcgaacagctgataggcaataaacactatgccgttgactccatccggcccaagtgccaggaactgaggcatctctgtgaccaatttagtgcagagattgccaggagaaggggcctcctgtctaagtcactcgaattacacaggagactcgaaacaagtatgaaatggtgcgacgagggcatctacctgctagcctcccagccagtcgacaagtgccagtcacaggatggcgcagaggccgcattgcaggagattgaaaagttcctggagacaggcgctgaaaataaaatccaggagctcaacgcgatctacaaagaatacgaatccatcctgaaccaagacttgatggagcacgtccggaaagtgtttcagaagcaagcctcaatggaagaagtctttcatcgcagacaggcaagcctcaagaagctcgccgcaagacaaacacgcccagtacagccagttgctccacgccccgaagccttggccaagtccccgtgcccatcccctggaatccgtcggggaagcgagaactcatcaagcgaagggggcgctctgagaaggggcccataccgccgcgcgaaatccgagatgtccgaatcccgccaaggacggggaagtgcaggcgaggaggaggaatctctggcaatactgcgcaggcacgtgatgagcgagttgctggacacggagcgcgcctacgtggaggagcttctatgcgtgctggaaggatacgccgcagagatggataatcccctgatggcacacctcctatctacaggcctgcacaataagaaagacgtgttgttcggtaacatggaggagatctaccacttccacaacagaatttttctgagggaactggaaaattatactgattgcccggaattggtcgggcggtgcttcctagagagaatggaagatttccaaatctacgagaagtattgccagaacaagccacgctctgaaagcctttggaggcagtgttcagactgccctttcttccaggagtgtcaacggaaactggaccacaagctgagtttggactcttacctgctcaaacctgtacaacgcatcaccaaataccagctgcttctgaaagagatgctgaagtactcccggaattgtgaaggcgcggaggatctgcaggaagctctaagcagcatacttgggatcctcaaagcggtcaatgattctatgcatctgatagccattaccggttatgacggtaacctaggtgacctcggcaagctgctaatgcagggttcattttctgtatggactgaccacaagaggggtcatacaaaggtgaaggaactggcccggtttaagcccatgcagaggcaccttttcctgcacgagaaggcagtccttttctgtaagaagcgggaggaaaacggcgagggttatgaaaaggcaccatcgtattcctataagcagtccctcaatatggcagccgttggaatcaccgagaatgttaagggagatgcaaagaaatttgaaatttggtataatgcaagggaggaagtgtatattgtgcaggcacccacccccgaaattaaggccgcgtgggttaatgaaatccgtaaagtgcttacatcacaacttcaggcatgtcgggaggccagtcaacatcgggctttggagcagtcccagtctttgcctcttcctgctcccacgagcaccagcccatcaagaggaaattcaagaaatattaagaagttagaggaaagaaagaccgaccccctgagtctcgaagggtatgtgtcaagtgccccgctcaccaagcccccagagaaggggaaaggatggtctaagacctcacactcactcgaggcccctgaagacgacggcggttggtcctccgccgaagagcagatcaattcttcagatgcagaggaagacgggggactgggccccaaaaagttggtacctggaaagtacacagtggtagccgatcacgagaaaggggggcctgacgctctgagagtccggagtggagatgtcgtggaattagtgcaagagggagatgaggggctctggtacgtgagagatccaacaacaggcaaggaggggtgggttccagctagcagtttgtctgtcagactgggcccgtccggcagcgcccagtgcctgagtagttccgagtcgtccccagggtcagccgtgctctcgaattcctcctcttgcagtgagggaggccaagcacccttcagtgacctgcaagggtag

SEQ ID NO: 194376 - DNA, 1713 bp, Artificial Sequence
  Description of Artificial Sequence: Synthetic coding sequence
atgagccggctggaggccaagaagcccagcctgtgcaagagcgagcctctcactacagagagagtccgaactacactgagtgtgttgaaacggattgtgacatcttgttacggaccctctggccgcctgaaacaactgcataatggcttcggtggatatgtctgtaccacatcccagtcaagcgcattgctgtcacacctgttagtgacacaccccatcctcaagatattgaccgccagtattcagaatcacgttagttccttttctgattgtgggttatttacggcaatcctgtgttgcaacctgattgaaaacgtgcagcgactgggactcacgcccacgacagtaataaggctgaacaaacaccttctcagtctgtgtatctcatatctgaagtcggagacctgcgggtgcagaattcccgtggatttttcaagcactcagattctactatgtctggttcgctccattctcacctctaaaccagcctgcatgctcacaaggaaagagacagagcacgttagcgccttgatcctccgtgctttccttcttacaatccccgaaaacgctgagggacacataatactgggaaagagtcttatcgtgcccctaaaggggcaaagagtgatagattcaaccgtgctcccgggcatcctcatcgagatgtcagaagtccaattaatgaggctgctgcccatcaaaaaatccacagcacttaaagtggcccttttctgtacaactctgtctggcgacacatcagataccggcgaggggaccgtggttgtgagctatggtgtctccctagaaaatgcggtccttgaccagctgttgaacctggggcggcaactcatttcagatcacgtagacttggtgttgtgccagaaggtgatacatcccagcctcaaacagtttctaaatatgcatcgcatcatcgcaatagaccgcattggcgtcacactgatggagccgctcactaagatgacgggtacacagccaatcggatcacttgggtctatttgccccaactcctatggttccgttaaagatgtgtgcactgccaagttcggcagcaaacactttttccaccttatccccaatgaagctaccatctgctcgctgctgctctgtaatcgtaacgacaccgcctgggacgaacttaaactcacctgtcagaccgccctgcacgttctgcagttgacactgaaggaaccttgggccctgttagggggcgggtgtaccgagacacatctcgccgcatatattcgtcataagactcacaatgacccggaaagcatcttgaaagacgatgaatgcacacagacagagctgcaactgatcgctgaggcgttctgtagcgccctggaatccgtggttggatctctcgagcacgatgggggcgagatactaacagatatgaagtatggacacctctggagtgttcaggctgacagcccttgcgtagcaaattggccagacctgctctcccagtgcggatgcggcctatacaattctcaggaggagttgaattggtcttttctgcggtcaacaagaaggccattcgtgccgcagtcgtgcctgccgcacgaggccgtgggctcagcttcaaacctcaccctcgactgcctgacagcaaagctctcagggctgcaggtagccgtggagactgctaacctcatcctcgacctgtcatacgtcatcgaggataagaattag

SEQ ID NO: 194377 - DNA, 1713 bp, Artificial Sequence
  Description of Artificial Sequence: Synthetic coding sequence
atgagccggctggaggccaagaagcccagcctgtgcaagagcgagccactcacaacggagagggtgcgcaccaccctgtcggtgttgaagcggatcgttaccagttgttacgggcctagcggccgcctgaagcaactgcacaacggttttggaggttacgtttgcaccacatcacagagctcggccttactgtcacatttactagtcactcatccgattctaaagattcttactgcttccatccagaaccatgtatctagcttcagcgactgcggcctgtttactgccattctgtgttgtaatttgattgaaaatgtacaacggcttggcctcacacccactaccgtgattcgattgaataaacacctcctctcgctgtgcatttcatatttaaagtccgagacctgcgggtgtaggatacccgtggatttttcttcgacccaaatactgctgtgcctcgtcaggtctatccttacctcgaaacccgcctgtatgttgactagaaaagaaacggagcacgtgtctgccctgatcctccgtgcatttctactgacaattcctgaaaatgctgaggggcatatcattttaggcaagagcctgatagtaccattgaaaggacagcgtgtcatcgactcaactgtactgccaggaatacttatcgagatgagcgaagtgcagttaatgcggcttctgcccattaaaaaatccactgctcttaaggtggctctgttttgcaccacactgtccggtgacacaagcgacaccggggagggaactgtggtggtgtcgtacggcgtgagtctggagaacgccgtcctcgaccagctgttaaacctgggcaggcagctgataagcgaccatgtggatctggtcttatgtcagaaagtgattcatcccagcctgaaacagttcctgaacatgcatcggatcatcgctattgatagaatcggtgtcacactgatggagcctcttaccaagatgaccgggactcaacccattggcagcttggggtccatctgtcctaactcctatgggtctgtcaaagatgtgtgtaccgccaaattcggctcgaagcacttttttcacctgattcccaacgaagcgacaatttgtagtctcctgctatgcaaccgaaacgatactgcctgggacgagctgaagctcacttgtcaaaccgcgctccacgtgctccagttgactttgaaggagccatgggcactcttgggcgggggttgcacggagacgcacttagccgcttatatcagacacaaaactcacaatgaccctgagagcatcctcaaggatgatgagtgcacacagaccgagctgcaactgattgctgaggcgttttgttctgctctcgaatctgttgttggctctctggagcacgacggcggcgaaattcttactgatatgaagtacggccacttgtggagtgttcaggcagacagcccctgtgtagcaaattggcctgatctgctgagccagtgcggctgtggcctgtataatagccaggaggagctgaattggtcatttcttcgatccaccaggcgaccgttcgtgccacaaagctgtctgcctcacgaggccgtcggctccgcttccaacctcacattggattgtctgacagccaagctcagcggcctgcaagtcgcggtagaaaccgcgaacttaattctcgacctctcatatgtgattgaagacaagaactag

SEQ ID NO: 194378 - DNA, 2145 bp, Artificial Sequence
  Description of Artificial Sequence: Synthetic coding sequence
atgcccgtgcggttcaagggcctgagcgagtaccagcggaacttcctgtggaaaaagtcctacttgtccgaatcctgcaattcttccgtcgggaggaaatacccgtgggctggactgcgaagcgatcagctgggtataaccaaggagcccagcttcatatcaaagcgccgtgtcccctatcacgaccctcagatttccaagtctctggagtggaacggcgccatatcggaatctaacgtggtcgcctcacctgagccggaggcccctgaaacgccgaaatctcaggaagccgaacagaaagacgtgactcaagagcgcgtccattccttggaggcaagcagggttcccaaacggactcgatcccactccgcagattcgagagctgaaggtgccagcgacgtggagaataacgagggagtaactaatcatacgccagtgaatgagaacgttgaacttgaacactcaactaaagtgctaagcgagaatgtcgataacgggctcgaccgcctgctgcggaaaaaggctggactgacagtggtcccgagctacaatgcgctgaggaattcagagtaccaacgccagtttgtgtggaagacttctaaagaaaccgcccctgcattcgcggccaatcaagtctttcataacaagtcccagtttgtgccacctttcaaggggaacagcgtgattcacgaaacggagtacaagagaaattttaagggattatcgccggtaaaggaacctaaactgaggaacgatttgagagagaatcgtaacctcgaaacggtcagccctgagcgcaagagtaataaaatcgacgaccgccttaaactcgaggctgaaatggagctcaaggatctgcaccagccaaaaaggaagttaactccttggaaacaccaacgactcggtaaagtgaactctgagtaccgcgcgaagtttttaagtccggcacagtatttgtataaagcaggggcatggactcacgtgaaggggaacatgccaaatcaggtcaaagaactccgtgagaaggctgagttctatcgcaagcgggtgcagggaacccacttctcacgggaccacctgaatcagatcctatcagacagcaactgctgttgggatgttagtagtacgacaagcagcgagggaaccgtatccagtaatatccgagcacttgacctcgccggcgacccaacctctcataaaacccttcaaaaatgcccaagtactgagcccgaggaaaaaggcaacattgtggaagagcagccacagaagaataccacagagaagctgggtgtgtcagctcctaccattccagtcaggcgccgcttggcatgggatactgagaacacatcggaggatgtgcagaagcagccgggagagaaggaggaggaagatgataatgaagaagaaggagatcggaaaaccggtaagcaggcattcatgggagaacaggagaaactggacgtgagagagaagtctaaagctgacaaaatgaaagagggctccgactccagtgtgtcttccgaaaaaggagggcgcctgccaaccccaaaactgagagagctcgggggtatacagcgcacccatcacgatctgaccactcctgcagtagggggcgctgtactcgtgagtcctagtaagatgaaaccgcctgcgcctgaacagagaaagcggatgacctcacaggactgtctggaaactagtaagaacgacttcacaaagaaggagtctcgggccgtatccctcctgacaagccctgccgccgggatcaagacagtagacccacttccactgagggaggactccgaagacaatatccacaagtttgcagaagctactctgcctgtctcgaagatacctaagtaccccaccaaccctcccggtcagctcccgagtcccccccacgtccccagttactggcatccaagcagacgaattcaggggagcctccgcgatcctgagttccagcacaatgtgggaaaagctcgtatgaacaatctgcaactcccgcagcacgaggcctttaacgatgaagacgaagacaggctctcagagatctctgccaggtcagccgccagctcgctgagagccttccagaccctggcccgggcaaagaagagaaaggaaaacttctgggggaaaacgtag

SEQ ID NO: 194379 - DNA, 210 bp, Artificial Sequence
  Description of Artificial Sequence: Synthetic coding sequence
atgcccgtgcggttcaagggcctgagcgagtaccagcggaacttcctatggaaaaaatcctacctcagcgaatcctgtaactcaagcgtgggtcgaaagtacccttgggcaggcctccgctccgaccagcttggcaaccagggtcgctgcaggactaaaattcaacatagcgatattagttctctgcttattttggtatgctcgacctag

SEQ ID NO: 194380 - DNA, 669 bp, Artificial Sequence
  Description of Artificial Sequence: Synthetic coding sequence
atgcccgtgcggttcaagggcctgagcgagtaccagcggaacttcttgtggaagaagtcttacctgagtgagtcctgcaacagtagcgtgggacgcaaatacccttgggccggcttgcggagcgatcagctaggaatcaccaaggagccctctttcattagcaagcgacgcgtcccctaccatgacccccagataagcaagagtctggagtggaatggtgcgataagtgagagtaacgtagttgcctctcccgaaccagaggcgccagagacacctaagtctcaggaggctgagcagaaagacgtgacacaggaacgggtgcactctctggaagcaagccgggttccaaagagaacccgaagccacagcgccgactcacgggccgagggggcttcagacgtggaaaataacgaaggagtgactaaccatacgcccgtgaacgagaatgtggaactggagcactcaaccaaggtgctcagtgagaatgtagacaacggtgtgggaatcttcacagccttcctttttaagtccattgagttcttcattggctttatcgtcatctccgtaatcctgcattttgtgttccagaatttcccgttgctgttttcctgtctgatgagtatccgtattgtcgataaccgcttacttacactggtgattgtgaattag

SEQ ID NO: 194381 - DNA, 2040 bp, Artificial Sequence
  Description of Artificial Sequence: Synthetic coding sequence
atgcccgtgcggttcaagggcctgagcgagtaccagcggaacttcctgtggaagaaatcctacctgagtgagtcatgcaattcatccgtgggccggaaatatccttgggccggactcaggtcagatcagctgggaataaccaaggagcccagctttatctcgaagcgaagagtgccctaccacgacccccagatttcaaagagtctcgagtggaacggggccatatctgagagcaacgttgttgcttcgcccgaaccagaagccccggagacaccaaaaagccaggaggcggaacagaaagacgtaacgcaggagagagtccattctttggaggccagccgtgttccaaaaagaacgaggagccatagcgcggatagccgcgctgaaggagcttctgatgttgaaaacaatgaaggcgtgacaaaccacacccctgtaaacgaaaatgtggagctcgagcattctacaaaggtcctgagcgaaaacgtcgataacggtgtgttccataataagagccagttcgtgccccccttcaagggaaactccgttatccatgagacagaatataaacgcaacttcaaggggctgagtccagtcaaggagcccaagctgcggaatgacctccgcgaaaataggaacttagagactgtatcccccgagagaaaatctaataaaattgacgatagactgaagctggaggccgagatggagctcaaggacctacaccaacctaaacgaaagttaaccccttggaaacatcagagacttggaaaggtgaactcagagtaccgggctaaattcctgtcacccgcccagtatctgtataaagccggcgcctggacacacgtgaaagggaacatgccaaaccagggaagccttaatgccatgtggtacgccgaggtgaaggagctgagagaaaaagccgagttctacaggaaacgggtccaggggactcattttagcagggaccacctgaatcaaattcttagcgactccaattgttgctgggacgtttcatcaacgacctcctccgaaggtacagtcagtagtaacatcagagcactggatctggccggggaccccactagtcataagaccctccagaaatgcccttctaccgaaccggaggagaagggcaatattgtggaagagcagccccaaaagaatacaacggagaagctgggcgtcagcgcccctacaattcctgtgaggagaaggttggcctgggacactgagaatacctctgaggatgtgcaaaagcagccaggtgagaaggaagaggaggatgacaatgaagaagagggtgacaggaagacaggcaagcaggcattcatgggtgagcaggagaaactggatgttcgcgaaaagtcaaaagccgacaaaatgaaagagggctctgactcttctgtctccagcgaaaagggcgggaggctaccgacgcccaaactccgggaacttggtgggatccagcggactcatcacgatctaaccacaccagccgtcggaggggcagtcctggtgtccccatctaaaatgaaacctcccgcccctgaacaaaggaagcggatgactagccaggactgtttggaaactagcaaaaatgacttcacaaagaaagaatccagggctgtgtctctcttaacatcccccgctgctggtattaaaacagtggatccactcccattaagggaggattcagaggacaacatacataagttcgctgaagccacgttgcctgtctccaagattccaaagtaccccacaaacccgccaggccagctgccatccccaccccatgtgcccagctactggcacccttctcggcgaattcaggggagcctccgggatccagaattccagcacaatgtcggcaaagcgcggatgaacaacctacagctgcctcaacacgaagcttttaacgacgaggacgaagataggctttcagaaatctcagctcgttctgccgcctcttccctgcgcgcattccagacattggccagggccaagaagcggaaggagaatttttgggggaagacttag

SEQ ID NO: 194382 - DNA, 2715 bp, Artificial Sequence
  Description of Artificial Sequence: Synthetic coding sequence
atggaccggtacctgctgctggtgatctggggcgagggcaagttcccaagcgccgcttctcgagaagccgagcatgggccagaagtatcctccggtgagggtactgaaaatcagcccgattttaccgcggccaatgtttatcacctgctaaagcggtccatctcagcttccatcaatcccgaggacagcacgttccctgcatgtagtgtgggggggatccctggttcgaaaaagtggtttttcgcggtccaggctatttacgggttttatcagttctgtagcagcgactggcaggaaatccacttcgataccgaaaaggacaaaattgaggatgtactgcagactaacatcgaggagtgcctgggcgcagtggagtgcttcgaagaggaggactccaacagtagggagagcctgtccctcgctgacctgtacgaggaagctgccgagaacctccaccagctgtccgacaagctcccagccccagggcgcgcaatggtggatatcatccttcttctgtctgacaaggatcctcccaaactgaaggactaccttcctacagtgggcgccctaaaacatctgcgggaatggtactcagccaagatcacgatcgccggtaatcattgtgagatcaactgtcagaagatcgccgaatatttgtccgctaatgtggtgagtctggaagacctgcgcaacgtaatcgacagtaaagaactgtggagggggaagatacagatatgggagcgtaagttcgggttcgagatctccttcccagaattctgcctcaaaggcgtgaccctcaagaactttagcaccagtaatctcaacactgacttcctggctaagaaaataatcccgtccaaggataaaaatattctccctaaagtcttccattactacggcccggctctagaatttgtccagatgatcaagttgagtgatttgccttcctgttatatgtcagatatcgagttcgaactgggccttactaattccactaagcagaacagcgtgctgctgctggagcagatctcttcactatgctcaaaggtcggagccctgtttgtgctgccttgtaccatttctaatatcctcatccctccaccaaaccagctgagctctagaaagtggaaggagtatatcgctaagaagcccaagactatctccgtacccgacgtcgaggtgaaaggggagtgctctagttattacctgctgctgcaagggaacggaaaccgcaggtgtaaagccaccttgattcattccgctaatcagattaacggttccttcgctctgaacctcatccacggaaaaatgaagacgaaaacagaggaggccaagctaagtttcccatttgacctgctgagcctgcctcacttctctggcgagcagatagtgcagcgggagaagcaactagctaatgtgcaggttttagctttggaagaatgcctcaaacgcagaaaactcgccaagcagccagaaaccgtgtctgtcgcggagttaaagtctctgctggttcttacgcgcaagcattttctggactacttcgatgcggtaatccccaagatgatcttacgaaagatggataagattaagacctttaacatactcaacgatttcagcccagtagaaccaaatagtagcagcctaatggagaccaatccactcgagtggccggaacgacacgtactgcagaaccttgaaacctttgagaaaaccaagcaaaagatgcgaaccgggtcccttccacattccagcgagcagctgctcgggcacaaagaaggcccccgggactcgattacgctgttggacgccaaggaactgctcaagtactttacaagcgatggactgccaatcggggatctgcagcccctccctattcagaagggagaaaagacgtttgtgttgacacctgaactgtcacctgggaagctccaggtcctgccctttgaaaaggcgtcggtgtgccattaccatggaatagagtactgcttagacgataggaaggctttagaacgcgacggaggttttagcgagctgcagtctcgcctgattaggtatgaaacacaaacaacctgtacaagagagtcattccccgtaccaactgttctatcccctctcccgtcgccagtagttagctctgatcctggatctgtgcccgacggggaggtgctgcaaaatgaattgcggacagaagtgtccaggttgaagaggaggagtaaggatctcaactgcctctacccacggaagagactcgttaaaagcgagagtagtgagtctctcctctcccagaccacgggcaactctaaccattaccaccaccacgttacttctcggaaaccacagaccgagaggtccctacccgtgacgtgccctctcgtccccattccgtcttgcgagaccccaaagctcgccacaaagactagttccggacaaaaaagcatgcatgagagcaagacgagcaggcagatcaaagaatctagatcacagaaacatacccggattttgaaagaagtagtaacggagactttaaagaagcactccatcaccgagactcacgagtgcttcactgcctgtagccaaagattgttcgagattagcaagttttatctgaaagaccttaaaacatctcgaggattgttcgaggagatgaaaaaaactgccaacaacaacgctgtccaggtaatagattgggtcctcgagaaaaccagcaaaaaatag

SEQ ID NO: 194383 - DNA, 1374 bp, Artificial Sequence
  Description of Artificial Sequence: Synthetic coding sequence
tgaatggccgagaccgtgtggagcaccgacaccggcgaggccgtgtataggtcaagagatccagtgaggaacctgcggctgcgtgtgcacttgcaaagaattacatcttctaacttcctccactaccagccggcggctgaacttggcaaggatctcatcgatctggcaacgttcaggcctcagccaaccgcttccggccacaggcccgaggaggatgaggaagaggaaatcgtaatcggatggcaggagaagcttttttcacagtttgaggtggacctgtaccagaacgaaacagcttgtcagtcgcccttggattatcagtaccgccaggaaatattgaagctggagaatagcggtggcaagaaaaataggcgcatcttcacatatactgacagcgaccggtacacaaacctggaggaacactgtcagagaatgacaacagccgcgtcagaggtgccaagcttccttgtagaacggatggccaatgttagacgccgcaggcaggaccgtagaggaatggaaggggggatcctgaaatcccgcatcgtgacttgggaaccatccgaggagtttgttcgcaacaaccacgtgattaacacaccgttacagacaatgcacatcatggccgaccttgggccatacaaaaagttgggatataaaaaatatgaacatgtcttgtgtaccctgaaggtcgattcaaacggtgtgatcacggtgaagcctgactttaccgggctcaagggcccttaccggattgagaccgaaggggagaaacaggaactttggaaatatactatcgataacgtgtccccacatgcacagccagaagaggaagaaagagaacgcagggtgtttaaggacctgtacggtagacataaggaatacctgtcctctcttgtgggaactgactttgagatgacggtgcctggggctctccggctgtttgttaacggcgaggtggtgtcggcgcagggctatgagtacgataatctctacgtgcatttctttgtagagttacctaccgcccactggagttcaccggcctttcagcagctgtctggagtgacacagacctgtacaaccaaatccttggccatggataaagtggctcacttttcgtatccatttacattcgaagccttcttcctgcatgaagatgaatcaagcgacgcgctaccggaatggccagtgctgtattgtgaggtattgagcctggatttctggcagaggtaccgcgtggagggctacggggcggtggtcctgcctgcgactcctggcccatcctggaaccgagcacctttcaggaaggggtgtggggtttgctggactgtgtggaaaggctccgcaagcagggtgcctttcacaatgtgctag

SEQ ID NO: 194384 - DNA, 1566 bp, Artificial Sequence
  Description of Artificial Sequence: Synthetic coding sequence
atggccgagaccgtgtggagcaccgacaccggcgaggccgtgtaccgctcgcgggatcctgttcgcaacttacggctgagggttcacctgcagaggattacgtctagtaacttcttgcactaccaaccagcagccgagctgggaaaggatctaatcgatcttgcaacgtttagaccccagcctactgcctctggccaccgccccgaagaagatgaagaggaagaaattgtcatcggctggcaagaaaaattattttcacagtttgaggtagatttatatcaaaatgagaccgcttgtcaaagcccactcgattatcagtatagacaggagattctgaagttagaaaattccggcggcaagaaaaatcggagaatttttacctacacagactctgacaggtatactaacctagaggaacactgtcagaggatgactacggccgcctctgaggtgccgagttttttggtggaacggatggccaatgtgaggagacgccggcaagatcgacgcggtatggaaggaggtatcctgaaatcccgcatagtcacctgggagccctcggaggagttcgtgagaaacaatcacgttattaacaccccgctgcagacaatgcacataatggcggacctcgggccttacaagaaacttgggtacaagaagtatgaacacgtgttgtgtacactgaaggtggactcgaacggcgtgatcacggtgaagcctgactttactggacttaagggcccttacaggatcgaaactgaaggcgagaagcaggaactgtggaaatacacaatcgacaacgtcagccctcatgctcagccagaggaggaggagagagaaagacgggttttcaaggatctgtatgggagacacaaggagtacctgtcctccttggttggtacagactttgagatgaccgttcctggcgccttacggctattcgtcaacggtgaagtggtaagtgctcagggttacgagtacgataacctttatgtccatttcttcgtggagcttccgaccgctcactggagctcccccgcctttcagcaactgtctggagtgacacagacatgtaccaccaagagcctcgcaatggacaaggtcgcccatttctcatatccttttaccttcgaggcatttttcttgcacgaggacgagtcctccgatgcactgcccgagtggcccgtgctgtactgcgaggtgctgagtctggacttttggcagcgctacagagttgagggatatggcgccgtcgtgctgccagccactcctgggtcccacacacttactgtgtcaacttggagacccgtcgagctcggtacagtcgcggagctccgacgcttttttatcggaggttcattggagttggaggatctcagctacgtacgtatcccgggcagcttcaaggctcttctgtccagcagtaagacaaaagaaggccggaaggtcgatggggagagggttttgaatccccaacccgtaagtttgtcgctttttcccggcaagccacactctacagcatggggactactaaggcttcgctatgagttattcctaagcaagtag

SEQ ID NO: 194385 - DNA, 1680 bp, Artificial Sequence
  Description of Artificial Sequence: Synthetic coding sequence
atggccgagaccgtgtggagcaccgacaccggcgaggccgtgtaccggtctagagacccagttaggaatttacgactacgcgtgcacctacagagaataacttcttctaactttctccactaccagcccgcagccgagcttggtaaagacctcattgacctcgccacctttcggcctcagcccacagcaagcggtcacaggccagaggaggacgaagaagaggaaattgtcattggttggcaggagaagttgtttagtcagtttgaagtcgacctgtaccagaatgagaccgcatgccagtcacccttggattatcagtaccggcaggagattctgaaactggaaaacagcggagggaagaaaaacaggcgaatattcacgtacacagacagcgaccggtacacgaacctggaagagcactgtcagcgtatgactaccgcagcttccgaggtccccagctttttggtcgagaggatggcgaatgtcagaagaagacggcaagatagacggggaatggaaggcggcatactaaaaagtagaattgtgacctgggagccaagtgaagagtttgtccgcaacaaccacgttataaacacaccactgcagactatgcacattatggcagacttgggcccttataagaagttagggtataaaaaatatgaacatgtgctttgcaccctcaaagtggacagcaatggtgtcatcactgttaaaccagactttacgggtcttaaaggcccgtaccggatagaaaccgagggcgagaagcaagaactttggaaatacaccatagataacgtgtctccccacgctcagcccgaggaggaggagcgcgaacgccgcgtctttaaagacctctatggtcgccacaaggagtatttatcatccctggtgggcacagatttcgaaatgaccgtgcctggggcactccgactcttcgttaacggcgaggtggtgagcgcgcagggctacgaatacgataatctgtacgtccattttttcgttgagctgcctaccgcccactggtcctcgccagcattccagcagctctctggtgtgacacagacgtgcaccacgaaaagtctggctatggacaaggtcgctcacttttcataccccttcacctttgaagccttctttctccacgaggatgagagcagcgacgcactccccgagtggccagtgctttactgtgaagtcctgagccttgacttctggcagagatacagagtagagggatacggagccgtggtcctgcccgcaactcccggttcacacaccctgaccgtgtcgacgtggcggcccgtggaactcgggacggtagctgagttgcgaagattttttatcggggggtccctggaactggaggacttaagctacgtgaggataccaggttcttttaaaggtgaaaggctaagccggtttggcctgcggaccgagacaacagggactgtcacattccgcctgcactgcttgcagcagtcacgcgcctttatggagtcaagttccttgcagaagagaatgcgtagcgtcctggaccggctggaaggcttttcccaacagtcaagcatccataacgttctggaggcattccgtagagcccgccggagaatgcaggaggctcgggagtccctcccccaggacctggtctcgcctagcggtactctcgtatcctag

SEQ ID NO: 194386 - DNA, 1563 bp, Artificial Sequence
  Description of Artificial Sequence: Synthetic coding sequence
atggccgagaccgtgtggagcaccgacaccggcgaggccgtgtaccggtcacgcgacccagtgagaaatttgcgtctgagagtgcacttgcaacgtatcaccagctcgaactttttacattaccaacctgccgccgagttgggcaaggatctgattgaccttgccaccttccgcccacagcctaccgctagcggacatcgccctgaggaggatgaagaggaagagatcgtaattggatggcaagagaagctttttagtcagttcgaagttgacctgtatcaaaacgagactgcctgccaaagtcctctcgactaccagtacaggcaggagatcctaaaacttgaaaattctggtgggaagaaaaaccgccggatattcacctacacagatagtgaccggtacactaacctagaggagcactgccaaaggatgacaacagccgccagcgaagttccttcctttctagttgaacgcatggctaacgtgaggcggcgccggcaggaccgtcgcggtatggaggggggcatcctgaagagcagaatagtgacatgggaacctagtgaagagttcgtacggaacaatcatgtcatcaatacacccctgcagaccatgcatattatggctgacctaggaccatacaaaaaattgggatataagaagtacgaacatgtgctctgcacgctgaaggtcgacagcaacggtgtgatcactgttaagcccgacttcaccgggctgaaagggccttaccgcatcgaaaccgagggtgagaagcaagaactctggaagtatactatagacaatgtttccccacacgcacagccagaggaggaagaacgcgaaagaagggttttcaaggatctgtatggacgccataaagagtacctcagctccctcgtgggtacagatttcgaaatgacagtgccgggcgccctgcggctgtttgtgaacggggaggttgtttcggctcagggatacgagtatgataacctgtacgtgcactttttcgtcgagctgcccacagcacactggtcttctccagccttccagcagctttccggcgtgacccagacatgtaccacaaaaagcctcgccatggataaggtcgctcacttttcatacccctttactttcgaggcttttttcctgcatgaagatgagagttctgatgcgctgcccgagtggcccgtgctgtattgtgaggttctttctcttgacttctggcagaggtaccgcgtcgagggttatggggcagtcgtgttgccagctacacccggctctcacaccctgacggtctccacctggagacctgtcgagctaggcacagtggccgagttaagaagattttttattgggggtagtcttgaactggaggaccttagctacgtccgaatcccaggatcattcaaaggtctctcttcctcaaagacaaaagagggcagaaaagtggacggggaacgggtgctcaacccccaacccgtatctctgagcctcttccccggtaaaccacactccacggcctggggactgcttcgtctgaggtacgagctgttcctgtctaaatag

SEQ ID NO: 194387 - DNA, 1650 bp, Artificial Sequence
  Description of Artificial Sequence: Synthetic coding sequence
atggccgtgcccgtgagcagcttcgcccagcggacccggagccggtttcgggtgcatctgcagaggattaccagttctaatttcttacattaccagccagccgctgaactggggaaagacctcattgatctcgcaacctttaggccacaaccaacagcctcaggacatagaccggaagaggatgaagaagaggaaatcgtgataggatggcaggagaagctgtttagtcagttcgaggtcgatctgtaccagaacgaaacagcttgtcagagtccactggactaccaatatcggcaggagattcttaaactcgagaacagcggagggaaaaagaacaggcggatctttacttacactgattccgacaggtacactaacctcgaagagcactgccagagaatgactacagctgcatctgaagtaccttcctttctggtggagaggatggcgaatgtccgccgccgcagacaggaccgacgagggatggaaggtggcatcctcaagagtaggattgtgacgtgggaaccatccgaagaattcgtacggaacaatcatgtaatcaatacccccttgcaaaccatgcacataatggccgaccttggtccttataagaaactcgggtataaaaagtacgagcacgtgctttgcacattaaaggtcgattccaatggtgtgattactgtcaaaccagatttcacaggcctcaagggaccatatcgcatcgagacggagggggagaagcaggaactgtggaagtatacaatcgacaatgtaagcccccatgcccagccagaagaagaggagcgcgagcgccgagtttttaaggatctttatggacgtcacaaggagtatctgtcatcacttgtggggacggacttcgaaatgacagtcccgggagcccttcggctgtttgtaaacggagaggtggttagcgcacaagggtacgagtatgataatctctatgtgcacttttttgtggaattgcctactgcgcattggagttctcccgcttttcagcagctgtctggagtcacacagacgtgtactactaagagcttagctatggataaggttgcccacttttcgtatccttttacttttgaggccttttttctccatgaggacgaatctagtgacgcactgcccgaatggccagttctatattgtgaggtgctttctttagacttttggcagcgctatagagtcgagggttacggcgccgttgtgctgcctgcgactcccggttctcataccctgaccgtgagcacttggcggcctgtggagttaggtacagtggcagagctgaggaggtttttcatcggaggttctctcgagctagaagaccttagctatgtgcgcattcccgggtcctttaaaggagagagactgagcagattcgggcttcgcaccgagactactgggaccgtgacattccggctgcactgtcttcagcagagtcgggctttcatggagtcttcttccctgcaaaaacgcatgcgaagtgtactcgacaggctggagggctttagtcagcagtcctccatccacaacgtgctggaagctttccggcgcgctagaagacggatgcaagaggcgagggagtccctaccccaggacctcgtcagtccctcaggcactctagtctcatag

SEQ ID NO: 194388 - DNA, 1071 bp, Artificial Sequence
  Description of Artificial Sequence: Synthetic coding sequence
atgcacatcatggccgacctgggcccctacaagaagctgggctacaagaaatatgagcacgtcctgtgtacattgaaggtggactctaatggggttattaccgtaaaacccgactttactggactgaagggtccatatcggatcgagacagagggagagaagcaggaattgtggaaatatactatcgacaatgtgtctccccatgcacagccagaggaggaagagagggagagaagggtttttaaggatctttatgggcgccacaaggaatacttgtcttctctagtgggtaccgacttcgagatgacagtccccggcgcactccggctgttcgttaatggcgaagtagtgtccgctcagggctatgaatacgataacctctacgtgcacttctttgtcgagcttcccaccgcccattggagtagtcctgcgttccaacagctgagtggtgtcactcaaacctgtaccaccaagtcccttgcaatggacaaagtcgcgcatttttcatatccattcacatttgaggcgttttttctgcatgaagacgaatcatcagatgccctgcctgagtggccagtgctttattgcgaagtgctgtctttggacttctggcagagatatcgcgtcgaaggttacggcgccgtcgtcctccctgcaacccccggctctcataccctgaccgtctccacctggcgaccagtcgagctcggtaccgtcgccgagttgcggcgcttcttcatcggcgggtcactggagctcgaagatttgtcctatgtgcgcatccccggaagctttaaaggcgaaaggctgagcaggttcggtctgagaacggaaaccacaggtaccgtgacttttagactccattgtctgcagcagagccgggcatttatggagtctagctcacttcagaaacgtatgcgcagcgttcttgatcgcctggaaggattttcgcagcagagcagtatccacaacgtgctcgaggcctttcggcgcgcccgtcgccggatgcaagaggcccgcgaaagtttgccccaggatttagtgagtccgtcaggtacattagtctcttag

SEQ ID NO: 194389 - DNA, 4746 bp, Artificial Sequence
  Description of Artificial Sequence: Synthetic coding sequence
atgaaggcccagggcgagaccgaggagagcgagaagctgagcaagatgtcctctctactcgaaaggctgcacgctaagttcaatcagaatcggccttggtcagaaaccatcaaactcgtgaggcaagtcatggagaagagggtagtgatgtcctccggagggcaccagcacctggttagctgtcttgaaactttacagaaggctctgaaagtgacctcactacctgcgatgactgacagactagagtccattgctagacagaacggattggggagccacctgagcgcctctggaactgagtgctatatcacgtcagatatgttttatgttgaggtgcagcttgatccagcaggtcaactctgtgacgtgaaggtggcccaccacggagaaaatcccgtgtcttgtcctgaacttgttcagcagctgcgggaaaagaacttcgatgagttctcaaagcatctaaaggggctcgtgaacttgtacaacttgccaggggataacaaactgaagacaaaaatgtatttggcgctgcaaagtctggagcaggatctgtctaagatggccatcatgtattggaaggcaaccaacgccggccccctggacaaaatcctgcatgggagcgtgggttatcttacccccagaagtggagggcacttgatgaacctgaaatactatgtttcgccttcagatctgctggacgacaaaacagcttctccaatcattctccatgaaaacaacgtgagccggagtctgggaatgaatgcctccgtgactatcgaaggcacttccgccgtttacaagctccccatagctcctctcataatgggctctcaccctgtagacaacaagtggaccccgtccttctcatcaatcacaagtgccaattctgttgacctgcccgcatgctttttcttgaagttcccacaacctattccggttagtagggccttcgttcagaagctgcaaaattgcactgggattccactgtttgaaacgcagcccacttatgcccccttgtacgagctcattactcagttcgagctcagtaaagaccccgaccctatacctctcaatcacaatatgaggttctatgccgctctgccaggccagcagcactgctatttcctgaacaaggacgcgcccctccccgacgggaggtctctgcaagggacactggttagcaagatcacgttccagcatcctggaagggtgccactgatactgaacctcattagacatcaggttgcttacaataccctcatcggttcgtgcgtgaagcgaacaattctaaaggaggatagcccaggtttgctgcagtttgaggtgtgcccgctgtcagaatcacgcttttctgtaagtttccagcatcccgtgaacgacagtctggtgtgcgtcgttatggatgtgcaagattctacgcatgtgtcttgcaagctctacaaaggcctttctgatgcactgatctgcaccgatgactttatcgctaaagttgtgcagcgctgcatgtccattcctgtgaccatgcgagccattcggcgaaaggccgagacgatccaagctgatactcctgcattgagcctgatcgctgagaccgttgaggacatggtcaaaaaaaatctcccccctgcctccagtccaggttacggcatgaccactgggaacaaccctatgtcaggaactacaactcccaccaatacctttcccgggggaccaattacgacacttttcaacatgtcaatgagcattaaagacaggcatgaaagcgtgggtcatggcgaagacttcagcaaggtgtcacagaatccaatacttacctccttgctgcagatcacggggaatgggggctcaacaattggatcctctcctacacccccccatcatacgcccccacctgtgagtagtatggccggtaacactaaaaaccaccccatgcttatgaacttgttaaaggacaaccccgcacaggactttagtaccctttacgggagcagccccctcgaacgtcaaaatagttcttccggctccccacgtatggaaatttgttctggcagcaacaagaccaaaaaaaaaaaatccagtcgcctacctccagagaaacccaaacatcagacagaggacgatttccagcgcgaactcttcagcatggacgttgatagccagaatcccattttcgacgttaacatgactgcagacaccttagatactcctcacattacacctgcgccatcccaatgcagcaccccacctactacatatccacagcctgtgcctcatccccagccatctattcagcgcatggttaggctgtcctcttctgacagcattggtccagacgtgacggatatccttagcgacatagccgaggaagcctctaaactgccttccaccagcgacgattgtcctgcgatcggtactcccctcagagactcatcttcgagcggccactcacagtcaaccctattcgatagcgatgtgtttcaaacaaacaataacgagaatccttacactgaccccgccgatctgatcgccgacgctgccgggtcccctagctcggattccccaacaaaccattttttccacgacggggtggattttaacccagatcttctgaactcccagagtcaaagcgggttcggcgaggagtactttgatgaatctagccagtccggggacaacgatgatttcaagggtttcgctagccaagctctcaacacccttggggtgcctatgctgggaggtgataacggcgagactaagtttaagggcaacaatcaggctgatacagtcgacttttccattatttcagtggccggtaaagcactcgcgccagcagaccttatggaacaccatagcgggagccaggggccactgttgacaactggagacctgggcaaggagaaaacgcaaaagagggttaaagaaggaaatgggacatctaattccaccctgtcaggtcccggtcttgatagcaaacctggcaagagaagccgtaccccaagtaatgatggcaagagcaaagacaagcctcctaaaagaaagaaggcggacacagaaggcaagtcaccctctcatagctctagcaacaggccttttacaccgcctactagtacaggaggatcaaagtcacccggatccgcaggtcgatctcagaccccccccggagtggcaactccaccaatccccaaaatcacaatacaaatcccgaaaggaactgtaatggtggggaaaccttcaagtcattcacaatataccagttccggcagcgtatcttcctcaggttcaaaaagtcaccattctcactcatccagcagcagcagctccgcctccacctcaggcaagatgaaatcgtccaaaagcgaagggagctcaagctccaagctgtcttctagtatgtattcctctcaaggcagcagcgggtcctcacagtcaaagaattcttcacagagcggaggtaaacctggaagtagccctattactaagcatggcctatcatctggcagcagctcaacaaaaatgaaaccccaaggcaagcccagctctctgatgaatccctcccttagcaaacccaatatttcaccttcccactcccgcccccccggtgggagtgacaagctggctagcccaatgaaacccgtgcctggtaccccaccatcctccaaagccaagtcaccaatctctagtggatcaggggggagccatatgtcaggtacctcttcctcaagtggtatgaagtcatcctcagggctaggatcatctggatcccttagccagaagacccccccttccagtaatagctgcactgcgtcctcaagcagctttagctcatccgggagttccatgtccagctcgcagaatcagcacggctctagcaagggaaagtccccttccaggaacaagaaaccatctctcacagccgtgattgacaagctgaagcacggagttgtaacatctggccccggcggcgaggatcccctcgatggacaaatgggcgtgagcactaatagctcttcacaccctatgtcatcaaagcataacatgagtgggggtgagttccagggaaagcgcgaaaagagcgacaaagacaaatctaaggtctcgactagcggaagttctgtggatagtagcaagaaaacaagtgaatcaaagaatgtgggatcaactggagtcgctaaaatcatcatatctaagcacgacggggggagcccatctatcaaggcaaaagtgaccctacaaaagccaggtgaaagcagcggtgaaggcttgcgcccccagatggcctccagcaaaaactatggttcacctttgatctcagggtccaccccaaagcacgaaagggggtctccatctcacagcaagagcccggcctacactccacagaacctcgatagcgaaagcgagagtggctctagtatcgctgaaaagtcttatcagaattcacctagcagcgacgacggcatcagacccctgcccgaatactcaacggaaaagcataaaaagcataaaaaggagaaaaagaaagttaaagataaagatcgcgatagagatcgggacaaagaccgggacaaaaagaagtcccactctataaagccagagagctggtccaaatcgccaatttcctctgaccaatctttatccatgacgtccaataccatattgtcagctgaccgaccctctaggctgtctcccgatttcatgatcggtgaagaggacgatgatctgatggacgtggccttgatcgggaattag

SEQ ID NO: 194390 - DNA, 1671 bp, Artificial Sequence
  Description of Artificial Sequence: Synthetic coding sequence
atgaaggcccagggcgagaccgaggagagcgagaagctgagcaagatgtcttccttgttggaaagacttcatgcgaagtttaatcaaaaccgaccctggagcgaaactatcaagttggtgcgccaagttatggagaaaagagtcgtcatgtcttcgggcggccaccagcacctcgtctcatgtttggagacactgcagaaggctcttaaggtaactagccttcccgcgatgacagacagactggagagcattgctcgccagaacgggttgggaagccatctttcggcatctggcaccgagtgctatatcacctccgatatgttctacgtggaagtgcagctcgaccctgctggacagttatgcgatgtgaaagttgcgcaccacggggaaaatccagtcagctgccctgagcttgtgcaacagcttcgcgagaagaacttcgacgagttctctaagcacttgaagggactggtcaatctttacaacctgcctggagacaacaagcttaaaaccaaaatgtacttggcgctgcagtccttagagcaggaccttagcaagatggcaattatgtactggaaggcaaccaacgccgggcccctcgataaaatcctgcatgggagtgttggttatctgacacccaggtctggagggcacctcatgaacctgaaatactacgtgagccccagcgacctgctggatgacaaaacggcgtcgcccatcattcttcacgagaacaatgtgtccagatccctcggaatgaatgccagcgtgacaattgagggcacttctgcggtctacaagttgcccattgcacccctgatcatgggctcacaccccgtggacaacaagtggacaccttcattctcaagtataacatctgctaactctgtggacctgcctgcatgcttctttctgaagtttccacagcccatacccgtgtctcgtgccttcgttcagaagctgcagaactgtacaggtatccctctgttcgaaacacaacccacatatgcccctctctacgaacttattactcaatttgaactctcgaaagacccagaccccatacctctgaaccataacatgaggttttatgcagccctgccagggcagcagcactgttactttctaaacaaggacgccccattacctgacggaagaagcctgcagggaacactggtttctaagatcacctttcaacatcctggccgggtccccctgatactcaacctgattaggcatcaggtggcctataataccctgatcggctcgtgcgtaaagcgcactatcctcaaggaggactccccaggacttttgcagtttgaggtgtgccccctgagcgagtccagattctcagtctccttccagcaccccgtcaatgactcactggtgtgcgtggtaatggacgtgcaagacagcacacacgtgagctgcaaactttataaaggactctctgacgccctgatttgcacagacgatttcatcgctaaggttgtccagagatgcatgagtattccagtgacaatgcgagctatcaggagaaaggctgaaacgatccaggccgacacgccagcactgagcctcatcgcagagacagtcgaagacatggtcaaaaaaaacctcccgccagcaagttcccctgggtctaagaacccggagctgggcagcggttag

SEQ ID NO: 194391 - DNA, 408 bp, Artificial Sequence
  Description of Artificial Sequence: Synthetic coding sequence
atggccgagaagttcgaccacctggaggagcacctggagaagttcgtggagaatatcagacagctcggtattatcgtctcggactttcagccctcgtcacaagccggcctgaaccagaagctgaacttcatcgtcaccgggctccaggacatagacaagtgtagacagcaattacacgacatcacagtaccacttgaggtgtttgaatatattgatcaaggtaggaaccctcagctgtatacaaaagaatgcctcgagagagccctggctaaaaacgagcaagttaagggcaagatcgacacaatgaagaaattcaagtcacttctgatccaggaactgtcaaaagtgtttcctgaagacatggccaaatatcggtctatccgcggcgaagatcacccacccagctag

SEQ ID NO: 194392 - DNA, 354 bp, Artificial Sequence
  Description of Artificial Sequence: Synthetic coding sequence
atggccacctacagcctggccaacgagcggctgcgggccctggaggatattgagcgcgaaataggcgcaattctccagaatgcgggcaccgtcattttagagctctctaaggaaaaaactaacgagcggctcttggatcgccaggccgccgcgttcacagccagtgtccagcatgtagaagcggagctgagtgcgcagatacggtacctaacccaggttgcaacaggtcagcctcatgaaggatctagctactcctcacgcaaggactgccaaatggcactgaaaagggtggattacgccaggctaaagctgtccgatgttgctaggacctgtgagcagatgctggaaaactag

SEQ ID NO: 194393 - DNA, 6543 bp, Artificial Sequence
  Description of Artificial Sequence: Synthetic coding sequence
atggccgccttcggcatcctgagctacgagcaccggcccctgaagcgacccagactgggccctccggacgtttacccacaggatccaaaacagaaagaagatgagctgacagctctcaatgtcaaacagggcttcaataatcagcccgccgtgtcgggcgatgagcacgggtctgccaagaatgtcagtttcaacccggctaagattagctccaacttttcctccattattgccgagaaactgaggtgcaacactctgcccgataccgggcgacggaaacctcaggtcaatcagaaggacaacttttggctggtgacagctaggtcccagagtgccataaacacctggtttactgatctagccgggacaaagccattgacacaactggcaaagaaagtacccatctttagtaaaaaagaggaagtttttggatatctggccaagtacaccgttccagtcatgagagccgcttggctcattaaaatgacttgcgcgtattacgccgccatatcggagacaaaagtcaagaaaagacacgtggacccattcatggaatggactcagattattactaaatacctgtgggaacagctgcagaagatggctgagtactaccgccccggacctgctggcagtggtggctgcggcagcaccatcggcccattgccccatgacgtggaagttgccatacgtcagtgggattatactgagaagcttgcaatgtttatgttccaggacgggatgctcgatcggcacgaatttctcacctgggtgctggagtgtttcgagaaaatccggccaggggaagacgaactgttgaagcttctgctcccactgctgcttcgttactccggagaatttgtccagagtgcatatctcagccggcgccttgcatatttttgtacacggcgattggctctccaactcgatggcgtcagttcccatagcagtcatgtgattagcgcacagtccacatctacattacctacaacgcctgccccccagcctccgacaagttctacacctagtacacccttcagtgatctgctcatgtgcccgcagcaccggccgttggtgttcggcctttcgtgtattctccagaccattctgctgtgttgtccaagcgctttggtctggcattacagcttgacagattctagaatcaagactggttcgcctcttgaccacttacccatcgctccatcaaacctcccaatgcctgaaggaaacagtgcctttactcaacaggtgagggcaaaattacgagagatagagcaacaaattaaagagcggggacaagctgtggaagttcgatggtccttcgataagtgtcaggaagctactgcagggttcaccataggtagggtcttgcacaccctggaggtgctggacagtcacagttttgagagatcagatttctcgaattccctggactctttgtgtaataggatcttcggattagggccctcaaaggacgggcatgaaatctcctcagatgacgacgcggtggttagcctcctatgtgagtgggccgtcagctgtaaacgctcaggaagacatcgcgccatggttgtggcaaagcttctcgaaaagagacaggcagagattgaagctgagagatgcggggagagtgaagctgccgatgagaagggttctatcgcttccgggagtctgtccgcgccttccgccccgatcttccaggatgtcctgttacagtttctagatacccaggcacctatgctgaccgaccccagatcagagtctgagcgggtagaattctttaatctggtgctgcttttctgcgagctgattcggcacgacgtcttctcccataacatgtacacctgcactctcatttcaagaggcgatctcgccttcggcgcgccggggcctaggccaccatctcctttcgacgaccccgcagatgaccccgagcacaaggaggctgaggggtcctccagtagcaagttggaagaccctggcctatcagaaagtatggatatcgatccatcttcttccgtcctgttcgaggacatggaaaagccagactttagcttattcagtccaaccatgccatgcgagggcaaagggtcgccatccccggaaaaacccgacgttgagaaggaagtcaaacctcctccgaaggagaagatagagggcactctgggggttctctacgatcaaccacgtcacgtgcagtatgccactcacttcccaattcctcaggaggagagttgttctcatgagtgtaaccaaaggttggttgtgctgttcggagtcggaaaacaacgggacgatgcccgacacgccatcaaaaaaattacaaaagatatcctcaaagttctcaaccggaagggcaccgctgaaacagatcagttggcccctatcgtcccactgaatcctggcgacttaacgttcttgggcggcgaggacggccaaaagcgtcgtcgtaaccgacctgaggcatttcctactgctgaagacatattcgccaaattccaacatctgtctcattatgatcagcaccaggtgactgcccaggtctccaggaatgttttggaacagattacctcttttgccttgggtatgtcctaccacctcccactggtacaacacgtgcagttcatctttgatcttatggagtattcgcttagcatctcaggcctcatcgatttcgccatccagctcctgaatgagctcagtgtcgttgaagctgagctattgctgaaatccagcgatcttgtaggtagctatactacctccttgtgtctttgcatcgtggccgtcttacgccactaccacgcctgcctgatcttgaatcaagatcagatggctcaagtgtttgaagggctgtgcggtgttgtgaagcacgggatgaaccggtctgacgggtcatctgccgaaaggtgtattctagcatatttatacgacctctatacctcatgctcccatctgaaaaacaagtttggggagttgtttagcgacttttgttcaaaggtgaagaacactatctattgcaacgtcgagccctcggaaagcaacatgcggtgggccccagaattcatgatagacaccttagagaacccagccgcacacactttcacctatacaggactcggaaagtcgctctctgaaaatcccgcaaatcggtactcttttgtgtgtaacgccctgatgcatgtgtgtgtgggccaccacgatcctgatcgggtcaacgatatcgctatactgtgcgccgaactcaccggctactgcaaaagcttgtcggcggagtggctgggggttttgaaagccctctgttgtagcagcaacaacggcacctgtggcttcaacgacttgctctgcaatgtcgacgtctccgacctgtcttttcacgactcactggccaccttcgtcgctatcctgatcgcccgccaatgcctgcttcttgaggacttgattaggtgcgccgctataccttctctgctcaatgcggcctgctctgagcaggatagcgagccaggcgcccgattaacttgcaggatattgctgcacctgtttaaaacaccgcagctgaatccttgccagtctgacggaaacaaacctaccgtgggaatccgctcttcctgcgacaggcacctgttagccgccagccaaaatcgtattgtcgatggcgccgtgtttgccgtgctcaaggccgtctttgtgttaggcgatgccgagctgaaagggtccggctttacggtaacaggcgggaccgaggagcttcccgaagaggagggcggtggcgggagcggggggaggagacaaggcgggagaaacatatctgtggagacagcctcactggatgtgtacgcaaagtacgttctccggagtatttgtcagcaggagtgggttggagagaggtgtctgaaaagcctgtgcgaagactctaatgatctacaggaccctgtgctcagctctgcacaggcacagaggctgatgcagcttatctgttatccgcacaggctactggacaacgaggacggggagaatccccagaggcagagaattaaaaggatcctgcagaacctggatcagtggaccatgcgacaatcatcactagagctgcagctgatgattaaacagacacccaacaacgaaatgaacagtctgctggagaacatcgccaaagcgactattgaggtcttccagcagtccgccgaaacggggtcatctagtggatcaacggcctccaatatgcctagcagcagcaagaccaagcctgtactcagcagcctggagagatctggagtctggctcgtggcaccactcatagccaaattgccaacctctgtgcaggggcacgttctcaaagcagcaggggaggaactcgaaaagggacagcacttgggctcatccagcaggaaagagagggatcggcagaagcagaagtccatgtctttgctgagtcagcagccctttttgtcccttgtgctcacatgcttgaaaggccaggatgagcagcgcgaagggctcctcacttcactgtactcgcaggtgcaccaaatcgtcaataactggcgcgatgatcaataccttgacgactgtaaacccaaacaacttatgcacgaggctctcaagctcagactgaatcttgtgggggggatgttcgacaccgtacagagatcaacacagcagactacagagtgggctatgctcttgctcgagatcatcatcagtggcacggttgatatgcagtccaataatgagctgttcactaccgtactggatatgctgtcagttttgataaacggtacattggctgcggacatgagcagtatctctcaagggagcatggaggagaataaaagggcatacatgaatctggccaaaaagcttcaaaaggagctaggagaacgccaaagtgactctctagaaaaagtacgccaactgctgccactgcccaagcaaacacgcgacgtgattacttgtgaaccgcagggctcattgatcgacacgaaagggaataagatcgctggctttgactctatcttcaaaaaagagggtctccaggtttcaactaagcagaagatctccccgtgggacctctttgaggggctgaagccaagtgcccctctttcatggggttggtttggcaccgtgagggtcgatcgccgagtggcgcggggtgaggaacagcagcgtctgctcctgtatcacacccatctacgccctcgcccgcgtgcgtactatctagaaccactgccattgcctcccgaagatgaggagcccccagcaccaaccctgttggaacctgaaaagaaagctccagaaccccccaaaaccgataaacctggcgccgccccaccttctacagaagagaggaagaaaaagagcacgaaaggcaagaagcgcagtcaaccggccactaagactgaggactatggaatgggcccggggaggagcggtccctacggggtaacggtgccccccgacctgttacatcaccccaaccccggcagcatcactcatcttaattataggcagggctcgatcggtctctacacccagaaccagccattgcccgcaggaggaccgcgcgtggatccctacagaccagtgaggctgcctatgcaaaaactgccgacccgcccgacctatccaggggttctaccaaccactatgactggagttatgggtctggaaccctcatcctacaaaacatctgtgtatcggcagcagcagcccgccgtgccgcagggacagcggttacggcagcagttgcaggccaagattcagtctcaaggtatgctgggccagtccagcgtgcaccagatgacaccgtcttcctcctacggcctgcagactagtcagggctacactccttatgtgtctcatgtagggctgcaacagcacaccggccctgctggcactatggtacccccttcctactcctcacaaccctaccaatctacccatccctcaaccaatcccacactggtcgatccaacacgccatctgcagcagaggccttctggttatgtgcaccagcaggctccaacttatggacatggtctgaccagcacacagcggtttagtcatcaaaccctgcagcagaccccaatgatcagcactatgacacctatgtccgcacaaggtgtccaggcaggcgttcgctccaccgccattctgcccgaacagcagcagcagcaacagcaacaacaacagcaacaacagcagcagcagcagcagcagcaacagcaacaacaacagcaataccatattcgccagcagcagcagcagcagatccttaggcagcagcagcagcagcagcagcaacaacagcaacagcaacagcagcaacagcaacagcagcagcagcagcagcagcagcaccaacagcagcaacaacagcaagctgccccgccacagcctcagcctcagtcacagccgcagttccagaggcaggggttacagcagactcagcagcagcagcagacggcagcactggtcagacaactgcagcagcagttaagcaatacacagccacagccatccactaacatattcggtcgttactag

SEQ ID NO: 194394 - DNA, 6534 bp, Artificial Sequence
  Description of Artificial Sequence: Synthetic coding sequence
atggccgccttcggcatcctgagctacgagcaccggcccctgaagagaccacgtctggggcctccagacgtctatcctcaagaccccaaacagaaggaggatgagctgaccgcactgaacgtcaaacagggattcaataatcagcccgctgtctcgggcgacgagcacggaagcgcaaagaatgtgagctttaatccggccaaaatatcctctaatttctcctctattatcgcagagaagctccggtgtaacacgctacctgatacaggtagaagaaaacctcaggtgaatcagaaagataatttctggctggtgaccgcccggagtcagagcgccattaacacttggtttactgatctggcaggcacaaagccactaactcagctcgctaaaaaagttcctatattttctaagaaggaagaggtgtttgggtatcttgccaagtacactgtcccggtgatgcgcgcagcatggctcataaagatgacgtgcgcctactatgccgccatctcggaaacaaaagtgaagaagaggcacgtcgatcccttcatggaatggactcagataatcactaaatatttgtgggaacagctgcagaaaatggctgagtactataggcctggccctgctgggtctggggggtgtggctccacaattgggcctctgcctcacgatgtcgaagtcgctatacgccaatgggattacactgaaaagctcgccatgtttatgtttcaggatggtatgctggaccgacacgaattcctgacctgggtccttgaatgtttcgaaaaaataagacctggcgaggacgagctgcttaagttgcttctccctctcctcctccgctattccggcgagtttgtgcagagcgcctacctgtcacggcggttagcatatttctgcacgcgccggctggccctccagctcgacggcgtatcgagccatagctctcatgtgatctcagctcagagcacctctacactgccaaccacccctgcaccccagcctcctacctctagtactccgtccacaccattctcagatctactgatgtgccctcagcaccggccacttgtgttcggactgtcttgcatcttgcagactatattactctgttgtcctagcgcgttggtctggcattactccctaacagactctaggataaagaccggctctcctctggatcacctgcctatcgcgccatcaaatctgcccatgcctgaaggtaactcagctttcacacaacaggtacgagccaaactaagagaaatcgagcagcaaatcaaggaacgggggcaggctgttgaggttcgatggagctttgataagtgccaggaggccaccgctgggttcacgattggtcgagttttacacacactggaggtgctagatagccactcatttgagaggtcagacttctccaactccctggacagtctctgtaaccgaattttcggcttaggaccgagtaaagacgggcatgagatctcctctgatgatgatgccgttgttagcttgctgtgtgagtgggccgtttcgtgcaagaggagcgggcggcacagggctatggtggtcgccaagttacttgagaaacggcaagctgaaatagaggccgaaagatgcggcgaatccgaggccgccgacgagaaaggctcaattgcaagcggaagcttgtccgctccttccgctccaatctttcaagatgtgctgctgcagtttctggatacacaggcaccaatgctgactgatccaaggtccgagtcagagagagtcgaattttttaacctcgtcctgttattctgcgagttgatacgccatgacgtgttctctcacaatatgtacacgtgtacactcattagcaggggtgatctggcatttggcgcccctggacctaggcccccatccccattcgacgatcccgcagacgatcctgagcacaaggaagctgaggggtctagctccagtaagctggaggacccaggtttatcagaaagcatggacatcgatccaagttcctccgtcttgtttgaagacatggaaaagccggacttctccctcttctcccctaccatgccctgtgagggtaaggggtctccttcacctgaaaagccggatgtggaaaaggaagtcaagccacccccaaaagagaagatagaaggaacactgggagtcctgtatgatcagcccaggcacgttcagtacgcaactcattttcctatcccccaagaagagagctgctcacatgagtgtaatcagcgcctggtggtcctcttcggggtaggcaaacagcgggacgatgctaggcacgctatcaaaaagataactaaggacatattgaaagtgctgaacagaaagggaaccgctgagactgatcagcttgcaccgattgttcccctcaacccgggtgacttgacctttctcggaggcgaggatggtcagaaaaggcggaggaatcggcctgaagccttcccaactgccgaggacattttcgccaagtttcaacacctttcccattacgatcagcatcaggtaacagcccaagtgtccagaaatgttctggagcaaattacaagttttgctttgggtatgagctatcatctgccattagttcagcatgtgcaatttatttttgatttgatggaatatagcctgtctatttctggactgatcgacttcgccattcagctccttaatgagctttcagtggtggaggctgagctactgctgaagtcatccgacctggtgggcagctacacgactagtctgtgcttgtgcatcgttgccgttttgcggcattaccatgcttgcttgatcctgaatcaggatcaaatggcgcaggtattcgagggattgtgcggcgtcgtgaagcatgggatgaaccggtcagatgggtccagtgccgagaggtgtattctggcctacctgtacgacctatacacaagttgttctcacctcaaaaataagtttggagaattattttccgacttctgcagtaaggtaaagaacaccatctactgtaatgtcgaaccatcagagtctaatatgagatgggcgcccgagtttatgattgacactctggagaacccagcagcacatacattcacatacacggggctggggaaatcactctcagagaaccccgccaatcgctactcattcgtgtgcaacgcactgatgcacgtttgcgtggggcatcacgatcctgatagagtcaacgacatagctatactttgtgcagagttaacaggatattgcaaatctttgtcagccgagtggttgggcgtgctcaaagccttgtgctgcagctccaacaacgggacctgtgggttcaacgacctcctgtgcaatgtggacgtttcagacctgtcttttcacgactccctggccacttttgtggccattcttattgccagacaatgcctgctgctcgaggatttgattcgctgcgccgctatcccctccctcctcaatgcagcttgttctgagcaagactccgaacccggggctcgccttacatgcaggatcctgttacatctgttcaagaccccacagcttaatccgtgccaaagtgatggcaataaacctaccgttggcatccggtcttcctgtgaccggcaccttctggccgcgagccagaataggatcgtggacggcgcagtgtttgcagtgttgaaggcggtgtttgtgctaggcgacgctgaactgaagggctctggtttcactgtaacgggtggaacagaagagttgcctgaagaggagggagggggaggcagtgggggccgtagacagggaggcagaaatatatccgtcgagacggcctctcttgatgtgtatgccaaatacgtgctcaggtcaatttgtcagcaagagtgggtgggcgagaggtgtctgaaatcactctgtgaagactccaatgatctccaggacccggttctcagctcggcgcaggctcagaggttaatgcaactgatctgttatccccacagactacttgataacgaagatggcgaaaaccctcaacggcagcggatcaaacgcatactgcagaacttagatcagtggaccatgcgacaaagttcactggaactgcagctcatgattaaacagacccccaacaacgagatgaattcacttctcgagaatatagccaaggccaccatcgaggtcttccagcaaagtgccgagacaggctctagtagcggctcgactgcttccaacatgcctagtagttcaaagactaaaccggtcttgtcctccctggaacgctccggagtgtggctcgttgctccccttatcgccaagcttccaacgtccgtgcaggggcacgtacttaaagccgctggggaggaactcgagaaaggccagcatttgggttcatcctctcgtaaagaaagagaccgtcagaagcagaaatcgatgtctttgcttagccagcaaccgtttttatctttggtactgacttgtctgaaagggcaagacgaacagagagaagggctgctcacgagcctttattcacaggtgcaccaaatcgtgaataattggcgagatgatcagtacctggacgactgtaagccaaagcagctgatgcacgaagcactcaaattaagactgaacctggtgggcggcatgttcgacactgtccagagaagcacccagcagacgacggagtgggccatgctgttgcttgaaatcattattagcggcaccgtggacatgcagagcaacaacgagctgttcactactgtgctcgatatgctgtctgtgctcattaatggcacccttgccgccgacatgtcatcaatttcacagggttcaatggaagaaaacaaaagggcatacatgaatttggcaaaaaagcttcaaaaggagctgggtgaaaggcaatcggattcactggagaaggtgcggcagctgcttccactgcccaaacaaactagggatgtcattacttgtgaaccccagggaagtttaatcgacacgaagggcaataagatcgctggcttcgacagcatttttaaaaaggaaggccttcaagtttctaccaagcagaagatctctccatgggatctgttcgaagggctgaagccctctgcccccctgtcatggggatggttcggcactgtcagggtggaccgacgagttgccagaggtgaagagcagcaacgcctgctgttgtatcacacacaccttaggcctcgccccagagcatactacctagaacctctgccactcccccctgaagacgaggagccgccagctcctacattactggaaccagaaaaaaaagcaccggaaccacccaagacagataagccgggagccgctcccccctcaaccgaagaaagaaaaaaaaagagcacaaagggtaaaaagaggagtcaaccagcgaccaagacagaagactatgggatgggccctggtcggtccggaccctacggggtcactgtgccacctgatttgctgcaccaccccaatccaggatcgatcacgcacctgaactaccggcaaggcagcataggactatacacccagaaccagcccctgcccgccggaggacccagggtggacccataccgcccagtacggcttcctatgcagaaattgccaacccgtcctacctaccctggggtccttccgaccactatgaccggtgtgatgggactggagcccagtagctacaagacctctgtatacaggcaacaacagcctgctgtgccccaggggcagaggctgcgacagcagttgcagcaatcccagggcatgctgggacagtcttccgtacatcagatgacacccagctcctcgtatggactacagactagccagggctacacaccatatgtatcccacgttggactccagcagcacacgggcccagccgggaccatggtcccgccatcttattcctctcagccctatcaatccacacatccaagtaccaatccgaccctggtcgaccctacacgacaccttcagcagcggccatccgggtatgttcaccagcaagcccccacgtacggacacggactcactagcacacagagattttctcaccagaccctgcagcagacccctatgatctcaacaatgacaccaatgtctgcacagggcgtgcaggcaggggtacgttccactgccatcctgccggagcaacagcagcaacaacagcagcagcagcaacagcagcagcaacagcagcagcagcaacagcaacaacagcaacagcagtatcacattcgacaacagcagcagcagcaaatactacgccaacaacaacaacaacagcagcagcagcagcagcagcaacagcagcagcagcagcaacagcaacaacagcagcagcagcatcagcagcagcagcagcagcaggctgccccaccccagccccagccccagtctcaaccccaattccagaggcaaggtctgcaacagactcaacagcaacagcagaccgctgctctggttagacagctgcagcaacagttgagcaatacgcagccacagccctctaccaacattttcgggcgctattag

SEQ ID NO: 194395 - DNA, 6531 bp, Artificial Sequence
  Description of Artificial Sequence: Synthetic coding sequence
atggccgccttcggcatcctgagctacgagcaccggcccctgaagaggcccaggctgggtcctcccgacgtctatccccaggaccctaagcaaaaggaagacgagctgactgcactgaacgttaagcagggcttcaataatcagcccgctgtgtccggggacgagcatggctccgccaagaacgtgtcattcaaccccgcaaagattagcagcaacttcagtagcatcatagcagagaagctgcggtgcaacacattgccggacacaggtcgccggaagccccaggtaaaccagaaggataacttctggcttgtcacagcccgcagtcagtcggcgattaatacgtggttcactgacctcgcaggcacgaagccgctgacccagttagccaagaaggtgccaattttttccaaaaaggaggaggtgtttggttatcttgcgaagtacacagtaccagtgatgcgcgctgcttggctgatcaaaatgacttgtgcctattatgccgccatcagtgaaacaaaagtcaagaagaggcatgttgacccgtttatggaatggactcagatcatcactaaatatctctgggagcagctacagaaaatggcagagtattaccgcccgggaccagcaggctccgggggctgtggatcgaccatcggcccacttccacatgacgtagaggtcgctataagacagtgggactacacagagaaactcgcgatgttcatgttccaggatggaatgttggaccgccacgagtttctgacctgggtcctcgaatgttttgagaagatcagacccggagaggacgaactactgaagctcttattaccactcctcctccgctatagcggagagttcgtgcagagtgcctatcttagccggagactcgcgtatttttgtacccgtaggctcgccctacagcttgacggcgtctcatcccacagttcacacgttatcagtgcgcagtccacgtctaccctgccaaccactccggccccacaaccccccaccagtagcacacccagcactccgttctctgatttactgatgtgcccacagcatcggcccctggtgttcgggttgtcctgtattttgcaaacaatcctgctgtgctgtccttccgcactggtgtggcattatagccttacagacagtcggattaagacaggtagccctctagatcacctccctattgcaccttctaacttgcctatgcctgaagggaactccgctttcacccagcaggtcagggcaaagctgcgcgaaatcgaacagcagattaaggaaagagggcaggcagtcgaagtacgctggtcatttgataaatgccaggaagctaccgctgggtttacgatcggcagagttctgcacacgctggaagtgctggactcccacagctttgagagaagcgatttctcgaatagcttggattccctctgtaaccgtattttcggactgggcccatcaaaagacggacacgagatcagtagtgatgatgatgctgtcgtgtcgttgctttgtgagtgggctgtgtcctgcaaaagatctggaagacaccgtgccatggttgttgcaaaactgttagaaaagaggcaggcagagatcgaggctgagaggtgcggggaaagcgaggcagccgacgaaaagggtagcattgcttctgggagcctgagcgccccatcggcccccatctttcaggacgttctcctccaattcctggacacccaggcccctatgctcaccgatcccaggtctgagagtgaacgggtcgagttctttaacctcgtcttgctgttctgcgagctgatcaggcacgacgtcttcagtcacaacatgtacacatgtacacttattagtcgcggtgacctagccttcggagcgccaggcccccgaccaccgagtccctttgacgaccctgctgacgatccagagcataaggaagcagaaggcagctcctcttcgaaacttgaagacccaggacttagtgagtcaatggatattgatccctcgtccagcgttctgttcgaagatatggagaaacctgatttctccctgttttccccaaccatgccatgtgaggggaaaggtagtccatcgcctgagaaacccgatgttgaaaaagaagtcaagcctccccccaaggagaagattgaaggaactctaggcgtgttgtacgatcagcctagacatgtccagtatgctacccattttcccataccgcaggaagaatcctgctcccacgagtgcaaccaaaggctggtggtgctcttcggagtcgggaagcagagggacgacgctcggcacgctattaaaaagatcaccaaagatattctcaaagtcttaaacagaaagggcacggccgagacagatcagttagcaccaatcgtgccccttaatcctggtgatctgacttttttgggcggcgaggatggccaaaaacgccgccgtaaccggcctgaggcattccctactgcggaggatatcttcgccaaattccagcatctgagtcactacgatcagcaccaagtgactgcccaggtatcccgcaacgtgctggagcagataaccagcttcgctcttggaatgtcctatcacctccctctggtgcaacacgtgcaatttattttcgatttaatggagtacagcctgtctatcagcggactgattgacttcgccatccagttgttaaacgaattgtctgtcgtggaagccgagctgctactgaaaagctctgatctcgtggggagctacaccacctctctgtgtctgtgtatagtggccgtccttagacactatcatgcttgcctcatcctgaatcaggaccaaatggcgcaggtgtttgagggtctatgcggggtggtgaagcacgggatgaatcgatccgacggctcctcggcagagcgatgcattctggcatacctatatgacttgtatacctcctgctcccatcttaagaacaaattcggggagcttttctccgatttttgctccaaggtcaagaatacaatctactgtaatgtagagccttctgaatccaacatgcgatgggctccagagttcatgattgatacactggagaatccagcagcccataccttcacctataccgggttagggaaaagcctgtctgagaaccccgctaatcggtacagctttgtgtgtaatgccctcatgcatgtctgcgtgggacatcacgaccctgatagggtcaatgacattgccatcctgtgcgctgagctgactggctattgtaagagtctgagtgcggagtggctgggagtcctgaaagctctctgctgcagtagcaataacggtacatgtggatttaacgacctgctgtgtaatgtggacgtgtccgacctcagtttccacgattcactcgccaccttcgttgcaatcttaatagcccgacagtgtcttctgctggaagacctgatcaggtgcgccgccatcccgtctctgttgaatgctgcttgcagcgagcaggactcagaaccgggcgctcgccttacttgcagaatcctgctgcacctgtttaagacccctcagctgaacccttgtcagagcgatggcaacaagcctacggttggcattaggtccagctgcgaccgtcatctgctggctgcaagtcagaacaggattgtggacggggcagtgttcgccgtgcttaaggcagtgtttgtgttaggagacgccgagcttaaagggtctggttttacagttactggcgggaccgaagagctacccgaagaggaaggcgggggcggttcgggagggcgtaggcaaggcggaaggaacatcagcgtcgagactgcttccctggatgtatacgccaagtacgtgctgagaagcatctgccagcaggagtgggtcggcgagaggtgcctgaagagtttgtgcgaggattccaacgaccttcaggatcctgtgctgtcctctgcacaagcccagcgattaatgcagctcatctgctacccccatagactcttggataacgaggatggggagaaccctcagcgtcaacgcattaaacgcattcttcagaatctggaccaatggacgatgcgtcaaagctctctagagttgcaactgatgattaaacagaccccaaataacgaaatgaactccctcctggaaaacattgccaaagcaacaattgaagtttttcagcagtcagccgaaacagggtccagtagcgggtcgactgccagcaatatgccgtcatcttcgaagactaagccggtgctctcatcccttgaaaggtcaggcgtatggttggtcgctcctttgattgctaaattgcctacctccgtgcagggccacgtgcttaaagcagcaggagaggaactcgaaaagggtcagcacctggggtctagcagtcgaaaggaaagagatcgtcagaagcagaaatctatgagcctgctgagccagcagcccttcctgagccttgtcttgacgtgcctgaaaggccaggacgagcagagagaaggactgctgacaagcttatacagtcaggtccaccagattgtgaacaactggagagacgaccagtatctcgacgactgcaaacccaaacagctgatgcatgaggcgcttaaacttcggttaaacctggtggggggcatgttcgacacagtgcagcgctccacccaacaaaccactgaatgggcaatgttgctgttggaaattataatctcaggaactgtggatatgcagagcaataacgaactctttacaacagtcctagacatgttatctgtgcttatcaacggaactctggctgccgacatgagctctatcagccaggggtccatggaggaaaataagagagcctatatgaatctggccaaaaagctgcaaaaagaactcggcgaaaggcaatctgacagccttgagaaagtcagacagctactccccctgcctaaacaaactcgggatgtgatcacctgcgaacctcagggcagcctcattgacactaaaggtaacaagatcgccgggtttgactcaatcttcaaaaaagaggggctgcaggtaagtaccaaacagaagatctctccctgggaccttttcgagggcctgaagccatcggcccctctctcctggggctggttcgggacggtccgcgtagacagaagagttgcgaggggtgaggagcagcaacggctgttgttataccatacccacctccggccacgtccacgtgcttactatttggaacccctgcctctgcctcccgaagacgaggagcccccagccccaactctgctcgaaccagagaagaaggcccccgaaccacccaagaccgataagcctggagccgctccaccctctaccgaagaacgaaagaagaaatccacaaaggggaagaaaagatcacagcccgcaaccaagacggaggactatggtatgggccccggaagaagcggcccttatggagtcacggttccccctgatttgttgcaccacccaaatcccggatctatcacgcacctaaactaccgccagggttccatcggactttatactcagaatcagcctctcccagctggaggaccgagagtcgacccatatcgccctgtccgcctgcctatgcagaaactacctactcgtccaacttacccaggagtcttgcctaccaccatgaccggtgtcatgggccttgagccctcttcgtataaaacgtcagtttatcggcagcagcagccagctgtgccacagggtcagagactgcgtcagcagctgcagagccagggcatgctcggccaaagcagtgtgcatcagatgactccctcatcttcctacggcctccagacctcccaggggtacaccccctacgtgagtcacgttgggctacagcagcatacagggcccgccggcacaatggttccaccatcctattcatcgcagccttaccagtctacacatccctccaccaaccccacactggtagatcccacaagacacctgcaacaacgccccagcggttacgtacaccagcaggcccctacctacggccacggcctgacctctacgcaaaggtttagtcatcagaccctgcagcagaccccgatgatatcaacaatgacaccaatgtccgcacaaggtgtgcaggcaggtgtccgcagcaccgccattctccccgaacagcagcagcagcagcaacagcagcagcagcagcagcaacagcagcaacagcaacagcagcagcagcaacagcagcagtatcatatccgtcaacagcagcagcagcagatattacgccaacagcagcagcagcagcagcagcaacagcagcaacagcagcaacagcagcagcagcagcagcagcagcagcaacagcatcagcagcagcaacagcaacaggcggccccccctcagccacaaccacagtcccagccccagttccagcgccaaggtttgcagcagacccagcagcagcagcaaacagcagcactcgtgcggcaactgcagcaacagctcagcaacacccagccccagcctagcacaaatatatttgggcggtattag

SEQ ID NO: 194396 - DNA, 393 bp, Artificial Sequence
  Description of Artificial Sequence: Synthetic coding sequence
tgaacccccaaccggcggcggaagaagcagctgaacgccgccttccttccccaggatgaactgacagccctgaacgtgaagcagggatttaacaatcagccagccgtgtccggggacgaacacggcagcgccaagaacgtgagtttcaatcccgctaagatctcttctaatttctcttctattatcgctgaaaagcttagatgcaacactcttccagacaccggaaggcgtaaacctcaggtaaaccagaaggataatttttggctggtcacggcccgcagccagtctgctataaacacgtggtttacagacttagcaggcactaagccacttacccagctggcaaagaaagtgccaatcttcagtaaaaaggaggaggtcttcgggtactag

SEQ ID NO: 194397 - DNA, 6384 bp, Artificial Sequence
  Description of Artificial Sequence: Synthetic coding sequence
gaggacgagctgaccgccctgaacgtgaagcagggcttcaacaaccaaccagctgtctctggagatgagcatggttcggctaagaatgtaagcttcaaccctgccaagattagtagcaatttttctagtatcatcgccgaaaaactccggtgcaatacattgcctgacactggccgcaggaagcctcaggttaatcagaaggataacttctggcttgtgaccgctcggtcgcagtccgccatcaatacatggtttacagacctggccggcaccaaaccgcttacccagctcgcaaaaaaagtccctattttctcaaagaaggaggaggtgtttgggtacctagctaaatacacagtcccggtcatgcgagcggcttggctgattaagatgacttgtgcttattacgcagccatttctgagactaaagtcaagaaacggcacgtagatccatttatggaatggacgcagataatcacaaagtatctctgggagcagctccaaaaaatggccgagtattacaggccagggcctgccgggagtggaggctgtggcagcaccatcggacccctgccacacgacgtggaagtggccattcgccagtgggattatacggagaaactggccatgttcatgttccaggacgggatgctggatcgccacgagtttctgacctgggtgttggaatgtttcgaaaagattcgtcctggtgaggatgaacttcttaagttgctcctccccctgctcctgcgctacagcggggagttcgtccagagtgcataccttagccgtcggttggcctacttttgcaccaggaggctggccctgcaactggatggtgtgtcgtctcacagctcacatgtgatttcagctcagtcgacctctacactaccgactactcccgcgcctcagccccctacatcgagtacaccctctactcccttttccgatctcttgatgtgtccacaacatcgcccccttgtgttcggcctctcctgtattttgcagacaatcctgctgtgctgtccttcagcacttgtgtggcattatagtctgactgattccagaattaaaaccggctcacccctcgaccatcttcccattgcccctagtaatctgccaatgccagagggtaactctgctttcacccagcaagtgagagccaaactgagggaaatagaacagcagataaaagaaaggggccaagccgttgaagttcggtggtctttcgataagtgccaagaggcgaccgctggattcaccataggccgtgtgttgcatactctggaggtgctggactcacattcctttgagcggtctgactttagcaactctctggactccctatgcaaccggatctttggacttggtccatccaaagacggtcacgagatcagctccgacgatgatgccgtcgtttcactgctgtgcgaatgggccgtgagctgtaagcgctcgggccggcacagagctatggtcgttgccaagttactggagaaaaggcaggcagagattgaggctgaaaggtgcggggagagcgaggcggccgatgaaaaggggagcattgcatctggaagtctgagcgccccatccgccccaattttccaagatgtcctgctgcagttcctggatacacaggcaccaatgcttacagaccctcgtagcgagtcagaacgggtggaattcttcaacctcgtcctgctgttttgcgagttaattaggcatgacgtcttttcccacaacatgtatacatgtaccctgatctcccggggggacctggcctttggcgctcccggcccccgaccaccatcacctttcgacgaccctgctgatgacccggaacataaagaggccgaagggtccagcagctccaaactggaggatcctggactgtccgaaagtatggacattgacccctcttcttcagtgctgtttgaggatatggagaagccagacttttccttgttttcccccaccatgccctgcgaagggaaaggatcaccctcacctgaaaagccggatgtcgaaaaagaggtgaagccgccaccaaaggagaaaatcgagggcacactgggtgtgctgtatgaccagccccggcatgttcaatacgccactcactttcctattccgcaggaagaaagctgttctcacgagtgcaaccagagactcgtagttctgttcggcgtgggcaaacagagggacgatgcacgccatgctatcaagaaaattaccaaagatattctgaaagtcttgaatcgcaaggggacagcggagaccgatcagcttgcccccatagtaccgttgaatccgggcgaccttaccttcttggggggcgaggacggtcagaagcgcagacggaaccgacctgaggcctttccaaccgctgaagatattttcgcaaaattccagcacctctcccactacgatcagcaccaggtgacggcccaggtatctcggaacgtgcttgaacagatcacctccttcgccctgggcatgtcttaccacctaccacttgttcagcatgtccaattcatttttgatttaatggagtattctttgagcatctccggacttattgacttcgccattcagctgcttaatgagctgagcgttgtagaagccgaattacttctgaagtctagtgacttggttggctcctacaccacttctctgtgcctgtgcattgttgcggtgctgagacactaccacgcatgcctgatccttaatcaggaccagatggctcaagtcttcgaaggcctctgcggggtggtgaagcatggaatgaacagatcggatggaagtagcgccgagcggtgtattctcgcttatctttatgacctctatacaagttgctcccacttgaaaaacaaattcggggagctcttcagtgacttctgctcaaaagtgaagaacactatttattgcaatgttgaaccctccgagagcaacatgaggtgggctccagaattcatgattgacacactggaaaatcctgcggcacatactttcacatatactggcctcggaaagtcattgagcgagaaccctgccaatcgctattccttcgtctgcaacgcgctgatgcatgtgtgtgtgggccaccatgacccagacagagtaaatgacatcgccattctgtgtgcggagcttactgggtactgtaagtccctatcggccgagtggttgggcgtattaaaagccctctgctgctcctctaacaacggcacttgtggcttcaacgatctgctatgtaatgtggatgtctcggatctctcctttcacgacagcttagccacatttgttgcaattctaatagcccggcagtgcttattacttgaagacttaattagatgcgcagctatccctagcctgctgaatgcagcctgctccgagcaagatagcgaacccggggcccgattgacatgtcgtattctcttacaccttttcaagacaccccaactaaatccctgtcagagtgacggaaacaaacctacagtgggcattaggtcatcttgtgaccgacacctgctcgccgcgagccagaaccgcatagtggacggcgccgtattcgccgtccttaaggctgtgttcgtgctgggcgatgccgaactcaagggaagcggattcactgtaaccggcggaactgaagagcttccggaagaggagggcggggggggtagcggcgggcgacggcaggggggccgtaatatctcagtggagacagctagcttagatgtctacgcaaaatacgtcctgaggtctatctgtcaacaggaatgggtgggcgagcgatgtctgaagagcttgtgtgaggattctaatgacttacaagatcccgtgctgtctagtgctcaggcccagagattgatgcagctcatttgctatcctcacaggctcttggataacgaagacggtgaaaacccccagaggcaacggatcaaaagaatactccagaacttggaccaatggacaatgcgccagtcctcactcgaactccagcttatgatcaagcagacacctaataatgagatgaactctttgttagaaaacatcgccaaggctacgattgaagtgtttcagcagagtgccgaaactggctccagctcaggctctacagcgagcaacatgcccagttcgtccaaaaccaaacccgtcttaagcagcctggagcgatccggcgtatggctagtggcacctctgatcgcgaagctgcctactagcgtccagggtcacgtgctcaaggcggctggtgaagaactggaaaaggggcagcatttgggatccagctccaggaaggagagggataggcagaaacagaagtccatgagtctcctctcccagcaacctttcttgagtctggtattaacctgcttaaagggacaagatgagcaaagagaggggctgctgacgtcgctctactcacaggtgcaccagatagtcaacaattggagggacgatcaatatctggatgattgtaagccaaagcagcttatgcacgaggcgctgaaactccgcctcaacctggtgggtggcatgttcgatacagtgcagcggtcaacacaacagaccaccgagtgggctatgctgttgctggagatcattattagtggcacagtcgatatgcaaagtaacaacgaactgttcaccacagtactggatatgctctcagttctgatcaatggaactctcgccgcggatatgtctagcatatcacagggctctatggaagagaacaagagagcttatatgaatttggctaagaaactacagaaagaactcggggaacgccagagcgattctttggagaaagtacggcagctactgccgctaccaaagcagacccgggatgtcattacctgtgagccacaggggtccctgattgacacgaagggcaacaaaatcgcgggattcgattcaatctttaaaaaggagggccttcaggtgagcaccaagcagaaaattagtccttgggaccttttcgaggggcttaagccctcagctcccctttcctggggctggtttggaaccgttagagtggaccggcgagtcgctcgaggagaggagcagcaaagactgctcttatatcatacgcatcttaggccacgcccccgcgcgtactatctggagcccctcccactgccacccgaagacgaggaaccacccgcccccacgctcttggagcccgagaaaaaagcaccagaacccccaaaaacagataaacccggagctgcccccccctccacagaggagcgcaagaagaagtctaccaaagggaaaaaaaggagccaaccagctactaaaactgaggattacggcatgggacccggccggtcggggccttatggcgtgacagttccaccagacctgctgcaccacccgaaccccggatcaatcacccatctgaactatagacagggttcaatcggtctgtatacccagaatcagccactccccgccggtggtcctcgtgtggacccttatagaccggtacgtttgccgatgcagaagctgcctacccggcccacctaccccggggtactgccaacaaccatgacgggagtgatgggcttggagccgagctcgtataagacatctgtctaccgccaacagcaaccagccgtacctcaaggccagagactgaggcagcagctgcagcagtcacaaggtatgttaggccagtccagcgtgcaccaaatgacacccagctctagctacgggcttcagacttcacagctctccccaagcagtctgcagggatacaccccctacgtgagtcatgttgggctgcagcaacatacaggcccagctgaccctacgcgccacctgcaacagagaccatccgggtatgtccatcagcaggcacccacttatggccatggtttaacttccactcagcgcttcagccaccagacgttgcaacaaacaccaatgattagtacgatgaccccgatgtctgcccaaggagtacaggccggggttcgaagcaccgcaatactgcccgaacaacagcagcagcaacagcaacagcagcagcagcagcagcagcagcaacagcagcagcagcagcagcaacagcaacaataccatattcggcagcagcagcagcagcaaatcctgcgtcagcagcagcaacagcagcaacagcaacagcagcagcagcaacaacagcagcagcaacagcagcagcagcaacagcagcatcaacagcagcagcaacagcaggcagccccaccccagccacagccacagtcccagccccagttccaacgccaggggttgcagcaaacacagcagcagcagcagaccgccgctctggttcgccagctccaacaacagctgtccaacacgcagccacaacccagtacaaacatttttggaaggtactag

SEQ ID NO: 194398 - DNA, 2778 bp, Artificial Sequence
  Description of Artificial Sequence: Synthetic coding sequence
ggcggcagcggcggccggcggcagggcggccggaacatcagcgtggagaccgcgtccctcgatgtttacgccaaatacgtgctccgaagcatttgccagcaggagtgggttggtgaacgctgcttaaaaagcctgtgcgaggactccaatgacttacaggatccagtcttatcatctgcgcaagcccagcgactcatgcagctcatatgctatccccatagactgttagacaatgaagatggagaaaatcctcagcggcaacgaatcaagagaattctacagaatctggatcagtggacaatgcgccagtcttccctggaactacagttgatgatcaagcagacccctaataacgaaatgaactccctgttggagaacattgctaaggctacgatcgaggtgtttcagcaaagcgccgagactgggagtagcagcgggagtaccgcctcaaatatgcctagttcatctaagacgaaacctgtcctgtcttccctggaacgttcaggagtgtggctagtagcacccctgatcgccaagctgccgacttctgttcaaggacacgtgcttaaggcggctggtgaggagttggagaaagggcagcacctgggttcttcatcccgtaaagaacgcgataggcaaaaacaaaaaagtatgagtctgcttagtcagcagccttttctgagcctcgtcctgacctgtttgaaaggacaggacgagcagcgcgagggtcttctgacctcgttgtactctcaggtacaccagatcgtgaataactggagggacgaccagtatctggacgattgcaagcctaagcagctcatgcacgaagcattgaagctccggctgaacctggtcggcgggatgtttgacactgtacagcgcagtacccaacaaaccacagagtgggctatgctcctgctagaaataattataagcggaacagttgatatgcaatctaacaatgagttgttcaccacagtccttgacatgctttccgtgctgattaatggtactctggctgctgatatgtctagcatcagtcagggctctatggaagaaaacaaaagggcgtacatgaatctagctaaaaagcttcagaaagagttgggcgaacgccagagtgatagcctagagaaggtcaggcagcttctgcctcttccaaaacagacccgggacgtgatcacgtgtgaaccccaggggtctctgatcgacactaagggcaacaaaatagccgggttcgattcaatcttcaaaaaagagggcctgcaggtctcaacgaagcaaaaaatttcgccctgggatctcttcgagggcctgaagccttctgctccactttcgtgggggtggttcggaacagttagggtcgaccgccgagtggccagaggcgaggaacagcagaggctgctgttgtatcacacccatcttaggcccaggcctagggcctactatctagaacctttaccactgcctcccgaagacgaagagcctcctgcaccgactttactcgagcccgaaaaaaaagctccagagccacctaaaacagacaagccaggagctgcaccacccagtaccgaagagagaaagaaaaagagtactaagggaaagaaacgcagccagcctgccactaagaccgaagattacgggatgggacctggaagaagtggcccctatggggtaactgtacctcctgatttactgcatcaccctaatccaggcagtatcacgcacctgaattatcgccaaggatcaatcggcctttatacacagaaccagcccctcccagcgggcggcccaagagtcgacccctacaggccagtaaggctgcctatgcaaaagctccctacccgccctacttaccccggcgtgctcccaacaactatgacaggagtgatgggcctggagcccagctcctataagacgtccgtgtatcgacaacagcagcccgctgttccacagggacagcgactgcggcagcagctgcaagcaaagattcagagccagggtatgttagggcaatcaagcgtgcatcagatgacgccctcaagctcttacggcctccagacttcccagggatatacaccatacgtgagtcatgtcgggctccagcagcataccggacctgcggggacgatggtgccgccttcctactcttcccaaccctaccagtctactcaccctagcactaatccaaccctggtggacccgaccaggcatctgcaacagcgcccaagtggctacgtgcaccaacaagcgcccacttatggacatggactaaccagtacccagcgtttttcacatcaaacgctgcagcagacgcccatgatttctacgatgacgccaatgtcagcccagggcgtccaggccggggtcaggtctacagccatcttacctgagcagcagcaacagcagcagcaacagcagcagcaacaacaacagcaacagcagcagcagcaacagcaacaacaacagcagtaccatataagacaacaacaacaacaacagatcctccgccagcaacagcaacaacagcagcagcaacagcaacagcagcaacagcaacaacaacagcagcagcagcagcagcagcagcaccaacagcaacaacaacagcaggctgctccaccccagccccagccccagagccagcctcagtttcagagacaggggcttcaacagacccagcagcagcagcaaacagccgctctggtgcgtcagctgcagcagcagctcagcaatacccagccccagccaagtacgaatatatttggaagatattag

SEQ ID NO: 194399 - DNA, 756 bp, Artificial Sequence
  Description of Artificial Sequence: Synthetic coding sequence
tgagagcggaagaagaagagcaccaagggcaagaagcggagccagcccgcaacaaagacagaggattacggtatgggcccaggcagatcaggcccctacggcgtcaccgtaccccctgatctcttacatcatcccaacccaggaagcataacccacctgaattatcgccagggctcaatcggactgtatacacagaatcagccgctgccagcaggcggccctcgggtggatccttataggcccgttcgcctgcccatgcagaagctcccaacgagacctacatatccaggggttttacccaccaccatgacaggggtaatgggcctcgagccttcatcatataagaccagtgtctaccgccagcagcagccagccgtaccacagggccagagactaaggcaacaactccagcagtctcagggcatgcttggtcagtcgtccgttcaccagatgaccccttcatcgagttacggtcttcagacaagtcaaggctacacaccctatgtgtctcatgttggactacagcagcacaccggcccagccgatcccacacggcatctgcagcagaggccatcaggatacgtccatcaacaggcacctacctatgggcacggtcttacatcaactcagcgatttagtcatcagactctgcaacaaacccccatgataagcacgatgaccccgatgtcggcgcaaggcgtacaggccggtgttcggagtacagcaatactgcccgagcagcagcaacagcagtag

SEQ ID NO: 194400 - DNA, 6003 bp, Artificial Sequence
  Description of Artificial Sequence: Synthetic coding sequence
atggccgccttcggcatcctgagctacgagcaccggcccctgaagaggccccggttaggtcctccagacgtgtacccacaagaccccaagcaaaaggaggatgagctgaccgctttaaatgtgaaacagggcttcaataaccagcctgccgtgtcaggcgacgagcatggtagtgcaaaaaatgtgtcttttaacccagccaaaattagtagtaacttttctagcattattgccgagaaactgcgttgtaacacattgcctgacacgggcaggcgcaagcctcaggtgaaccagaaggacaatttttggctggtgacggcaaggtcccagtctgcaatcaatacttggtttaccgacctggctggcacaaagcccctgacgcagctggccaagaaagtgcccatctttagtaaaaaggaggaggtgttcggatacttggccaagtacactgtgccagtcatgagagctgcctggctgatcaaaatgacgtgtgcttactatgccgctatctctgagactaaagtcaagaaaaggcacgtcgatcccttcatggagtggacccagatcatcactaaatatctgtgggagcagctgcagaagatggccgagtactaccgcccagggccggccggctctggcggatgcgggagcacaatcggtcccctccctcatgacgttgaggtggccattcggcagtgggactatacggaaaaacttgccatgttcatgtttcaagacgggatgcttgaccgccatgaattcctgacttgggtgctcgaatgttttgagaaaattagacccggagaagacgaactactgaaactgctcctccctctccttctgcgctattccggggagttcgtgcagtcggcctacctgtctaggagactcgcctatttttgcacaagaaggttggccctgcagctcgacggcgtgagctcacacagtagtcacgtcatttctgcccagagtacgtcaacacttcccactactcctgcaccccagccaccaacgtcgtcgacaccaagtactcccttctcagatctactcatgtgccctcagcaccggccccttgtctttggactgtcctgcatcttgcaaactatcctcctctgttgtcccagcgcgctcgtctggcattacagcctaacagactccaggatcaagaccggaagccccttggatcacctgccaatcgcacccagcaatctgcctatgcccgaagggaattctgctttcacccagcaggtgagagctaaactgagagaaattgagcagcaaataaaggaacgcggtcaagctgtagaagttagatggtcatttgataaatgccaggaggccactgccgggtttacaatcggtagggtactgcacaccctggaagtgcttgattcccattctttcgaacgtagcgatttttccaatagtctcgattccctgtgcaaccggattttcggacttgggccgagcaaggatggacacgagatatcaagtgacgacgacgccgtagtgtcactgctatgtgaatgggccgtgtcctgcaagaggtccggtcgacacagggccatggttgtggctaaactgctcgagaagcgtcaggcagagatcgaggctgagcgctgtggtgagagcgaagcggcagacgagaagggaagtattgcctcaggctccttatctgccccctcagcacccatcttccaggatgtgcttctccagtttcttgacactcaggccccaatgctgactgatccccgcagcgaatccgaaagagttgagttttttaacctcgttcttctgttttgtgagctcatccgtcacgacgtttttagccacaacatgtatacctgcaccctcatatccaggggggatctcgcctttggcgctcctggacctcgaccaccctctccattcgatgatcctgccgatgaccctgagcataaagaggcagaggggagtagctcctctaagctggaagatcctggactgagcgaaagcatggatattgacccgagtagttccgtacttttcgaggacatggaaaaacctgacttttctctgttcagtcccaccatgccatgtgaggggaagggatccccaagccccgaaaagccagatgttgaaaaagaagtcaaacctcctccaaaagaaaaaatcgaaggcactcttggggttttgtacgatcaaccacgccacgtccaatacgccacgcacttccccattccgcaggaggagtcatgttcccatgagtgcaatcaaagactggtggtcctgttcggggttgggaagcaacgggacgatgctcgccatgccattaagaagattactaaggatattctgaaggtgttaaaccgtaaggggacagccgagaccgatcagcttgctcccatagtaccgctgaacccgggggacctgaccttcctgggcggcgaggatggacagaaacgacgaaggaatagaccagaagcattccccactgcagaggatatctttgctaaattccagcatctcagccactatgaccagcatcaggttacagcccaggtctcaaggaacgtcctggagcagatcacatccttcgcacttggcatgagctatcatctcccactggtgcaacacgtgcagtttatctttgatcttatggaatatagtctttctatcagcggcctgatcgattttgccatccagctgctcaatgaactgtctgtggtggaggctgagctgctgctcaagtcaagcgaccttgtgggatcctacacgacaagtttgtgcctgtgtatcgtcgctgttctaagacactatcacgcatgtctgattctgaaccaggatcagatggctcaggttttcgagggcctgtgcggcgtggtgaaacatggcatgaatagatctgacggatctagcgccgagcgatgcattcttgcttatctgtacgacctgtacaccagctgctctcacttgaagaataagtttggggaactgttctccgacttctgctccaaagtcaagaataccatctattgcaacgtcgaacctagtgaatccaacatgcgttgggcgccagagttcatgatcgacaccctcgaaaatccagctgcccatacttttacctacactggcctggggaagtctctgtccgaaaacccagccaatcgttacagctttgtatgtaacgctctaatgcacgtttgcgtgggacatcatgatcctgaccgtgtcaatgatattgcgatactatgcgccgagctcacgggttactgcaagagtctctcagccgagtggctgggcgtcctaaaagctctgtgctgttcctctaacaatggcacttgtggatttaatgaccttctgtgcaacgtcgacgtttctgatctctcattccatgactccctggctacctttgtagctattctgattgcaaggcagtgcctgctgctggaggacttgattcgttgcgccgctattcctagcctgctaaacgccgcgtgctccgaacaggactccgaaccaggagctaggctcacttgtcgtatcctgctgcatcttttcaaaacccctcaactgaacccctgccagagcgacggtaacaaacccaccgtggggattaggtcatcatgtgacaggcatttattagccgcctcccagaaccgaatcgtggacggcgctgttttcgccgtgttaaaggccgtcttcgtgttgggggatgcagagctgaaaggtagtggattcacggtgacgggtggcacagaagaactccctgaagaggagggaggggggggctctgggggccggcgacagggtggcagaaatatatctgtagagacggcaagtctcgatgtgtatgctaaatacgtcctgcgcagcatttgccagcaggaatgggtgggcgagagatgcctcaaatccctgtgtgaagactcaaacgacctgcaggaccctgtgctctcttcagcccaggcacaacggttgatgcagttgatctgctacccccaccgcctgttagacaacgaggacggtgaaaatccacaacgccaaagaatcaagaggattctgcagaacctcgatcaatggaccatgcgccagtcttctctggagttgcagctcatgattaagcagacgccgaacaatgagatgaactccctcctagagaatatcgcaaaagctaccattgaggtatttcaacagagtgcagagaccggtagcagctctggcagtaccgcaagtaacatgccatcatcatccaaaaccaagccagtgctgtcatccctggaacgaagcggcgtgtggctggtggcacccctgatcgctaaattgcctacatccgtacagggtcacgtcttaaaggcagcaggggaggagctggagaagggccagcatctgggcagttcatctagaaaggaacgggacagacagaaacagaagtcaatgagcttactgtcccagcagccctttctcagtctggtgctgacctgcctaaaaggccaggacgagcagagagagggtctgcttacttctctttactcgcaggtgcaccagatcgttaataactggcgggacgaccaatacctcgacgactgtaaacctaaacagctcatgcacgaagcactgaagctgcggctgaatttggtcggcggaatgttcgatactgtgcagcggtcgactcagcagaccactgaatgggccatgctcttactggagataataatatccggcactgttgacatgcagtctaacaatgaactgttcactaccgtactggacatgctatcagtgctcatcaatgggacattagccgcggacatgtcatcgatcagccagggaagcatggaggaaaataaacgggcatacatgaatctcgctaaaaaactgcagaaagagctgggcgaacgccaaagcgacagcttggagaaagtgcgccaacttctgccactccccaagcaaactcgcgatgttatcacttgtgagccccagggcagtctgatcgacacaaaaggcaacaagatcgctgggtttgattctatctttaagaaagaaggactgcaggtttctaccaaacaaaagatctccccctgggacctctttgagggtttgaagccatccgctcccctatcttggggatggttcgggactgtccgagtggacaggagagtggccaggggggaggagcagcaacggctccttctgtaccacactcacttgaggcctaggccgagggcctattacctcgaaccccttccactgccccctgaagatgaggagccacccgctcccaccctcctggaacctgagaaaaaggctcctgagcctcctaaaaccgacaaacctggagctgcaccaccatccacggaagaacgaaagaaaaaatccacgaagggcaaaaaaaggtctcagcccgctactaagaccgaagattatggaatgggccccggcagatctggcccgtatggagtgaccgtccctccagatctcctgcaccatcccaatccgggctcaatcacccacctcaactaccggcaggggtcaataggattatacacgcaaaatcagccgcttccagccgggggtcctagagtagatccttaccggccagtgagattgccaatgcagaagttgcccactcggccgacctatccaggggttctccccacaacaatgaccggagtgatggggctggaaccttcttcctacaaaactagtgtgtatcggcaacagcagccagctgtaccccagggtcagagactgaggcagcagcttcaacagtcacagggcatgctggggcagtcaagcgtgcaccagatgacccccagttcttcctatggtttgcagacatctcaggggtacacaccttacgtgtcacatgttggcttacaacagcatacaggtcctgcagaccccactaggcacctccagcagcgcccttccggatatgtccatcaacaagccccgacatatggtcatggtctgacctctacccaaagtttccacacccgccactgttcaagacacccatag

SEQ ID NO: 194401 - DNA, 2271 bp, Artificial Sequence
  Description of Artificial Sequence: Synthetic coding sequence
atggccgccttcggcctgctgagctacgagcagcggcccctgaagagacctaggctgggaccgcctgacgtttacccccaggatcctaagcagaaggaagatgagctgacagctgtgaatgtgaaacagggcttcaataaccaaccagcgtttacgggggacgagcatggcagcgcgcggaatattgtgatcaacccaagtaaaattggggcttacttcagtagcattctggctgagaagctgaaactaaatacctttcaagacaccgggaagaagaaaccccaggtaaacgctaaagacaactactggctggtgaccgcccgcagccaatccgccattcatagctggttcagcgacctggctgggaataagcccttatccatcctggccaaaaaagtacccatcctgtccaagaaagaggacgtgttcgcctacttagctaaatattccgtccccatggttagggcgacatggctgataaaaatgacatgcgcgtactacagtgcaatatctgaagcgaagatcaagaagcgtcaggcacctgacccaaatttagagtggacgcagatttctacaaggtaccttagggaacaactcgccaagatctcagacttctatcatatggcatccagcacaggagatggtcctgtacctgtgccccctgaggtcgaacaagcaatgaaacagtgggaatacaatgaaaaattagcttttcatatgttccaggagggcatgctcgaaaagcatgagtatctcacctggatcctggacgtgttggaaaagataaggcccatggatgatgatcttctgaaactgctcctcccattaatgttacagtacagcgacgaattcgttcagagtgcatatctgagccgacggctagcttatttttgtgctaggcgcctgtctctgttactctctgatagcccaaacctgcttgcggctcactctccccacatgatgatcggtccgaataacagttccattggggcaccatcccctggcccccctgggccagggatgtcacccgttcaactagcctttagcgactttctcagctgtgctcagcatggaccactggtgtacggtctatcatgtatgttacagacagtcacactgtgttgccctagcgcattggtatggaactattcgacgaatgagaacaaatcagccaatcccggctcccctcttgatttgctgcaggtagcccccagcagtctcccaatgccaggcggtaatactgctttcaatcaacaggtacgggcgaggatctacgaggtggaacagcaaatcaaacagcgcggccgggcggtcgaagtcaggtggtcattcgataaatgtcaggagagcaccgcaggcgtgacaatatcgcgcgttctgcacacgctagaggtgttagacagacactgttttgaccgaacagactcctctaactctatggagactctatatcataaaatattctgggcaaaccaaaataaggacaaccaagaagtagccccaaatgatgaggctgttgtaacccttttgtgtgagtgggctgtcagctgtaagcgctctggcaagcatcgagccatggctgtggcaaagttgctggaaaagcgccaggctgagattgaggccgagcggtgcggggaatctgaggtccttgacgagaaggagagtatatcctcttcttcgcttgcaggctcaagcttgccggtcttccaaaacgtgctccttaggtttcttgacactcaggcaccttccttgtccgatcctaactccgagtgtgagaaggttgaattcgttaacctggtgttgctcttttgcgagttcataaggcacgatgtgttctcccatgatgcgtatatgtgcaccctgatctctcgcggagatctgagcgtgaccgcgtcgacacgcccccggagtcccgtgggagaaaacgctgacgagcactattctaaagatcatgacgtaaagatggaggagcagtccattatggctcatatgggaattgactctggaaccacaaacatttttgatgaagtcgataaaagtgacttcaagactgacttcggtagcgagttccctatttttagccccatgccaggtgagagctgtgaaaacgccaacacaagtctgggtaggagaatgagcgtcaactgtgagaagctggtcaagcgggagaaaccccgcgagctgatctttccatcgaactacgaccttctgaggcacctgcagtatgctactcattttccgatcccgctggtttctcattgcttctcttag

SEQ ID NO: 194402 - DNA, 2166 bp, Artificial Sequence
  Description of Artificial Sequence: Synthetic coding sequence
atggccgccttcggcctgctgagctacgagcagcggcccctgaagcgccctagactgggccctcccgacgtttatccacaggaccctaagcagaaagaggacgagcttacagcagtaaatgtgaaacaaggctttaataatcagcctgccttcacaggagacgaacatgggtctgctcgcaatatcgtaattaacccttcaaagatcggcgcctacttctcctcaattctggccgaaaaacttaaacttaatacgttccaggataccggaaagaagaagccccaggtcaatgccaaggacaactattggctcgtcacagccagatctcagagtgcgattcattcgtggtttagcgacctggccgggaacaagccacttagtatcttagcaaagaaagtgcccattttgtccaaaaaagaggatgtgtttgcgtatttggccaaatactcagtgccaatggtgagggcaacatggttgatcaaaatgacctgtgcctattacagcgccatttccgaggccaaaatcaagaagcgtcaggcaccagacccaaatctggaatggacacaaatcagcactcgttacttgcgcgagcagctggctaagatttccgacttttatcacatggcatctagcacaggagacggtccagtgcccgtccctccagaagtggagcaggccatgaaacagtgggagtacaatgaaaagttggcctttcatatgttccaagagggtatgttagagaagcacgaatatctgacttggattctcgatgtgctggagaagattcgacctatggacgatgatctcctcaagcttctgctcccactaatgttacagtatagcgacgaatttgtccagtctgcttacctgtcaaggcggttagcgtacttttgcgctcgcaggctgagcctcctactgagtgactcccctaatttactggccgctcactcccctcatatgatgatcggcccaaataattcatcaattggggccccctcaccggggccccctgggccagggatgtctcctgtccagttagcgtttagcgactttctttcatgcgcccaacacggacccctcgtctatggcctgagttgtatgctccaaaccgtcaccctgtgctgtcccagcgcgctagtttggaattatagcactaacgagaataaaagtgccaatcccggatcccccttggatctgctccaggtggcgcccagctcccttcctatgcctggtggaaataccgccttcaaccaacaggtgcgcgcaaggatctatgaggtggaacagcagatcaaacagcgaggcagggccgtcgaggttcgatggtcattcgataagtgtcaggagtctacagctggtgtgacaatttccagagttctgcatactttggaggtgctcgacagacactgctttgacagaacagattcttccaactcaatggagacgctctatcacaagatcttctgggcgaatcagaataaagataaccaggaagtcgccccaaatgacgaggcagttgtgacacttctgtgcgaatgggcagtgtcttgcaagcggagcgggaagcaccgcgccatggcagtggctaaactgttggagaaaagacaggcggaaatagaggcagagcgctgcggcgaatcagaagtactcgacgaaaaggagtctatctcctcttccagtctggccggctccagtctgcctgtctttcagaatgtccttctgagattcctggatacccaggcgcctagcctgagtgatcccaactctgaatgcgagaaggtggagtttgtcaatctcgtcctgctgttttgcgaatttattcgtcacgacgtgttctcccatgatgcatatatgtgcactctcatctctcgcggtgacctgtctgttacagcttcaacccgccccagatccccggtaggggagaatgcggatgaacactattcgaaggatcatgacgtaaagatggaaatcttctctcctatgccaggagaatcctgcgagaatgctaacacctcgctcggacggcgtatgtctgtcaactgcgaaaaattagttaagcgcgaaaaaccaagagaactcattttccctagcaactatgacttattacgacatctgcagtatgctactcactttcccatacctctggtgtcccactgtttctcctag

SEQ ID NO: 194403 - DNA, 6438 bp, Artificial Sequence
  Description of Artificial Sequence: Synthetic coding sequence
atggccgccttcggcctgctgagctacgagcagcggcccctgaagcgaccacgcttaggcccacccgatgtctacccacaagaccccaaacagaaggaagacgagctgaccgcggttaacgtcaaacagggattcaataaccaaccagctttcacaggcgacgaacacgggagtgctcgtaatatcgtcattaatccttctaagattggcgcttactttagttctatcctagccgaaaagctgaagctcaatacctttcaggatacaggcaagaaaaagccacaggtgaatgcaaaggataattactggcttgttactgcccggagccaatctgctattcatagttggttctcggatctggcagggaacaaacctctatctattctggcaaagaaggtacccatactctctaaaaaagaggatgtctttgcctaccttgctaaatactctgtccctatggtgcgcgccacatggttgatcaaaatgacatgcgcgtactacagcgcaatatccgaggctaaaatcaaaaaaagacaagctcctgatcccaacttggaatggactcagatctccacccggtatctgcgtgaacagttggcaaaaatctcagacttctaccatatggcgagctcaaccggagatgggcctgtgccggttccacctgaggtcgagcaggctatgaagcaatgggagtataatgaaaaactggcgttccatatgtttcaggaaggtatgttggaaaaacacgaatatctgacttggattctcgacgtgctcgaaaagataaggcccatggacgacgacctcctgaagctgctgttgcctctgatgctccagtacagcgatgagtttgttcagtcagcatacttaagcaggaggcttgcctatttttgcgcccgtaggctttcacttctactctccgactcgcctaacctccttgctgcccatagcccccatatgatgattggtccaaacaatagctccattggcgcaccatcgccagggccaccaggccccggaatgtcacctgtacaattggccttctccgacttcctgagctgtgcccagcatggtccactggtctacggactgtcatgcatgctgcaaacagtaaccctttgctgccctagtgccctggtctggaactacagcacaaacgagaacaagtccgccaatcctggcagccctttggacctactgcaggtcgcccctagctctctccctatgccgggtggtaatacagcgtttaaccagcaggtgagggcaagaatctatgaggtcgagcagcagattaaacagcggggccgagctgtggaagtgcgatggagttttgacaagtgtcaagagagtacagcaggcgtcacaatatctagagtcctccacaccctggaggtcttagatcggcactgctttgacagaaccgacagtagcaattccatggaaacactataccataaaatcttttgggcaaatcagaataaagacaatcaggaagttgctccaaacgacgaagcagtcgtgaccttgctctgcgagtgggcagtgtcttgtaagcggtctgggaaacaccgtgctatggctgtagctaagttgctagagaagcgacaagccgaaatcgaagcagagcgatgtggcgagagcgaggtgttggacgagaaggagtctatatcttcttcctctcttgcgggctcttcactgcctgtgtttcagaacgtgctgctgagattcctcgacacacaggccccgtctctgtcagatcccaattccgagtgtgagaaagtcgaatttgtcaatctcgtcttgctcttctgtgagttcattcgacacgatgtcttctctcacgatgcctatatgtgtactctgatttctcgaggcgatctgagcgtgaccgcttccacccgaccgaggtcaccggttggagaaaatgccgacgaacattattccaaggaccacgacgtcaaaatggagattttttcccctatgcctggtgaaagctgtgaaaatgccaatacaagcctaggacgccgtatgtcagtgaactgtgagaagttggttaaacgtgaaaagcccagagagttaatcttcccctctaattacgacctgttgagacacctgcagtacgctacccattttccgatccctcttgacgagtccagcagtcacgaatgtaatcaaaggacaatccttctgtatggtgttggcaaagagagagacgaggctcggcatcagttgaagaagatcacaaaggacatcttaaagatcctgaacaagaagagcactactgaaacaggtgtgggcgacgagggtcagaaagccaggaaaaacaagcaggaaaccttcccgaccctggaaaccgtttttaccaaactccagttgttaagctactttgatcagcaccaagtgacatcgcagatcagtaacaacgtgttggaacagatcacaagcttcgcgtccgggactagctaccacctgcctctggctcaccatatccagctcatctttgatctaatggaacccgcacttaatatcaatgggcttatcgacttcgccatacaactgttaaacgaacttagtgtggtagaagctgagcttttgctgaagagctctagcctagccggctcttacacgaccggactctgtgtttgtatcgtcgccgtgttaagacgctatcacagctgcctgatcctaaaccccgaccaaactgcacaggtgtttgaggggctgtgtggcgtggtgaagcacgtggtaaaccctagtgagtgctcttcacctgaaaggtgtatcttggcatatctgtacgacttatacgtcagctgttcccacctgcgatctaagttcggggacttgtttagctccgcctgctcgaaggtgaaacagacaatctacaacaatgtcatgcctgctaatagcaacttacgctgggacccagacttcatgatggacttcatagaaaacccctcggcccggtccattaactactccatgttgggtaaaattctctctgacaacgcggctaatagatacagtttcgtctgcaacactctaatgaatgtgtgcatgggtcaccaggacgcgggccggatcaacgatatcgccaatttctccagcgagttgactgcttgctgtactgtcctgtcaagcgagtggctcggagtgctgaaggctctttgctgttccagtaatcacgtgtggggattcaacgatgtgctttgcactgtggacgttagcgacttgtcctttcatgattcacttgctactttcatcgccatactcatcgctcgacagtgcttcagtctggaagatgtcgtgcagcacgtcgcgctcccaagcctcctggcagctgcttgtggtgatgccgatgccgagcccggtgctcggatgacttgccggctcctgctgcacctgttccgcgcaccccaggcatgcttcttaccgcaagcaacagggaaacccttcccaggcattaggagctcatgtgatcgccatctgcttgccgctgcccacaatagtatcgaggtgggagccgtcttcgccgtgttgaaagccatcatgatgttaggggatgctaaaataggtaacaattcagttagttctcttaagaatgacgacttcaccatgagaggcctacgctgtgacggcaatgccgatgatatctggaccgcaagccagaacccaaagtcgtgcggcaagagcatctccatagagactgccaacctgagggaatatgcccgttacgtcctgagaaccatctgccaacaggaatgggtcggggaacattgtctaaaggagcccgagcggttgtgcacggacaaggagcttattctcgaccccgtgctgtccaatatgcaggcgcagaagctcctgcagctgatctgctatcctcacggtatcaaggagtgcaccgagggggacaatctgcagaggcagcatatcaaacggatacttcaaaacttggaacagtggaccttgcggcagagctggctggaactacagcttatgattaaacaatgtttgaaagaccccggatccggcagcgtcgccgaaatgaacaacctgttggataacatagcaaaagcaacaatcgaggtatttcagcagtccgccgatctcaataatagtagtaatagcggcatgagcttgttcaatccgaactcaattggttccgctgatacctcttccaccagacagaatgggatcaagacgttccttagttcgtccgagagaagaggggtctggttagttgcccccctgatagctcggctgcctacctccgttcagggccgggtgttgaaagccgctggagaggagctggagaagggccagcacctgggaagctcctcaaaaaaggagagagaccggcagaagcagaagagcatgagtctgctctcccaacagccgtttttatccttggtgctgacttgtctcaaaggccaggatgagcaacgtgaaggactcctgacctccctgcagaatcaggtgaaccagattttatctaactggcgggaggagagatatcaggatgacatcaaagcccgccaaatgatgcacgaagccctccagctgcggctgaacttggtgggcggaatgttcgataccgtgcagcgatctacccaatggacaacagattgggcattgctgctactccaaatcatcacttctggaactgtggatatgcacaccaacaacgagctgtttactacagttctcgacatgctgggagtgcttataaacgggaccttagccagtgacctttcaaatgcttcacctggtgggagcgaggaaaacaaaagggcatacatgaacctagttaaaaaactgaaaaaggagttgggcgataagcggtccgagtcaatagataaggttcgtcagctgttacccttgccaaagcaaacttgtgacgtcattacttgtgagccaatgggctcactaatagacaccaaaggcaacaaaattgccggattcgactctatcgacaagaaacagggtctgcaagtatccactaaacagaaagtcagtccgtgggacctcttcgagggccagaagaatcctgctcctctctcctgggcctggtttggaaccgtccgcgtggacaggcgagtgattaagtatgaggagcagcatcacttactgctctaccatactcatcctatgcccaaacctcgcagttactatctccaaccactccccctaccacccgaggaagaggaagaagaacctacgtcacccgtgagccaggagcctgaacggaagagcgccgaactctctgaccagggaaagactactacggacgaggagaaaaaaacaaagggtcggaaacggaaaactaaatcctcaagcagggtggatgagtaccctcagtcgaacatctacagggttcccccaaactacagccctatcagctcccagatgatgcatcatccccagtccacactctggggatacaatttggtcggtcaaccccagcagccggggttcttcctgcaaaaccagagcctgacacccggcggctctcggctggatcctgctggcagctttgtccccactaatacaaagcaggccctgagcaatatgctccaaaggaggtcgggcgctatgatgcagcctccctctctgcacgcaattacatctcaacagcagttgatccaaatgaaactgcttcaacagcagcagcaacaacgactgctcagacaagcccagacgagacctttccaacagggacaaccgggggatcaagccgccctattcgctgctcaggcccgaccctccccacagcttccccaataccctgggctgcagcaagctcagaccatgcctcagggatataccatgtacggaacacaaatgcccttgcaacagaccagtcagcagcaggcaggctccgtggtccttagcccaagttataactctcgcgcttatccagcggctcactcgaatcctgttctgatggagcgccttagacagatccaacagcaaccttccggatacgtccagcagcaagccagcccttatttgcaacccctgactggatcccagcgacttaaccaccaggcccttcagcaaagtcccctcgtgggagggggcatcgatgcagtgttaacatcagctcaccccaatcttccttctgtccccctgcctcaggatcctatgcggcctagacagcctcaggttaggcagcaacagagactgttgcagatgcagcagcctcagcaacctcagccacaacagccaccacagcctcagcaatcgtcccagagccagagccaaactctgggtcttcaggccatgcagcctcagcaacctctgttcccccgtcagggactgcagcagacacagcagcagcagcagaccgcggctcttgtccgacagctccagaagcaattgtcaagcaatcagcctcagcagggagtcacaccatatggacatcccagtcatttttag

SEQ ID NO: 194404 - DNA, 6522 bp, Artificial Sequence
  Description of Artificial Sequence: Synthetic coding sequence
atgagcgccagcttcgtgcccaacggcgccagcctggaggactgccactgcaacctgttctgcctcgccgacttaactggaatcaaatggaaaaaatatgtgtggcaaggacccacctctgcaccaatactctttccagtcactgaggaagatcccatattaagctcctttagcaggtgtctcaaggctgatgtgctgggggtttggcggcgggaccagcgacccggacggagagaactctggattttctggtggggagaagatccagttttgctgacccttttcacaatgacctatcaaaagaagaaaatggaatgtggcagaatggactttcctatgaatgccgtgctgtgctttcaggctgtccacaaccttctcgaaaggtgtttgatgaataggaatttcgtccggatcggaaagtggttcgtgaagccatatgagaaagacgagaagcccatcaataagtcagaacacctatcctgctctttcacattttttttgcacggagactcaaacgtctgtacctctgtggaaattaatcagcaccagcccgtgtacctcctaagtgaagagcacatcaccttagcacaacagagtaattcaccctttcaggttattctgtgcccatttggcctgaatggaactcttaccgggcaggcattcaaaatgagcgactcggctacaaaaaagcttatcggagaatggaagcagttctacccaattagttgttgcctgaaggagatgagcgaagaaaagcaggaggacatggactgggaggatgactctctcgccgctgtggaggttttggtggcaggggttaggatgatctacccagcttgcttcgtcctggtccctcagagcgatatccccaccccgtctcccgtaggcagtacccactgtagtagtagctgcttgggcgtccaccaggtgccagcttcgacccgggaccctgctatgagcagtgtgaccctgacacctccaacttcgcctgaggaagttcagaccgttgacccccagtctgtccagaaatgggtgaaattttctagtgtttcagatggtttcaacagcgacagtactagtcaccatggcggcaaaatccctcggaaactggccaaccacgtggtggaccgggtgtggcaggaatgtaatatgaatcgggctcagaacaagcgtaagtattctgcgtcctcaggaggattgtgtgaagaagcaacagccgcgaaggtcgcaagttgggactttgtggaggcaactcagcgaactaattgcagctgtttacggcacaagaacctgaaatcaaggaatgcaggtcagcagggacaagctccaagccttgggcagcaacaacagatcctgcctaagcacaagactaacgagaaacaggaaaagtctgaaaaaccccaaaaaaggcctctcacgcccttccatcaccgggtgagcgtcagtgatgacgtcggaatggacgctgatagtgccagccaacgcctcgtgatctctgcgcctgatagccaggtcagattctctaacataaggactaatgatgtggccaaaaccccgcagatgcatggcactgaaatggctaatagcccacagccacccccactcagcccccacccctgcgacgtggtggacgaaggtgtgaccaagactccttccactccacagtctcaacatttctatcaaatgcccacacctgatccactggttcccagcaaacccatggaggaccggatcgattccctgagtcagtccttccccccccagtaccaggaggccgtagaacccaccgtgtatgtcggcactgctgtcaatctagaagaggatgaggcgaacattgcttggaagtattacaagtttccaaagaagaaggacgtggaatttctgcccccgcagcttccaagtgataaatttaaggacgatcccgtaggaccctttggccaggagtccgtgacgtcggtcaccgagttaatggtgcagtgtaaaaaacccctgaaggtatccgacgaattggtgcagcaataccagataaagaaccaatgcctgtcagctatcgctagtgacgccgaacaggagcccaagattgacccatatgcattcgttgagggcgatgaggagttcttgtttcctgataagaaggaccgtcagaacagtgaaagggaggccgggaagaagcataaagtcgaggacgggacaagctctgtgaccgtactgtcgcatgaagaggatgctatgtctcttttctcacccagtattaaacaagatgccccacgccctacttcacacgctagacctccgagtacaagtctcatatacgattccgatttagccgtcagctacacagatttagataatctcttcaatagtgatgaagatgaattgacccccgggagcaagaagagcgctaatggcagtgacgacaaagcttcatgtaaagagtccaaaaccggcaatctcgacccactgtcctgcatcagcaccgctgacctgcacaaaatgtatcccactccacccagcctggagcaacacataatgggcttctcccctatgaatatgaataacaaggagtacggttctatggacacgactcctgggggcactgtgctcgagggaaactctagcagtatcggcgcacagttcaaaatcgaggtcgatgaaggattttgcagccccaaaccctcagagattaaggattttagctatgtctataagcccgagaattgccagattctcgtggggtgtagcatgtttgctccgctcaaaaccctgccatcacaatatttgcctcctatcaaactgccagaggagtgtatctacaggcagagctggacggttggcaagcttgagctgctgtcaagcggtccatccatgccctttatcaaggagggtgatggctcaaatatggatcaagaatacggaactgcctatactcctcagacacacacttcttttgggatgccgccttcatctgctcctccttctaatagcggcgctgggatactcccctccccttccaccccccgtttccctactcctagaacaccgcgcacaccacggacaccaagaggcgcaggcggtccggcctctgcccagggaagcgttaagtatgaaaactccgatttatactccccagctagtacaccctctacgtgtcgacccctgaacagcgtggagccggctacagtcccaagcatacctgaggcccactccctgtatgtgaatctgatactgagtgagagtgttatgaatctttttaaagattgcaattttgattcctgttgcatctgcgtgtgcaacatgaacatcaaaggagcggatgtgggtgtctatatcccagatcctactcaggaggctcaataccggtgtacttgtggcttcagcgctgttatgaacagaaagtttggcaataattccggactcttcctagaagacgagttggacattatcgggcgcaacactgactgcggaaaagaagctgagaagaggttcgaggccttgagagcgaccagtgcagagcacgtgaatggagggttgaaagagagcgagaagcttagtgacgatctgatcctccttctgcaagatcagtgtacaaatctgttcagcccttttggagctgctgaccaggacccgttccccaagagtggagtcatctccaattgggtgagagtagaggaacgggattgctgcaatgactgctatctggctctcgaacatggaagacaatttatggataatatgtccggagggaaggtggatgaggcccttgttaaatctagctgcctgcatccttggagcaaaagaaacgatgtaagcatgcagtgttcccaagatatcctccgtatgctgctcagcctgcagcccgtgctgcaggacgccatccagaaaaaacgcactgttcggccttggggcgtgcaaggccccctgacctggcagcaatttcacaaaatggctggtagaggtagttatgggaccgacgagtcgcctgaacctttgcctattccaacctttctcttgggatacgattatgattacctagtgctgtcacccttcgccctcccctactgggagaggttaatgctggaaccttacggctctcagcgggatatagcttacgtagttctgtgccctgagaatgaggccctcctaaatggggccaaaagtttttttcgagatttaacagctatctacgagtcctgccgtctgggtcagcaccgtcctgtgagccgcctcctcacagacgggatcatgcgggtgggttcgacagccagtaagaaactaagcgagaaactcgtggctgagtggttttcccaagcagccgacggaaacaatgaggccttctcaaaactgaaactttacgcacaggtgtgcaggtatgacttaggaccctacctcgccagcttgcctctcgactcgtctttgttgagtcagcctaacttggtggcccccacttcccagagcttaatcacaccaccacagatgaccaatactgggaacgccaacacgccgtcagctaccctcgccagcgccgcaagctctacaatgactgtgacaagcggcgtcgcaatttccacgtccgtggcgactgccaactccactctgacaacagcaagcaccagttcttcatcgtcctctaacttgaattcaggagtgagcagcaataagctgccatcttttccccccttcgggtcaatgaactctaacgccgccggaagcatgagcacccaggcaaataccgtgcaaagcggccagctcgggggccagcaaacctctgcccttcagactgccgggatctctggagagtctagctctctccctacacagccgcacccagatgtgtccgaatcaactatggatagggataaagtaggaatccctactgacggcgatagccatgctgtcacatacccacctgctattgtggtgtatatcatcgatccatttacctatgagaacaccgacgagagcaccaattcttcgtctgtctggaccctgggactgctgcggtgctttcttgaaatggtgcagactttgcctcctcacatcaagtccaccgtatcggtgcagatcatcccctgtcagtatctgctccaaccagtcaagcatgaggatcgggagatctacccgcagcaccttaagtccctggcattctccgcattcacacagtgccgccgccccctccccacaagcaccaacgtgaaaaccctcaccggtttcggacctggcctggccatggaaacagcactccggagcccagatagacccgaatgtatacggctgtacgccccaccctttattctcgcccccgttaaagacaagcaaactgaactcggtgagaccttcggagaggccggccaaaagtataatgtgctgtttgtggggtattgtctgtcgcacgatcagcggtggattctggcaagctgtacggatctgtatggtgagctactggagacctgtatcatcaatatcgacgtgccaaaccgagctcgcagaaagaagtcatcagcccggaagtttggcctccagaaactttgggaatggtgtctgggtttggtacagatgagctcgttaccatggagagtggtcatcggacgtctgggcaggatcgggcatggagaattgaaagactggagttgcctgctgtctcggaggaaccttcagtcgctttctaagaggctaaaggacatgtgtcgtatgtgcggtatctctgccgccgatagccctagcatactgtccgcatgcttggttgcgatggagccacaggggtcatttgtcattatgcccgactccgtttctacgggttctgtgttcggtagatctaccacactgaatatgcagacatctcagctgaacaccccgcaggatacaagttgcacccacattttggtttttcccacatcagcctcagtacaggtggctagcgccacatacacgacagagaatcttgatctggccttcaaccctaacaatgatggagcagacggcatggggatcttcgacttgctggataccggcgatgatttagacccagacatcatcaacatcctgccggcctcacccaccggaagccccgtccattccccgggcagtcactatcctcacgggggggacgctggaaaaggccagagtacagaccgcctactcagcactgagccccatgaagaggtgccaaacatcctccagcagcctctcgcattggggtactttgttagcacggcaaaagcaggtccattgcccgactggttttggtctgcctgcccacaggcacaatatcagtgtcctttgttccttaaagcctcattgcacctgcacgtcccatcagtccaatcagacgaactgctacactcaaagcactcccaccctctggatagcaaccagactagcgacgtgttgagattcgttctggagcagtacaatgctctcagctggcttacttgtgaccctgctacccaagaccgcaggtcatgcctgccaatccactttgtcgtgttgaatcagctatacaacttcattatgaacatgctttag

SEQ ID NO: 194405 - DNA, 6525 bp, Artificial Sequence
  Description of Artificial Sequence: Synthetic coding sequence
atgagcgccagcttcgtgcccaacggcgccagcctggaggactgccactgcaacctcttttgtcttgctgacctcacaggtatcaagtggaaaaagtacgtgtggcaaggaccaactagcgcccctattctgtttccagttactgaggaagatcctatactcagttcattttctcggtgtctcaaggccgacgtcctaggcgtctggcgccgggatcagcgcccaggtagaagggaactgtggatcttctggtggggggaagacccgtcatttgcggacctgatacatcacgacttaagcgaggaggaggatggagtgtgggaaaacgggctgtcttacgaatgtcgaaccctcctattcaaagccgtccacaatcttctagaaaggtgtcttatgaatcgaaacttcgtgcgcatcggaaaatggtttgtgaagccatacgaaaaagatgaaaagcctatcaacaagagtgaacacttaagctgcagctttacctttttcctgcatggcgactctaacgtgtgcacatctgtggaaataaaccaacatcaaccagtctatttactgtccgaggaacatatcacattagctcagcagtccaacagtccatttcaggtgattctgtgtccttttgggctgaatggtacgctcaccggccaagcgttcaaaatgtccgactctgcaactaagaagctcatcggtgagtggaaacagttctaccccattagctgttgcctcaaagaaatgtcggaagagaagcaggaggatatggattgggaggatgacagcctggccgctgtagaagtgctggtcgccggcgtccggatgatttacccagcttgctttgtcctggtgcctcagtccgacattcccacaccatctcccgtgggatctacccattgttcatcttcctgcctgggcgtgcaccaggtaccagcaagcacccgggatcccgccatgtcctctgtcacactgacaccccccacttctcctgaagaagtccagacagtcgatcctcagagcgtgcagaagtgggttaagttctcctccgtgtccgatgggttcaactctgactctacctcacatcacggcggaaagattcctaggaaattggcgaatcatgtcgtcgatcgtgtatggcaggagtgcaacatgaacagagctcagaataaacgaaaatatagtgccagtagtggaggtttgtgtgaagaggccaccgccgccaaagtggcctcttgggacttcgttgaagccactcagcggacaaattgcagctgtctgcggcacaagaacttgaaaagtcggaacgccggtcagcaggggcaagccccttctctcggccaacagcagcagatattgcctaagcataagacaaatgagaaacaggaaaaatcagagaaacctcagaagaggcctcttactccttttcatcatagggtgtccgtgtctgacgatgtgggaatggatgccgactctgcctctcagcggttggtgatcagcgcacctgattctcaagtgagattttccaatatcaggaccaacgatgttgctaaaacccctcagatgcacgggactgagatggctaattcacctcaaccacccccgctgagccctcacccatgcgatgtggttgacgaaggggtcactaagacaccgtcgacacctcagagtcagcacttttaccagatgcccacacccgacccgctagttccgagcaagcccatggaggacaggattgattctctgtcccagtcattcccaccgcagtatcaggaagccgttgagcccactgtatatgttgggactgcagtgaatctggaagaagacgaggctaacatcgcatggaagtattataaatttcctaaaaaaaaagacgtagaattcttacctcctcaacttccgagcgacaagttcaaagatgatcccgtcggtccattcggtcaggagtcagtcacttccgtgaccgaactgatggtccaatgcaaaaagccactgaaagtatcggatgagctggtgcagcagtatcagattaagaatcagtgtctgtctgccatagccagtgatgcagagcaggaacccaagattgacccctacgctttcgtggaaggcgacgaggaattcctgttccccgacaaaaaagaccggcagaactcagagcgcgaagctggcaagaaacataaagtcgaagatggcaccagcagtgtcactgtcctgtcccacgaggaggacgcaatgagtctattcagcccatccataaagcaggacgcgcctcgacccacctcccatgcacgacctccttccacctcgctgatttatgactccgatctcgcagtttcctacacagacctggacaatctttttaattccgacgaagacgagctgacaccgggatccaagaagtccgcaaacggctctgatgacaaggcctcttgtaaggaatccaagaccgggaacctggaccctctgtcctgtatcagcacagccgacctgcacaagatgtacccgactccgccaagcctggaacaacacataatggggttctccccaatgaatatgaacaacaaggaatatggctcaatggacaccaccccagggggcaccgtgctggaagggaattcatcctccatcggcgcacaatttaagatcgaggtggatgagggtttctgcagtccaaagccttccgagattaaggacttttcctacgtgtataagcctgagaactgccagatacttgtgggatgtagtatgttcgcgccattaaagacactgccctctcagtacctgcccccaatcaagctaccggaggagtgtatctatcgccaaagctggactgtgggcaagttggagctgctatcttctggcccatccatgcctttcattaaagaaggcgatgggtctaatatggaccaggagtacggcactgcatataccccacagactcatacgtcattcgggatgcctccttccagcgcccctccgagcaactctggggccggaatactgcctagcccaagtaccccaagatttcccacccccaggactccccggacccccaggacgccccgaggcgccggaggcccggcatcagcacagggcagcgtcaaatacgaaaatagtgacctctattccccagcgagtaccccatccacatgccgcccgttgaattctgtggagcctgcgactgtcccaagcattcccgaagctcatagcctctatgtgaacctgatcctttctgagagcgtcatgaatctgttcaaagattgtaatttcgactcatgctgtatctgcgtgtgtaacatgaatattaagggggcagacgtcggcgtctacattccagacccaacacaggaggcccaataccgctgcacatgtggtttcagtgctgttatgaaccggaaattcggaaataattctggcctgtttttggaggacgagctggatattatcggaaggaatacagattgtgggaaggaggccgagaagcgctttgaagccttgagggccacatctgccgagcacgtgaatggtgggctgaaggagagcgaaaagctgtccgatgacctcattttactgctgcaagaccagtgtactaacctcttcagcccattcggggccgccgatcaggatccattccctaagtccggcgtaatcagcaactgggtgcgagtggaggagagggattgctgcaacgactgctaccttgctctggagcatgggagacagttcatggacaatatgtcagggggtaaggtggacgaggcactggtgaaaagttcttgtctgcacccctggtccaagagaaacgatgtgagcatgcagtgctctcaggacatcttgagaatgctgctgtctttacagcctgtgctgcaagatgccatccagaagaaaaggactgttcggccgtggggggtgcaaggccccctgacctggcagcagttccataagatggctgggagaggatcttatggaacagatgaatctcccgagcccctgcctattcccaccttcctcctaggctatgattacgactacctcgtgctcagtcccttcgccctgccttattgggaacgactgatgctggaaccatatggctcacagagagacattgcctacgttgtcctatgtcccgagaacgaggctctgctgaacggcgctaagtcatttttccgagacctgacggccatctatgagagttgccgactgggccagcaccggccagtgtcacggctcttaaccgacggaattatgcgggtgggaagcaccgcctctaagaagttgtccgagaaattggtggctgaatggtttagtcaggcggcagacggtaacaacgaggcttttagcaaactgaagctttacgcccaggtctgccgatatgacctcggcccatacctggcaagcctgccactggacagttctctcctatctcagcctaatctggtggcacctacgagccagagccttatcacgccaccccagatgaccaacacaggaaacgcaaatactccatctgctacgctcgcatcggccgcatccagcaccatgacagtgacttcgggagtggcaatcagtacatccgtggcgacagccaacagcaccctgaccaccgcctctacgtcatcaagtagttccagcaatttgaattcaggggtgtctagcaataaattaccatctttcccgcccttcggcagcatgaactcaaacgccgccgggagcatgagcacccaggccaacacagtacagtcaggacaactcggcggccagcagacatcggcacttcagactgccggaatctccggtgaaagctcaagcctgccaacccagccccaccctgatgtgagtgagagtacgatggaccgcgacaaagtggggattcccactgatggtgattcccatgccgtgacttacccccctgctattgtagtgtatatcatcgacccatttacttatgagaataccgatgaaagtaccaactcctcttcggtgtggacactggggttgctgcgttgcttcctggaaatggtgcaaacgcttcccccacatatcaagtcaacagtcagcgtgcagatcatcccatgccagtatctgctgcagcctgtgaaacacgaggatagggaaatttacccccagcacttgaaaagcctcgccttttctgcctttactcagtgtcgaagaccattgcctacttcaacaaatgtcaagaccctgaccggcttcgggcccggacttgccatggagactgctctacgcagtcccgatcgacccgagtgtataaggctgtacgccccgcccttcattctggcccccgttaaggataagcagactgaactaggcgagacctttggcgaggccgggcaaaagtataatgttctcttcgttggctattgcctctctcatgaccagagatggatcctggccagctgtactgacctttacggcgaactcctcgaaacgtgtattatcaacatcgatgtaccaaacagagccagacggaagaagtcatcagcccgcaaatttgggttacagaagctgtgggagtggtgtctgggactggtccaaatgagctcgctgccctggagagtcgtaatcgggaggttagggcggattgggcatggtgagctaaaggattggagttgcctgctatcgaggcggaacctacagtctctgagtaagagacttaaggatatgtgccggatgtgcgggatctcagccgctgatagtccctcaattctgtctgcctgtctggtggccatggaacctcagggatcgttcgttatcatgccagactccgtaagtaccgggtccgtgttcggccgctccacaacacttaatatgcagacttctcaattgaatacccctcaggatacgtcatgcacccatatcttagtgttccccacttcggccagtgttcaggttgctagtgccacatacacgacggagaatctggatcttgcatttaaccctaacaatgatggagctgatggcatgggcatcttcgacctactggacacaggggatgacctggaccccgacataatcaacatcctgcccgcctccccaaccggaagtcccgtacactcgcccggttctcattacccacacggaggagatgctgggaagggtcagtcaaccgaccgattactgtccacagaaccccatgaggaagtgcccaacatcctgcaacagcccctggccctcggttattttgttagtaccgccaaagctgggcctctacccgactggttttggtccgcctgcccacaggcccaataccagtgtccattgttcttaaaggctagccttcacctgcacgtgccttctgtgcagagtgacgagctcttacactccaagcattctcatccgctggattccaaccagacctctgacgtcctcagattcgtcctcgagcaatataatgcactgtcatggctgacgtgcgacccagctacacaggaccgccgttcctgccttcccatccattttgtggtccttaatcagctgtataacttcataatgaatatgttatag

SEQ ID NO: 194406 - DNA, 6633 bp, Artificial Sequence
  Description of Artificial Sequence: Synthetic coding sequence
atgaccgccgccgccaactgggtggccaacggcgccagcctggaggattgccactcaaatttgttctctttggctgagcttacggggatcaagtggaggcgctataactttggtggccacggggattgcggacccattatctccgcccctgcccaggatgaccccatcctcctgtctttcattcggtgtttacaggctaacttgctgtgtgtgtggcggcgtgacgtgaaaccggactgcaaggagctttggatattctggtggggcgacgagcctaacctcgtgggggtcattcatcacgagctgcaagtggtcgaggaggggttgtgggagaacggcctgagctatgagtgccgcactttactttttaaggctattcacaacttgctggagcgatgcctaatggacaagaattttgtgcggattggaaaatggttcgtgcgcccgtacgagaaggacgaaaagccagtgaataagagtgaacatctctcatgcgcctttacctttttcctacatggcgagtcgaacgtgtgcacctccgtcgaaattgcacagcatcagcccatctacctcattaatgaagagcatattcatatggcacaatcttctccggcacctttccaggtacttgtctcaccttacggactcaacggcaccctgactggccaagcatacaagatgagcgaccctgccacacgaaagctcattgaggaatggcagtacttctatccaatggtgttaaagaagaaggaagagagtaaagaggaagatgagctgggctatgacgatgacttccctgtggctgtggaagtaattgtggggggcgtgcgaatggtgtacccctccgccttcgtactgatctctcagaatgacatcccagtgccacagagcgtggcctctgccgggggacacatcgcagttggtcaacagggcctcggctcagtcaaagatcctagtaactgtggcatgccccttactcctcccaccagtccggagcaggccattctcggagagtctggtgggatgcaatccgccgccagtcacctggtgtcccaggacggaggcatgatcactatgcatagccccaaacgctctggcaaaattccccctaaactgcacaatcacatggtccatagagtgtggaaagagtgtatcctgaatcgtactcagtccaagaggagccagatgtcgacacccacattggaagaagagccggcaagcaatcctgccacctgggatttcgttgaccctacacagcgtgtttcatgctcatgctcgcgacacaaactcctgaagcgatgcgccgtggggcccaatagaccaccaaccgtaagtcagccaggtttcagcgctggaccgtccagttcttccagccttcctcctccagcctctagcaagcataaaaccgctgaaagacaggagaagggagataaattgcagaagcgcccactcatcccattccatcacaggccgtccgtagccgaagagctttgtatggagcaggatactcccggacagaagttgggactcgccggtatcgacagcagtttagaggtgagctcatcccgcaaatatgacaagcaaatggcagttccctctaggaataccagtaaacaaatgaacttaaaccctatggacagcccccacagccccatttcccccctcccaccaactctgtcgccccagcctaggggccaggagaccgagagtctcgatcctcctagcgtgcccgtcaatcctgccctctatgggaatggcctggaactgcagcagctttccacccttgatgatcgaacagttctagtgggccagaggcttccactcatggccgaggtgagcgagactgccctgtactgtggcattagaccaagtaatccagagagttctgagaaatggtggcactcctataggctacccccctccgacgacgcagaattccgcccccctgagttgcagggggaacgttgcgatgctaagatggaggttaatagcgaatcaaccgcactgcagagactactcgcccagccgaacaaaaggttcaaaatttggcaggataagcagccgcaactccagcccctacactttctcgaccctttgccactctcgcagcaaccaggcgatagcctaggagaggttaacgacccttatacatttgaggatggggatatcaaatatattttcacagccaataaaaagtgcaagcagggcactgagaaagatagtttgaaaaagaataaaagcgaggacggcttcggaactaaggacgtaactacgcccggccactccacccctgtgccagatggaaaaaatgccatgagtattttttcttcagctacaaaaaccgatgtcagacaggataatgcagcggggcgagctggctccagttcattgacacaggttaccgatttggccccttcattacatgacctggacaacattttcgacaactctgacgatgatgaactcggcgctgtttcacccgccttgcgcagtagcaagatgcccgctgttggcactgaggataggccattaggaaaggatgggagggcagcagtgccttatcctccaaccgtcgccgatctgcagagaatgtttcccacccccccttcactggagcagcaccctgccttttcccctgtgatgaactataaggacgggatctcttcagagaccgtgactgctctgggaatgatggagagtccaatggttagcatggtttcaacgcaactgacggagtttaagatggaagtggaggatggactgggttcccctaagcccgaagagatcaaagacttcagttacgtgcacaaggttccgagcttccagcccttcgtcggtagctccatgtttgctcctctgaaaatgttacccagccattgcctgctgcctctaaagatccctgacgcctgcctgtttcgcccctcatgggctatcccaccgaagatcgagcagctgcctatgccgccagccgcaacttttatcagggacgggtataataatgttccatccgtgggaagtctcgccgaccccgattatcttaacaccccccagatgaatacacccgtcacattgaactccgccgcaccagctagcaacagcggcgcgggggtgttgcctagtcccgctactccacgcttttcagtccccacgcctagaacacccaggactccccgcactcctagagggggcggcacagctagcggtcagggatccgttaagtatgattctaccgatcagggctctcccgcctccacaccaagtacaactagaccgttaaattctgtagaacctgcaacgatgcagcccatccctgaggcccattccctatacgttaccctgattctctcagattccgtgatgaatatcttcaaagatcggaactttgattcctgctgcatttgtgcctgtaatatgaatattaaaggcgcagatgttggtctctacatccctgacagctcgaatgaggaccagtaccgatgtacatgtggcttcagtgcaattatgaacaggaaactgggttataattctggactattcctagaggacgaactggacatattcggcaagaattcagatattggccaggctgcagagaggcggctgatgatgtgtcagagcaccttcctgccacaagtggagggaactaagaaacctcaggagccaccaatcagcctgcttttgttgctgcagaaccagcacacccagcccttcgctagcttaaacttcctggactacatttccagcaacaatcggcagacattgccttgtgtgagctggagttacgaccgcgtacaggctgacaataatgactactggacagaatgttttaatgctctggaacagggcagacaatacgtggataacccaactggagggaaggtggatgaagctttggtccggtcggcaaccgttcacagttggccccatagcaacgtgcttgatatcagcatgctctccagccaagatgtggttagaatgctcttgagcctccagccctttctccaggacgccattcagaagaaaagaaccggccggacttgggaaaatattcagcacgtgcaggggcccctgacctggcagcagttccacaaaatggccggaaggggcacatatggcagcgaggaatccccagaaccacttccaatccccactcttctggtgggctatgacaaggacttccttactatctcccccttcagccttccgttttgggagagattactcctggatccctacggaggccatagagatgtggcatatatcgtggtgtgcccagagaatgaagccctcctggaaggcgcaaaaacattttttagagaccttagcgccgtatacgaaatgtgcaggctgggccagcacaagcctatttgcaaggtactgcgggacgggataatgagagtggggaaaacagtggcacagaagttgactgacgaactcgtttccgagtggttcaaccagccctggagtggcgaggagaacgacaatcatagccgtctcaagctgtatgcacaggtgtgccgacaccatcttgcaccctatttggctaccctgcagttggattcttcacttctgatccccccgaaataccagacccctcctgctgccgcacaaggacaggcaacacccggaaatgcgggtcccctggctccaaatggatcagccgcaccccccgcgggctctgcgtttaaccccacttccaatagctccagcaccaatcctgccgcaagctcaagtgcctcaggctcatctgtcccgccagtctctagcagcgcgtctgcgccggggattagccagatcagcacgaccagttcttcaggcttttctggctcagtgggaggtcagaacccatctacagggggcatctccgctgaccggacccaggggaacatcgggtgcggaggagatacagaccctggtcagtcttcatctcagcctagccaggatggacaggagtctgtgaccgagcgcgaacggatcggcattcccacagaacctgattccgcagacagccatgctcacccaccagctgtggttatctatatggtggatccctttacatacgccgctgaggaagactccaccagcggcaacttctggctcttgtcactaatgaggtgttatacagaaatgctcgacaatctgcccgagcacatgcgcaattctttcatactgcagattgtaccgtgtcagtacatgctgcagactatgaaagatgaacaggtgttttacattcaatatttaaagtccatggcattttctgtgtattgccagtgcaggcgaccgttgcccacgcagattcatattaaaagcctcacaggcttcggccccgccgcctccattgaaatgacactgaagaatccagaacgtccatcccccatacagttgtacagtccgccattcatcctagccccgataaaggacaagcagacggaactcggggagacattcggggaggcctcccagaagtataatgttctcttcgtcggctactgcttgtcacacgaccaacgatggctcctagcctcttgcacagacttacatggcgaattgttggaaacttgcgtggtaaacatcgccctcccgaacagaagtaggagatcgaaggtgtccgccagaaaaatcgggcttcagaagctctgggagtggtgcatcgggatcgtacagatgacatctttgccctggagggtcgtcatcggccgcttaggtcggctgggacatggggaactgaaagactggagcatattactgggggaatgttctctgcagacaatatctaaaaagcttaaagatgtctgcaggatgtgcgggataagcgcagcagattcccccagtattttgagcgcctgtcttgtcgctatggagcctcaagggtctttcgtcgtgatgcctgacgcagttacaatgggttcagtgttcggcagatcaactgccctcaacatgcaaagcagccagctgaatactccacaggatgcttcctgcacgcatatattagtgtttcccaccagtagcactatacaggtggctcctgcaaattatcctaacgaagacggattcagccctaacaacgatgacatgtttgtggatttgccttttcctgatgatatggacaacgacatcggcattctcatgaccggaaaccttcactcctccccaaactcttctcccgttcctagcccagggagtccgtctgggataggggttggctcccactttcagcattcgcggagccagggggagcgcctcctctctcgcgaggcccctgaagagctcaagcagcagcctctcgccctggggtatttcgtcagcaccgcaaaagcggaaaatctaccacagtggttctggagttcatgtccccaggcccagaaccagtgcccccttttcctcaaagcttccctacatcaccacatttctgttgcccagacagacgagttgctcccagcccggaacagccagcgcgtcccccaccccctggatagcaagactacctcggacgtgctcagatttgtgctggaacagtacaacgctctgagctggctgacctgtaaccccgccacccaggacaggacaagctgtctgccggtgcactttgtggtcctgacccaattgtacaacgcaatcatgaatatcctgtag

SEQ ID NO: 194407 - DNA, 4365 bp, Artificial Sequence
  Description of Artificial Sequence: Synthetic coding sequence
atggcccccgtgcagctggagaaccaccagctggtgccccccggcggcggaggaggcggttcaggtggccctccttccgcccccgctccccccccccccggtgctgccgtggccgccgccgctgccgccgcagctagccccggctaccgcctgtccactctcatagaattcttgcttcaccgtgcatacagcgagcttatggtcctgaccgatcttctccccaggaagtccgacgttgaacgtaagatagaaatcgtgcagttcgcctcccgcacaaggcaacttttcgtgcgactcttggccctggtcaaatgggctaataacgcagggaaagttgagaaatgtgctatgatctcgtctttcctcgaccagcaggcaatcctgtttgtcgacaccgccgatcggctggcctctttggctagggacgcactcgtccacgctcgcctgccttcatttgcgattccctatgcaatagacgtgctcacaacaggaagctatcctagactgcctacctgtatacgagacaagatcatccccccagatcctatcaccaaaatcgaaaagcaggccaccctccatcagttaaatcaaatcctgagacatcggctagtcactacagacctgcccccccaactcgccaatctcacagttgcgaatgggcgagtcaagttccgagttgagggagaatttgaggccacgcttactgtaatgggcgacgatccagatgtcccatggaggctgctgaagcttgagattctggttgaggacaaggagactggggacggacgcgcgcttgtccattcaatgcaaatctcgttcatccaccaattagtgcaatcacgtctgtttgcagacgaaaaaccccttcaggacatgtacaattgcctacactccttctgcctctccttgcagctcgaggtactgcattctcagacattgatgctgatccgagagaggtggggggacttggtccaggtggaacggtaccacgccggaaaatgcttatcattatctgtatggaaccagcaagtcctggggcggaagacgggaacagcgtcagtgcataaagtgaccattaagatcgacgaaaacgatgtttcaaaacccctccaaatcttccacgaccctcccctcccagcttcagactccaagctggtcgaaagagcaatgaaaatcgaccacttgagcattgaaaagctgttgatcgattccgtgcatgcacgggcccaccagaagctccaggagttaaaggccattttgagaggattcaatgctaacgagaattccagtattgagacagcattacctgcactggttgtcccaatactcgaaccttgtggtaactccgagtgtcttcatatttttgttgacctgcactcaggaatgttccagctaatgctgtacggcctggaccaggcaaccctggacgatatggaaaaatccgtcaacgatgacatgaagagaatcattccatggatccaacaactaaagttctggctcgggcagcagagatgtaaacagagcatcaaacatcttcctaccatttcgtcagaaactttgcagctgtctaactactccactcatccaattggcaatctcagtaagaacaaactgtttatcaaactaactagactgccgcagtactatattgtggtagagatgttggaagtgccaaataagcctacccagttgtcctacaaatattactttatgagtgtaaatgccgccgaccgcgaagacagtcctgcaatggccctccttctccagcagttcaaagaaaacatccaggacttggtattcaggaccaagactggtaaacaaacgcgaacaaacgcaaagaggaaactctcagacgacccctgccctgtggaaagtaaaaaaactaagagggctggtgaaatgtgtgcctttaacaaggtgctggctcactttgtcgccatgtgcgacacgaatatgcctttcgtgggcttgaggcttgagctgtcgaatctggaaattccccatcagggggtacaggtggagggagacggcttcagtcatgccattagactgctgaaaattcccccttgtaaaggaattactgaggaaacccaaaaggcgcttgacagatccctgttagattgtacttttcgtcttcaggggcggaacaatcggacttgggttgcagagctggtgttcgccaattgtccactgaatggcactagtactagagagcaagggccttcaagacacgtgtatcttacctatgaaaacctgctaagcgaaccagtgggcggccggaaagtcgttgaaatgtttttaaatgactggaactctatcgcgcgtttgtatgagtgtgtgcttgagtttgcaagatccctccccgatattccagcacatttaaacatcttcagtgaagtccgggtgtacaattacagaaaactcatcctctgttatggtacgacaaagggctcttcgatctcgatccagtggaatagtattcaccagaagtttcatatctctttagggacagtgggacccaactcaggctgcagcaactgccacaacaccatcttacaccaactccaagaaatgtttaataagacacccaatgtcgtgcagttactacaggtgctatttgacacgcaggcccccctgaatgccatcaacaagctgcctacagtgcctatgctcgggttgactcaaaggaccaacaccgcatatcagtgcttcagtattctgccccagtcttctacacatatcaggctggcattccgaaacatgtattgtattgatatttattgtcgttcacggggagttgtagcaatccgggacggcgcctacagtctttttgacaacagtaagctagttgagggcttctaccctgccccagggttaaaaacctttctgaacatgtttgtggacagcaaccaagacgctaggaggaggagcgttaacgaagatgacaaccccccctctccgatcggaggagacatgatggactcactgatttctcagctgcaaccaccccctcagcagcagccctttcctaagcagcctggaacttcgggagcctatcccttaacgtcaccaccaacgtcataccactcgaccgtcaatcagagcccctcaatgatgcatactcagtctccaggaaacctgcatgctgcctcctccccctcaggtgccctgcgagcgccgtccccggcttcattcgtcccaaccccgcccccatccagccatggcatcagtatcggcccaggcgcctcatttgcatcgccacacggcactcttgatccttcctcaccgtataccatggtgtccccttcgggacgggccggaaactggcctgggagtccacaggtgtctgggccctcccctgctgcaaggatgcctggtatgtcacccgccaacccttccctgcactctccggtaccagacgcaagccactcacctagagcgggcacgtctagccagactatgcctacaaacatgccaccccctcggaagcttccgcagcgctcttgggctgctagtatcccgaccatcctgacacattcggcacttaatattctgctactgccctccccgacaccaggccttgtgcccggactcgccggctcctacctgtgctcacccttggaacgcttcctcgggtccgtcattatgcggcggcatctccagagaattattcagcaggagacactacagctgattaattctaatgagccgggcgtgatcatgttcaagaccgacgcccttaagtgcagagtggcgctttctcccaagacaaaccagaccttacagttgaaagtgacccccgagaatgccggccagtggaagcccgacgagctgcaggtgctcgagaagttcttcgagactcgtgtggcaggcccaccatttaaggccaacacattaatcgcctttaccaagttactgggagcccccacacatatcttgagagattgcgtccatataatgaagctcgagctttttccagaccaggccactcagcttaaatggaatgtgcaattctgtctcacaattccccccagtgctccacccattgccccacctgggacacctgccgtcgtgctgaaaagcaagatgttatttttcctccagctcacgcagaagacctcagtgccacctcaggagccagtatcaattatcgtgccgatcatctatgatatggcttccggtactacccagcaagcggacataccacgtcagcagaactcctccgtcgcagctccaatgatggtgagtaatattttaaaacgcttcgctgagatgaatcctccccggcagggcgaatgtacaatctttgccgcagtccgcgacctcatggccaatctgaccctaccccccgggggcaggccctag

SEQ ID NO: 194408 - DNA, 468 bp, Artificial Sequence
  Description of Artificial Sequence: Synthetic coding sequence
gtggccggcccccccttcaaggccaacaccctgatcgccttcaccaagctgctgggggcccctacacacattcttagggactgcgttcatatcatgaaacttgaactttttccggatcaggccacacagctgaaatggaatgtgcaattctgtctcactatccctccatccgctccgcctattgcaccccctggcacacccgccgtggtgctaaaaagcaaaatgttgtttttcttacagctgacccagaagacttcagtacccccacaggagccggtcagtattattgttcctatcatctatgacatggcctctggaacgacccagcaggctgacatcccccgccaacaaaattcctcagtcgccgcacccatgatggtcagcaatattctaaagcggtttgccgagatgaatcctcccagacagggcagcattaaaggaactggctgtccctccgactttctttag

SEQ ID NO: 194409 - DNA, 996 bp, Artificial Sequence
  Description of Artificial Sequence: Synthetic coding sequence
cccagcggccgggccggcaactggcccggcagcccccaggtgagcggccccagtccggcagcccgcatgccggggatgagcccagctaatccttcattgcacagccccgttcctgatgcctctcactccccccgtgccggaacctcatcccagacaatgcctacaaacatgccgccgccaagaaaattgcctcagcgaagctgggcagcatctatccctaccatcctgacacattcagccctcaacattctgctcctccccagcccaaccccaggcctggtacctggactggccggatcatatctgtgctcgccactggagagatttctcggctctgtaattatgagaaggcatctacagcgtattatacaacaggagacactgcagctgatcaacagtaacgagccaggggttatcatgttcaaaacagacgctctgaaatgtagggttgctttgagccctaagactaaccaaactctacagcttaaagtcactcccgaaaacgcaggacagtggaaacctgatgagttgcaggttctggaaaagttctttgaaaccagggttgccggcccccccttcaaagctaatacactgattgcttttacgaaattgctaggcgcaccaacacacatcttgcgggattgcgttcatattatgaaactagaactgttccctgatcaggcgacccagctgaagtggaacgttcagttctgcctgactattcctcctagcgctcccccaatcgcaccacccggcacgcccgcggtggtgctcaaatccaagatgctgttcttcttgcagcttacccagaagacttccgtgcccccccaagaacctgtatcaattatcgtgcccatcatttacgacatggcttccggaaccacacagcaagccgatatacccagacagcagaacagcagtgttgccgctcccatgatggtatcgaacatcctcaagaggttcgctgagatgaacccacctaggcagggcacttag

SEQ ID NO: 194410 - DNA, 2367 bp, Artificial Sequence
  Description of Artificial Sequence: Synthetic coding sequence
atggacgtgagcggccaggagaccgactggcggagcaccgccttccgtcagaagctcgtttcacagattgaggatgcaatgagaaaggccggagtggcccattcgaagtcaagtaaggacatggaatctcacgtcttcctgaaggctaagacacgcgatgagtatttgagtctggtcgcacgccttattattcatttccgagatatccataataaaaaatcccaggcaagtgtctccgacccaatgaacgccttacagtcgttgacaggggggcctgccgctggcgcagctggcattgggatgcctcctcgcggtccaggacagagcctcgggggtatgggatcactaggcgctatgggacagccaatgagtctgtcgggacagccccctccgggaacctcgggtatggcacctcattccatggccgtagtgtctactgctaccccacagacacagcttcagctccagcaagtcgctctccagcagcagcagcaacagcagcaattccagcagcagcagcaagccgccttacaacaacagcaacagcagcaacagcagcaacaattccaggcccagcagagcgctatgcagcagcaattccaagcagtcgttcagcaacaacaacagttgcagcagcaacagcagcagcagcagcacttaataaagctccaccaccaaaatcaacagcagatacagcagcaacaacaacagctccagcgaattgcacagctacagctacagcaacagcagcagcaacagcagcagcagcagcaacagcaacagcaggccctgcaggcacagccgcctatccagcagcctcccatgcagcaaccccaaccacctccatcccaggcactcccccaacagctgcagcaaatgcatcacacgcagcaccaccaaccaccccctcagccccagcagcctcccgtcgcacagaatcaaccgtcgcagctccccccacagtcccagacacagcctctggtgtctcaagcgcaggcgctgcctggtcagatgctgtatacccagccgccgctcaagttcgtccgagcccccatggttgtgcaacagccccccgttcagccccaggtgcagcaacagcagacagccgttcagactgcgcaagctgcccagatggtggcacctggtgtgcaaatgattaccgaggccctggctcaaggcgggatgcacatccgcgcaaggtttcctcctacgactgccgtgtctgccatcccttcatcttctatccctcttggccgccaaccgatggcccaggtgagccaatcctcccttcccatgctaagctcccctagccctggtcagcaagtgcaaactccccagtccatgcccccgcccccccagccaagcccacagcccggccagcccagtagccaacctaatagcaacgtctctagcggtccagcaccatctcccagctccttcctcccctcccctagtccacagccctcacagtcgcctgtaactgcacgcacaccccaaaacttctccgtgccctctccaggcccattgaacaccccagttaatccctcaagtgtgatgtcacccgcaggtagttcccaggccgaggagcagcaatatcttgacaagttgaaacagctgtccaagtacatcgagccacttagaagaatgattaacaaaatagacaagaacgaggatcggaaaaaggatctaagcaagatgaagtctttactcgacatcctgactgatccctctaaacgctgcccactgaagactctccagaaatgtgagattgccctcgagaagcttaaaaacgacatggctgtgccaaccccaccacctcctccagtgcctcccaccaagcagcaatatctgtgccagcccctccttgatgcagtactcgctaacatccggtcgccagtgttcaatcactctctctacaggaccttcgtgcccgcaatgaccgcgatccatggcccccccattacggccccggtggtatgcaccaggaagaggcgcctagaggacgacgaacggcagtccatccctagtgttctccagggtgaggtcgccaggctggatcctaaatttctggtcaatctggatcctagtcactgcagtaacaatgggactgtgcacctcatctgtaagctggatgacaaggacctgccttcagtccccccactggaactgagcgttcctgctgattaccccgctcagtcaccactctggattgaccggcaatggcagtatgatgcaaatccattcctgcagtctgtccaccgctgcatgacatccagactcctccagctcccagacaagcactcagtgacagccttgttgaatacttgggcacagtctgtccaccaggcatgcttgagtgccgcatag

SEQ ID NO: 194411 - DNA, 2247 bp, Artificial Sequence
  Description of Artificial Sequence: Synthetic coding sequence
atggacgtgagcggccaggagaccgactggcggagcaccgccttccggcagaaactagtgtctcaaatagaagatgccatgaggaaggctggggtggcacactctaaatcgtctaaggacatggagtcacatgtattccttaaagctaaaacccgcgatgaatacctgtcactggtggcccggctgataatccactttagggatattcataacaaaaaatcccaggcaagcgtcagtgatcccatgaatgcactgcaaagtctgacgggcggacccgccgcaggggccgctgggattggcatgcccccaaggggcccagggcagtcactgggcggcatgggcagcctgggtgctatgggtcagcccatgtcgctgagcggccagccccccccaggcacctccgggatggcacctcactccatggcagttgtgagtactgccacaccacagacacagcttcagcttcaacaagttgcacttcagcagcagcaacagcagcagcagtttcagcagcagcagcaggccgccttgcagcagcaacaacagcagcagcagcagcagcagtttcaggcccagcaatcagctatgcaacagcaattccaggctgttgtccaacagcagcagcaattgcagcagcaacagcagcagcagcagcacctgatcaaacttcatcatcaaaatcagcagcagattcaacagcaacaacagcagctccagcggatcgctcagctacagttgcagcagcagcagcagcagcagcaacagcagcagcagcagcagcaacaagccttgcaggctcagcccccaatccagcagcccccaatgcaacagccccaacccccaccatcgcaggcacttcctcagcagctccagcaaatgcatcacactcaacatcaccagccaccccctcagcctcagcagccacctgttgctcaaaatcagccgagtcagctccctccccagtcccaaactcagccgttagtcagccaagcccaagccctccctggacagatgctctacactcagccacctctcaaattcgttcgggcacccatggttgtgcagcagcctccggtgcaacctcaggtgcaacagcagcagactgctgtgcagactgcccaagcggctcaaatggtggcacccggggtgcaagtgtcacagagctctctgcctatgctgtctagtccctcccccgggcagcaggtgcagactccccagagcatgccaccacccccacagccgtcccctcagcccggacagcccagttcccagccaaacagcaacgttagttctggacctgcgccttctccatcaagtttcttgccaagtccatcaccacagccttcgcagtcgccagttacagcacgaactccgcagaacttcagcgtcccttccccgggacccctgaacacgccagtcaacccttcgtccgtgatgtcacccgcgggctcatctcaggccgaagagcagcaatacctggacaaacttaagcagttgtccaagtatattgagcccttgcggaggatgatcaataaaattgataagaacgaagatagaaaaaaggacctgtctaaaatgaagtccctcctggacatccttacagacccctctaagcgatgcccactgaaaaccttacagaaatgtgaaatcgccctcgagaagttgaagaacgatatggctgtcccgacgccaccccctcccccagttccacccactaagcaacagtacctttgtcagccactcctagatgccgtgctcgccaatatacgttcgccggtgttcaatcattccttgtatagaacctttgtgcctgctatgacagctattcacgggcctccgattactgcccccgtagtttgtaccaggaaacggcgcctggaggatgacgagcggcagagcattccctcggtcctacaaggagaggttgccaggctggacccaaagttcctggtaaatttagatccttctcactgctccaataacggcacagtccacctcatttgcaaactcgacgacaaagaccttccctctgtgcctccactcgaactcagcgtgcctgcggattatccagcccagagtcccctttggattgatcggcagtggcagtacgatgccaatccatttctgcagagcgtccaccgatgcatgacttctcgcctcctgcagttacctgataaacatagtgtgacggccttgctgaacacctgggcccaaagcgtacatcaggcctgcctgagcgcggcctag

SEQ ID NO: 194412 - DNA, 2034 bp, Artificial Sequence
  Description of Artificial Sequence: Synthetic coding sequence
atggacgtgagcggccaggagaccgactggcggagcaccgccttccggcagaaactagtttcccaaatcgaggatgcaatgcggaaggccggcgtagcccactcaaagtcgagcaaggacatggagagccacgtctttctgaaggccaaaacgcgagatgagtacctctcattggtagcccgcctcatcatccactttcgcgatatccacaacaagaagtcgcaagctagcgtatccgctcaacttcagctgcagcaggtggctttacagcagcagcagcaacagcagcagtttcagcaacaacagcaggcggccttacaacagcaacagcaacaacagcagcagcagcagtttcaggcgcaacagtcagccatgcagcagcaattccaggccgttgtgcaacagcaacaacaactgcagcagcagcagcagcagcagcaacatctgatcaaactgcaccatcaaaatcagcagcagatccagcaacaacagcagcagcttcagcggatagcgcagctccagctacagcagcagcaacagcagcaacaacaacagcagcagcaacagcaacaggctctccaggcccagccccctatccaacagcctccaatgcagcagccccaacctcctcccagccaagctctgccccagcaattgcagcagatgcatcacacacagcatcaccagcccccgcctcagcctcagcagcctcctgtcgcacagaaccaaccttctcagttgccaccccagtcacagactcagcctctggtgtcccaggcgcaggctctaccagggcagatgctgtacacacagcctcctctgaagtttgtcagagctcctatggtggtgcagcagccacccgtccagccccaggtccaacagcagcagacggctgttcaaaccgcacaagctgctcaaatggtggcccctggtgttcaggtctcgcaatcctccctacccatgcttagcagcccatctccgggccagcaggtgcagaccccacagtctatgcctccacctccgcagccttccccgcagcccggccagccatcctcccagcccaactccaatgtatcctcaggtcccgccccctcacctagctcttttcttccatcacctagcccccagccatcccagtcacccgtcactgcgcggacccctcagaacttcagcgtacctagcccagggcctctgaacaccccggtcaatccatctagtgtgatgtcaccagccggaagttctcaggccgaagaacaacagtacctagataaattgaaacaattatccaagtacattgagcccctgaggcgaatgattaataagatagataaaaacgaggaccggaaaaaggacctgagtaaaatgaagagtctcctagacatcctcacagacccctctaagaggtgcccactcaagactctccaaaagtgcgaaatagccctggagaaactaaagaacgacatggcagtgcccaccccccccccgccacccgtgcctccgactaaacagcagtacctgtgccagccactgctagatgcagtcctcgccaacatccgctcaccggtgttcaatcacagcttgtaccgaactttcgtgcctgccatgactgctattcacggtcctccgatcacagcccctgtggtgtgtaccaggaagaggcggcttgaggacgacgagagacagagtatacccagcgtattacagggcgaggtagcccggctggatccaaagttccttgtaaaccttgatccaagccattgctctaacaatggtacagtgcacctcatctgtaaactcgatgacaaagacctgcccagtgtgcctccattggaactgtctgtgcccgctgattaccctgcccaaagccctctgtggatcgaccgccaatggcaatacgacgctaacccatttttgcagagtgtacacaggtgtatgacaagccgcctcctccagctacctgacaagcattccgtcacagctctgctcaacacatgggcccaatccgtccaccaagcatgtcttagcgcggcctag

SEQ ID NO: 194413 - DNA, 2169 bp, Artificial Sequence
  Description of Artificial Sequence: Synthetic coding sequence
atgcggaaggccggcgtggcccacagcaagagcagcaaggacatggagtcccatgttttcttgaaagcgaaaactcgtgacgagtatctaagcttagtagctagacttatcatccacttcagagatattcacaataaaaaatcccaggcctctgtctcagacccaatgaacgctctgcaatctctgaccggagggccagcagccggagccgccggcattggcatgcctccacggggacccggccaaagtctaggtggcatgggctctctaggggcaatgggccaacccatgtcattaagcggccagccgccccccggtacctccgggatggctccacactccatggccgtggtgagcacagctacacctcaaacacaactacaattacagcaagtcgccctgcagcagcagcaacaacagcagcagttccagcagcagcagcaggctgcgttgcaacaacagcagcagcagcagcagcaacaacagttccaggcccagcagagcgcaatgcaacagcagttccaggctgtggttcagcagcaacagcagctgcagcagcagcagcagcagcaacagcatcttatcaagctgcaccaccagaatcaacagcagatacagcagcaacagcaacagctccagcgcatagcccagttgcagctccagcagcagcagcagcagcagcagcagcaacagcagcaacagcagcaggctctgcaagctcagcccccaattcagcagccacctatgcaacaaccacaaccgccaccatcacaagcccttccgcagcagctacagcaaatgcaccatacccaacatcaccagccccctcctcagccacagcaacccccagttgcccagaaccagccttctcagttgccccctcagtcacagacacaacccctggtgtcacaggcacaggcactgcctggccagatgctgtacacccagcctccacttaagtttgtacgcgccccaatggttgtgcagcagccccccgtgcagccccaagtccagcagcaacagacagcggtccagacggcccaagctgcccagatggtggctcctggcgtgcaagtgagtcagtcctctttaccaatgctgtctagtcctagtcctggacagcaggtgcagaccccccagtctatgccacccccaccccagccaagtccacagccgggccaaccctccagccagcccaatagtaacgtctctagcggccccgctccatccccgtcctcattcctgcccagtccttccccacagcccagtcagagccccgtgacagcacgaacacctcagaatttttcagtgcccagccctggacctctaaacacaccggtgaatccctccagtgtgatgagccctgccggatcgtcacaggccgaggagcagcaatacctcgacaagctgaagcagctgtccaagtatatagagcctctgaggcgcatgattaataagatcgataagaatgaggaccgcaagaaagacctgagtaagatgaaatcgttgctggacatcttgaccgatccaagtaagcggtgtccactcaagaccctacagaaatgtgaaatagctctagagaagctgaagaacgatatggcggtacctactccccctcccccacccgtccctccaacaaaacaacaatacttatgtcaacccttgctggatgccgtcctggctaacatcagatccccagtgttcaaccacagcctatatagaaccttcgtgcctgccatgacagccatacacgggccgccaattacagcccctgttgtgtgcacccggaagcgacgcctggaagacgacgagcggcagtcgataccatccgtcctacaaggcgaggtggccaggttagaccccaagtttctggtcaatctggacccttcccactgcagtaacaacggcactgtgcatctcatatgtaagctggacgacaaggacctcccatccgtgccaccgctggaactgagtgttcccgctgactaccccgcacaatcacctctgtggatcgaccggcagtggcaatatgatgccaacccttttctgcagtctgttcatcgctgtatgacatctcgcctgctgcagcttccagataaacactcagtcaccgcgcttctaaacacatgggcgcagtctgtacatcaggcttgtctctccgctgcctag

SEQ ID NO: 194414 - DNA, 1914 bp, Artificial Sequence
  Description of Artificial Sequence: Synthetic coding sequence
atggagagccacgtgttcctgaaggccaagacccgggacgagtacctgtctctggtagcacggctgattatacacttccgcgatatccacaacaagaagtctcaggcatccgttagcgcccagctacagttacagcaagtagctctgcagcagcagcaacagcagcagcagttccaacaacagcagcaggcggccctgcagcagcaacaacagcagcagcaacaacagcaattccaggcacaacaaagtgctatgcagcagcagttccaggcggtggttcagcagcagcaacaactgcagcaacagcaacaacagcaacaacacctgataaagctgcatcatcaaaaccagcagcaaatccagcagcagcaacaacagctccagcgtattgctcagcttcagttgcagcaacagcaacagcagcagcagcaacaacagcagcagcagcagcaggcactgcaagctcagccccccatccagcaaccccccatgcagcagccacagccccccccctcgcaggcactcccccagcagctgcaacagatgcaccacacacagcaccaccagcctccaccccagccccaacagcctccggtggcgcagaatcagccctctcagctccccccacagtctcaaacgcaacccctagtgtcacaggctcaggccctaccaggacagatgctctacacccagccccctctgaaatttgtccgagcgcccatggtagtgcagcagcccccagttcagccacaagtgcagcagcagcagaccgctgtccagacagcccaggcggctcagatggtggctccgggagtgcaggtctcacagagttccctgcccatgttgagctccccctcccccgggcagcaggtgcagactcctcagtcaatgccacctccacctcagccctcaccacagcccggccagcctagctcacaacctaatagcaatgtgagctcagggccagcaccctcaccttcatccttcttgccatcaccgtcacctcagccctcccaatcacctgtgacagcccggaccccccagaacttttcagtgccctctcccggccccctgaatacccccgtgaaccccagctccgttatgtcaccggccggctcttctcaggcggaggagcagcagtacctcgacaagctgaaacaactctctaagtacatcgagccccttcggcggatgattaataagatcgataagaacgaagataggaagaaggatcttagcaagatgaaatccctcctggacattttgactgacccatccaagcgttgccccctgaagactctgcagaaatgcgaaattgccctcgagaagctcaagaacgacatggcggtaccaacgccaccaccaccccctgtgcctcccactaaacagcagtacttgtgccagcctttgctggatgcggtgctggcgaatattcgctctccagtcttcaaccatagcctctatcgcacatttgttccagccatgacagctatacacggaccacctataactgcacccgttgtgtgtacaagaaaacggcgccttgaagacgatgagaggcagagcattccatccgtgctgcagggggaagttgcccggctagaccccaaatttctagtgaatctcgaccctagtcactgctccaacaatggcactgttcacctgatctgcaaattagatgataaggatttaccatctgtgcctccacttgagctgagcgtgccggctgattatcccgcccaaagcccattatggatagacagacagtggcagtatgatgctaacccctttctccagagtgttcaccgttgtatgacctcccgcctgctgcagctgcctgataagcactccgtgacagccctcctgaatacatgggcccagtcagtgcaccaggcctgcctgtcagccgcctag

SEQ ID NO: 194415 - DNA, 2169 bp, Artificial Sequence
  Description of Artificial Sequence: Synthetic coding sequence
atgcggaaggccggcgtggcccacagcaagagcagcaaggacatggagtcccatgtttttctgaaagcaaaaaccagggacgaatatctttctcttgtggcaaggctgatcattcactttcgtgacatccacaataagaaatctcaggcatcagtctcagacccgatgaacgccctccagtccctgacggggggtcccgctgctggtgcagcaggcattggcatgccccccaggggacccggccaatccttaggtggaatggggtcccttggcgcgatggggcagcccatgagtctgagtggccaacccccaccgggcacatctggcatggctccccattcaatggcggtggttagcacagcgacaccacagactcaactgcagctgcagcaggtggcgctccagcagcagcaacagcaacagcagtttcagcagcagcaacaggctgcactccagcagcagcaacagcagcagcaacagcagcagttccaggcacagcagtccgccatgcagcagcaattccaggcggtggttcagcaacaacaacaactgcagcagcagcaacagcagcagcagcatcttataaagctccatcatcagaaccaacagcagattcagcagcagcagcagcaattgcaaagaatagcccaactgcagcttcaacagcagcagcagcagcagcagcagcagcaacagcagcagcaacaggctctccaggctcagccaccaattcagcagccaccaatgcagcagccccagcctcccccttctcaggccttgccacaacaactgcagcagatgcatcatacacagcatcaccagccccctccacagccacagcaacccccggtagcacagaaccaaccatcgcaattgcctccacaatcacagacacagccacttgttagccaggctcaggctctccctggtcagatgttatacacacagccgcccctcaagtttgtacgagccccaatggtggtccagcagcctcccgtccagccacaggtgcaacagcagcagaccgctgtccagactgcccaagctgcacagatggtggcaccgggggtgcaggtatcacagtcctctctgccaatgctgtccagcccatcgccaggacagcaggttcaaacaccacagtcaatgccccctcccccacagcccagccctcagcccggccagccatctagtcagcccaactctaatgtgtcctccggcccagcaccatcaccatccagtttccttccatcacccagcccccagcccagtcaaagcccggtgaccgcccgcaccccacagaactttagcgtgccctccccgggaccactcaatacaccagtgaatcctagttctgttatgtcgcccgccggcagtagccaggctgaagaacagcagtatcttgataaactcaagcagttgtccaagtacattgagcctttacgccgcatgatcaacaaaattgacaaaaatgaagacaggaagaaagacctcagcaagatgaaatctctgctagacatcctcaccgacccctcaaaaaggtgccctctcaaaacccttcagaagtgcgaaatcgctctggaaaagttaaagaacgacatggccgtgcccacccctccacctcccccagtcccgccaaccaagcagcaatatctctgtcagccattactcgatgctgtcctggctaatatcagatcaccagtgttcaaccactcactttaccgaacattcgttccagctatgacagcaatccatggccctcccattaccgccccagtcgtttgtaccaggaagaggaggctcgaggacgatgagcgacagtcgatccctagcgtcctgcagggggaggtggctaggttggaccctaaatttctggtgaatctggatcccagccactgcagtaacaacgggacagtgcatttgatatgtaagctcgacgacaaggatctcccttctgtgccaccccttgaattgtctgtgccagccgattatcctgcacagagcccactgtggattgaccgtcagtggcagtatgacgccaaccccttcctgcaatcagtgcatcggtgcatgacgtccagacttctgcagctcccagacaagcacagtgtgacagccctgttaaacacctgggcccagtcagttcatcaggcatgcctttcagccgcctag

SEQ ID NO: 194416 - DNA, 2157 bp, Artificial Sequence
  Description of Artificial Sequence: Synthetic coding sequence
atgcggaaggccggcgtggcccacagcaagagcagcaaggacatggaatctcacgtgttcctgaaggcgaaaacaagagatgaatacctgtcgctggtagcccggttgatcatacactttcgtgatattcacaacaaaaagtcccaggccagcgtgtccgatccaatgaatgccctgcagagcttgactgggggccccgcggccggcgcagctggcatcggtatgccgccccgcggtccagggcagagcctcggcgggatgggaagtctcggagcgatgggacagccgatgtccctgtctggccagcccccaccagggacgagtgggatggctcctcacagtatggccgttgtgagcacagccaccccacagactcagctgcagctgcagcaggtggcgcttcagcagcagcagcagcagcagcagtttcagcagcagcagcaagcagccctgcagcagcagcaacaacaacagcagcaacagcaatttcaggctcaacagtccgccatgcagcagcagttccaagcggtcgtacaacagcagcagcagctgcaacagcagcaacagcagcagcagcatctgatcaagttgcaccaccaaaaccagcagcagcagcagcaacaggctctgcaggcccaacctccaattcagcagccccccatgcagcaacctcagccaccgccgtcacaggccctccctcaacaattacagcagatgcaccatacacagcaccaccagccccccccgcaaccccagcaaccgccggtggcccagaatcagccaagtcaactgcccccccagagccagacccagcccctagttagccaagcccaggccctgcctggccagatgctctatactcagccacctttaaaattcgttagagcccccatggtggtacagcaaccacccgtgcagccccaggtgcagcagcaacagacagcagttcaaacagcccaagcagcgcaaatggtggcccccggcgtccagatgatcaccgaggcattggcccaaggaggcatgcacataagagcacgcttccccccaaccaccgccgtcagtgcgattccttcatccagtatccccctgggccgacagcccatggcgcaacaggtgcagacaccccaaagcatgccacccccaccccagccatctccccagcccggtcagccatcaagtcagcctaactcgaatgtcagcagcggaccagcaccgtctccatccagctttttacctagtccatcgccccaacccagtcaatctccagttacagccagaactccacagaatttttccgtcccgtctccaggtccactcaacactccagttaaccccagttcagtgatgtctcctgccggctctagtcaggctgaggagcagcagtacctggacaaacttaagcaactgtccaagtatatcgagccgctcaggaggatgatcaataaaattgacaaaaatgaggatagaaaaaaggatctttctaaaatgaaatcattgctggatattttaaccgatcctagcaagagatgcccgctcaagaccttacagaagtgcgagatcgccctggagaagctgaagaacgacatggccgttccaacacccccccccccccccgttccccctaccaagcagcaatacctctgtcaaccactattggacgccgtcctggctaatatacgatctcctgttttcaaccactccttgtacaggacattcgttcccgccatgaccgcaatccacgggccacctatcaccgcccctgtggtatgcacccggaaaagacgtctggaagacgatgaacggcagtcgatcccgtctgtacttcagggagaggttgcacgccttgatccgaaattcctggtgaacttggacccctcacactgtagcaataacggaactgttcacctaatttgtaagttagacgataaggacctaccctcagttcctccactcgagctttccgtcccggcagattaccccgcccagagccctctgtggattgacaggcagtggcagtacgacgccaaccccttcctccagagtgtacacaggtgtatgactagtagactcctgcaactccctgataagcatagcgttacagccttactgaatacatgggcccagagtgtgcaccaggcttgtttgtctgcggcgtag

SEQ ID NO: 194417 - DNA, 570 bp, Artificial Sequence
  Description of Artificial Sequence: Synthetic coding sequence
atgcagcagcagttccaggccgtggtgcagcagcagcagcagctgcaacagcagcagcagcagcagcagcacctcatcaaactgcatcatcagaaccagcagcagatccaacagcagcagcagcagctgcagcgcattgcccaactgcagctacagcagcaacagcagcagcagcaacagcagcagcagcagcagcagcaagctctgcaggctcagccccctatccagcagcctccgatgcagcaaccccagccccctccttcacaagctctgccccagcaactccagcagatgcatcacacccagcatcaccagccacccccccaaccccaacagcctccagtagctcaaaaccagccctctcagctgccgcctcagtcgcagactcagccgctggtgagtcaagctcaagctctgcccggtcagatgctgtacactcagccacctctgaagttcgttcgcgcccctatggtggttcagcagccccccgttcagcctcaggtgcagcagcagcagaccgcagttcaaaccgcccaggcagcgcaaatggttgctcccggcgtgcaatag

SEQ ID NO: 194418 - DNA, 1956 bp, Artificial Sequence
  Description of Artificial Sequence: Synthetic coding sequence
atgagcggcgtgcgggccgtgcggatcagcatcgagagcgcctgcgaaaagcaggtgcatgaggtagggttagatggcaccgaaacatatctgcctcctctgagtatgtctcagaacctggctcgccttgcacaacgtattgatttttctcagggtagcggctccgaggaggaggaggccgcagggaccgaaggcgacgcacaggagtggccgggcgcaggctcctccgcagatcaggacgatgaggaaggcgttgtgaagtttcagccgagcctgtggccatgggatagcgtccggaataacttgagatccgcattgactgagatgtgcgtcctatacgacgttctctctattgtcagagataaaaagtttatgacactggacccagtttctcaagacgcccttcccccaaagcagaaccctcagacattgcaactaatctccaagaaaaaaagtctcgccggggccgctcagatactccttaagggcgctgagcgtttgactaagagcgtgactgagaaccaagagaataaacttcaacgagatttcaactccgagctgctgaggctgagacaacattggaaacttcgtaaagtgggagacaaaattctgggcgacttgtcttatcggagtgctggatccctatttccacaccatggtaccttcgaagtgatcaagaatacagatctggatctggataagaaaattccagaggactattgtcctctggacgtgcagattccttccgatctggaaggaagcgcctacattaaagtttctattcagaagcaagccccagatattggagacttagggactgtgaacctgtttaagcgccccttgcccaagtctaagccagggagccctcattggcaaacaaaattggaagccgcgcagaacgtcctgctgtgcaaggaaattttcgctcagctgtctcgggaagccgtgcagataaagagccaggtgccccatatcgtggtgaagaatcagatcatcagccaacccttcccctccctacagctttctattagcctgtgtcactcctctaacgacaagaaaagtcaaaagttcgccaccgagaaacagtgccctgaagatcatctttacgtgttggaacacaaccttcacctgctcatccgggaattccacaagcagactctctctagcataatgatgccccaccccgcctcagctccattcggccacaaaaggatgcggctcagtggccctcaggccttcgataaaaatgagattaactcactgcagtcttcagaagggctgctagaaaagattatcaaacaggccaaacatatcttcttacggagcagggctgcagcgaccatagactcattggcttccagaattgaagatcctcagattcaggcccactggtcaaacattaatgacgtgtacgaatcttcagtgaaagtgctgatcacatcccagggctatgagcagatatgcaaatctatccagttacagctgaatattggagtggagcaaattcgagtggtgcatcgggacggtagagttattacgctgagctatcaggaacaggagctgcaggatttcctgctctcgcagatgagccagcaccaggtacacgcggtgcagcagctcgcaaaggttatggggtggcaggtactgtcttttagcaaccatgtcgggcttggtccgatagaatcaatcggcaatgcttctgccatcaccgtcgcaagtccgagcggagactacgccataagcgtaagaaatgggcctgagtctgggtctaagatcatggtgcagtttcctaggaaccagtgtaaagatttgcccaaaagtgatgttctccaggacaacaagtggtcgcatctgaggggcccttttaaggaagtccagtggaacaagatggaggggcgcaacttcgtgtataaaatggagttgttaatgtccgcattgagcccgtgcctcctctag

SEQ ID NO: 194419 - DNA, 1866 bp, Artificial Sequence
  Description of Artificial Sequence: Synthetic coding sequence
atgagcggcgtgcgggccgtgcggatcagcatcgagagcgcctgcgagaagcaggttcacgaagtcggcctggatggcaccgagacataccttcccccgctgtcaatgtcccaagagtggcccggcgctgggtcctctgcggaccaggacgatgaggagggagtggtaaagtttcagccatcactttggccatgggacagcgtccgaaacaatcttcggtccgctctgacagaaatgtgcgtgctatacgacgtgctcagtattgttagagacaaaaagtttatgacactcgaccccgtgtcccaggacgcactcccacccaagcagaatccccagactcttcagttgatttctaagaagaagtctctggccggagccgcccagatcctgctgaagggcgcagagcgactcaccaaatctgtgactgagaatcaggaaaataaattgcagagggatttcaactctgaactgcttcggttaagacaacattggaagctgcgcaaggtgggtgataaaatactgggtgatttatcatatagatcggctggaagcctttttccccatcacgggacattcgaagtaataaaaaacaccgacctagacttagataagaagatacccgaagactattgccctttggacgtgcaaatcccatccgacctcgaaggtagtgcctatatcaaggtcagtattcagaagcaagcacccgatattggtgatctgggcactgtgaacctgttcaagcgccccttgcccaagtctaagccaggttcaccccattggcagaccaaacttgaagcggcacagaacgtgcttttgtgtaaagaaatttttgcgcagttaagtcgagaggctgtgcagatcaagagccaggtgcctcatatagtggtgaagaatcagattatttcccagccattccccagcctgcaactgagtatctccttgtgtcatagctccaacgataagaaatctcaaaaattcgcaaccgagaaacagtgccccgaagatcacctctacgtgctggaacataatctccatctattaatccgggagttccacaaacagactctgagcagcatcatgatgcctcatcccgcctcagctcccttcgggcacaaaagaatgagactctcaggcccccaggcattcgacaaaaacgagattaactcactccagtccagcgagggcctgcttgagaaaattattaaacaagcaaagcacatctttttacgttcacgcgctgctgcgactatagattctctcgcctccaggatcgaggacccccagattcaggcccactggagtaatatcaatgatgtgtatgagtctagcgttaaggtcctcatcaccagccaaggctatgaacaaatttgtaaatctattcagctccagctaaatattggcgtcgaacagattagagtcgtgcatagggatggaagagttataaccctttcctaccaagagcaggagctccaggattttttgttgagccagatgagtcagcaccaagtccacgccgtacaacagttagccaaggtgatgggttggcaggtgttgtcattttctaatcatgtgggacttgggcccattgaatctataggaaatgcttcagctattaccgtggcctcacctagcggggattatgctatttcagttagaaacggacctgagagcggatccaaaattatggtgcagttcccgaggaatcagtgcaaggaccttcccaagtccgatgtgcttcaggataataagtggtcccacctgcgtggcccattcaaggaggtgcaatggaataagatggaagggcggaactttgtgtacaagatggagttactgatgagcgctctgtctccctgcctgctgtag

SEQ ID NO: 194420 - DNA, 438 bp, Artificial Sequence
  Description of Artificial Sequence: Synthetic coding sequence
atgagcggcgtgcgggccgtgcggatcagcatcgagagcgcctgcgagaagcaggtgcacgaagtgggacttgatggaaccgagacatatctgcctccgctttcaatgtcccagaaccttgcccgcctggcccagcgcatcgacttttcccaaggctcggggagtgaggaagaggaggccgccggcacggaaggtgacgcccaggagtggccaggggcggggtctagtgcagaccaggatgacgaagagggggtcgtcaagttccagccctctctgtggccttgggatagtgtgaggaataatcttcgctccgcactgacggagatgtgcgtgttatatgatgtcttgtcaatcgtcagagataaaaaattcatgaccctggatcccgtttctcaggatgctctgccgccaaaacaggttttcgtcgactttaactag

SEQ ID NO: 194421 - DNA, 627 bp, Artificial Sequence
  Description of Artificial Sequence: Synthetic coding sequence
atggaggccccccccgtgaccatgatgcccgtgaccggcggcaccatcaacatgatggaatatctgttgcagggttccgtcctggatcacagcttagagagtctcatccatcggttgagaggcttgtgcgataacatggagcccgagacgtttcttgatcacgagatggtgttcctgctgaaaggccaacaggcttctccctttgttctccgggctaggagaagtatggatcgcgccggggccccatggcacctgaggtacttaggccaacccgagatgggcgataagaacaggcacgcattagtgagaaattgcgtggatatagcaacatccgagaacttgacggattttctcatggaaatgggattccgcatggaccacgagtttgtggccaagggccacctctttcgtaaggggataatgaagattatggtgtataagatattccgaattttagtcccagggaacaccgactcaactgaggcactatctctgtcttatttggttgaactatcagtggtggcgcctgccggccaggacatggtgtcagatgatatgaagaatttcgccgaacaactcaaacccctcgtacacctggaaaaaattgaccccaaacgcctgatgtag

SEQ ID NO: 194422 - DNA, 627 bp, Artificial Sequence
  Description of Artificial Sequence: Synthetic coding sequence
atggaggccccccccgtgaccatgatgcccgtgaccggcggcaccatcaatatgatggaatatctgcttcaaggttcggtgttggaccatagccttgaaagcctcatccaccgcctgagaggtctctgtgataacatggagccagaaacatttctggatcacgagatggtgttcctcttgaaggggcagcaggccagcccctttgtactgcgtgctcgtcgctctatggaccgtgcaggcgccccctggcacctcagatatctcggccagccagagatgggcgacaagaatcggcatgccctggtgcgtaattgcgtcgacatcgcgacgtctgagaatctcacagatttcctcatggagatgggcttccgcatggaccatgagtttgtggcaaaagggcaccttttccgaaaaggcatcatgaaaattatggtgtacaaaattttccggatcctggttcccggcaatacagactcaacggaggctctttccctttcctatttagttgaactaagcgtggtagctcctgctggccaagatatggtgtcagacgacatgaaaaattttgccgaacagctcaaaccattagtccaccttgagaaaatcgaccccaagagattgatgtag

SEQ ID NO: 194423 - DNA, 585 bp, Artificial Sequence
  Description of Artificial Sequence: Synthetic coding sequence
atggagaacttcaccgccctgttcggcgcccaggccgacccccccccaccccccacggctctgggatttgggccgggcaaaccccctcctccgccacccccgccagcgggcgggggaccagggactgcaccacccccgacagctgcaaccgccccccctggcgcggacaagtccggcgccggatgtgggcctttctacctgatgcgggagctaccaggttctaccgaactcaccgggtcaactaacctcatcacccattacaatctggagcaggcatacaacaaattctgtgggaagaaagttaaagagaagctaagtaactttttacctgacctccctggcatgatagacctgcctggaagtcatgacaattcgagtctgcgcagcctgatcgaaaagccccctatcctctcctccagcttcaatcctataaccggtaccatgctggctggatttcggctccacaccggtccactgcccgagcagtgtcgcctcatgcatatccaacctcccaagaaaaaaaacaagcataagcataagcaatcacgtacgcaagaccccgttccaccaggaaaaccatcttag

SEQ ID NO: 194424 - DNA, 735 bp, Artificial Sequence
  Description of Artificial Sequence: Synthetic coding sequence
atggagaacttcaccgccctgttcggcgcccaggccgacccccccccccctcctacagcattagggttcgggcctggcaagcctccccctccccctcctcctcccgccggcggtggaccggggacggcccctccgcccactgccgccaccgccccccccggggctgacaaatcaggagcaggctgcggccctttttatctgatgagggagttgccgggcagcacggagctgacaggaagcaccaatttgattacgcactataatttggaacaggcctataataaattctgcgggaagaaagttaaagaaaagctctcaaattttctcccagatctcccaggaatgattgaccttccaggttcacacgataatagttccctgcgttctctgatcgaaaagcctcctatcctctcttcatccttcaatccgattacaggaaccatgctggctggctttaggctgcacacagggcctctgccggagcagtgcagacttatgcacatccagccgccaaaaaagaaaaataaacataaacacaagcagagccggacacaggatcccgttcctcccgaaaccccaagtgatagcgaccacaagaaaaaaaaaaagaaaaaagaggaggatcctgagaggaaaaggaaaaagaaggagaaaaaaaagaagaagaacagacacagtcccgaccatccaggcatggggagtagccaagcctcttcttccagcagtcttaggtag

SEQ ID NO: 194425 - DNA, 639 bp, Artificial Sequence
  Description of Artificial Sequence: Synthetic coding sequence
atgggcgtgacctgcgtgagccagatgcccgtggccgagggcaagagcgtgcagcaaaccgtggaattgctgacgagaaagctggagatgctgggagcagaaaagcaggggaccttctgtgtggactgtgagacttatcacactgctgctagcacccttgggagccagggacagactggcaaactcatgtatgtgatgcacaatagtgagtacccgctgagttgtttcgctttgttcgagaacggtccttgcctgatcgcagatacaaacttcgacgtactgatggtgaaattgaaggggttcttccagagtgcgaaggcctccaaaatagagacaagaggaaccaggtaccagtattgtgactttcttgtcaaagtggggaccgtaaccatgggtccttccgccagaggcattagcgtcgaagtcgaatacgggccctgtgttgtggcatcagactgctggagccttctcctggaattcctacagtcttttctaggtagccacacccctggagcgcccgctgtattcggtaacaggcacgatgctgtgtacggcccggcagacacaatggttcaatacatggagttatttaataagattcgcaagcagcagcaggttcccgtggctggaatcagatag

SEQ ID NO: 194426 - DNA, 423 bp, Artificial Sequence
  Description of Artificial Sequence: Synthetic coding sequence
atgcccgtggccgagggcaagagcgtgcagcagaccgtggagctgctaactcggaagctcgagatgctaggagccgaaaagcaggggaccttttgcgtcgactgtgaaacctatcacaccgctgcgtcaaccctggggagccaggggcagacgggaaagcttatgtacgtgatgcacaacagcgagtaccccctgagctgctttgccctctttgaaaatggaccatgtcttattgccgacactaacttcgatgtgctgatggttaagctgaagggtttcttccaaagtgcaaaagcctccaagatcgaaacaaggggtacacgatatcagtactgtgactttctggtcaaggtcggtaccgtaacaatgggaccttctgctcggggcatctcagtggaggtggaatatgggccctgtgtgtag

SEQ ID NO: 194427 - DNA, 438 bp, Artificial Sequence
  Description of Artificial Sequence: Synthetic coding sequence
atgggcgtgacctgcgtgagccagatgcccgtggccgagggcaagtcagtgcagcagaccgttgagttattaactcggaaactcgagatgctcggcgccgaaaaacagggaaccttttgtgttgactgtgaaacttaccacacggctgcctccaccttgggctctcagggtcagaccgggaagcttatgtacgtgatgcacaattcagaatatccactatcatgttttgcactgttcgaaaacggcccatgtctcatcgctgacaccaatttcgacgtgctgatggtgaagctgaagggattctttcaatcggccaaagcctcaaaaattgaaactagaggtacacgatatcaatactgtgactttttggttaaagtgggaaccgttaccatgggaccaagcgcacggggcataagtgtcgaggtccggccctggtag

SEQ ID NO: 194428 - DNA, 372 bp, Artificial Sequence
  Description of Artificial Sequence: Synthetic coding sequence
atgggcgtgacctgcgtgagccagatgcccgtggccgagggcaagtccgttcaacagacagtggagctattgacacggaaactcgaaatgttaggagcagagaagcaaggtaccttctgtgtggactgcgaaacttaccatacggccgcttctactctcggttcccagggccagacaggcaagctgatgtatgtgatgcacaattccgagtaccctttgagttgcttcgccctgtttgagaacggcccttgtctgatagctgacacaaactttgacgttttaatggtgaaactcaaaggattctttcagtcagccaaggcaagcaagattgaaacacggggcacaagatggtcaatggcccccgtgtggtag

SEQ ID NO: 194429 - DNA, 435 bp, Artificial Sequence
  Description of Artificial Sequence: Synthetic coding sequence
atggccgaccggctgacccagctgcaggacgccgtgaacagcctggcggaccagttctgcaacgccatcggagttctgcagcaatgcggcccacccgcgtcattcaataatattcaaactgccatcaataaggaccagcccgctaaccccaccgaagaatatgctcagctatttgccgcgctgatcgcccggacagcgaaggacatcgacgtgcttatagactcccttccaagtgaggaaagcacagcagctctgcaggccgcatcactctataagttggaggaagaaaaccatgaagctgcaacatgtcttgaagatgttgtctaccgaggtgacatgctgctcgagaagattcagtccgcactggccgacatagcccagagtcaactgaagactcgctctgggactcatagccagtctctccctgacagttag

SEQ ID NO: 194430 - DNA, 4098 bp, Artificial Sequence
  Description of Artificial Sequence: Synthetic coding sequence
atggagacccagctgcagagcatcttcgaggaggtggtgaagaccgaggtaattgaagaagcctttccaggaatgttcatggacacgcctgaagatgaaaaaacgaagctgataagctgtctgggtgcatttagacagttttggggaggcctgtctcaggagtcccacgagcagtgcatacagtggatagtcaagttcatccatggtcaacattccccgaagcgcatcagcttcttatacgactgcctggcgatggcggtggagactggtcttttgccccctaggctggtctgtgagtcactgatcaactctgatacactggaatgggaaagaacccagctttgggcactgaccttcaaactggtccggaagatcatcggcggggtggattataaaggcgtccgcgaccttctaaaagtgatcctggagaagatcctaaccatccccaacacggtgtcttctgcagtggtgcagcagctgttggccgcgagggaggttatcgcatacatcctggagcgcaatgcatgtttgctacccgcttacttcgctgtaacagaaattcgtaaactctacccagagggtaagcttccacattggttgctgggcaacctggtcagtgacttcgtggacactttccggcctacagccaggattaattctatctgcgggcgttgcagcctgcttcccgtggtgaacaatagcggcgccatatgtaactcatggaagttggatccggcgaccttgaggtttccgttaaagggactattgccctatgacaaagacctttttgagccacagacagcactgttgcgatacgttcttgaacagccttactcacgcgacatggtctgcaatatgctgggcctgaacaagcagacactgaacatcgcccagcacaagcagcgctgccccgttctcgaggaccagttagttgaccttgttgtttacgccatggaacgctcagaaaccgaggaaaaattcgatgatggcggcaccagccagttgctttggcagcatctcagttcacaactcatctttttcgtgctgtttcagttcgcctccttcccgcacatggtgttgagcctccaccagaaactggccggccgcggtcttatcaaaggccgcgaccatttaatgtgggtgcttctgcagttcatctccggctccattcaaaagaacgcactggctgatttcctgccggttatgaagctgtttgacctcctgtaccccgagaaggagtatattcccgtgcccgatattaataagccacaatctacacacgctttcgccatgacgtgcatttggattcatttgaatagaaaggctcagaatgataattccaagctccagatccccattccacatagtctccgcctgcaccatgagttcttgcagcagtctttgcgcaataagtctttgcagatgaacgactataagattgcattgctttgcaacgcctactcgactaacagcgaatgcttcacacttccaatgggggccctcgtggagacgatctacgggaacggtatcatgcgcatacctctccccggcactaactgtatggcttctggtagtatcacaccactcccaatgaacctgctggattcactgactgtgcatgctaaaatgagcctgatacatagtattgcaacgcgggtgatcaagctggctcatgctaagtcctccgtggctcttgcccctgcgctggtcgagacttattcaaggctcctcgtctacatggagatagaatccctcggcatcaaaggcttcatcagccaacttctgccaactgtgtttaagtcccacgcatgggggatcctccacacactcctggagatgttctcttataggatgcatcatatccagcctcattacagagtgcagcttttgtctcacctccacactctggcagcggtggcccagaccaaccagaatcagttgcacttatgcgtggagtctaccgccttgcgtctgattaccgctctaggctcttctgaagtgcagccccagttcacaaggtttttgagcgatccaaaaactgttctgtcggcagagagcgaggagctgaaccgagccctgatcctgacactggctcgggctactcacgtgacagacttttttaccggctcagattcaatacagggcacctggtgtaaagacattttgcagactattatgagcttcacccctcacaactgggcgtcccacacactctcttgcttccctggtcccctccaagcattcttcaaacagaacaatgtgccccaggagtcgagattcaacttaaaaaagaacgtggaagaagaataccggaagtggaagagtatgtccaacgagaatgatataatcacacatttctctatgcaggggtctcctccactcttcctgtgcctgctgtggaagatgctgcttgaaactgaccacattaaccagattggatacagggttctcgaaaggataggtgctagagcattagtagcacacgtgaggaccttcgccgatttccttgtgtatgagttctcaacctctgcaggagggcagcaactcaataagtgcatcgaaattctcaacgacatggtctggaaatataacatcgtgactctggaccggttaattctctgtcttgccatgaggtctcacgaaggaaatgaggctcaagtgtgctactttatcatccagctgctgcttctgaagcccaacgacttccgcaacagggtaagcgatttcgttaaagagaactcacctgaacattggcttcaaaacgattggcatactaaacatatgaattaccacaaaaagtatccagagaagctgtactttgaaggcctcgccgaacaggttgacccaccagtacagatccagagtccttatctccctatttattttggaaacgtctgcctgaggttcctaccagtcttcgatatcgtcatccacaggttcctcgagctactgccagtgagcaaaagccttgaaactctgctggatcacctaggtggcttatacaaattccatgaccgtcccgtgacttacttgtataacaccttacattactacgagatgcaccttcgcgatcgggcctttctgaaaagaaagctcgtgcatgctattattgggtcgctaaaggacaaccgaccccagggctggtgcctttcagatacatacctaaagtgcgctatgaatgcccgggaggaaaacccgtgggtgcccgatgatacctactattgtagactcattggccgcttggtggacactatggcgggcaaatccccaggcccctttcctaactgtgactggcggttcaacgaattcccaaatcctgctgctcatgcgctccacgtgacgtgtgtcgagttgatggcattagccgtttcgggcaaagaggttggtaacgccctgctgaacgttgttctgaagagtcagccgctcgtgccaagagaaaatataaccgcctggatgaacgctattggactgattatcaccgctttgcccgagccctattggatcgtgctgcatgatcgcattgtttccgtgataagcagtccctcactcacctctgaaactgagtgggtgggatacccgttccgtctcttcgactttacagcatgtcaccaatcttactccgaaatgagttgcagctacacactggcattggcccatgccgtctggcaccacagtagcatcgggcaactgagcctaattcctaaattcttgacagaggtcctgctccccatcgtgaagaccgaattccagctgctgtacgtctatcacctcgttggcccatttctgcagaggttccagcaggaaaggacaaggtgtatgatcgaaattggagtggcattctacgatatgttgctgaacgtggaccaatgttccacccacctgaattacatggatcctatatgtgattttctatatcatatgaagtatatgttcaccggggacagtgtgaaggaacaagtagaaaaaatcatctgcaatctcaagcctgcccttaagttgaggctccggttcattacccacataagtaagatggaacccgcagcggttcctcctcaagccatgaacagcgggtcacccgctcctcagagtaaccagtag

SEQ ID NO: 194431 - DNA, 2661 bp, Artificial Sequence
  Description of Artificial Sequence: Synthetic coding sequence
atggagacccagctgcagagcatcttcgaggaggtggtgaagaccgaagtcatagaggaagcattccccggtatgttcatggacacccctgaagatgaaaagacgaagctaattagctgtttgggagccttccgacagttttggggtggtctcagtcaagaatcacacgaacagtgcattcagtggatcgttaaatttattcacggccagcacagtccaaaacggatctcgttcttatacgattgtctagcaatggctgtggagactggcctgcttccgcctagattggtttgtgaatcacttataaactctgacacgttggaatgggagcggacccaactctgggccttaactttcaagttagtccgaaaaatcatcgggggggtggattataagggcgtccgcgacctgcttaaagtaatactcgagaaaatcctgacaattcccaacacagtgtctagcgccgtggtccaacaactgctcgccgcgcgcgaagtgatcgcatacatcctggaacgaaatgcttgcttactgcccgcatacttcgccgtgacagaaatacgaaagttatatcccgagggcaagctgccccactggctattgggcaacttagtgagtgatttcgtggatacgtttcgaccaacagcaagaattaattctatttgcggccggtgcagcctcctgccggttgtgaacaactctggcgccatttgcaacagttggaagttggatcccgccaccctgaggtttccacttaagggcctcctgccctatgacaaggaccttttcgagcctcagactgcactgttgcgatacgtcctggaacagccttattctcgagatatggtctgcaatatgttaggcttgaataaacagacacttaatattgctcagcacaaacagcgatgccctgtgctagaagaccagctggtggatctggtggtttatgcaatggagagaagcgaaaccgaagagaagttcgatgacggcggcaccagtcaactactgtggcagcatcttagtagccagcttatattctttgttctttttcagttcgcatcttttccacatatggtcctctccttgcaccaaaagttggccggtcggggccttatcaagggccgggaccacctcatgtgggtgctgctacagtttatcagtggatctatccagaagaatgcactggccgactttctccccgtaatgaaactgtttgatctactgtatcccgagaaggaatacattcctgtgcccgacatcaataagccacagagcacccacgcctttgccatgacctgcatctggatccacctgaatagaaaggcccaaaatgacaattccaagctgcagatacccataccgcattccctccgcctgcatcacgagttcttacagcagtcacttcgaaataagtccttgcagatgaacgactacaaaattgccttgctgtgcaacgcctattctaccaattccgagtgtttcacactgcctatgggggctctggttgagacaatctatggtaatggaataatgcggatccctcttccagggaccaactgtatggcctcaggttcgataacacctttgcctatgaatttgctggactctctcacagttcatgccaagatgtcgttaatacattccattgcgacacgagtgatcaaactcgcccacgctaaatctagtgtggccctagccccagccttggtggaaacttactcaagactgctcgtctatatggagatagaatctctggggatcaagggatttatcagtcagctgctccccaccgtgttcaagagtcacgcctggggaattctccacaccctattagaaatgttttcgtataggatgcatcacatccaaccccattatcgagtgcaactactgtcacacctccacaccctggctgctgtggcccagacaaaccagaaccagcttcacctgtgcgtggaatccaccgccttaaggttgatcactgccctggggtcttccgaagtacagccccagttcaccagattcctgagtgatcctaagacagttttgtccgcggaatctgaggaactgaacagagccttaatccttactttagccagggcaactcacgttacagacttctttactgggagcgacagcattcaaggtacttggtgtaaggatatcctgcagaccatcatgagtttcaccccccacaactgggccagccacaccctgagttgttttcccggaccactccaagcctttttcaagcaaaacaatgtgccccaggagtctcgttttaaccttaagaaaaacgtggaggaagagtatcgaaaatggaagagtatgtccaatgagaatgatatcattactcacttttccatgcagggctccccccctctgttcctgtgtttactctggaagatgcttctggagactgaccatattaatcagattgggtacagagtcctcgaacgaataggggcccgagccctggtggctcacgttcgcaccttcgccgactttctcgtttatgaattttctaccagtgccgggggtcaacagctcaacaagtgcatcgagatactgaatgacatggtatggaagtacaatatcgtgaccctcgacaggttgattctgtgtctggtgcgcattaatacctttctgtctctattctcgtag

SEQ ID NO: 194432 - DNA, 4125 bp, Artificial Sequence
  Description of Artificial Sequence: Synthetic coding sequence
atggagacccagctgcagagcatcttcgaggaggtggtgaagaccgaggtcatcgaggaggcctttccgggaatgttcatggacacacctgaggacgagaaaacaaaactgatatcttgtctgggcgcctttcggcaattttggggtggcttgtcgcaggagtcacacgaacagtgcatccagtggattgtcaagtttatccatggacagcactctccaaagagaatatctttcctgtacgattgcctcgctatggctgtcgagacggggctcttgcccccaagactggtgtgcgaatccttgatcaacagcgatacgctggagtgggaaaggactcagctttgggcactcaccttcaagcttgtaagaaagattattggcggcgtggactacaagggcgtcagagatttgttgaaagtaatactggaaaaaatcctgacaatccctaacacagtatcatctgcagttgtgcagcagctcctggcagcacgggaagtcattgcctatattttagagcgcaatgcttgtctcctacccgcatactttgccgtcacagaaatccgcaagttatatccagagggaaagcttcctcactggctgctgggcaacttggtatcagattttgttgacacatttcgccctactgctagaattaactcaatttgcgggcgctgctccctgctgccagttgtgaacaacagcggtgccatctgtaactcttggaagctcgatcctgcaaccctccgcttcccattaaaaggactgttaccgtacgacaaagatctcttcgaacctcagacggcactgctgaggtatgtcttagaacagccatattctcgggacatggtttgcaacatgctggggctgaataagcaaactctgaatatcgcacagcacaaacagagatgtcccgtgctggaggatcagctggtcgacctcgtggtctacgccatggagcggagtgaaaccgaggagaagtttgacgacggtggcacctctcagctgctgtggcagcacctgagcagtcagctgatcttcttcgttctgttccaattcgctagcttccctcacatggtcctgagcttgcatcagaagctggccggcagaggattgatcaaaggacgagaccacctaatgtgggtgctgctccagttcatctccggctctattcagaaaaatgctttagccgactttctccctgtgatgaagcttttcgatctgctgtatcccgagaaggagtatattcccgtacctgatattaacaagccacagtcaactcacgccttcgcaatgacatgcatttggattcatctgaacagaaaggcccagaacgataattctaagttgcagatccctatcccacacagcctcagactccaccacgaattcctgcaacagtcattgcggaacaagtctctccagatgaatgactacaagatcgccctattatgcaacgcgtactcaacaaattccgagtgcttcactttgcctatgggagctttggtcgagacaatttacggcaacgggatcatgcggatccctctgccgggcacgaactgcatggcctccggtagtattactcctctccccatgaatttgcttgattcccttacagtgcatgccaagatgtcattgattcactccatagcaacaagggtgatcaagctggcccacgccaagtcatcggttgcactggccccagcactggtggaaacatattcccgcttgctggtttacatggaaattgagtctctgggcatcaagggatttatcagccaactgctgcccactgtttttaaaagtcatgcttggggcatcctgcataccctgctcgagatgttcagctatagaatgcatcatatccagccccactaccgggtgcagctgctctcacaccttcacacactggccgcagtggctcagactaatcagaatcaactgcacctctgcgttgagtctaccgccttacggctgatcaccgcgctcggaagttccgaggtgcaaccgcaattcacacgttttctatcagaccctaaaaccgtgctgagcgccgagtccgaagagcttaacagagccttgatcctgacactggcacgtgccacacacgtcactgatttctttacgggcagtgactccattcagggaacctggtgcaaggacattctacagactataatgtcattcacgcctcacaactgggccagtcacacactgtcttgtttccctgggccactccaggccttctttaagcaaaataacgtcccccaagagtcgaggtttaatttgaaaaaaaatgttgaagaggaatatcgtaagtggaagagcatgtctaatgagaatgacattatcacccactttagcatgcaggggtcacctcccctattcctttgcttgctttggaaaatgttactggagacagaccacataaatcagattggctatcgggtgttggaacgaatcggggccagggccctcgtcgcacatgtgaggacatttgctgactttcttgtatatgagttttccacatcagccggtggccagcagctcaataagtgcatcgagatcctcaatgacatggtgtggaagtacaatatcgtcaccctggaccgcctgatcctgtgtctcgcaatgcgttctcacgaggggaacgaagcccaggtgtgctactttatcattcagctgcttttactgaaacctaacgacttccggaatagagtgtcagacttcgtgaaagagaatagtccggaacattggttgcagaacgattggcacaccaaacacatgaactaccataaaaaatatccggagaagctttattttgagggacttgccgaacaggtggaccctcccgttcaaattcagtctccatacctgccaatatattttggaaacgtgtgcctgcgctttctgcccgtgttcgacattgtcatacaccggttcctggagttgctgcccgtgagcaaaagcctggaaactctgcttgaccacttgggggggctctacaagtttcacgatagacctgttacatacttgtacaacactctgcattattacgagatgcatctccgcgaccgggcgttcctcaagaggaagctcgtccacgcaattatcggaagcctgaaagacaaccgccctcaggggtggtgcctgagcgacacatatcttaaatgcgctatgaatgctcgtgaggagaatccgtgggtacccgacgacacatactattgtcggttgatcggccggctcgtggacaccatggccgggaagagcccagggccgtttcccaattgcgactggcgatttaacgaattccccaatcccgcggcccacgctctccacgtcacctgcgttgaactgatggctttagctgtcagtggaaaagaagtgggcaacgcattgctgaatgtggtgctgaagtcacagccccttgttcctcgtgaaaacatcacggcatggatgaatgccatcgggctgattatcactgctctccctgaaccatattggattgtgctgcacgatcgcattgtctcagtgatatcatcaccctccctgaccagtgaaacagaatgggtgggctatccatttagactgtttgatttcactgcttgccatcagtcctatagtgaaatgtcatgctcatacactctcgcccttgcacacgcagtgtggcaccacagcagcataggccaactgtcactcatacctaagttcttgaccgaagttttgttgcccattgtgaagactgagttccaactgttgtatgtttaccatttggtgggcccattccttcaacgttttcaacaggagaggacgcggtgcatgattgagatcggagtcgcgttctatgatatgctgttgaatgtagaccagtgcagtacacaccttaattacatggacccaatatgcgacttcctgtaccacatgaaatacatgtttaccggcgatagtgtgaaagaacaggtcaagaagatcatttgcaatctgaaaccagctcttaagttgaggctcaggtttattacacacataagtaagatggaacctgcagccgtgccccctcaggccatgaacagtgggagtcccgctccgcagagcaaccaggtccccgtgtcactcccagtaacccagtag

SEQ ID NO: 194433 - DNA, 4095 bp, Artificial Sequence
  Description of Artificial Sequence: Synthetic coding sequence
atggagacccagctgcagagcatcttcgaggaggtggtgaagaccgaggttatagaggaagccttcccaggaatgttcatggacacgcctgaagacgaaaagactaagttaatttcgtgtctcggggcttttcgccagttctggggaggcctctcccaggaatcccacgagcaatgtatacagtggatagttaaattcatacatggccagcatagccctaagcgcatttctttcttatacgactgtctggctatggctgtcgaaaccggccttctgcctccgagactggtttgcgagtctctgatcaatagcgatactctggaatgggagcgcacccaactttgggctctcacatttaagctggtgagaaaaattattggtggggtcgactataaaggtgtgcgagacctgctgaaggtcatattagaaaagatactgaccattcctaatactgtttcctcagccgtcgttcagcaactgctggcggcacgtgaagtcattgcctatattttggagcgcaatgcatgtcttttgcctgcctactttgccgttacggagattcgcaagctgtatcctgagggcaagctgccccactggctgctgggtaatctcgtatctgacttcgtcgacacctttcggcctactgcacgaatcaatagtatctgtggcagatgctcgttgcttccagttgttaataattccggagccatctgcaattcttggaagctggatccagctaccctgagattcccccttaaaggcctgctgccatatgataaagatctatttgagccccaaactgctctgttgcgatacgtcctggaacagccatactcacgcgatatggtatgcaatatgctggggttaaataaacagcacaaacaaaggtgccccgttttagaagaccagctggtggatttagtggtttatgcaatggagcgctccgaaacagaagagaaattcgatgatggcgggacctcacagcttctttggcagcatctcagctcgcagttgatcttttttgtgttattccagttcgcctcctttccccacatggtcctgagcctgcatcagaagctggcgggcaggggactcatcaaaggaagggaccatctgatgtgggtactgttacagtttattagcggctcgatccagaagaacgctctcgcagactttctgcctgtgatgaaattatttgacttgctgtatcccgaaaaggaatatatccctgtacctgatataaataagcctcagagcacacacgccttcgccatgacgtgtatatggattcatctgaatcggaaggcccagaacgacaacagcaagctacagattcctataccccatagcttgcgattgcatcacgagtttttacaacagtcgctgcgtaacaagtctcttcaaatgaacgactacaagatcgcactgctctgcaacgcttactcaacgaactctgaatgtttcactctccccatgggcgccttggtcgaaaccatttatggaaatggaatcatgaggatcccactgccgggtacaaattgtatggcttctgggagcatcacacctctcccgatgaatctactggactcactgactgtccacgccaaaatgtctctcattcacagtatcgccaccagagtaataaaactcgcacacgccaagagttctgtagccctggctcctgccctagtggagacatactctaggcttctcgtgtacatggagatagagagtctcgggattaaagggttcatctctcaattgctgcctaccgttttcaaaagccacgcatgggggatcctgcacacattgttggaaatgttcagctatcggatgcaccatattcagccacactaccgtgtgcaactcctgtctcacctgcacacactggccgctgtggcccagactaaccagaaccaacttcacttgtgcgtcgagagcaccgcgttgagactcatcaccgctcttggttcaagcgaggtacaaccccagtttacgaggtttctctccgatccaaaaaccgtgttgtcagccgagagtgaggaactcaaccgggcattaatcttgacgttggcaagggccactcacgttaccgactttttcactgggtcagatagcatccaggggacatggtgcaaggacatcctgcagacaattatgagctttactccccataattgggcaagccatacgctgagctgtttcccggggccacttcaggccttcttcaaacagaacaacgttccacaggagtctcggtttaatcttaagaaaaacgtggaggaggagtatcggaaatggaaatcaatgagcaacgagaacgatatcataactcacttcagcatgcagggctcaccacctctgtttctctgccttctgtggaaaatgctgctagagactgatcacatcaaccagatcgggtacagggtgcttgagagaattggtgcgagggcactggtggcacatgtgagaacattcgctgactttctggtgtacgagttttctacgtccgccggagggcaacagctgaacaagtgtattgaaatcctcaacgatatggtgtggaaatacaatatcgtcacactggataggctgatactttgtctggcaatgcgcagccatgagggcaacgaggcacaggtctgctattttattattcaattgttgctcctgaaacctaacgactttcgcaaccgtgtatctgactttgttaaagaaaattcccctgaacattggctgcagaatgactggcatacaaagcatatgaactatcacaaaaaataccccgagaagctctactttgaagggctcgctgagcaggtggaccctccggtacagattcagtccccttatctaccaatatactttggcaatgtttgcctgcgctttttaccggtgttcgatatcgttatccaccggttcctcgaactgttgccagtctccaaatccttagagactctcctggatcacttgggtggcctctataagtttcatgaccgacccgtgacttatctgtataatactcttcactactacgagatgcacctcagagacagagcattcctaaagcgcaagctggttcacgctataataggctctctgaaagataacagaccacagggatggtgtctcagcgatacctatctgaagtgtgccatgaatgctcgggaggagaatccgtgggtgcctgacgacacatattattgtcgacttattgggaggttggtcgacactatggcagggaaaagcccaggacccttccctaactgcgactggagatttaacgagttccctaatcccgccgcacacgcactccatgtgacttgcgttgaattaatggcgctggctgtgtcgggcaaggaggtcgggaatgcactgctgaacgttgtactgaagtcccagcccttagtaccccgtgagaacatcacggcgtggatgaacgccatcggtctgattataactgccctgcctgagccttactggattgtcctgcacgatagaattgtttcagtgatctcaagcccttctctcacctctgagaccgaatgggtgggatatccattccgcctgtttgatttcactgcatgtcaccagagttattctgagatgtcctgctcctatacccttgctctggcccacgcagtgtggcaccattctagcattggccaactttcactgatccccaagtttctgacagaggtcctgttaccaatcgtaaaaacagaatttcaactcctctatgtgtatcacctggtggggccttttctccaaaggttccaacaggaacgaacccgttgtatgatcgaaatcggcgtggcgttctatgacatgctgctcaacgttgaccagtgttccactcatttaaactacatggaccccatttgcgacttcctttaccatatgaaatacatgttcaccggggattcagtgaaggaacaggtggagaagattatctgcaacctcaaaccggcactgaaacttaggctccgatttataacacatatatctaagatggaacccgccgctgttccaccgcaggctatgaattctggcagcccagccccgcagagtaaccaggtagataccttaacatag

SEQ ID NO: 194434 - DNA, 4107 bp, Artificial Sequence
  Description of Artificial Sequence: Synthetic coding sequence
atggagacccagctgcagagcatcttcgaggaggtggtgaagaccgaagtgatcgaggaggcttttccaggaatgttcatggatacgcctgaagacgaaaagactaaactgattagttgtctgggggctttccgccaattttggggtggactgtctcaggagtctcacgaacagtgtatccaatggattgttaaatttattcacggccagcattctccaaaaagaatatcattcctgtacgactgccttgcaatggccgtggaaactggcctactgccccccaggctggtctgcgagtccttgataaattccgataccctggagtgggagaggacacaactctgggcgctcacttttaaactggtccggaagatcatcggcggcgtagactataaaggggtgcgggaccttctgaaagtgatcttagaaaaaattctgacaatccctaacaccgtatcctctgcagtggtccagcaactgttggcggctagggaagtaattgcatatatactagagcgaaacgcctgcctactacctgcatattttgctgtgactgaaattcgcaagctgtaccccgagggaaagcttcctcattggctccttggcaacctagtgtctgactttgtggataccttcagaccaacggccaggattaactctatttgcggtaggtgctctctgctgcccgttgtgaataacagcggcgcaatatgtaattcctggaagctggatcccgcaacccttaggtttcctcttaaagggttgcttccatatgataaggacctatttgaaccacaaactgccttactgagatatgtccttgagcaaccatactccagggacatggtatgcaatatgcttggactaaataagcaacataaacagcggtgtccagtccttgaagatcaacttgtagatctcgtggtttacgcaatggagcgtagtgagactgaagagaaatttgacgatggtggaacaagccagctcctctggcagcatttgtccagccagctcatcttttttgtcctgttccaattcgcttccttcccccatatggtcttgagcctacatcaaaagctggccggtcggggcctaattaagggcagagatcatttgatgtgggtcctgctgcagtttatttccgggagtattcaaaagaacgctctggctgacttcttgcccgtgatgaagcttttcgacctcctctatcccgagaaggagtatatcccagttcccgacatcaacaagccccaatcgactcacgctttcgccatgacctgtatatggatccatcttaacagaaaagcgcagaatgataacagcaaactgcagatcccaattccgcacagcctgcgactgcaccatgagtttctccagcaatctttacgaaacaaatcactccagatgaatgactacaagatagccctcttgtgtaatgcgtacagcacaaactcggagtgcttcactttaccaatgggagctttggtggagaccatctacgggaatgggatcatgagaattcccctacccggtactaattgcatggctagcggatcaataactccactacccatgaacctactggactccttgacagttcacgcaaagatgagcctgatccattcaatcgcgactagagttatcaaacttgcacacgcgaagagctcagtcgcactagcacctgctctcgttgaaacctactccaggctcctggtctacatggagattgagagcctcgggatcaaagggttcattagccagctgctcccaacagtgttcaaaagccatgcctggggaatcctgcacactcttctcgaaatgttctcttacagaatgcaccacatacagcctcattacagagtccagctattgtcccatctgcacactctggcagccgtggcccagactaatcagaaccagctgcacctgtgcgtggaatccactgccctccgtctcatcactgccctgggcagcagcgaagtacaaccacagtttacacggttcctgtcagatccaaaaacagttctctcagcagagtcagaagagctgaatcgcgccctgatactaaccctggctcgggctacgcatgtgaccgacttttttacaggctcagattctatccagggtacctggtgtaaagatattttacagaccattatgagtttcaccccccacaactgggcctctcataccctgtcatgcttccccggtcctttacaggcatttttcaagcagaataacgtaccgcaggagtcccggtttaacctgaaaaagaacgtcgaggaagaataccggaaatggaagagtatgagtaatgagaatgatattattacccacttttctatgcagggctcacctcctttgtttttgtgtctactgtggaagatgcttttagagactgaccacattaaccaaatcggataccgagtgctggagcgcatcggcgcgagggcactcgtggctcacgtgcggacattcgctgattttctggtttacgagttttccacctcagccggtgggcagcagctcaacaaatgtatcgagatccttaacgacatggtatggaaatacaatatagtgacactcgacaggctgatcttatgcctggcaatgcggtcccatgaaggcaatgaggcacaagtctgctacttcataatacaactgttattactgaagccgaacgacttccggaaccgagtgtctgacttcgttaaagaaaactcccctgagcattggcttcagaacgattggcatactaagcatatgaattatcacaagaaataccctgagaaattatatttcgaagggttagctgaacaggttgatccccctgttcagattcagtcgccctacttaccaatctatttcggaaatgtgtgcttgagattccttccagtgttcgacatcgtcattcatcgctttctggagctactgccagtgagtaaatctctggaaacgttattggaccatctggggggactgtataagttccacgaccgcccagttacgtacttatacaatacccttcactattacgagatgcacctgagggaccgtgcatttcttaaacgtaagctcgtgcacgccattataggctcccttaaggacaatagacctcagggctggtgcctgtccgatacatacctgaagtgcgctatgaacgccagagaggagaacccatgggtcccagatgatacttactactgccgccttattggacggttggtcgacacaatggcgggcaaaagtccaggcccttttccaaactgcgactggcgctttaacgagtttcccaacccagcagctcatgccctacacgtcacgtgcgtggagttgatggctctagctgtttcggggaaggaagtcggtaacgccctccttaatgtggtattgaaatcacagccactggtgcctcgcgagaatatcacagcttggatgaatgcaatcggactcatcatcactgccctgcccgagccctattggatagttctgcatgacagaattgtctcagtaatttctagccccagtctcacatctgaaaccgaatgggtggggtacccttttcgtctatttgatttcaccgcctgtcaccagtcctactccgagatgagctgctcgtacacgttggccctggctcacgcggtctggcaccacagctccataggccagctatccttgattcccaagtttctgaccgaagtgctgctccccattgtaaaaacagagtttcagcttctctatgtgtatcacctggtggggccattcctccagcggtttcagcaggaaaggacgaggtgtatgatcgagatcggagttgccttctacgacatgctgcttaatgttgaccagtgctctacccacctcaattatatggatcctatatgcgacttcctgtaccacatgaagtacatgttcactggagacagtgtgaaagaacaagttgaaaagatcatttgtaacctcaagcccgctctgaagcttaggctgcgttttattacccacatcagcaaaatggaaccagccgcagtgcctcctcaggccatgaacagtggttcacccgccccccagagcaaccaggtcccagtgtccctccccgtaacgcagtag

SEQ ID NO: 194435 - DNA, 4125 bp, Artificial Sequence
  Description of Artificial Sequence: Synthetic coding sequence
atggagacccagctgcagagcatcttcgaggaggtggtgaagaccgaagtgatagaggaggctttcccaggcatgtttatggacactcccgaagacgagaaaaccaaactaatatcatgcctcggagcctttcgccagttctgggggggactttctcaggaatcacatgagcagtgtatacagtggatcgtcaagtttatccacggccagcatagccccaaacgaatcagctttctgtacgattgcctggctatggctgttgagaccggactcttgccccctaggctcgtatgtgaaagtctcatcaacagcgatacgctggaatgggagcggacacagctctgggccctgaccttcaagctagtccggaaaattattggtggcgtggactataaaggcgtcagagatcttcttaaagttatcctggagaaaatcctcactattcctaataccgtgtcttccgccgtggttcagcagctgcttgcagcacgggaagtgatcgcgtacatcctggaacgcaatgcttgtctcctgccggcgtacttcgcggtaaccgaaattcgaaaattgtaccccgagggcaaactgccacactggctgctgggcaacctggtgtcagattttgttgacactttccgtcctaccgccagaatcaacagcatctgcggtagatgctctttgctgccagtcgttaataacagcggggccatttgcaatagctggaagctggatcctgctacgctcagattccccttaaaaggcctcctgccctacgataaggacctgttcgaaccgcagactgctctgctgaggtatgtgctggagcagccctactctagggacatggtctgcaatatgttagggctaaataagcagctgatttcagctctccagcacaagcaacggtgtccagtactcgaggatcagctcgttgaccttgtggtatacgccatggaacgaagtgaaactgaggagaagtttgacgatggggggacatcccaactactctggcagcacctgagcagtcagctgattttttttgtgctgttccagttcgcaagcttcccgcacatggtgttaagcctgcatcaaaaactcgccgggcggggactgattaaggggagggaccacctgatgtgggtactgctgcagtttataagcggatccatccaaaagaatgcactggccgacttcctgccggtcatgaagctcttcgacttgttgtatcccgagaaagaatatatccctgttcccgacattaacaagccgcagtccacacatgcattcgccatgacttgcatctggatccacctgaatagaaaggcacagaacgacaattctaagctccagatccctataccccacagtctccgcctgcaccacgaattcctacaacaatctctccggaacaagtccctgcagatgaatgattacaaaatcgcgttgctatgtaacgcctactctaccaatagcgagtgttttactcttcctatgggagctttagtggaaacaatttacggtaatggtattatgaggattcccctgcccgggaccaactgcatggctagcggcagtataacgcccttgccgatgaacctactagattccctaaccgttcacgctaagatgtccctgatccatagcattgctaccagggtcatcaaactggcccatgcaaaatcctctgtggcacttgctccggccctggtagaaacttattctaggctgttggtctacatggaaatcgaatcacttggcatcaaagggtttataagccagcttcttcccactgtcttcaaatctcacgcatggggaatcttacacacactcctggagatgttctcgtacagaatgcaccacattcagccacactatcgcgtccagctcctgagccacctgcacacactggctgcagtggcccagacaaaccagaaccagctgcacctgtgcgtcgagagtactgctctccggctaatcactgctctgggatccagcgaagttcagccccagtttacacggtttctgtctgatcctaagaccgtcttgtcagctgaaagtgaggagctgaaccgcgctctgatcttaacgctggctcgtgcaacacacgtgaccgacttcttcactgggagcgactcaatccagggcacctggtgtaaagacatactgcagaccatcatgtctttcaccccacacaactgggctagccacactttgtcatgctttcccgggcctctgcaggccttcttcaagcagaataacgtgccccaggagtctcgctttaaccttaaaaagaacgtcgaagaggagtatcgcaagtggaagtcaatgagtaatgagaacgacattattacacactttagcatgcagggtagccccccgctttttttgtgtctcctgtggaagatgctcctagagacagaccacattaatcaaattggatatagggtcctggaaagaatcggagctagggccctggtcgcccacgttcgcacattcgctgacttcctggtctatgagttctccactagtgcagggggccagcaattaaataagtgtatcgagattctcaatgacatggtttggaagtataacattgtgactctggatcggttgattctctgcctcgctatgagatcccacgagggcaacgaggctcaagtttgctactttattatacagctactgctgctgaagccgaatgacttcagaaatcgcgtatctgatttcgtcaaagaaaacagtcctgagcactggctgcagaacgattggcacactaaacatatgaactatcataaaaaatatcccgaaaaactgtatttcgaaggcttagccgaacaggtggatccaccagtacagattcagagtccatatttgccaatctattttggcaacgtatgtctgaggttcctcccagtcttcgatatcgtgatccacagatttcttgagctgcttccagtgagtaagagccttgaaacccttcttgatcatctggggggtctctataagttccatgataggcctgttacatacctctataatacgctgcattattacgagatgcaccttcgcgatcgtgcttttctcaaacgcaagctcgtccacgctattatcggctcgttaaaggacaatagaccccaaggctggtgcctctccgatacttacctgaagtgcgctatgaatgctcgggaggagaacccatgggtgccagatgatacatactactgcagattaatagggcggctggttgacactatggctggcaagtcacccggccctttccctaattgcgactggcgctttaatgagtttcccaacccagccgcccacgccctccatgtgacttgtgtcgagctcatggccctagctgtgagtggcaaagaagtcggaaatgctctccttaacgtggtattgaaaagccagcctttggtcccccgggaaaatattaccgcctggatgaacgccataggcttaattattacggcactgcctgaaccgtactggatcgtgttgcacgaccgcattgtatcagtgatctctagtccgagtctcactagtgagaccgagtgggtgggctatccttttagactctttgacttcacagcgtgccaccagtcatattctgagatgagctgcagctatacactagcactggctcatgccgtgtggcaccactccagcataggccagctctctctaatccctaagtttttgactgaggtgttactgccaattgttaaaacagagttccagctcctatacgtgtatcatctcgtcggaccattcctgcaacgctttcagcaggaacgaacgcgctgtatgatcgagatcggggtggctttctatgatatgttgctgaacgtggatcagtgttctacccatctgaattacatggatcccatctgtgactttctgtaccatatgaaatatatgttcaccggtgactccgttaaagagcaagtcgagaaaatcatctgtaacctaaaacccgcactgaagctcagactccgcttcatcacccatattagtaaaatggaaccggccgctgtacctccccaggcgatgaactctggctcccccgcccctcagtcaaatcaggtccccgtctcactgcccgtaacacagtag

SEQ ID NO: 194436 - DNA, 114 bp, Artificial Sequence
  Description of Artificial Sequence: Synthetic coding sequence
atggagacccagctgcagagcatcttcgaggaggtggtgaagaccgaggtgatcgaggaggcatttcccggcatgtttatggacacgccagaagacgagaagagttccaagtag

SEQ ID NO: 194437 - DNA, 132 bp, Artificial Sequence
  Description of Artificial Sequence: Synthetic coding sequence
atggagacccagctgcagagcatcttcgaggaggtggtgaagaccgaagtcatagaagaggctttcccgggaatgtttatggacaccccggaggatgaaaagacaaaactttttatggagatggaactgtag

SEQ ID NO: 194438 - DNA, 1428 bp, Artificial Sequence
  Description of Artificial Sequence: Synthetic coding sequence
atggagacccagctgcagagcatcttcgaggaggtggtgaagaccgaggtgattgaagaagcattcccaggaatgttcatggatacaccagaagatgagaagacaaagctgatttcatgtcttggcgctttcagacagttttggggcggcctctcacaggagagccacgagcaatgcattcagtggattgtgaagttcatacacgggcaacattcccccaagaggattagttttctgtacgactgcctcgccatggctgtggagactggccttctccccccccgcctggtttgtgaatccctcataaatagcgacacactggagtgggagcgcacacagctctgggccctgacgttcaaactggttcgaaaaatcataggtggagtcgactacaagggggtgcgggacctattgaaagtgatcctcgaaaaaatcctcaccatccccaacacggtatcttcagccgtcgtgcagcaactcctggccgcccgggaagttattgcttacatactggagagaaacgcatgcctgttaccagcctactttgccgtgaccgaaattagaaagctgtaccctgaggggaagctgccccactggctgctagggaatctagtctccgattttgtggacaccttcaggcctacggcaaggataaactccatttgcggacggtgttctctgctcccagtcgttaacaactccggtgcaatctgtaattcctggaaactcgaccccgctacgctgcgttttcctctgaaggggttgctcccttacgataaggatctcttcgaaccccaaacagctctgcttcggtacgtgctggagcagccgtactcaagggacatggtttgtaacatgcttggcctcaataagcaacacaagcagcgatgtcccgtcctggaggaccagcttgttgatctggttgtttacgccatggagaggtcagagacagaagaaaagtttgacgatggcggcacttcccagttactatggcagcacttgtcttctcagttgatattttttgtgctttttcaatttgctagttttccacacatggtattatccctacaccaaaagctcgccgggcgcggactgatcaaaggacgcgaccatctcatgtgggtgcttctgcagtttattagtggtagcatccaaaagaatgcacttgcagactttctgccggtgatgaagcttttcgatttgctctacccggaaaaagaatatatccccgttccggacatcaacaaacctcagagtacacacgcttttgccatgacgtgcatctggattcaccttaaccgcaaggctcagaatgataattcaaagctgcagatccccattccgcatagccttagactccaccacgagtctgcttttgccaactgtttccagatcacctgtatgggggatttaactcatactccttag

SEQ ID NO: 194439 - DNA, 429 bp, Artificial Sequence
  Description of Artificial Sequence: Synthetic coding sequence
atgcaccacatccagccccactaccgggtgcagctgctgagccacctgcatacactggccgctgtggcacagacaaatcagaatcagctccacctgtgcgtagagtcaaccgccttgcggctcattaccgccctggggagcagcgaggtgcagccacaattcactcggttcttgagtgacccaaagactgtcttgtccgctgagagcgaagagctgaacagagccttaatactgactttggcccgtgccacccatgtaacggacttcttcacggggtctgattccattcaaggaacctggtgcaaagacattcttcagacaatcatgtcctttacgccacataattgggcctcccacacactctcttgcttccccggacctctgcagacattattaattttaggcgagcttgccctccggaagacatag

SEQ ID NO: 194440 - DNA, 2661 bp, Artificial Sequence
  Description of Artificial Sequence: Synthetic coding sequence
atggagacccagctgcagagcatcttcgaggaggtggtgaagaccgaagtgattgaggaagcatttcctggcatgttcatggatacccccgaggatgaaaaaaccaagcttatatcttgcctgggggccttcagacagttttggggaggtctgtcacaagagtctcatgagcagtgtatccagtggatcgtgaaattcattcacggccagcattcccctaaaaggatttccttcttgtacgattgtctggccatggcggtcgagaccgggttgttgccaccccggcttgtgtgtgagtcactcatcaactccgatacgcttgagtgggaacgcacccagctctgggcgttaacatttaaactggtccggaaaattattggcggcgtggattataaaggtgttagagacctgttaaaagtgatcttagaaaagatcttgaccataccaaatacagtaagttctgctgtggtgcagcagttgctcgcggcaagggaagtcatcgcctacattttagagcgaaatgcttgtttgcttcctgcctactttgcggtgaccgagataagaaagttgtaccctgagggtaagctccctcactggctattgggcaacctggttagtgattttgtggacacctttagaccaactgctcggatcaacagcatctgtgggcgctgctcattgttacctgtggtgaataactcaggtgccatctgtaatagctggaagttagacccagcaaccctgagattcccgttaaaaggtctgctgccatatgacaaagacttgtttgaaccacaaaccgcattactaaggtacgtccttgagcaaccctactctagagatatggtctgcaacatgctgggtctcaataagcaggtactgaaaatttttaagcacaagcagcggtgtccagtgctggaggaccaattggtagacctagtcgtgtacgccatggaaagatccgaaactgaagaaaagttcgatgacggtggaacatcccagctattatggcaacacctttcttcccaattaatcttttttgtgctcttccaatttgccagctttccccacatggtactgagcctgcaccaaaagctggccggcagagggctgattaaggggcgcgatcacctcatgtgggtgctgctccaatttatcagcggctcaattcaaaaaaacgctcttgccgactttctgcccgtgatgaagctgtttgatctcctgtatcctgaaaaggaatacattcccgtgcctgacattaacaaaccgcaatcaacgcacgcctttgcgatgacttgtatttggattcatcttaataggaaggcgcaaaacgataacagcaagctccaaattcccatcccccattctctcagactgcaccacgagttcctgcaacaatctctgagaaataaatctcttcaaatgaacgattacaaaattgccctgctatgcaacgcatactctacgaatagtgaatgtttcacccttcctatgggagctcttgtagaaactatttacggcaatggcatcatgcgtatccccctgcccggtaccaactgcatggcttctggctctatcaccccgttgccaatgaatctgcttgattctctgaccgtacacgcaaaaatgtccctgatccactctatcgccacaagagttattaagctcgcacacgctaaatctagcgtcgccctggctcctgcgctcgtcgaaacatattcaaggttgctagtgtatatggagatcgagtccctggggattaagggctttattagccagctgctgcccaccgtgttcaaaagtcacgcctggggcattttgcacaccctcctggagatgttttcatataggatgcatcatatccagccacactatagggtgcaactcctcagtcacctgcacacccttgctgcagtggcacagaccaaccagaaccagctacacctctgtgttgagtcaaccgcccttaggctcatcactgcactgggttcttctgaggtgcagcctcagttcactcggtttcttagtgatccaaaaactgttctgtccgcagagtcagaggagctgaatagagcactgatcttgacactggctagggctactcatgtgaccgatttcttcacaggtagcgactccattcagggaacctggtgtaaagatattttgcagaccattatgtcatttacacctcacaattgggcctcccacactcttagttgttttcccgggcctctgcaggccttcttcaaacagaataatgtgcctcaagaaagtcggttcaatttgaaaaagaacgtcgaggaggaatatcgaaaatggaagtccatgtcaaacgagaatgatatcatcacccactttagtatgcagggctctcccccactttttttgtgtttactctggaagatgctgctcgagaccgaccatatcaatcaaatagggtacagggtgctcgagcgtatcggagctcgagctcttgtcgcacacgttagaaccttcgcagacttccttgtatacgaattctctaccagcgccggtggacagcagttgaacaagtgtatagagatactgaacgacatggtgtggaaatacaacatcgtcacgttggacaggctgattctgtgcctggtacggatcaacacattcctgagtcttttctcatag

SEQ ID NO: 194441 - DNA, 3030 bp, Artificial Sequence
  Description of Artificial Sequence: Synthetic coding sequence
atggagcggagcgagaccgaggagaagttcgacgacggcggcaccagccagctgctctggcaacacctctcatcccagttgatcttttttgtcttgttccagtttgcatcttttccacacatggtcctctccctgcatcagaaatatatccctgtgccagacattaacaaaccacagagcacacacgctttcgccatgacctgtatctggatacacttgaacagaaaagctcagaatgacaatagtaaactgcagatacccatcccccactccctgcggctgcatcacgagtttctccagcagtctttgaggaataagtctttgcagatgaatgactataaaatcgctctgctgtgtaatgcctacagcaccaactccgaatgttttaccttgcctatgggcgccctcgtggaaactatctatggaaacgggattatgcgcatcccactgccaggaacaaattgcatggcgagtggtagtatcacgcctctgcctatgaacctcctggattcactgacggtgcacgctaagatgagtctgatccacagcatcgctacccgggtgatcaagctcgctcatgccaaaagctcggtggcattggctcctgcactagtggaaacctatagccggctcttagtgtacatggaaatcgagtcactgggtatcaagggctttatctctcagcttctccccactgtgttcaagtctcacgcgtggggaatcctgcacactctcctcgaaatgttcagctatcgcatgcaccacatccagccccattacagggtccagcttctatcacacctgcatacccttgcagctgttgcccaaacgaatcaaaaccagctccacctttgtgtggaaagcaccgcactgcgcctgatcaccgccttaggatctagcgaagtgcaaccccagtttactagatttctttctgatccaaagaccgtactcagtgctgaaagcgaggaactcaaccgcgctctgatcttgacccttgccagggccacccatgtgacagatttcttcacagggtcagacagtatacaggggacctggtgtaaagacattctgcagacgatcatgagtttcactccccacaattgggcctctcacacactgtcttgtttcccaggccccctccaggctttcttcaaacagaacaacgttcctcaagaatctaggttcaatcttaaaaagaatgtggaggaggagtatcgcaaatggaaaagcatgagcaatgaaaatgatatcattacccacttcagcatgcagggtagtcctcccttgtttttgtgcctcctgtggaaaatgttgctcgagaccgatcatatcaaccagattggatatagggtgctcgaacgcatcggagcccgggctcttgtggcacacgtgcgcacctttgccgacttcctggtctatgaattttctacgtccgccggcgggcagcaactcaataagtgtattgaaatcctgaacgacatggtatggaaatataacatagtcaccttggaccggctcatcctgtgtctggcaatgcggtcccatgaaggcaacgaagcacaggtctgttatttcattattcagttgcttctgcttaagccaaatgattttaggaatcgggtaagtgactttgtgaaggagaatagccctgagcactggctacagaatgactggcacaccaaacacatgaattatcataaaaaatacccagagaagttgtactttgaagggctggccgagcaggtcgatccaccagtgcagattcagagcccatatctgccaatctactttggcaatgtgtgtctgaggttcctgcccgtgttcgatatcgtcattcacagatttctggaattgctccctgtcagcaagtccctcgagactctattggaccatctgggtgggctctataagttccatgataggcctgtgacctatctgtacaatactctccattactacgaaatgcatcttcgggatcgggcctttctgaagaggaaattggtgcatgccatcattggttccctcaaagataatagaccccagggatggtgcctgagcgacacctacttgaaatgtgccatgaatgcacgcgaggagaatccctgggtgcctgatgacacttactactgtcgtctgatcggaagattggtcgacacgatggccggcaaaagccctggaccctttcctaattgtgattggcggttcaacgagtttccgaatcccgcagcacacgccctgcacgtgacctgcgtcgagctaatggcattggccgtgagcggaaaggaagtgggtaatgccctacttaacgtcgttctgaaatctcagccactggtgcctagggaaaatattaccgcctggatgaacgcaatagggctgatcattactgcattacccgaaccttactggatagtgttacacgacagaatcgtttcagttattagtagtccctccctgacttctgagaccgagtgggttgggtacccttttcgcctgttcgatttcacggcctgccaccaaagctatagcgagatgagctgttcatacaccttggccctggcacacgctgtctggcaccacagttccatcgggcagttgagcctgattcccaaattcctgacagaagtgctactacccattgtaaagacagagttccagcttctgtatgtatatcatttagtggggccttttctgcagaggttccaacaagagcgcacaagatgtatgatcgagattggtgtggctttttacgacatgctgctgaacgtcgaccagtgcagcacacatctaaattatatggaccccatttgcgacttcctttatcacatgaagtacatgttcacaggggattccgtgaaggaacaggtggagaaaattatctgtaatctgaaacccgcactcaagctgcgacttcgctttatcacgcatatcagcaaaatggaacctgccgccgtaccccctcaagccatgaactctggctcccctgccccccagagcaatcaggtccccgtctctttaccagtgactcaatag

SEQ ID NO: 194442 - DNA, 2970 bp, Artificial Sequence
  Description of Artificial Sequence: Synthetic coding sequence
atgaaggtggtgaacctgaagcaggccatcctgcaggcctggaaggagcgctggagcgactatcagtgggcgatcaacatgaagaagttttttcctaagggcgcgacgtgggacattctcaacctggctgatgctcttttggaacaggcaatgattggcccttccccaaaccccctgatcctgagttatctcaaatatgcaatttccagtcagatggtctcttattcttctgtacttacagctatcagcaaatttgacgacttttcacgagatctgtgtgtccaggcgttactagacattatggatatgttctgtgacaggttgtcatgtcacggaaaagctgaggagtgtatcggtttatgccgcgccctgttatccgcactgcactggctcttacggtgcaccgcggcctcggctgagcgccttagagaaggtctagaagccggtacaccggctgccggcgagaaacaacttgcaatgtgcctccagagactggagaagacactatcaagtacaaaaaatagagcgctgttgcatatcgcaaaactggaagaggccagtagctggacagccattgagcacagcctgttgaagctcggggagatcctggcaaacttatctaatcctcagctgaggtctcaggctgaacagtgcggtactttaatacggtccatccctacaatgctatccgttcatgcggaacaaatgcacaagaccggttttcctaccgttcacgctgtgatccttcttgagggcacaatgaaccttaccggggagactcaatccctggttgaacagctgacaatggtgaagcggatgcagcacatccccactccactgtttgtgctggagatctggaaggcctgcttcgtggggcttatcgagtcccccgaaggcactgaagagcttaaatggaccgcatttacattccttaaaatcccccaagtgctggttaaactgaagaaatacagccacggagacaaagacttcacagaagacgtaaattgcgcctttgaattcctgttaaagctgacgcctctgctggataaagcagaccaacgttgcaattgcgactgcacaaatttcctcctgcaggagtgcgggaagcagggactactcagtgaagcttctgttaataatctcatggccaagcgaaaggccgatcgtgagcatgccccccagcagaagtccggcgaaaacgccaacatccaaccaaatatccagcttattttgagagcagagcctacagtgaccaacatcctcaagactatggatgctgatcattcaaaatctcctgagggcctactcggcgtgctgggtcatatgctgtcagggaagtctctggatttactgctggccgcagccgccgctacaggcaaacttaaatcttttgctcgcaaattcataaacctcaatgaattcaccacttacggctctgaagaatcaaccaagcccgcctcggtcagggcgctcctgtttgacatcagcttcctgatgctatgccacgttgcacaaacttatgggtccgaggtcatcttgtcagaatccagaacgggggctgaggttccctttttcgagacttggatgcaaacttgtatgcccgaagaagggaagatcctcaatcctgatcatccttgttttagaccagacagtacgaaagttgagagtctcgtggctctgctgaacaactcgagcgaaatgaaacttgtgcagatgaaatggcacgaagcttgcctgtctatctccgccgcgattcttgagattcttaacgcatgggagaacggcgtcttggcctttgagagtatccagaaaataactgacaacataaagggaaaagtgtgctccctggcagtatgcgctgtcgcttggcttgttgctcacgtgaggatgctcgggctggacgagagagaaaaatccctgcagatgatccgccagctcgctggcccgctgttcagtgaaaacaccctccagttctacaacgaacgtgtcgtgataatgaactcaatccttgagcgtatgtgtgctgacgtgcttcaacaaactgctacacaaattaagttcccctcaaccggggttgataccatgccatactggaatttgctacctccaaaacgacccataaaagaggttctgaccgacatctttgctaaggttttggaaaagggctgggtcgattcaaggtctatccacatcttcgacacccttcttcatatggggggcgtctattggttctgcaacaacctgattaaggaattattaaaggaaactcgcaaggaacacacgctaagggctgtcgagctcttgtacagcatcttctgtctggatatgcagcaggtgaccctcgtgctcctggggcatattcttcccggacttttgacggatagctccaagtggcattcattgatggatcctcccggaactgccttggcgaagttagctgtgtggtgcgccctgagctcatactcttcacataaaggccaggctagtacccgacaaaaaaagcgtcaccgcgaagacatcgaagattatatctctctttttcctctggacgacgtgcaacccagcaagctcatgcgcctccttagtagcaacgaggatgacgctaacatcctttcgtcccctacagatcgttctatgtcttctagtctgagcgctagtcaactgcacaccgtgaatatgcgcgatccattaaatcgcgtcctcgccaatctctttcttctgattagtagcattctcgggtcaaggacagctggccctcatacacagtttgtgcagtggttcatggaagaatgtgtcgactgtctggaacagggaggaaggggctctgtgttgcagttcatgcctttcaccactgtgtctgagctcgtgaaggtatcagcaatgagctccccgaaggtggttcttgcaattaccgacttatcactgccactcggaaggcaggtcgctgcgaaggcaatcgcagcgctatag

SEQ ID NO: 194443 - DNA, 2970 bp, Artificial Sequence
  Description of Artificial Sequence: Synthetic coding sequence
atgaaggtggtgaacctgaagcaggccatcctgcaggcctggaaggaacgctggtcggactaccagtgggccatcaatatgaaaaagttttttccgaagggtgcaacttgggatatcctaaacctcgcagacgcgctcttggagcaggctatgatcggcccatcccccaaccctttaattctctcctatttgaaatacgccatctcaagtcaaatggtctcatattcatccgttctcaccgcaatctcaaaatttgacgacttctctcgtgacttgtgtgttcaagccctcctggacattatggacatgttctgcgatcgactttcctgtcacgggaaagccgaagaatgtatcggactgtgcagggccctgctctcggcactgcattggctgttaagatgtacggccgcatccgcagagcgcctgagggaaggattggaggcagggacccccgcggcgggagaaaaacagcttgcgatgtgtttacagcgcctagagaagaccctgtcaagcactaagaacagagcactgctgcacattgccaagctcgaagaagcttctagctggacagctatcgagcactccttgctcaaattgggcgagatactcgccaatctctccaacccccagttacggtcccaagcagagcagtgtggaaccctgatacggagtattccaacaatgctgagtgtccatgccgagcaaatgcacaaaacagggttcccgaccgtgcacgctgtgatcctgcttgagggtactatgaacttaacaggagagactcagagcttggtggagcaactcacgatggtgaagaggatgcaacacatccctacacctcttttcgtgctggaaatatggaaggcctgcttcgtaggcctgatagagtcacccgaggggactgaggaactcaagtggaccgcattcaccttcttgaaaatcccacaagtactagtgaagttaaaaaaatattcacacggggataaagactttacagaggatgtgaactgcgcttttgagtttttgctgaaattgacacctctgctcgacaaagccgaccagcgttgcaattgcgattgcaccaatttccttctgcaggaatgtgggaagcagggactcctatcagaagccagtgttaataacttgatggccaaacgcaaagccgatcgtgagcacgcaccccagcagaaatctggagagaacgccaatatacagccgaacatccagctcattctaagggcagaaccaacagtgactaacatcctgaaaaccatggacgcggaccactccaagagtcccgagggcctattgggcgttctgggtcacatgttgtctggcaagtccttggacctcctgctggctgccgctgcggctactggtaaacttaaatcattcgccagaaaatttattaacctgaatgagttcacaacctacggtagcgaggagtcaactaaacctgcaagcgttcgagctctgctttttgatatttcatttctgatgctgtgccacgtggcccagacctatggatcggaggtgattctgagcgaaagccggacaggcgccgaggtgccgttctttgaaacctggatgcagacatgtatgcccgaggagggaaagattctgaaccccgaccatccatgctttaggccagactcaaccaaggtggagagtctggttgccctgcttaataattccagcgaaatgaagttggtccagatgaagtggcacgaagcctgtctgagcatcagcgccgctatactagaaattctcaatgcttgggagaacggcgtactggcatttgagtctatccaaaaaattacagacaatatcaagggcaaggtgtgttcactggcagtctgcgccgtggcctggctagtcgctcatgtcagaatgctgggattagatgaacgagaaaagagtttgcagatgatccgccagttggcgggaccacttttcagcgagaacaccctgcagttttacaatgagcgcgtagtgatcatgaacagtattctcgaacggatgtgcgccgacgtgctgcagcaaacagccacacagatcaagttcccctcaaccggcgtcgacaccatgccatattggaacctacttccacccaaacggcccataaaagaggttttgactgatatcttcgccaaagtgctggagaaagggtgggtggactcccggagcattcacatcttcgacactctgctgcacatgggcggggtctattggttctgcaacaatctgatcaaagagctgctcaaggaaactagaaaagagcatacactcagagccgtggaactactgtatagcatcttctgcctggacatgcagcaagtcacactggtgctgcttggacatatcctgcccggactccttacggactcctccaagtggcattccctcatggaccctccaggaactgctctggcaaagctggcagtgtggtgtgctttgtcatcatattcgtcgcataaggggcaagcctctacccggcagaaaaagaggcatagggaggatatcgaggactacatttctctgtttccactggatgatgtccagccatcaaagttaatgcgcttgctatcgagcaatgaggatgacgccaatatactttcttcccccacggacagaagcatgagttcaagcctatccgctagccaattgcatacagtgaacatgcgagacccactcaacagagtgctggctaacctgtttctgctaatttcctcaattctggggtcgaggacagccgggcctcacacccagtttgttcagtggtttatggaggagtgtgtggactgtctcgagcagggcggcagagggtcagtgctgcagtttatgcccttcacgacggtgtctgagcttgtcaaggtgagcgccatgagttcacctaaagtggtgctggccattactgacctttctctgccacttggacgacaagtcgccgccaaagcaatcgctgccctgtag

SEQ ID NO: 194444 - DNA, 2931 bp, Artificial Sequence
  Description of Artificial Sequence: Synthetic coding sequence
atgaaggtggtgaacctgaagcaggccatcctgcaggcctggaaggagagatggagtgactaccagtgggctattaacatgaaaaaattctttcccaaaggcgccacttgggacatcctgaacctcgctgacgccctacttgagcaagccatgatcggcccttcaccaaatcctctcatactaagctatttaaagtatgccatttcctctcagttcgacgatttcagccgggatctgtgcgtacaagccctgcttgacatcatggacatgttctgcgacaggctcagttgccatggaaaagcggaggagtgcatcggattgtgcagggctctgctcagcgccctacactggctcttgcgctgcaccgccgcatccgccgaaagactccgagagggactggaggctggcacccccgccgccggagagaagcagctggccatgtgtctgcagagattggaaaagactctgagttcgaccaaaaaccgtgctcttctccacatcgcaaaactggaagaggcgtcttcctggactgctattgagcatagcctcctgaaacttggggagatacttgctaatctgtccaatccgcagctccgttcacaggccgagcagtgtggaacattaattaggtcaatccccactatgctcagcgtgcacgcggaacagatgcacaaaacaggattccctaccgtccatgctgtgatcctgctggagggaacaatgaacctgacaggcgagacccaaagcttagttgagcagctgaccatggttaaacgcatgcaacatattcctacccccttattcgtactggaaatctggaaggcctgctttgtggggctcatcgagagtcccgagggaaccgaggagttgaagtggactgcctttacgttcctgaaaattcctcaggtcttggttaaactcaagaagtattctcatggggataaagattttactgaagatgtaaattgtgcattcgaatttctactgaagctgactccactcctggataaggctgatcagagatgcaattgcgactgtacaaatttcctattgcaagaatgtggcaagcaaggcctgttgtctgaggcatcagtaaacaatcttatggccaagaggaaggccgatagagaacacgccccccagcagaagtctggagaaaacgccaatatccagcccaacattcagctcatactgagagccgaacccacagtgacgaacatcctgaagacgatggacgccgatcacagtaagtctcccgaaggacttctgggggtgctcggacacatgcttagtggcaaatccttagatctgttactcgccgcagctgctgcaaccggcaaactaaagagtttcgccagaaagtttatcaatctgaatgaatttacgacatacggaagtgaggaatcaaccaagcccgcaagtgtccgcgccctcctctttgatatcagcttcctaatgctgtgccatgttgcccagacttatggaagtgaagtcatcctgagcgagagcaggacgggcgcagaggtgcccttcttcgagacttggatgcaaacatgtatgcccgaagaagggaagattttgaatccagaccatccgtgcttccgaccagatagcaccaaagtggagtccctggtggctcttcttaacaattcgagcgagatgaagctggtgcagatgaaatggcatgaggcctgcctctcaattagcgcagccattctggaaatactcaatgcttgggaaaatggcgtgctggcctttgagtcaattcaaaagattactgataacatcaaagggaaggtttgctcactggccgtatgcgctgtagcctggctggtggcccacgttagaatgcttggtctggacgaaagagagaagtcccttcagatgataaggcagcttgcaggtcccttgttctccgaaaatacactccagttctacaatgaaagagtggttattatgaatagcatccttgagaggatgtgcgcggacgttctgcaacagacagccacacagatcaaatttccctccaccggggtcgacaccatgccttattggaatctgctcccccctaaaagaccgatcaaagaggtgctcaccgatatctttgccaaggttctagagaagggctgggtggatagccgcagcatccacatctttgataccctattacatatggggggagtctactggttctgtaataacctcatcaaggagctcctcaaggaaaccagaaaggaacacactcttagagctgtggaacttctctactctattttttgcctcgacatgcagcaggtgactctcgtgctgctgggccatatcttacccggcctgctgactgactctagtaagtggcatagtctcatggacccgccaggaactgcgttagccaagctagccgtttggtgcgcgctgtctagctacagctctcacaagggacaggcttcaacaagacagaagaaacggcacagggaagatatagaagattatatctcactttttccccttgacgatgtgcagcccagcaagctgatgaggttactctctagcaatgaagatgacgccaatattctctcttcccccacggaccgatccatgtcctcatctttgtccgcaagccagctgcatactgttaacatgagggatcctcttaaccgggtattagccaatctgttcctgctaatttcttctattctcggctctcgtaccgccgggccgcacacccagtttgtgcagtggtttatggaagagtgtgtagactgtctcgaacagggtggccgcggatctgtcctgcagttcatgccgtttaccacagttagcgagctcgttaaagtgtcagccatgtcatccccaaaggtagtcctagctattacagatctctctcttcctctcggaagacaggtcgcggcgaaagccattgcagcgctttag

SEQ ID NO: 194445 - DNA, 2970 bp, Artificial Sequence
  Description of Artificial Sequence: Synthetic coding sequence
atgaaggtggtgaacctgaagcaggccatcctgcaggcctggaaggaacgatggagtgactaccaatgggctattaacatgaagaaattctttcccaagggcgcgacctgggacattttgaatctggccgatgcccttctcgaacaggccatgataggaccttcgcctaacccgttgatactttcctacttgaagtacgctatctcatcacagatggtaagttattcttcggtgctgacagccatctctaagtttgatgatttctctcgagacctctgcgtgcaggctctgctcgacattatggatatgttttgcgatcgtctgagttgccatggtaaggccgaagagtgcattggtctttgccgcgccctcttgtctgccttgcactggttgcttagatgtacggcagcttccgctgagcggcttagagagggccttgaggctggaacgccagccgccggcgagaagcagctggctatgtgtctgcagcggctggaaaagaccttgagttccacgaagaatagagcccttctccacattgcaaaactggaggaagcgagtagctggactgcaatcgagcattccctgttaaagctcggcgaaattctcgcgaatctgtccaaccctcagcttagatcccaggccgagcaatgcggcaccttaatccgcagcatccccacgatgctgagcgtacatgccgaacaaatgcacaagacaggctttccaaccgtccatgctgttatcttgcttgagggcacaatgaacctgacaggcgagacccaaagcttggtggagcagctgactatggtgaaaaggatgcaacacattcctacccctctcttcgtgcttgagatctggaaagcatgcttcgtgggtcttattgagtcaccggaaggtacggaagaacttaagtggacagccttcacttttcttaagatcccacaggtgctggtgaagctgaaaaagtacagtcatggggataaagattttaccgaggacgtgaattgcgctttcgaattcttactaaagcttacgcctctcctggacaaggcggatcagaggtgcaattgtgattgtactaatttcctgctgcaggagtgcggaaagcaagggctccttagtgaggcgtccgtgaacaatttaatggcaaaaagaaaggcagatcgggagcatgctcctcagcaaaaatcaggagagaatgcaaatattcaacctaacatccagctgattcttcgcgccgagccaacagtgacaaatattctgaaaacgatggatgcagatcactcaaaaagcccggagggtcttctgggagtcttgggccacatgctgagcggaaagagtttggacctcctgttagccgctgccgctgccactggcaagctgaaaagcttcgcccggaaatttatcaacctaaacgaattcaccacatacggtagtgaggaaagtacaaaacccgcgagtgtacgcgccctgctgtttgacatctcttttttgatgctttgccacgtagctcagacatatggatcagaggtgatcctttccgagtcccggacgggcgccgaggtgccatttttcgagacttggatgcagacctgtatgccagaggaaggtaaaatattgaatcccgaccacccctgcttccggcctgattcgaccaaggtggagtcactggtggccctgcttaacaactcatctgaaatgaaactggtgcagatgaagtggcacgaggcttgtctctccataagtgcagctatcctggaaatcctcaatgcatgggagaacggcgttctggcatttgaaagcatacagaaaataaccgataatatcaagggcaaggtgtgtagtctggccgtttgcgcggtagcatggcttgtggctcacgtacgtatgctgggactggacgaaagggagaaaagtttacagatgattaggcagctggctggcccactttttagtgaaaacacactccagttttacaatgagcgtgtcgtcatcatgaactctattcttgaacggatgtgcgctgatgtgttgcaacagacggcaactcagataaagttcccgtccacaggcgtggacacgatgccgtactggaacctgcttcccccgaaacggcctattaaagaggtgttaaccgacatctttgccaaagtgctggagaaggggtgggttgactcccggagcatccacatctttgacacacttcttcatatggggggcgtgtattggttttgtaataacttgatcaaggaactactgaaggaaacgaggaaggagcatactctgagagccgttgagctgctgtatagcatcttttgtctggatatgcagcaagtaacgctggtactcctgggacacatactgcctggattattgactgatagctctaaatggcattctcttatggacccaccggggacagcactagcgaaactagccgtatggtgtgccctctcaagttactcttctcacaagggacaagcctctactagacagaagaaacgccacagggaggatattgaagactacatttcgctgtttcccttggacgatgtgcagcctagcaagcttatgaggctcctgtccagtaacgaggacgacgcgaatattctgagttcgcctacggatagaagtatgtcttcttcactcagcgcatcacagctccacaccgtaaatatgagagaccctctgaatcgcgtactcgccaacctgttcctgctcatttcatctatcctgggttccagaactgcagggccccatactcaatttgtgcaatggtttatggaggagtgcgtggattgcttggaacaaggcggacgcggctccgttctccagtttatgccttttactacggtgtcggagctcgtcaaggtctcggctatgtcttcacccaaggttgtgctagccataaccgacctgtcgctgccccttggcagacaggtagccgcaaaggcaattgccgccctatag

SEQ ID NO: 194446 - DNA, 864 bp, Artificial Sequence
  Description of Artificial Sequence: Synthetic coding sequence
tgaaacctgatcaaggagctgctgaaggagacccggaaggagcacacgctgcgcgcagtcgaacttctttactcgatcttctgtctggacatgcagcaggtcactctagtgctccttggtcatatcttgcctgggcttctcacagatagctccaagtggcactcgttaatggatcctccaggcacagcactggccaaattggctgtctggtgcgccctctcttcctacagctcacataagggacaggcttcaaccaggcaaaagaaacggcatcgagaggacatcgaagattacatcagcttgttcccattggacgatgtgcaaccctccaagctgatgaggctgctctcttcaaacgaagatgatgcaaatatcctgagttctccacgaagtagcctcggttccccatgcacttcatatctccgctgggtcaaggtgggactgggtcaccctagaggtgcaccgttacttcattctgccgggtgttttccagctcttcaccttctgcgccctacagcggaccggagtatgagctccagcctctctgcttctcagcttcacacggttaatatgcgtgaccccttgaatcgagtcctggctaaccttttcttgctgattagttccattctaggatctagaacagccggtccacatacgcagtttgtgcaatggtttatggaggaatgcgtcgattgtttggagcaaggtggccgaggctcagttcttcaatttatgccgttcacaaccgtctcagagctggtgaaggttagcgccatgtctagccccaaagttgttctagcaattacagacctcagcttaccactgggtaggcaggtggcggcaaaggccatagcagctctgtag

SEQ ID NO: 194447 - DNA, 906 bp, Artificial Sequence
  Description of Artificial Sequence: Synthetic coding sequence
atgaaggtggtgaacctgaagcaggccatcctgcaggcctggaaggaacggtggagcgactatcagtgggcaataaatatgaaaaagttttttcccaaaggcgcgacttgggacatccttaacttagctgacgcactgctggaacaggcaatgatcgggccttctccaaatcctctgatacttagctaccttaaatatgccattagtagccagatggttagttacagcagtgtgcttaccgccatatctaaattcgatgacttttcacgcgatttatgcgttcaggcactccttgacatcatggacatgttctgcgacagactgagttgtcacgggaaagctgaagaatgtatcggcctgtgcagagccctgcttagtgccctgcactggctgctgcgttgcactgccgccagcgctgaaagactgcgggaagggcttgaggccggtaccccagcagcaggcgagaagcagttggccatgtgtctgcaacggcttgagaagacccttagcagcacgaagaacagagcgctgctccatattgccaagttagaggaggcaagcctacatacatctcagggacttggccagggcggtacccgcgccaatcagcccactgcctcctggacagccatagaacattcgctcctgaagttgggtgagatcctggcgaatctcagcaacccccaactgcgctcccaggcagagcaatgcggaaccctgatacgaagcatccccaccatgcttagtgtgcacgccgaacagatgcacaaaacagggttcccaaccgtgcatgctgtgattctgctggaagggaccatgaatcttactggggaaacgcagagtttggtagaacagctaactatggtaaagcgcatgcagcacatcccgacccctttgtttgtctag

SEQ ID NO: 194448 - DNA, 2700 bp, Artificial Sequence
  Description of Artificial Sequence: Synthetic coding sequence
atgcccctggtgccccggtggtgccccaccctgctgagcagccagccctctgtgtcatgccatggcaaggctgaggaatgtattgggttatgtagggctctcctaagtgctctccactggctcctgagatgtaccgccgcctctgctgagagactgagggagggtctggaggccggtacaccagccgcgggcgagaagcagctggcaatgtgcttgcagcgtctagaaaaaaccctttccagtactaagaacagggcacttctgcatattgcaaagctggaggaggcctcgagctggacggccattgagcacagtctcttgaaactcggcgaaattctggctaatctctccaacccccagctgcgatcgcaggcagagcagtgcggcactctgattagatcaatcccgacgatgctcagcgttcatgctgaacaaatgcacaagacgggcttccccaccgttcatgccgttatcctgttagagggcacaatgaatttgacaggagagacccagtccctggttgagcagctgactatggttaagaggatgcaacatatccccactccccttttcgttctggaaatctggaaggcctgtttcgtagggctgatcgagagcccagaaggcaccgaggagctcaagtggacagctttcacgttccttaagatcccccaagtcctggtgaaactcaagaagtactcccatggagacaaggattttactgaggatgttaactgcgctttcgaattccttctcaagttgactcctttgctggataaagccgaccagaggtgcaactgtgattgcaccaacttcttactgcaggagtgtggaaaacaaggtttacttagtgaggcttccgttaacaacttgatggccaaacgaaaggcagatagagagcacgctccacagcagaaaagcggcgaaaatgcgaatatccagcccaacattcaactgattcttcgggccgagcctactgtgaccaatatactgaagaccatggacgccgaccactcaaaatccccagaggggctgcttggcgtgctgggacatatgctttccggcaaatcactagacctattactggctgccgccgccgctaccggtaagctgaagtcctttgcccggaagttcatcaaccttaacgagttcacaacgtatggcagcgaagagtctactaagccagcaagtgttcgagccctgttatttgacatctccttcctgatgctgtgtcacgttgcccagacatacggatcagaagtcatactgtccgagtccagaacgggagccgaagtgccgtttttcgagacttggatgcaaacatgcatgccggaggagggtaagatcctgaatcccgaccatccatgtttccggcctgatagcaccaaggtggaatctctggtcgccctgctaaacaattccagtgagatgaaattggtgcagatgaagtggcacgaggcttgtctgagcatctcagccgccatcctggagattctgaacgcctgggagaatggcgttctcgcatttgagtccatccagaaaatcaccgataatatcaagggaaaggtctgtagtctggctgtatgtgcagtcgcctggttagtggcgcatgtgcggatgcttggactcgatgaacgtgagaagtccctgcagatgatcagacagctggctgggccgttattcagcgaaaataccctgcagttttataacgaacgtgttgtcataatgaactccattctggaacgcatgtgtgccgatgtgcttcagcagactgcaacccagattaagttcccttctacaggcgttgacaccatgccgtactggaatttactcccccccaagagaccaatcaaggaagtgctgacagacatatttgccaaagtgctggaaaaaggatgggtggacagcaggagcatccatatcttcgacacgcttttacacatggggggggtgtattggttttgtaataacctaatcaaagaacttctgaaagaaacaagaaaggaacacacactcagggccgtggagcttctgtattcaattttctgtctagacatgcagcaggtcacactggttcttctggggcatatcctccctggcctgttgactgattcctcaaagtggcactcactaatggacccgcctgggacagccctcgccaaattggccgtctggtgtgccctgtcatcatacagcagccacaaagggcaggcctctactaggcagaagaaaagacatcgcgaggatattgaggactatatctctttattccccctggacgatgtgcagccgtccaagctcatgaggctcttgagcagcaatgaagacgatgctaacatactgagctctcctactgacaggagtatgtcatcctcactctcagcgtctcagctgcatactgttaacatgcgcgatcccctcaacagagtgctcgccaatctgttcctgttaattagttctatactcggcagcagaacagcgggtccccacacacagttcgttcaatggttcatggaggaatgtgtggattgccttgaacagggcgggcgcggatccgtgctgcagttcatgccgttcacgactgtgagcgagctggttaaggtgtcagcaatgtcctcgcccaaagtggtgctggccatcaccgatctctccctgccacttggacggcaggtcgccgccaaagccatcgctgctctgtag

SEQ ID NO: 194449 - DNA, 756 bp, Artificial Sequence
  Description of Artificial Sequence: Synthetic coding sequence
atgaagaagttcttccccaagggcgccacctgggacatcctgaacctggcggacgctttgttggagcaggcgatgattggcccgagtccgaatccattgatcctgtcatacctgaagtacgcaattagcagtcagatggtgtcctacagttccgttctcaccgccatcatggaaattctgaatgcatgggagaacggcgtgctggcatttgaaagtatacagaaaattaccgataatattaaaggcaaagtgtgcagtcttgccgtctgcgctgtagcctggctcgtagcacacgtgagaatgttagggctcgacgagagggagaaatcccttcaaatgattcgacagcttgctggtcccctcttttctgaaaatactttacaattctataatgaaagagtagtgattatgaatagcatcctggaaaggatgtgcgccgacgttctacaacagaccgccacacagatcaagttccccagtacgggcgtcgacactatgccatactggaatctgctgcctcccaagcggcctatcaaagaggtacttacagatatctttgctaaagtgctggagaagggttgggttgactccagatcaattcacattttcgacactcttctgcacatgggcggcgtgtactggttctgtaacaatctcatcaaggaactgctcaaagaaaccaggaaggagcacaccctgcgggcggttgagttgctgtattcaatcttctgtctcgacatgcaacaggtgacctag

SEQ ID NO: 194450 - DNA, 2466 bp, Artificial Sequence
  Description of Artificial Sequence: Synthetic coding sequence
atgatcggccccagccccaaccccctgatcctgagctacctgaagtacgcaatctcctcccagatggtctcttatagttcagttcttacagcaatcagtaaatttgatgacttttccagagatctgtgcgtgcaggccctactggatatcatggatatgttctgcgatcgtctctcgtgccatggcaaagcggaggaatgtattgggctatgccgcgcattgctcagtgcccttcactggctgctgaggtgcactgccgcgagcgcagaaaggctgagggaggggctggaggcaggaacccctgctgcaggggagaagcagctggctatgtgcttgcaaagactggagaagacactttctagtacaaaaaaccgggcacttcttcatattgccaaactagaggaggcttccagctggactgccatcgagcactcactgcttaaactcggggaaatactggctaacctctctaacccccaactgcgctcccaagctgagcagtgtggaacattaatccggagtatccccaccatgctatctgttcacgcagaacagatgcataaaactggttttccgactgtccacgctgtcattctgttggaagggaccatgaatctgaccggagagacccaaagcttagtggaacagctgaccatggttaagcgaatgcagcatatcccaactcccctgttcgttttggagatctggaaagcttgcttcgtgggtcttatcgagtcacctgaggggaccgaagaattaaagtggactgcatttactttcctgaagatacctcaggtcctcgtcaaactgaaaaaatattcacacggtgataaggactttacagaggacgtgaattgcgcctttgagtttctgctgaagcttacacctctgctggataaagcagatcagaggtgtaactgtgattgtactaacttccttcttcaggagtgtggtaagcaaggtcttctctccgaggcttccgttaacaacctcatggccaagcgtaaggccgaccgagagcatgccccacaacaaaagtccggcgaaaatgctaacatccagcccaacattcagttaatcttgcgcgccgagcctaccgtgacaaacatcctcaagacgatggacgcagatcactctaaaagtcccgagggactgttgggagtgttagggcacatgctgagtggcaaatctctcgacctcctcctggcagccgctgccgcgacaggtaagcttaagagtttcgccaggaagttcatcaacttaaatgaatttactacctacggctccgaagagtcgactaagccagcctcagtccgagccctactgttcgacatcagtttcctgatgctgtgccatgtggcgcagacatatggaagcgaagtgattctcagcgagagcaggacgggggccgaggtacccttctttgagacctggatgcagacttgtatgcctgaagaggggaagatactaaatcccgaccatccctgtttccgtcccgactcaactaaggtagagtcattggtcgccctgttgaataattcttctgagatgaagctggtgcagatgaagtggcacgaggcctgcttatcaatctctgctgccatccttgaaattctgaatgcctgggaaaacggggtgctggccttcgagtctatccaaaaaattacagacaacatcaagggcaaggtgtgtagcctggccgtatgtgcggttgcgtggcttgtggcccacgtcaggatgctcggccttgacgagcgagagaagagcctgcagatgatcagacagctcgcaggacccttgttttccgaaaatacccttcaattctacaacgagagagtggtaattatgaatagtattctggaaagaatgtgtgccgatgtgctgcagcagactgcgactcaaatcaaattccccagcacgggagtcgatacgatgccctattggaatcttctgccacctaagaggccaatcaaggaagtgctcactgatattttcgcaaaggtgctggagaaaggatgggtggatagtcggtcgatccatatttttgacaccctccttcacatggggggcgtatactggttttgtaacaacctcatcaaggagttgctgaaggagacccggaaggaacatacccttcgggctgtagaactgctttacagcattttctgcctggacatgcaacaggtgactctggttttgctgggccatatactgccgggtctgctgacagattctagcaaatggcactcgctgatggacccccctggtacggctctggccaaactagccgtgtggtgcgccctttcatcttacagctcacataaggggcaggcttctacaagacagaaaaaaaggcacagagaggacatcgaggactatattagtccaaaagtcgtgctcgctataactgacctatccctgcctctgggaaggcaggtggccgccaaagctatcgctgctttgtag

SEQ ID NO: 194451 - DNA, 1026 bp, Artificial Sequence
  Description of Artificial Sequence: Synthetic coding sequence
atgaagaagttcttccccaagggcgccacctgggacatcctgaacctggccgatgctctgctggagcaggccatgatcggccctagtcccaaccccctgatccttagttacttgaagtacgcaatcagttcgcagatggtgagctactcatctgtgttgacagccatcagcaagttcgacgacttttctagagacttatgtgtccaggccctcttagatatcatggatatgttttgcgatcgactgagctgccacggtaaggctgaggagtgtataggattgtgccgagctcttctaagtgcactgcactggcttctacggtgtacggcggcctctgcagagaggctgcgggagggactagaagccggtacccctgccgcaggagagaagcaacttgcaatgtgcctacagagactcgaaaagactctcagctccaccaaaaatagggccctgttacacatcgctaaactcgaggaggcttcttcttggacagctattgagcattccctgctgaaattgggggaaatcctagctaatctcagcaatccacagctgaggagccaggccgagcaatgcgggacacttatccgatctatccctacgatgttaagcgtccatgccgagcagatgcacaagactggcttcccgacagtccatgcagtcatccttctcgagggtacaatgaacctcactggtgaaacccaatccctggttgagcaacagactgcgacacagatcaagttccctagcaccggcgtcgatacaatgccttattggaaccttctgccacccaaacggcccattaaagaggttctgaccgacattttcgcgaaagtcttagaaaaaggctgggtcgattctcggagtattcatattttcgacaccctgctgcatatgggcggtgtttattggttttgcaacaatctgatcaaagagctgctcaaagagacccggaaggaacacaccctgagggctgtcgaactcctttattccattttctgtttagacatgcaacaggttacatag

SEQ ID NO: 194452 - DNA, 2796 bp, Artificial Sequence
  Description of Artificial Sequence: Synthetic coding sequence
atgaaggtggtgaacctgaagcaggccatcctgcaggcctggaaggagcgctggtcagattatcagtgggcaataaacatgaagaagttcttccctaaaggcgctacatgggatatcctcaacctagctgacgccttgctagagcaggcaatgataggtccctcacccaacccactgatcctatcttatttgaagtacgccatcagctcgcagatggtatcctacagctctgtgctcactgcaataatgtgtttgcaacggttagaaaagaccttatctagtaccaagaacagagcactgttgcacatagccaagttagaggaggcttccctgcacacgtctcaggggctcggacagggtggcacgcgggcaaatcaaccgaccgcctcctggactgccatagaacacagccttctgaagcttggtgagattctagcaaatctgagtaacccacaactgcgctcccaggcagagcagtgcgggaccctgatccggtcaattccaaccatgctaagcgttcatgccgaacagatgcacaaaaccggcttcccaactgtccatgccgtgatactcttggaaggcactatgaatctcacaggcgagacccagtctctggtggagcagcttaccatggttaaacgcatgcaacacatacctactcctctgtttgttcttgaaatatggaaagcatgctttgtgggcctcatcgaatcgcccgaggggaccgaggagctgaagtggacagcttttactttcctcaagatcccgcaggtgctcgtcaagttgaagaagtactcgcacggggacaaagactttacagaggacgtcaactgcgccttcgaattcctgctgaagctgacaccattactggacaaggcggaccagaggtgtaattgcgattgcaccaatttcctgcttcaggaatgcggcaaacagggattgctgagtgaggctagcgtgaataacctgatggcgaagcggaaagcggacagggaacatgcaccacagcagaaatcaggggagaatgccaacattcaaccgaatattcagttaattcttagggctgagcccacagtaaccaatatcctgaagaccatggacgctgatcactctaaaagtccagagggtctcctgggcgtcctgggacatatgctctccggtaagtcattggaccttctgcttgcagctgcggcagcaacaggcaaacttaagtctttcgcccgcaagtttatcaacctgaatgaattcaccacatatggctctgaagaatctactaaaccagctagcgtgagggcactcctcttcgatatcagcttcctgatgctctgccatgttgcccagacctacgggtcggaagtgattctttcagaaagccgcacaggtgccgaggtccccttcttcgagacctggatgcagacctgcatgcccgaagagggaaaaatcctgaaccccgatcatccctgcttccggcccgacagtacgaaagtcgagtctctggtagcacttcttaataattcctcagagatgaaactggtccagatgaaatggcacgaagcttgtttgtccataagcgcggccatactggagatactcaatgcctgggagaatggtgttctggcatttgagtctattcaaaaaattacagataacattaaaggaaaagtctgttcactggcagtctgcgcagtcgcatggctcgtggcccatgtccgtatgctgggactggacgagcgcgaaaagagccttcaaatgattagacagctggcagggcccctattttctgagaatacactgcagttttataatgagcgggtggtcatcatgaactccatcctggagcgcatgtgcgccgacgtgttgcagcaaacagcaactcagattaaatttcccagcactggagtagataccatgccttattggaacttactgcctccaaagaggcctatcaaagaagtgctcactgacatttttgctaaagtgctggagaaaggctgggtcgattcccggagcatacatatttttgacaccctcctacacatgggtggagtctattggttctgcaataatctcattaaagagctcctgaaggagacaaggaaagagcatactctgcgagcagtcgagctgctgtacagcatattttgccttgacatgcaacaggtgaccctggtgctcctgggccacatcctgcctggattattaactgacagtagcaagtggcatagtcttatggacccacccgggaccgcactggctaagctggctgtctggtgcgctctgtcttcgtattcatcccacaagggccaggcgtccactcgtcaaaagaagcggcacagagaggacatagaggactacatctcccttttccccctcgatgatgtccaaccaagtaagctgatgaggctgctgtcctccaacgaagacgatgctaatattctgagtagccccactgacagaagtatgtcaagttcactgtccgcatctcagctgcacactgttaatatgagggatccattgaacagggtcctggctaatttgttcctgcttatttcatcaatactcggatctaggaccgccggccctcacactcagttcgtacagtggtttatggaggaatgcgtggactgtctggaacaaggggggaggggatccgtgcttcagttcatgccattcactactgtgtctgaactggtgaaggtctcggccatgagcagtcccaaagttgtgctggcgattacagacctgagtttaccactggggaggcaggtagctgctaaggcgattgccgcactctag

SEQ ID NO: 194453 - DNA, 444 bp, Artificial Sequence
  Description of Artificial Sequence: Synthetic coding sequence
atgaagaagttcttccccaagggcgccacctgggacatcctgaacttggctgatgctctgttagaacaggcaatgattgggccctcgcccaatccactcattctctcgtatcttaagtatgcaatttcgtcccagatggtcagttatagtagcgtcctcacagctatttcaaagttcgatgacttctcgcgggacctgtgtgtccaggccctcctggatatcatggacatgttttgcgacaggttgagctgtcatggaaaggccgaggagtgtatcgggctgtgtcgcgcattgctgtcagcactgcactttatgccctttactaccgtgtccgagctggtcaaggttagcgcaatgtcttctcccaaagtggttcttgccatcacggacctgagcctccccctcggaaggcaggttgccgctaaagccattgctgcgctgtag

SEQ ID NO: 194454 - DNA, 921 bp, Artificial Sequence
  Description of Artificial Sequence: Synthetic coding sequence
atgaagaagttcttccccaagggcgccacctgggacatcctgaacctggccgacgcactgctcgagcaggctatgataggaccaagtccaaaccccctgatcctcagttatctgaagtatgcaatttcaagccagatggttagctacagctccgtcctgactgcgattagcaagtttgacgatttcagccgagacctgtgtgtgcaagcactgctcgacatcatggacatgttctgtgataggttgtcctgccatgggaaagctgaggaatgtataggcctttgtcgggcgctgctcagcgccctccattggcttctccgctgtactgctgcatccgccgagaggctgagggaaggattggaagcagggacccccgctgcaggcgaaaagcagctcgcaatgtgtctgcaacgcctcgagaaaacattgtcatctactaagaacagggccctcctgcacattgccaagctggaagaagcaagctcatggactgctatcgaacactccttacttaaattaggcgaaattctcgcaaacctgtccaatccacaactccgctcccaggccgagcagtgcggtaccctgatacgctctataccaactatgcttagcgttcacgcggagcagatgcacaagacggggtttcccaccgtgcacgccgttatcttgctggaaggcacaatgaacttgaccggcgagacccagtccctggtcgaacaactgacaatggtgaaacgtatgcagcacatcccgacccctctgttcggaagaggatctgtcctgcaattcatgcctttcacaacggtgagcgagctcgtcaaggtgtccgcgatgtcctcccccaaagtagtgttggcaattacggatcttagtcttccactaggaagacaagtggccgctaaggctattgccgccctgtag

SEQ ID NO: 194455 - DNA, 2244 bp, Artificial Sequence
  Description of Artificial Sequence: Synthetic coding sequence
atggtgcccggcagcgagggccccgcccgggccggcagcgtggtggcagatgtagttttcgtgattgaggggactgccaatctgggtccttactttgagggtctgcgtaaacactatctgctgcctgccatagagtatttcaatgggggacctccagccgagacagactttggtggcgattacgggggaacgcagtattccctggtggtgttcaacacagtagactgcgcccccgaatcgtacgtccagtgtcatgccccaacatcttcagcctatgaattcgtgacctggctggacggtattaaattcatgggcggcggaggcgaatcatgctcgttgatagccgagggccttagcacagcactccaattgttcgacgacttcaagaaaatgcgcgaacaaattgggcaaacccatagagtgtgcctactgatctgcaacagccccccctatctgcttcccgcggtcgagtctaccacttattcgggctgcaccacagagaacctggtgcagcagattggtgagcgaggaattcacttttcgattgtgtcaccacgaaagctgcctgcgcttcgcctccttttcgaaaaggccgcaccccctgcgctcttggaacccttgcagccacccaccgacgtgtcccaggatcctaggcatatggtcctcgtccgagggcttgtcctgcctgtggggggcggcagcgcccccggcccacttcagtccaagcagccggtgccactacctccagccgccccctccggagccaccttgtctgccgctccgcaacagccactgccaccggtccccccgcagtatcaggtccctggtaatcttagtgcagcccaggttgccgcgcagaacgccgtggaggccgctaagaatcagaaagccggtcttggaccgagattcagtcccataaccccgcttcagcaggcagcacccggtgtggggccccctttttctcaagcccctgcgccacagctgccacccggaccaccgggagccccaaaaccccctcccgccagccagccatcgctggtgagtaccgtggcccccggtagcggccttgctcctaccgcccagccaggggcgccgtccatggccggaactgttgcccccgggggcgtgagcggtccatcacccgcgcagctaggtgcacccgcactgggtggtcaacagtcagtgtcaaataagctgctggcttggtcaggggtcctcgagtggcaagaaaagccaaaacctgccagcgtggatgccaacactaagttgactcggagcttaccttgtcaggtgtacgtgaaccatggtgagaacctgaagaccgaacaatggccgcagaagcttattatgcagctgattccccaacagctgctcacaacgctcgggcctctgttcaggaattcaaggatggtgcagtttcactttaccaataaagaccttgaatctctgaagggactctacagaattatggggaatggctttgcgggttgtgtgcactttccacataccgccccatgcgaggtcagggtactgatgctcttgtattccagcaagaagaaaatctttatgggactgattccgtacgatcagtccggttttgtgaacggcattaggcaggtaatcactaatcacaagcaagttcagcagcaaaagctggagcaacaacagaggggaatgggcggccagcaggctcctcctggcctcggccccattttagaagaccaggccagaccaagtcagaacctcctccaactgaggcccccccagcctcagccacaaggaacagttggcgccagcggagccaccggacagccacaaccccaggggactgcacagcccccccctggcgccccccagggccctccaggagccgcaagcgggccacctcccccgggtccaatcctaagacctcagaatcctggggcaaacccgcagctcaggtcgctgctgttgaatccacctcccccacagacaggtgtcccccccccacaggcatcactgcaccacctgcagcccccaggagcccctgccttgttgcccccccctcaccagggtctgggccagcctcaactgggccctccgctgctgcacccaccccccgcccagtcctggcctgcccagcttccaccgagggcacccctgccagggcagatgctgttaagcggtggcccccgcgggcccgtcccacagccgggcctgcagccaagtgttatggaagatgacattttgatggatttgatctag

SEQ ID NO: 194456 - DNA, 2268 bp, Artificial Sequence
  Description of Artificial Sequence: Synthetic coding sequence
atggtgcccggcagcgagggccccgcccgggccggcagcgtggtggctgacgtcgtgtttgtgatcgaaggtacagctaatcttggcccatacttcgagggcctacggaagcactatctactcccagctattgagtactttaacggaggaccccctgcagagactgattttggcggtgattatggaggcacgcagtattcacttgtcgtttttaacactgtggactgtgcgcccgaatcttacgtacaatgtcacgctcccacatccagtgcatatgagtttgtaacctggctcgacggcatcaaatttatgggcggcggcggcgagagctgctccctcatcgccgagggcctcagtaccgcactgcagttatttgacgattttaaaaaaatgagggagcagatcgggcaaacacaccgggtgtgcctgctcatctgtaactctccaccctatctcttgccggcggtcgaatccaccacctactccggttgcaccaccgagaatctggtacagcaaataggggagcgggggatccacttttcaatcgtgtccccaagaaagttgcccgctttgcgcctattatttgaaaaggcggccccccccgcactcttggaacccttacaaccacccacggacgtgtcacaagaccctcgacacatggttctggtccgcggactcgtgctgccggtgggcggcggcagcgccccagggccgctgcagagcaaacaacccgtccccctgccacctgccgctccctccggagcaacactaagtgctgctcctcaacagcctttaccacctgtcccacctcagtaccaggtaccaggaaatctctctgctgcccaggtcgcggcccaaaatgcagtggaagctgcgaaaaatcagaaggccggactgggcccccggttcagccctatcacacccctgcaacaggctgccccaggagttggcccccctttctcccaggcgcctgcaccccagctgccacctggccctccaggtgcgccaaaaccaccacccgcaagccagccgtcactggtctctaccgtcgcccccggcagtggcctcgcaccaacagcgcagccgggggctccctcaatggccggaactgtggcgccaggaggcgtatccggcccctcccctgctcagctaggagcaccggcgctcgggggacagcaatccgttagtaataaactgttggcctggagcggcgtgctggagtggcaagagaaaccaaagcctgcatctgtggatgcaaacacgaagcttacaaggagcttgccctgtcaggtgtatgtgaaccacggtgaaaatctaaagaccgaacagtggcctcagaagctaatcatgcaacttattcctcagcagctccttaccacattgggaccactctttaggaactcaagaatggtgcagtttcactttactaataaagatctggagtccctaaaggggctgtacagaatcatgggcaacgggttcgcaggatgtgtgcacttcccccatacagcaccctgtgaggtgagagtgcttatgctcctgtacagctcgaaaaagaagatctttatggggctcatcccttacgatcaatccggtttcgtgaatggcatccgtcaagtgattaccaatcataagcaggtacaacagcagaaactggagcagcagcagagaggaatgggaggacaacaggctcctccgggactgggccctatcctggaagaccaagccagaccaagccagaatctgctgcagctgcgaccacctcagccccagccgcaagggacggtcggcgccagcggggcaaccggccaaccgcagccacaggggaccgcacagccacctcccggggctcctcagggaccgcctggagctgctagcgggcctccccctccaggacctattctgaggccccagaatccaggggctaacccccagcttagatccctcctgcttaaccccccgccaccccagacaggcgtcccaccgccacaagcctcgctccaccaccatctgccatccccaggccctcacaattttcctctgggactacattgccaggtgcggggaccaggcgggggccagcgatccgggctctcggtgcccgccgcccccggcctcgagcatcaagaccgagtcctgctcgggtctaaggacatcgggtctaagaatgagggatccccgataagagcctgcagtccagccagttggagaaccacatcctcctggatttctagcgaatccccaacacccaacaaggtaccattctag

SEQ ID NO: 194457 - DNA, 2349 bp, Artificial Sequence
  Description of Artificial Sequence: Synthetic coding sequence
atggtgcccggcagcgagggccccgcccgggccggcagcgtggtggctgacgttgtgtttgtcatagagggcaccgcaaacctcggcccatatttcgagggcctgaggaaacactatctcctgcccgctattgagtacttcaatgggggacctccggcggaaactgactttggtggcgactacggcggcactcagtactcccttgttgtgtttaataccgtggactgtgcccctgaatcatatgtccagtgtcatgccccaactagctccgcctatgaattcgtgacatggttggatggcatcaagttcatggggggcggaggcgaaagctgtagcctcatcgcagaaggattgtcgaccgcactgcaactgttcgatgactttaagaagatgagggagcagattggacagactcaccgcgtctgcctattgatttgtaactctccaccctacctcctgcctgcagtggagagtacaacgtattcaggatgtaccaccgaaaatctggtgcaacaaatcggcgagcgcggtattcacttttcaattgtttcaccgcgtaaactgcctgctttgcgtttgctgtttgaaaaggccgcaccacctgctctgttagaacctctgcagcctccaaccgacgtttcccaagatcctaggcacatggtgctcgtcagaggtcttgtgctgccagttgggggggggagcgctcccggcccactgcaatccaaacagcctgtgccgcttcctcctgccgccccctctggtgccacattgagcgcagcaccccaacaacccctgcctccggtccctcctcagtatcaagtgccaggtaacctgtcagccgctcaggtcgcggctcagaacgccgtggaagctgcaaaaaaccagaaagctggactgggtccccgtttctcccccattactccactgcagcaggcagctccaggagtcggccctcccttcagccaggctcccgctccacagctcccccccgggcctccgggcgcccccaagccccccccggcctctcagccctctttagtctctacagtcgccccggggtccgggctcgcgcctacggcccagcctggagcgccgtctatggccgggactgtggccccaggcggggtgagtggtcccagccccgctcagttaggggccccagctctcggggggcagcagtccgttagcaacaaattactggcatggtccggcgtgctagagtggcaggaaaagcccaagcctgctagcgtcgatgccaacacaaagctgacccgctctctcccatgtcaggtgtacgttaatcatggcgagaatctcaagaccgaacaatggcctcagaaacttatcatgcagttgatcccccagcaacttctgaccacattgggccctctgttccgtaacagcagaatggttcagttccactttacaaataaagacctcgagtccctgaagggtctgtatcgtatcatgggtaacgggtttgcaggatgcgtgcactttcctcacaccgctccctgtgaggttcgggtccttatgctgctgtatagctcgaagaaaaaaatttttatggggcttattccctatgatcaaagtgggttcgtaaacggaattagacaggtcattacgaatcataagcaggtgcagcagcagaaactcgaacagcagcagcgtgggatgggggggcaacaggctccacctggcctggggcccatcctagaagatcaggcaaggccttcacagaatctgttacaactacgccccccccagcctcaacctcaggggacagtgggagcctccggcgccactgggcagccacaaccacaggggacggcccagcctcccccaggagctccacagggccctcccggtgccgcgagtggcccccccccgccgggccctatactccgcccacagaatccaggagccaatccacaactcagaagcctgttactgaatcctcctccgccacaaacaggtgtgcctccccctcaggccagtctgcatcatctccagcccccaggagcccctgcgctcctgcctcccccacatcagggtcttggccagcctcagctggggcctccattattgcacccaccacctgctcaaagctggcccgcccagctacccccacgcgccccccttcccgccgctaagcggaaacgcgaaggtgagggacgcgttttcagggagaagtgggagagggcttatttcttcgtcgaggttaagagcatgcccatgtgtctgatttgcaagcagatcgtctccgtgttgaaggaatacaacctaaagagacactacgagtctaagcactccaagagctacgatcagtacactgagcagacacgatag

SEQ ID NO: 194458 - DNA, 1449 bp, Artificial Sequence
  Description of Artificial Sequence: Synthetic coding sequence
atggtgcccggcagcgagggccccgcccgggccggcagcgtggtggccgacgtggtgtttgttattgaggggactgccaatctagggccgtatttcgaaggactgaggaagcattatcttctccccgcaatcgagtattttaatggaggcccaccagcaccattcagtcaggctccagctccacagctgcctcctggacctcctggggcccctaagccccctcccgcttcccagccttctttagtgagtacggtggctcccggcagcgggttagcccctactgcccagccgggagcacctagcatggccgggactgtggccccaggcggtgtgtcaggaccctctcctgcacagctgggggcgcctgccctgggtggacaacagtccgtgagtaataagctcctggcttggtccggggtgttagaatggcaggagaaacctaagccagcctccgtggatgccaataccaaactcaccaggagcctcccctgccaagtgtatgttaaccacggggagaatttaaagaccgagcagtggccccaaaagctgataatgcaactgataccccagcagctcttgacaacgcttggcccattgtttagaaactcgcgtatggtacagtttcacttcaccaataaggacctggaatcgctgaagggactttacaggattatgggcaatgggttcgcagggtgcgtacatttccctcacacggccccttgcgaggtgagagtactgatgctgctgtactctagcaagaagaaaatctttatgggactcattccctacgaccagtccggttttgttaatggtatccgccaagtaattacgaatcacaagcaggtccaacaacaaaagcttgagcagcaacagagaggcatgggcggtcagcaagccccacctggtctgggccccatcctcgaggatcaggcaaggccttctcaaaacctgctgcagctgcggccaccccagccccaaccacaggggaccgtcggtgccagtggtgccactggccagccccaaccacaaggcacggcccagcccccccccggcgcaccccagggtccacctggggcggcctccgggcctccgccacccggacctatcctgaggccccagaacccaggggccaaccctcagctgagatctcttcttctgaatcctccgcctccccaaactggcgtccccccgccccaggccagccttcaccatctgcagccacccggagcacctgcactgcttcccccacctcatcaggggttaggtcagcctcagctcggaccacccctacttcatcccccccctgcgcagtcttggcccgcccaacttccaccccgcgctcccctccccggacagatgctcctgagcggtggccctagaggccctgtcccgcagcccggactccagccttccgtgatggaagacgatatcctgatggacctaatatag

SEQ ID NO: 194459 - DNA, 2385 bp, Artificial Sequence
  Description of Artificial Sequence: Synthetic coding sequence
atggtgcccggcagcgagggccccgcccgggccggcagcgtggtggccgacgtcgtctttgtcatcgagggtacagccaacttgggaccgtatttcgaaggtctgcgcaaacactatctgttgcctgccattgaatacttcaacggtggccccccagccgaaacagacttcggtggcgactacggaggtacccaatatagcttagtggttttcaacactgtcgactgtgctcctgaatcatatgtgcagtgccacgctcctacatcatctgcatatgaatttgtgacctggttagatggtataaaattcatgggaggtggcggagagtcatgctccttaatagcagagggtctgtctaccgccctgcagctttttgatgattttaaaaagatgagagaacagatcgggcaaacacatagagtttgtcttctcatctgtaactcaccaccctatctgctgcccgcagtggagagtaccacctactctggctgcactacggaaaacctagttcagcagattggggagcgcgggatccatttttccatagttagcccccggaaactgccagccctcaggctgctcttcgaaaaggccgcaccacctgcactgctggagcctttgcagccccccaccgacgtgagtcaggaccccagacatatggtcctagtcagggggcttgtgctccctgtgggagggggctcagcccctggaccactgcagtcgaagcaacccgtacctcttccccctgctgcccccagtggggcaacactcagtgcagcaccacagcagccattgccacccgtaccaccccagtaccaggttccagggaacttaagtgccgcacaggtggcggctcaaaatgcagtcgaggccgcaaaaaaccagaaggccggattagggcctaggttcagtccaataactcctcttcaacaggctgcacctggagtggggcctcctttttcccaggcccctgcgcctcagctgccgccagggcctcctggtgccccgaaacccccccctgcgtctcagccctcattggtttccactgtggctccgggcagcggtctagccccaactgctcaaccaggcgccccctctatggcggggaccgtcgcccccggtggagtgtctggaccttctcctgctcaattgggagcgcccgcactggggggacagcagtccgtgtctaataagcttctcgcctggtccggagtattagagtggcaagagaaaccaaagcctgccagcgtagatgcaaacacaaaactaacaagatcgttgccttgccaggtgtatgtcaatcacggtgagaacctgaaaaccgagcagtggccccaaaaattgattatgcagttaatccctcagcagctgttgactactttgggtccactcttcaggaactctaggatggtccagttccacttcaccaataaagatctggaaagtctgaaaggattatataggatcatggggaatgggtttgccgggtgtgtgcacttccctcatactgcgccgtgcgaggtccgtgttctgatgctactctacagtagcaaaaagaagatctttatggggttgataccatatgaccagtcagggttcgtaaatgggatccgccaggtcatcacaaaccacaagcaggtgcaacaacaaaagcttgagcagcagcaaagggggatgggcggccagcaagcccccccgggtcttgggcccatcctggaggaccaagcccggcctagtcagaacctgttgcagctgaggcctccgcaaccccagcctcagggaacagttggcgcctctggagctacgggccagccccagcctcaagggactgcacagcctccacctggagctccacagggcccaccaggtgcagcctctgggccccccccaccagggccaatcctgcggccacaaaaccctggagccaatccacaactacgcagtctattgctcaatccgcccccgcctcagacgggagttcctcctccgcaggccagcctacaccacctgcagccacctggtgcgcctgcacttctgcccccaccgcatcagggcctggggcagccccagctcggccctcctctactgcatccaccccctgatggcgctagaagatccgatgctgccgagagggggagtcccgggcctggaagaagcccccagtcgccgcccttacccctggggttccccgttcgtcaaagggttactgctttccatgtgtccatcacgtctggcaaaacaaaagagcggaggcgcggaccctgcgtcagcagaaagatgggagcgtcactcttcctctgcgggtccgaggaacatgcctacgtgttcaacatgcagaccaatcgcgtgtgtgtggaaagaatccagccagaaaccccactctag

SEQ ID NO: 194460 - DNA, 2175 bp, Artificial Sequence
  Description of Artificial Sequence: Synthetic coding sequence
atggtgcccggcagcgagggccccgcccgggccggcagcgtggtggctgacgttgttttcgtgatcgagggtactgctaacttgggaccctacttcgaaggactgcgcaagcactacctcctgccggccatcgagtattttaacgggggcccaccagcggagacagattttggtggagattacgggggaacgcagtatagcttggttgtgtttaacactgttgactgcgcacctgagagctacgttcagtgtcacgccccgacctcatcagcttacgagtttgtcacctggctggatggcattaagttcatgggcggcggcggtgaaagctgcagccttatcgccgaggggcttagcaccgccctccagcttttcgatgatttcaagaagatgagggagcagatcgggcaaacccaccgagtctgtctcctaatctgcaacagccctccttacctcctaccagcagtggagagcactacatattcgggctgtaccactgagaatctggtgcagcagatcggggagagaggcattcacttttccatcgtcagtcctcggaagctgcccgccctccgcctgctgttcgaaaaggctgcacctcccgccctgctagaacccctgcaaccgccaacagacgtatcccaggaccctcgtcatatggttctggtgcgtggcctggttcttccagtaggtggcggttccgctcccggacccctccaatcaaagcaaccagttccactgccaccagccgcgccttcgggcgctaccctcagcgctgcaccacagcagcccctgccccctgtgcccccacagtatcaagtgccaggaaacctcagcgcggcacaggtcgcagcacaaaacgccgtggaggctgccaaaaatcagaaggctggcctgggcccacgcttctcacctatcacaccactccagcaggctgctcccggcgtgggaccacccttcagtcaagctcctgctccccaactcccgcctggcccccctggcgcaccgaaacctcctcctgcctcccaacccagcctggtaagtacagtcgcccccggaagcggcctggcccctactgcccagcccggtgcaccgtccatggctggtacggtggcccctgggggagtgtccgggcctagcccagcccagctcggagcaccagcactcggaggccaacagtcagtctctaacaaactcctggcctggagcggtgtgctggagtggcaagaaaaacccaaacccgccagtgtagatgctaacactaaacttacccgctccctgccatgccaggtctacgtaaatcacggtgaaaatctgaaaactgagcagtggcctcagaagctgatcatgcagctgatccctcagcagttactgacaacactgggcccactctttcgtaatagcaggatggttcaatttcactttactaacaaggacctggagagcctcaaagggctatacagaataatggggaatggctttgccggatgtgtgcattttcctcacactgcaccatgcgaagttcgggtgcttatgctgctctacagttctaaaaagaagatcttcatgggcttgattccatatgaccaaagcggattcgttaacggcataagacaggtgattaccaaccataagcaggtgcaacagcagaaattagaacagcagcaaagggggatgggcggtcagcaggcccctccaggccttggtcccattcttgaagaccaggccagaccctcacagaatctgctgcagctcaggcctccacagcctcagcccccaccaggagcgccccagggcccgccaggagccgcatcaggacctccacccccaggaccaattttgcgcccccagaaccctggtgccaacccacaacttcgaagcctgctcctaaatcctcccccaccgcagaccggggtgccccctcctcaggcttctttacaccacctgcagccccccggagccccagctctgctgcctccccctcatcaaggcttgggccagccccagctgggccccccgctgctccatccccctcccgcacagagctggcctgcacagttaccacctcgggcccccctgcccgggaaaggcacgcggggcagagcagaggtgtggacggagtgcccaagttcttcgtgggccagggccccacgccctagcgctccggggaagtag

SEQ ID NO: 194461 - DNA, 753 bp, Artificial Sequence
  Description of Artificial Sequence: Synthetic coding sequence
atgctgctgtacagcagcaagaagaagatcttcatgggcctgatcccgtatgaccagtcaggatttgtcaacggtatacggcaggttattacgaatcacaagcaggtgcagcagcaaaaactggagcagcaacagagggggatgggcgggcagcaggctcctcccggactcgggcccattctggaggaccaggctagaccatcccagaatctcttgcagttgcggccacctcagccgcagccgcagggcaccgttggggcctccggcgcaaccggccaaccgcagccccagggcactgcccagccccctcctggggccccgcagggccccccgggtgcggctagcggaccccccccgccaggaccaatttttggcccacggactcttggtcctacactttcatgtgaggcctcctccagcacccaccataggcggcggctgggctgccctcatccccgcccaccttcaaccacaagcagtcatcagggcctgctgcgctgttgcctccggcggcagggcttgggtcagcctcagctgggaccccattcttgcatccatcatttgccgtcccccggccctcacaattttcccctagggctgcattgtcaagtcagagggccaggtggcggccaaagaagtggtctcagcgtacccgccgctccaggcctcgaacaccaggatagggtgttactgggaagcaaagacattgggagcaaaaacgagggatcgcctatggcattcgcagagctgtag

SEQ ID NO: 194462 - DNA, 1605 bp, Artificial Sequence
  Description of Artificial Sequence: Synthetic coding sequence
atggtgcccggcagcgagggccccgcccgggccggcagcgtggtggccgatgtggtgttcgtcatcgaaggcacagcaaacttgggcccatacttcgaggggctaagaaagcactatctgttacctgcaattgaatacttcaatggcgggcccccagccgaaactgacttcggaggagatgtgcctggcaacctcagtgccgcacaggtggcagctcaaaacgccgtggaggccgccaaaaaccaaaaagctgggctcggtccacgcttcagtcccattacccctttgcagcaagctgcacccggcgtggggccaccattcagtcaggctccagcgcctcagctgccgcccgggcctcccggtgcgcctaagccccccccggcctcacagcctagcctggtgtctaccgtggctcccgggtcaggcttggcacccactgcccagcccggcgccccttcgatggcaggaactgtggccccagggggagtatctggtccaagcccggcacagctaggtgccccagcactgggtggacagcagagtgtctcaaacaagctccttgcctggagcggcgtgctggagtggcaggagaagccaaagccagcttcagttgacgctaacaccaagctgacacgttctctaccatgccaagtgtacgtaaaccatggcgagaacttgaagaccgagcaatggcctcagaagcttattatgcagttgatccctcaacagctgctgacgaccctcggcccactctttagaaattcccgaatggtccagtttcatttcactaataaagaccttgaatccctgaaaggcttgtacaggatcatgggaaatggcttcgcaggatgtgttcactttccccataccgctccttgcgaagtgcgcgtgctcatgctgctatatagcagtaaaaagaagatcttcatgggactcatcccttatgaccagagcgggttcgtgaatggcatccgccaggtgataaccaaccacaagcaggtgcagcagcagaagttggaacagcaacagaggggaatggggggacaacaggcccctcccggactcggacctattctggaggatcaagcgcgaccatcacagaacttgttgcagttgagacccccccaaccccaaccgcagggcacagttggtgcttctggcgctaccggacagccacagccacagggtacagcccagcctcccccaggagctccccagggccctcccggtgcggcgtcagggcccccacctcccggtcccattctaagacctcaaaaccctggcgccaacccacagcttcgaagcctacttcttaatccacctcctccacagactggagtgccccctccccaggcctctctgcaccatctgcagccaccaggggcccccgctttattgccacccccccaccagggtctgggccagccacagctggggccaccattgcttcaccctcctcccgcacagtcctggcctgctcagctccccccgagggctcccctacccgggcaaatgctgctgtccggtggaccacgagggcctgtgccccagcctggtttacaaccatcagtcatggaggatgacatcttaatggacctgatttag

SEQ ID NO: 194463 - DNA, 1194 bp, Artificial Sequence
  Description of Artificial Sequence: Synthetic coding sequence
atggtgcccggcagcgagggccccgcccgggccggcagcgtggtggctgatgtagtattcgtgatcgagggcaccgccaatctgggaccgtactttgaaggcctgcggaaacactatcttctgcctgctattgagtactttaatgggggcccccccgccgagaccgattttggcggcgactatggagggacccaatacagcctggtagtctttaatacagttgactgcgctcctgaaagctatgtgcagtgtcacgcgccaacaagctcagcctatgagtttgtgacatggctggatggcataaagttcatggggggtggcggagaatcttgttcccttatcgctgaaggtctgtccactgccctgcagctcttcgatgactttaagaagatgcgagagcaaatcggtcagactcatagggtgtgtcttctgatatgcaactcgccgccctatttgctgccagctgtggagagtaccacctactctggctgtacgaccgagaatcttgtccagcagatcggagagcggggaatccatttctccatcgttagtccacggaagctgccagccttaagattattgttcgaaaaggccgccccccctgcattactggagcccttgcagccaccaactgacgttagccaggaccctcggcatatggtgctggttcgcgggctcgtattacccgtcggcggggggtccgcccctggccccctgcagagtaaacagcctgtaccactgccacccgcggccccatccggggcaacccttagtgcagcaccacagcagccactgccacccgtgccacctcaataccaagttcccggtaatctatccgccgcccaagtcgcagcgcagaacgctgtagaggcagctaagaatcagaaggctgggctaggcccccgtttttctcccataactccgctgcagcaggcggccccgggagtgggcccaccattctctcaggcccctgcccccgccctgctaccacctccacatcaggggctgggccagcctcagttgggacctcccctgctgcacccgcccccagcccagtcctggcctgcgcagttgccacctagggcacccctgccgggccagatgctgctgtcaggcgggccaagaggcccagtcccccagcccgggctgcaacctagtgtaatggaggacgatatcctcatggaccttatttag

SEQ ID NO: 194464 - DNA, 780 bp, Artificial Sequence
  Description of Artificial Sequence: Synthetic coding sequence
atggtgcccggcagcgagggccccgcccgggccggcagcgtggtggctgacgtggtgtttgtaatagaggggactgccaatctgggcccgtacttcgaaggtctgcgtaaacactaccttttacccgccattgagtacttcaatggaggaccccctgccgagacagatttcggcggggactacggcgggacccagtactcccttgttgtgttcaataccgtcgattgtgcccccgaatcctacgtgcagtgccacgcccccaccagcagcgcctacgagtttgttacctggttggacggcattaaatttatgggtggtgggggggagagttgctctttgattgccgagggcttgagtaccgctctgcagttgtttgacgacttcaagaagatgcgcgagcagatcggccaaactcaccgtgtctgtctgctgatttgcaattctcccccttatcttctcccagccgtagaatcaaccacatacagtggatgtacgactgaaaatctcgttcagcagattggggagcgcggaatacacttcagtatcgtgtccccacgaaagctgcccgcgttgagactgctctttgagaaggctgcccccggcctcgcgggagctgccgccgcttccgacagatgtgagcccgggcccgaagcccatggcgctggctcaggcacgcgggccgcttgctggggctggctgtctccaagaccaccacccgtgaaggcagcttcccctccggctagtcgcaggaccctccgttgtcaggttcggtgctgttag

SEQ ID NO: 194465 - DNA, 1803 bp, Artificial Sequence
  Description of Artificial Sequence: Synthetic coding sequence
atgaccgccgcccccgccagcccccagcagatccgggaccggctgctgcaggcaattgatccacaaagcaatattagaaatatggtggccgttttagaagtcattagttccctcgaaaaatatccgatcacaaaggaggccctggaagaaaccagactgggcaaattgatcaacgacgtaagaaaaaaaactaagaacgaggaactggctaagagagcgaaaaaactgctccggagttggcagaaactgattgagccagcccaccagcatgaagcagcacttcggggcttggcgggggcaacaggatcagcgaacggcggggcacacaattgtagaccggaggtcggggctgccggccctcccagatctattcacgatctaaagagccgaaacgatcttcaaagactgcccgggcagagattggatcgtctcgggtctcggaaaaggcgcggcgaccagcgcgacctcggccatcccgggcccccgccaaaggtatcaaaagcttctcacgatcccctggtacccaattctagtcccctgcccacgaatggcatcagcggctccccagaaagttttgcatccagcttggatggctccggtcacgccgggcctgaaggctcacggctggagcgtgacgaaaacgacaaacactccggtaaaatccctgtcaacgccgtgcgtccccacaccagcagcccaggtctgggtaagccaccaggaccctgtcttcagcccaaagcatctgtcctgcagcagctagacagagtcgacgaaaccccaggcccaccacatcccaagggccctccccgctgttccttctctcctcggaactcacggcatgaaggcagtttcgccaggcaacagtcactgtacgcacccaagggcagcgttcctagtccgtctccacggccccaggctctggatgccacccaagtgccaagtcctttgcccttggctcagccctccactcccccagtacggcgcctcgagctcctaccatccgcggagagcccagtgtgctggctcgaacaacctgagagccatcagcggttggctggcccagggtgcaaggcagggcttagcccggctgaaccattgctgtccagagctggctttagcccagatagtagcaaggccgactcagacgctgcatcctctggggggagcgatagcaagaagaagaagaggtataggcctcgcgattacacagtgaacctcgatggtcaggtggccgaggcaggggtgaagccagtgcgactcaaagagcgcaaattaacatttgatcctatgacacggcagattaaaccactcacacaaaaagaacctgtgagggcagattcccccgtgcacatggagcaacaatccagaaccgagttggacaaacaggaggccaaagcaagcctccagtctcctttcgagcagactaactggaaggagctcagccgaaatgaaatcatccagtcataccttagtcgccagtcttccctgctgtcatcctcgggggctcaaactccaggtgcccatcatttcatgtccgaatacctgaagcaggaagaaagcaccaggcaaggcgcaaggcagttgcacgtgctggtgcctcaatcgcctccaaccgacctccccggactcaccagggaggtgacccaagatgatttagataggatccaggcatctcagtggcccggtgtgaacggttgccaggacactcaaggaaactggtatgactggacccaatgcatttcgttagatccacatggtgatgacgggcgtctcaacattcttccttacgtgtgcctagactag

SEQ ID NO: 194466 - DNA, 282 bp, Artificial Sequence
  Description of Artificial Sequence: Synthetic coding sequence
atgaccgccgcccccgccagcccccagcagatccgggaccggctgctccaagcgatcgaccctcagtctaacatccgcaatatggttgccgtccttgaggtcatttcgtcactggagaagtaccctattacgaaagaagccctcgaagagacacggctgggtaaacttataaacgatgtgcggaaaaagaccaagaacgaggaactggctaagcgtgccaagaagctgctgcccggatggcagtgggcttgccgcccgcggggtcaaccccccggcgcgtag

SEQ ID NO: 194467 - DNA, 936 bp, Artificial Sequence
  Description of Artificial Sequence: Synthetic coding sequence
atggccgacgtgatcaacgtgagcgtgaacctggaggccttcagccaggcaattagtgcaattcaagccttgcggtcctctgtgagcagagtatttgattgcttgaaagacggtatgcggaacaaagagaccctcgaaggcagagagaaggcctttatcgcccatttccaagataatttgcattccgtcaatagagatctgaatgaattggaacgactgtccaatttggtaggaaagccttccgagaatcatcccctgcacaactcgggcctactctccctggacccagttcaggataaaacgcccctctattctcagctcctccaggcgtataaatggagcaataagctacagtatcacgcaggactggcaagtggccttctgaaccagcagtccctcaagcggagtgctaatcagatgggagtctctgccaaacgccgacctaaggcccagcccacgaccttagttcttcctccacagtatgtagacgacgtcattagcaggatcgatagaatgttccctgagatgagcatacatttatctcgtcccaatggaacaagcgcgatgttactggtgacgcttggcaaggtgctgaaagtcattgtggtgatgcgctcactttttattgacagaacaatagtcaaaggatacaacgagaatgtgtacaccgaagatggcaagctggatatttggtctaagtccaattaccaggtttttcagaaagtcacagatcacgcaacgactgccttgctgcactaccaactgccgcagatgcctgacgtggtagttaggtcattcatgacttggctgcgatcctacatcaaactttttcaagctccgtgtcagagatgtgggaaatttcttcaagatggcttaccacctacctggcgtgactttcgcacacttgaggccttccatgatacctgtcgacagtag

SEQ ID NO: 194468 - DNA, 714 bp, Artificial Sequence
  Description of Artificial Sequence: Synthetic coding sequence
atgcggaacaaggagaccctggagggccgggagaaggccttcatcgcccattttcaggataacttgcactcggtgaaccgggacctgaatgagctagaacggctttctaacctggtgggaaaaccgtcggagaaccatcccctccacaattctggcctcctctctctagaccccgtacaggacaagactcctctgtatagtcagctcttacaggcatacaagtggagcaacaagctccaataccacgcgggtcttgcctctggcttgcttaaccaacagagccttaaacggagcgcaaatcagatgggcgtttccgccaagagaagaccaaaagcccagcctactacccttgtcctaccccctcagtacgtagatgatgtgatctcacgaatcgatagaatgtttcctgagatgagcatacacctatcaaggccaaatggtacctccgcaatgttgctgctggacatttggtctaagagtaattatcaggttttccaaaaggtcactgaccatgctacaacggctctgttacactaccagttgccccaaatgccagacgtggttgtgagatcattcatgacatggctgcggagttatatcaaactgtttcaggccccatgtcagagatgtggaaaattcttacaggatggattgccaccaacatggagggacttcagaacactggaagcctttcacgatacctgtcgccagtag

SEQ ID NO: 194469 - DNA, 828 bp, Artificial Sequence
  Description of Artificial Sequence: Synthetic coding sequence
atggccgacgtgatcaacgtgagcgtgaacctggaggccttcagccaggctatatcagcaatccaggctttgcggagcagcgtctccagagtctttgactgtctgaaagacggcatgcggaacaaggaaacactcgaaggtcgtgagaaggcattcatagcccacttccaggacaatctgcacagtgtaaatcgcgatctgaacgagttggaaaggttatctaaccttgtgggcaaaccttctgagaatcacccactacacaacagtggcctcttatccctcgaccccgtgcaagacaaaacacccctttattctcagctgttacaggcctataaatggtcaaataaacttcagtatcatgctggcctcgccagcggcctgcttaatcaacagagcctgaagcgttctgccaaccagatgggtgtgtcagccaaaagacgtccgaaggcccagcccaccacactcgtgctgccgccccagtatgtggatgacgtaatctctcgcattgacagaatgttccccgagatgagcatccacctgagtaggccaaacggcacgtcagcaatgctgcttttggacatttggtcgaaaagcaattaccaggtctttcaaaaggtcacggatcacgctacaacagccctcctccattaccagctgccacaaatgcctgacgttgttgtcagaagctttatgacctggctgagaagttatatcaagttgttccaggccccttgtcaacgctgtggcaagtttctgcaggatggactgcccccaacctggcgtgactttaggacactggaggctttccatgacacttgtaggcagtag

SEQ ID NO: 194470 - DNA, 666 bp, Artificial Sequence
  Description of Artificial Sequence: Synthetic coding sequence
atgctgaagagcaacggcgagcggcggagccggaacgccctgcccgcagtctatgcaagaaagatggccgcatcacagcaacaggcttcagcagcatccagcgccgctggagtttccggcccctcgtcagcaggcggccctgggcctcaacaacagcctcagcctccagcccagcttgtcgggcccgcacagagtggccttttgcaacagcagcagcaggacttcgaccctgtgcagcggtacaagatgctcatccctcaactgaaggagtctcttcagactcttatgaaggtagcagcccagaacttaattcagaacaccaatatagacaatggccagaaatcaagcgatggccccatccagagattcgacaagtgtttggaggaattctatgccctttgcgatcagctggaactttgcctccggttggcacacgagtgtctcagccagtcatgcgattctgctaagcacagtccaactttagtccctactgccactaaaccggacgccgttcagccggactcgctcccatatcctcagtatctcgccgtgattaaggcacaaataagctgtgcaaaagacattcacaccgctcttcttgactgcgccaataaggtgactggcaagacgcctgcaccacctgcaggacctggaggcacactgtag

SEQ ID NO: 194471 - DNA, 420 bp, Artificial Sequence
  Description of Artificial Sequence: Synthetic coding sequence
atgctgatcccccagctgaaggagagcctgcagaccctgatgaaggtcgccgcccagaaccttatccagaatacaaatatagacaacggacagaagagtagtgatggccctatccaacgattcgacaaatgcctggaggaattctacgccctgtgcgaccaactggagttgtgcctccgactggcccacgagtgtctcagccagtcttgtgattctgccaagcattccccgactctcgtgccaacagccactaaacctgatgctgtacagcctgatagcttgccatacccacaatacttagcagtgatcaaggcccagatttcttgcgcaaaagatatacataccgctcttctcgattgtgctaataaggtcacgggcaagacaccggcccccccggctggccctggaggtactttgtag

SEQ ID NO: 194472 - DNA, 537 bp, Artificial Sequence
  Description of Artificial Sequence: Synthetic coding sequence
atgagcaccccccccctggccgccagcggcatggcccccggccccttcgctggaccacaagcgcagcaagccgctcgggaggttaacaccgcctcactctgcaggattggtcaagagaccgtacaggacattgtttatcggaccatggagattttccagctcctacgaaatatgcagctgcctaatggagtgacctatcacactggcacttaccaagaccgactcaccaaactccaagataacctaagacaactgagcgtactgttcaggaagttacggctagtttacgataagtgtaacgaaaattgcggaggcatggacccaatccctgtcgagcagctgattccatacgtagaagaggatgggagtaagaatgacgaccgtgcaggacctccccggtttgcctccgaagaaaggcgcgagatcgctgaagttaacaaaaaactcaagcaaaagaatcagcagctgaagcaaattatggaccagctgcggaacttgatatgggacatcaacgctatgctggccatgcggaattag

SEQ ID NO: 194473 - DNA, 813 bp, Artificial Sequence
  Description of Artificial Sequence: Synthetic coding sequence
atggccgccagcagcagcggcgagaaggagaaggagcggctgggcggaggcctcggagtggcaggcggaaactccaccagagaaagactactgtcggctctcgaggatctcgaggtgctctccagggagctcatcgagatgttagctatctcccgtaatcagaagctgttacaagccggagaggagaaccaggtcctcgaattgctcattcacagggatggcgagttccaggaactaatgaagcttgcactaaaccagggaaaaatccaccatgaaatgcaggtgctcgagaaagaggtggaaaaacgagactccgacattcagcagctccaaaagcagctgaaggaggctgaacagattctcgccactgctgtctatcaggccaaagagaagctaaagtcaatcgagaaagcaaggaaaggagcaatcagctccgaagagatcattaagtatgctcaccgcataagcgcgagcaatgccgtctgcgctcctctgacttgggttcctggcgacccccgccggccctaccctacggacctggagatgcggtcgggactactcggtcagatgaacaatccctctaccaatggagtcaatgggcatctccctggcgacgctctcgctgccggccgacttcccgatgtgctggcaccccagtatccgtggcagtctaacgatatgagtatgaacatgctgcccccaaatcatagcagtgacttcctcctggagccccctggccataataaggaaaatgaagatgatgtggagataatgagtaccgattcttcttcttctagcagcgaatctgactag

SEQ ID NO: 194474 - DNA, 675 bp, Artificial Sequence
  Description of Artificial Sequence: Synthetic coding sequence
atgctggccatcagccggaaccagaagctgctgcaggccggcgaggagaaccaggtgctcgaattattaatccacagagacggggagttccaggaactcatgaaacttgctctgaatcaaggtaaaatccatcacgaaatgcaagtgctggaaaaggaagtggaaaagcgtgactcggatattcagcagctgcagaagcagctgaaggaggccgaacagatcctcgcgacggcagtctaccaggctaaggagaagcttaagtcgatcgagaaagccaggaagggagccattagcagtgaggagatcattaagtatgctcataggatcagcgcctctaacgctgtatgtgcacctctcacgtgggtgcctggagacccgaggcgcccctatcccactgacctggaaatgcggtccgggcttttgggccagatgaataatccctctaccaacggcgtcaacggccacctgccaggggatgccttggcagcgggtaggctacccgacgttttggccccgcagtacccttggcagagcaatgatatgagcatgaatatgctgcctcccaatcactcatcagatttcctgttggaaccaccaggtcacaacaaggaaaacgaagatgatgtcgaaatcatgtcaaccgactctagttcctctagttcagagtccgactag

SEQ ID NO: 194475 - DNA, 747 bp, Artificial Sequence
  Description of Artificial Sequence: Synthetic coding sequence
atgaagctgctgtggtggtgcgactggctgcccgagcggagccacgtgttcacccagagagagctgatcgagatgttggccatttctcggaaccagaagctgctacaagcgggtgaagaaaatcaggtgctcgagcttctgattcaccgagatggtgagtttcaagagttgatgaaactggccctgaaccaggggaaaattcaccacgaaatgcaggtgctggagaaggaagttgagaaaagagactccgacatccagcagctccagaagcaactcaaggaagccgagcagatactggctacggcggtataccaggccaaggaaaaattgaagagcatcgaaaaggccaggaaaggtgcaatttcctccgaagaaatcatcaagtacgctcacaggatctctgccagcaacgctgtttgcgcgcccctgacttgggtgccaggtgaccctagacgcccataccccaccgatctggaaatgagaagcggtctgctagggcaaatgaacaacccatctacaaatggcgtaaatggtcatcttccgggggacgcccttgccgctggcaggcttccggatgtcttagcccctcagtatccctggcagtctaatgatatgtccatgaatatgctaccccccaaccattcgagcgactttctgctggagccaccaggccacaataaggagaacgaggacgacgtggagatcatgtccacagatagtagctcgtcctcatcggagagcgactag

SEQ ID NO: 194476 - DNA, 717 bp, Artificial Sequence
  Description of Artificial Sequence: Synthetic coding sequence
atgaagctgctgtggtggtgcgactggctgcccgagcggagccacgtctttactcagcgcgagctcatagagatgctagccatcagtcgtaaccagaaactgctgcaagcaggagaggaaaaccaagtgttggagctcctgatccaccgtgacggggaattccaggagctgatgaagctcgccctcaaccagggaaagattcaccacgaaatgcaagtcctggagaaggaagtcgagaagcgcgactctgacattcagcagctacagaaacaactgaaggaagccgagcagatcctggccactgccgtgtatcaggccaaggaaaaactaaagtcaatcgaaaaagcgcgcaaaggagctatctctagcgaagagatcattaagtatgcacaccggatttctgcctcaaacgcagtctgcgcacctcttacatgggtgccgggagatcctaggcgcccttatcccacggatcttgagatgcggtcagggttactcgggcagatgaacaacccaagcacgaacggtgtgaatggccatctgcctggggatgctttggcagccgggaggcttcccgacgtgctcgctccacagtatccgtggcagtcaaatgacatgagtatgaacatgttgccacctaaccacagctccgatttcctcctcgagccccccgggcataataaagagaacgaagatgatgtcgagattatgagtacatag

SEQ ID NO: 194477 - DNA, 702 bp, Artificial Sequence
  Description of Artificial Sequence: Synthetic coding sequence
atgggcgagccccagcaggtgagcgccctgccccccccccccatgcagtacatcaaagagtataccgacgagaatattcaggaggggctggcacccaaaccacctccgcccatcaaagattcatatatgatgttcggcaatcagtttcaatgtgacgacctgatcattagacccctggagagtcagggcatagagcggctccaccccatgcaatttgaccataaaaaagaattgcgaaagctgaatatgagtattcttatcaactttttggacctgctcgatatacttatacgcagtcccgggagcatcaagcgcgaggaaaagctagaggatctgaagttactcttcgtgcatgtgcaccatctgataaacgagtatagaccccatcaggcacgagaaaccctccgcgttatgatggaggtacaaaaaaggcagcgcctggagaccgcggagcggttccagaaacatcttgaaagggtgatcgagatgattcagaactgtttggcttcgttacccgacgacctaccacactctgaggctggaatgcgcgtcaagacggagcctatggacgccgatgatagtaataactgtaccggccagaatgagcatcaaagggagaattcgggtcacaggcgtgaccagatcattgagaaagacgcagctctgtgtgtacttatagatgagatgaacgaaaggccttag

SEQ ID NO: 194478 - DNA, 702 bp, Artificial Sequence
  Description of Artificial Sequence: Synthetic coding sequence
atgggcgagccccagcaggtgagcgccctgccccccccccccatgcagtacataaaagagtacaccgacgaaaatatacaggaagggctggcccctaagccccctccacccatcaaagatagctatatgatgttcgggaatcaatttcagtgcgatgacctcatcattcgtcctttggaatcccagggcatagagcgactgcacccgatgcagtttgatcacaagaaggagctccgaaagctgaacatgagcatactcattaacttcttggacttactggatatcctgatccgctccccaggctcaatcaaaagagaagagaaattggaggacctgaaactcctgtttgtccacgtgcaccacctcattaacgagtatcgaccccaccaggccagggagaccctccgcgtgatgatggaagtgcagaagcgccagaggttggagactgccgagagatttcaaaagcacctggagagagtcattgaaatgatacagaactgcctggcttcactgcctgatgacctaccccactcggaggcgggaatgcgtgttaagacggagccaatggatgccgacgatagcaataactgcacaggtcagaatgagcaccagcgagagaattcaggtcatcgccgagaccaaattatagaaaaagatgctgcactctgcgtgctgatcgatgagatgaacgaaagaccttag

SEQ ID NO: 194479 - DNA, 588 bp, Artificial Sequence
  Description of Artificial Sequence: Synthetic coding sequence
atgggcgagccccagcaggtgagcgccctgccccccccccccatgcagtatattaaggagtatactgatgagaacattcaggaggggttagcccctaagccaccgccaccaatcaaagattcatacatgatgtttggtaatcagttccagtgcgacgacttgattattcgacctctggaaagtcagggcatcgagagactccaccccatgcagttcgaccacaagaaggaattacgcaagttgaacatgtcaatactcataaatttcttagatcttcttgacattctgatccgctctcctggttccatcaagcgagaagagaagctggaggacctgaaactgctgtttgttcatgtccaccacctcatcaacgaatacagaccacaccaggcacgcgaaacactgcgcgttatgatggaggtacaaaaacggcagcgcctcgaaacggccgagaggtttcagaagcaccttgaacgggtcatagagatgatccagaactgcttggctagtctgcctgacgatctgccccactcggaggccggcatgagagtgaaaacagagcccatggatgcagatgatagtaactag

SEQ ID NO: 194480 - DNA, 441 bp, Artificial Sequence
  Description of Artificial Sequence: Synthetic coding sequence
atggccagcgccggcgtggccgccggccggcaggccgaggacgtgctgccaccaacttccgaccagccactgcccgacacgaagcccctgcccccaccacagcctccgcccgttcctgcaccccagccccagcagtctcccgccccccgaccacaatcccccgctcgagcaagggaagaagaaaactactcatttctgccgctcgtgcacaatattataaagtgcatggacaaagactcaccagaggtgcaccaggacctgaacgctctgaaaagtaagtttcaggaaatgcggaaactgatatccacaatgcctggcatccacctttctccagagcagcagcagcagcagctccagtcacttagggaacaggtgcgtacgaaaaatgagctgttgcagaaatacaaatcactgtgtatgttcgagatccccaaggaatag

SEQ ID NO: 194481 - DNA, 894 bp, Artificial Sequence
  Description of Artificial Sequence: Synthetic coding sequence
atgagcaaccgggtggtgtgccgggaggccagccacgccggcagctggtacactgcaagcggccctcagcttaatgctcagttggagggttggctcagccaggttcagagcaccaagaggcctgctagggcaattattgcccctcacgcagggtatacgtattgcggcagctgcgctgcacacgcctataagcaagtggaccccagcataaccaggcgtatcttcattctcggccccagtcatcacgtgcctctcagcaggtgcgccctttcctcggtcgatatttatcgaacccctctgtatgatctgcgcatagaccagaagatctatggagagctctggaaaactggcatgttcgaaaggatgtcgctgcagactgatgaggacgagcattcaattgaaatgcatctgccatacaccgccaaagccatggaaagccacaaggatgaattcactatcatcccggttcttgtcggtgcgttgtccgaatctaaggagcaggagttcggaaagctgttttcaaagtacctggcagacccatctaacttgttcgtcgtgtcctctgacttctgccactggggccagcgcttccgctatagctactacgacgagtcccagggagaaatctaccgctctatagagcatctggataagatggggatgagcattatagaacaactggatcccgtgtctttttctaattatctcaagaagtaccacaatactatctgtggccgccatcccattggagtcctgctcaacgcaattacggagctgcagaagaatggtatgaatatgtccttttcttttctgaattacgcccagagctcccagtgtcgtaactggcaggattccagcgtgtcatatgccgcaggagctctcactgtgcactag

SEQ ID NO: 194482 - DNA, 903 bp, Artificial Sequence
  Description of Artificial Sequence: Synthetic coding sequence
atgcccctgtggcgggccgacaagtgccaggacgtgcagagcgcctcctggcgacccaggagggccgacggcccccagctgaatgcccagttagaagggtggctcagccaggtgcagagcaccaagcgccccgcccgggcaattattgcacctcacgccggctacacctactgcggatcttgtgccgcacacgcttacaaacaagtggatccatctatcactcggaggatatttattcttggccccagtcatcacgtgcccctgagccgctgtgcgctttcatccgtggacatttataggacccccttatatgacctccgcatcgaccagaaaatttatggagagttgtggaagacagggatgttcgaaaggatgagcctccagaccgacgaggacgaacattccatcgaaatgcatctgccatataccgccaaggctatggagtcccacaaggacgagttcacaatcataccagttctcgtgggggccctctccgaatctaaggagcaagaatttggcaaattgttttcaaagtatctcgccgatccttctaatttgtttgttgtatcttcagacttctgtcactggggccagcgatttcggtattcctactatgatgagagtcaaggagaaatttatcggagcatagagcatcttgataaaatgggaatgtcaattatagagcagctcgacccggtgtctttttccaactatttgaagaaatatcataacacaatttgtgggcggcatcctataggcgtactcctgaacgccattactgaactgcaaaaaaatggcatgaatatgagtttttccttcctcaattatgcccagtcaagtcaatgccggaactggcaggacagcagtgtgtcttacgctgccggcgctcttactgtgcattag

SEQ ID NO: 194483 - DNA, 894 bp, Artificial Sequence
  Description of Artificial Sequence: Synthetic coding sequence
atgagcaaccgggtggtgtgccgggaggccagccacgccggcagctggtacaccgcatccggaccccaactcaatgctcagctggaaggttggctctcccaggtgcagtctacaaaacgccccgcaagggcaattatagccccgcatgccggctatacgtactgcggctcttgtgccgctcatgcatataaacaggtcgaccccagtataactagacgcatctttattctaggaccctcccaccacgtccccctttctagatgtgcattaagctccgtcgacatctatcgaaccccactttatgatctgcgtatcgaccagaaaatttacggagaactgtggaagacaggcatgttcgaaaggatgtccctgcaaaccgatgaagatgagcacagtatcgagatgcacttaccatacactgctaaagctatggagtctcacaaagacgaattcaccattatcccagttctggtgggcgcccttagcgagtctaaggaacaggaattcggtaaacttttttccaaatacctcgccgatcctagcaacctgttcgtcgttagctccgatttttgccactggggacagcggtttcgctatagctattatgatgaatcccagggggagatctatcgcagcatcgaacacttggacaagatgggtatgtctatcatcgagcagctggatccagtaagtttttcgaactatcttaaaaaataccacaataccatttgcgggaggcacccaattggcgttctgctaaacgccatcaccgaactgcagaaaaacggcatgaacatgtcgttttcgtttctgaattatgctcaaagcagccagtgtcggaactggcaggattcttctgtcagctacgccgctggcgctttgacagtccattag

SEQ ID NO: 194484 - DNA, 825 bp, Artificial Sequence
  Description of Artificial Sequence: Synthetic coding sequence
atgagcaaccgggtggtgtgccgggaggccagccacgccggcagctggtacacagccagtggaccccaactgaacgctcagctggagggctggctgtctcaggtgcagtccacgaaacgtcctgcgagggccatcatagcaccacgacgcatctttatcctcggaccttcccatcacgtcccactgagtaggtgcgctttgtcatcagttgatatttacaggacacctttatatgacttgcgcatcgatcagaagatatatggtgaactgtggaagactggaatgtttgagagaatgtctctgcaaactgacgaggacgagcactctattgagatgcacctgccttacacagcaaaagctatggagtcgcacaaagatgagttcacgatcatacccgtgctagtgggggccctgtctgagtccaaggaacaggaattcgggaagttgttctcaaagtatcttgcagatccgtcaaacctgttcgtggtgagctctgacttctgccactggggccagaggttccggtattcgtattatgacgagagccagggtgagatatatcgatcaattgagcacttagataaaatggggatgagcatcatcgaacagctcgatccggtgtcattcagcaattatctaaaaaagtatcataataccatttgcgggcgtcaccctattggagtcctacttaatgctattaccgagctgcaaaaaaacggtatgaacatgtcatttagcttcctgaactatgcacagagttcccagtgccgcaactggcaggattcctctgttagctacgcggcaggggctcttaccgtccactag

SEQ ID NO: 194485 - DNA, 63 bp, Artificial Sequence
  Description of Artificial Sequence: Synthetic coding sequence
atgagcaaccgggtggtgtgccgggaggccagccacgccggcagctggtacacagcgagttag

SEQ ID NO: 194486 - DNA, 5478 bp, Artificial Sequence
  Description of Artificial Sequence: Synthetic coding sequence
atggaggacacccaggccatcgactgggacgtggaggaggaggaggagactgaacaatccagcgagtctttaagatgcaatgtggaacccgtgggaagattacacatcttcagtggtgcacatggccctgaaaaagacttcccattacacctgggaaagaacgtggtcgggagaatgccggattgctctgtggcactaccttttccgagcatttcaaagcagcacgcagagatcgagattctggcctgggacaaggctcccattttgcgggattgcgggtctctgaacggcacccaaattctgcgacctccaaaggtcctctcacccggcgtatcgcaccggctgcgagatcaagagctgattttgttcgccgatttgctttgccagtatcacaggctcgatgtctcactcccctttgtaagtcgcgggcccctcacagtcgaggagaccccaagggttcaaggggaaacacagcctcagcgtttactgcttgcagaggacagcgaggaagaagtcgatttcctcagtgagaggcggatggtgaagaaatctcggactaccagctcctccgtaatcgttccagagagcgatgaagaaggacatagcccagtcctaggcgggctgggacccccctttgctttcaacctaaattccgacaccgacgtggaggaggggcagcaacccgccactgaagaagccagctcggccgcccgccgtggcgccacagtggaggcgaaacagagcgaagccgaggtcgttactgagattcagctcgagaaggaccagcccctggttaaggaacgagacaacgataccaaggtcaagaggggggctgggaacggagtggtgcccgctggcgttatcctggagcgttcacagccccctggcgaggattctgatactgacgtcgacgacgactcccgccctcccgggcgacccgcagaagtacacttagaaagagcccagccgttcggattcatagactcagataccgacgctgaagaggaacgtatcccagcaacacccgtggtcatccccatgaagaagcgtaaaatcttccacggggtcggcacacgaggacccggggccccgggtttggcccacctacaggagtcacaggccggttccgatactgacgttgaggaaggaaaagcacctcaggctgtccccctggaaaagtctcaggcgtctatggttataaacagcgacactgacgacgaggaggaggtgagtgccgccctgacactggcccaccttaaagaatctcagcccgctatttggaatagagatgcagaggaagacatgcctcaacgcgttgtgctcctccagcgctcacagaccaccaccgagagggacagtgatacagacgtggaggaggaggagctccctgtggagaaccgtgaagccgtgttaaaggaccataccaaaattagggccctggtgcgcgcgcacagtgagaaggaccagcccccattcggggatagcgatgacagcgtggaagctgacaaaagttcacccggtatacacttagaacgatcacaggcatctacaacggttgatataaatacccaggtggagaaggaggtgcccccggggtccgcaatcattcatattaaaaagcaccaggtctccgttgagggaacaaatcagacagacgtaaaggccgtcggcggccccgccaagctgctcgtggtcagtctcgaagaagcttggcccctgcatggcgactgcgagaccgacgctgaagaaggaacctcgctgacggcctcagtggtcgctgacgttaggaaatcacagctacctgctgaaggagatgccggagctgagtgggccgcagccgtacttaagcaggaaagggctcacgaagtcggagcccagggcggtccccccgtcgcccaggtcgagcaagatctacctatctccagggagaacctcacggacctggtagtcgatacagacacactgggggagtctactcaaccccagagggaaggagcccaagttcctacaggacgggagagagagcagcacgtgggcgggactaaggatagtgaagataactatggagacagcgaggacctcgacctgcaggccacccagtgcttccttgaaaaccagggcttggaggctgttcaatccatggaggacgaacctacccaagcatttatgctgactccgccccaggagttaggccccagtcactgcagttttcagaccaccggccttcttaactgcaaaatgccccccgccgagaaggcttcacggattagagctgccgaaaaagttagtcgaggagatcaagagagcccggacgcctgtctgcctcccacagtccctgaggctcccgctccccctcagaagcccttgaacagccagtcgcagaaacacctggccccgcccccgcttctgtcacccctgctcccgagcattaaaccgacagtccgcaagactagacaagacggcagtcaggaagcacccgaagcccctttgagctccgagttggaaccattccacccaaagcccaaaattcggacacgcaagtctagcagaatgacaccgttccctgccacctcagcagctcccgagccccacccttctacctccaccgctcaacctgtcacccctaaaccaaccagccaggcaacacgaagccgaacaaacaggtcatccgtgaaaacccctgaaccggttgtccctaccgcccctgaactccagccatctacttccaccgaccagccagtcacatctgagccgacatctcaggtgacgcgcggaaggaagtcccgctcttcagtgaagactcctgaaactgttgtgccaactgctttggagctacagcccagcacatctactgaccgtcctgtgacaagcgaaccgacctcacaagctactcgcggaaggaagaacagaagctcggtcaagacccctgagccagtcgtccctacagctcctgaattgcaacctagcacatctacagatcagccagtgacatctgaacctacgtatcaagccaccagggggcgcaagaatcgaagcagcgtaaaaaccccagagcccgtggtgccaacagcaccagaattgagaccgtctactagcaccgaccgaccagtcacccccaaaccaactagtagaaccactcgttctaggaccaacatgtcatccgtcaaaacacctgaaacggtcgtgcctacagcccctgagctgcagatctcaacctctacggatcagcctgtcactccaaaaccaacctcaaggaccacaagatcaaggacgaatatgtctagcgttaaaaaccccgagtccacagttcctattgctcctgagctgcctccctctaccagcacggagcagccggtaaccccagaacccacatcccgtgcaacgaggggtaggaagaacagatcttcaggcaaaaccccagagacgctggtgcctactgcccctaagctggagcctagtacatcaactgaccaacccgtgactccagagccgacctcacaggccacacggggaagaacgaacagatcaagcgtgaaaactcctgagaccgttgttcccaccgctcccgagttacagccttccacctctacggaccaacctgtcacacccgagcccacgtctcaagctactcgtggaagaactgaccggtcctcagtcaaaactcctgaaacagtggtacctaccgcgccagagctccaagcctcggccagcaccgaccagccagttacctcagaacctacaagtcggacaacaagaggccggaaaaataggtcttctgtgaagacccctgaaacggtggttccagctgccccggaactccagcccagtacgagcactgatcagcccgttacccctgagccaacatcgcgcgctacgagggggcgcacgaaccgaagctcagtgaagactccagagtcaattgtgcccatcgcaccagagttgcagccgagcacctcaaggaatcaactggtgaccccagagcctacctcaagggccacgaggtgccgaaccaatcggtctagtgtgaaaacacctgaacctgtggtgccaacagcacctgaaccccatccgaccacaagtaccgaccagccagtcacaccaaagctgacctctcgcgctacccgacggaaaaccaatcggtccagtgtcaagactcccaagccggtggagcccgcagcttctgatctcgaaccattcactcctaccgaccagagcgtcacccctgaggccatcgcccaaggtggtcagtccaagaccctgcgctcttccacggtgagagccatgcccgtccctacaacaccggaattccagagtcctgttaccaccgatcagccgatttcccccgaaccaatcacacagccctcttgtattaaacgccagagggctgctgggaatcccgggtcacttgctgcccccatagaccacaagccttgctccgccccacttgaaccgaaatctcaggcaagtagaaatcagaggtggggtgccgtcagagctgccgagtccctcactgccatccccgaacccgcatcccctcagctgttggagacacccatccacgcctcgcaaattcaaaaggtggaacctgctggtaggtcccgttttacacccgagctgcaacctaaggccagccagagccgaaaacgttccctggctaccatggacagtccaccacaccagaagcagcctcagcggggcgaggtgtctcagaagactgtgatcattaaagaggaagaggaggataccgccgaaaaacccgggaaggaagaagacgtggtgacacctaaaccaggaaaaaggaagagggatcaggccgaggaagaacctaaccgtataccgagtaggagtctgcggaggactaaactgaatcaagaaagcacagcacccaaagtgctgtttaccggcgtagttgatgctaggggcgaacgtgctgtgctggctctcggcggcagtctggcgggatctgcggctgaggcttctcacttggttaccgaccggatcagaaggacagtgaagttcctgtgtgcgctcggacgaggaattcccatcttaagcctggattggctgcaccagagtaggaaggccgggttctttctacccccagacgaatacgtggtgactgacccggagcaagagaagaattttgggtttagtttgcaggacgcactatcacgcgcgcgcgagcgcaggctgctggagggatacgaaatctatgtgacacctggcgttcagccaccacccccacagatgggggaaatcatatcctgttgtggggggacatacctgccctctatgcccaggtcatataagccgcagagagtggttataacatgcccccaagacttccctcactgtagcatacctctcagagttggcctgcccctcttgtctccagagtttctgctgactggtgtccttaagcaggaggccaaacccgaggcctttgttctgagcccactggagatgtcctctacatag

SEQ ID NO: 194487 - DNA, 6270 bp, Artificial Sequence
  Description of Artificial Sequence: Synthetic coding sequence
atggaggacacccaggccatcgactgggacgtggaggaggaggaggagacggaacagtcaagcgagtcacttcgttgcaatgtcgagcctgtgggacgcctccacatattttctggagcacatgggcctgagaaggacttcccactccacctgggtaaaaatgtggtggggagaatgcctgactgttccgtcgctcttccgttcccttccatctctaaacagcatgctgaaatagagattctggcatgggataaggcccccattttgagagattgcgggtctctgaacggaacgcagatcctgcgacccccaaaggtgctttcccccggtgtgagccacagactcagagaccaggagctgatcctcttcgcagatcttttgtgccagtaccaccgcctggacgtctccctcccctttgtttccaggggccccctgaccgtggaagagactccaagagtgcagggagaaacccaaccccagagactcttgctggcggaggattcagaggaggaagtagattttctgtcagaacgccgcatggtcaagaagagtaggacaaccagctcctcagttattgtgccagagagcgatgaggaaggccattcgccagtgctgggggggttgggtccaccctttgccttcaatctcaattccgatacagatgtcgaagagggccagcagccagcaacggaagaagccagctctgctgcgagacgcggagctaccgtggaagcgaaacagagcgaggccgaggtcgtaacggaaattcagctggagaaggaccagcccttggttaaagagcgagataatgatacaaaggtcaagcgcggcgctggcaacggggtcgtgccggcgggcgtgatcctggagaggagtcaacctccaggcgaagactccgatactgatgtagatgatgactctaggcctcctgggaggcctgcagaagtccacttggagcgtgcccaaccctttggttttatcgattccgacacggacgccgaggaggaaaggatacctgcgacgcccgtggtgattccaatgaaaaagcgcaaaatttttcacggggtgggtactaggggacctggagccccgggattagctcacctgcaggagagtcaggccggatctgacaccgacgttgaagaaggaaaagcacctcaggcggtccctctcgagaagtctcaagctagtatggtcattaattcagatacagacgacgaagaagaagtctctgcggctctgactctcgcccaccttaaggagtcccagccagcaatatggaacagggatgccgaggaagacatgccacagagggtggttctgcttcaaagatctcagactaccactgaaagggatagcgatacagacgtagaggaggaggaactgccagtggagaacagagaggccgtgttgaaggatcacacaaagattagggctttggtgcgcgcccattcagagaaggaccagcccccatttggggactcagatgacagcgtggaagccgacaaatcgagtccgggaatccacctagagcgctcccaagcctctactactgtggatatcaacacccaggtcgagaaagaagtgcctccagggtcagcaattattcacatcaagaaacatcaggtgtcagttgaaggcacaaaccagaccgatgtcaaagctgttggcggcccagccaaattacttgtggtgtcccttgaagaggcctggcctctgcatggtgattgtgagactgacgccgaagagggaacatcccttactgcctccgtggtcgcagacgtcagaaagtctcagctgcccgccgaaggggatgctggtgccgaatgggcagctgccgttttgaagcaggaacgtgcccatgaggtgggagctcagggcggcccccctgttgcccaggtggagcaggatctcccaatcagccgcgaaaatttaacagatctagtcgtggacactgatacactgggcgaaagcacccagccccagcgggagggcgcgcaagttcccactggcagagaacgtgagcagcatgtgggcggcacaaaggacagcgaagataactacggagattctgaggatctcgatttgcaggccacccagtgctttctggaaaaccaaggcctcgaagccgtgcagtctatggaggatgaacccacacaggcattcatgctaacaccaccccaggagctgggtcctagccattgctcatttcagactactggtacgctggatgagccatgggaggtgctcgccactcagcctttttgcctgcgcgagagcgaggattccgagacacagccattcgacacgcatttggaggcatacggcccatgcctctcccctccacgcgccatcccaggagaccagcatccagaaagccctgtccatacggaaccaatgggtattcaaggcaggggtcggcagacggtcgacaaggtgatgggtatacctaaagaaaccgctgaaagggtgggacccgaaagagggccactggaacgcgagaccgagaaattgctgcccgaacgacaaacggacgtgaccggagaggaggagctcacaaaaggcaagcaggaccgagagcaaaagcagctcctggccagagacacccagagacaggagtccgacaagaatggcgagtctgcttcacccgaaagagatcgcgaatccctgaaggtagaaatcgagaccagcgaagagattcaggagaagcaggtccaaaagcagacactgccgagcaaagcttttgagcgcgaggtggagcgaccagttgcaaaccgcgaatgtgacccagcagaactggaggagaaggtgccaaaagtgattctggagcgagatacacagcggggagaaccagaaggcggctcccaggaccaaaaaggccaggccagcagtcccacaccagagcccggcgtaggcgcaggcgacctgcctggccctacctccgctccagttccttcaggctcccagtctggggggaggggctcacccgtgagtcctcgccggcatcagaagggcctcttaaactgcaagatgccgccagccgagaaggcctccagaatccgggcagccgaaaaagtgagtcgaggcgaccaggagtctccagatgcctgtctgcctccaacagtacccgaggctcccgctcccccccagaaaccgctgaactcccagtcccaaaaacatctggccccaccacctctgctgtctccactcctgccatcaataaaacccaccgtacgaaagaccaggcaggatggttcccaagaggcgcctgaggctcccctgtcctcagaactggaacccttccacccgaagcctaagattagaaccagaaaaagctctaggatgacccctttccccgcaactagtgccgccccagaaccccacccatccacttccaccgcccagccagtcacaccaaagccaacatctcaggccacacggagccggaccaatcggtcatcagtgaagacgcccgagccggtagtccctactgctcctgagcttcagccttccaccagcaccgatcagccagtgacatcagaacccacttctcaggtgacgagggggcggaaaagtcgttcatctgttaagacaccggagaccgttgttcccaccgctctagagcttcagccctcaacaagcacggatcgccccgtgacttctgaaccaaccagtcaggctacccggggcagaaaaaatcgctcctccgtgaagaccccggagcctgtggtccctactgctccggaattgcagccgtccacatccactgaccagccagtcacctctgagccaacgtaccaagcaaccagagggaggaaaaaccgcagctccgtgaagaccccggagcccgtggtgccgacagctcccgagcttcgaccaagcacatccaccgaccgccctgttacacctaaacccacttcacggacaacgagaagtcgaacaaatatgtcttcggtgaaaacaccagaaacagtagtacccacagcacccgagctgcagattagtacctccactgaccagcccgttacgcctaaacccacctctagaaccaccaggtcccggaccaacatgtcatcagtgaagaaccctgaaagtaccgtgccgatcgcacccgagctccccccctctacctcgactgaacagcctgtcacgccagaaccaacctctcgggccacccggggcagaaaaaataggagttctgggaagactcctgaaaccttggtacccaccgctcccaagctggagccaagcacctctaccgatcagcccgttaccccagagccgacttcccaagctacaagggggagaacaaatagaagctcagtaaaaacccccgagaccgtggtccctaccgcccctgagctccagcccagtaccagtaccgaccaaccagtgactcccgaaccaaccagccaggccacccgcggcagaaccgataggtcctcggtcaaaacccctgagacagtggtccccaccgctccggaactccaggcatccgcaagcaccgaccagccagtcacatcagagcctacatcgagaacaactagggggagaaagaaccgtagctctgtcaagactccagagactgttgttcctgccgcccctgaattgcaaccttctacaagtaccgatcagcccgtgactcccgagcctacgtcgagagccaccaggggacggaccaatcgaagcagcgtcaaaacacctgagtctattgtgccaattgctccggagctgcagccatcaacgagcagaaatcagctggtcacccccgaacccacttcccgcgcaacccggtgtcggacaaaccggagcagtgtgaagacgccagagcccgtggtgcccaccgcccctgaacctcaccctacaacatctacagatcagcctgtgacccctaagctgacatcccgggccacgaggcgtaagactaaccgctccagcgttaagacgcccaaaccagttgaaccagcagcaagtgacctggaaccttttacacctacagaccagagtgtaactccagaagcaattgcccagggggggcagagcaagaccctccgtagctccacggtacgagccatgccagtgcccaccacgcccgagtttcagtcccccgttactactgaccaaccaatttccccggagccaatcacacaacctagttgcataaagcgccagagagctgcaggcaatcctggatcgctggccgcacccattgaccacaaaccgtgctcggcacccctggagcccaaatcacaagccagtcgtaaccagcggtggggtgctgttagagcggctgagtccttgactgcaatccccgagcctgcttccccccagttgttggagactccaattcacgccagtcagatccagaaagtcgaacccgccggtcgctccaggtttacccctgagctacagccaaaggcctcgcagtctagaaaaagatctctcgcaacaatggattccccaccacaccaaaagcaacctcagcggggggaggtgagccagaagaccgttattatcaaggaggaggaggaagacacagccgagaagccaggcaaggaggaggatgttgtgacaccgaagcctgggaagagaaaacgagatcaggctgaggaagagcctaacagaataccctcccgttctttgaggcggaccaaacttaatcaagagtctaccgcacccaaggttttgttcacaggcgtggtcgatgcaaggggggagcgagcagtgttggctctcggaggcagcctcgccgggagtgccgctgaggcttcccacctggtcaccgatcggatccggcgcacagtcaagttcctatgcgctttaggtagagggataccaatcctttccttggattggttgcaccagagtagaaaggcaggcttctttctgcctccagatgagtatgtggtgaccgaccccgaacaggaaaaaaacttcggcttctcactccaggacgctttgagccgggctagagagagacggctcctggaagggtatgagatctacgtgaccccaggagtccaaccccctccacctcagatgggtgaaatcatctcctgttgcgggggcacgtacctgcccagcatgccaaggagctacaagccacagagggtcgtaatcacctgtccccaggatttcccgcattgttctattcctctccgcgtgggactgcctctgctatctccggaatttctgctgactggagtccttaaacaggaagcaaagcccgaagcctttgtactgagtcccctggagatgtcaagtacatag

SEQ ID NO: 194488 - DNA, 489 bp, Artificial Sequence
  Description of Artificial Sequence: Synthetic coding sequence
atggaggacacccaggccatcgactgggacgtggaggaggaggaggaaaccgagcagtcatcagagtctctgcggtgtaatgttgagcccgttggccggttacatatttttagcggggcgcatgggcctgagaaggattttcctctacacctgggcaagaatgtggtggggaggatgcctgactgttcggtcgcactgccgttcccttctattagtaagcagcatgctgaaatcgaaattctcgcatgggacaaagcccctatcttacgggattgtggctcactgaacggcacccaaatccttcggcccccaaaagttctcagccctggcgtgagtcatcgattacgggaccaggagctcattttgtttgccgaccttctgtgccagtaccatcggctcgatgttagcctgcctttcgtgagtagaggacctttaaccgtcgaagagacccccagagttcagggggaaacacagcctcagagattgtag

SEQ ID NO: 194489 - DNA, 342 bp, Artificial Sequence
  Description of Artificial Sequence: Synthetic coding sequence
atggaggacacccaggccatcgactgggacgtggaggaggaggaggagactgagcagtctagcgagagtctgcggtgtaatgtggagccagtaggtcggctccacatattcagcggggcccatggtcccgaaaaagacttcccacttcatttgggaaaaaatgtcgttggcaggatgcccgattgctcagtagctctgcccttcccatcaatttcaaagcaacacgccgaaatagagatcctggcttgggacaaggcacccatcctgcgcgattgtggatctttaaacggaactcagattctgaggcccccgaaggtcctttctcctggagtgagtcattag

SEQ ID NO: 194490 - DNA, 384 bp, Artificial Sequence
  Description of Artificial Sequence: Synthetic coding sequence
atggaggacacccaggccatcgactgggacgtggaggaggaggaggagacagagcagtcctctgagtctctgaggtgcaatgtcgagcccgtgggcagactccacatcttttcgggcgcgcatggacccgaaaaagacttccccttgcacctaggcaagaatgtagtaggcaggatgccagattgttcagtggctctcccattcccctccatcagcaagcagcacgccgagatagagatcctggcttgggacaaagcgcctatcctaagggactgcggatcactcaatgggactcaaattctgcgcccacctaaagtgcttagccctggggtcagccacagacttagagaccaagagctcatcctgttcgcagatctgctgtag

SEQ ID NO: 194491 - DNA, 489 bp, Artificial Sequence
  Description of Artificial Sequence: Synthetic coding sequence
atggaggacacccaggccatcgactgggacgtggaggaggaggaggagaccgagcaatcgtctgaaagcctcaggtgcaatgtcgaaccagtaggaagattacatatcttctctggggcccacggcccggagaaagattttcccctgcacctcgggaagaacgtggtgggacgcatgcccgattgcagcgtcgccctacctttcccctcaatctcaaagcaacacgccgaaattgagatcttggcttgggataaggctcccatattgcgcgactgcgggagtttgaatgggacccaaatcctcaggccccctaaggtcctctctcccggggtgtctcaccgcctgagggatcaggagctgatcctcttcgccgacttgctgtgccagtaccatcgtctcgacgtgagcctgccattcgtgtctcgcggcccactaacagtggaagagacacccagggttcagggagaaactcagccccagaggctttag

SEQ ID NO: 194492 - DNA, 921 bp, Artificial Sequence
  Description of Artificial Sequence: Synthetic coding sequence
tgacacgtgggcggcaccaaggacagcgaggacaactacggcgactcggaagatcttgaccttcaggccacacagtgttttctggagaaccagggcctggaagccgtgcagtctatggaagacgagccaacacaggcctttatgctcacaccaccccaggagctgggaccctcacactgtagcttccagacaactggtctactgaactgtaaaatgcctcccgccgagaaggcaagcagaattagagctgctgaaaaagtctcccgaggcgaccaagagtcaccagacgcgtgtctgcctcctacagtccccgaggcaccagcacctccccagaagcctttaaacagtcaatctcagaagcacctcgccccgccccctctgctctcacccttgctgccctccattaagccaaccgtccgaaagactcggcaggatggaagccaggaggcacctgaagctccccttagtagcgaactcgagccttttcacccgaagccaaagattcgcacccgcaagagctcaaggatgacgcctttccccgccaccagcgcagcaccagaaccacacccttcaacgtccactgcacagcctgttactcccaaacccacctcgcaggcgacccgttcccgaaccaatagatcttcagtgaagactccagagcccgtggttcctacagctcctgagcttcagccatccacaagcacggaccagccggtgacaagcgagccaaccagtcaggtaacaaggggaagaaagagccggtccagcgtgaaaactcctgaaaccgttgtaccaactgccctggagctccaaccgtccacttccacggacagacccgttacaagcgagcccaccagccaggcaactcgtggtagaaagaataggagctccgtgaagacacctgaacctgtcgtgccatag

SEQ ID NO: 194493 - DNA, 384 bp, Artificial Sequence
  Description of Artificial Sequence: Synthetic coding sequence
atggaggacacccaggccatcgactgggacgtggaggaggaggaggaaacagagcagagctcagaaagccttagatgcaatgtggaacccgtcggaaggctgcacatcttctccggggcccacggccctgagaaggacttccccctccaccttggcaaaaacgtagttgggcggatgcctgattgcagtgtagcactgccattcccaagcataagtaagcagcacgcggaaattgagatccttgcatgggacaaggcccctatcctacgtgactgtggtagtttgaacggcacacagatcctgcggcccccgaaagtcctctcacctggcgtatcccatcgactgcgggaccaggaactgattttgttcgccgacctcctgtag

SEQ ID NO: 194494 - DNA, 921 bp, Artificial Sequence
  Description of Artificial Sequence: Synthetic coding sequence
tgacacgtgggcggcaccaaggacagcgaggacaactacggcgactctgaggacctcgatctacaggccacccagtgctttctggagaatcagggattagaggcagtgcagagcatggaagacgagccaacgcaggcgttcatgctcacgccaccccaagaactgggtccaagtcactgctcgttccagactactggacttttgaactgcaagatgcctccagccgagaaggcctccagaattagggccgcggagaaagtgtctcggggcgaccaggaatctcccgatgcctgcctgcctcccacagtacctgaagctccggctccacctcagaagcctctgaattctcaaagtcagaaacatctcgctccaccaccactactgtcccctctcctgccttccattaagccaacagtgcgcaagacaagacaggacggtagccaggaagcccccgaggcaccactttccagcgagctggagccttttcaccctaaaccaaagattcggactaggaaatctagcaggatgactcctttcccggctacctccgcagccccagaacctcacccctcaacttcaactgcccaaccagtgacccctaagcccacgtcccaggccactagatctagaaccaatcgctcctctgtaaagacgcccgagcccgtggtccctacagcgccggagctgcagccatccacaagtaccgatcagcctgtgacaagcgagccgacctcccaggttactagggggagaaaatcccggagctcagtgaaaacccccgaaaccgtggtgccaactgctctagaattgcaacccagtacaagtaccgaccgaccagttacatctgaacctacctcccaggccactagggggagaaagaaccggagttcagtcaagactcctgaaccggtggtaccctag

SEQ ID NO: 194495 - DNA, 921 bp, Artificial Sequence
  Description of Artificial Sequence: Synthetic coding sequence
tgacacgtgggcggcaccaaggacagcgaggacaactacggcgactcagaggatctggacctgcaggccacccagtgttttctcgaaaatcaggggctggaagccgtacagagcatggaagacgaacctacacaggccttcatgcttacccccccacaagagctcggaccctcacactgctcattccagacaaccggattactgaactgcaaaatgccaccagcagaaaaggcatcacgaattcgtgccgctgagaaagtgtccagaggggaccaggaaagccctgatgcttgcctcccccctaccgtacctgaagctccagcacccccccaaaaaccgctaaactctcagagccaaaaacacttggctcctccgccgctccttagccctctgctgcccagcatcaagcccaccgtgaggaaaacgaggcaggacgggtctcaggaagccccggaggcgcctctgtcatctgaactggaacccttccacccaaagccaaaaattagaactcgaaagtctagtagaatgacgcccttccctgccacttcggccgccccagaaccgcatcccagcacctctactgcccaacccgtaacacctaaaccaacatctcaggccaccagatcacgcactaaccggtcctcagttaaaacacctgaacctgtggttcctacagctcctgagctacagcctagtacttccaccgatcagcctgtgacaagcgagccaacatcccaggtcacccgggggcgcaagagcaggagtagcgtcaagacccctgaaaccgtcgttccaaccgccttggagctccagcccagcacatcgacagaccggccagtgacgtccgagcccacgtctcaagccacccgtggtagaaagaatcgctcatccgtgaaaacgcctgagccagtggttccatag

SEQ ID NO: 194496 - DNA, 6270 bp, Artificial Sequence
  Description of Artificial Sequence: Synthetic coding sequence
atggaggacacccaggccatcgactgggacgtggaggaggaggaggaaactgaacagtcctcagagtctctgaggtgcaatgtggaacccgtcgggcgtttgcatatcttctccggcgcacatggccccgagaaggattttcccttacacctgggcaagaatgtagtaggccgcatgccagattgttcagtggcgttaccctttcctagtatctcaaaacagcacgccgagattgaaatactagcatgggacaaggccccaattctgagggactgtggatccttgaatggaacacagatactgcgtccccctaaggtcttatctccaggggtttcccatagattacgggaccaggagctaatccttttcgccgacttactgtgtcagtatcacaggctggatgtcagtctgccttttgtatctcgcggccctctcactgttgaggagacacccagagtccagggtgagacccagccgcagcgtctgctattggctgaagacagcgaggaagaggtcgacttcttgtccgaaagaagaatggtgaaaaagtcgcgcaccacatcctccagtgttatcgtgcctgaatctgacgaagaagggcattcaccggtgctagggggcctgggtccacccttcgctttcaacctcaattctgacacagacgtggaggaagggcagcaaccagcaactgaggaagcgagtagtgcagcccggagaggtgccactgtggaagctaaacaatccgaggccgaggtagtgaccgagatccagctggagaaggatcagcccctcgtgaaggagcgggataatgacacaaaggtaaaacgcggggcaggaaatggcgtcgtcccggccggagtgattctcgagaggagccagcctcccggagaggactccgatacagatgttgacgatgactcaagacctcctggccggcccgccgaggtgcacctcgaacgcgctcaaccatttggatttatcgatagcgatacggacgctgaggaggagcggataccagcaacgccagtcgtcattccgatgaagaagcgaaagatctttcacggggtcggcacccgagggccaggggcacctgggctcgcgcacctccaggaatcccaagccgggtctgacacagacgtggaagaaggcaaggcgccacaggccgtgcccctggagaaatcacaggcgtccatggtgataaattccgacaccgatgacgaggaggaggtttccgccgctttgacattggcccacctgaaagaatcccaaccagccatatggaatcgggatgctgaggaagacatgccgcaaagagtggttctactacaaaggtctcaaacaacaactgaacgagatagtgacacagacgtcgaggaggaagaactgcccgtcgagaacagagaagctgtgctgaaagatcacactaagattagagctcttgtgagagcacattcggagaaagaccaacctccattcggggatagcgacgactctgtggaggccgacaaatcaagcccaggcattcacctggagaggtcacaggcctccactactgtcgatatcaatacccaggttgagaaagaggtgccacctgggtctgccataatacatattaagaaacaccaagtttccgttgaaggaacaaatcaaacagacgtgaaggcagtgggcggacccgctaaattgctagtggtcagtttagaggaggcctggcccctccacggcgattgcgaaacggacgctgaagagggcacctcacttactgcctccgtcgtggcagatgtgcggaaatcacagttacctgccgagggcgacgccggggctgagtgggcagccgccgtgttgaaacaggagcgcgctcacgaagtaggagcacaaggtggtccacccgtggcacaggttgaacaggacctgcctatcagtcgggagaatttgacagacctggtagtggataccgacacattgggtgagagcactcagcctcaacgggagggagcccaggtgcctacaggaagggaaagggagcaacacgtgggaggaaccaaagattcagaagataactacggagactccgaggatttggaccttcaggccacacaatgtttccttgaaaaccaggggctggaagccgtacagagtatggaggacgagccgacacaagcttttatgctcacacctccccaagaacttggaccatctcactgctccttccagacaaccggcacattggatgagccatgggaggtgttggctactcaaccattttgcctgcgcgagtccgaggactctgaaacccagccattcgacacacacctggaggcctatggaccctgcctctcgcctccacgggctattccaggggaccaacatcctgagtctccagttcacactgagccaatggggattcaggggcggggccgccagactgtggacaaggtcatggggatccccaaggagactgccgaacgggtgggaccggaacgaggccccctggaaagagaaaccgagaaactgcttcctgagcgtcaaacagatgtcaccggagaggaggaattgactaaaggcaagcaagatagggaacaaaagcagttattagccagggatacacaacggcaagagagcgacaagaatggggagtcggccagtccggaacgggatcgggaatctctgaaagtcgagattgaaacctcagaggaaattcaggaaaagcaagtgcaaaagcagactctcccctctaaggcatttgaaagggaggtggaacgccctgtcgcaaacagagagtgcgatcctgccgaactggaagaaaaagtgcccaaggtgattctcgagcgagacactcagcgtggagagccggaaggtgggtcccaagatcagaaagggcaggcgagttccccaactccagagcctggggtgggtgccggtgatctgccaggcccaacaagtgcacctgttcccagcggttcacagtctggggggcgggggagccccgtttctcctagaaggcaccagaaaggcctgttgaactgtaaaatgccccccgctgaaaaggccagtcggatacgggctgccgaaaaggtgagtcgaggcgatcaggaatcccccgacgcatgcctgccccccacagttccagaggctcccgccccaccgcagaagccccttaacagccagtcacagaagcatcttgctcctccgccattactgtctccattgttgccttccataaaaccaacagtgaggaagacacgccaggacggcagccaagaggccccagaggcccctctgagcagtgaactcgaaccttttcaccctaagccaaagattcgcacacgaaagtcttcaaggatgaccccattcccggccaccagcgccgcccccgaacctcatccgagtactagtactgctcagcctgtgacgcctaaacctactagccaggccaccaggagtcgaaccaatcgctcttccgtcaagacaccagagcccgtcgtgccgactgcccctgagctgcagccaagtacttcaacggatcagcccgtcactagcgaaccgacgtcacaggtgacacgaggtcgcaagagccgcagttctgtgaagacccccgaaaccgtagtacctactgccttggagctgcagccatctacctcgaccgatagacctgtgacatcagagcccacatctcaggccactagagggcgcaagaaccggagctccgttaagacaccagaacccgttgttccgaccgcacccgaactgcagccatccacctccactgatcagcctgtgacatctgaacctacataccaggctaccagggggcggaaaaacaggtcaagtgtgaaaacccctgagccggtggtccccactgcgcccgagttgcgcccgagcaccagcacagatcgacctgtcacccctaaacccacctcacggactacccggtcccgcactaatatgtctagcgttaaaacgcctgaaactgtagtccccactgcacccgagctccaaattagtacgtccaccgaccagccggtcactcccaagcccactagtcgcaccactcgttcacgcacaaatatgagtagcgtgaagaaccctgagtccacagtgccaattgcgcccgagctacccccctcaacatcaacagagcaaccagttactccggagccaacaagcagggcaacaagagggagaaagaacagatcgagtgggaaaacacccgagacactggtcccaacagctcctaagttggagccatccacctctacggaccagcccgtaacacctgagcctacttcgcaagctacccgcgggcggaccaatcggagttcagtcaaaacccccgagaccgtggtaccaactgcaccagaactgcagccttccacatccacagatcagccagtcacccctgagccaacctctcaggccactagagggaggacagaccgcagctccgtgaagactcctgaaacggttgtcccgacagctcccgaactacaggcaagcgcatcaacagaccaaccagtcacttccgagccaacgagtcgaactacacggggaagaaagaatcggtcttcggtcaagacccccgagacagtcgtaccggctgctcccgagttacaacccagcacaagcaccgatcagcccgtaacccctgagccgaccagccgagcgacaagagggagaacaaacaggtcctctgtcaaaaccccagaatccattgtgcctatcgcaccagaacttcagcctagcacttcaaggaatcagttggtgacccctgaacccaccagtcgggctactcggtgccgcaccaatagatccagtgtcaaaacccccgaacctgtggtcccaacggctccagagccccaccctactacatctacagatcagccagtgacccctaaacttacgagcagagctacaaggagaaaaaccaatcggtcttctgtcaaaactccaaaacctgttgagcctgcagcctccgacctggagccctttaccccaacggatcagtccgtgactcctgaggctattgcgcaggggggtcagtctaaaacgctgcgttcttctacagtccgggccatgcccgtgccaacaacaccagaattccagagcccagtgaccaccgatcagcctatcagcccggagcccattactcagccctcatgcattaagcggcagcgcgctgcaggaaatcccggctcactggcggctcctatcgaccataaaccttgctcagcaccactggaacctaagagccaggcttccaggaaccagcggtggggcgccgtccgagcagccgagagtctcacagcaatccctgaacctgctagcccacaactgctcgagacaccaatccacgcctctcagattcagaaagtggaaccagccggccggagcagattcacccccgaactacagcccaaagctagccaaagccgaaaacgcagcttggccactatggattcccctccccatcagaaacaaccccaacgcggggaagtgagccagaagacggtcatcatcaaggaggaggaagaggataccgctgaaaagcctggcaaagaagaggatgttgtgacacctaagcccggaaagcgcaagagagaccaggccgaagaggaaccaaacaggatcccaagtagaagtctcaggcgcactaagctgaatcaagagtcaacagcaccgaaggtgctgtttaccggggtggtagacgctcggggagaaagagctgtcctggcattgggaggcagccttgctggctcagccgctgaggcttctcatttggtgacagatcggatacgtcggactgtcaagttcctgtgtgccctcggcagaggtattcctattctctccttagactggttacaccaaagtagaaaggccgggtttttcctccctcctgacgaatacgtcgttactgacccagagcaggagaagaattttggattctctctgcaagacgcgctctcacgagctcgggaacgaagactcctggaaggatatgaaatatatgtcaccccaggagttcagcctccacctccccagatgggggagatcatcagctgttgtgggggcacatatctgcctagcatgcctagatcttataagccacaacgggtggtaatcacatgccctcaggacttcccccactgctcaatcccactgagggtggggttgcctctgctcagtcccgaatttttgctgacaggcgtgctgaaacaggaggcaaaaccggaggccttcgtgctgtcccccctggaaatgtcaagcacctag

SEQ ID NO: 194497 - DNA, 6270 bp, Artificial Sequence
  Description of Artificial Sequence: Synthetic coding sequence
atggaggacacccaggccatcgactgggacgtggaggaggaggaggagaccgaacaaagtagcgagtccctacggtgtaacgttgagcccgtgggccgcctacacattttctccggcgcacacggccccgagaaagactttcccctgcatcttggtaagaatgtggtgggccggatgcccgactgctctgtcgccctgccctttccctctatttccaaacagcacgctgagatcgagatccttgcctgggacaaagctcctattctgagagactgcggctccctgaacggtacacagatactgcgccctccaaaagtacttagcccaggggtgtctcacaggctgagagaccaagagctaatattattcgctgatttgctgtgtcagtaccaccggcttgatgtatctctaccttttgtgtcgcggggtcctctgaccgttgaggaaaccccgagagtgcagggggagactcagcctcagcgcttgctgctggccgaagactctgaagaagaggtggatttcctgtctgaacgacgcatggtgaagaagtctagaacgaccagcagttcagttattgtgccagaatccgacgaagaagggcactcccccgtcctgggcggcctcggtcctcccttcgcattcaacctgaactccgatactgatgttgaagaggggcagcagccagctaccgaagaagcctcctcagccgcccggcggggagcgacagtggaagcaaagcagagtgaggcagaagttgtaactgagatccaactggagaaggatcagcccctggtaaaggagcgggataatgacaccaaagtcaaaagaggagctggtaacggagtagtccccgccggggtcattcttgagaggtcccagccccccggagaggactctgatacggatgtggacgatgattcccggccgcctggccgccctgctgaggtccacttggaacgggcacagcccttcggtttcatcgatagtgatactgacgctgaggaggaaaggattcccgccacgcccgtggtaatccccatgaagaagcgcaaaatattccacggggtggggacccgtgggcctggtgcaccaggcttagctcatttgcaggaatctcaggccgggtctgacactgacgtggaggagggaaaggcaccacaggccgtaccgctggagaagtcgcaggcttccatggtgattaactccgacaccgatgacgaagaggaggtgagcgctgctctgaccctggcccacctcaaggagagccagccagccatatggaatagggatgcggaggaggatatgcctcaaagagttgtcttgttacagcggtcccaaacaaccactgagcgggacagtgatactgatgtcgaggaggaggagctgcccgtggagaacagggaggcggtgctcaaagatcacaccaaaatccgggccctggttagggctcactctgaaaaggaccaacccccttttggcgactctgatgattctgtggaggcagataagtcttccccaggaatccacctcgagagaagccaagcatctactacagtggatatcaacacccaggtggagaaagaggttccccctggatctgccatcatacacatcaaaaaacaccaagtgtccgtcgaaggcacgaatcaaacagatgtcaaagcagtcggaggccctgcaaaactccttgtggtgtcccttgaagaggcttggcctttgcacggggactgtgagacagatgctgaggagggtacaagcttgactgccagcgttgttgctgacgttaggaagtctcagttgccggctgaaggcgacgcaggtgcagagtgggccgccgcagtgttgaaacaggaacgcgctcatgaagtaggtgctcagggcggcccccctgtcgcacaggtcgaacaggacctcccaatcagcagggaaaatctgaccgacctcgtagttgacactgacactctaggagaaagcacccaacctcagcgggagggagcacaggtaccaacaggaagggagcgtgagcagcacgtcgggggaaccaaggactcagaggacaactatggtgacagtgaagacctggatctgcaggccactcaatgttttctggagaaccagggccttgaagctgttcagagcatggaggacgaacccacacaggcttttatgctcacccctccacaggaactggggcccagccactgctccttccagaccacggggactcttgacgagccttgggaggtcctggcaactcaacccttttgccttcgcgaatctgaggattcagaaactcaaccgtttgatacacacctcgaagcgtacggtccctgcctctcgccgcctcgcgctatccctggagatcaacatccggaaagccctgtccatactgagcctatgggaatccaggggcgggggagacaaacagtggacaaagtgatgggcatcccgaaggaaactgcagaacgggttggccctgaacgggggccgctagagcgggagactgaaaagctgctgcccgagagacagaccgatgtaacgggagaggaggagctgaccaaggggaagcaggatcgcgaacagaaacagcttttggcaagggacacccagcgtcaggaaagtgacaagaacggagaaagcgccagccctgaacgcgatcgggagagtcttaaagttgaaattgagacaagcgaggagatccaggaaaagcaggtgcagaaacagactctgccttcaaaggcttttgaacgagaggtggagagacccgtggccaaccgtgagtgtgaccctgccgagctggaagagaaagtccccaaagtgattttagaacgggacactcaaaggggagagccagagggcgggtcccaggatcagaaaggtcaagccagttcaccaacacctgaacccggcgtgggcgctggggatctccccggaccaacttccgctcctgtgccctcaggctcccagtctggcggccgtgggagccctgtgagtcctcgtagacaccaaaagggcctgctgaactgtaagatgccacccgctgagaaagcttctagaatacgcgccgcagaaaaagtgtccaggggagatcaggagtcccccgatgcatgtctgccccctactgtacccgaggcccctgcaccaccccaaaagcctctgaactcccagagccaaaagcacttggcacctccaccgttgctctcccccctgcttccgtccattaaaccaactgtgagaaaaactaggcaggatggatcacaggaggccccagaggctcctttgtcaagcgaattggaacctttccacccaaagcccaaaatcagaacccgcaagagttctcggatgaccccattccctgccacttctgcagcccccgagcctcaccctagcacctccaccgcacagcccgtgaccccaaagcctacttctcaagctacgcggagccggactaataggtcaagcgttaaaaccccagagccggtggtgcccaccgctcccgaactacaaccgagtacctcaacggaccaacccgtcaccagcgagcccacatcgcaggtgaccagagggagaaagagtcggtcctctgtaaagactccagagaccgtggtcccgacagcacttgaactgcagccttctacaagtacggaccggcccgttacgtcggagcccaccagccaggcaactcgaggccgaaagaataggagcagtgtaaagactccagaacccgtcgtaccaaccgcgcctgaactccagccaagtacctccaccgatcagccagtcacctcagaacccacatatcaggcaacacgcggaaggaaaaaccggagttccgtgaagactcccgagcccgtggtacccaccgcccccgaactaaggccctccactagcaccgaccgcccagtcacccctaaacctacatctcgtaccactcgatcacggacaaatatgtccagcgtcaaaaccccggaaactgtcgttccgacagcaccggaactccagatttcaacaagcacggaccaaccggttacacccaagcctacctccaggaccaccagatccagaacaaatatgagttcagtgaagaatcctgagtccacagttcctatcgctcctgaactgccaccgtctacatctactgaacaaccggtgaccccggaacctacaagccgggcgactagaggacgcaagaatcgctcttccggcaagacccccgagacccttgttccaacggctcccaaattagagccctctacatccaccgatcaacctgtgacacccgaaccgacatcacaggctacaaggggcaggaccaatcgctccagcgttaagactcctgaaacagtagttccgactgcccccgaactccagccctccacatccactgatcaacctgtaacaccagaaccgactagtcaggctacacgcgggcggacggacaggagcagcgttaaaaccccagaaactgtggtgcccacggctccagagctgcaagcgtccgccagtactgaccaacccgtcacaagtgaacctacatcccgaactaccaggggtagaaaaaatcgatcttcagtgaaaaccccagagacagtggtaccagccgctccagagttgcagcctagcacaagcacagaccagcctgtcactccagaacctacctccagagctaccaggggtcgaaccaacagatcttcagtcaagacacctgagtccatcgtgcctatagcgccagagctgcaaccctctacctctaggaaccagctagtcactcctgaaccaaccagcagagccacccggtgcaggactaatcgttctagcgttaagactcccgaacctgtcgtaccgacggcacctgagccacaccctacaacctccaccgatcagcctgttaccccgaaattgacaagcagagccaccaggcggaagactaatcggtctagcgtgaagactcccaagccggtagaaccagccgcctccgaccttgagcctttcacgccaacagaccaaagcgtgaccccagaagctatcgcccaagggggccagtcaaagaccctgcgatcgtctaccgtgcgcgccatgccagtacctactacaccggaattccagtcccctgttaccactgatcaacccatatccccagaacccatcacccagccatcttgcatcaagcggcagcgcgccgccggtaatcccggctccctggccgcacccatcgaccataagccatgctccgcaccactggagcccaagtcacaggcatctcgcaaccagaggtggggcgctgtcagagctgcagagtcattgacagccattccagaacccgctagcccacagctcctggaaacgccgatacatgcttctcaaatccagaaagtcgagcctgccggacggtcacgcttcacacccgaactccagccaaaagccagtcaatcaaggaaacgctcacttgcaacaatggatagtccgcctcaccagaagcagccgcagaggggagaagtcagtcaaaaaactgttataataaaagaagaagaagaagacacagccgaaaaacccggcaaagaagaagacgtagtgacccctaaaccaggcaagaggaagcgggaccaggcagaggaggagccgaacagaattccatcccggagtcttaggcggaccaaactgaaccaagaaagtacagccccaaaagttctgttcaccggagtggttgacgcaaggggcgagcgggcggtgctagcactcggcggcagcttagcagggtcagctgccgaggcgtctcatctggtaacagataggatcaggcgcactgtgaagttcctctgtgcccttggtcgcggcatccccattctgtcactcgactggcttcaccagtctaggaaggctggattcttcctcccccctgatgaatacgtcgtcaccgaccccgagcaggaaaaaaacttcggctttagtctccaggatgccctgtctagggctcgcgaacgccggctcctggagggttacgagatttacgtgactccgggtgtccaaccccccccaccgcagatgggggagataatttcttgttgtggggggacttacctgccctctatgcccaggtcctacaagccccaacgggtcgtgatcacctgcccacaggactttccacattgtagcattcccttgcgtgtgggactgcccctcctgagtcccgaatttctgctgactggagtgttgaagcaggaggcaaaaccagaggcctttgtcttgagccccctggagatgtccagtacttag

SEQ ID NO: 194498 - DNA, 4968 bp, Artificial Sequence
  Description of Artificial Sequence: Synthetic coding sequence
atgtaccaccggctggacgtgagcctgcccttcgtgagccggggccccctgactgtagaagagacccccagggtgcaaggcgagactcagcctcaaaggctgttattggccgaggattctgaagaagaggtggacttcctgagcgaaagacgtatggtgaagaagtctcgaaccacttcctcatcagtaattgtgccagaaagtgatgaagagggccactcccccgttctgggcggcctcggtcctccctttgcctttaatcttaatagcgatactgatgtcgaggaaggacagcagcccgccaccgaagaagctagctctgcggctagacgaggagctaccgtcgaggctaaacagtctgaggcagaagtcgtgactgagatccagttggagaaggatcagccactcgtgaaagagcgcgataacgacactaaagtgaagcggggggctggtaatggtgtggtgcctgcaggcgtgatccttgaaaggagccagccaccaggggaagatagtgatacggatgttgacgacgactccaggcctcctggacggccagccgaggtccatctggagcgcgctcagccatttgggttcatagattccgatactgatgcagaggaagaacgcatacccgccacccctgtagtgatccctatgaagaaaaggaaaatctttcacggagtcggaacccgcgggcctggcgcacctggtctcgcgcacctgcaggaaagccaggccggaagcgacacagacgtggaggaagggaaagcaccccaagctgtgccactagaaaagtctcaggcatcaatggttattaacagcgacactgacgatgaggaagaagtcagtgctgcgcttaccctcgctcacctcaaggagagccagcctgccatttggaatcgagacgcggaagaggacatgccacagcgggtggtgcttctgcagcggtcccaaactactacagagagggacagtgatacagacgtggaggaagaggagctccccgtggagaatcgggaggctgtcctgaaggaccatacaaagatcagggcattggtacgagctcattctgaaaaagaccagcctccctttggggacagcgatgattctgtcgaagcagacaagtcctcacccggcattcatctggagagaagccaggccagcactacagtcgatattaacacacaggtggaaaaagaggtgccaccagggtcggccattatccatataaagaagcatcaagtgtccgttgagggtaccaatcagactgatgttaaggccgtcggaggcccagcaaagctgctggtggtgagtttagaggaagcttggccactgcatggcgactgcgagacagatgccgaggaggggaccagcctgaccgcaagcgtcgtggccgatgtgagaaagagtcaactgccagccgagggcgacgcgggcgctgaatgggccgcagcagtgttgaagcaagagcgagctcatgaggtcggcgcccagggcggccctcctgttgcacaagttgagcaggacctgccaatctcccgcgaaaatctcaccgatctagtggtggacactgatacattgggagaatcaacccaaccccaacgagagggggcacaggttcctacgggccgggagagagagcagcatgtcgggggaaccaaggacagcgaagacaactatggggatagtgaagatttggacctccaggcgacacagtgttttctcgaaaaccagggactggaagtccagtctatggaagacgagcctacacaggccttcatgctgacccctccacaagagttgggaccttcccactgcagctttcaaacaaccgggctgcttaattgcaagatgccgcccgctgagaaggcctcacgcatacgagccgccgaaaaagtgtcacggggggatcaggaatccccagacgcttgtctaccccctactgtccccgaggcaccggctcctcctcagaaaccgctgaattctcagagccaaaagcacctggccccccctccactcctgagtcccctcttaccgtccatcaaacccaccgtgagaaaaactaggcaggacggaagtcaggaggccccagaagccccgctgtcatccgaactggagccattccatcctaaacccaaaatacggacccgcaaatcaagtcggatgaccccctttcctgccaccagtgccgcccccgagccacacccatcaacgagcaccgcacagcccgtgacccctaaacccacctcgcaggcgacgaggtcgcggaccaatcgaagcagtgttaagaccccagaacccgtggtgcccacagctcccgagctccagccctctaccagcacagatcagcctgttacctctgaacccacatcacaggtaactcgcgggcgaaaatccaggtctagcgtaaaaacccccgaaactgtcgtacccactgccctggagctgcagccctcaacctctacggatcggcccgttacatccgaacccaccagccaagcaacaagggggaggaaaaatcgctccagcgttaagacccccgagcccgtggtgcctactgctcccgaactgcagccctctacaagcacggaccaaccggtgacaagcgagcctacgtaccaggctacgaggggacgaaagaatcgcagcagcgtaaaaacaccagagcctgtcgtgcccaccgctccggagctgagaccctcaaccagcaccgacagaccagttacgccgaagccaacaagtcgcacgacccgatcccgtaccaatatgtccagtgtcaagaatccggagtcaaccgtgcccatcgcacccgaactgccgccatccacatctacagaacagccagtgacccccgaaccaacctccagagctactaggggcaggaaaaatcgctcatccggcaagactcctgagactttagttcctactgcccccaagttagagccatccacaagtaccgaccagcctgttactcccgagcctacatctcaggccacccgaggcagaacaaaccgtagcagcgttaagactccagagactgtggtgccgactgcacctgaactacaaccatctacaagcactgaccagccagtgactccagaacctaccagtcaagccacacgaggtcgcacagatcgcagcagcgtaaaaacccccgagacggttgttccgacagcaccagagctgcaggcctccgcttccacagatcaacccgtgacatccgagcctacaagccggaccacacggggacgtaagaatcgctcatccgtcaagacaccagagacggttgtgccggccgccccagagctgcagccttccacttcaacagaccaacctgtgacccctgagcccaccagcagggccactcgaggccggactaaccggtccagcgtcaagacgcctgaatcaatagtgccgatcgccccggagttgcaaccctccacatcccgtaaccaactagtgactcccgagcccacctcccgtgctacaaggtgtaggaccaaccgttctagcgtgaagactccagagcctgttgtccccacagccccagaaccgcaccccacgacatctaccgatcagcccgtgaccccaaagctgacgtccagagccacccggcggaaaactaatcgatcaagtgtcaagacccccaaacccgtagagccagctgccagtgatctcgaaccgtttactccaaccgatcagagcgtcacccctgaggcgattgcccagggcggccagagcaagactctccgttcgagcactgtgcgtgccatgcctgtgccaacaacaccagaattccaaagtcctgtgactacggatcagcccatttcccctgaacctattactcaaccatcctgcattaaaaggcagagggccgcaggcaacccgggcagtctcgccgccccaatcgatcacaagccgtgctccgccccgctggaacctaagagccaagcaagtagaaaccagcggtggggtgcagttagggctgccgagtcactcacagccatccccgagccagcctctcctcagctgttggagacacctatccacgcttcgcagatccagaaggttgaacccgccgggcggtcaaggtttacaccagaattgcagcctaaagcctctcagagtcgcaagagatcccttgcaaccatggactcacctccccaccagaaacaaccacagcgaggcgaagtgtcccagaaaactgtgataatcaaggaagaggaggaagacacagcagagaaacccggaaaggaagaggatgtggtcaccccaaagccagggaagagaaaacgagatcaagccgaggaggaaccgaacaggataccgtcgcgaagtctgcgaagaactaaactgaaccaggagtcaaccgcccccaaagttctctttactggtgttgtcgacgcacgcggagagcgcgccgtgcttgcactgggcgggtccctggctggaagcgccgccgaggcttcgcatctggtgacagatcgaattcgacgcacagtgaagtttttgtgtgctcttgggcgcgggattcctatactgagcctggactggctacatcaatcacgaaaagccgggttttttcttcctccagatgagtacgtggtgactgatcccgaacaggaaaagaacttcgggttcagcctgcaagacgcgctgtcgcgcgccagagaacggagacttctggaaggttacgagatttacgtcaccccaggagtacagccacctccaccacagatgggggaaatcattagctgctgtggtggtacataccttccatcgatgccaagaagctacaaaccacaacgggtggtcataacttgtccacaagattttccccattgctccattcccttaagagttgggcttcctcttctttcacctgagtttctgcttacaggggtactcaagcaggaagcaaagccagaggcatttgtgctgtcccctttagaaatgtcatccacttag

SEQ ID NO: 194499 - DNA, 489 bp, Artificial Sequence
  Description of Artificial Sequence: Synthetic coding sequence
atggaggacacccaggccatcgactgggacgtggaggaggaggaggaaaccgaacagtcctccgagagtctgcggtgtaacgtggaacccgttggccggctgcacatcttctcaggggcgcacggaccagaaaaagactttccgctgcacctgggaaaaaacgttgtgggccggatgcctgattgtagcgtggcactccctttcccatccatctcaaagcagcacgctgaaatcgaaatacttgcctgggataaggctccgattctacgcgattgtggcagtctgaatgggacccagatactgcggcctccaaaggtgctctctcccggggtctctcaccgtctccgtgaccaggaactgatactgttcgcagatctcctctgtcagtaccaccgcctcgacgtcagcctaccatttgtgagccgaggtcctctgactgtggaagagaccccgcgggttcaaggcgaaactcagccacagcggctgtag

SEQ ID NO: 194500 - DNA, 342 bp, Artificial Sequence
  Description of Artificial Sequence: Synthetic coding sequence
atggaggacacccaggccatcgactgggacgtggaggaggaggaggaaaccgaacagtccagcgaaagcctgcgctgtaatgttgagccggtcggccgattacatatcttttccggtgctcacgggccggagaaagattttcccctacacctgggtaaaaacgtcgtggggcgcatgcccgattgttctgtcgcgcttcccttcccatcaatatcgaagcaacatgctgagatcgaaatactagcatgggataaagcccccatcttgcgagattgtgggtcactgaacggtacccagattctgaggccacctaaagtactctctccaggggtgagtcactag

SEQ ID NO: 194501 - DNA, 342 bp, Artificial Sequence
  Description of Artificial Sequence: Synthetic coding sequence
atggaggacacccaggccatcgactgggacgtggaggaggaggaggagaccgagcagagctcagaaagccttaggtgcaatgtcgagcctgtcgggcgactacatattttttcaggagcacacggcccggagaaggatttccctctacatttgggaaaaaatgtggtgggccgtatgccggactgctccgtggctttaccatttccttccataagcaagcagcacgctgagatcgagatcctcgcatgggacaaagccccgattctgcgtgattgcggctcccttaacgggacccagatcctcaggcctcccaaagttctgtccccaggagtttctcattag

SEQ ID NO: 194502 - DNA, 384 bp, Artificial Sequence
  Description of Artificial Sequence: Synthetic coding sequence
atggaggacacccaggccatcgactgggacgtggaggaggaggaggagactgaacaatcaagcgagtccctgcgttgtaatgtggagcctgtgggtcgtctccacattttttccggggcccacggaccggaaaaggactttccccttcacctggggaaaaatgtcgtcggcaggatgcccgactgttccgtggcccttcccttcccgagcatctcaaaacaacatgcagagatcgaaatcctggcatgggacaaggcacctattctgagggactgcggctctttgaacgggacccagattctccgtcccccaaaggtcctatcgcctggcgtgtcacaccgcctccgcgatcaggagctcattctcttcgccgacctgctgtag

SEQ ID NO: 194503 - DNA, 489 bp, Artificial Sequence
  Description of Artificial Sequence: Synthetic coding sequence
atggaggacacccaggccatcgactgggacgtggaggaggaggaggaaactgaacagagttcggaatcacttcgttgtaacgtcgagcccgtgggaagattgcacattttctccggcgcccacggacctgagaaggattttccccttcatttgggaaagaacgtcgtgggaagaatgccagactgttccgtggctttaccatttccttctatctcaaaacaacatgcagagatcgagatactggcctgggataaagccccaatactccgtgattgcggcagtcttaatgggactcagattttgcggccgcctaaagtcctgtcgcccggagtgtcccacaggttaagagaccaagagctaatcctttttgctgatttgctttgccagtaccaccgccttgatgtatccttgccgtttgtatcgagaggacccttgaccgtcgaagaaacgccacgcgtgcagggagagacacagccacagagattatag

SEQ ID NO: 194504 - DNA, 342 bp, Artificial Sequence
  Description of Artificial Sequence: Synthetic coding sequence
atggaggacacccaggccatcgactgggacgtggaggaggaggaggaaacggagcagtctagcgaatctcttagatgtaatgtggagccagttggaagactgcatatctttagcggagcacacggacctgagaaagacttcccactccacctggggaaaaatgtggtgggcagaatgcctgactgttctgtggcactgcccttcccaagtatttcaaagcaacacgccgagatagagatacttgcctgggataaagctcccattttgcgggattgcggatctttgaacggaacccagattctgcgcccgcctaaggtcctgagccctggggtgtctcactag

SEQ ID NO: 194505 - DNA, 489 bp, Artificial Sequence
  Description of Artificial Sequence: Synthetic coding sequence
atggaggacacccaggccatcgactgggacgtggaggaggaggaggaaaccgagcagagttcggaatcgcttaggtgcaacgtggaacctgtcgggagactacacatatttagcggtgcccatgggcctgagaaggacttcccactgcacctcggtaagaacgttgtagggcggatgcccgattgttctgtggcgctcccctttccatctattagcaaacagcatgctgagatcgagattcttgcgtgggataaggcgccaatactgagggactgtggctcactgaacggcacacaaatactgaggccacccaaagttctctcaccaggcgtgtcccatcgtctccgggaccaggagctgattttgttcgctgacctcctgtgccagtaccatcgcctagatgtttccctgcctttcgtgagtagaggccccctgacagtggaggagacaccccgcgtccaaggcgagacacagccgcaaagactgtag

SEQ ID NO: 194506 - DNA, 384 bp, Artificial Sequence
  Description of Artificial Sequence: Synthetic coding sequence
atggaggacacccaggccatcgactgggacgtggaggaggaggaggaaacggagcagagcagcgagtcactccgctgcaacgttgagcctgtcgggcggctccatattttcagtggagcgcatgggcctgagaaggattttccattgcacttgggcaaaaacgtggttggtcggatgccagattgttctgtagctctgccgtttccctctatcagcaagcagcacgccgagatagagatcctggcttgggacaaagctccaatactgcgtgactgtgggtccttaaatgggacccagatattaagacctcctaaagtgttgtcaccgggtgtatcacacagactgcgtgatcaggaattaatcttgtttgctgacttgttgtag

SEQ ID NO: 194507 - DNA, 921 bp, Artificial Sequence
  Description of Artificial Sequence: Synthetic coding sequence
tgacacgtgggcggcaccaaggacagcgaggacaactacggcgacagcgaagaccttgacctgcaagcaacccagtgctttctggagaatcaggggctggaagccgtgcaaagtatggaggacgagcctactcaggctttcatgctgactcccccccaggagctcgggccgagccactgtagctttcagacgacaggactcctgaactgtaagatgcctcctgcagaaaaagcttcacggataagagccgcagagaaggtttccagaggcgatcaggaatcccccgacgcctgcctgcctcctactgtaccagaggcgcccgccccacctcagaagcctcttaatagccagtctcagaagcacctagcccctccaccattgttgtctcctttgctcccttccatcaagcccactgttcgcaagacgaggcaggacggtagccaggaggcacccgaggccccactttcatcagagctagaaccatttcatccaaaaccaaagataagaacgcgtaagtcatctcggatgacaccctttccagcgacatccgccgcgccggagccccacccctccacctctaccgctcagcctgttacacctaagccaacttcacaagccacaaggtctagaactaacagatcctctgtcaaaacccctgagccagtggtgcccacggctcccgaattacaaccatccactagcacagaccaaccagtgacatcagagccgacaagccaggtgactcgcgggcgtaaatcacgctcgagtgtgaaaacacccgagactgtggtgcccacagccctagagttgcagccctctacaagcaccgatagacccgtgacttcagagcctacttcacaagccactcgagggaggaaaaacaggagctcggtgaaaactcctgaacctgttgtcccctag

SEQ ID NO: 194508 - DNA, 6270 bp, Artificial Sequence
  Description of Artificial Sequence: Synthetic coding sequence
atggaggacacccaggccatcgactgggacgtggaggaggaggaggagacagagcaaagcagtgaatcactgaggtgtaacgttgagccagtaggccggcttcacattttctctggggcccacggccccgagaaggatttcccactacacctaggcaagaatgttgtgggtcggatgcctgactgtagcgtggccttgccatttcccagtatcagcaagcagcacgcagaaatagagatcctggcctgggataaagcccctattctgagggattgcggcagcctgaatggaacacagatcctgcggcctccaaaggtgttgtccccaggtgtttcccatcgtttgagagaccaggagctgattctctttgccgatttattatgccagtatcataggctggatgtaagccttcccttcgtgtcccgaggcccccttaccgttgaggaaacccctcgtgtgcagggagagacccagccccaaaggcttctcctggctgaggattctgaggaggaagttgactttcttagtgaacgccgtatggtaaaaaaatcacgcaccacttccagttccgtgatcgtcccggagtctgacgaagagggacacagccctgtcctgggcggattgggccccccgtttgcgttcaacctcaacagcgacacagacgtggaggaagggcagcagccagccaccgaggaggctagttctgcagcacgtaggggcgccacagtagaagccaagcagagcgaagctgaggtcgtcaccgaaattcagctggaaaaggatcaacctctggtgaaggaacgtgacaatgatactaaggtgaagcgcggcgccggcaacggtgtagtgccagccggggtaatactggaacggagccaacctcccggcgaagattcagataccgacgttgacgacgattcacggcccccagggaggccagccgaagtgcaccttgagagagcccagcccttcggctttatcgatagtgataccgacgccgaagaagagaggatccctgcaactcctgtggtaataccaatgaagaagaggaaaatcttccatggtgttgggactcgcggaccaggcgcgcccggtctagcccacctgcaggagagtcaggccgggtccgataccgacgtggaggaagggaaggcgccacaggcggttccactcgaaaagtctcaagcctccatggtgatcaattccgatacggacgatgaagaggaagtgtctgccgctctgaccctggcccacctgaaggaatcccaacccgcgatctggaaccgggacgcagaggaggacatgccccagcgcgtggtattgctgcagcgtagtcagacaacaaccgagagagactccgatactgatgtagaggaagaagagcttcctgtggagaacagagaagcagtccttaaggatcatactaagatcagggccctcgtccgcgcccattcagaaaaagatcagcccccgttcggagacagtgacgactctgtcgaggccgacaaatcttctccgggaattcacctcgaacgaagccaagcatctactacagtcgacatcaatacccaggtggaaaaagaggttcctcctggctccgccatcatccacattaaaaagcatcaggtctcagtggaagggaccaatcagacagacgtcaaggccgtgggcgggccggccaagctgctggtcgtgagcctcgaagaagcgtggcccctccacggcgattgtgaaaccgacgcggaggagggtacctctttgacggcatccgtcgttgcggacgtccggaagagccaacttcccgcagagggggatgcgggggccgaatgggcagcggccgtattgaagcaggagagggcccatgaggtgggagcgcaagggggacccccagtcgcacaggtggagcaggacctccccatcagccgcgagaatctgacggacctggttgtggatactgatacccttggggaatccacccagccgcaacgggaaggagcacaggtgcccaccggaagagagcgcgaacagcacgtcggtggcaccaaagactctgaagacaactatggggatagtgaagaccttgacctgcaggccactcagtgcttcctagaaaatcaggggctggaggcagtgcaatccatggaggatgagccaactcaggcgtttatgttaactcccccgcaagaactaggcccaagtcactgttcttttcagacaaccggtactctggacgagccttgggaagtcttggcaacccagccgttttgcttgcgggaaagtgaagatagcgagacacaacccttcgacacccacctcgaggcatacgggccatgtctttcacctcccagagctatccctggtgaccagcatccagagtccccagtgcatacggaaccaatggggatccagggcagagggcgtcagactgtggacaaggtgatgggcataccgaaagaaaccgccgaaagagttgggccagagagaggccccctcgagcgagaaaccgaaaagctgcttccagagcggcagactgacgtcacgggggaagaggagctcacaaagggcaagcaggatcgggaacagaagcaattactggcacgagatactcaaagacaagaatccgacaagaacggtgagtctgccagtcccgagagggatcgggagagtctcaaggtggaaatcgagacatctgaggagatccaagagaagcaagtgcagaagcagacattgccgtctaaagcattcgaaagagaggtcgaacggccagtcgccaacagggaatgcgaccctgccgaactggaggagaaagtgccaaaagtgatccttgagcgggacacacaacggggggagcccgagggaggctcacaggatcagaagggacaggcctctagccctacaccagaacctggcgtcggcgccggcgatctgcccgggcccacctccgctcctgtcccgagcggatctcaatctggtgggagaggttcaccagtgagtccccgacgacatcagaagggcctactcaattgtaagatgcctccagcagaaaaagccagcagaatccgggctgcagagaaggtgagcagaggcgatcaagaatctcccgatgcttgcctgccgccaacggtccccgaggcccccgcgcctccccagaaacctctgaactcccagagtcagaaacacctcgccccaccccccctcttgagcccactccttcccagcattaaaccaaccgtgcggaaaactcggcaggatggctctcaggaggctcccgaggcacccctttcatccgagctcgagccttttcatcctaagccaaagattcgcacaagaaagtcatcgagaatgacaccctttcccgctacgagtgctgcccctgagccgcatccaagcacaagcaccgcgcaacccgtaacccctaaacctacatcccaggccacaaggagccgaacaaatcggtctagtgtaaaaacccctgagccagttgtccccacggcccccgagctccagccatctacgtcaactgatcagcccgtgactagcgaaccgaccagccaagtgacgcgtgggagaaagagccggagcagtgtcaagacgccagagactgtcgtgcctaccgcactggagcttcagcctagcacatccacagaccgcccagtcaccagcgaaccgacatcccaagcaacacgcggaagaaagaaccgaagtagcgtgaaaacacccgagccagttgtgcccactgcgcccgaactgcaaccatcaacatctaccgatcaacctgtgacgtcagagcctacataccaggctacgcgcgggagaaaaaacagatcgtctgttaagacaccagagccagtcgtccccaccgcacctgaactgagaccctcaacctccaccgataggccagtgactccaaagcctaccagcagaactacccgtagtcggactaacatgtcgagcgtgaaaacgcctgaaaccgtggtgcccactgctccagagctgcaaattagtacatcaacagatcagccagtgacacctaaacccacatccagaacaacccgcagccggaccaatatgtcatccgtgaaaaaccccgagagcactgtgcctatcgcccctgaattgcctccttccacttctaccgagcagcctgtgacaccggaacccactagccgggccacccgagggcgcaagaatagatcctctggcaaaacccccgaaacactggttcctactgctccgaagctggaaccaagcacctccactgaccagcccgtcaccccagagccaactagccaagctacgagggggcggacgaatagatcatctgtcaaaacaccagaaaccgtggtcccaactgctcctgaattacagccctccactagtacagaccagccggtgacgccagagccgaccagtcaggctacgcgagggcggacagatagatcatcagtgaagacacctgagacggtcgtcccaactgcaccggaactgcaggcctccgcaagcacggaccagccagtaacatccgagccaacctcccggactactaggggtcggaaaaacagaagctctgtcaagaccccagaaacggtcgtgcctgccgccccggagcttcagccttcaacatccaccgaccaacccgtcacacctgagccgacaagccgtgcgacaaggggacgcactaataggtcgagcgttaagacgcccgagtccatcgtcccaatagcccctgaactccagccctcaacttctcgtaaccagttagttactcccgaacccacttctcgcgccaccagatgtagaaccaatagatcctccgtcaagacacctgaacccgtcgtacctaccgccccagagcctcaccctaccacgtctacagaccagccggtgactcctaagctgacttctcgagcaacacggagaaagaccaatagaagctctgttaaaacacctaagccagtggaacctgccgcaagcgatctggagccatttacccccactgaccaaagtgtgacaccggaggcaatcgcacaggggggtcaatcaaagactctgagatcttctaccgtaagggcgatgcccgtcccaaccacacccgagtttcagtcccccgtaactaccgatcagcccatcagcccagagcctattacacagccttcctgtataaaacgacagagagccgcaggaaaccccggcagcctggccgcccccatagaccataagccatgcagcgcccccctagagccaaagtcccaggcgagcaggaaccaacggtggggcgccgttcgagcagctgaatcgcttactgccatccctgagcccgcctccccgcagctcctcgagacaccaatacacgcttcacagatccagaaggtggaaccagcgggacgttcccggtttaccccggaactgcagcccaaagccagccagtcacggaaacggagtctggcaacaatggactcccctccacaccagaaacagccacagcggggagaagttagtcagaagaccgttattatcaaagaggaggaggaggacacagccgagaagcccggaaaagaggaggatgttgtcacgccgaagcctggaaagcgaaagagggaccaggcagaggaagaacctaatcgaatcccaagccgctcactgcgacggactaaattgaaccaggaatcgacagcccccaaagtcctctttacaggggtggtggacgccagaggcgagagggctgtgctcgcactgggcggaagcctcgccgggtcggccgctgaggcgtctcacctcgtcaccgacagaatccggcgcaccgtgaagtttctctgcgccttgggaagagggattcccatcctgagtctggactggctacatcagagcaggaaagctggattctttttaccgcccgacgagtacgttgtgacagacccagagcaggagaagaattttggcttcagcctgcaggatgctttgagtagggctagagagcgccgtctgctagagggatacgaaatatacgtgacacccggcgtccaaccgccacctccccagatgggcgagatcatctcttgttgtggcggtacatatctgccgtccatgccacgctcatacaagccccagcgagtagtgattacctgcccgcaggatttccctcattgctccattcctcttcgggttggcctacctttgctgagtcctgagtttctcttgactggggtgctgaaacaagaggccaagccagaagctttcgtcctgtccccccttgagatgagctctacatag

SEQ ID NO: 194509 - DNA, 5409 bp, Artificial Sequence
  Description of Artificial Sequence: Synthetic coding sequence
atggaggacacccaggccatcgactgggacgtggaggaggaggaggagacggagcagtcctcggaatcattgaggtgcaatgtcgaacccgtcggacggttgcatatttttagtggtgcacacgggcccgagaaggattttcccctgcacctgggaaagaatgtagtgggaagaatgcccgattgcagtgtcgctctacccttcccctcgatttccaaacaacacgcagaaatcgagatcctggcctgggacaaagcccccattctccgcgactgcgggagccttaatggaacacagatcctgagacctcccaaggttctgagccccggggtgtcccaccgcttacgtgatcaagaactgatcctgttcgcggatttattgtgccagtaccaccggctagatgtcagcctcccctttgtgtctcgcggcccgctgaccgtggaggagacgccgcgggtccaaggcgaaacacaaccccaacgactgctgttagccgaagattccgaagaagaagtagactttctgtctgagagaagaatggtaaagaaaagccgtactactagttcatccgttatcgtgccagaaagcgacgaggaagggcatagccccgtcctggggggtttaggaccgccatttgcctttaacttgaactccgatactgacgtggaggaaggtcagcagcctgccacagaggaggcttcgtcagccgcccggcggggtgcaactgtggaagcaaagcaatctgaagcggaggtggtgacggagatccagctggagaaagaccagcccctggtgaaagaaagggataatgatactaaggtcaaacggggtgcgggtaatggggtcgttccagctggcgtgatcctagaaagaagtcaaccgccaggggaagacagcgatacagatgtcgatgacgattctcggccccccggacgtccggccgaggttcacctggaaagagcccagccatttggcttcattgactccgacaccgatgccgaagaagaaagaatccctgctacgcccgtggtaatcccaatgaagaagagaaaaatttttcacggcgtcggaactcgtggtcccggtgcccccggtttggcacacttgcaggaatcccaggcagggtccgataccgatgtcgaggagggcaaagctccacaggccgtaccactagaaaaatcccaggcgtccatggtgatcaacagtgacacggacgacgaagaagaggtgtctgcggccttgacgctggcccatctgaaggaatcccagcccgctatctggaatcgggacgctgaagaggatatgcctcagcgagtggtgttgctgcagagatctcaaacaaccaccgaaagagattctgacaccgacgttgaggaagaagaactccccgtggagaatagagaggccgtcctgaaggatcatacaaaaattcgggccttggtaagggcccatagcgaaaaggaccaacccccctttggcgattccgacgactctgtggaagctgataagagctccccaggcatccatctggaaaggagtcaggcgagcactaccgtcgacatcaacacccaagtggagaaagaggtgccccccggctctgccatcatacatatcaagaagcatcaagtttcggtggaaggcacaaaccagaccgatgtgaaggcagtcggggggcccgcaaagctgctagtggtatcactcgaagaggcatggccgctacacggggactgcgaaactgacgctgaggagggcacaagccttactgccagtgtcgtagcggatgtaaggaagtcacagctgcccgctgaaggtgacgcaggtgcagaatgggccgcagctgtcctgaaacaggaacgggcccacgaggtgggcgcccagggtggccccccagtcgcccaggtggagcaggatttgcctatctcccgcgagaaccttacagaccttgtggtggacacagacacacttggagagagtacacagccccaacgcgaaggagcccaggttccaaccggccgggagcgcgaacagcacgtgggcgggaccaaggattccgaagacaattacggagatagcgaggaccttgatttgcaagcaacacaatgctttctggagaatcaaggactggaagcagtgcagagcatggaggatgagccgacacaggcttttatgctcaccccaccacaggagctgggaccctctcactgtagctttcaaacaacaggcaccctagacgagccatgggaggtgctggccactcagcctttttgccttcgcgaaagcgaggatagtgagacccaaccattcgacacacatcttgaggcatacggcccgtgcctctctccaccacgcgcaatcccaggcgatcagcaccccgagtctcctgtgcacactgagcctatgggaattcagggtagggggcggcaaacggttgataaggtgatgggaatcccaaaggagacagcagagagggtcggacctgagcgtggaccactggagcgagaaaccgaaaagcttttaccggagcgccagaccgatgtgacaggtgaggaagagctcacaaagggcaaacaagaccgggagcagaaacaactgctggctagagatactcagcgccaagagagcgacaagaacggcgaaagcgcaagcccagagagagatcgggagagtctaaaggtggaaatcgaaacaagcgaggaaatacaggaaaaacaggtccagaaacagacccttccctccaaagcgttcgaaagagaggtcgaacggcctgtggccaaccgtgagtgcgacccagctgaattggaagaaaaggtccctaaggtgattttggaacgggacacacagaggggagagcccgagggcgggagccaggaccagaaggggcaggctagttcacccaccccagaacctggggttggcgccggagacctcccggggcccaccagcgcgcccgtgccaagtggctcccagagtggaggcagaggaagcccagtgtcaccccggaggcaccaaaaaggcctgctcaattgcaagatgccccctgcggaaaaagcaagccggatccgggcagcggaaaaggtatcccgaggcgaccaggaatcaccagacgcctgtctacctccgacggttccggaagccccagctcccccacagaagccactaaattcccagagtcagaagcatctagctccacctcccctcctgagcccgcttctccccagcatcaaacccaccgtgaggaaaactagacaggacgggtcccaggaggcaccagaggcaccactgagctctgagctcgagcccttccaccccaagccaaaaattaggactagaaaatcaagcaggatgacacctttccctgcaaccagcgccgcacccaagctggagcctagcactagcaccgaccagcctgtgacacctgagcctacttctcaggcgacacgagggcgtactaatcgttccagcgtgaagacacctgagaccgtcgtgcccacggcgcccgaactgcagcctagtacttcaacggaccaacctgtgaccccagagcctacaagccaggcaactcgggggcgaacagacagaagctcagtgaagactcccgaaactgtggtgccaacggctcctgagcttcaggcttctgcttccacagatcagccggtaacgtccgagccaacttcaagaaccacccgtggtcgtaaaaaccggagttctgtgaaaacgcctgagactgtggtcccagcagctcctgagcttcagcctagcacttctaccgatcagccagtgactcccgagcctacgagtagggcaacaaggggaagaacaaataggtcttctgtgaaaacccccgaatctatcgtgcctattgcgccagaactacagccctctacatcaagaaaccagctggtgaccccagaaccgacatcccgggcgacacggtgtcgaactaatagaagctcagttaaaactcctgagcccgtggtccctaccgcccctgagccacatcccactaccagcacagatcagccggtcacccccaaactcacttcccgggcaacacggcgcaagacaaaccgctcctctgtgaaaacacccaagcctgtcgagcctgccgcatcagacctggaacctttcacgcccaccgaccagagtgtgacccctgaggcgatcgctcaggggggccaaagtaaaactcttcgcagtagcaccgttcgcgccatgcccgtcccaaccactccagagttccagtcccccgtgaccaccgatcagcctatttccccagaaccaatcacccagccatcttgcataaaacgtcagagggctgccgggaatcccggctcccttgctgccccaattgaccataagccttgctccgccccgctggaacccaagtcacaggctagtcgcaaccaaagatggggagctgtccgggctgccgagtctttgacagccatacccgagcctgcttcccctcagcttctggagacaccaattcatgcctcacaaatccagaaagtagagcctgccggaagaagccggttcacccccgaactgcagccaaaggcttctcagtcccggaaaaggtcattagccaccatggattcccctccgcaccaaaagcagcctcagaggggggaagtctcccagaagacagttattatcaaggaggaagaggaagacactgctgagaaacccgggaaagaagaggacgtggttacaccaaagcccgggaagcggaaaagagatcaggccgaagaggagccgaaccggattccttcccgcagtctaagaagaacaaaacttaatcaggagtccaccgctcctaaggttctcttcacaggtgtggtggacgcacgcggagagagagctgtgctagcactggggggatctctggctggctcggctgccgaggcctcccatttggtcactgacagaatccgccggacagtaaagttcctctgtgcactgggccgtggcattccaatccttagcctggactggcttcatcagtccaggaaggccggcttttttctccctcctgacgagtatgttgtgaccgatccagagcaggaaaaaaacttcggattcagccttcaagacgccctctcccgagcaagagaacgcaggttattagagggttatgagatatatgtcactccgggcgtgcaacctcctccgccgcaaatgggcgagatcatctcatgttgcggcggtacctatctcccttctatgccgaggtcttataagccacaaagggtcgtgatcacctgcccacaggacttcccccactgttctatacccctgagggtcgggctgcccctcttatctcccgaatttctgctcaccggcgtcctgaagcaggaggccaagcctgaagcatttgtcttgagcccccttgagatgtctagtacctag

SEQ ID NO: 194510 - DNA, 342 bp, Artificial Sequence
  Description of Artificial Sequence: Synthetic coding sequence
atggaggacacccaggccatcgactgggacgtggaggaggaggaggaaacagagcagtcatccgaatccctgagatgtaacgttgaacctgtggggagactacacatattcagcggggcacatgggccagagaaagatttccccttgcacctggggaaaaacgtggtggggcggatgcccgattgctccgttgcactccccttccccagtatcagcaagcagcatgcggagatcgagattcttgcttgggataaggccccaatcttgagagactgcggtagcttgaacggaactcagatcctacgccctccaaaggtactgtctcctggcgtcagccattag

SEQ ID NO: 194511 - DNA, 6270 bp, Artificial Sequence
  Description of Artificial Sequence: Synthetic coding sequence
atggaggacacccaggccatcgactgggacgtggaggaggaggaggagacagaacaatcaagcgaaagtcttaggtgcaacgtggagcccgtcgggagactgcacattttctccggagctcacgggcccgagaaggatttcccgttgcatctgggtaaaaatgtggtgggcaggatgcctgattgctctgtagcgctgcctttccccagtatttcgaaacagcacgctgaaatcgaaattttagcatgggacaaggccccaatcttgcgggactgtggttctctcaacgggacacaaatcctgcgaccccctaaggttctgagccccggagtatctcaccggctgcgcgaccaggagttgatattattcgcggacctgctgtgtcagtaccaccgtctggacgtaagcctgccatttgtgtcgaggggacccctgacagtggaagagacaccaagagtacagggggagactcagcctcagcgcttgctgctcgctgaagattcagaagaggaggtggacttcctgtctgagcggcgaatggtgaaaaagtcccgcactacctccagtagcgtgatcgtgccagagtccgacgaggaaggacacagccctgtgctggggggactgggtccccccttcgcgttcaatttaaattccgacactgatgtagaggagggtcagcaacctgccactgaggaggcctcgtcagctgccagacgaggcgccaccgtagaagcaaagcagagcgaggccgaggttgtaaccgagattcaactcgaaaaggaccagccacttgtgaaagagcgggataacgataccaaagtcaagcgaggggctgggaacggtgttgtcccagctggagttatccttgaaagaagtcagcctcctggggaagattccgacacagatgtggatgatgacagccggcccccgggcaggccagctgaggtgcacctcgaaagagctcagcccttcggctttatagatagtgacaccgacgcagaagaagagagaatcccagctactcctgttgtgattcctatgaagaagaggaaaatatttcacggcgtgggtacaagagggcctggagcacccggcttggctcatctgcaggagagtcaggcaggttctgataccgatgttgaagagggcaaggcaccccaggctgtcccactggagaaaagtcaggcttcgatggttatcaactccgatacagacgacgaagaggaagttagcgcagccttgaccttggcccatctgaaggagtcacagcccgccatttggaacagagacgcagaggaagatatgccgcagcgggtggtcttactgcagcgcagccagaccacgactgaaagggacagcgatacagacgtggaggaggaggaactccctgtggaaaacagagaggcagttttaaaagatcacacaaagattcgtgcccttgtccgcgcccattctgagaaggatcagcctcctttcggagacagcgacgatagcgtggaggcagacaagtcttctccaggaattcatttagaacgaagccaggccagcacgaccgtagatattaacacccaggtagagaaagaagtgccaccagggtcggctatcattcatattaaaaaacaccaagtgtctgtggaaggaacaaaccagaccgatgtgaaagccgtgggtgggcctgcgaagttgctggtggtgtcgctcgaagaggcatggcccttgcatggtgactgtgagaccgatgccgaggagggcacttcgctgacggctagcgttgtggccgatgtgaggaagagccaattgcccgctgaaggtgatgcaggagccgaatgggccgctgctgtgctgaagcaggaacgagcccacgaggttggcgcacaaggcgggccaccggtcgcacaggtagaacaggacctcccaatctccagggaaaatcttaccgatttggttgtcgatacggataccttaggagaatctacgcagcctcagcgcgaaggagcccaggtcccgactggaagagagcgggagcagcatgtcggcggaactaaagactctgaagacaattacggcgatagtgaggatctcgacctacaggcgactcagtgtttcctcgaaaatcaagggctcgaggccgtccaatcaatggaggacgaacctacgcaagcattcatgcttacccccccacaggagcttggaccttcacactgcagctttcagaccactggtactctcgatgaaccctgggaggtgctcgccacgcagcctttttgtttaagggaatctgaggactccgagacgcagccatttgatacacatctggaggcgtatggtccatgcctgtccccacccagggccatccccggcgaccaacacccagaatccccagtgcataccgagcccatgggaatccagggacggggtcgacagaccgtggataaagtgatgggaattccaaaagaaactgccgagagagtaggtcctgagcgcggccctctggagcgggaaaccgagaaattgctaccagagcgacaaaccgacgtgaccggtgaagaggagctgactaagggcaaacaggatagagagcaaaagcagctgttagcacgcgatacacaaaggcaagaatcagacaagaatggcgagagcgcctctcctgagcgagatcgtgaatctctgaaagtcgaaatcgagacatctgaagagattcaggagaagcaagtgcagaagcaaactctcccttctaaagcgtttgaacgtgaagttgaaaggcccgtggccaatcgcgaatgcgatcccgcagagctagaggaaaaagttcctaaggtcatcctggaacgcgacacccaacgcggcgagccagagggaggatctcaggaccagaaggggcaggcctcaagcccaacccctgagcctggagtgggggcgggcgacctgcctgggcctacctccgcacctgtcccttcagggtcccaaagcggcggtcgcggatcacctgtttctcctcggaggcaccagaagggcctgcttaattgtaagatgccccccgccgaaaaagcctcccgtattagggcagctgagaaggtcagcaggggtgatcaggaatcccccgacgcgtgtctcccacctactgttcctgaagctcctgccccacctcagaagcccctgaactcacagagccagaaacaccttgccccacctccactgttatccccattattacctagtatcaaaccaaccgtgcggaaaaccagacaggatggatcccaggaggctccagaagcgccattatcaagtgaactggagccatttcatcccaagcccaagattcgcacccgtaaaagtagtcgcatgacacctttccccgctacatccgccgcaccagagcctcatccatcaaccagcacggcccagccggtcacccccaaacctacctcccaggcaacgcggtccaggactaaccgatcctcggtgaaaacacccgaaccagttgtgccgaccgctcctgaactccaaccttctaccagtaccgaccagcccgtgactagtgaacccacaagccaggtgacccgagggagaaagagtcggagcagcgttaagacccctgagaccgtcgtgcccacagctctggagctgcagccttctacctctacagaccggcccgtgacaagtgaacctacctcccaggcgacaagggggagaaaaaataggtcatcggtcaagacaccagagcccgttgttccaacagccccagaattacagcccagcaccagcaccgaccagcccgtgacatcagagcccacgtaccaggccacccggggccgtaaaaacagaagttctgtgaaaacgccagagcccgtggtacccacagccccagagctacggccttctacaagcaccgatcggcctgttacccctaaaccaacttcacggacaacaaggagtcgcacgaacatgtcttcggttaaaacccctgaaacagttgttcccacagcacccgaactccagatttctacgagcacagatcagccagtcacccctaagcccacgagcagaactacgcgctctaggacaaacatgtctagcgtgaaaaaccctgaatctacagtccctatcgctcccgaactaccaccctcaacaagtaccgagcagcccgtaactccagagcccacatctcgggctactaggggtagaaaaaaccgaagttcaggaaagaccccagaaaccctcgttccgacggcccctaaactggagccatccacttctactgatcaaccggtgactccagagcccacaagccaagccacacgtgggaggaccaatagatcctcggtcaaaaccccagagacagtcgtgcctactgctccggagctgcagcctagcacatctactgaccagcccgtcacacccgagcccactagccaggccacacgggggaggacggatcggtcttctgttaaaacgccagagaccgttgtccccaccgcccctgagctgcaagcctctgcatcaacggatcagcccgtcaccagcgagccaacttcacgcacaacccgcgggaggaagaatagatcaagcgttaagaccccagagaccgttgtgccggccgcccctgcattgcaacccagtacctcaactgaccagccggtcacccccgagcctaccagtagggccacgcgcgggcgaaccaaccgctcctccgttaagacccccgagagcattgtacctattgcacctgagctgcagcctagcacttctcgcaatcaactcgtcaccccagagcccaccagccgggctacgagatgtcgcactaacaggtcgagcgtaaagacacccgaacccgtcgtcccaacggctccggaacctcaccccaccaccagcactgaccagcctgttacccccaagctgacatctagggcaacccgccggaagacaaaccgcagctcagttaagactcctaaacctgtggaacccgctgcatctgacctcgagcccttcacacctactgaccagagcgttaccccggaggccatcgcccagggcgggcagtccaaaaccctcaggagctccacagttcgagccatgcccgtgcccacaaccccagagttccagtcacctgttaccaccgaccaaccgattagtccggagcccattacccagccatcttgcatcaagaggcagcgcgccgccggcaatccagggagccttgctgctcctatcgatcacaagccatgcagcgctcctctggagccaaagagccaggcttcccgcaatcaacggtggggcgctgtgagggcggcagagagcctcaccgccatccccgagcccgcctcaccccagctgctggaaaccccgatacacgcgtcacaaatccagaaggtggagcctgcagggcggtctcgttttacccctgaattgcagccaaaggcatcccagtcaagaaaacgaagtctggccaccatggacagccctcctcatcaaaagcagccacagcgtggggaagtgtcacaaaagacagtcatcatcaaagaggaggaagaagacaccgcagagaagcctggaaaagaggaggacgtggtgacacctaagccggggaagcggaaaagggaccaggcagaggaagaaccaaaccgtataccttcacggagtcttaggaggacaaagctcaatcaggaaagcaccgctcctaaagttctatttacgggcgtggtggacgcgcgcggggaacgcgctgttctcgcgctgggcgggagtctcgctgggtcagcggccgaagcatcacatctggtgacagaccggatcagacgcaccgttaagtttctgtgtgccttggggcgcgggatcccgatcttaagccttgactggctccatcagtctagaaaggctggattcttcctcccgcccgacgaatatgtggtcaccgacccggagcaagaaaagaatttcggcttttccttgcaggatgcgctgagtcgagcccgagagcgtcgcctgttggaggggtacgagatctacgtcacccctggggtgcagccccccccgccacagatgggagagataatcagctgctgtggcggcacatatctccccagcatgccaaggtcttataagccgcagcgtgtggtgattacttgcccacaggatttcccccattgcagtatcccgctacgcgtaggcttacccctactcagcccagagtttcttctcactggggtcctcaaacaggaagctaagccagaggcattcgtcctgtccccactggagatgtcgagtacctag

SEQ ID NO: 194512 - DNA, 738 bp, Artificial Sequence
  Description of Artificial Sequence: Synthetic coding sequence
atggaggacacccaggccatcgactgggacgtggaggaggaggaggagaccgagcaatccagcgaatcccttagatgcaacgtagagcctgtaggacgcctgcacatcttcagtggagctcacggccctgagaaggattttccactgcatctgggtaagaacgttgtgggccgcatgcccgattgctccgtggcgctgccctttccatcaatttccaagcagcacgccgaaattgagattctcgcatgggataaagcccctattctgagagattgcggatcactcaacggaacccagattcttaggcccccaaaggtgctgtctccaggggtctctcacagactgcgggaccaggaacttattctgtttgctgatctgctgtgccaataccatcgccttgacgtgtctttgccattcgttagtcgtggcccactgactgtcgaggagaccccgagagtccaaggcgagacacaaccccagcgcctgctgttggccgaagattcagaagaggaggtggacttcctaagtgagcggcgtatggtaaagaaatcccgcactacctcctcttctgtgatagtgcctgaatctgatgaagaaggtcattcacctgtgctgggtggacttgggccccccttcgctttcaaccttaacagcgacactgacgtcgaggagggtcagcagccagctacagaagaagccagctccgctgcaaggagaggcgcaactgtagaggcatag

SEQ ID NO: 194513 - DNA, 342 bp, Artificial Sequence
  Description of Artificial Sequence: Synthetic coding sequence
atggaggacacccaggccatcgactgggacgtggaggaggaggaggaaacagagcagagcagtgaaagcttgagatgcaatgtggagccagtgggacgacttcacatcttcagtggagcacatggtccagaaaaggactttccattgcatcttggcaagaatgtggtaggaaggatgcccgactgcagtgtggccctaccgtttccctctatatccaaacagcacgccgagatagagatcctggcctgggacaaagcccctatcctgagagattgtggaagtcttaacggtacccagatacttagaccccccaaggtgctctctccaggcgtgagccactag

SEQ ID NO: 194514 - DNA, 384 bp, Artificial Sequence
  Description of Artificial Sequence: Synthetic coding sequence
atggaggacacccaggccatcgactgggacgtggaggaggaggaggaaacagagcagtcctccgaaagcctgcgatgtaacgttgaacctgtaggccgtcttcacattttcagcggcgcacacgggcccgaaaaagattttccactgcacttaggcaaaaacgtggtcggacgtatgccagactgtagcgttgctttgccttttccaagcatctcaaagcagcatgccgagatcgagattctcgcctgggataaggctcccatattacgggattgcggaagcttaaatggcacccaaatactgaggcctccaaaggtgctgtccccaggcgtgtcacaccgactgcgggaccaggaactcatcctgtttgccgacctgttgtag

SEQ ID NO: 194515 - DNA, 6270 bp, Artificial Sequence
  Description of Artificial Sequence: Synthetic coding sequence
atggaggacacccaggccatcgactgggacgtggaggaggaggaggagaccgagcagagcagtgaatcactgcggtgcaacgtggagccagtgggaaggttacacatctttagtggagcacatggccccgagaaggacttccccctgcacctcggaaagaatgtggtgggaagaatgcctgattgcagcgtcgctttaccctttccatctatttccaagcagcacgcggaaattgaaatcctcgcttgggacaaggctcctatcctgcgagactgtggctcgctgaatggtacccaaatcctcaggccccccaaggtccttagtcctggcgtctctcaccgattgcgtgatcaggaactaatcctgttcgctgaccttctttgccagtatcaccggctcgatgtttctctgccattcgtgtctcgcggcccgctgacagtggaggagacccctcgcgtccaaggtgagacacagccacagaggctgttactggccgaggactccgaagaagaagttgacttcctgtctgagcgtcggatggtcaagaaaagccgaaccaccagctcctcggttatcgtgcctgaatcagacgaagaaggacatagcccagtgcttgggggtctgggccccccgtttgcgttcaatttaaatagtgacacagacgtcgaggagggccagcagcctgcaacagaggaggcatcgtcagctgctcggcggggagctaccgtggaggcaaagcagtccgaggccgaagtggtcacagagatccagctggaaaaggatcagcccctggtgaaggaaagggataacgataccaaagtcaagcggggcgccggcaacggcgtggtaccagccggtgtgatattggaaagatcccaacctcccggagaggattccgacacagacgtcgatgacgacagcagaccaccaggccggcctgccgaagtacacctggagcgcgctcagccgttcggctttatagattctgacactgatgccgaggaggagaggatccccgctaccccggtggtgattccgatgaagaagcggaaaattttccacggggtcgggacccgtgggccaggggcaccgggtttggctcacctccaggagtcccaggccggctccgacactgacgtggaggaaggtaaagccccacaggcagtgccgctcgagaagtctcaggcatccatggtgattaattcagatacggatgatgaagaagaggtgtcggctgccctgaccttggctcatttgaaagagtctcagcccgccatctggaacagggatgccgaggaggacatgccacagcgggtagtattactgcagcggagtcagactaccacagagcgcgatagcgacacggacgtggaagaagaggagctgcccgttgaaaatagagaggcggttctgaaagatcacactaagatcagggccctagtccgggctcatagcgaaaaagaccagccacctttcggcgactctgacgactcagttgaggctgacaaatccagccctggaattcaccttgaacgctctcaggctagtaccaccgtggacatcaacactcaagttgaaaaagaggtgcctcccggaagcgcaatcattcatattaagaaacatcaagtgtccgtcgaaggtaccaaccagacagacgtgaaagcggtcggagggccagcgaagctgctggtcgtgtccctggaagaggcatggccactccacggggactgcgagaccgacgcagaagagggaaccagtctgacagcctctgtagtagctgatgtaaggaagtcacagctcccagccgaaggggatgctggcgccgaatgggccgctgcagtactgaagcaagaacgggcccacgaggttggtgcccagggtggaccccctgttgctcaggtcgagcaagacctccccatttcgcgcgaaaacctgacagatctggtagtggacaccgacactcttggagaatctacccaacctcagcgggagggcgcccaggtgcccacaggtagggaacgggagcagcacgtcgggggaacaaaggatagtgaagataattacggcgactcggaggaccttgatctccaggccacccagtgctttctggagaatcaaggcctggaagccgtgcagtctatggaagatgagccgacccaagcgttcatgttaacccccccccaggaactgggaccatctcattgcagtttccagacaacaggcaccttggacgagccgtgggaggtgctggcgacacaaccattttgcctgagagaatctgaggatagcgagacccaaccttttgacacccacctggaggcttacggaccgtgcctgtctccgccacgggccatcccgggcgaccagcatccagaatctcctgtccatacagaaccaatgggcatccaggggcgcggaagacagacggtggataaggttatggggattccgaaagaaacagccgagagagtcggccccgagcggggaccgctggaacgagaaaccgagaagctgctccctgagcgtcagacagacgttactggcgaggaagagctcaccaagggaaagcaagacagagagcagaagcaattgcttgcaagagatacgcagaggcaggagtctgacaagaatggtgaaagcgcttctccagagagagacagagaatctctgaaggtggagatcgagacgtccgaggagatacaagaaaagcaggttcagaagcaaactcttccctccaaagcattcgagcgtgaagtcgagagaccagttgccaacagagagtgtgaccccgctgagctggaagagaaagtgcccaaggtgatcttagagcgggatacacagagaggggagcccgagggcggctcccaggatcaaaaggggcaggcaagttcgccaacccctgagccaggggtgggcgccggggacctgcctgggcccacaagcgcccccgtgccaagcggcagccaatctggcggaagaggcagcccagttagccctagaagacatcagaaaggactgctcaactgtaaaatgccgcccgctgaaaaggcatctcgcattcgagctgccgagaaggtctcgagaggcgaccaggagtcccctgacgcctgtctgcccccgacggtcccagaggctccagctcccccccagaaaccactgaatagccagagtcaaaagcacctcgctccgccccccctcctctctcccctcttaccgagtattaaaccaacagtgaggaagacaaggcaggacggttctcaagaagctcccgaggctcctctgtctagtgaactcgagccatttcatcccaaaccgaaaatcagaactcggaagagctcccgtatgacaccttttcccgcaacgagcgcggcccctgagccacatccctctacgtcaaccgctcagcccgtcacaccgaagcctactagccaggccacaagatcccgtacgaacaggagctccgtaaaaacccccgagccggtggtcccaactgccccagaattacagccatccacatccacagatcaaccagtcacctctgagccaacatctcaagtgacccgggggcggaagagcaggtcctccgtgaaaacacccgagacagtcgttcccactgccctcgagctgcaaccatctacatcaactgatcgccccgtgacaagtgaacccacctcccaggcgacaaggggacggaaaaaccgctcatctgtaaagacacctgagcctgttgtgcctactgcaccagaactccagccttctacctctaccgaccagcccgtaacgagcgaacctacataccaggccactcgcggcaggaagaacaggagctctgtaaaaacccctgaaccagtcgtacctactgcacctgagctcaggccaagcacctccactgatcgtccagtcacgccaaagccgacgtctaggacgacacgaagccgcacgaacatgtcctccgtgaaaacccccgaaacagtggtgccaactgcaccagagcttcagatctctacaagcaccgaccagccagtaacccccaaaccgacctcacggactacccggtccagaaccaatatgtccagtgtgaagaaccccgaatcaacagtacccatcgcgccagaactgccacctagcacatccaccgaacaaccagtgacccccgagcctacctcccgggcaacccgcggtcgcaagaatagatccagcggaaaaacaccagagactttagtgcctacagcccctaagctcgagccatctaccagcacagatcaaccggtgacacccgagcccacctcccaggctacacgcgggaggaccaatcgctccagcgtgaagacgccagaaaccgttgttcccactgcccccgaactgcagcctagcacatctactgaccagccagtcaccccagaacctacaagccaggccacgcggggccgcaccgaccgctcatctgtcaagacacccgaaaccgtcgtgccgacagctccggagttgcaggcgtcagcttcaaccgatcaacccgtcacaagcgaacctacttcccgtacaacccgcggcagaaaaaatagaagcagcgtgaagaccccagaaaccgtggtgcccgccgcccctgagctgcagcccagcacttccacagaccaacctgtcacccctgaaccaacttcgagggccacaagaggacgcacaaaccgctcctcggttaagacacccgagtcgatcgtgcctatagctcccgaactgcagccttcaaccagccgaaatcagctggtgacccccgagccaacaagcagagctactcgatgccggacaaaccgctccagtgtgaagacacccgagccggtcgtacccaccgcgcctgagccacaccccacaacctcaactgatcaacccgtcacccccaagctcacctcgagagcgactcggcggaagacgaaccgcagcagtgtcaagacaccaaagccagtggagcctgccgcatccgatcttgaaccctttacgcctactgaccaaagcgtcacacccgaagccatcgcccagggcggacagagcaagactctgagatcttccacagtgcgcgcaatgcccgtgcctacaaccccagagttccagtctcccgtgacaaccgatcaaccaatctcccctgaacctattacccagccctcgtgcatcaagaggcagagagccgccggaaatcccggcagcctcgctgctcccatcgaccacaagccatgcagcgcaccactggagcctaagagccaggcatcaagaaaccagaggtggggtgcagttagggccgctgagtccttaacggccatccctgagccagcgtccccacagcttctggaaaccccaattcatgcctctcagattcagaaggtagaaccggcagggcgcagtagatttacaccagagctgcagccaaaggcaagtcagagtagaaaacgttcacttgctaccatggattcaccccctcaccagaaacagccccagagaggcgaagtcagccagaagactgtcattatcaaggaagaggaagaggacactgccgaaaaacccggaaaagaggaggatgtggttacacccaagcctggaaaacggaagagagatcaggccgaagaggagccgaacaggattccatctcggagcctgcgcagaacaaagctgaatcaggaaagcaccgcaccaaaagttttgttcacgggtgtcgtggacgcaaggggggagcgtgctgtgcttgctctggggggaagcctggccggatccgctgcggaagctagccacttggtgacggacaggattcggcgaacggtgaaatttttatgtgccctaggaagaggaatccctatactctccctggattggttgcaccagagcagaaaggcaggcttctttctgcccccagacgaatatgtagtcaccgaccctgaacaagaaaagaatttcggtttctctctgcaggacgccctgtcacgtgccagagaaaggcggttgctcgagggttatgagatctacgtgacccccggagtgcagcccccccccccacaaatgggggagataatttcttgctgcggcggcacatacctcccctccatgcccaggtcttataagcctcaacgggtcgtgatcacttgtcctcaggacttcccacactgctccatccctttacgagtcggcctccctcttctttcccccgagtttctgcttaccggtgtccttaaacaagaagccaagccagaggcatttgtcctgtcccccttagagatgtcctctacatag

SEQ ID NO: 194516 - DNA, 489 bp, Artificial Sequence
  Description of Artificial Sequence: Synthetic coding sequence
atggaggacacccaggccatcgactgggacgtggaggaggaggaggagaccgagcaatcatctgaatccctgaggtgcaacgtggaaccagtgggcaggctgcatatcttctctggagctcatggccccgaaaaagatttccccctacacctaggcaagaatgtggtgggaaggatgccagactgttccgtggccctgccctttcctagcattagtaaacagcatgccgaaatcgagatcctggcttgggacaaggcaccaattctcagagactgtgggtctctaaatggcacccaaattcttcgacccccgaaggtgctttcccccggcgtgtcccaccgcctgcgtgaccaggagctaatcctcttcgcagacctcttgtgccagtaccatcggctggacgtgagcctgccctttgtgtcgcgtggtcctctaacagtcgaagaaacaccacgagtacagggcgagactcaacctcagaggctgtag

SEQ ID NO: 194517 - DNA, 921 bp, Artificial Sequence
  Description of Artificial Sequence: Synthetic coding sequence
tgacacgtgggcggcaccaaggacagcgaggacaactacggcgactcagaggatctggacttgcaggccacacagtgcttcctggaaaatcagggtcttgaggccgtgcagagcatggaagacgaaccaacccaggcctttatgctaacccctcctcaggagctcggaccttcacattgtagcttccagactaccggcttgcttaattgcaaaatgcctcccgccgaaaaggcaagcaggattcgggctgcggaaaaggtatccagaggggatcaagagtcccctgacgcttgtttgccgcctactgtgcctgaggcacccgcgcccccccagaagccgttgaattctcagagccaaaaacacctcgcgccccctcccctactgagtcccttgctcccatctataaagcctacagtgcgcaagactcgccaagacggatcacaagaagcacccgaggcccctctgtccagtgagctagaaccattccaccccaaacctaagatccgaacacgcaagtcttcacgcatgacaccatttccggcaacgtctgcagcgcccgaaccccatcccagtacctccacagcgcagcccgtgacaccaaagcctacatctcaagcaaccagatcccgaaccaacaggagctccgtgaaaactcccgaacctgttgtgcccaccgcccccgagttgcagcctagcacctcaacagatcagcctgtgacaagcgaacctacctcccaggttactcgcggcaggaaatctaggtcgtccgtaaaaacccccgaaaccgtcgtgccaacagctctggagctgcagccttctacgagtactgacagaccagttacctccgaacctacctcacaggccaccaggggacgaaagaaccgtagctctgtgaagacgcccgagcccgtcgtcccctag

SEQ ID NO: 194518 - DNA, 921 bp, Artificial Sequence
  Description of Artificial Sequence: Synthetic coding sequence
tgacacgtgggcggcaccaaggacagcgaggacaactacggcgactccgaggacctagatctccaagctactcagtgttttctcgagaatcagggcctagaggccgtgcagtccatggaggacgagccaactcaggcctttatgttgacacctccccaggagctcggccccagccactgttccttccagacaactgggctgcttaactgtaagatgccgcccgctgaaaaagcatctcgcatcagggcagcggaaaaagtatctcgtggcgatcaggaatcgcctgatgcctgcctgccacctactgtcccagaagccccagctccaccacagaaaccactgaattcgcagagtcaaaaacaccttgctcctcccccgcttctgtcccctctgctgcccagtatcaaacccacagtgcgtaaaactcggcaagatgggagccaggaggctcccgaagctccacttagcagcgagttagagcctttccatcctaagcccaagatcagaacaagaaagagtagccggatgaccccctttccagcgacttctgccgcccctgagccacacccctctaccagcacagcacagccggttacaccaaagccaaccagccaggcaacacggagtaggaccaatagatcttccgtgaagacgcccgagcctgtcgtgcctactgcacctgagctgcagccttctacctccacagatcaacccgtgacgagcgaacctactagccaagttactcgcggtagaaaaagtagatcatcagtaaaaactcccgaaacagtagtacccactgccttggaactgcaaccaagcacaagcaccgacagaccagtcaccagcgagccaacgtctcaggccacaaggggccgcaagaatcggagctccgtaaagacacctgaaccagtggtgccatag

SEQ ID NO: 194519 - DNA, 384 bp, Artificial Sequence
  Description of Artificial Sequence: Synthetic coding sequence
atggaggacacccaggccatcgactgggacgtggaggaggaggaggagaccgaacaaagttcggagtctttacgctgcaacgtggagcctgtgggccggttacatatattttcaggcgctcatggccccgagaaggactttcctttgcacctcggtaaaaacgtggtgggtaggatgccagattgcagtgtggccctgccctttccttcgataagcaagcaacacgcagagatcgagatacttgcttgggacaaggctcccatccttcgtgattgcggctccctgaacggaacccaaatacttaggccaccaaaggtcttaagcccgggggtcagtcatcgacttcgggatcaggagctgattttattcgccgacctgctgtag

SEQ ID NO: 194520 - DNA, 921 bp, Artificial Sequence
  Description of Artificial Sequence: Synthetic coding sequence
tgacacgtgggcggcaccaaggacagcgaggacaactacggcgacagtgaagacctggacctgcaggctacccaatgctttctggagaaccaaggcctggaagctgtgcaatctatggaggatgaacctacacaggccttcatgctgacacctcctcaggagctgggtccatctcattgtagctttcagacgaccggcttactcaattgcaagatgccgcctgccgaaaaggcttcccgaatcagagcggccgagaaggtgagccgtggtgatcaggagtcgccagacgcgtgcttgccgccaacagtacccgaagcgcccgcgccgccacagaaaccactcaatagccaaagtcaaaagcaccttgcccctcctccactgctgtctccacttttgccttctatcaagcctacagtcagaaagaccagacaggatggatcacaggaagccccagaagcaccgttgtcaagcgagctcgaaccgtttcacccaaaacctaagattcgcacgaggaagtcatccagaatgacacctttccccgcgacttcggctgcccccgaaccccatccaagtactagcacagcacaacccgtaacccctaagccaaccagccaggcgacccgatcaagaacaaaccggagtagtgtgaaaactccagagcctgtagtgcctactgcacctgagctgcagccctctacctctaccgaccagccagtgacatctgaacccacaagccaggtgacgcgaggcaggaaatcccgcagcagcgtgaagactcctgaaacagttgtccctactgctctggagctgcagcccagcaccagcaccgacagacctgtcacttccgaaccaacgtcccaggctacccgcggcaggaaaaaccgctccagcgtgaaaacccctgagcctgtcgtgccctag

SEQ ID NO: 194521 - DNA, 489 bp, Artificial Sequence
  Description of Artificial Sequence: Synthetic coding sequence
atggaggacacccaggccatcgactgggacgtggaggaggaggaggagacagagcaatccagtgagagtctgaggtgtaatgtggagcccgtaggacgcctgcatattttttcaggcgcgcacggacctgaaaaggactttcccttgcatctcggcaaaaatgtcgtcggtcgcatgcctgactgttctgtggccctcccttttccaagcattagcaagcagcacgcagagatcgagatcctggcctgggataaagctcccatcttgagggattgcggatcactgaacggtactcagatactgaggccaccgaaagttctaagtccaggtgtgtcgcataggcttcgtgatcaggaactgattctcttcgcagatcttctctgccaatatcataggctggacgtctccctgcctttcgtcagcaggggcccactgactgtggaagagacaccccgcgtgcagggcgaaacccagccacagcggctgtag

SEQ ID NO: 194522 - DNA, 6270 bp, Artificial Sequence
  Description of Artificial Sequence: Synthetic coding sequence
atggaggacacccaggccatcgactgggacgtggaggaggaggaggagacagaacagtcgagtgagtccctcaggtgcaatgtcgaaccagtgggcaggttgcatatttttagcggtgcacacgggccagagaaggattttcctctgcacctcggaaagaatgtggtgggccgcatgcccgactgtagtgtggcattgcccttcccatccatcagcaaacagcacgccgaaatcgaaattctggcctgggacaaggcacccatactcagagactgtgggtccttgaatggcactcagattctgcgacctcccaaggtgttgtctcctggggtctcacaccgcctccgggatcaagagctgatcctgttcgcagacctgctctgccagtaccatcggctggatgtttccctgcctttcgtgtcccgagggccgctcacagtggaggagactcctcgagttcagggggagacacagccccagaggctcctgctagcagaggattccgaagaggaagtggacttcctttccgagcggagaatggttaagaagtctagaaccactagttcttctgttattgtgccagaatcagatgaagaaggtcactccccagtgctgggcggcctggggccccccttcgcgtttaacctgaactccgacactgacgtagaggaagggcaacaacctgcgacagaagaggcatcgagtgccgctcgacgcggagctaccgtcgaagccaagcagtcagaggctgaggtggtgacagaaatccagctggagaaggatcagccgctggtaaaagagagggacaacgatactaaggttaagagaggagccgggaacggggtggtgcctgccggagtgatcctggaacggagtcagcctcctggcgaggacagtgatactgacgtagatgatgactccagaccacccggcaggcccgcagaggtgcacctggagcgggctcaacctttcggctttattgattccgacacggacgcagaggaagagaggatacccgcgacccctgtggtaattcctatgaaaaaacgtaaaatcttccatggggtgggaactcggggccctggcgctcctggactagcccatctccaagaatcccaggcaggctcagacacagacgtcgaagaagggaaagcccctcaggctgttcctcttgagaaaagccaggcctctatggttatcaacagcgatacggatgatgaggaggaggtgtctgcagcactgaccttggctcatctgaaggagtctcagccggctatatggaacagagacgccgaagaggatatgcctcagagagtggttctgttgcagagaagccagaccaccacagagcgggattccgacaccgacgtggaggaggaagaattacccgtcgaaaatcgtgaagcagttcttaaggaccatacaaaaatcagagccctggttcgcgctcactctgaaaaagaccaaccgcccttcggtgatagcgatgattctgtggaggccgataagagctcccctggcattcacctcgaaagaagtcaggccagcaccacagttgacattaacacacaggtggaaaaggaggtgcccccaggatccgccattattcacatcaaaaagcaccaggtgtctgttgagggcactaaccaaacagatgtaaaagcagtcggaggccccgcgaagttactggtagtgtccctggaggaggcctggcctctgcatggagactgtgagaccgatgctgaagagggcacatccttgacagcttccgtggttgccgatgttagaaaatcccagttgcccgccgagggcgatgctggcgccgaatgggcagccgccgtgttgaagcaagagagggcccatgaagtgggagctcagggtgggccgccagtagcacaagttgaacaggacctgccaataagtcgggaaaatctgacagacttggtggtcgacacagatactttgggggaatctacacagccacaacgtgagggagcccaggttcccaccggcagggagcgtgagcagcatgtgggcggaaccaaggactcagaagataattatggtgacagtgaggatctggacctgcaggcaacccagtgcttcctcgaaaatcaagggctggaagccgtccaaagcatggaggacgagccaacacaggcttttatgctaacccctcctcaggagctgggaccgtcacactgcagcttccaaacaaccggcaccctcgatgagccttgggaagtgctggctacacaaccattttgcctgagagagagcgaagactccgagacgcagcccttcgatacacatttggaggcttatggcccatgcctttcccccccccgggcaatcccgggcgaccagcatccagagtcaccagtgcacacagaaccaatgggaattcagggaaggggaaggcagaccgtcgataaggtgatggggatacccaaggagactgcagagagagtcgggcccgaaaggggaccgcttgagcgcgagaccgagaaattgctgcctgagcgtcagaccgacgtaacgggagaagaggagctgaccaaggggaagcaggatcgcgaacagaaacagctactcgcgagggacacccagcggcaggaatctgacaagaatggggagtcagcctctccagaacgcgatcgggagtccctgaaggtggagatcgaaacctcagaggaaattcaggaaaagcaggtccagaagcagacattgcctagtaaggcctttgaacgcgaagtggagcgaccagtggccaatagagagtgcgatcccgctgagttggaggagaaggtgccaaaggttatactggaacgggatacccagaggggggagccagaaggcggcagtcaagatcaaaagggacaggccagctcccctacccctgaaccaggcgttggggcgggcgatcttcctggacctactagcgcacctgtcccctcaggaagtcagtcaggcggacgtgggtcccctgtaagccctcggcggcatcagaaaggacttttgaattgcaagatgcctcctgcagagaaagcgtcccgcatccgtgctgccgagaaggtatctaggggggaccaggagtcccctgatgcttgtttaccacccactgtgccagaagcccccgcccctccacaaaagcccctgaactctcaaagtcaaaagcacctcgccccacccccactgctctctcccttattaccatccatcaaaccaacagtgcgcaaaactcgtcaggacggtagccaggaagccccagaagcaccactctcatcagagctggagccatttcacccaaagccgaaaataagaacccggaagagctctcgaatgacacccttccctgctacctccgcagcccctgaacctcatccaagtacctctacggcccagccagtgactcctaaacctacttcccaggccacgagatcacgcactaaccggtcgagtgtaaagacaccggaacccgtggtgcccacggcccccgaactacaaccatccaccagtaccgatcaaccggtgacttccgaacctacgtcacaagtcactcgcggtaggaaatctaggtcctctgtgaagactcccgagacggtggttcccaccgccctcgagctgcagccgtccacctctacagaccgccccgtgacatcagaacctaccagccaggcaacacgtggccggaagaaccggtcaagtgtgaaaaccccagagccggtggtgccaaccgcaccagagcttcagccttcgacaagcacagaccagccagtgacttccgagcccacctatcaggcaacaagaggccggaagaataggtccagtgttaagacgcctgaaccagtggtaccgactgctcctgagctccgcccctccacctcgaccgatcgaccagtgacacccaaacccacttctcgcacaacacggtcccgcacaaatatgagctcggttaaaacccctgagaccgtggtccccacagccccggagctccaaatcagcaccagtacagatcagcctgtgacccccaagccaacaagtcgcacgactaggtcaagaacgaacatgagttcagtaaagaaccccgaaagcactgtgccaatcgcacctgaattgcctccatccacatctaccgagcaacctgtcaccccagaacccaccagcagagcaactcgcgggcggaagaatcgctcttctggcaagactccagagacactcgttccaaccgcccccaaactggagccgagcacttccaccgatcagcccgtgactcctgagcctacatcccaggccactaggggacgaacaaatcgcagttcagtcaagactccagaaaccgtggtccctaccgcccctgagctgcagccctcaacatctactgaccagcctgtcacacccgagcccacgagccaggctactagaggtaggaccgatagatcttccgtgaaaacaccggagacagtagtcccaaccgcgccggagttgcaggcgagcgcctctacggatcagcccgtgacatctgaacctaccagtcggactacccgaggaagaaaaaatagatcatcagtgaagactcccgaaactgtggttcctgcggccccggagcttcagccaagcaccagcaccgatcagcccgtgacaccggaacctacatcccgggccacacgagggaggaccaaccggagctccgttaagacccctgagtctatcgtccctatagcccccgagcttcagccttccacatctagaaatcagctggtcaccccagaaccaacttctagagccacaaggtgcagaacaaaccggagcagtgtgaagacccccgaacctgtggttcccaccgccccagaaccgcacccaactaccagcacagaccagcccgtcacccctaagctcaccagtcgcgcgacccgacgcaagacgaaccgcagcagcgtaaaaaccccaaagccagtcgaacccgcagcctctgacctcgagcccttcacccctaccgaccagagcgttacccctgaagcaatcgcacaggggggccagtccaagactctgcgctcaagtacggtgcgagctatgccagtcccaactacccctgaatttcagtcacccgttactaccgaccagcccatcagtccagaacctatcacacagccatcttgcattaagcgtcagagagctgccggaaacccaggcagcctcgctgcgccaatagatcacaaaccttgcagtgcccccctagaaccaaagtcacaggcgagcagaaaccagcgatggggggccgttcgtgccgcagagtctctgaccgccattcctgaaccagcaagccctcagcttctcgaaacgcccatccatgcatctcagatacagaaagtggaacccgccggacgaagccgttttactcccgaactccagcccaaggctagccaatccagaaaacgcagccttgcgactatggacagtcccccccaccagaagcagccacagaggggcgaagtctcacaaaagaccgtgattatcaaagaggaagaggaagatacagcagaaaagcccggaaaggaagaagacgttgtgacgccgaagcctggtaagaggaaacgcgatcaggcggaggaggaaccaaaccgaatccctagtaggtcgctcagacgaacgaagctgaatcaagaaagcacagcacctaaggtgctgtttaccggtgttgtggacgccaggggcgaacgcgccgtcctggccttaggaggctcccttgctgggagtgcagccgaggcatcccatttggtaacagaccggatcaggagaaccgtcaaattcctctgtgccctggggcgcggcatccccatcctctccctagattggctgcatcagtctaggaaagctggcttcttcctaccacctgatgagtacgttgtcactgatccggagcaggagaagaattttggtttttctctgcaggatgctttatccagggccagggagcgtcgcctgcttgaggggtacgagatatatgtgaccccgggagtgcagccacctccccctcagatgggggagataatctcatgttgcgggggcacttacttaccgagcatgcctagaagctataagcctcagagggtagtaattacttgtccacaagacttcccacactgttcgatcccattgcgtgtgggccttccacttctttcaccagaatttttgttgaccggagttctgaaacaagaggccaaacccgaggccttcgtactttctcctttagagatgagctctacctag

SEQ ID NO: 194523 - DNA, 735 bp, Artificial Sequence
  Description of Artificial Sequence: Synthetic coding sequence
atggaggacacccaggccatcgactgggacgtggaggaggaggaggaaacggagcagagctcagagtcgctgcggtgtaacgtagagcctgtagggcgtctgcacatattctctggcgcccacgggccagaaaaggacttccccctgcacctcggcaagaatgtggtgggacgcatgcctgattgcagcgttgcactgccctttcctagtataagcaagcagcacgccgaaatcgaaatccttgcctgggataaggcccccattctccgagattgtggcagtctcaacggcacacagatactccgtcccccaaaagtcctcagtcctggggtgtctcatcgcctaagagaccaagaactgatcctgttcgccgatctgctctgtcagtaccatcgcctggatgtgagcttgccctttgtatcacgggggccgctaacagtcgaagagacccccagagtgcagggagaaacacagcctcagagactgttgctggccgaagattctgaggaggaggtggacttcctctctgagcgccggatggttaagaagtcccgtacaacctccagctctgtcatcgtgcctgaatccgacgaagagggccactcacccgtgctgggaggactcgggcccccttttgctttcaacctaaacagcgatacagacgttgaggagggccaacaaccacaccggggaggactgctaagttgccaaaaacgttgccactgtcggggctag

SEQ ID NO: 194524 - DNA, 384 bp, Artificial Sequence
  Description of Artificial Sequence: Synthetic coding sequence
atggaggacacccaggccatcgactgggacgtggaggaggaggaggaaaccgagcagtcgtcagagtccctgcgttgcaacgtggaaccggtgggtcgactgcacatcttctctggcgctcatgggcctgagaaggacttccctttacatttgggaaaaaatgtggtagggcgcatgcccgattgcagtgtggccctgcctttcccttcaatctctaagcagcacgccgagatcgaaatcttggcttgggataaggccccaatcttgagggattgcggtagtttgaatggaacccagatactgagaccaccaaaggtgctaagtcctggagttagccacagactgagagatcaggaactgatcctttttgcagatttactgtag

SEQ ID NO: 194525 - DNA, 342 bp, Artificial Sequence
  Description of Artificial Sequence: Synthetic coding sequence
atggaggacacccaggccatcgactgggacgtggaggaggaggaggagacagagcagtccagtgagagccttcgctgtaatgttgagccagttggccggctgcacattttttccggggcccacggtccagagaaggacttcccccttcatctcgggaagaacgtcgttggcagaatgcctgactgctctgtcgccctcccctttccctctatcagtaagcagcatgcggagatcgagatcctggcatgggataaagctcccatcctcagagactgtggcagcctcaacggtacccagatccttagaccgcccaaggttcttagcccaggggttagtcactag

SEQ ID NO: 194526 - DNA, 5409 bp, Artificial Sequence
  Description of Artificial Sequence: Synthetic coding sequence
atggaggacacccaggccatcgactgggacgtggaggaggaggaggagaccgagcaaagctcagaatccctgaggtgtaacgtggagccagttggtaggcttcacatattcagtggagctcatggacccgaaaaagatttcccgctacacctgggaaagaatgttgtgggacgcatgcctgattgttccgtggccctgccattcccgtccatctccaaacagcatgccgaaattgagattctcgcttgggacaaggctcctattttgcgggattgcgggtccctcaacggcactcaaatccttagacctcctaaagtcttatccccaggagtgagtcatcgactgagggaccaggagctcatcctgttcgccgacctgctgtgccaatatcaccgcttggacgtgtctttgcctttcgtttcaaggggcccactgactgtggaagagacaccccgtgtccaaggagaaactcagccacagcggttacttctggctgaagactccgaagaggaggtggattttctctcagagagacgcatggtgaagaagagcagaaccacgtcgtcctctgtaatagtccccgaatctgacgaggaaggtcattctcctgttctgggcggcctaggtccgccgttcgcattcaatcttaattctgatactgatgtcgaagagggtcagcagcctgcaacagaggaggctagctccgccgccagaagaggtgccacagttgaggccaagcagagcgaagcggaggtggttactgaaatccagctggagaaggaccaaccactggtcaaagagagagacaatgacacaaaggttaagcgtggtgcgggcaacggggttgttccagccggcgttatcctggagagatcccagccccccggggaggattctgacaccgacgtggacgacgactcccgacctcccgggcgcccagcagaggtccatctcgaacgggcccagccgtttggtttcatagattccgacacagacgctgaggaggagcgcattcccgcaactcccgttgtgattccaatgaaaaaaaggaaaatcttccacggagttggaactaggggcccaggagcccctgggctggcccatttacaggagagtcaggccggtagcgacacagacgttgaagaaggcaaagccccacaggccgtcccactcgagaaaagccaagcgtctatggtgatcaatagcgatacagatgacgaagaggaagtgagcgccgccctgaccttagcccacctgaaagaaagtcagcctgcaatatggaatagggacgcagaggaggatatgccgcagcgggtggtacttttgcaacgctcccagaccacaaccgaaagggactccgataccgatgtggaggaggaggagctgcccgtcgaaaatagggaagccgttttgaaagatcacaccaagatccgggcgctggtcagggcccattcagaaaaggaccagcccccctttggcgatagcgacgattctgtggaggcagacaaatcttctcctggaatacatctcgaaagaagtcaggcttcaacaactgtcgacatcaacacccaggttgaaaaggaggtgccccccggctccgccatcatccacattaaaaaacatcaggtgtctgttgagggcacgaaccagactgacgttaaagccgtggggggacctgctaagctgctggtcgtctctctagaggaggcttggccgctgcatggagattgtgagaccgatgcagaggagggcacaagcttgactgctagcgtggtggcggacgttcggaagtcacagctgcccgctgaaggcgatgctggcgcagaatgggccgccgcagttctgaaacaggaaagggcacacgaagtaggtgcccagggtggcccgcctgtcgcccaagtggagcaggatctaccaatctcacgcgagaacttaaccgacttagtcgtagacaccgacaccttgggcgagagcacacagccgcagcgggagggcgcgcaggttcctaccggtcgggaaagagagcaacacgtgggtggcactaaagactctgaagacaattacggcgacagtgaggatcttgacctgcaggccactcagtgtttcctcgagaaccagggtttggaagccgtgcagagtatggaagacgaacctactcaggccttcatgcttacacctccccaagagcttggaccgtcacactgcagcttccaaaccacaggtacactggacgaaccgtgggaggtcctggcaactcagcctttttgcctgcgagagagcgaagattctgagacccagcccttcgacacccatttggaggcttatgggccctgtctctcaccgccccgtgccatcccaggggaccaacacccagaatctccggtgcacaccgagcctatggggattcagggaaggggacggcagacagtagataaagttatggggattccgaaagagacagctgaacgcgtcgggccggaacgcggaccccttgaaagagaaaccgaaaagctcctgcccgagaggcaaactgatgtgacaggcgaagaagagctgacaaaagggaaacaggatcgtgagcaaaaacagctcctggccagagacacgcagaggcaggaaagcgataagaacggcgagtctgcttctcccgagcgcgacagggagtcactgaaggttgagatcgagactagcgaggaaattcaggaaaagcaggttcagaaacaaaccttgccaagtaaggccttcgaacgcgaagttgagagaccagtggccaatcgggaatgtgaccccgcggaactcgaggagaaggtgccaaaggtgatcctcgaacgcgatacgcagcggggggaacctgaaggggggtcacaggatcagaagggacaggcgagcagtccaacaccagagccaggtgtgggggccggcgacctccctggccctacttccgcaccagtgccgtcagggtcccagtccgggggccgcggttcgccagtcagcccaagacggcatcaaaagggcctgctgaactgcaagatgccccctgccgaaaaggcatctagaatacgagcagctgagaaggtctctagaggtgatcaagaaagcccggatgcatgccttccacctaccgtgcccgaggcccccgctcctcctcagaagccccttaatagccagagccagaaacacttggcccccccgcccttgctttcgcctttgttgcccagcatcaagcctacggttagaaaaacacgtcaagacggctcacaggaggcccccgaggcccccttatcttccgaattggagccctttcaccccaagcctaaaatccgcacacgcaagtcttcgaggatgacaccctttccggctacttccgctgcccctaaactggagccctctaccagtacagatcagcccgttacccctgaacctacctcccaagcgactcgggggcgcacaaaccgtagttctgtgaagaccccggagacggttgttcccacagccccggaactccagccatcgacttctactgaccagcctgtaacccctgaacctaccagtcaagctacccgcggccgtactgataggagcagcgtgaagacacccgaaaccgtggttcctaccgctcctgaacttcaggcaagtgcatctactgatcagccggttaccagcgaaccgaccagccgtacaacacggggaaggaagaacaggagttctgtgaaaacgcctgagacagtggtgcccgccgccccagaactccagcccagtaccagtacagaccagccggttacccctgagcctacttccagggctactagggggcgaacgaacaggtcaagtgtcaaaaccccagaatctatcgtcccaatcgcacccgagctgcagcctagcacttccaggaaccagttagtgaccccagaaccaacttcccgagctacccgatgcaggacgaaccggtccagtgtgaaaactcccgaacccgtggttccaacagcgccggaaccacaccccaccacatcaacagatcagcctgtgacgccaaaactcaccagccgggccacgcgtaggaaaacgaacagatctagcgtgaagacgcctaagcccgtggagcccgccgcatcagacttggagccattcaccccaacggaccagtcggtgacccccgaagcgatagcacagggtggtcagagcaaaacgctccggtcttccacagtcagggcgatgcccgtgccgaccacccctgagttccaaagtccagtgacaacagaccagcccatctctcctgagcccataacacagcccagctgtatcaaaagacagagagccgcagggaacccaggcagcctcgccgctccgatcgaccacaaaccctgctctgcccccctggagcctaagagtcaagctagcagaaatcaacgttggggtgcggtgagggcagccgaatccctcaccgctatcccggaaccagcaagcccccagttgctggagactcctatccacgccagtcagattcaaaaagttgagccggccggtcggtcccgcttcactcctgagcttcagccaaaggcatcccagagcaggaagcgcagcctagcaaccatggactctcctccccatcagaagcagccgcagcggggtgaagtgagtcagaaaaccgtcatcataaaggaggaagaggaagataccgctgaaaagcctggcaaggaggaagacgtcgtcacccccaagccgggaaaaagaaagcgtgaccaggcagaggaggagcccaacagaatccccagtaggtccctccggaggactaagcttaaccaagaaagcaccgccccaaaagtgctattcacaggagtggttgacgctcggggcgaaagggccgtcttagccctcggcgggtctctggcaggctccgccgctgaggcctcccatctcgtgactgatcggatcaggaggacagtgaagttcttatgtgccctcgggcggggcattccaattttaagcctcgattggctccatcagagcagaaaagcaggcttctttctgccacctgacgaatacgtggtcacagacccagaacaagagaaaaacttcggcttctccctgcaagacgccctcagccgggccagggaacgtagacttttggagggttatgagatttacgttactccaggagttcaacctccacctccacagatgggagaaatcatcagttgctgcggggggacatatttaccatccatgccccgatcttacaaaccacagagagtggttatcacatgcccacaggacttcccccactgttctataccactgagggtgggactgccattactatctccggagtttttactgaccggggtcctcaagcaggaggccaaaccagaagctttcgtgctctccccactggagatgagctcaacatag

SEQ ID NO: 194527 - DNA, 735 bp, Artificial Sequence
  Description of Artificial Sequence: Synthetic coding sequence
atggaggacacccaggccatcgactgggacgtggaggaggaggaggagacggagcaaagcagcgaaagcctccggtgcaacgtggagcctgttggccggctccatatattctctggggcccacgggccagaaaaagatttcccattacatctcggaaagaacgtcgtgggtcggatgccagactgttctgtagctctgcctttcccctccatatctaaacagcacgccgagattgagattctcgcttgggacaaagcgccaattctcagggactgtggctctttgaatggtactcagatcttaaggccaccaaaggtgctctctcccggcgtgtctcaccgcttgcgagatcaggagcttattctttttgccgacctgctctgccaataccatagacttgacgtgtctcttccttttgtgagtcggggtcctctgactgtcgaagagacgccacgggtccaaggggaaactcagccccaaaggctcttactggccgaagacagcgaggaagaggtcgatttcttgtctgagcggagaatggtgaaaaagtccaggacgacttcttcctctgtgattgtgcctgagtcagatgaagagggccattcccctgttctgggcggactcggtccccccttcgccttcaatcttaatagtgatactgacgtagaggagggacagcaacctcaccgaggcggcctcttatcctgtcagaagagatgtcactgccgtgggtag

SEQ ID NO: 194528 - DNA, 5409 bp, Artificial Sequence
  Description of Artificial Sequence: Synthetic coding sequence
atggaggacacccaggccatcgactgggacgtggaggaggaggaggagacagagcagtcttccgagtcactgcgatgcaatgttgagcccgtgggccgactgcacatttttagcggcgcgcacggccctgaaaaagacttccctttgcatttaggaaagaacgtcgtgggtaggatgcctgattgcagcgtggctctgcctttccctagcatcagtaaacagcacgccgagatcgagatactggcctgggacaaagctccaatcctacgcgactgcggctcactgaatggaacccagatcctgagacctcctaaagtgttgagcccgggggtttcacacagactccgagatcaagagttaatcctttttgccgatctgctgtgtcagtaccacagacttgatgtgtcactcccctttgtctcgcgcgggcctctaacagtcgaagagacacctagggtgcaaggagagacacagccccaacgactcttgctcgctgaggattcagaggaagaggtggacttcctcagcgagaggcgtatggtaaagaagtctcgcacgacatcctccagtgtgatcgtgccagaatccgatgaggaagggcactcccccgtgcttggtggcctcggtcctcccttcgcattcaacctaaactccgacaccgacgtggaagaaggccagcagccagccactgaagaggcatcttcagctgcccggagaggggccaccgtggaagctaaacagagcgaagcggaggtggtgacagagatccagcttgagaaggaccagcccctggtgaaggaacgtgataatgacacaaaggttaaacgtggggccggcaatggcgtggtcccagccggtgtcatactggagcgcagccagccccctggggaagactccgacactgatgtggatgacgatagtcggccacccggaagaccggctgaagtacatcttgaacgcgcccagcctttcggttttatcgactctgacacagatgcggaggaagaaaggatcccggccactccggtggtgattccaatgaaaaaacgtaagatctttcacggggtgggcactcgaggcccaggcgcaccgggcctggctcaccttcaggagtcacaggcaggctctgacactgacgttgaagagggcaaagccccccaggcagtgcctctggagaagagccaggctagcatggtgatcaatagtgatacagatgacgaggaggaggtcagtgctgctctgacactggcgcatctgaaggagtcccaacctgcgatatggaatagggacgcagaggaagacatgccacagagggtcgttctactccaaagaagtcaaacgaccaccgagcgagacagcgacactgatgtcgaggaagaagaacttccagtagagaacagggaggctgtgctaaaagaccacactaaaatccgcgcccttgtcagggcccacagtgaaaaggaccagccgcccttcggggattccgatgactctgtcgaagctgataaatccagccctgggatccacctggagagatcacaggcttccacgactgttgatatcaatacccaggtggaaaaagaagtgcctcccggcagtgctataatccacataaaaaaacaccaagtctcggttgaggggacgaatcagaccgacgtaaaggccgttggcggtcctgccaagctgctcgtggtctcgctggaggaggcttggccactccatggggactgtgagacagacgcggaggagggtacttcattgactgcttctgtagtggcagatgtgcgcaagtctcagctgcccgccgaaggagacgctggggctgaatgggccgcagccgtgctgaaacaggaaagggcgcatgaggtgggcgcacaaggagggccaccagtggcccaggtggaacaggatcttcctattagccgggaaaatctgacagacttggtagtcgacactgacactctcggcgagtcaactcagccccaacgtgagggcgcacaggtccctacgggaagggaaagggaacagcacgtgggtggcaccaaagatagcgaggacaattatggggatagcgaggacctggaccttcaagccacccagtgttttttggagaaccagggtctggaagcagtgcagtccatggaagatgagcctactcaggccttcatgcttacacccccacaagagctcggcccctcacactgcagtttccagactacaggcactctagacgaaccgtgggaagtcttagccacccagcctttctgtctcagggagagtgaggacagtgaaactcaaccattcgacacccacttagaggcatacggtccctgccttagccctcctcgcgccatacccggcgatcagcaccctgagagcccagttcataccgaacctatgggcatacagggtagaggccgccagaccgtcgacaaggtcatgggcatcccaaaagaaacagccgaacgggtaggccctgaaaggggtccattagaacgggaaacagagaaactgctcccagagcgccagaccgacgtgactggagaggaagaactgacaaaaggtaagcaagatcgcgagcagaagcagcttcttgcccgtgatacccaacggcaagaaagcgataaaaacggcgagtctgcaagcccagagagagacagagagtcgctgaaagtggagattgagacatctgaagagatccaggagaaacaagttcagaagcagaccctgccctcgaaagcctttgaaagagaagtggagcgaccagtagcgaacagagaatgtgatccagcagagctggaagagaaggtcccaaaggtgatcttagaaagggatacacagagaggcgagccagaaggaggctctcaggaccaaaagggacaggcctcatccccaacaccagagcctggggtgggtgcgggcgaccttcctgggcccacgtccgcacctgtgccaagcggaagtcagagtggcggtaggggctcaccagtctcccctagacgccatcaaaagggcctgctgaactgcaaaatgccacctgccgaaaaggctagtcggatccgggctgctgaaaaggttagtagaggcgatcaggaatccccagacgcgtgcctgccacctaccgttccagaagctcccgcaccaccccagaaacctctgaactcacaatcccagaagcaccttgccccaccaccacttttgtcccccttgctgccctcaattaaacctaccgtgcgaaagacacgacaggatggaagtcaggaggctcccgaagcgccgctcagttccgagctcgagcctttccacccaaaaccaaaaatccgcacccgaaagagttcaagaatgacgccctttccggcaacgagcgccgccccaaaattggaacctagcacctcgaccgatcagcccgtgactcctgagcctacctcccaggctacccgtgggcgaacaaaccgcagcagcgttaagacaccagagacagtggtccccactgctccagagcttcagccaagcaccagtaccgaccaaccagtaaccccggaaccgactagccaggcaactcggggcagaacggacagaagttcagtcaaaacccctgagaccgtcgttcccacggcccccgaactgcaggcatcagccagtacggaccaaccagttacctctgagcccacatcgcgtactacacgaggccgcaagaaccgctctagtgttaagacaccggaaaccgttgtgccggccgctccggagctgcagcctagcacctcaacggaccaacccgtcacaccagagcctacaagccgggctacgagaggtcgaacaaaccgatctagcgttaaaacccctgagagtatagtgcctattgctcctgagttgcagccttccacaagccggaaccagctcgtaacacctgaacccacatccagggccactcggtgccgtacaaaccggtcttctgtcaaaacccccgagcctgttgtgcctaccgcaccagaacctcatcctacaacctcaacagaccagcccgttacgccgaagctcacctcccgagccacacggcgtaaaacaaatagaagttccgtcaagacgccaaagccggtggaacccgccgcctctgacctagagccattcacacctaccgaccaatccgtgacccctgaggccattgcacagggcggtcagagtaaaacgctgaggagctccaccgtccgcgccatgcccgtgccaaccacgcctgaattccagagtcccgtcacaacagaccagccgatctctcctgagcctattacgcagccttcttgtataaaacgccagcgggccgcagggaatcctggtagcctcgcagcccctatcgatcataaaccttgcagtgcaccgttggaacctaagagccaggcaagtagaaaccagcggtggggagcggtccgggcagctgaaagcctcacggcaattccagaacctgcctctccgcagctgctggagactccaatccacgcatctcagatacagaaggtcgagccagccgggcggtcccggttcactccggagctgcaaccaaaagccagccagtcccggaagcggtcgctagccacaatggatagtcctcctcaccagaagcagccccagcgaggcgaggtgtcacaaaagaccgtcatcatcaaggaagaagaagaagacaccgccgagaagccaggtaaagaagaggacgtggttactccaaaaccagggaagaggaagcgggatcaggcagaagaggagcccaatcgtatcccgagtagatccctgaggaggactaagctcaaccaggaatcgaccgcacctaaagttctcttcaccggcgtggtcgacgcacgtggagagcgggcagtgctggcgctcggcgggtccctggcaggctcagcggcagaggcttcgcacttggtgaccgaccggattaggagaactgtgaaatttctgtgtgcactgggacggggtatacccatcctttctttggactggcttcaccagtcccgaaaagcagggttcttcctgcctcctgatgagtacgtggtgacagaccctgaacaagagaagaacttcggcttctcactgcaggatgcacttagccgggcaagggaacgaaggctgctcgagggctatgaaatctatgtgactccaggggtgcagcctccaccgcctcaaatgggagagatcattagttgctgtggcgggacttacctgccgtccatgccaagatcatacaagccacagcgtgtcgtgattacgtgtcctcaggacttcccccactgttccatccccttgagggtgggtttaccgttattatcgccagagtttcttttgacaggtgtgctgaaacaggaagctaaacctgaggcctttgttctgtcccctctggaaatgtctagcacgtag

SEQ ID NO: 194529 - DNA, 735 bp, Artificial Sequence
  Description of Artificial Sequence: Synthetic coding sequence
atggaggacacccaggccatcgactgggacgtggaggaggaggaggagactgaacaatcgtcagagagccttaggtgcaacgtcgaacctgtagggcgcctgcacattttttctggagcccatggccctgaaaaggatttcccgcttcacctgggcaagaacgtggtcggtcgaatgccggactgtagcgtggccctgccctttccgagtatctctaaacagcacgcagagatagagatcttggcctgggataaagcccccattctccgggactgcggcagcctcaacgggacccagatccttcgtccccctaaggttctgtctcccggggttagtcaccgactgcgggatcaagagctcatcctcttcgccgacctgctttgccagtatcacaggttggatgttagccttccctttgtgtctcgggggcccctaacggtcgaagagactccacgagtacaaggcgaaactcagccacagcgcttgttactggctgaggatagcgaggaggaagtggactttctgagcgaacgtagaatggtaaaaaaaagcaggactacttcatcctccgttattgtgcccgagagtgacgaggaggggcattctcctgtgctgggcgggttaggacccccttttgctttcaatcttaactcggacactgacgtggaagagggccaacagcctcatcgcggcgggctcctctcatgccaaaaaaggtgccattgtagaggctag

SEQ ID NO: 194530 - DNA, 735 bp, Artificial Sequence
  Description of Artificial Sequence: Synthetic coding sequence
atggaggacacccaggccatcgactgggacgtggaggaggaggaggaaacagaacagagtagcgagtcattacgatgcaacgtggagcccgtcgggcggctgcacatcttcagcggagctcacggtccagagaaggatttccccctgcacctggggaagaatgtagtggggcggatgcctgactgctcagttgcactcccgttcccgtcaataagcaagcagcacgcggaaatagaaatcctggcttgggacaaagcaccgattctacgcgattgcggcagcctcaacggcacacagattctgcggccccctaaagtgctgtctcctggtgtgtctcaccgcctccgagaccaggagctgatcctgtttgccgatctgttatgccagtaccaccgcttggatgtgtctcttccattcgtgtccaggggtcctttgaccgtagaagagactccccgagtgcagggcgagacccagccacaacgcctgctcctggccgaggatagcgaggaagaagttgattttcttagcgagcgtagaatggtcaagaaatccagaacgacatcaagctctgtgatcgttccagagagcgatgaagaaggtcactcgccggtgctagggggactcggaccccccttcgcttttaaccttaactctgataccgatgtggaagaaggacagcagccgcatcgaggcggcctgctatcttgtcaaaaacggtgccactgtcgcggttag

SEQ ID NO: 194531 - DNA, 738 bp, Artificial Sequence
  Description of Artificial Sequence: Synthetic coding sequence
atggaggacacccaggccatcgactgggacgtggaggaggaggaggaaacagaacaaagtagtgagtcacttcgttgtaatgttgaaccagtcgggcgcttgcacatcttttctggagcccacggtcctgaaaaggacttccctctgcacctggggaaaaatgtggtagggagaatgcctgattgctcagtcgcactgcccttcccctcaatttcgaaacaacacgctgagattgaaatactcgcgtgggataaggctcctatcttgagggactgcggctccttaaacgggacccagatacttcggccacctaaagttctcagccctggtgtgtcacacaggctccgggatcaggagctgattctttttgcggatctcttatgccagtaccaccgactggacgtttcactgcctttcgtctctagaggtcccctgacagtggaggaaacaccaagggttcaaggcgagacacagccccagcggctcttgctcgcggaagactctgaggaagaagtagatttcttgtctgaaaggcggatggttaaaaagtctcggaccacctcttcttctgtcattgttccagaatcggatgaggagggacattctcccgtcctgggcgggttaggcccccctttcgcttttaaccttaactctgacactgacgtggaggaaggtcagcagccagcaacagaggaggcgtccagcgccgccagacggggcgcgactgtggaagcctag

SEQ ID NO: 194532 - DNA, 5478 bp, Artificial Sequence
  Description of Artificial Sequence: Synthetic coding sequence
atggaggacacccaggccatcgactgggacgtggaggaggaggaggaaactgagcagtcctctgaatctctacggtgcaatgtggagccagtgggccgtctccacattttttcaggagcacatggcccagagaaggatttcccacttcatctgggaaagaatgtggtgggaagaatgcccgactgcagcgtggccttgccattcccatcaatatccaagcaacatgctgaaattgaaatattggcatgggacaaggccccaatcttgcgcgactgtgggagtctgaacggaacacagatcttacggccaccaaaggtcctctctccgggggtgagccacaggctcagagatcaggagctgatcctcttcgccgatctcctgtgccagtatcacagactggatgtgagcctcccttttgtgagccgcggtcccttgactgtcgaagaaacacccagggttcagggagaaacccagccgcagaggcttcttctggctgaggattcggaagaggaggtcgactttctgtcagaaagaagaatggtaaaaaaaagcaggaccacttcctcaagtgtgatagttccggagagtgacgaggaagggcactctccggtgctcggaggcctcggccctccctttgccttcaacctgaattcagacaccgatgtagaggagggacagcagccagcaacggaggaagcatcaagcgctgcccgccggggcgcaaccgtcgaagccaaacagagcgaagccgaggtggttaccgaaatccaactcgaaaaggaccagcctctggtcaaggaaagagacaacgacacgaaagtgaaacggggagctggtaatggtgtcgtgcctgcgggcgtgatccttgagcgaagccaacctcctggagaggattccgacactgacgtcgacgatgattccagacctcctggcagacccgccgaggtgcatctcgagcgagcccagccatttggcttcatcgacagtgacactgatgcggaggaggagcgtatcccagctacaccagtggtgatccccatgaagaaacggaagatattccatggcgttggcacccgtggtcccggcgcgccgggtctggcacatctgcaggagagccaggccggttccgacactgatgtggaggagggaaaggccccacaggcggtgcccctcgagaagtctcaggcatctatggtgatcaacagcgatactgacgacgaggaagaagtcagtgctgcactgactctagcccatttaaaggagagccagccagctatctggaaccgggacgctgaagaggacatgccccagcgggtcgtactgctgcagaggtcgcagacgacgacggagcgcgatagcgatacagacgtcgaggaggaagagctccccgtggagaacagagaggccgtgttgaaagatcacactaagatccgcgctctggtgcgagctcacagcgagaaggaccagcctccatttggagattctgacgacagcgtcgaagcagataagagttcccccggtatccatcttgagcggagtcaagcttcgacgaccgtggatattaacacacaagtagagaaagaggtgccccccggctctgccataattcacattaagaaacaccaagtcagcgtggaaggtactaatcagaccgatgtcaaggcagtcgggggaccggctaagttactggtggttagcttggaggaagcttggccactccacggagattgtgagactgatgccgaggaaggcacctcactaaccgcatctgtcgtcgcggacgtgagaaagtcacagttgcctgcagaaggcgacgcgggggctgagtgggcagccgcagtgctgaagcaggaacgcgcacatgaagtgggcgctcagggaggaccaccagtagcccaggtcgagcaggatctccccattagtcgggagaatcttaccgacctcgtggtggacacagatacactcggcgagtctacacagcctcaaagagaaggcgctcaagtgcccaccggtagagaacgggagcaacacgtcggggggaccaaagattccgaggacaactacggagacagtgaggacctggatctacaagcgacacagtgctttctggaaaatcagggactcgaggcagtccagtcaatggaggatgaacctactcaagccttcatgctgacacctcctcaagaactgggaccctcccactgctcttttcagactaccgggcttctcaattgcaagatgcctccagcggaaaaggcctcacgaatcagggctgccgaaaaagtatcgcgtggtgaccaagaatcacccgatgcctgtctaccccctaccgtaccggaggcccctgctccgcctcagaagccactgaactcgcagtcccagaaacatcttgcaccacctcccttgctcagtccgctgctcccaagtatcaagcccaccgtcaggaagaccagacaggacggatctcaggaggcccctgaggcacctctgtcctccgaactagaacccttccaccctaaaccaaagattcgtactcggaaatcctccaggatgactccgttccctgcgacatccgcagccccggagccccaccccagtacctcaaccgctcagccggtcaccccaaagccaaccagccaagccactagaagccgcactaacagatcctccgttaagactcctgagcctgtggtacctacagctccagagctacaacccagcacttctacagaccaacccgtcacctccgaacccacatcccaggttaccagaggcaggaagagtcggagctccgtaaaaacaccggaaaccgtggtccccaccgccctagagttgcagccgtctaccagtaccgatcgacccgttacatctgaacccacctcccaagcgacccgtggcaggaagaatcggtccagtgtcaagactcctgaaccagttgttccgactgcacccgagctgcaaccttccacttctaccgaccagccagtgaccagtgagccaacttatcaggcaacgaggggtaggaagaaccggagcagcgttaaaactcccgagcccgtggtgcccacagctcctgagctgaggccttccactagcaccgacagacccgtgacccctaagccaactagtcggaccactcgatctcgcactaatatgagttctgtcaagaccccagagaccgtggttcccacagctccagagttgcagatcagcacatccacagaccagcctgtcacgcctaagccaacctcccgcaccactcggtctaggaccaacatgagttccgtgaaaaacccagaaagtaccgtgcccattgcgccagaactgccaccttcaacgtcaaccgagcagccagttaccccagagcccacttctagggccactaggggtaggaagaaccgctcatctggaaaaacgcctgagactctcgtgcccaccgcccctaaactggagccaagcacatctacggatcagccagtaactccagaacccacgtctcaagctacaagaggccggacgaatagaagttccgtcaaaacaccagaaaccgtcgtgcctacagctccggagctgcaacccagcacctctacagaccagcctgtgactccagaacctactagccaggcaacacgtggtaggactgaccggtcgtcagttaaaactcctgaaacggtggtgccaaccgcacctgaactgcaggcaagtgcatccaccgaccaaccggtgacatcagagcccacctcacggactactcgcgggagaaaaaataggagcagcgtcaagacacccgagacggtggtgcctgcggctcctgagctgcagccatccacctcgaccgatcagccggtcactcccgagccaactagccgagcaacaagaggcagaaccaataggtcctctgtgaagacccctgagtcaatagttcccattgcccccgagttacagcctagcaccagccgcaaccagcttgtgaccccagagcccaccagtcgagccaccagatgcaggactaacaggagcagcgttaaaacacccgagccggtcgtccctaccgcaccagagccccacccgaccacatctacggatcagcctgttaccccaaagctgactagcagggctactcggagaaaaacaaatcgctccagtgtgaaaactccaaagcctgtcgaacccgccgcttccgacctcgaaccttttaccccaactgaccagtcagtgacaccggaggcgattgcccagggaggccagtccaaaactctgaggtcctccaccgtgcgtgcgatgcctgtaccaacaacccccgaatttcagtcccccgtgactacagaccaacctatctccccagagccaattacgcaaccttcttgcattaaacgccagcgagccgccggcaatcccgggtcgctcgccgcccctatcgaccacaagccctgttccgcaccgctggagccaaagagtcaggcctcaaggaatcagagatggggcgcagttcgggccgcggagtctctgacagccatccccgagcccgctagtccacagctcctggagacacccattcacgcatctcagatccaaaaagtggaacctgctggccgttctagatttacacctgagctgcagcccaaggcctctcagagccgaaagcgatctctcgccacaatggactctccacctcatcaaaagcagccccagaggggtgaggtgagtcagaagaccgtcatcataaaggaagaagaagaggatacagccgagaagccggggaaagaggaagacgtggttaccccaaagcctggaaagaggaagcgagaccaagcagaggaagagccaaatcgcatccctagccggtcgcttcgccgcaccaagctaaatcaggagtctacggcgcccaaggttttattcacgggcgtggtggatgctcggggggaacgagctgtattggcactcggcggatctttagcaggctctgctgcagaagccagccacttggtgaccgacaggattcggaggacggtgaaattcctgtgcgcactggggcgcgggatcccgatcctgtctttggattggttacatcagagcagaaaagcagggttttttctacctcctgatgaatatgtggtgactgaccccgagcaggaaaagaatttcgggttctccctccaggacgccctctctcgcgctagggaacgaagactgctggaggggtacgaaatttatgtcacccctggtgtgcagccaccgccgcctcaaatgggggaaatcatttcctgctgcgggggcacgtatctaccctcaatgccccggagctacaaaccacagagggtggtaattacctgcccccaggactttcctcactgtagcatcccactgcgcgttggtctgccgctcctaagtcctgaattcttgttgaccggggtattgaaacaggaagccaagcccgaagctttcgtgctgtcccctttggagatgtcaagcacctag

SEQ ID NO: 194533 - DNA, 738 bp, Artificial Sequence
  Description of Artificial Sequence: Synthetic coding sequence
atggaggacacccaggccatcgactgggacgtggaggaggaggaggaaacggaacaatcctccgaaagccttcgatgcaacgttgaaccagtcgggcgattgcacatcttttctggcgcgcatgggccagaaaaggactttccactgcatctggggaaaaatgtcgtcggtcgaatgcccgactgctctgtggctttaccatttccctctatcagtaaacagcacgccgaaatagaaatcctcgcatgggacaaagcccccatacttcgcgattgcggtagtcttaatggtacgcagatcctgcgccccccgaaggtcctgtcgcccggtgtctcccatagattgcgggatcaggagctgatcctgttcgccgacctgttgtgccagtatcataggctcgatgtcagcctacccttcgtttcccgaggaccgctcaccgttgaggaaacgccacgcgttcagggagagacgcagccacagaggctgcttctggccgaggactcggaggaagaagtagacttcctgagcgaacgaaggatggttaagaagtcccgcaccacgtcctctagcgtgatagttcccgaaagtgatgaagaaggacattctccagtgctgggcgggctggggcctccattcgctttcaacctgaactcagataccgacgttgaagaaggacagcagcccgctacagaggaggcctctagcgctgccagaagaggcgctactgtcgaggcatag

SEQ ID NO: 194534 - DNA, 5409 bp, Artificial Sequence
  Description of Artificial Sequence: Synthetic coding sequence
atggaggacacccaggccatcgactgggacgtggaggaggaggaggaaacagaacagtctagcgaaagtctgcggtgcaacgttgaacctgtaggaaggctgcacatctttagcggagcccacgggccggaaaaagattttccactgcatctgggcaaaaacgtagtcggcaggatgcctgactgcagcgtggctctgcctttccccagtatcagcaaacagcatgccgagattgagatcctggcctgggataaggcaccaatcctacgggactgtggcagcctgaacggcacgcagattttgcggcctcctaaagtactatcgccgggcgtcagtcatcggctccgggaccaggagctgatcctgtttgccgacctgctttgtcagtaccataggctggatgtctcacttccattcgtgtccaggggccctcttacagtggaagagacaccacgggtgcagggggaaacacaaccccaaagattgctattagccgaagattcggaggaggaggtcgactttctgtccgaaagacgaatggtgaaaaagtctcgaaccacctcatcgagcgtgatcgtgcccgagtccgatgaagagggccacagtcccgtacttgggggcttgggtccacccttcgcgttcaaccttaattccgacacagatgttgaggagggccagcagcctgccacggaggaggcgagcagcgctgctaggcgtggagcgaccgtggaagcaaagcagtctgaggccgaggtcgtgaccgagattcagctcgagaaggatcagcccttggtgaaggaacgagacaacgatacaaaagtcaagcggggggcaggtaatggtgtggtacctgctggtgtgatcctggagcgctcacagcctccaggggaagattccgacaccgatgtcgacgacgattccaggcccccaggacggccagcagaggtgcaccttgaaagagcacaacccttcgggtttatcgactccgacaccgacgcagaggaggagcgcatccctgctacacccgtggtgattccgatgaagaagcgcaagatatttcacggagttggaaccagggggcccggcgcaccagggctcgcacacctgcaagagtcacaagcgggcagcgacactgacgttgaggagggcaaagccccccaggcagtgcccctggagaaatcacaggccagcatggtcataaactccgatacggacgacgaggaggaagtttccgccgcactgaccctggctcatcttaaagagagccaacctgcaatctggaaccgcgatgctgaagaagacatgccacagcgcgtcgtcctcttgcagaggtcccagaccaccacggaacgcgactctgacactgatgtggaggaggaggagcttcccgttgagaatagagaagctgtgttgaaagatcacaccaagatccgggcactggtccgcgcccatagcgagaaggatcagcctccttttggcgattccgacgactctgtggaggccgacaagagctcccctggtattcatctagagaggtctcaagccagcacgactgtggatattaacacacaggttgaaaaagaggtgcctccaggttctgccatcatacatattaaaaaacaccaggtgtccgtggagggaaccaatcaaactgatgttaaggctgttgggggacctgccaagcttttggttgttagtctcgaagaagcttggccacttcacggcgactgtgaaacggacgctgaagaggggacatcccttaccgctagcgtcgtggcagatgtgagaaaatctcagctgcccgcagagggagacgccggggctgaatgggccgctgcagtgctcaaacaagaaagagctcacgaggttggtgcacaaggcgggccccccgttgcccaggtggagcaggacctacctatttcccgcgagaatcttaccgacctggtggtcgacacggacaccctgggcgagtccacgcagccgcagcgggagggggcccaggtaccaactggcagagaacgagagcagcacgtaggtggaacaaaagatagcgaggataattatggtgatagcgaggatctggaccttcaggccacccaatgctttcttgaaaatcaaggactggaagctgtgcagagcatggaggatgagcctacacaggccttcatgctcacgccaccacaggagttgggcccatcccactgttcgtttcagactacggggactctcgacgaaccctgggaagtgctcgcgacacagccattctgtctgcgggaaagcgaagactccgaaacgcaaccatttgacacccacctagaagcctacgggccctgtcttagtccaccccgggccattcccggagatcagcatccagaatcccctgtccataccgagccaatgggaatacaagggaggggacgccagactgtagacaaggtgatgggtatccctaaggagaccgcagagagagtgggaccagaacgtggacccctggaacgcgagactgagaagctcttgcctgaaagacagacagacgtcacgggcgaggaggagcttacaaagggaaagcaagaccgggaacagaagcagctgcttgctcgggacacccagaggcaggaatcagataaaaacggcgaaagtgcctcccccgaacgagacagagaaagtcttaaggtggagatagaaacatccgaggagatacaggaaaagcaagtgcagaaacagaccctgcccagcaaagccttcgagagagaggtggagagaccggtagccaatcgagagtgcgaccccgcagaacttgaggagaaggtgccaaaagtcatcctggagcgggacactcagcgcggagagccggagggagggagccaagaccagaaagggcaggccagctctcctactccagagccaggggttggcgcaggggacctccccgggcccacttcagctcctgtgccttcaggatcacagtctggggggagaggatctcctgtgagccctaggcggcaccaaaagggacttcttaactgtaagatgccgcctgccgaaaaagcaagcagaattcgggcagccgagaaggtgagtcgcggagatcaggaatccccagacgcttgccttccaccgactgttccagaggcaccagcccccccacagaaacctctgaactcacaatcccaaaagcaccttgccccacccccgttactgtctcctttacttcctagtatcaaacccacggttcgaaaaacccggcaagatggaagtcaggaagccccagaggctcctctgtccagcgaactagaaccattccatccaaaaccgaaaatccggactaggaagtcctcccggatgacccccttccccgctacctctgctgctcctaagctcgaaccgagcaccagtaccgatcaaccagtaacgcccgagcctacatctcaagcgacaagagggaggaccaacagatcaagcgtgaaaacccctgaaaccgtggtgcccactgcccctgaacttcaacccagcacgtccaccgatcagcccgtgacacctgagccaacatctcaagcgacccgtgggcggaccgacaggtcctctgtgaagaccccagaaaccgtcgtgccaactgcccctgagctccaggccagcgccagtactgaccagccagtgacttccgagccaaccagcaggacgacccggggtcggaaaaatcgtagctccgtgaaaacccccgagacagtggttcctgctgccccggaactgcagccctctacaagcaccgaccaaccagtgaccccagaacccacttcgagggccacccgaggaagaaccaatcggagctcagttaagacacctgaatctatcgttccaattgctcccgagcttcagccttccacatcacggaaccagttggtaacaccagaacccaccagccgggccacacgatgccgcactaatcgttcctccgtcaagactcctgaacccgtcgtgccgacagctcctgagccgcaccctaccacatcaacagaccagccagtcactcctaaactgactagccgagcaacaagacgaaaaactaacaggtcttcagtgaaaactcccaaaccagtggagcccgcagcttctgatttggaaccattcacgcccacagaccagagtgtgacaccagaggcaatcgcacagggaggccaatctaagacactgcgctcgtctactgtgcgcgcgatgcctgtcccaactaccccagagtttcagtctccagttactacagaccagccaatctcacctgagcccatcactcagccaagctgtattaaacgacagcgggcagcaggaaacccgggaagcctggccgcacccattgaccataaaccatgctcagcccctcttgaacccaagtcccaggctagtcgtaatcagcgctggggcgccgtgcgggcagcagagtctctaacggcgatccccgaacccgcctcgccacaactgctggaaactccaatccatgcctcccaaattcagaaggtcgaaccagctggccgtagcaggtttactcccgagctgcagcctaaggctagtcagtctcgaaaaagatccctggcaactatggattccccgcctcaccaaaaacaaccacagcgaggcgaggtttcccagaagacggtgattatcaaagaggaggaagaagacacggctgagaagcccggaaaagaggaggatgtggtcacgccaaaaccaggcaaacggaaacgcgaccaggcggaagaggaacctaataggattccaagccggagcttgagacggacaaagctgaatcaggagtcaacagcgccaaaggtactgttcaccggcgttgttgatgcaagaggtgaacgtgctgtgctggccctgggcggatctctagccggctctgccgcagaggccagtcacctggtgactgaccggatcagaagaaccgtcaagtttctgtgcgcactggggcgcgggatacccatcctgtcacttgactggttacatcagagccgcaaggccgggttcttcctccccccagatgagtacgtggtgacagatccggagcaagagaagaactttggcttctccctgcaagacgcgctgtcccgggcccgcgagcgtcggctgttggagggatacgaaatatacgttacacccggcgtacagccccctcctccacagatgggggaaatcattagctgttgcggaggcacttacctcccatccatgccacggagctataagcctcagcgggtggtgataacatgtcctcaggattttccccactgctccattccactccgtgtgggcctgccgcttctgagcccggaattcttgctcacaggggttctcaaacaggaggccaaacctgaggctttcgtcctgagtcctttggagatgtcgagtacgtag

SEQ ID NO: 194535 - DNA, 738 bp, Artificial Sequence
  Description of Artificial Sequence: Synthetic coding sequence
atggaggacacccaggccatcgactgggacgtggaggaggaggaggagacagagcagagttctgagtctttgcgatgcaacgtcgagcctgtgggtaggctgcacattttctcaggagcacatgggccagaaaaggatttccccctacatcttgggaagaacgtggtcggccggatgcccgattgcagcgtggctctgcctttcccttccatctctaagcaacatgctgaaattgagattcttgcgtgggacaaggctccgatcctacgggactgtggcagccttaacggaacccaaatccttcgaccgccaaaggtgctgtccccaggcgtgtcccacagactgcgcgaccaggagctgatccttttcgccgatctcttgtgccaataccacaggctggacgtttcactgcccttcgtgagccgagggcccttgacagtcgaggaaacgccacgggttcaaggggaaacccagcctcagcgcttgttgctggccgaagattccgaggaagaagtagatttcctttctgagcgaagaatggtgaagaagtcccgcacaaccagctcttccgtcatcgttcccgaaagcgatgaggaagggcacagtcctgtgctgggcgggttgggaccacccttcgctttcaatcttaactccgacaccgacgttgaggagggacagcagcctgccactgaagaagccagcagcgcagccaggagaggcgccacggtcgaagcctag

SEQ ID NO: 194536 - DNA, 5409 bp, Artificial Sequence
  Description of Artificial Sequence: Synthetic coding sequence
atggaggacacccaggccatcgactgggacgtggaggaggaggaggagacggagcagagtagtgagagcctcagatgcaacgtcgagcccgtgggccgtctgcatatcttctcgggcgctcatgggcccgagaaggacttcccactgcacctgggcaagaatgtcgtgggtagaatgcctgactgttccgtcgcactgccattccctagcatctctaagcagcatgcagagatagagattctggcgtgggacaaagccccaatattgcgggattgcggcagcctgaatggcactcagattctgcgcccacccaaggtgctgtctcctggcgtgtctcacaggttgcgcgatcaggaacttattctgttcgcagatctgctgtgccagtaccatcgcttggatgtgtctctgcccttcgtatcgcgagggcctttaacggttgaagagacaccacgcgtccagggagagacccagccacagcgcttattgctggccgaggatagcgaggaggaggtggattttctgtcggaaagaagaatggttaagaaatcacggacgacatcctcatccgtcattgtccctgagtccgatgaggaggggcactctccggttctgggagggctaggaccacccttcgcctttaatctgaactctgataccgatgtggaggaggggcagcagccggccactgaagaagctagcagtgcagcacgcaggggggcgaccgtggaggccaagcagagcgaagctgaggttgtgaccgagatccagctagagaaagatcagccactcgtcaaagagagagataacgataccaaagtaaaaaggggggccggtaatggggtcgtcccagctggcgtcatcctcgagcgatcccagccccctggtgaggactccgataccgacgtggacgatgacagtcgcccacctggtaggcccgcggaggtacatctggagcgcgcccaaccgttcggcttcattgactcggatacagacgctgaagaagaacgcatacctgctactccagtggtgattccaatgaaaaaacgcaaaattttccatggagtgggtactcgcggccctggggcacccggcctggctcacttgcaggagagtcaagcaggaagcgatactgatgtcgaagagggcaaggcgcctcaagcagtaccgctggaaaagtctcaagcctccatggtcattaattcagatacagacgatgaggaagaagtgagcgctgcactgaccctcgcccatctcaaggaaagtcaaccagccatatggaatagggacgcagaggaagatatgccacaaagagtagtgctgctccagcgctcacagaccacgacagaacgggattcagatacagatgtagaagaagaggagctacccgtagaaaaccgagaagctgtgctgaaagaccatacaaagatacgggcccttgtgcgagctcatagtgaaaaagaccaaccacctttcggggacagcgatgatagcgttgaagcagacaaaagcagccctggtatccatcttgagaggtctcaagcaagtactaccgtggatataaatactcaggttgagaaagaggtccctcctgggagcgcaattatccacatcaaaaaacaccaggtatcggtcgaaggaaccaatcagaccgacgtcaaagcagtggggggcccagcaaaattgctggtggtttccctcgaagaagcatggcctcttcacggggattgcgaaaccgatgcagaggagggtacctccctcaccgccagtgtggtcgctgatgtgagaaagagccagctgccagccgagggagatgctggggcggaatgggctgcggccgtgctgaagcaggaacgcgcacatgaagtcggggcacaagggggtccaccagtggcccaggtggagcaggatctgccaataagccgcgagaacctgactgatttggtggtggacacagatacgttaggcgagagtacacagccccagagggagggtgctcaggtacctaccggccgggagagggagcagcatgtcggaggcactaaggatagtgaggataactacggcgattctgaagacctagatcttcaggctacgcaatgtttcctcgaaaatcagggactggaggcggtgcagtctatggaggacgaaccaacacaggcctttatgctaactccacctcaggagttgggccctagtcactgttccttccagacgaccggtacccttgacgagccctgggaggtgctggccacacagcctttctgtctgagagagagtgaagactcagagacgcagccatttgacactcatctcgaggcctatggaccatgcttgagccctccccgcgccataccaggcgatcagcatcctgagtcccccgtccatacagagcctatgggcatccaaggcagaggtcgccagaccgtagataaggtaatggggattcctaaggaaaccgcagagcgcgtagggcccgagaggggcccactggaacgggagactgaaaagctactcccagaaagacagactgacgtgaccggggaagaggagctcactaaaggcaagcaagatcgcgagcagaagcagctgctcgccagagatacccagaggcaggaatccgacaagaacggggagagcgcgagcccagagcgcgatcgggagagcctgaaagtagaaattgagacctccgaggaaattcaggaaaaacaggtccagaagcagacgctgccctcaaaggcttttgagagagaggtcgagagaccggttgctaatagggagtgcgatccagctgagctggaggaaaaagtacccaaagtaatactggaacgcgatacacaaaggggcgaacccgaaggcggcagtcaggaccaaaaaggccaggctagcagcccgacccctgagcctggcgtcggggctggcgacttgcctggtcccacctctgctccagtgccgtctggtagccagtcagggggaagagggtcccccgtgagtccccgccggcaccagaagggcctgctgaattgtaaaatgccaccggctgagaaagcttctcgcatcagagccgccgaaaaggtttcaagaggggaccaggaatcacccgacgcttgccttccacctacagtcccagaggctcccgctccgccgcaaaaaccactgaatagccagagtcagaagcatctggcccctccgccactgttgagcccactgttacccagcattaagcccaccgtccggaaaacacggcaggacggaagccaagaggctcctgaagctcccctgtcttccgagttagagccctttcatccgaaacctaagatcaggactaggaaaagctcgagaatgacccctttccccgccaccagtgccgccccaaaacttgaaccaagtacttcaacagaccagccggtgactcctgaacccacttctcaagccacccgcggacggacaaatagatcttcggtgaagacccccgagacggtggtgcctactgcacctgaactgcagccaagcacctctactgatcagccagtgacacctgagccgacaagccaggcgacgcggggaagaacagatcgaagctctgtaaaaacccccgagactgtggtcccaacagcgccagaactgcaggcttctgccagtactgaccagccagtcacgtctgagcctacgtccaggacaacccgcggtcgtaagaatcgttccagcgtgaagactcccgagaccgtagtacccgcggcacccgccctgcagccttccacgagtaccgaccagccagtcaccccagaaccgacatccagggctaccagagggcgcactaaccgctcctccgttaagactcctgaatcaattgtcccgatagcccctgaactgcagcctagtactagcagaaatcagctggtaacaccagagcctacctccagggccacaaggtgtcgtacgaaccgttcctcagtgaaaaccccggaaccggtagttccaacagctcctgaaccgcacccaacgacaagcacggatcagccggtcacccctaaactcacctccagggctaccaggagaaaaaccaaccgcagttccgtcaagacaccaaaaccagtcgagcccgctgcaagcgacctagaacctttcaccccaaccgatcagtctgtcaccccggaggccatagcccagggcggacagagcaagacactgcgctcctctaccgtccgcgccatgcctgtgccaactactcccgagttccaaagccccgtcacgaccgatcagccaatcagccccgaaccaataacacagccttcgtgcatcaaacggcagagggcggcaggtaatccaggaagtctggctgctcctatcgaccacaaaccttgtagcgcgcccttagagcccaagtcacaagccagtcgaaaccaaagatggggggccgtacgcgcagccgaaagtctcacagcgatcccagaacctgcctcgcctcaactgttagagactccaatccacgctagtcaaattcagaaggtggagccggcagggcggagccgcttcacaccagagctccagcctaaggcctctcagagcaggaaacgtagccttgctaccatggactcacctcctcaccaaaaacagccacaacgcggtgaagtgagccagaaaactgtgataatcaaggaggaggaagaagataccgcggagaaacccggaaaagaagaggatgttgtcacaccaaagccgggaaagaggaagcgcgaccaggccgaggaagaaccaaatagaattcctagccggtccctgcggcggacgaagctgaaccaggagtcaaccgcgccgaaggtgctgttcaccggcgtggtggacgcccgaggtgaacgggcagttcttgcgctcggcggatctctcgcgggcagcgcagcggaggcgagtcacctcgtcactgatcggattcggagaacagttaagtttctttgcgctctcggccgtggcattcccattctgtcattagactggctccatcagtcccgcaaggctggattctttctcccacccgacgaatatgtggttaccgatcctgagcaggaaaagaattttgggtttagtctgcaagacgctttgagccgggcacgagagcgcagactcctggagggctatgaaatctacgtgacccctggagtgcagccacccccaccacagatgggggagataattagttgttgcggggggacgtacctgccttctatgcccaggagttataaaccccagagagtagtcatcacctgtccgcaagatttcccccactgtagtattccactgcgggttggcttacctctactgtcccccgaattcctcctgacaggtgttctcaagcaagaggccaaacctgaggctttcgtcctctccccccttgaaatgtctagtacatag

SEQ ID NO: 194537 - DNA, 5478 bp, Artificial Sequence
  Description of Artificial Sequence: Synthetic coding sequence
atggaggacacccaggccatcgactgggacgtggaggaggaggaggaaaccgagcagagtagcgagagcctccgttgcaatgtagagcccgtaggccggctgcatatcttctcaggcgcccatggccctgagaaggacttccctctgcacctggggaaaaatgtagtaggacgcatgccagactgctccgtagccttaccctttccaagcatctcaaaacagcatgcagagatcgaaatcttggcatgggataaggcccctatcctgcgcgactgtggctcactgaatggcactcagattctccgcccaccgaaagtgctgtcccctggcgtgtctcatcgactgagagaccaggagctgattctctttgcagacctgctctgccagtatcaccgccttgatgtttcactcccattcgtgtcccggggcccacttaccgtggaggagacacctcgcgtgcagggggagacccagcctcagcggttgttgttggcggaagattctgaagaagaggtcgacttcctgagtgagcggagaatggtgaagaaaagtagaacgacatcatcttcagtaatcgttccagagtccgacgaagaggggcacagccccgtgctaggtggtctcggtccacccttcgctttcaatttgaattcagatacggatgtcgaagaaggccagcagccagccaccgaggaggccagtagtgccgcaagacgtggcgcaacagtggaggctaagcagagtgaggctgaggtagtgacagagatacagctggaaaaggaccagccgctcgtgaaagaacgggataacgacacaaaagttaagaggggagccggcaacggggtcgtgcctgccggggtcattctggaacggtcccagccccctggtgaagactctgatactgacgttgatgacgactcaagaccaccgggtcgtccggccgaagttcaccttgaacgggcgcagccgtttggcttcatcgatagtgacaccgatgctgaggaggagcgtatacctgcaactcccgtggtgatacctatgaagaagcgcaagattttccacggtgtggggactaggggcccgggagcacctggactggctcacctgcaagagagccaggctgggagtgatacggacgtagaggaggggaaggcacctcaggccgtgcccctcgagaagtcacaggcgagcatggtaataaactcagacactgatgacgaggaggaggtgtccgcagcccttactctggcccacctgaaggagtcccaacccgccatctggaatcgcgacgccgaggaggatatgcctcagcgggtggtcttactgcagcgttctcaaacgacaacagaacgggacagcgacacagacgtggaggaggaggaactccccgtcgaaaatagagaagctgtccttaaagaccacacaaagatcagggccttggtgcgtgcccactccgagaaggaccagcccccatttggtgactctgatgactcggtagaggcagacaagagttcgcctggaattcacttagagagatcacaggccagcaccacagtcgacatcaacacccaggtcgagaaggaagtgcccccaggcagcgccattatccacatcaaaaagcatcaggtaagtgtggaggggacgaatcagactgacgtcaaggccgtgggaggccccgcgaaacttcttgtagtcagtctggaggaggcatggcctttgcacggtgactgcgagacagatgccgaagagggaactagtcttaccgctagcgtggtagcagacgtcaggaagagccaacttccagcggaaggtgatgctggtgcagagtgggccgcggccgtgttaaaacaggaacgagcgcacgaagtgggcgcacagggcggacctcccgttgctcaggtagagcaagacctgccaattagtcgcgagaaccttactgacctggtggtagatactgatactctcggcgagtccactcagccacagcgagagggcgcacaagtgccaactggtcgggagcgggagcagcatgtgggaggaactaaagacagcgaagacaactacggcgactccgaggatctcgacctccaggctactcaatgcttcctggagaaccagggcctcgaagcagtgcagtccatggaggacgagcccacccaggccttcatgctgaccccaccacaggaattgggaccttcccactgctcattccagacaactgggctcctgaattgcaagatgcctcctgcggagaaagcaagtcgtattagggctgctgagaaagtatcacgaggggatcaggagagcccagatgcttgcttgcctccaaccgtgcccgaagccccagcacctccacagaaaccgctgaactcccagtcccagaagcatctggccccgccacctctacttagccccctccttccaagtattaagcccacagtacgtaaaacgcgccaggacggctcacaggaagctcctgaagctcccctgagctcagagcttgagccttttcaccctaagcctaaaattagaacgcgcaagtctagtcgcatgacccccttccctgcaacctctgctgcacccgagccgcacccatccacaagcactgcccaaccagtgactccaaaaccgacatcgcaggccacgaggtcgcggacaaacaggagtagtgtcaagaccccagagccagtggtgcccactgcccctgaactccaaccctctacctcaactgatcagccggttacctccgagccaacttctcaggtgactcgcggcaggaaaagccgctcttccgtaaagactccagaaacagtagtgcctaccgcattagagctccaacccagcacttccacagatcgacccgttactagcgagccaacctcacaagctacccgcgggcgcaaaaaccgctcctctgtgaagacccccgagccagtggtcccgaccgccccggaactccagccatccacatccacagaccagcccgtcacaagtgagcccacgtaccaggccaccagaggacgaaagaaccgatcctctgtgaaaacaccagagccagtggtacctacagccccagaactgcgcccatcaacgagtacagatcggcctgttacccctaagcccacatccagaaccactcggtcaagaaccaacatgtcctcggtgaaaacccccgaaaccgtcgtgcctactgcgccagagcttcagatctcgaccagcaccgatcagcccgtgacccctaagcctacttcaagaacgactagatctcgcactaacatgagcagcgtgaagaaccctgaatccacggtgcctatcgcacctgagctgccaccgtccacgagtacagaacaaccagtcaccccggagccgacctctcgcgcaacaaggggtcgcaagaacaggagttctgggaagacaccagaaacacttgtgccaactgcccctaagttggaaccctccacgagcaccgaccagcccgtcactccagaacccaccagtcaggctactcggggcagaacaaaccggtcatcagttaaaacacctgagacggttgtgcccacggcccctgagctccagcctagcaccagcaccgaccagccagtcactccagagccaacgtcccaagccacgcgcggtcggacagatcggtcatctgtgaagacaccagagaccgtggtgcctaccgccccagaactgcaagcttccgccagtacagaccaacccgtgacctcagaacccacctcaaggaccacaagggggcgtaaaaatagatcctccgtgaaaacaccggagactgtggtgccagcagcaccagagttgcagccgtccacgagtacggaccagccagtgacaccagaacccacatccagagctacacggggacgcaccaaccggagtagcgtgaagacccctgaatcaattgtccccattgccccagaactgcaaccctccaccagtcggaatcaactggttactcccgaaccaacctcacgcgcaacgcgctgcagaaccaacagatcgagcgtgaaaactcctgagccagtggttcccaccgcacctgagcctcaccctaccacctccactgatcagccagtcactccgaagctgaccagtcgcgcgacccgaaggaaaaccaaccgttcctccgtgaagacacctaaacctgtggagccagcagctagtgacctggagccatttactcctacagaccagtcagttacgcccgaggcaatcgcccagggcggccagagcaagacacttagatccagcaccgtgcgcgccatgcccgtacccaccaccccagaatttcagtcccctgtcactacagatcagcccatctccccagagccaatcacacaaccctcatgcattaagaggcagcgcgcagcaggtaatcccgggtctctggccgctcccattgaccataagccttgctcggcaccattggagcccaagtcccaggcatctcggaaccagagatggggcgcagtccgggctgcagagtctctcacagccatccccgaaccagcctccccccagctgctcgagacgccaatccacgcatcccaaattcagaaggtagagcccgccgggcggtcccggtttactccagaattgcaacccaaagctagccaatcccggaagcgatcgcttgctacaatggactctccaccacatcagaaacagcctcagagaggggaggtgtcacagaagacagtgatcattaaggaggaggaggaggacacggcagaaaagccgggtaaggaagaggacgtggtgacaccaaagcccggcaaacgaaagagggatcaggctgaggaggagcctaaccggattcctagccggagccttcgccgcacaaaacttaatcaggaatccaccgctccaaaagtcttgtttacaggggtagtggatgcccggggcgaacgggccgtactggccttgggcggttccctggccggctcggccgctgaagcctctcaccttgtgactgatcgtattcgaaggactgtgaagtttttatgtgcactggggagggggatccctattctgagcctagattggctccaccagtcaaggaaggccgggttttttttgcctccagatgagtacgtggtgacagacccagagcaagaaaaaaactttgggttctcccttcaggatgctctaagcagagctagggagcgccgactgttggaggggtatgaaatttatgtgacccctggcgtacagccaccacccccacagatgggcgagataatttcttgttgcggaggcacctacctgccttcaatgccaagaagctataaaccccagagagtagttatcacatgtcctcaggatttccctcactgcagtatccctctgcgggtcggcttgcccctgctcagtccggagttcctcttgaccggggtactcaagcaggaagccaagccggaggcattcgtgctctccccactggagatgtctagcacttag

SEQ ID NO: 194538 - DNA, 4968 bp, Artificial Sequence
  Description of Artificial Sequence: Synthetic coding sequence
atgtaccaccggctggacgtgagcctgcccttcgtgagccggggccccctgactgtcgaagaaaccccccgggtacagggggagacccaacctcagcggctcctattagcagaagattctgaggaggaggtagattttctctcagagagacgcatggtgaaaaagtcacggactacaagcagctcggtgatcgtgcccgagagtgatgaagagggacattcacccgttctcggaggattgggtccaccatttgcctttaatctcaattcagatactgatgtcgaagaaggacagcagccagctacagaggaagcttcaagcgcggcccgtcggggggccactgtggaggcaaaacagtccgaagctgaggtggtgaccgaaattcagttggagaaggatcagccccttgtgaaagagcgcgataacgacaccaaagttaagagaggcgccgggaatggggttgttccagccggagtaattctcgagagatcccagcctccgggggaggacagtgacactgacgttgatgacgatagcagaccacctggacggccggccgaggtccacctggagagggcacagcctttcggcttcatcgatagcgacacagacgccgaagaggaacgaattcctgccacacctgttgtgattccaatgaaaaagcgcaagatcttccacggcgtaggtacccgggggcccggcgccccgggcttggcacacctgcaggaaagtcaggctggttcagataccgatgtcgaggagggaaaggcccctcaggcggtgcctctggagaagtcgcaggcttctatggtcataaactccgatacagatgatgaggaagaagtgagtgccgctctgacgttggctcatttgaaggagtcgcagcctgccatctggaatcgagacgcggaggaagacatgcctcagagagtggtgctcctgcaacgctctcagacaactacggaaagagactcggataccgacgtcgaggaagaggagctccctgtcgaaaatcgagaggccgtgctgaaagaccatacaaagattcgcgccctcgtccgcgctcattccgaaaaagatcagcccccattcggggatagtgacgactctgtagaggccgacaaaagcagccccgggatccatctggagcggagccaggcgagtactaccgtggatattaatactcaagtagagaaggaggtaccaccaggctccgcgatcatacatattaagaaacaccaggtatcagttgaaggtacaaatcaaaccgatgttaaggccgtgggcggacccgccaagttactagtcgtcagcttggaggaggcatggcctttacatggggactgcgaaaccgacgcggaagagggcacctcactaaccgcaagcgttgtggccgatgtccggaaatcccagcttccagctgagggagacgctggcgcagagtgggcagccgcagtgctgaagcaggaacgggcccatgaggtcggggcgcagggtggacctcccgtggctcaagtcgagcaagacctccccatctccagggagaatcttacagacctagtggtggacacagatactctgggcgaaagcacacagccccagcgcgaaggcgcacaggtgccgaccggtcgtgagcgcgagcagcacgtaggcgggactaaagattctgaagacaactacggcgatagtgaggacctggacttgcaggctacccaatgtttcctggagaaccaggggctcgaagtacagtctatggaggatgaacctacacaagccttcatgctcaccccccctcaagagctaggcccgtctcactgctcgttccaaacaacagggctcttaaactgtaagatgcctccagccgagaaggctagccggatcagggctgccgaaaaggtatcccgcggcgatcaggagagccccgacgcatgcttgccacccacagtccccgaggcccccgcccctcctcagaagcctctcaattctcagagccagaaacatctggcacccccacccctgttgtctccattactgccctcaatcaaaccgacagtgaggaagactcgccaggacggaagccaagaagccccagaggcaccactgtccagtgagttggagccgttccatccgaaacccaaaatccggacccgcaaaagttcacgaatgaccccattccccgctacctccgcggctccagaacctcatccgagcacttcgacagcccagcctgttacacctaagcccacctcccaggctacgagatcgcgcacaaatagatccagtgtgaagacaccggagccggtggtccccaccgcaccagagttacagcccagtacaagcaccgaccaacccgtcacaagcgaacccacttctcaggtgacccgaggtcggaaaagtaggagttccgtgaaaactcccgaaacagtggttccaaccgcattagaactccagccgtctacctccacggatcggccagtaactagcgaacctacttctcaggccacaaggggacggaaaaataggtccagcgtcaagacacccgagccggttgtgccaacagcaccagaactgcaaccaagtacgtcaactgatcagcccgtgacttcagagccgacgtatcaggccactaggggaaggaagaatcggtcttcggttaagaccccggaacctgtcgtccctaccgcccccgaactccgccccagcaccagcacagacaggcccgtgacgcccaagccaacatccagaactactagaagccgtactaatatgtcaagcgttaaaaaccccgaatcgaccgtccctatagcccctgaactgcctccgtctacgtcaaccgaacagccggtgactcccgagccaacttctagggctacacggggcagaaagaatagaagctccggcaaaactccggaaaccctggtacctacagcccccaagcttgagccttccacatctactgatcagccagttactccggaacctaccagtcaggcaacgaggggacgtacaaatagatctagcgtgaaaacacctgaaacggtggtccctaccgcccccgagcttcagccctcgacttcaaccgatcagcccgtgactcccgagccaacaagtcaggctactaggggcagaactgatcgaagcagcgttaagacaccagagactgtggttccgacggcgcctgagctgcaagctagtgcttcaacagaccagccagtcacatccgagcccaccagtcggaccacccgagggcgaaagaataggtcttcagttaaaactccggagacggtggtgcctgccgcacccgagctccagcccagcactagtacagatcaacctgtgacccccgagccaacgagtcgcgccactaggggaaggacaaatcggtctagtgtgaagacgccagaaagcatcgtcccaatcgctccggagttacagccctctacatccagaaatcagcttgtgactcctgagcctactagtagggccacccgctgtcggacgaacagatcctctgtaaagactccagagccagtagtgccgacagcgcccgaaccacatcccaccacatcaacagatcagcctgttacgccgaagcttacctcccgtgctacaaggcggaagacgaaccgctcgagtgtcaagacacccaagccagtagaacccgcggcttctgatctggagcctttcactcccactgaccagtcagtcaccccggaagcaattgctcagggaggtcaaagcaagaccttgagatcctcaaccgtgcgggccatgccggtgcccaccacccccgagtttcaatctccggtgactacagaccagcctatctctcctgagcctattactcaaccgtcctgtatcaaacgccaacgcgccgccgggaaccctggtagcctggcggccccaatagaccataaaccatgttctgccccccttgaacccaagtctcaggcgtccagaaatcagcggtggggagcggttagagcagcagagtcactcacagctattccagagcctgccagccctcaattactcgagacgcctattcacgcatcgcagatccaaaaggtggaacctgctggccgcagtcggtttaccccagagctgcagcccaaagcatcccaatcccggaaacgcagccttgcaactatggattcacctccacaccagaaacaaccacagagaggggaggtcagccaaaagaccgtcatcattaaggaagaggaggaagacaccgccgagaagcccggaaaggaggaggacgtggtaacacccaaacctggaaagaggaagagagatcaggccgaggaggagccaaataggatacctagtagaagcctgcggagaaccaagttgaaccaggagagcacggccccaaaagtgctgttcacaggggtcgtggatgcgagaggagagcgagccgttttggccttgggagggagcctggctggcagtgccgccgaggccagtcacctagttacagacaggatcagacgaaccgtaaagtttctttgcgctctgggcaggggaattcctattctgtcactagattggctgcatcaaagcagaaaggccggattctttctgccccctgacgaatacgtagtgaccgatcctgagcaggagaaaaatttcggattttctctgcaggacgcattgtctcgtgccagagagaggaggttgctggaaggctacgaaatttacgttactcccggtgtgcaacccccccctccacagatgggcgagattatcagctgttgcggcggtacttaccttccgtccatgcccagatcgtacaaacctcagcgtgtcgtaataacctgcccccaggacttcccccattgctcgatccctctgagggttggactgcctttactatctccagaattcctcctcactggcgtcctgaaacaggaagccaaaccagaggccttcgtgctgtccccacttgagatgagttccacatag

SEQ ID NO: 194539 - DNA, 4968 bp, Artificial Sequence
  Description of Artificial Sequence: Synthetic coding sequence
atgtaccaccggctggacgtgagcctgcccttcgtgagccggggcccgttgaccgtcgaggagacaccgcgggttcagggtgagactcagccacaacggctgttgctggccgaggattccgaagaagaggtagattttttgtcagaacgaaggatggtaaagaaatccagaaccacaagttcctctgtcatcgtgccagagagcgatgaggaaggccactcgccagtgctaggaggtctgggcccgccgtttgccttcaacctcaattctgacacagatgtggaggagggccaacagccagccaccgaggaggcttcgagcgcagctcgcaggggcgctaccgtagaagcgaaacagtccgaggcagaggtagttaccgaaatacagctggagaaggaccaacctttggtaaaagaacgtgacaacgacactaaggtgaagaggggcgctggaaatggggtcgtgccggccggcgtcattctggagaggtcccagccccctggcgaggattccgacaccgatgtggatgacgacagtcggccgcctgggaggccagcagaggtccatctggaaagagcccagcctttcggcttcatcgacagtgacaccgacgccgaagaggaacggatccctgctactcccgtggtgatcccgatgaagaaaagaaaaatctttcacggggtcggaacacgaggtccaggtgcacctggcttagcacacctccaagagtcacaggcgggcagtgacacagatgttgaagaaggcaaagcacctcaggcggtgccgctagagaagagtcaggccagtatggtcattaactccgataccgacgacgaggaagaggtttcagcggccctgacactcgctcacctaaaagagtcgcagccggccatctggaaccgggatgctgaagaagatatgccacaaagagtggttctgttgcagaggtcgcaaacgaccacagaacgtgattctgacaccgatgtcgaagaagaagagctgcccgtggagaatcgggaggctgtgctaaaagaccatacgaagatccgagcactcgttcgagcacactccgaaaaggaccaaccccctttcggtgattccgatgatagtgtcgaggctgacaaaagctcacctggcattcatctggaacgctcacaagcatccactaccgtcgacatcaatactcaagtggagaaagaggtaccacctggttccgccattatccatatcaaaaagcaccaggtctccgtcgaggggaccaaccagacagacgtgaaggctgtgggcggacccgctaaactgttagtcgtgagtctcgaggaagcctggcctctccacggcgattgcgagactgacgccgaagagggtacctcactaacagccagcgtagtggccgatgtgcgaaagagccaactgcccgccgagggggatgctggtgccgagtgggcggcagccgtgttgaagcaggagagggctcacgaggtaggtgctcagggaggcccgccagtggcccaagtggaacaggatctcccaattagcagagaaaacctaacagacctggtggtagataccgataccttgggtgaaagtactcagcctcagcgggagggggctcaggttcctactggacgggaacgggagcagcacgtcggtggtactaaagacagtgaggacaactacggagacagtgaggatctagacctacaggcaacgcagtgcttcctcgaaaatcaaggtttagaggtgcaaagtatggaagatgagcccacgcaagccttcatgctaactccaccacaggaactgggtccctctcattgcagtttccagacaactggcctcctcaattgtaaaatgccaccagctgagaaggcttctcggatccgtgccgctgagaaggtgtcccgcggcgatcaggaatcacctgatgcatgcctccctcctacggtgccagaagctccagcacctcctcagaagcctttgaactcgcaaagtcagaagcacctggcccccccacctctgctttctccactgctgccctcaataaaaccgacagtgcgcaaaacccggcaggatggaagccaggaggcccctgaagcccccctgtcatccgagctcgaaccttttcatcccaagccgaaaatccgaacccggaaatccagtagaatgactccatttcctgctacaagcgcagccccagaaccacaccccagcactagcacagcccaaccggtcactcctaagcccacctctcaggctacacgaagcaggaccaacagatcttctgttaaaaccccagagcccgtcgtgcctactgcccccgagctgcagccttcaacaagcaccgaccaaccagttactagtgaacccacctcccaggttacgaggggacgaaagtctcgctcatcagttaaaactcccgagaccgtggttcctaccgctctagagctgcaacccagcacaagcactgacagaccagtgacatcggagccaaccagtcaagctacccggggcaggaagaacaggtcttccgtgaagactccagagcccgtagttcctaccgctccagagcttcagccttctaccagcaccgatcagccagtgacctcggaaccgacgtaccaggccacacggggccgaaagaatcgcagttcggtgaaaacgccggagcctgtagtgccaactgccccagagctcaggccctctaccagcaccgaccgtcccgtcactccaaagccaacctcccgaacaacccggtccaggacaaacatgagctcagtaaaaaatccggaatccactgtgcccatcgcacctgagctgccgccgtctacatccactgaacagcctgtgactccagagcctacgtccagggcaacaagagggagaaaaaatagaagctcaggaaaaacaccggaaaccctggtgccaactgcgcccaagcttgagccaagtacgtcaaccgatcagccggtgactcccgagccaacctcccaggctacccgcggtagaaccaatcgttcatcagtgaagacgcccgaaacagtagtgcctactgcccctgagttgcaaccatcaacgtcaactgaccaacctgtcacccccgagccaacatcccaggcgacgcgagggcggacggaccgatctagtgtgaaaacccctgagaccgtggtccctacggcgccagaacttcaggcatctgcctcaactgatcaacccgtgactagtgaaccaacgtctagaaccactcgcggcagaaagaaccggtcctccgtgaaaactccggagacggtcgtaccagccgcacccgctttacaaccctcaacaagtactgatcagcctgtgacacccgagcccacttccagggctactagaggtcggactaatcgctccagtgtaaagacgcccgagtctattgtgcccatcgctccagagctccaaccgagtacttcccgaaaccagctggtaacccctgaacccaccagcagagccaccaggtgtagaactaatagatccagtgtgaaaacccccgagcccgtggtgcccactgcgccggagcctcacccaactacatctacggatcagccagtcacccctaaactcacttcacgcgccacccgcagaaagacgaacagaagttcagtgaaaacacctaagcccgtggagcccgccgccagcgacctcgagcccttcactcctaccgaccagagcgtaaccccggaagcaatcgcccaaggtggccagtcaaaaactctccgctcatccaccgtccgcgctatgcctgtacccaccaccccagagtttcagtctcccgtgacaaccgaccagccaatcagtcccgagccaattacgcaaccaagctgtataaagagacagcgggcggccggcaatcctggctccctcgccgcgcctatcgatcacaaaccttgctcggcccccctggaaccaaaatcccaagcctcacgaaatcagcggtggggcgccgtgagggctgctgaaagcctgacggccatacccgagccggcatccccacagttgctggaaacccctatacatgcctcacagatccaaaaggtagagcccgccggtagaagtcggttcaccccagaactgcagcccaaggcctcccagagccggaaacgatctttggctacaatggactctccccctcatcagaagcaacctcagaggggcgaagtctcacaaaagacagtcattataaaggaagaggaggaggataccgcggaaaagcctggcaaggaagaggacgtagtgacgcctaaacccggcaaaagaaaaagagatcaagccgaggaagaacccaaccggatcccctctcgctcattacgcaggacgaagctcaatcaagagtctacagcacctaaggtgctgttcactggagtggtggacgcacgcggggaacgggccgtcctggctttgggggggagcctggccggaagtgccgcggaagcaagccacctggtaaccgaccgtattagacggactgtgaagttcctctgtgctctgggacgggggattcctattctgtctctcgactggttgcaccagagtcggaaggccggcttcttcttgccccccgacgaatatgtggtgaccgaccccgagcaagagaaaaattttggttttagcttacaagacgccctctcccgtgcccgggaacgaagactccttgaagggtacgagatctacgtgacacccggcgttcagccgccacctcctcagatgggtgagattattagctgctgtggcggaacctacctgccttcaatgccgcgatcatataagccccagagggtggtgatcacctgcccccaagatttcccgcattgttctatacccctgagggtgggcctgccgctgctctcaccagagtttctcttgacaggcgtactgaagcaggaggcaaagccagaagcctttgtattgagccccctggagatgagctccacatag

SEQ ID NO: 194540 - DNA, 666 bp, Artificial Sequence
  Description of Artificial Sequence: Synthetic coding sequence
atggaggacacccaggccatcgactgggacgtggaggaggaggaggagacagaacagagttccgaatctttacggtgcaacgttgagcctgtgggacggctgcatatcttcagcggtgcccacgggcctgaaaaggattttcctcttcatttgggcaagaacgtcgtcggaagaatgcccgattgttccgtcgctcttccttttcccagcattagtaaacagcacgctgagattgaaatacttgcttgggacaaggccccgattttgcgcgactgcggctccctgaacgggacacaaatactgtcttccagtctgccaccaccacagacgtccctccttcctctctccttaaggctcaggctactcggcgaagagcagatcgaccccctgagccgtcttcttaaacaactctccccacagccacttagctaccggctacccccacctcagacttccctctccccgctgtcacctcacttgggaccactgggcgaggaaaagataggaccgctttcccggccactaaaacagctctgcccacagcctctatcgtctagtctgccacctccccagaccaacctgagccctctatcccctcaccttgggcccctgggggccggccaaattggcccgttgagccgccctctgaaccaactatccctgtag

SEQ ID NO: 194541 - DNA, 666 bp, Artificial Sequence
  Description of Artificial Sequence: Synthetic coding sequence
atggaggacacccaggccatcgactgggacgtggaggaggaggaggaaaccgagcagagtagcgaatcactaagatgcaacgtcgaaccagtcggacgtctccacatttttagcggtgcccacgggccagaaaaagacttccccttgcatctaggcaagaacgtagtgggccgcatgccagactgttctgttgcgctgccctttccctcaattagcaagcagcacgctgaaatcgaaatcctggcttgggataaagctcctatcctgagagactgcgggtcactgaatggcacacaaatcctgagcagcagcttaccaccaccacagacttcgttgctgcctctctccttgcgcttgcgcctcttgggggaggaacaaattgatcccctgagcagattgcttaagcagttgtcccctcagccactttcctaccggctgcctcccccacagacttcgctgagcccgctttctccacaccttgggcctctgggggaggagaagataggtcctctgtctcgtccactgaaacagctctgtccccagcctctgtccagttcattgcctccaccccagaccaatctgagtccactatccccccatctgggacccctcggcgctgggcagataggcccgctttcccgccccctgaaccaactgtctctctag

SEQ ID NO: 194542 - DNA, 738 bp, Artificial Sequence
  Description of Artificial Sequence: Synthetic coding sequence
atggaggacacccaggccatcgactgggacgtggaggaggaggaggagaccgagcagtcttcagaaagtctacgctgtaatgtggagccagtcggaaggctacatatttttagcggagcccacggcccagagaaagactttccactacacctgggaaagaatgtggtgggtaggatgcccgactgtagcgtcgccttgcccttcccaagcataagcaaacagcatgccgagatcgaaatccttgcctgggacaaagctcctattctgcgagattgtgggtcattgaacgggacccagattcttaggccgcccaaagtgctaagtccgggcgtgagtcacagactgagagatcaagagctcatactatttgctgacctcctctgtcagtatcatcgtctggacgtttccctccccttcgtgagtagagggccgctaactgtggaagaaacccctagagtgcaaggggagacacagcctcagaggctgctgctggccgaggatagtgaggaggaggttgactttctttcagaacggagaatggtcaagaaaagcagaaccacctctagttctgtgattgtcccagagtcagatgaagaaggccactccccagtgctcggaggcctgggacccccatttgcctttaacctgaattccgatacagacgtcgaagagggccagcagccggcaacggaagaggcctcaagcgcagcccggcgtggcgcaactgttgaggcttag

SEQ ID NO: 194543 - DNA, 4968 bp, Artificial Sequence
  Description of Artificial Sequence: Synthetic coding sequence
atgtaccaccggctggacgtgagcctgcccttcgtgagccggggcccactgactgtggaggaaacaccgagggtgcagggggagacccagcctcagaggctgctcctcgccgaagatagcgaggaggaggtggacttcctgagcgagcgtaggatggtaaagaaatcaaggaccaccagcagtagtgtgatcgtgcccgagagcgacgaggaaggccattccccagtgcttggaggcctaggtcccccatttgctttcaacctgaactccgatactgatgttgaggagggtcaacagcccgctactgaggaggctagctccgccgcacgaagaggtgccactgtcgaggccaaacagagtgaggcagaagtggttactgaaatccagctcgaaaaagatcagccgctagtgaaagagagggacaatgatacgaaggtcaaaaggggagccggcaacggagtcgttcctgccggagttattttagaacgcagtcagcctcccggtgaggactccgataccgatgtcgacgatgatagccgtccgcctgggaggccagccgaggtccatctagagagagcccagcccttcggatttatcgacagcgacactgacgccgaggaggagcggatccctgctacgcctgtcgtgatccctatgaagaaaagaaagatctttcacggggtcggcacacgaggtcccggggcgcctggtctggcccacctccaggaatcacaggctggctccgacactgatgtcgaagaaggaaaggcacctcaagcagtgccattagagaagagccaagcaagtatggtaattaatagtgatacagacgacgaggaagaggttagcgcggccctcactctggctcaccttaaagagagtcagcccgccatctggaatagggatgccgaggaagatatgccacaacgggtggtgttgttgcagcggagccagaccacaacagagagagatagcgacaccgacgttgaggaggaggaactgccagtggagaacagggaagctgtgcttaaggatcatacaaaaatcagagccctcgtcagagcgcactccgagaaggatcaacctcccttcggggactctgatgactccgtggaagcagacaagtcttctcctggtattcatttagaaaggtctcaagcttccaccacggtggatatcaacacccaggtggagaaagaagtaccacccggctctgccatcattcatatcaagaaacaccaagtctctgttgagggcacgaatcagaccgacgttaaagccgtggggggtcccgcaaaactccttgtggtgagcctggaagaggcttggcccctgcacggagattgtgaaactgatgcagaggagggcacctccttaactgcctccgtcgtagcggatgtcagaaagagccagctgccagcagagggtgacgcaggcgctgagtgggccgccgccgtgctcaagcaggaaagagctcatgaggtcggagcccagggaggcccacccgtagcccaggtggaacaggatctgcctatatctagagagaatctgacagacttagtcgtagacacagacacattaggggagagcacacagccacagcgcgagggggcccaggtccccaccgggcgagagcgggagcagcacgtgggtggcaccaaggattccgaggacaactatggggattctgaagaccttgatcttcaagctacacagtgtttcttagaaaaccagggcctggaggtacagtcaatggaggatgaacccacccaggccttcatgcttacacccccccaggagctcgggccatctcattgctcattccaaacaaccggactcctcaactgcaaaatgcccccagccgagaaggcgagtcgtatccgggcggcagagaaggtttctcggggtgaccaggagagcccagatgcatgtctgccacctacagttcccgaggcccccgcacctcctcagaaacccctcaatagccagagccagaagcacttggctccacccccgctgctgtccccactccttccatcaattaaacctaccgtgcgcaaaacaaggcaggacggatcacaggaggctcccgaagcccccctcagctctgagcttgaaccatttcatcccaaacccaagatccgcacccgcaaaagcagcagaatgacccccttccccgccacatcggctgcccctgagcctcatcccagcacctcaaccgcccagcctgttactccaaagccgacctcacaggcaacccggtcacgaacgaacagatcctctgttaagacacccgagccagtcgttcccaccgcaccagagctccagccaagtacatccactgatcaacccgtgaccagcgagcctacatcccaggtcacgcgaggcagaaagagcaggtcctccgtcaagacacctgaaaccgtggttccgaccgctctagagctgcagcctagcacatctactgatcggcctgttacctccgagcccacaagccaggccactcgaggaaggaagaatcgatcatccgtaaagactcccgaacccgtggtgcccaccgcccctgagcttcagcctagtacttctactgatcagcctgtgactagcgagccaacatatcaggctacaagagggcgcaagaaccgctcttcagtcaagacacccgaacctgtagtgcctactgcccccgagctgagaccctcgaccagcaccgataggccagtaacacctaaacctacttcacggacaacgagaagcaggaccaacatgagctcggttaagaatcccgaatctaccgtgccaatcgcccccgagctcccaccttccacctccactgaacagcctgtgacgcccgagcctaccagtcgagccacccgagggagaaaaaataggagttccggaaaaacccctgagaccctggtgcctaccgcccctaagcttgagccctcaacgtcgaccgaccagccagtgacgcctgagcccacctctcaagcaaccaggggcaggactaacaggtcatcagtcaaaacaccagagaccgtggtccccaccgcgcctgaactgcagccctccacatccacagaccaacccgtcacacccgagccaacttcccaggcaacacgtggacggacagatcggtcttccgtgaagacccctgagactgttgttccaactgcccctgaactacaggcatccgcaagcacagaccaacctgtcacgagtgaacctacgagcaggaccaccaggggccgcaaaaacagatcctccgtgaaaacacctgaaacggtggtcccagccgccccggagctgcagccatctaccagcaccgaccaaccagtgacccctgagccaacgagcagggccacacgtggcaggaccaatcggtcctctgtgaagacaccagagagcatagtccccattgcacctgagctccaaccctcaactagccggaatcagctggtaacccctgagcccacttcccgggcgacgcgctgccgtaccaaccgatcatcagtaaaaaccccggagccagtggtccctaccgcgcctgagccacacccaactacgtctacagatcagccggtgactccaaaactgacatcaagggccactaggagaaagaccaaccgaagttcagttaaaacccctaaacccgtggaaccggcagctagcgacctagagcccttcacacctacagaccaaagcgtcaccccagaggctatcgcccagggaggccagtcaaaaacgctgagatcttcaacagtccgcgctatgcccgttcctaccacccccgagtttcagtcccccgtgacaaccgaccagccaatatcacccgagcctattacgcaaccctcctgtatcaaaaggcagagggccgccggcaacccagggtctctcgctgcgcccatagaccataaaccctgttcagcaccacttgaacccaaaagtcaggccagcagaaaccaacgctggggtgctgtgagagccgctgagtcactcacggcaatcccagagccggcctcgccgcaactcctcgaaactcccatacacgcttcccagattcagaaagtggaaccagcgggcaggtctaggttcaccccagaactccaacccaaagcctcccagagcagaaaacgcagtcttgccaccatggattcaccaccccaccaaaagcagccccaaaggggtgaggtgtcccaaaaaacggttataatcaaggaagaggaggaggatactgccgagaaacctggcaaagaggaagatgtggtgaccccaaaaccaggcaagcgcaaacgtgaccaagcagaagaggagcctaacaggattccgagtcgatccttgcgacgcacaaaacttaatcaggaaagcacagcccctaaggtgctctttaccggagtggttgatgcccggggcgagagggccgtcctggctcttgggggcagcctggccggctctgcagccgaagcttctcacctggtgactgaccgtattagaaggacagtcaagttcctgtgcgccctggggagggggatccctatcctttcattggactggttgcatcagagccgcaaggcaggtttttttttgccccccgatgagtacgtggtgaccgatccagagcaggagaaaaactttggcttctccctgcaggacgccctctctcgggcccgggaaaggaggctattggagggctacgagatctatgtgacccccggcgttcagccgcctccaccgcaaatgggggaaattatatcctgttgtggagggacctatcttccatcgatgccaagatcctacaagccgcagagggtggtgataacttgcccacaggacttccctcactgcagtatccccctgcgggtcgggctgcctttactgtccccggagtttctcctaaccggcgtgctcaagcaggaagctaagcccgaagctttcgtcttgtcccccctggagatgagctcaacatag

SEQ ID NO: 194544 - DNA, 5478 bp, Artificial Sequence
  Description of Artificial Sequence: Synthetic coding sequence
atggaggacacccaggccatcgactgggacgtggaggaggaggaggaaactgaacaaagtagcgagtctcttcgatgcaatgttgagcccgtgggccgcttgcatatctttagtggcgcccacggtcccgagaaagactttccgctccacctgggcaaaaacgtcgttgggaggatgccggattgttcagtcgctctgcccttccccagcatatccaagcaacacgctgagattgagattctggcgtgggacaaggcacccattctgcgggattgcgggtcactgaatgggacccagatcctccggccacctaaggttttgtctcccggcgtgtctcacaggctgcgggaccaggagttaattcttttcgccgatttactttgtcagtaccacaggttggacgtgagcctcccctttgtatctagggggccactgacggttgaagagacacctcgggtgcaaggtgaaacacagccccagcgccttttgctggcagaagattctgaggaggaggtagacttcttgagcgagaggcgcatggtgaaaaagagccgaaccacaagcagttcggtcatagtacctgaatcggacgaggaaggccacagtcccgtcctgggaggactgggccctcccttcgcgttcaacctgaattccgacacggatgtggaagagggccagcagccagcaactgaagaggccagctctgctgccagacgcggagcgactgtcgaggctaagcagtcagaggctgaggtggtcacagagattcagctggagaaggaccaaccactggttaaggagcgagataacgatacaaaagtgaagcggggtgcagggaatggagttgtcccagccggcgtgatccttgagaggtcccagccccctggggaggacagcgacactgacgtcgacgacgattccaggccacctggccgcccagcggaggttcacctggagagggctcaaccctttggattcattgactccgacacagacgccgaagaggaaaggattccagctaccccggtagtgattccaatgaagaaacgcaagatatttcatggggtgggcacacgcggtcccggcgcccccggacttgcacacctgcaagaatcccaagctggtagtgatacagacgtggaggagggcaaagcacctcaggccgtgcctctggaaaaatcacaggctagcatggtcattaacagcgacaccgatgatgaagaggaagtgtccgccgctctgacactagcccatttaaaagagagccagccagccatctggaaccgtgacgcagaggaggacatgccccaaagggttgtgctgttacagcggagccaaactacaacggagcgtgattccgacaccgacgttgaagaggaggagttgcccgttgagaatagagaggcggtcctcaaggatcataccaagatcagggcactggtacgcgcacattcagaaaaggaccagccaccttttggggactccgacgactcggtagaggctgacaagtcttcccctggcatccacctagagcgcagccaggcctctaccaccgtggatatcaatactcaggtcgaaaaggaagtgccccccgggtcagcaatcatacatattaaaaagcaccaagtgtccgttgaagggaccaaccagacagacgtgaaagctgtggggggtcctgcaaagttgctggtcgtatctttggaggaagcttggcctctgcatggggattgcgaaactgacgccgaggagggaacatccttgactgcctccgtagttgcagacgttcgcaaaagtcagttgccagccgaaggagacgcaggtgctgagtgggccgccgcagtcttaaaacaggaaagagctcatgaagtcggtgcccagggggggccgcctgtggcccaggtcgaacaagacctcccaatttcgcgggaaaacttgaccgacttagtcgtcgacacggatactctgggggagagtacacagccgcaaagggaaggtgcacaggtccctactggcagagagcgggaacagcatgttggcggtacaaaggacagcgaggacaactacggagacagtgaagacttggatcttcaagcaacacaatgctttttggagaaccagggccttgaagccgtgcaatccatggaggacgaacccacacaagcttttatgttgactccccctcaggaactcggcccgtcacactgtagcttccaaactaccggactccttaactgtaaaatgccacccgcggagaaagcgtccaggatcagggcagcagagaaggtgagccggggggatcaggagagtcctgacgcttgcttaccgcccaccgtgcctgaggcgccagcgccaccacagaaacccttaaacagccagtcccagaagcacctggccccacctcccctgttgtccccattgctgcccagcatcaagcctaccgtccgcaagactcgccaggatggcagccaggaggctcccgaagctccactctcatctgagctggaacccttccaccccaaaccaaaaatcagaacacggaagagctccaggatgactccttttcccgctacatccgccgcaccagaacctcatccatccacatcaacggcccagcccgtaacaccaaaacctacgtcacaggctacgagaagcagaactaacagatcatccgtgaagacccccgagccagtggttccaacagcccccgaactgcagccttccaccagtacagaccaaccggtgacctctgaaccgaccagccaggttacacggggccgaaagagccgttcttccgtcaaaacgccagaaactgtggtgcctaccgcccttgaactgcagccatctacatcaaccgatcgaccagtcactagtgagccgaccagccaggccaccaggggacgcaagaataggtcatcggtgaaaaccccggagccagttgtccctactgcacccgaactacagccaagcacatcgacagaccaacctgtgacatccgagcccacctaccaggcgacccgtggacgaaagaatagatcttccgtcaagacccctgagcctgtcgtgccaacggcccccgagctgcggcccagcacatctactgatagacctgtgacccctaagccaacttcaaggactactagaagtcgtactaatatgtccagcgtgaagacacctgagacggtggttcctacagccccagaactccaaatctccacttcaacagaccagccagtcacccctaagcccacgagcaggacgacacgtagccgaaccaatatgtcttccgtgaagaaccctgaatctaccgtcccgattgcaccagagctgccaccttcgacatctactgaacagcctgtgactccagagccaactagcagggccacaagggggcgcaagaatcgtagctctggcaaaaccccagagacactagtgcccactgcccccaagctggagccctctacctccaccgatcagcctgtcacccctgaacccacaagccaggctacaagggggaggactaaccgctcttccgtcaagactcctgaaaccgtcgttcccaccgcccccgagttgcagccatctactagcactgaccagccggttaccccagaacccaccagtcaagcaaccaggggccgcaccgaccgttcatccgtgaaaactccagagaccgtggtgccgaccgcacccgagcttcaagcgtctgcttcaacagatcagcccgtgacatcagagcctacatcaaggaccactcggggacggaagaacagatcttccgtgaagacccctgagaccgtggtgccagccgcacccgagctgcagccgtctacttctactgatcaacctgttacgcctgagcctaccagcagagctacaagaggacgaactaatcggtcttcagtcaagacgcccgaatcaattgtgccaattgcacccgagctgcagccatctacatccaggaaccagctcgtcactcctgagccgacctcccgagctactcggtgtcgcactaataggagttcagtgaagaccccggagcccgtcgtgcctactgccccagagccacaccctactacttccacggaccagccagtgacgcccaagttgactagcagggcaactcgtcgcaaaacaaataggtcaagcgtgaagacaccaaagccagtggaaccagccgcttctgacctggagccctttacaccaacggaccagtccgttacccctgaagctattgcacagggcggccagagcaagaccctccggagctctacggtgcgcgctatgccggttcctaccacacctgagttccagagtcctgttacaacagaccagcctatttcccccgaaccaattactcaaccgagctgcataaaacggcagcgagcagctgggaatcctggttccctggccgcgcccattgatcataaaccatgttctgccccactggaacccaagtcccaagctagtagaaatcagagatggggcgcggtacgcgccgctgagagcctgactgccatcccagaacctgcgtcgccccagctgttggagacccccattcatgcaagtcagattcagaaggtggaacctgcgggccgcagcagatttacacctgaactgcagccaaaagctagtcagagccgaaagagaagcctggccactatggattcgcctcctcaccagaagcagccccaaagaggggaagtgtcccagaaaaccgtgattataaaagaggaagaggaagatacggctgaaaaacccggcaaggaagaagatgtcgttacacccaagcctggtaagcgcaagcgtgaccaagctgaggaagaacctaacaggatcccctctagaagtttgcgtaggacaaaactcaatcaggagtctaccgcaccaaaggtgctgttcaccggggtcgtggatgccagaggggaacgggccgtcctggcactcggcggctcactcgccgggagcgcggctgaagctagtcacctggtcacagaccggatccgacgcacggtgaagttcttgtgtgccctgggacggggcatccccatactgtccttggattggctccatcagtcacgcaaggccggcttttttcttcctccggatgaatatgttgtcaccgatcccgagcaagaaaagaatttcggattttctttacaggatgcactctctcgtgcaagggaacgaaggctgctggaaggttacgagatttacgtcacccccggtgttcaaccacctccaccccagatgggtgagatcatcagctgttgtggagggacatatcttccttccatgccccgaagttataagccccaaagagtggtgatcacttgccctcaggacttcccacattgtagtattcctctgcgtgtgggccttccattgctgtcccctgagttcctgctgacgggcgtcctaaagcaagaagccaaacctgaggctttcgttctgagcccacttgaaatgagctcaacctag

SEQ ID NO: 194545 - DNA, 4968 bp, Artificial Sequence
  Description of Artificial Sequence: Synthetic coding sequence
atgtaccaccggctggacgtgagcctgcccttcgtgagccggggccccctgaccgtcgaggaaactcctcgcgtccagggcgaaacccaacctcagcgcctgctgcttgcagaagattccgaggaggaggtcgacttcctgagtgaacgccgcatggtgaaaaagtctagaactactagtagcagtgtcattgtcccagagtcggacgaggaggggcattctccagtcctggggggtctcggaccgccctttgcgttcaatctgaacagcgatactgacgtcgaagaaggtcagcaacctgcaacagaagaagcttcctccgcagcccgtcggggggctaccgtggaggccaagcagtctgaggcggaggttgtgaccgagatccagctggagaaggaccaacctttagtgaaggagcgggacaatgacaccaaagtcaaacgaggggccggcaatggcgtcgtgcctgcgggagtgatcttggagcgttcccagccgccaggagaggattcagacacagatgtcgacgacgactcccgcccccccggtcgccctgctgaggtgcacctggaacgagcacaaccattcggcttcatcgattcagacaccgatgccgaggaagaacgcatccctgctacccctgtggttatcccaatgaaaaaacgaaagatattccacggtgtcggcactagggggcccggtgctcccggcctggcccatctacaggagagtcaggctgggtcagataccgacgtggaagagggcaaagccccccaggcggttcccctggagaagtcacaggcgtctatggtcattaacagtgatacggacgacgaagaggaggtatctgctgctctaacgctcgcccacctgaaagaatcccagcctgctatttggaatagagacgcagaagaagatatgcctcagcgtgtggtactcctacaaaggtcccagaccacaacagaaagagatagcgataccgatgtggaggaggaggagctccctgtggagaatagggaagccgttctgaaggatcacactaagatcagggccctggtgagggcccattcagagaaggatcagcctcccttcggcgactcagacgacagcgtggaagcggacaagtcctcaccaggaatccacctcgagagatctcaggccagcactaccgttgacattaacacccaggtggaaaaggaggtcccacccggcagcgccataatccacatcaagaagcaccaggtctcagtggaaggtacaaaccagactgatgtgaaagcagttggtgggccagccaagctgttggtagtatcccttgaggaggcatggccactgcatggcgattgtgaaaccgatgcagaggagggcacatcgttaaccgcttccgtcgtcgcagacgtcaggaaaagtcagctccccgccgagggcgatgcaggcgcagagtgggcggccgcagtgctgaaacaggagagggcccatgaggtgggtgcccaggggggaccccccgtggctcaggtagagcaggatctgcccattagtcgtgagaacttgaccgacctggtcgtggataccgataccttgggtgaaagcacacagccacagcgtgaaggagcccaggtgccaacgggacgcgagagggagcagcacgtcgggggaactaaggacagcgaggataattacggagatagcgaggacctggacttgcaggccacccaatgttttctggaaaaccagggactggaggtccaatctatggaggacgagcctacccaggcctttatgctcaccccccctcaggaactagggccctcccactgcagcttccagaccactggcctcttgaactgtaagatgcctccagcggaaaaggccagccgtattcgagctgcagaaaaggtcagccgtggcgaccaagagagccctgacgcctgtctcccgcccaccgtcccagaggcccccgcccctcctcagaagccacttaatagccaatcccaaaagcatttggcccccccaccactcttgagtcctcttctgccttctattaaaccaactgtgaggaaaacccgccaagacgggagccaagaagccccggaggcaccattgtcctctgagctggagccatttcaccctaagcctaagattagaacacgcaagagtagcagaatgacaccctttccagccacctcggctgcccctgaacctcacccaagcacatccactgcacagccagttactcccaaaccaacatcacaggcaacaaggtcgaggacgaaccgatcatccgtcaagacaccagaacctgtggttcctacggcacccgaactccagcccagtacaagcaccgatcaaccagtgactagcgagccaacttcccaagtcaccaggggacgcaaatctcggtcatctgtcaaaacaccagagacagtggtgcctactgctctggagttacagccctcaacaagcactgatcggccggttacaagtgaacctacttcccaagctactaggggcagaaaaaataggtcctcagtgaagactcccgagcctgtggtgcccactgctcctgagctgcagccttccacatcgactgatcagcctgtgacgtcagaacccacataccaagctacccgtggcagaaagaacagatcttcagttaaaaccccagagcctgtcgtacccactgcccccgaactgaggccctctacatccactgatcgccctgttacaccgaaacccacttctcgcacaaccagatctaggaccaatatgtcatcagtaaagaatcccgagagcaccgtaccaatcgcccccgaattgcccccctccacctctactgaacaacccgttactcccgaaccaactagccgtgcaacccgcggtcgaaagaatcggtctagtggaaaaacgcccgaaaccctggtccctaccgctcccaagctcgaacctagtactagcaccgatcagcccgtgactcccgagcccacttcacaagctaccagggggcgaaccaacaggagcagtgtaaaaacacctgagaccgtcgtaccgactgctcctgagttgcagccatcaacaagcaccgaccaaccggtaaccccggaaccgacttcacaggccacacgtggccggactgatcggtcatctgtgaagacgccagagaccgtggttcctactgctcctgagctgcaggcgtcagcatccaccgatcagccggtgacctctgagccgaccagccgcacaacacgtggtaggaagaaccgttcatctgttaagacccctgaaacagtggttcccgccgcacccgagctccagccatcaacctcgactgatcagcccgtaacaccggagccaaccagccgcgccactcgcggcagaactaacagaagctcggtaaagactcctgagtctattgtgccaatagcgcctgagctccaaccttctacctcccgcaaccaactggttacccctgagccaacaagcagagcgactaggtgtagaacaaataggtcatccgtgaagaccccagagcccgtggtcccaactgcccctgagccacacccaaccactagtaccgatcaacccgtgactcctaagctgacttccagggctacaagacgcaaaaccaaccgatcgtctgtgaagacaccaaaacctgtggagccggcagcttcagacttagagcctttcacgcctaccgatcagtcagtgaccccagaagcgatcgcacaaggagggcagagtaaaactctgaggagcagtacagtacgcgccatgcccgtgcctacaacgccggagttccagagtccagtaacaacagaccaacctatttccccagaacccatcacacagccatcatgcattaaaagacagcgcgcggccggtaatccgggtagccttgctgcacccatcgatcacaagccctgttctgcccccttagagcctaaatcacaggctagccgaaatcagcgatggggtgccgtgcgcgcagctgagagcttgacagccatcccagagcctgcatctcctcagttacttgagacgcccatccatgcaagccagattcagaaggtggagcccgccgggcggtcccgctttacgcccgaactccaacccaaagccagtcagtcacgcaagcgcagccttgctaccatggacagccccccacaccagaagcagcctcagaggggggaggtgtcgcagaagacagtcatcatcaaagaagaagaggaggacaccgccgagaagccaggaaaagaggaggacgtggtcactcctaagcccggcaaacgcaagcgggaccaggccgaagaagaacccaacaggattcccagtaggtcacttcggcggaccaaattgaaccaggagagcacagcacctaaggttttgtttaccggggtggtggacgctcgtggcgagcgcgcagtgctcgccctgggcggaagtctggctggcagcgcagccgaggcaagtcacctcgtcactgatcgaatccgtcgtactgtgaaattcttatgcgctctgggccgtggcatcccgattctcagtctggattggctgcaccagtcacgcaaagccggcttttttttacctccagatgagtacgtcgtcactgaccccgagcaagagaagaactttgggttttccctgcaggatgctctgtcccgagctagggagcgaaggctcctcgagggatacgagatctacgtaacacctggggttcagccacccccaccacaaatgggtgagataatttcttgctgcggcgggacttatttgccaagcatgcctcgctcatacaagccgcagcgggtagttattacatgtcctcaagattttccccactgcagcatccccctcagggttggcctgcccctgctaagccctgaatttttgttaaccggggtactcaaacaggaagcgaaaccagaagcatttgtcctctccccattagagatgagcagtacttag

SEQ ID NO: 194546 - DNA, 4968 bp, Artificial Sequence
  Description of Artificial Sequence: Synthetic coding sequence
atgtaccaccggctggacgtgagcctgcccttcgtgagccggggccctctcactgtggaggaaacccccagagtgcagggtgagacacagcctcagcgcttgctccttgccgaggacagcgaagaggaggtggacttccttagcgaacgcagaatggtgaaaaaatcccgaaccacctctagctcagtcattgtgccagagagcgacgaagaagggcacagtcccgttctgggcgggctggggccccctttcgcatttaacctgaattccgataccgatgtggaagagggtcagcagccagccaccgaagaggcttcttcggccgccaggaggggcgctaccgtggaagcaaaacagagcgaggccgaggtcgtcactgagattcagctggagaaagaccagccactcgtcaaagagagggacaacgacacaaaggtgaaaagaggtgctggcaatggagtcgtcccggccggggtgatcctggaacgaagtcagccgcccggcgaagactccgatacagacgtggacgacgattctcggccccccgggaggcctgcagaagttcacctggaacgggcccagcccttcggtttcattgacagcgacacagacgcagaagaggaacgaatcccggccacccccgttgtaatccctatgaagaaaagaaagattttccatggcgtagggaccagagggcctggcgcccctggcctggctcatttacaagaatcacaggccggaagcgacacggacgtggaggaggggaaggctccgcaagccgtgccactagagaaatcacaagcaagcatggttatcaatagcgataccgacgatgaggaggaggtgtccgccgcactgactcttgcacacctgaaggagtctcagccggccatttggaatagggatgccgaagaagacatgccacaaagggttgtcctcctccaacgttcccagaccactaccgagagggattcggacactgatgtggaagaggaggaactgcccgtcgaaaatcgtgaggccgtgctgaaggatcataccaagatccgtgcccttgtcagagcacacagcgagaaggatcagccaccatttggtgattccgatgatagtgtggaggcagacaaaagttctccaggtatccacctggaacggtctcaggcttctacaacagtcgacatcaatacacaggtcgagaaggaggttccgcccggaagtgccatcatccacatcaaaaagcatcaggtgagtgttgaaggcaccaaccaaactgacgtcaaggcagtgggcggccctgccaagctccttgtcgtcagtcttgaagaggcctggccactgcacggcgactgtgaaactgatgcagaggaaggcacatccctgaccgcatcagtcgtcgctgacgtgaggaaaagccaactgcctgcagaaggagatgctggggccgagtgggctgcggccgtgctaaaacaggagagggcccatgaggttggcgcccagggcggaccgccggtggctcaggtcgaacaggatttaccaatctcacgggagaatctgaccgacctggtggtggataccgacacactgggtgagtctactcagccacagagagagggtgcacaggtgccaaccgggcgggagagggagcaacatgtcggcggtacaaaagattccgaggacaactatggggatagcgaagatttggacttacaagcaactcaatgtttccttgaaaatcaaggcctggaggtacagtcaatggaggatgagcccacacaggcgttcatgctgactcccccgcaagagctcggtcctagccactgcagttttcagacaaccgggcttcttaactgtaagatgccacccgcagaaaaggcatctcggatccgagcagcagaaaaggtgtcacgcggggatcaagaaagcccagacgcctgcctcccacctaccgtcccagaagcacccgctcctccgcagaagccactgaattcccagagccagaaacatctggcaccccccccactcctgagtccccttctgccttccattaaacccactgtgaggaaaacaagacaggacggcagtcaggaggcccctgaggcaccactgtcctccgagttggaaccgttccaccctaagcctaagatacgcacccggaaatcctcgcgaatgacgccgtttcccgcaacatccgccgcaccagagcctcatcccagtacatctacagcacaaccagtgaccccaaagcctacttcccaggcgacccggagtaggactaataggagctctgttaagacccctgaacccgtggtgcccacagcacctgaactgcagcctagcacgagcaccgaccagcctgtcacgtctgagcccacatcccaggtgactcggggtagaaagagcaggtcatcagtgaaaacgcccgagacagtggttcccaccgccctggaacttcagcccagcactagcaccgaccgccccgtaacgtccgagccaacgagccaagcgacccgaggccgaaagaatcgtagctctgtcaaaactcctgagccagtggtcccaactgcacctgagttgcagcctagcactagcacagaccaaccagtgacatctgaacctacttaccaggcaacgagaggccgaaagaatcggtcctctgtgaaaactccagaacccgttgtgccgaccgccccagagctgagaccctccacgagcaccgaccgcccagtgaccccgaaacccacgtctaggactacaaggtcccgaactaacatgtcatccgtaaagaacccagaatccacagtaccaattgccccagagctcccgccaagcacctcaactgagcagcctgtgaccccagagcctacttccagggccacacgaggaaggaaaaatcgtagctctggtaaaactccagagactctagtcccaaccgcgccaaagcttgagccaagcacaagcactgatcagcctgtaacgcctgagccgacttcacaggctacgcggggcaggacgaaccggagctccgtgaagacaccagaaacggtggtcccaactgcaccagaactccagccctccacatccactgaccaacccgtcactcctgaaccaaccagtcaagcaacacggggaaggacagaccgttcaagtgtgaagacccccgaaacagttgtgcctacagctcctgaactacaggccagcgcgtccacggatcagcctgtgacttccgagcctacctcaagaacaaccagaggcaggaaaaatcggtccagtgttaagaccccggagaccgtggtgccagctgctcccgagctgcaacctagtacctctaccgaccagccagttactcctgagcccactagcagagcgaccagaggtcgaacgaaccgatccagcgtgaagactccagagtctatcgtgcccatcgctcctgagcttcagccgtctacctcacggaatcagctcgtgacacccgagcctactagtcgcgccacacgctgtcgcacaaatcggtctagcgtgaaaaccccggagccggtggtgccaaccgcacccgagccccatccaacaacctcgacagaccagcctgtcactcctaaattaaccagccgggcaacccggcgcaaaacaaaccgctctagcgttaaaacaccgaagcctgtcgagccggcggcttctgacctcgaacctttcactccgacagatcagtccgtgacgcccgaggctatagcccagggaggtcagtcaaaaaccctgaggtctagtaccgtccgggcaatgccggttcctaccactccagagtttcagtctcctgttacgaccgatcagccgattagccccgaacccataacacagccttcctgcataaagcgccaacgggcggctgggaatcctggttcgcttgccgcaccgattgatcacaaaccttgttcagctccacttgagcccaagtcccaggcgtccagaaaccaaagatggggagccgttagagcagctgaaagcctcactgcaattcccgaaccagcctcccctcagcttctagaaaccccgattcatgcgtcccagatccagaaggtggaacccgctggccggtcccgtttcacgccagaacttcaacctaaggcctcccagtctagaaaaagaagtctggccaccatggactccccaccgcatcagaaacaaccgcagcgcggggaggtatcccagaagactgtgattatcaaggaagaggaggaagacacggcggagaaaccaggcaaggaagaggatgtcgtgacacctaaacctggtaaaaggaagagagaccaggcagaagaggaaccgaaccgtatcccaagccgctcccttcggaggaccaagctgaatcaggagagcacggcacctaaggttctgttcaccggggtggtcgatgctaggggggaacgagccgtcctggcacttggaggctctctggccgggtcagcggccgaggctagccatttagtgactgaccggatcagacgtacagttaagtttctatgcgcactagggaggggcataccaattttgagtctcgattggcttcatcagtctcgcaaggccggctttttcctaccccctgacgaatatgtcgtgactgaccccgaacaagagaagaatttcggtttctctctgcaggacgccttgtcccgagcgcgggagcgccgcttgctcgaagggtacgaaatatatgtaaccccaggtgtgcaaccccctcctccccagatgggggaaataatcagctgttgtggcggcacctatctgcctagtatgccgcgctcatacaagccccaaagggtagtcatcacatgccctcaggactttcctcactgctcaattcctctcagggtcggcctcccactgctctcacctgagttcctgctgaccggcgttttgaaacaggaggccaaacccgaggcttttgtcctttcccctctggaaatgtcttcaacctag

SEQ ID NO: 194547 - DNA, 735 bp, Artificial Sequence
  Description of Artificial Sequence: Synthetic coding sequence
atggaggacacccaggccatcgactgggacgtggaggaggaggaggaaaccgagcagtcgtccgaaagcctgcggtgcaacgtggaacctgtcggcagattacatattttcagtggggcgcatggtcccgagaaggacttcccactccaccttggaaaaaatgttgttggcaggatgcccgactgtagcgtcgcactgcccttcccatcaatctccaagcaacatgcagaaatagaaattctcgcctgggataaagcacctatccttagagactgtggatctctgaacgggacccaaattctcaggccgcccaaggtgctgagcccaggcgtgagtcatagattgcgtgaccaggagctgatcctgttcgctgacctcctgtgtcagtaccaccggctggatgtgtctctgccgttcgtgtctagggggccactcaccgtggaagagactccccgggtgcaaggagaaacacagccccagcggttgctgcttgccgaagatagcgaggaggaggtggactttttgagtgagcggcgtatggttaagaagtcccgtacaacctctagcagcgtcattgtacccgagtcagacgaggagggacactctcctgtgctcggtgggctgggacccccttttgcattcaacctgaactctgataccgacgtggaagaaggccaacagccgcaccgaggtggactgctgagctgtcagaagaggtgtcattgtcgcggttag

SEQ ID NO: 194548 - DNA, 5409 bp, Artificial Sequence
  Description of Artificial Sequence: Synthetic coding sequence
atggaggacacccaggccatcgactgggacgtggaggaggaggaggaaaccgagcaaagctccgagtctctgcggtgcaacgtcgagccagtgggtcgcctgcacatatttagtggcgcccacgggcccgagaaggatttccctctgcacctaggcaagaacgtggttggccgaatgcctgactgtagtgtggcccttcctttcccctcaatcagtaagcaacacgcagagatcgagatcttagcctgggacaaggctcccatcttgcgggactgcggctctctaaatggcacgcaaattttaagaccaccaaaagtcctgagccccggtgtaagccacaggctgagagaccaggagctgatcctgttcgctgacctcctttgccagtatcatcggcttgatgtaagtctcccattcgttagccggggcccattaaccgtggaggagaccccgagggtgcagggagagacccagccacagcgcttgttgttggctgaggacagcgaggaagaagtcgacttccttagcgaaagacgcatggtgaagaagtctcgaacgacctcttccagtgtgattgtcccagaatcggacgaggaggggcactccccagtgctgggaggccttggcccaccgtttgccttcaacttgaatagtgacacagatgtggaagaagggcagcagcccgccaccgaagaggctagctccgccgcccgaaggggagctacagtggaagccaagcagtccgaggccgaagtggtcacggagatccagctggagaaggatcagcctcttgtcaaagagagagataatgacacaaaggtcaagaggggcgcggggaatggtgtggttccagctggggtcatcctggaacggtctcaaccccctggagaggactccgatacggacgtggatgatgacagtcgcccacccggtcggccggctgaagtacacctcgaaagggcacaaccatttggctttatcgattccgacaccgacgccgaggaggagcggattcctgctactcctgttgtgatacctatgaaaaaaagaaagatttttcacggggttgggacaagagggcctggggcccccgggctggcccacctgcaagaaagccaggcgggctcagatactgacgtggaagaaggcaaagccccccaggctgttccactggagaagagccaggcttctatggttattaatagcgacacagatgatgaagaggaagtttctgcagccctgacactcgcgcacctgaaggagtcacagcccgctatatggaacagggatgccgaggaagatatgccgcagcgcgtggtcctcctgcagaggtctcaaacgactactgaacgggattccgacaccgatgtggaagaggaagagttgcccgtggagaaccgggaggctgtactcaaggaccacaccaagatccgcgcgctcgttcgggctcactctgagaaggaccaacctccattcggtgacagcgacgacagcgtggaggcagacaaaagctctcccggcatacatctcgaacgttcccaggccagcacaactgtggatatcaatacccaggttgaaaaagaagtgccgcctggaagcgcgattattcatatcaaaaagcaccaggtgtccgtggaggggactaatcaaacagatgtgaaggccgtcggcgggcccgccaagctcctggtggtgagtctggaagaggcgtggcctctgcacggggactgtgaaactgatgctgaagaaggaacgagccttacagcatctgtggtagctgatgtgcgcaaaagccaactgcccgccgagggtgacgctggcgcagagtgggcagccgctgtgttgaaacaggagcgggcccacgaggtcggtgcacagggcgggcctccggtggctcaagtagagcaggatttgccaatttcacgcgagaacctcacagacttagtagtcgacactgatacattaggggaaagtacccaacctcagcgggaaggagcacaggttccaaccgggcgcgaacgcgaacagcacgtaggcggcaccaaagacagcgaagacaattatggtgactctgaagatctggacctgcaggccacacaatgtttcctggaaaatcagggtctcgaggctgtgcagagtatggaagatgagcctacccaggcctttatgctcacgcccccacaggaactgggcccgtcacattgctcattccagacgacagggactctcgacgagccatgggaggtgttggctacacaaccgttctgtttgagggagtcagaggactccgagacacagcccttcgatacgcatctagaagcttacgggccatgccttagcccacctagggctatccctggagaccagcacccagaaagtccagtacacacagagccaatgggcatccagggccggggcaggcagactgtcgataaagtgatgggaattccaaaggaaaccgcagagagagtggggcctgaaaggggccccttggagagagagacagagaaactgttgcctgagaggcaaacagatgtgacgggcgaggaagagcttacgaaaggcaaacaggacagagagcagaagcagctcctcgcacgcgacactcaaagacaagagtccgacaagaatggtgagagcgcttctcccgaaagggacagggaatccctcaaggtcgagatcgaaacgagcgaagaaattcaagaaaagcaggtgcagaaacagacactgccgagcaaagcttttgaacgagaagttgagcgacccgtggcaaacagagagtgcgacccagcggaattggaggaaaaggtccccaaggtgattctagagcgggacactcagaggggagaacccgagggcggctcccaagaccagaagggtcaggcgtcctcaccaacccctgaaccaggtgtgggagccggagatcttcccggtcccacaagcgccccagtgccatctggcagtcagagtggcggaagagggtccccggtctctccacgacgccatcaaaaggggctcctcaactgtaagatgcctcccgccgaaaaagcatccagaatcagggccgcggaaaaggtcagtcgcggggatcaggaaagcccagacgcttgcctgcctccaactgtccccgaagctcccgcccctccacagaagcctctgaacagccaaagtcaaaagcatctggccccgcctccattgctctctccactgctgcccagcattaagcctactgtgagaaagacacggcaagatggcagccaagaggcacccgaagctcctttaagcagtgaactcgaaccatttcaccctaagccaaaaatcaggacccgaaaaagttctcggatgactccctttcccgctacgtcggcagcgcccaagttggagccatcgacatcgacagaccaaccggtgacccccgagcccacgtctcaagctaccaggggccgcacaaacagatccagtgtaaagactcctgagaccgtggtgccaaccgccccagagctccagccaagtacctcaacagaccaacccgtcacccccgaacccactagccaggctacccgaggccgtaccgaccgctcttccgtgaaaacacctgagactgtggttcccacagctccagagctgcaggcctcagcatcaactgatcagcccgttacatccgaacccacatcgcgcacgacacgagggaggaaaaatagatcaagtgtgaaaacccctgagaccgtggtgcctgctgccccagaacttcagccttccacttctacagatcagcctgtgactccagagcccacatcccgggcaacccgaggacggacgaaccggtccagtgtgaaaacacctgaatctattgttccaattgccccagagttgcaaccaagcacctctcgaaatcagttagtgactccagaaccgacaagccgcgcaaccaggtgccgaaccaaccgatccagtgtgaagactcccgagccagtcgtccccacggctcctgaaccacatccgaccacttccactgaccaacctgtgactcctaaactcacaagccgcgctactagacggaagacaaaccgtagcagcgtcaaaacacctaagccagtcgaaccagcagcctccgacctcgagcctttcacccccacagatcaatcagttactcccgaggcaatcgcgcagggaggccagagtaagaccctccggtcaagtacagtccgagcaatgcccgttccaacaactcctgaattccagtcaccagtgactaccgatcagcctatttctcctgaacctatcactcaaccctcatgtatcaagaggcaacgtgccgccggcaatccaggctctttagctgccccaattgatcacaaaccatgcagcgcaccacttgaacctaaatcgcaggcttctcggaatcagaggtggggtgccgtgcgtgccgccgagtccttgaccgcgattccagagccggcctctccgcagctgctggaaacgcccatccatgcatctcagatccaaaaagtggaaccggcaggccgctccaggtttactcccgagcttcagcccaaggccagtcaaagcagaaagagaagcctggctacaatggatagcccaccccaccagaaacagccccagaggggcgaagttagtcaaaagactgtgattattaaggaggaggaggaagatactgccgagaagccagggaaagaggaggatgtggtgacaccaaaacctgggaaaaggaaacgggaccaggccgaggaggagcccaacagaatcccatcccgctcgctcaggcgcacaaagttgaatcaggaatccaccgccccaaaggtcctcttcacaggcgtcgtcgacgcccgcggcgaaagagccgttctcgccctaggaggatccttggcaggcagcgcggccgaagcaagccatctggttacagatagaatccggcgaactgttaaattcctgtgcgcactcggaaggggcattcccatcttgagccttgactggctgcaccaatctcgtaaagccggattctttttgccacctgatgaatacgtggttacagatcctgagcaagaaaaaaacttcggatttagccttcaagatgctctgagtcgtgccagggagagaagactactcgagggctatgagatctatgtcacacccggtgttcaacccccacctccacagatgggagagattatatcttgttgcggcggtacatatctacccagcatgccccggagctacaagccgcagagagtggtgataacctgcccccaggacttcccccattgttccattccactgcgcgtcggcctccccttgttgtctccagagttcctcctgacaggcgtcctgaagcaggaggcgaaaccggaggccttcgtcctgtctcccctcgagatgtcatcaacgtag

SEQ ID NO: 194549 - DNA, 4968 bp, Artificial Sequence
  Description of Artificial Sequence: Synthetic coding sequence
atgtaccaccggctggacgtgagcctgcccttcgtgagccggggcccacttactgtcgaagagacaccacgggtccagggcgagacacagccgcagagactcctgcttgccgaggatagtgaggaggaggtagacttcctgtcagaaaggcgaatggtaaaaaagtcccggaccacctcttcatcagtcatcgttcctgaatccgatgaggaggggcactcacccgtgctgggcgggctgggccctcctttcgcctttaaccttaacagcgataccgacgttgaggagggtcaacagccggcgactgaagaggccagctccgccgcccggcggggagctacagtggaagccaaacagtccgaagcagaagtggtcactgagatacagctggaaaaagaccagcccctggttaaagaacgggataacgataccaaagtgaaaagaggcgcaggcaacggagtggtgcccgccggtgttattctggaaagatctcaacccccaggcgaggactcggatactgacgtagatgacgactccagaccacccggcaggcctgctgaggtgcatctggagagggctcagccattcggctttatcgacagcgacacagatgccgaagaagaaaggattccagccacgcccgtggtcatcccaatgaaaaaacggaaaatctttcacggcgtaggtacaagaggcccaggcgctcccggcctcgcccatcttcaggagtcccaggcgggttccgataccgacgtggaggagggcaaggcaccgcaggctgtccccctggagaaatcccaggcttcgatggtcatcaactctgatacagatgatgaagaagaagtcagtgctgctttgacgctggcacacctcaaagagtcacagccagctatatggaatagggacgccgaggaagacatgcctcagcgagttgtgctactgcagagaagccaaacgaccacagaacgcgacagtgacaccgatgtggaagaggaggaactacccgttgagaatcgagaggccgtcctcaaggatcacaccaagataagggcactagtaagagcccatagtgagaaggatcaacccccatttggcgattcggacgactccgtcgaagctgacaaatccagtcctggcatccacttagagcgctctcaggccagtactactgtagacataaatacacaggtcgagaaggaggtccctccaggtagcgctataatacacatcaaaaaacatcaggtcagtgtggagggcaccaatcagactgatgtgaaggctgtgggtggtcccgcgaagctgctagtcgtaagcttagaggaagcttggcctctccacggagactgcgagaccgacgccgaagagggaaccagccttacggcctctgttgtggctgatgttcgaaagagccagctgccagcagagggtgacgccggcgcggaatgggcagcggccgtcctcaaacaggagcgggcccacgaagttggggcccagggaggacccccagtggcacaggtggagcaagacctacctattagtcgagagaacctgactgacctagtggtggatacagatacactgggggaatcaacacaaccacagagggaaggagcccaggtgccgaccggaagagagagggagcaacacgttggcgggaccaaagactccgaagataactacggagactctgaagatcttgatctacaagcgactcagtgtttcttagaaaatcaggggctggaagtccagtccatggaggacgaacccacccaggcttttatgctgacgcccccccaggaattaggaccaagtcattgctcttttcagacaacgggcctgctaaactgcaaaatgcctcctgctgagaaggcttctagaatccgagccgccgagaaagttagccgaggagatcaagagagtcccgatgcatgtctcccaccgacagtccccgaggctcccgcgcctccgcagaagcccctgaatagtcagagccaaaaacaccttgcaccgccaccattactgtcgcccctactgccctcaattaagccaaccgtccggaagacacggcaggacggatcccaagaggccccagaggctcctttaagcagcgaactggagcccttccaccccaaaccaaagatccgtactcgaaaatcttccagaatgactccattccccgcaacatcggccgcccccgagccacacccgtcaacctccactgcgcagccggtgacgccaaagccaaccagccaggcgacccgctcacgaactaaccgatcttcagtgaaaacccccgaacccgttgtccccacagcgcctgaacttcagccatccacttctacggaccaaccagtgacgtcggaacctactagccaagttacccgcggccggaaatcgcgaagctctgtgaagacacccgagacagtggtgcccactgcactagaacttcagccatctacatcaacagatagacccgttaccagtgaaccaacgtcccaggctacccggggtaggaaaaaccgctcttctgtgaaaacacccgaaccagtcgtccctaccgctcccgagttgcagccttccacgagtactgaccagcctgtaacatccgagccgacctatcaagcgaccagaggccggaagaaccggtcttccgttaaaacccccgagcccgtggttcccacagccccagaacttagaccctcaacatccactgaccgcccagttaccccaaagcccacttcccgaaccacacggagccggacgaacatgtcaagtgtgaaaaatcccgagagcactgtccctattgcacccgagctgccaccctccacttctacagaacagcccgtgacgcctgagcccacgtctagagccacccgcggtcggaagaatcgcagcagcggcaaaacccccgaaaccctggttccgacagcgcccaagttagaaccttccacatctactgaccaaccggtgacgccagagcccaccagtcaggcgaccaggggccggacaaacaggtcatccgtcaaaacgccagagaccgtggtccccaccgctcctgaactgcaaccttctacctcaacagatcagcccgttaccccagagcccaccagtcaggcaactcggggcaggacagataggtcttcagtcaaaacccccgaaaccgtggtcccaaccgctccagagctccaggccagtgccagcaccgaccagccagtgacctctgaacccacatctagaaccactcggggtaggaagaatagaagttccgtgaagacacccgagacggtcgtgccagctgccccagaactgcagccgtctacaagcacagaccagcccgtgaccccggagcccacttcaagggcaactaggggaaggacaaataggagcagcgtgaagacacccgagtccatcgtcccaattgcaccagagctgcagccaagtacctcacggaaccagctggtcaccccggagcctacctcacgggccacccgctgcagaaccaaccgctcatccgtgaagacaccagagccagtggttcctactgcgcccgagccacacccgactacatctaccgaccagccagtcacccccaaattgactagtcgtgccacgcgcagaaaaaccaatcgcagtagcgtaaagacgccgaagccagtggagccggcggcctctgatctggaaccattcacaccaacagatcagagcgttacccctgaagctattgcacaggggggtcagtcaaagactttacggtcttctaccgtcagggccatgcctgtgcctacaacacctgagtttcaatctcctgtcacaacagatcagcctatctccccagagccgatcacccagccctcgtgcatcaagcgccagcgggccgccggtaatcccgggtcccttgcggctccaattgaccacaaaccctgtagcgccccattggaacctaagagccaggccagcagaaaccaaaggtggggagccgtaagagcagcggagagtttaacagctatcccagagccagctagtccacagctgctcgagaccccaatccacgcttcccaaatccaaaaagtggaacccgcaggcaggtcacgctttacaccagagctgcagcctaaggcttcacagagtagaaaacggtccttggctaccatggatagtcctccacatcagaagcagccacaaaggggggaggtcagtcagaaaacagtcataatcaaggaggaggaggaggatactgccgagaagcctgggaaagaggaagacgtcgttaccccaaaacctggaaaacgcaagcgggatcaagccgaagaggaacctaatcggatcccatccagatctctgcggaggacaaaattgaaccaagagtctacagcaccgaaagtgttgtttacaggcgttgttgatgcccggggtgagcgcgccgtcctagccctgggcggatcgctggccggttcggccgcagaagcctcacatctcgtgactgatcggatcaggcgaactgttaagtttttatgcgccctcggtagagggatccctatcctgagcctggactggctgcatcaaagccgcaaggctggcttttttctaccccctgacgagtatgtggtgacagaccctgagcaggaaaagaatttcggattcagcttacaggacgccctgagtcgcgcaagggaacgtaggctgctggagggctatgaaatttacgttactcctggggtccagcctcccccaccccagatgggagaaatcataagctgctgcggcgggacgtacctcccgtcaatgcccaggtcgtataaacctcaaagggtcgttattacctgtccacaagatttcccccactgttctattccactccgagtagggctgcctctactctccccagagtttctgctgacgggagtgttaaaacaggaagctaagccagaagcgtttgtgctgagcccattggaaatgagtagcacctag

SEQ ID NO: 194550 - DNA, 5409 bp, Artificial Sequence
  Description of Artificial Sequence: Synthetic coding sequence
atggaggacacccaggccatcgactgggacgtggaggaggaggaggaaaccgaacaaagtagcgagagcttgagatgcaatgtagaacccgtagggaggcttcatattttcagcggagctcatgggccagaaaaggattttcccttgcacctgggcaaaaatgtggttggtagaatgccagactgtagcgtggctcttccctttccgagcatatccaagcagcatgccgagatcgagatccttgcctgggataaagccccaatcctgagggattgtggctcgctgaacggaacgcaaatcctgaggccccccaaggttttgtcccccggagtgtctcaccgcctaagagatcaggagctgatcctcttcgcagatctgctctgccagtatcatagactagacgtcagccttcctttcgtgtcacgcggtccactaacagtcgaggagactccaagggtgcagggcgagacccagccacaacgcctgcttctagccgaagactcagaagaagaagttgattttctcagtgaaaggcgtatggtgaaaaaatctcggaccacttcctcgtccgtgattgtgccggagagtgacgaggagggtcattcccccgtgctggggggactgggccccccctttgcatttaacctgaactcagataccgacgttgaagaagggcaacagcccgccactgaggaagcatctagcgcagccaggagaggtgccacagtcgaggccaaacaatctgaggctgaagtggtaacagagattcaacttgagaaagatcaacccctggtgaaggagcgagataacgacaccaaggttaaacggggcgctggtaacggcgtggtgcctgccggggtcattctcgaaagaagccagccaccaggagaggacagcgacacagatgtagatgatgattcacggccacccggacgtcctgctgaggtgcacttggagagagcacagcccttcggcttcatcgacagcgacacggacgcagaagaggagagaatccccgccactccagtggtgataccgatgaaaaaacggaagatctttcacggtgtgggcaccagggggccaggagctccagggttagcccacctgcaggagtcccaagcagggagcgacaccgatgtggaggaaggaaaggcgccacaggcagtgcccctcgagaagtcacaggcttcaatggttattaactcagatacggacgatgaagaggaggtctctgcagcattaacgctcgctcacttgaaggagtcccaacccgccatatggaacagagacgctgaggaggacatgcctcaaagagtagtgctgttacagcgctcccaaacaaccacagagagggactccgacactgacgtcgaagaggaggaacttccagttgagaaccgggaagcagtgctgaaagatcacacaaaaatccgagctctggtgagagcccatagcgaaaaggaccagccccctttcggcgattctgatgattcagtggaagctgacaagtccagccccggaatccatttagagcgcagtcaagccagcactaccgtcgacataaatacccaggtggagaaggaggtacccccggggagcgccataatccatattaaaaagcaccaggtttctgtggagggaacaaatcagacagacgtaaaggcagttggtgggcctgccaaactgctagtcgtgtcattggaggaggcctggccccttcacggggattgcgaaactgacgccgaagaagggacatctctgactgccagcgtggtcgctgatgtccggaaatcacagctgcccgctgagggcgacgccggtgctgagtgggccgctgctgttctaaagcaggaaagggcccacgaggtcggtgctcagggcggaccccccgtggcacaggttgagcaggatctgcccatctctcgcgaaaacctcactgatctggtcgtggataccgacacacttggcgaaagtacccagccacaaagagagggagcacaagtgccaacgggccgcgaacgggagcagcacgtcggtggcacgaaagatagtgaggataactacggggatagtgaggacctagatttgcaagccacacagtgcttcttggaaaaccaaggtctggaggctgtacaatcaatggaggacgaaccaactcaggcttttatgctcacacctccacaggaactgggcccgtcccattgttccttccaaaccaccggcactctggatgagccgtgggaagtacttgcaacgcaaccattctgtttgagagagtccgaggacagcgagacacagcccttcgacacacaccttgaggcctacggcccctgcttgtctcccccccgcgctattccaggggatcagcaccctgagtctccagtgcatacagagccaatgggaatccaggggagagggagacagaccgtggacaaagtcatggggattcctaaggaaaccgccgagcgtgtcggaccagagcggggccctctggagcgggaaacagaaaaactgcttccagaaaggcagacagacgtcactggcgaagaagaactcacgaaaggtaaacaggatcgcgaacaaaaacagctcctggctagggacactcagcggcaggaatctgataaaaacggggagtccgccagtccggaacgcgatagggagtctcttaaagtcgaaatagaaacttccgaggagattcaggaaaaacaagtccaaaaacagaccttgccctccaaggcctttgaaagagaggttgagagacctgtcgcgaacagggagtgcgatcccgcagaactggaagagaaggtcccgaaagtgatactggaaagagatacacaaaggggggaacctgagggaggctcacaagatcagaaaggccaggcatcaagtccgacaccagaacccggtgtaggggccggtgatcttcccggcccgacaagcgctccagtgcctagtggaagccagagcggagggaggggcagccctgtcagcccccgaagacatcaaaagggattactcaattgcaagatgccacccgccgaaaaagccagtagaatacgagcggccgagaaggtatcacgcggcgaccaagagtctccggacgcttgtttaccgcctacagtgcccgaggctcccgccccacctcagaagccattaaacagtcaatcacaaaagcacctggccccaccacctctgctgtcgcccctgctcccatcaatcaaacctaccgtcaggaagacgcgacaggacggatcccaagaggccccagaagccccattgagctctgaactcgagccttttcatcctaaaccgaagatcaggacacggaagtccagccgaatgactcccttccccgcaacatcagccgcccctaagcttgagccaagcacaagcacagatcagcccgtgacgcctgagccaaccagccaggctactagaggaagaaccaacagaagctccgtgaagacacctgagactgtcgtgcccaccgcgccagagctacaacccagtacatcaacagatcagcctgtcacgccagagccaacctctcaggccacaagagggagaacggatagaagctccgtgaagaccccggagaccgttgtcccgacagcaccggagctacaggctagtgctagtacagatcagccagtgacaagcgagcctacaagcaggaccaccaggggacggaagaaccgcagtagcgttaaaacccccgaaacagtggtgcctgctgcacctgaactgcagccatctactagcaccgaccaaccagttaccccagagcctacatcacgtgccacaagagggcgcacgaaccggtcaagcgtgaagaccccagagagtatagtacctatcgctcctgaacttcagccctcaacttctagaaatcagctcgttacacccgagcccacttctagagctacccgctgtagaaccaatcggtctagcgtgaagacaccggaaccggtggtccccaccgctcctgagcctcacccaaccacaagtacagatcagcccgtgactcccaaactgacatcccgtgctacccggaggaagactaaccgttcctcagtgaagaccccgaaacccgtcgagccggcagcgtctgaccttgagcccttcactccaacagatcagagcgtgaccccagaggccatagcccagggaggccagtctaagacactccggtcctctactgtgcgagctatgcctgtgccaacaacaccagaattccagagccccgtcactaccgatcagccaatatccccggaacccataacccagccctcctgtatcaagcgacagagagccgctggtaatcctggatctctcgccgcccctatcgaccataagccttgttccgccccattggaaccgaagagccaagcttcaagaaatcagagatggggggcggtgagagctgcagaatcgctgaccgccatccctgagcccgctagccctcagctgctggagactccaatccatgcatcccagatccaaaaggttgaaccagctgggaggtctcgcttcacacctgagctccagccaaaggcgagccagagccgaaagcgcagcttggcgactatggactcaccgccacatcaaaagcagccacaacgcggagaagtatctcaaaagactgtgattataaaggaagaagaggaagatacagccgaaaaacctggaaaggaggaggacgtcgtgaccccaaaaccaggcaaacgtaagcgggaccaagccgaggaagaaccgaatcgcatcccaagccggagcctgcggagaaccaagctgaatcaagagtccaccgcacccaaggtgctgttcaccggggtggtggatgctcggggagagcgagcagtactcgccttaggcgggtccttagcaggatccgccgcggaagcctcacatctcgtgacagacagaatccggagaaccgtgaaattcctttgtgcgctaggcagggggataccgatcctgagtctcgattggttgcaccagtctcgtaaagccggattcttcctgcctccggatgaatacgttgttaccgaccccgagcaggagaaaaattttggattcagcctccaggacgccttgagcagagcccgggagcggagactcttagaggggtatgaaatatatgtcactcctggcgtccaacctccacctccccaaatgggggagatcatcagttgctgcggcggcacttacctgcctagcatgccgaggtcctacaaaccgcagcgggtagtcatcacatgtcctcaggacttcccccactgctctatccctctccgcgtcggcctccccctgttgtctcccgaatttctccttacaggggtgctgaagcaagaagctaaacctgaggcctttgtgctgtctcctttggaaatgagcagtacgtag

SEQ ID NO: 194551 - DNA, 666 bp, Artificial Sequence
  Description of Artificial Sequence: Synthetic coding sequence
atggaggacacccaggccatcgactgggacgtggaggaggaggaggagaccgagcagtcatcagaaagtctgcgctgcaacgtggagcctgtgggcaggttgcacatcttctctggagctcacggccccgagaaggattttcctcttcaccttggcaaaaatgtcgtgggtcggatgcccgactgctctgtcgctttaccctttccatccatctccaaacagcatgccgagattgaaatactagcgtgggataaggctccaatcctgcgggattgcgggtcgcttaatggtacacaaatcctctcctcgtcgctgccaccgccacagacgtcccttctccccttgagcctgcgtctccgtctgctgggcgaagaacagatcgaccccctgagtcgcctgctgaaacagctgtcaccccagcctctgagttaccgactaccaccccctcaaacatcattgtctcccctctcgcctcatctgggccccctgggtgaagagaagattggccctctgagtagacctctgaaacagttgtgcccccaaccactgaggtcttccctgcccccacctcaaactaatctgtcccccctttcccctcacctcggtcctctgggggctggtcagataggaccactgtctcgtcctctgaaccaattaagcctatag

SEQ ID NO: 194552 - DNA, 666 bp, Artificial Sequence
  Description of Artificial Sequence: Synthetic coding sequence
atggaggacacccaggccatcgactgggacgtggaggaggaggaggaaactgaacaatcctccgagagcctccggtgcaacgttgaacccgtgggtaggctgcacatcttctcgggcgcccatggccccgaaaaggacttccctctgcacttaggcaaaaacgtggtgggaagaatgcccgactgttcggtggccctgcccttcccaagtatctcgaaacaacacgcagagatcgaaatcctcgcctgggacaaagcccctattctgagggattgcggcagcctgaatggcacccagatcctgtcttctagcctcccgcccccacaaacatccctgctgcccctgtctctccgcctacgactgttgggcgaagaacagatcgaccctttgtctaggcttttaaaacagctgagcccccagccactcagctacagactgccgcctcctcagacttccctgagccctctgagtccacatctgggaccccttggtgaagagaagattggtccactgagcagaccgctgaagcagctctgcccccagcccctgtcatcatcactcccacccccgcaaacaaatttatctcctctgtctcctcacctgggccctctgggggcgggtcagatcggcccactgagccggccactgaatcagcttagtctgtag

SEQ ID NO: 194553 - DNA, 738 bp, Artificial Sequence
  Description of Artificial Sequence: Synthetic coding sequence
atggaggacacccaggccatcgactgggacgtggaggaggaggaggaaaccgagcagagttctgagtcactgaggtgtaacgtggagccagtcggccgcctacatatttttagcggggcacacgggccagaaaaggatttccccctgcatttggggaagaacgttgtagggcgcatgcccgactgctctgtggcactgccctttccctccatatctaaacaacatgctgagattgaaatcctcgcttgggacaaagcgcctatcctccgcgattgtggatcactcaacgggacgcagattctccggccacccaaagtgctcagccctggcgtgtcccacagacttcgggatcaagaactcatcctgttcgccgatcttctctgccagtaccatagattggacgtgtccctgccttttgtctccaggggccccctgacggtcgaagaaacacctcgtgtgcagggcgagactcagccccagcgcctcttgcttgccgaggatagtgaagaggaggtggatttcctcagcgaaaggcgaatggtgaagaaatctcggacaacttcttcatccgtgatcgtccccgaatcagatgaagaaggacattcacctgtcctgggcgggcttgggccacctttcgccttcaaccttaactctgacactgacgtggaagaagggcagcagcccgcgaccgaggaggcctcatccgctgcccgaagaggcgccactgtggaagcctag

SEQ ID NO: 194554 - DNA, 5478 bp, Artificial Sequence
  Description of Artificial Sequence: Synthetic coding sequence
atggaggacacccaggccatcgactgggacgtggaggaggaggaggaaacagaacagagcagcgagagcctcagatgcaacgttgagcctgttggaagactgcacatcttctctggagctcatggtcctgagaaagactttccactgcacctggggaaaaatgtggtgggcagaatgccggattgcagcgtggccctgccgttcccctcgatatccaagcagcatgccgagatcgagattctagcttgggataaggcaccaatcctcagagactgcggctcactgaatggaacacagatcctgcgtcctcctaaggtgctgtctcctggtgtgagccaccgtctgagggatcaggaactcattctgtttgcagacctcttgtgtcagtaccatcgactggacgttagcctgcccttcgtctctcgaggccccctcaccgtggaggagacgccgcgcgtacagggtgagacacagccacagagattgttactggctgaggattccgaagaggaggtcgatttcttgtcggagcgcaggatggtgaagaagtcgaggaccacatcttctagtgtgatagtaccagaatccgacgaagaagggcactcaccggttcttggcggcctgggcccaccttttgcctttaacttgaatagcgacacagatgtcgaagaaggccagcagcctgctaccgaggaggcatccagtgcagcgcgcaggggggccactgtagaggccaaacagagcgaggctgaggtggtcacagagattcagctggaaaaagaccagcccttggtcaaggagcgtgataacgacactaaagtgaagagaggcgcgggcaacggcgttgttccggctggggtgatactggagcggtctcaacccccaggtgaagactctgatactgacgttgatgacgactccagaccgcctggaaggcctgcagaggtccacctggagcgggcgcagccatttgggtttatagacagcgataccgacgcggaagaggaaaggatccccgccactccagtagtgattcctatgaaaaaacggaaaatatttcatggcgttggaactagaggccctggcgcccccggccttgcacacctgcaggaaagtcaagccggcagcgacaccgatgttgaggaggggaaagctcctcaagccgtgcccctcgagaaatcccaggcatctatggtgatcaatagtgatactgacgacgaagaggaagtatcagccgccctcaccctggctcatctgaaagaaagtcaacctgccatctggaatagagatgccgaggaggacatgcctcagagggtcgtcctgttgcagcggagccagacgacgactgagcgggattcagacaccgacgtcgaagaggaagagctgcccgttgagaatagggaggcagtgctgaaggaccatacaaagatcagagcgctggtgagagcccacagcgaaaaagatcagccccctttcggcgattctgatgactctgtcgaagcggacaagtcatcaccgggcatacacttggaaaggtcccaggctagtaccacagtcgatatcaatacccaggttgagaaagaagtcccacccggctccgcgatcatacacatcaaaaagcaccaggtttcagtcgagggcaccaaccagactgacgtaaaggccgttggtggccccgccaagctcttagtggtgagccttgaggaggcctggccccttcatggagactgcgagaccgatgccgaggagggcacttcccttaccgcctccgtagtggccgatgtgagaaagagtcagttacctgcagaaggggacgcgggcgccgaatgggcggcagccgtgttgaagcaagaacgagctcacgaggtgggggcacagggaggccctcccgtggctcaagtggagcaagatctgcccattagtcgcgagaacctaacggatctggtggtggacacagatacattgggggagagtacgcagccacagcgggagggagctcaggtcccaaccgggagagaaagggaacagcatgttggtgggacaaaggacagtgaggataactacggagactccgaggaccttgatctacaggctacacaatgtttcttagaaaatcagggtctggaggcagtgcagagcatggaagatgagcccacccaggcattcatgcttaccccgccacaggaattggggcccagccattgcagctttcagacaactggattgctgaattgcaaaatgcctcctgccgaaaaagcatcgcgaatccgtgccgccgagaaagtctctcgcggagaccaggagtctcctgacgcctgcttgcccccaactgtgcccgaggcacccgcccctccacagaaaccactcaattctcaaagccagaaacacctggctccgcccccactgctttctcctttgttgcctagcattaagcctactgtcagaaaaactcgacaggacggctcacaggaggcacctgaagcacccctaagctctgagctcgagccctttcatccaaagccgaagatcaggacccgcaagtcatccaggatgacccccttccctgccacatcagccgctcctgagccacacccaagcacttccacagcacagcccgtcacacccaaacccacatctcaggccaccagatccaggaccaatcggagcagcgtcaagactccagaacctgtcgtaccgactgcaccagaacttcagccatcaacatccacagaccaacctgttacatcagagccaacctcgcaggttaccaggggtcgcaagagtcgatcaagtgtcaaaacacctgagacagtcgttccgaccgctctggagctgcaaccatcaacctctacagatcggccagtcaccagtgaacccacttcacaagccacccggggcagaaaaaacaggtccagcgtgaagacacccgagccagtggtacctactgcacctgagctacagccgagcacttctaccgaccaacctgtgacatctgaacccacctatcaggccacacggggcagaaagaaccgatcttccgtgaagacaccagagcctgtggtgccaaccgcacctgaattacgtccttccacttccaccgatcggcccgttacccccaaacccacctcacgcaccacccggtctagaaccaatatgtcctcagtcaagacaccagagactgtagtaccaacagctccagaattacagataagcacgagcacggatcagccagtcactcctaagccgacctccaggacaacgagaagccgaaccaacatgtcttccgtgaagaaccccgagagcaccgttccaattgcaccagagctccccccttctacgagcacagaacagcctgtcaccccagagccaacctcaagggcaacccgcggccgcaaaaatcggtccagtggcaagacgcccgaaaccctggtgcccactgcccctaagctggaaccctcaactagcacggaccaaccagtcacacctgagcccacctcccaggccacccgcggacggactaaccgttcttctgtgaagacacccgagacagttgtacccacagccccagagctgcaaccaagcacctcaactgatcagcccgtcacaccggaaccaacctcacaggcaacgagggggagaactgaccgctcaagcgtgaaaacgcccgaaactgtcgtgccgaccgcacctgagcttcaggcatccgcatcaactgatcagcccgtcacatccgagcccacttcacggaccacacggggcaggaaaaatagaagctcggttaaaacccctgaaacggttgtcccagcagcacctgaactgcagccaagcaccagcaccgaccagcccgtcacccctgaacccactagccgggccacaagagggcggacgaatagatcatcagtaaaaactcctgaatctatcgtgccaattgcgccagagctccagccctccacaagcaggaaccagttagtgactcctgagcctaccagtcgggcgacgcgatgccggaccaaccgcagctctgtaaaaacccccgaaccagtggtacctactgctcccgagccacatccgacaactagcacagatcagccagtgactccaaagttgacctcccgcgccaccaggaggaaaactaatcgcagcagcgtcaagactcccaagccggttgagccagcggccagtgatctggaaccctttactccaaccgatcagtcagtcactccggaagccatcgcacagggcgggcagtccaaaaccctgcggagctccactgtacgagccatgcccgtgcctacaacacccgagttccagtccccagtaacaaccgaccagccaatttccccagaacccattacccaaccaagctgcatcaaacggcagcgtgccgccggcaaccccggatcccttgcagcccccattgatcataagccctgttcggcccccctggagcctaagtcacaggcttcaaggaaccagcggtggggcgccgtacgagctgcggagtccctgacagcaatccctgagcccgcctcaccccaactgcttgaaactccaattcacgccagtcagatccagaaagtcgagcctgccgggcgctctagattcacccccgagctgcaaccaaaagcctctcagtcacgtaagaggtctttggcgactatggacagcccacctcatcaaaaacagccccagcgcggtgaagtctctcagaagaccgtgatcattaaggaggaggaggaggataccgccgaaaagcccggcaaggaggaggatgttgttactcccaaacccgggaaaaggaagagggaccaggcagaggaagaacctaataggattcccagtcggagcttacgccgcactaagcttaatcaggaatcaacggcacctaaagtgctctttactggggtcgttgacgccagaggggagcgcgcagtactcgctttgggcggaagcctggccggctccgctgctgaagccagccacctggttaccgaccgcattagacgcaccgttaagttcctttgcgccctgggacgaggaatccccatactgtcactggactggctgcaccaaagccgtaaagctggcttcttcttacctcccgacgaatacgttgtcaccgaccctgagcaggagaaaaacttcggtttctccctgcaggacgctctgagcagggcccgtgagagaaggctcctggagggttacgagatttacgttacacccggagttcagccgccacctccccagatgggcgagatcatatcttgttgtggaggcacctatctgccttccatgcctagatcatataagccacagcgggtcgttatcacttgcccacaggacttccctcactgttcaatccctttaagagtgggcctcccactcctatcacccgagtttctcttgaccggagtgctgaaacaggaggcgaagccagaggcctttgttctgtcccccttggagatgagctctacctag

SEQ ID NO: 194555 - DNA, 735 bp, Artificial Sequence
  Description of Artificial Sequence: Synthetic coding sequence
atggaggacacccaggccatcgactgggacgtggaggaggaggaggaaacggagcagtctagtgagtcactgagatgtaacgtggaacccgtggggaggctccatattttcagtggagctcatggaccggagaaggattttccactccatctcggaaagaatgtggtaggacgcatgcctgactgctccgtggcactaccttttccgagcatttccaaacagcacgcagagatagaaatcctggcctgggataaagctcctattttgcgagactgtggatccctcaacggaacccagattctgcgcccaccaaaagtactgagtccaggagtcagccaccgtcttcgggaccaagaactaattctctttgccgacttgctgtgccagtaccaccggctggacgtttcacttccattcgtttccagggggcccctcaccgttgaggaaacgccccgggtccaaggcgaaacacagccgcagaggcttctgctagccgaggactcagaggaagaagtggattttctttccgaaaggaggatggtaaagaagagtaggacaacctcttcatccgtcatcgtgcctgaaagtgatgaagaaggacatagccccgtgctgggtggattgggccccccatttgcgttcaacctaaatagtgataccgatgtcgaggagggacagcagcctcatcgcggaggcttgttaagctgccagaagcggtgccactgccgtgggtag

SEQ ID NO: 194556 - DNA, 735 bp, Artificial Sequence
  Description of Artificial Sequence: Synthetic coding sequence
atggaggacacccaggccatcgactgggacgtggaggaggaggaggagacggaacagagcagcgagtccctaaggtgcaacgttgagcctgtggggcgtctgcatatttttagcggagcacatggtcctgagaaggacttccctctgcacctcggtaagaacgttgtggggaggatgccggactgttcggttgcattgccctttcctagcatttccaaacagcacgcggagatcgagatacttgcctgggacaaggctcctatactgagggattgtggttctctcaatggaacacagattttgagaccacccaaggtgttgtctcccggcgtgtctcatcggcttcgcgatcaagagcttattctttttgctgacctgctctgccaataccatcggctggacgtttcgttgccgtttgttagccgcggacccctcactgtagaagaaactccaagagtgcagggcgaaacgcaacctcagcgactcctgctggcagaagactctgaggaagaagtggacttcctgagcgagcgtcggatggttaagaagtccaggaccacaagtagcagcgtaattgtgccagagtccgacgaagagggtcattccccagtccttggcggtttgggccctccatttgctttcaatctcaactctgataccgacgttgaggagggacagcagccacaccgcggcgggcttctatcctgccaaaagaggtgccactgccgtggctag

SEQ ID NO: 194557 - DNA, 666 bp, Artificial Sequence
  Description of Artificial Sequence: Synthetic coding sequence
atggaggacacccaggccatcgactgggacgtggaggaggaggaggagacagagcagtcttccgaatctctgcgctgtaatgtagagccagtgggtcggctgcacattttcagcggcgcccatggccctgagaaggatttccctctacatctggggaagaacgttgtgggcagaatgccagactgttctgtggcactaccctttccatcaatcagcaagcagcatgctgagatcgagatcctcgcatgggacaaagctcctatattgagggattgcggcagtctaaatggaacccagattctcagctcctctctgcccccgcctcagacttcactgctgcctctgtcactgaggttgcgcctcttaggcgaagagcaaattgatccattgagccgcctgcttaagcagctcagcccgcagcctctgtcttaccgactgcctccaccacaaacgtctcttagcccgctctcccctcatctgggaccccttggggaggaaaaaatagggccgctgtccaggcccctgaaacagctttgtcctcagccgctcagcagttcccttccaccaccccagacaaatctgtctccgctgagcccccatttgggcccactgggtgctggccagatcgggccactcagcagaccactgaaccagctgtccttgtag

SEQ ID NO: 194558 - DNA, 666 bp, Artificial Sequence
  Description of Artificial Sequence: Synthetic coding sequence
atggaggacacccaggccatcgactgggacgtggaggaggaggaggaaaccgagcaatcttcagaaagcctgaggtgcaatgtagaacccgttgggcggctccatatttttagcggggcccatggccctgagaaggattttcctttacacttaggcaagaacgttgtgggaagaatgccagactgcagcgttgccctgccgtttccgagcatttccaagcaacacgccgaaatcgaaatcctggcttgggataaggcgcctatcctgagagattgtggttctctgaacggcactcaaatcctgagtagctcactgccaccacctcagaccagccttctccctttatcattgcggttgcgcttactcggtgaggaacagatcgatcccttatcgcggcttttgaaacagttgtcgccacagcctctcagctatcggctccccccacctcagacctctctgagccctctctctccccacttagggccgctgggcgaggagaaaattgggcccctctcacgacctctgaagcagctgtgtccgcagccgctcagcagctcactgcctccgccacagactaatctcagccctctctccccccacctgggtcctctgggggcgggtcagattggaccgctgtccaggcctctcaaccaattatctttgtag

SEQ ID NO: 194559 - DNA, 5478 bp, Artificial Sequence
  Description of Artificial Sequence: Synthetic coding sequence
atggaggacacccaggccatcgactgggacgtggaggaggaggaggaaaccgaacaatctagcgagtccctaagatgcaatgtcgagccggttgggcggctccatatttttagtggagcccatggtcctgaaaaagactttcctctgcatctcggcaaaaatgtggtaggtcgtatgccagattgttcggtggctctgccattcccgtcaattagcaagcagcacgctgaaattgagattctcgcatgggacaaggcgcctatcctgcgcgattgcggcagtctcaatgggacgcaaatactgaggcctccaaaagtactctctcccggggtgagtcacaggttacgggatcaagagcttatactgttcgcagacttgctgtgtcagtaccatcggctagatgtgagcctgccctttgtgagtcgaggacctctgaccgtagaggagactccgagagtgcagggtgaaacccaacctcaaaggctgctgctcgctgaggactctgaagaggaggtggatttccttagtgagaggagaatggttaagaagagcaggaccacctccagttcggttatagtgccagagtccgacgaggagggtcactcgcctgtgctgggcggcctgggcccgcccttcgcgttcaaccttaacagcgacactgacgttgaggagggacagcagcctgctaccgaagaagccagttctgccgcgaggaggggggcaactgtggaagcaaagcagagtgaagccgaagtggtgactgagatccagcttgagaaggaccagcctttagtcaaagagagagataacgataccaaggtaaaacgcggagcaggcaatggagtcgtacccgccggagtgattcttgaaagaagccagcctccaggagaggactctgataccgacgtcgacgatgactcgagaccacctggccggccagcagaagttcacctggaacgagcccagcccttcggcttcattgactctgacactgatgcagaagaggaacgtataccagcgacaccagttgtgatcccgatgaaaaagcgcaagatattccacggagtcggaactcgcggaccaggggcgccggggcttgcccacctccaggagagtcaggcaggcagtgacacggatgttgaggagggtaaggctccccaggccgttcccctagagaagagtcaggcaagtatggtgatcaactcagatacggacgatgaggaggaagtgtcggcagccctgactctcgcgcacctaaaggagagccagccagctatatggaaccgggacgcggaggaggacatgccacagagggtggtgctcctgcaacggtctcagaccaccaccgaacgggactctgatacagatgtggaggaggaggaacttccggtggagaatcgcgaagccgtgctgaaggaccatactaaaataagagccctcgtgagagcccatagtgagaaggatcagccccctttcggcgattccgacgatagcgtcgaagctgataaatcatcccctggcattcacctagaaaggagccaggccagtaccacagtcgatattaatacccaggtggaaaaggaagtcccacctggttccgccatcattcatattaagaaacatcaggtcagcgtcgagggcactaaccagacggatgtcaaagcggtagggggccctgccaagctgcttgtggtttcactggaggaggcctggcccctccatggtgactgcgagactgacgcggaggaaggcacaagtctgaccgcctctgtagtcgcggacgtgaggaagagccagttgcctgccgagggcgacgcaggcgctgaatgggcggcagccgtcctcaagcaggaacgcgcccatgaagtgggtgctcaggggggaccccctgtggctcaggtcgagcaggacctgccaatctccagggagaatctaaccgatctggtggttgacacagatactctgggagagtccacacagccgcagagagagggggcgcaggtgccaacgggcagagaaagagagcagcacgtcggagggactaaggatagcgaggacaattatggcgattcggaagacctcgacctccaggccacccagtgctttctagagaaccaaggacttgaggctgtccagagcatggaggacgagcctacacaggctttcatgctcacccctcctcaggaactcgggccatctcattgttcgtttcagacaactgggctcttaaactgcaaaatgcctccagccgaaaaagcgtcccgcatccgcgcggccgaaaaggtgtctagaggtgaccaagagtctcccgacgcctgcctgccacccacagtccccgaagcgccggctccccctcagaagcctcttaactcccagtctcaaaaacatctcgcacccccacccttgctgtcccctctgctcccctctataaaaccaacagtgagaaaaaccagacaagacggaagccaggaagctcctgaagcccccctgagcagtgagcttgagccattccacccaaagcccaaaattagaacacggaaatccagccgcatgaccccatttcccgccacttccgccgcacctgaaccacatccttccacctctacagctcagccagtcacacccaagcccaccagccaggccacgagatctcgaactaaccgttcctccgtgaaaaccccagaaccagtcgtgccgaccgctcctgaactccagccgtcaaccagtacagaccagcctgtcacaagtgagccaacctcccaggtaactagaggcaggaagtcaagaagcagtgttaagacacccgagacagtggtgcctaccgccctggagcttcagcccagcactagtactgacaggccagtcacttcagagcctaccagtcaagccacgcgcgggcggaagaatagatcctccgtgaagacacccgaacccgttgtacctacagcacccgagctccagccttccacatcaactgaccagccagtgacttcagaacccacgtaccaggccacccggggaagaaaaaacagatccagcgtgaagacaccggagcctgtggtgcccaccgccccagagctcaggccatcaacatcaaccgatcggcctgtgaccccaaaaccaactagccggacgacccgatctaggactaatatgtcaagtgtgaagactccagaaaccgtcgtcccaacagcacctgagctccagatatcaacgtctaccgaccagcccgttacacccaagcctacatccagaacaaccagaagccgtactaacatgtcctctgttaaaaatccagagtcaacagtcccgattgcccctgaactccctccaagcactagcacagaacagcctgtgacgccagaacctaccagccgggccactcgggggaggaaaaataggagcagcggtaagactcccgagactcttgtcccgacagcgcccaagttggaaccctctaccagcacagaccagccggttacacctgagcctaccagtcaagctacaaggggcaggaccaacagatcttccgtgaaaaccccagaaaccgtggttccaacggcccccgaactgcagcccagcacgagtactgatcagccagtgacaccggaacccacctctcaggccacgcggggaagaactgatcgctcaagcgtcaaaacccccgagacagtagtgccaactgctccggaattacaagcctccgctagtactgatcagcctgtgacttcagaacctactagtcgaactaccaggggcagaaagaacaggtcctctgtcaagacacccgagacagtggtgccagctgcacccgaactacagccctccacatctacagatcaacctgtcacccctgagcccaccagtcgggccacaaggggcaggaccaaccgcagctccgttaagactccagaaagtatcgtgcctattgcacctgagttgcagccttctacttcgagaaatcagctggtgacccctgagcctacgagtcgcgcgactagatgtcggacgaacagaagctctgttaaaacgcccgaacctgtggttcctacagcccctgagccgcatcctaccacttccacagaccagccggtcactcctaagctcaccagtagagcaacacggcgaaagacaaatcgctcttcagttaagacgcctaagcctgttgaacccgcagctagcgacctggaacctttcaccccaacggatcaaagcgtaacgcccgaggcaattgcacagggcggccagtccaaaacccttagaagctctacggtacgggcaatgcctgtacccactaccccagaatttcagagccccgtgaccactgaccagcctatctcacccgagcctatcacacagccatcttgcattaagaggcaacgcgccgctgggaatcctggctctctggcagcccctatcgaccacaagccatgcagtgcaccactggagccgaagagccaggcgagtcgcaatcagcgttggggggctgtccgtgcggcggaaagtttgacggccattccagagcctgcctcaccccagctgttggagacacctattcacgccagtcagatacaaaaggttgagcccgcaggccgtagccggtttaccccggaactccagcctaaggcaagtcagtctcggaagcgcagtctcgccactatggatagtccacctcatcagaaacagcctcagcggggagaagtttctcagaagaccgtgatcatcaaggaagaagaggaggatacagccgagaaacctgggaaagaggaagatgttgttacacccaagccaggcaaacgtaaacgggatcaagctgaggaagagccgaataggatcccctcccggagcttgcgacgcaccaaactgaatcaggagtccacggcgcccaaagtgctgttcaccggggtggtagacgcccggggggaacgagccgtgctggcactgggcgggagtctggccggctccgcggcggaggcatcccaccttgttactgacaggatacggcgtaccgttaagtttttgtgcgcgctgggcagaggaataccaatcctgtcactcgattggctgcaccagagccgcaaggcaggcttcttcctcccccccgacgagtatgtcgttacagaccccgaacaggagaagaatttcgggttctccctccaggatgcgctgtcacgcgctagagagcggcgtctgttggaaggatacgagatttatgtcacacctggcgtccaaccccctcccccccagatgggcgaaattatctcttgttgtggcgggacgtacctgcctagcatgcctcggagctacaagcctcaaagagtggtgatcacctgcccccaagattttccccactgttctattcccctgagggtggggttgcccttactcagcccggagtttctcctcacaggcgtgctcaagcaggaggcgaaaccggaggccttcgtgctttcgccgttagagatgagcagtacctag

SEQ ID NO: 194560 - DNA, 738 bp, Artificial Sequence
  Description of Artificial Sequence: Synthetic coding sequence
atggaggacacccaggccatcgactgggacgtggaggaggaggaggaaacagagcaaagctccgaaagcttacgctgtaacgtggaacccgtgggcaggttgcatatcttcagcggcgcacacgggcccgaaaaagatttcccactccaccttggaaaaaacgtggttggcagaatgcctgattgtagcgtcgcactgccattcccaagtatttctaagcagcacgcagagatcgaaatcctggcatgggataaagcacctatcttgcgcgactgcgggtctttgaatgggacacagatactgaggcctcctaaggtgctgtcacctggagtgagccacagacttagggatcaagagcttattcttttcgctgatctactgtgtcagtaccatagactggacgtaagcttgccatttgtctccaggggccctttgactgttgaagaaactccccgcgtacagggtgaaactcaacctcaacgacttctgcttgctgaagactcagaggaggaggttgattttctctcagagcgccggatggtgaaaaagagtagaacaacgtcttcttctgtcatcgtgcccgagtccgatgaggaaggccattcacccgttctgggtggcctcgggcccccatttgcctttaacctcaactctgacacagacgtagaagaagggcagcagcccgcgacagaggaagctagcagtgccgctagacggggcgccacagtggaggcttag

SEQ ID NO: 194561 - DNA, 2238 bp, Artificial Sequence
  Description of Artificial Sequence: Synthetic coding sequence
atggcctgccggcagcggggcggcagctggagccccagcggctggttcaacgccggatggtctacatataggagcatatccctgttctttgcactggtgactagcggaaattccattgacgtgagccaactagtgaatcctgcctttccaggcactgtgacatgcgatgaacgcgagatcacggtggaattccccagctcacctgggactaagaagtggcatgcctctgttgtggatcccctgggattagatatgcccaactgtacgtacattttggaccctgaaaagctcactcttagagccacatatgataattgcactcggagggttcacggcgggcatcagatgaccatccgtgtgatgaataactctgccgctttacgacacggggccgtgatgtatcagtttttctgccccgccatgcaggtcgaagaaactcaaggcttgtcagcttcaactatttgtcagaaagactttatgagcttctccctgccaagggtgttcagtggtttggccgacgacagtaaggggaccaaagtgcagatgggctggtcaatcgaagtgggcgatggtgctcgcgctaagactctgacactcccggaggcaatgaaggaggggttctcccttttgatcgacaatcaccggatgacctttcatgtgccgttcaacgcaactggtgtcacacattacgtgcaaggcaactcacatttgtatatggtcagtctgaagctgacgttcatatcccctggccagaaagtgatatttagctctcaggctatatgcgcaccagatcccgtgacatgtaacgctacacacatgacattgacaatccccgagtttccaggcaagctgaagtctgtcagctttgaaaaccaaaacattgacgtcagtcagctacacgacaatgggatagacctggaagctaccaacggcatgaagctccacttctccaagacattactcaagactaagttatctgaaaaatgcctgctccaccaattctatctggcctctctgaagctgacattccttcttcggccggagactgttagtatggtcatctatcctgagtgcctgtgcgagagtccagtgagtatagtcacaggagaactgtgtacccaagatggcttcatggacgtcgaagtttattcttatcagacacagccggccttagacctgggaactctgagagtgggcaacagcagctgccagcccgtcttcgaagctcaatctcagggtctagtgcgctttcacattcccctcaacggatgtggcactagatacaaatttgaggatgacaaagtcgtatacgaaaacgagatccacgctctctggacggatttccctccctctaaaatctctcgtgacagtgagttccgtatgaccgtgaaatgttcgtacagtaggaacgacatgctgcttaacatcaacgtggaaagcctgacaccccccgttgcttcagtcaaattgggcccgtttacccttatcttgcagtcttatcccgacaatagttaccaacagccatacggagaaaatgagtacccgctcgtacggtttttgaggcagccaatctacatggaggtgagggtgctaaatagggacgaccccaatatcaagcttgtgcttgacgattgctgggctacttctactatggacccagactcctttccacagtggaacgtcgttgtggacggttgtgcatacgatctggacaactatcagacgacatttcaccccgtcgggtctagtgtaacacaccccgatcattaccagagatttgacatgaaggcctttgcttttgttagcgaggcgcacgttctgtcatctcttgtctattttcactgcagcgccttgatttgtaaccggttgtcaccagattcaccactctgttccgtgacatgcccagtgagctccagacacagaagagcgactggcgccactgaggccgagaaaatgacagtgtctttgccaggcccgattcttctcctttccgatgatagcagcttcaggggggtaggctccagtgatctgaaggcatctggaagcagtggagagaaaagccgttccgagacaggtgaagaggtgggcagccgaggcgctatggacacaaaggggcataaaacagccggggacgtggggtccaaggccgtggctgccgtggctgccttcgccggggtcgttgcaaccctaggattcatttactatctctatgagaagagaacagtgagcaaccactag

SEQ ID NO: 194562 - DNA, 1806 bp, Artificial Sequence
  Description of Artificial Sequence: Synthetic coding sequence
atggccaagacccccagcgaccacctgctgagcaccctggaggagctcgtaccgtatgactttgagaagtttaaatttaaactccagaacacctccgtccaaaaggagcacagccgtatcccacgcagccagatacagagggcccggcccgtgaaaatggctactctgcttgtcacttactacggggaggagtacgccgtacagttaacccttcaggtgttaagggctattaaccagcgtttgctagcagaagagctacaccgggccgctatccaggacatggggtcctgttacgtggcgcaggtcggtcttgaactcttaattagtaacaacccccccatcttcgccagtgagactgccggcattacaggtcgccctccagacaccgcagcttctcccagatgccacgcccaggagggggaccccgttgatggtacttgtgtgcgggattcctgctcttttcctgaagccgtcagcgggcatccccaggccagcggctctcgctctcccgggtgtccacgatgtcaggactctcacgagcggaaaagccctggctctctctccccccagccattaccccaatgcaagcgacatctgaaacaagttcagctgttattttgcgaggaccatgacgaacccatttgcttgatctgcagtttgagccaagaacaccaaggtcatagggtgcgtccaatcgaggaagtagccttggaacacaagaagaagatccagaagcagttggaacatctcaagaaactgagaaaatccggcgaagaacagcgtagctacggggaggaaaaagccgtcagtttcctcaaacaaaccgaagcgctgaagcaaagggtgcagcgaaaactcgaacaggtttactactttttggaacaacaggaacattttttcgtggcctcgctcgaggatgtcggtcagatggtcggtcaaatccgcaaagcctatgacacccgcgtttcccaggatattgccctcctggatgctctgattggggaactagaagccaaggaatgtcagagcgagtgggagttgctacaggacattggagatattctgcatcgggccaaaacagtgcccgtacccgagaaatggacaacgcctcaagagattaaacagaagatccagctgctgcaccagaagtccgaatttgtcgagaaatcaactaagtatttctccgaaacactccgctctgagatggagatgtttaatgtgcctgaattgatcggggcccaggcccatgccgtaaacgtgatactggacgccgagaccgcataccccaacttaatctttagtgatgatttaaagtccgtgcggctaggaaacaagtgggaaagactgcctgacggtcctcaacgcttcgatagctgtattattgtgctgggctcccccagtttcctgtcgggccgacggtattgggaggttgaggtgggcgataagactgcatggatattaggtgcctgtaaaacctccatcagccggaaaggtaacatgaccctatcacctgaaaatggctactgggtggtcatcatgatgaaggaaaacgagtaccaagcgtcgagtgtgccacccacccgtcttctgatcaaggaacctcctaaacgggtgggaatcttcgtcgactacagggtggggagtatctccttctacaacgtcaccgccagaagccacatctacacctttgccagctgttctttctctgggcctttacagccaatattttcccccgggacacgggatgggggaaaaaatactgctccgctcactatatgtcccgtgggagggcagggacccgactag

SEQ ID NO: 194563 - DNA, 1239 bp, Artificial Sequence
  Description of Artificial Sequence: Synthetic coding sequence
atggccaagacccccagcgaccacctgctgagcaccctggaggagcttgtgccatatgactttgaaaagttcaaattcaagttgcaaaacactagcgtgcagaaggagcacagtaggataccaaggagccaaatccagcgcgctcggcctgtaaagatggctacccttcttgtcacgtattacggggaagaatacgcagttcaactgactctccaggtgctgagagctattaatcagaggttattggctgaagagctgcacagggccgcaattcagggcaggcctcccgatacagccgcctctcctcgctgtcatgcacaagaaggtgaccccgtggacggaacttgtgtaagagatagttgttcattccctgaggccgtgtcgggacacccgcaggcatctggcagccggtcccccggttgtccaagatgtcaggattctcacgaacgcaaaagtcctggtagcttgtccccacagccgttacctcaatgtaagaggcatcttaagcaggttcaactcctattctgtgaggaccacgacgaaccaatctgtctgatctgtagcctgtcccaggagcaccagggacaccgcgtgcgacccatcgaagaagttgctcttgagcacaagaagaagattcagaagcagttggagcacctgaagaagctgcgtaaatccggagaagagcagcgttcatacggcgaggaaaaggccgtgagctttctgaaacagacggaggctctcaaacagcgagttcagaggaagctcgagcaggtctactactttctggaacagcaggaacactttttcgtcgcgtctctggaagatgtgggacagatggtggggcagattcggaaagcttatgatacgcgcgtctcccaggacatcgccctgctggacgcattgatcggagaactggaggccaaggaatgccagagtgagtgggagctactccaggatatcggagacattctccacagggcaaaaacggtgccagtgccagagaagtggacaacgccccaggaaatcaagcagaagatccaactattgcatcaaaagtcagagtttgtcgagaagagtactaagtacttttctgaaacgttgcggtctgaaatggaaatgtttaatgaccacagccctcagcatggtcttggctcctgggaggagagggactatactcagcatagcatgcaggggccaaaacagggggtgccatgttttttggttgtgaggaccgtatag

SEQ ID NO: 194564 - DNA, 1713 bp, Artificial Sequence
  Description of Artificial Sequence: Synthetic coding sequence
atggccaagacccccagcgaccacctgctgagcaccctggaggagctggtgccctatgacttcgagaagtttaaatttaagctgcagaacacatctgtgcagaaagagcattctagaataccacgttctcaaatacaaagggccaggcccgtcaaaatggctacccttctggtgacatactatggagaagaatacgccgttcaacttacgcttcaggtcttgagggccattaaccaaagactgctggccgaggagctgcacagagccgctattcaagggaggcccccggataccgccgccagccctcgctgccacgctcaagaaggggaccctgtcgacgggacctgtgtgcgagattcttgctcatttccagaggcagtttctggccaccctcaggcctctgggtctcggtcccccgggtgtcctagatgccaagacagccacgagagaaagtctccaggttccctctccccccagcccctgcctcagtgcaaacgacacctgaaacaggttcagttgcttttctgcgaagatcatgatgagccaatttgtttgatatgttcattatcacaggagcatcaaggccacagagtgcgaccaatcgaagaagtggcactggaacataagaagaagatccaaaaacagctcgagcatctaaaaaaactgagaaagagcggcgaagaacagcgtagttatggcgaagaaaaggccgtctcatttctcaaacaaacagaagctctcaaacagcgcgtacaaaggaaactagagcaggtctattactttttagagcagcaggaacatttttttgtggcgtccctggaggacgtcggacagatggtaggccaaattcggaaggcttacgacactcgtgtttcccaggacattgccctgttagatgcattgatcggggaactcgaggctaaggagtgtcaaagcgagtgggagctgctgcaggatattggggacatccttcaccgcgccaagacggtgcctgttcctgaaaaatggacaacaccccaggaaattaagcagaagattcagctgctccaccagaaaagtgaattcgttgagaagtccactaaatacttcagcgaaaccctccggtccgagatggagatgttcaacgtgccagaactgattggggcacaagcacatgctgtaaatgtgatcctagatgctgagaccgcttatccaaacttgattttctccgacgatcttaagagtgtaagacttggaaacaagtgggagcggttgccagatggacctcaaagattcgacagctgcatcattgtacttggcagcccctctttcctgtctggtcggcgctactgggaggtggaagtcggagataaaaccgcttggatactgggggcttgcaagacaagcataagtagaaaaggaaacatgaccctgagccccgagaacgggtactgggtcgtaataatgatgaaagagaatgagtaccaggccagctctgtaccgcctactaggttacttatcaaagaaccccctaaacgcgttggcattttcgttgactatcgggtgggatcaatcagcttttataatgtgacagcccggagccatatttacacgtttgcctcctgtagctttagcggccctttgcagcccattttctccccaggaacaagggacggcggtaaaaacacggccccactcacgatttgccccgtgggcggtcagggcccagactag

SEQ ID NO: 194565 - DNA, 1209 bp, Artificial Sequence
  Description of Artificial Sequence: Synthetic coding sequence
atggccaagacccccagcgaccacctgctgagcaccctggaggagcttgtgccctatgatttcgaaaaattcaaatttaagctgcaaaataccagcgttcagaaggagcactctcgcatccccagatctcagatacagagagctaggcccgtgaaaatggccactctcctggtcacctattacggagaagaatatgcagtacaactgacactgcaggtacttcgtgcgatcaaccaaagattactggcagaggagctgcaccgggccgcaatacaaggccggccccctgatactgcagcatcaccacggtgccacgcacaagaaggcgaccccgtggacggtacatgtgtgcgggactcctgcagttttcctgaagccgtgtcagggcacccccaggcatcaggttcacgaagtcctggttgcccccggtgccaagacagccatgaacgcaagagcccaggttctttgtcaccccaacctctaccccaatgcaaaagacacctgaagcaggttcagctgttattctgcgaagatcatgatgagcctatttgtttaatttgcagtcttagccaggagcaccagggccatagagtgaggcctattgaggaggtggccctcgagcataagaaaaaaatacagaaacaactcgagcatctaaaaaaactgaggaagagcggcgaagagcaacggtcttatggggaggagaaggctgtgtcgttcttgaagcagaccgaggccctcaagcaacgcgtacaaagaaaacttgaacaagtgtactacttcctggagcagcaggagcatttttttgtagctagtttggaggatgtggggcagatggttgggcagatccggaaagcttatgatacaagggtgtctcaggacatcgcacttctagacgcgctcatcggtgagcttgaagctaaagagtgtcaatctgagtgggaactgttgcaggacattggtgatatcctgcatagggccaagaccgtcccggtgccagagaaatggaccactccacaggagatcaagcagaagattcagctcctgcatcagaaatcagaattcgttgagaaatcaactaaatattttagcgagactctgcggtccgaaatggagatgtttaatggtgaatcatccggcaatggtgtctgttggcctggcgtagtggcagtctttccctgcgcagttgacctgcgaggtcctatttag

SEQ ID NO: 194566 - DNA, 1338 bp, Artificial Sequence
  Description of Artificial Sequence: Synthetic coding sequence
atggccaagacccccagcgaccacctgctgagcaccctggaggagctggtgccttatgactttgaaaagttcaaatttaaactgcagaacacaagcgtccagaaagagcacagcaggattccccggagtcagattcagcgcgcccgtcctgtcaaaatggccacactcctggtcacatattatggagaggaatacgctgtgcaactgactttgcaggtgctgagagccattaaccagcgcctgctggctgaggagctgcatagggcggcaatccagggcaggcctcctgacaccgcagccagtcctcgttgtcacgcccaggagggtgatcctgtcgatgggacctgcgtgcgcgactcctgctctttccccgaagctgtgtctggccacccacaggcttccggcagccgatcccccggatgtcccagatgtcaggatagtcacgaaagaaaaagccccggctcgctgagcccccaaccactgccccagtgcaaaaggcacctgaagcaggtgcagttgctcttctgtgaggaccacgatgaacccatttgtttgatctgtagcctctcacaggagcaccaagggcaccgcgtcagacctatagaagaggtggcgttggagcacaagaagaaaattcagaagcagcttgagcatttaaagaagctgagaaagagcggtgaggaacagcgcagctacggggaggaaaaggccgtcagcttcctcaagcagactgaggccctgaagcagcgggtccagcgcaaattggagcaagtgtactacttcctcgagcagcaggagcacttctttgtcgcatctctcgaggacgtgggccagatggtcggacagatcagaaaagcttacgatacaagggtctcccaagatatcgcactccttgatgctctgatcggggaacttgaagcgaaggagtgtcaaagcgagtgggagctgttgcaggatattggcgacatcctgcatagggccaagacagtgcccgtgcccgagaagtggaccacaccacaggagattaaacagaaaattcagctgttacaccagaaatcagagttcgtcgagaagagcactaagtacttcagtgagacactacgctccgagatggagatgtttaacgatcactcgccacaacacggcctcggtagctgggaggaaagagattatactcagcactccatgcagggccccaaacagggtgtgccatgcctgtcactcctctccggtcaatgcaacctggcccccctgaacgccaatgcccaggacttctttccatacttgatttttctgagatcctccggggcagattggaggtccggcacctgctgttag

SEQ ID NO: 194567 - DNA, 2067 bp, Artificial Sequence
  Description of Artificial Sequence: Synthetic coding sequence
atggccaagacccccagcgaccacctgctgagcaccctggaggagctggtcccctacgattttgagaaatttaaatttaagcttcagaacacatccgtgcagaaagaacattctcgtattcccagaagccaaatccagcgggcccggcctgtgaagatggccacactgctggtcacttactacggagaggaatacgcggttcaactgactctgcaagtactgcgagccattaaccagcggctgctggccgaggagttgcaccgggcggcgatccaagagtattctactcaagagaacgggactgatgactcagccgcaagcagtagccttggggaaaacaagccccgatccctgaaaacacctgatcaccccgagggaaacgaaggaaatggcccacggccatacggcggaggggctgccagcttaagatgctctcagcccgaggcaggccgcgggctttcccgaaagccactgagcaagcgtcgggagaaagcatccgagggcttggacgcgcaggggaagcctcgtactcggtcacccgcgctgcccggagggagatcgcctggtccttgccgtgccctggagggaggacaggctgaggttagactgaggcgcaatgcctccagcgccggaagactgcagggcctcgccggcggagcacccgggcagaaggagtgtaggcctttcgaggtttacttaccctccggcaagatgcgtcccagaagcctggaggtgactatcagcactggggagaaggcgccagccaaccctgaaatcctgttaacccttgaggaaaagaccgccgctaatttggattccgctacagaacctagagcccgccccacaccagacggtggtgctagcgcagacctcaaagaagggcctggcaaccccgagcactccgtcacaggccgcccccccgacactgccgcttcacctaggtgccacgcacaagagggcgatcctgtggacggcacctgcgtgcgcgacagttgctcctttcccgaggctgtgtcaggtcacccacaagccagtggctcaagaagcccaggctgcccacggtgccaggacagccacgagagaaaaagtccaggcagtctgtctccccaacctctgccgcagtgtaagagacacctgaaacaggtgcagctgcttttttgtgaggaccatgacgaaccgatctgtttaatctgttcactgagccaggagcaccagggccaccgtgtgcgccctatcgaagaagtggcattggaacataaaaaaaaaatacaaaaacagctggaacacctcaagaagctgaggaagagtggggaggagcagagatcttacggcgaagagaaagcagttagctttctcaagcagaccgaggctctgaagcagagagtccagagaaaattagagcaagtgtattatttcctcgaacagcaggagcatttctttgtggcaagcctggaagatgtcggacagatggtaggccagattaggaaggcatatgatacacgggtcagccaagatatcgccctgctggacgcccttattggtgaactggaggcaaaggaatgtcagtcagagtgggaactcctgcaggatatcggcgacatcctgcatcgggcaaaaacagtaccagtgccagagaagtggaccactccccaggagattaaacaaaagatccagctcctgcatcagaagtcggagttcgtggagaagtcaactaagtatttcagcgaaactctaaggagtgaaatggagatgtttaacgttcccgaactgattggggcacaggcacacgctgtgaatgtgatcctcgatgcggaaacagcctacccgaatttgatctttagcgacgaccttaagagtgtccggctggggaacaaatgggagaggttgccagatgggccccagcggttcgacagttgtatcattgtgctgggctcccccagtttcctttccgggcgacgatattgggaagtagaggtgggcgataagcgattctcctgcctcagccttcgttctagctgggattatcggcgaccacccccctgtccggccaacttcctgcacttctag

SEQ ID NO: 194568 - DNA, 2796 bp, Artificial Sequence
  Description of Artificial Sequence: Synthetic coding sequence
atgccccccctgaagagccccgccgccttccacgagcagcggcggagtcttgaaagggctagaacagaggattacctcaagagaaagatcaggtcaaggcctgagcggtcagagttggtgaggatgcatatactagaggagactagtgcggaaccttctctgcaggccaagcagctgaaactgaagcgcgccaggctggccgacgacctcaacgagaagattgcgcaacgtcccggtcctatggagctcgttgaaaagaatatactgcctgtggagtcatccctgaaggaggctataatagtgggccaggtgaactaccccaaagtggcagatagcagtagctttgacgaggattcatcagacgctttgtctcctgaacagcccgcttcccacgagtcacaaggttctgttccttcccctctggaagcacgcgttagcgagcccttgctgagtgctacgtcggcctcacctacccaggtggtgtctcaattgcccatggggcgggacagcagagaaatgctttttcttgccgagcagcctcctttgccgccgccacctctcctacccccctcccttaccaatggcaccactatcccgaccgccaaaagcacacccaccctaatcaaacagtcccagcccaaatccgctagcgagaagtcccagcgcagcaagaaagcaaaagaattgaaaccaaaagtgaagaagctgaaataccaccagtacataccaccagaccagaagcaggacaggggtgcaccaccaatggactccagctatgccaagattttgcaacagcagcagctttttctgcagttacaaatactgaaccagcagcagcagcaacaccataattatcaggcaatcctgcccgcgcccccaaaatccgccggggaagctttggggagtagtggcacccctccagtaaggtctctctccactaccaactcctcctcatcatcaggtgcgccagggccctgtgggctagctaggcagaatagcaccagtctgacggggaagcccggggcgttacccgcgaacctggatgatatgaaggtcgccgaacttaaacaggagctcaaactaaggtctctacccgtttctggtacaaaaacggagctgattgagcgtctccgcgcgtaccaagatcagatctcccccgtccccggtgcgcctaaggctcctgctgctacaagcatactacacaaggccggcgaggtggtggtggcatttccagccgcacggctgtcaacgggtccagctttggttgccgccggtctggctcccgcagaggtggtggtagctaccgtggcctcatctggtgtggtcaaatttggttctaccggatctacaccaccggtgtctcctacaccatccgagagaagccttctgagcaccggcgatgagaactccacaccaggggatacttttggcgagatggtgacctcccccctcacccagcttaccttgcaggcctcgcccttacagatcctcgtgaaagaggagggccccagagcagggtcttgctgtctttcccccggggggagagctgaattggaaggacgagacaaggaccagatgctacaggagaaggacaagcaaatcgaagctctgacacggatgctgcgccagaaacagcagctcgtggaacgtctgaagttacagctggagcaagagaagcgagcacagcagcctgcaccagctcccgcccccctcggtacacccgtcaaacaggagaattctttttcaagctgccaactttcacagcagccactgggcccagcccacccattcaacccatcactggctgcgcctgcaacgaatcatatcgatccctgcgcagttgcccccggaccccctagcgtggtggtgaagcaggaagctctccagcccgaacctgagccagtgccagcacctcagctgctgttgggtcctcaaggaccaagcctcatcaaaggggtggcaccacccactctaataactgacagtactggaacccacttggtgttaacagtgactaacaagaacgcagatagccctggccttagctccggcagcccacagcagcccagcagccagcccggaagcccagcaccagccccatccgctcaaatggacctcgaacacccgcttcaaccgctctttggcacaccaacctcactcctgaaaaaggaaccccccggttatgaggaggcaatgtctcagcaacccaaacagcaggaaaacgggagcagttctcagcagatggacgacctctttgatatcctgattcagtcaggggaaatctctgctgactttaaggagcccccatccctgcctggaaaggaaaagccttcccctaaaacagtatgtggctcccctttggccgcacagccaagcccatctgccgagctcccacaggctgccccccccccccctgggagcccatctttacctggccgattggaagacttcctggagtcctccactggccttccccttcttaccagcggtcatgacggacctgaacccttgtcccttattgacgatctgcactcgcagatgctgtccagtacagccattctggaccacccaccctctccaatggacacatctgagcttcacttcgttcctgaaccaagctctaccatgggtctcgacctggctgatggacatcttgactccatggattggctggaattgagtagtggcgggcccgtgctgagcctggcacctctttcaacaaccgcccctagtctcttttctaccgatttcctcgacggccacgacctccagctgcattgggacagctgtctgtag

SEQ ID NO: 194569 - DNA, 2397 bp, Artificial Sequence
  Description of Artificial Sequence: Synthetic coding sequence
atgccccccctgaagagccccgccgccttccacgagcagcggcggtccctcgagagggcaaggaccgaggattatctcaagaggaaaatccgttccaggcctgagagatctgaattggtgcggatgcacattctagaggagacatccgccgagcccagcttacaggccaaacagttaaaactcaagcgagctagacttgcggacgacctgaacgagaagatcgcgcagcggcctgggcccatggaactcgtcgaaaaaaatatccttcccgtggaaagctcacttaaggaggctatcatcgtcgggcaggtgaattatccaaaagttgccgactcatcctcattcgatgaggattcttccgacgccctgagccccgagcagccagcctctcacgaatcacaggggtcggtacccagccccctcgaggccagggttagtgaaccgctccttagcgctacctccgcaagccctacccaagttgtttcccagttacccatgggccgagactccagggagatgttgttcttagctgagcaaccacctttgccaccacctccattattgccacccagcctgactaatggaaccacaatacccacagctaagagtacacctacccttattaagcagagccagccgaaaagtgcttcagagaagtctcagaggtccaagaaggctaaggagttgaagcctaaagtcaaaaaactaaagtaccatcagtatataccccccgaccagaagcaagacaggggggcgcctccaatggactcttcgtatgcaaaaatcctccaacagcagcagttgtttctacagctgcagatcctcaaccaacagcagcagcagcaccataactatcaagccatcctccctgccccacccaaatctgcaggcgaagccttggggtcatctggtaccccacctgtccggagcttgtccacaaccaattcttcctcatccagcggggcgcccggaccttgcggcttggcccgacaaaattctacctccctgacaggcaagcccggggccctacctgcgaatctggatgatatgaaagtggcagaacttaaacaggagctgaagctccggtcacttccagtcagtggaactaaaaccgagctgatagagcgattgcgagcataccaggaccagatcagcccagtccctggggcccctaaagcccctgccgccacttctatcctccacaaggccggggaggttgtggtggcgtttccagcagcccggctgtctacaggacctgcccttgtggcagcaggcctggcaccagctgaagttgttgtcgctaccgtggcaagctctggggtagtcaaatttggctccacaggctcgacccctcccgtcagccctaccccaagcgaacggtcactcctaagcacaggcgatgagaattccacccctggtgacaccttcggagagatggtaaccagcccacttacgcagctcaccctgcaggcttctcctctccagattctcgtgaaggaggaaggaccacgcgccgggtcctgttgtcttagtccgggaggtcgtgccgaactcgagggccgggacaaggaccagatgcttcaggagaaagataagcagatcgaggccttgacacgcatgttgcgccaaaagcaacagctcgtagagagactgaaactccagctggaacaagagaaacgggcacagcagccagcccccgctccagcccctttgggaacacccgttaaacaggaaaactccttctcttcctgccagctctcccagcagccgctcgggcctgctcatccctttaatcctagcctggccgcaccggctactaaccacatcgacccatgcgctgtagcccccggacctccatctgtcgttgtcaagcaggaggctcttcagcccgagcccgagcccgttccggctccccagctgttacttggcccccaggggccgtccctgattaaaggagtcgctccccccaccctgattacagatagtaccggaacccaccttgtgctgactgtgaccaacaaaaatgccgactctcccggtctgagcagcgggagccctcaacagccttctagtcagcctggcagccccgcgcctgccccgtcagcccagatggacctagaacaccctctgcagcccctatttggcactccaacaagtctgcttaaaaaggagccaccaggctacgaagaagctatgtcacagcagccgaagcagcaagaaaatggctcatctagccagcagatggacgacctttttgacatcctaattcagtctggaggcaacccccgaaatttctccaggttccagggcgcagctatacctgcccgggaaggagaagcaattcctgaggatagcctgtgggttcctcccggttcaactgctatcacgttctgttag

SEQ ID NO: 194570 - DNA, 2646 bp, Artificial Sequence
  Description of Artificial Sequence: Synthetic coding sequence
atgccccccctgaagagccccgccgccttccacgagcagcggcggtccctggagcgggcccggactgaggactacctcaagaggaaaatcaggagcaggccagagcggagtgagctcgtgagaatgcatatcctggaagaaacaagcgcagaaccaagcttgcaggccaaacagctgaagttgaagagagctagactcgctgatgacctcaacgagaaaattgcccagaggcctggccccatggagctggtcgagaagaacatcctacctgtggaatcatcattaaaggaggctatcattgtcggtcaggtcaactacccaaaagtcgctgattccagttctttcgacgaagactcctccgacgccttgagccccgagcaaccagcaagtcacgaaagtcagggtagtgtgccatcccccctggaggccagggtgtccgagccactcctctcggccacaagtgcctctccaactcaacagtcccagcctaagtccgcctcagaaaagtctcagcgcagcaaaaaggcaaaagaactgaagcctaaagtcaagaagcttaagtaccaccagtatatccctccggaccagaaacaggacaggggcgctcccccgatggattccagttacgccaaaattttgcagcagcagcagttgttcctgcagctgcagatcttgaaccaacagcagcagcaacaccataattaccaagccatcctcccagcccctcctaaaagtgcaggggaggccctgggatcgagcggtacgccacccgtgaggtctctgtctacaaccaactcgtccagctcttctggtgcccccggaccatgtgggctggcgcggcagaactcgacatccctgaccggcaagcccggcgccttgcccgcgaacttagacgatatgaaagtggcagagcttaaacaagaacttaagctgagatctctcccagtatccgggactaagaccgagctgattgaaagactgagagcttatcaggaccagatttcccccgtaccaggtgcacctaaagcaccagccgctacaagcatactgcataaggccggagaagtggtggtggcattccccgcagctagactcagtacaggaccagccttggtagccgctgggttggccccggcagaggttgtggtcgcaacagtggcaagctctggcgtggtgaaattcgggtccacagggagtacaccccccgtgtctccaacaccgtccgagcgcagcttactgtccacaggggatgagaacagcactcctggcgacacattcggtgaaatggtgacctctcccctgacccagttgacgttgcaggctagtcccctgcagattctggtgaaggaagagggccctcgcgctggatcctgctgccttagccccggtggacgcgcggaactggagggccgcgacaaggatcagatgttacaagaaaaggacaaacaaatagaagctttaacccgcatgctgaggcaaaaacaacagctagtggagaggctgaaactccaattagaacaggagaagagggcccagcaaccggcgcctgccccagcccccctggggacccccgtgaaacaggagaacagcttcagcagctgccaactttcgcagcagcctctgggtcctgcccatccattcaacccttcccttgccgccccagcaactaatcatatagacccatgtgctgtggcgcctgggccccccagtgtggtcgtgaaacaggaagcactgcagccggagccagagccggttcccgctcctcagttgctgttgggcccgcagggaccttctctcattaaaggcgtggccccacccactctcattacagatagcacagggacacacctggtgctcactgtcacaaacaagaatgctgacagccctgggttgagttccggtagtcctcagcaaccttcctcacaaccgggatcgccagcacccgccccgtcagctcagatggatcttgagcatccactccagcccctgttcggcacaccgaccagcctgctgaaaaaggaaccccccggttacgaggaggcaatgtcgcagcagcccaagcaacaagagaatggctcaagttctcagcagatggatgatctattcgacattctgattcaaagcggggagatctccgcagactttaaagagcctccttccctgccaggaaaggagaaaccttctcctaaaacagtgtgcggtagcccactggctgcccagcctagtcctagcgcagaactgccccaggctgctcccccgcctcccgggagcccttcgctgcccggccgcctcgaagatttccttgagtcgagcactggcctgccgctcctgaccagcggacacgacggaccagagccgctttctctaatcgacgacctgcacagtcaaatgctgtctagcaccgcaatcctggatcaccccccctccccaatggatacttcagagctgcatttcgttcccgagccgagttctacaatgggattagatttggcagacggacatctcgacagtatggattggcttgaactcagcagtggtggacctgtgctcagcctggctcctctgtccacgactgccccatcactgttcagcaccgacttcctcgatggccatgatctacagctgcattgggatagctgtctgtag

SEQ ID NO: 194571 - DNA, 2796 bp, Artificial Sequence
  Description of Artificial Sequence: Synthetic coding sequence
atgccccccctgaagagccccgccgccttccacgagcagcggcggtcactcgagcgcgcaaggacggaggactatcttaagagaaaaataaggagcagacccgaacgcagcgaactggtaaggatgcacatcctggaggaaaccagcgctgagccaagcttgcaagctaagcaactcaagctgaagagagcccggctggccgatgatctcaacgaaaagattgcgcagaggcccggaccaatggagctggtcgagaaaaatattctacccgtcgagtcctcactcaaggaggctatcatcgtgggacaggttaattaccccaaggtcgcagactcctcttcattcgacgaagattctagcgacgctctatctccagagcagccagcatcacatgagagccaaggtagcgtaccgtcccccctcgaagcccgggtatcagagccattactgtcagcaacgtcagcaagccccacccaggttgtgagccagctgcctatgggtcgggactctcgtgagatgctttttttggcagaacaacctccgctgccgccacctccgttattgccacctagcctcacaaatggcaccaccattccaactgcaaaatcaaccccaaccttaattaaacagtcgcagcccaaatctgcctcagagaaatcgcaacgctccaagaaagctaaggagcttaagcccaaggtgaagaaattaaagtaccatcaatacatcccaccagatcagaaacaggacaggggcgctcctcccatggattctagctacgccaagatcctccaacaacaacagcttttcctccagttacaaatcctcaaccagcaacagcagcagcaccacaattatcaggctatactgcctgccccacctaaaagcgccggggaggcactgggaagctctggaactcctcccgtgcgttcgctctctacaaccaattcctcctcatccagcggagcccctggaccctgtggcttggcccggcagaactcaacctcactcacaggaaaaccaggggccttaccagccaacctggacgatatgaaggtcgccgagctgaaacaggaactgaagctaagaagccttcctgtaagcggaactaagaccgaactgattgagcggttacgcgcctatcaggatcaaatcagcccagtgcccggcgcacctaaggcccctgctgccactagcattctgcacaaagctggtgaggtcgtcgtggcattcccggccgcgaggctgagtacggggccggcgctggtggccgctgggcttgccccagccgaggtcgtggtcgcgaccgttgcatcatctggcgtagtgaaatttggttcaaccggctccacaccccccgtgtccccaactccgtccgagagaagcctgctgtccaccggggacgagaactctacaccaggcgacaccttcggcgagatggtcacctcacctctaacccagttgactctacaggcctcccccctgcaaatcctcgtgaaagaggaggggccacgcgctggatcctgctgtttgagtccaggaggacgagcagaattggagggtagggacaaggatcaaatgttgcaagaaaaagacaagcagatcgaggctctcacgagaatgctcaggcagaaacagcaactggttgaacggctgaagttacagctcgaacaggagaaacgcgcccagcagccagcgcctgctcccgcacctcttggtacccctgtcaagcaggaaaacagtttctcctcttgtcagctgtctcagcaaccattggggcctgcgcacccattcaatcccagtttggccgctcctgccaccaaccacattgatccgtgcgccgtcgctcccgggcccccaagcgtagtcgtgaagcaggaagccctacagcctgagcctgagccggtgcccgcacctcagttgctgctgggccctcaaggaccttctctcatcaagggcgtagctccacctactctaataacggatagtacgggaacccacctcgttctgaccgttactaacaagaatgccgacagcccaggtttgagttctgggagtccacagcaaccttcaagtcagccagggtctcccgcacccgcccccagcgcccaaatggatcttgagcatccgctgcaaccactcttcggtaccccaactagcctgttaaaaaaagagcctccggggtacgaagaggcaatgtcccagcagccaaagcagcaggagaacggcagtagttctcagcaaatggatgaccttttcgacatcctgatccaaagcggcgagataagtgcggacttcaaggagccacctagcctccctggcaaggagaagccttctcccaaaacagtatgcggcagccccttagccgcacagcctagtccatcagctgaattgccgcaggctgcccctccccctcctggcagcccaagtcttccgggccgccttgaagattttctggagtcctccacagggctgccgctgctgacaagtggacatgacggcccagagccattaagcttgatcgatgacctacacagccagatgctgagctctacagccattttggaccatccacctagcccaatggatacatcggagctgcatttcgtccctgaaccttcttccaccatgggcttggacctggcggatggtcacctagattctatggattggctagaacttagtagcggtggaccagttctgtcactggcaccgttgtccactactgcccctagcctgttctcgactgattttctggatgggcacgaccttcagctgcactgggacagttgcctgtag

SEQ ID NO: 194572 - DNA, 258 bp, Artificial Sequence
  Description of Artificial Sequence: Synthetic coding sequence
atgctgagcagcaccgccatcctggaccacccccccagccccatggacacctccgaactgcacttcgtccctgagccaagctccaccatgggattggatcttgctgatggtcatttggattccatggactggctagagctaagctcgggggggcctgtgctatcgctggccccactgagcaccaccgccccgtccctgttcagcacggactttttggatggccatgacctgcagttgcactgggactcctgtctttag

SEQ ID NO: 194573 - DNA, 1524 bp, Artificial Sequence
  Description of Artificial Sequence: Synthetic coding sequence
atggccggccggggcagcctggtgagctggcgggccttccacggctgtgattccgctgaggagctccctcgagtgagtccacgcttcttgagggcgtggcaccctccacctgttagcgccaggatgccaacccgacggtgggcccctgggacacagtgtataaccaaatgtgagcacacccggcccaaaccaggagagctggcatttagaaaaggggacgtagtgaccatactggaggcttgcgagaacaaatcttggtatcgcgtgaagcaccacacttcgggccaggagggcctgctcgcagctggcgccttgcgcgagcgagaggcgctgagtgccgacccaaaactttctctgatgccctggttccatggcaaaatcagcggtcaggaagcggtacagcagctccagccacctgaagatggcttgtttctagtccgagagagcgctcgacatccaggtgattatgtactttgcgtgtcctttggaagagacgttatacattacagagttttgcaccgcgatggccatctcaccatcgacgaagccgttttcttctgtaacctgatggatatggtggaacattactccaaagacaagggggccatctgtacaaagctggtgcggccaaagcgcaagcatgggacgaagtccgccgaggaagaattggcccgggccggctggctgctgaatttgcagcatctgacactcggggcgcagatcggcgagggtgagtttggcgccgtgctccagggggagtacctcgggcagaaggttgcagtgaagaacattaaatgcgacgtgactgctcaggcctttttggatgaaactgcagttatgaccaagatgcagcacgagaacctggttcgactgttgggagtcatcctgcaccagggcctatatattgtcatggagcacgtgtccaaaggcaatcttgtcaacttcctccgaacccgcgggcgagcactagtgaacacagcgcagctgctccagttcagtctgcatgtggctgagggaatggagtatctggaaagcaagaaactcgtgcatcgggacctagccgctcgaaacatcctagtatctgaggacctggtggctaaggtatccgatttcgggctggctaaggctgaaaggaaaggtctcgattcatccagattacctgtgaaatggactgccccagaggccctcaaacatggcaagtttacctccaagtccgacgtgtggagctttggagtacttctttgggaagtgttctcttacggacgagcaccttacccgaaaatgtctcttaaagaagtgtcagaagcggtggagaaaggctaccggatggagccacctgaaggctgcccagggcccgtacatgtgctgatgtccagttgttgggaggcagagcctgccaggcgcccaccttttaggaagttggccgaaaagctggcccgcgagctccgctccgccggtgccccagcatctgtgtcaggccaggatgccgatgggagcacttctcctcggagtcaggagccttag

SEQ ID NO: 194574 - DNA, 1401 bp, Artificial Sequence
  Description of Artificial Sequence: Synthetic coding sequence
atgcccacccggcggtgggcccccggcacccagtgcatcaccaagtgtgagcacacccgcccaaaaccaggcgaattggcgtttcggaaaggagacgtggtcacaattctggaggcctgtgaaaacaaaagctggtatcgcgtcaaacaccatacatctggtcaggaaggcttactggctgcgggagctctacgggagagagaggccttgtcagccgatccaaaactgtcccttatgccatggttccacggtaaaatctcagggcaggaagccgtgcagcagttgcagcctcctgaagatgggctttttttggtaagagaaagcgcccgtcacccgggcgactacgtgctgtgcgtaagcttcggacgggacgtgattcactacagagtcttgcacagagatgggcacctcaccatcgatgaagctgtgttcttttgcaatctcatggatatggtggagcactactcgaaagacaaaggcgctatttgcacaaagcttgtgaggcccaaaaggaagcacggtaccaagagcgccgaggaagagctggccagggccggctggttactgaatttacagcatttgactctcggggctcagatcggcgagggcgagtttggggccgttctccagggggaatatttaggccaaaaggtagctgtgaagaatataaaatgtgatgtaaccgcacaggcattcctcgatgaaaccgccgtgatgactaaaatgcaacacgagaacctcgttcgtcttctgggagtgattctccaccaggggctctatattgtgatggagcatgtctccaaggggaacttggtcaacttcttgcggacaaggggacgcgcgctagtcaatacagcccagctcctacagttctccttgcatgttgcggagggaatggaatatctcgagtctaagaagttagttcaccgagatctggccgctcgtaatattctcgtgtcagaggatttagtcgcaaaggtgagcgattttggcctggctaaagccgaacggaagggtctggacagcagtagactgcctgtgaagtggaccgccccagaggcactgaagcatggcaagtttacctcgaaatctgacgtatggagcttcggggtgctcctgtgggaggtctttagctatggccgggcgccttatcctaagatgagccttaaggaggtcagcgaggcggtggagaagggttataggatggagccacctgaaggttgcccgggcccagtacatgttctgatgagctcatgttgggaggcagaaccagctagaaggcccccttttaggaaactcgcggagaagctggccagggagctgaggtccgccggcgccccggcatcagtttccgggcaagatgctgatggctctaccagcccacgctctcaggagccctag

SEQ ID NO: 194575 - DNA, 1527 bp, Artificial Sequence
  Description of Artificial Sequence: Synthetic coding sequence
atgcagggccacttccccgccgagcggcgggagggccggccccggagaggtacccggggccaacagcagcttcttgtaagtccaaggtttctccgggcttggcatccccctcccgtcagcgcaaggatgccaactcgtcgctgggcccccggaacacagtgcattactaagtgcgaacacacccgacccaaacctggagaattggcatttcggaaaggcgacgtggtaacaattcttgaggcgtgcgaaaataagtcgtggtaccgcgtaaagcatcatacctctgggcaggagggcctgctggccgctggcgcccttagggagcgcgaagcactgagcgccgatcccaagttgtctctaatgccgtggttccacggaaagatttcagggcaggaggcagttcaacagctgcaaccgcccgaagatggcctgtttcttgtgcgagaatccgctagacatccaggcgactacgtgttgtgcgtgagctttgggagggacgtcatacattacagggtactccatcgggacggacacctgacgattgatgaggccgtgttcttttgcaacctgatggacatggtggaacactactctaaagacaagggcgccatttgcaccaagctggtgcgccctaagcgtaagcacgggacaaagagtgccgaggaggaactggcccgggctgggtggctactgaacctgcagcacctgaccttaggggcccaaatcggcgaaggcgagtttggcgctgtcctccagggtgaatacttggggcagaaagtcgccgtgaagaacataaaatgtgacgtgaccgctcaggcgttcctggatgagacagccgtgatgactaagatgcagcatgagaaccttgtgagactgctgggagtaatcctccaccaggggctatacatcgtgatggagcacgtctcgaagggcaatctggtaaattttctgagaactaggggcagagctctggttaatacagctcagcttctccaattctctctccacgtcgccgagggaatggagtatctggaatcaaaaaagctcgtccatagggatctggccgcccgcaatatcctcgtgagtgaagacctcgttgccaaggtgagcgattttggactggcgaaggccgaacgcaagggattggactcttctagactgcctgtcaaatggaccgctcccgaagcccttaaacacggcaaattcacgtccaagtcagacgtttggagcttcggagtcctgctctgggaagtatttagttacgggcgcgcgccctatcctaagatgagcctgaaagaagttagtgaagctgtcgagaaggggtatcgcatggagccccctgaaggctgccctggccctgtgcacgtgttaatgagctcatgttgggaagcagagcccgcaagaaggcctcctttcagaaagctagcagagaagcttgcccgcgagctgcgcagcgccggcgcccccgccagcgtgtccggtcaagacgccgacggaagtacaagtccaagaagtcaggaaccctag

SEQ ID NO: 194576 - DNA, 1134 bp, Artificial Sequence
  Description of Artificial Sequence: Synthetic coding sequence
atgacccaggagcccttccgggaggagctggcctacgaccggatgcccacactggagcggggaagacaggatccggccagctacgcaccagatgcgaagcccagtgacctgcagctgagtaagcgacttcctccctgcttctcccacaagacttgggtgttcagcgtgttgatggggagctgcctgctggttaccagtggtttttcactgtacttgggcaatgtctttcccgctgagatggattatctcagatgtgctgcaggaagctgcatcccaagcgccattgtctcatttaccgtgtcacggcgcaacgcgaacgtgattccaaattttcagatactgttcgtgagcacctttgctgttacaactacctgcctgatatggtttggatgcaaactggtcttgaacccatccgcaatcaatattaatttcaatctgatccttctactacttttggagctcttgatggctgctactgttatcattgctgctagatccagtgaagaggattgtaagaagaagaaagggtccatgtccgattcagctaacatactggatgaagtcccttttccagcacgggtcctgaagtcttattccgttgtggaggtgatcgctgggatctccgccgtcctaggcgggatcatcgccctcaacgtagatgattcagtgtctggccctcacctgagcgtgactttcttttggattctggtcgcttgcttcccctccgctatcgcctcacatgtggcggctgagtgcccatctaaatgtttggtggaagtgctcatcgccatatctagcctgaccagcccacttctcttcaccgcttctggttatctctcgttctctattatgaggattgtcgagatgttcaaggactaccctccggctataaagcctagctacgatgttctgctcctgctgctactgctagtgttgctcctacaagctggcctaaataccggtactgccattcagtgtgttcgatttaaagtgagcgccagactgcagggcgcctcctgggatacccaaaacggccctcaggaaaggctggccggcgaagtagcccgctcaccactgaaagagtttgacaaggaaaaggcctggcgcgctgtagtggtgcaaatggcacaatag

SEQ ID NO: 194577 - DNA, 1134 bp, Artificial Sequence
  Description of Artificial Sequence: Synthetic coding sequence
atgacccaggagcccttccgggaggagctggcctacgaccggatgccaaccctggagcgcggtcggcaggatcccgcgtcctacgccccagacgcaaaacccagcgacctgcagctgtctaaacgactgcccccttgtttttcccataagacatgggtgttctcggttctcatggggtcatgcctcttggtgacttccggcttctctctgtacctcgggaatgtctttcctgccgagatggactatctgcgctgtgcagctgggtcttgcatcccatcagccatcgtgtcctttacggtctccagacgcaacgctaatgtgatacccaactttcagattctattcgtgtcgaccttcgcggtaacgacaacctgcctgatttggtttggctgtaagcttgtccttaatccttccgctatcaacattaattttaacctcattctcctcctgcttttggagctgctgatggctgcaactgtgattattgctgcgcgctcaagtgaggaggactgtaaaaaaaaaaagggctcaatgtctgacagcgccaacattttggatgaggtgcctttcccggctagggtgcttaaatcctactccgtcgtcgaagtgatcgcggggatctcggccgtactcggagggattatagctctgaatgtagacgactctgtctctggacctcacctcagcgtgaccttcttctggatcctggtagcctgtttcccctccgccatagcctctcacgtcgcagctgagtgtccctctaagtgcttggtagaggttctgatcgccatatctagcctgacttctccacttctgttcaccgcctccgggtacctctcattttctattatgagaattgtcgaaatgtttaaggattacccacccgccataaagccttcatatgacgtcctcctccttctcttactcctggtgctcctccttcaggccggcctgaacaccggaactgctattcaatgcgttaggtttaaggtgtcagctaggctgcagggggctagctgggatactcagaacgggccgcaggaaagactcgctggcgaggtggcacggagcccgctgaaggaattcgataaagagaaggcatggagagccgtggtagttcagatggcccagtag

SEQ ID NO: 194578 - DNA, 1044 bp, Artificial Sequence
  Description of Artificial Sequence: Synthetic coding sequence
atgacccaggagcccttccgggaggagctggcctacgaccggatgcctaccctagaacgcggcagacaggatcctgccagctatgccccagacgccaaaccgagtgacctgcaactatctaagaggctgcccccctgtttctcccacaagacatgggtattcagtgtgctcatgggctgcattcccagcgcaattgtgagttttaccgtgtccaggagaaatgccaacgtcatccccaatttccagattctgttcgtatctacttttgccgtgacaaccacctgtctgatatggttcggatgcaagctggttctcaacccctccgcaatcaatataaatttcaatctcattttactattgctgctggagctgctcatggccgctaccgtgattatcgctgccagatcctccgaggaagactgtaaaaaaaagaaaggctctatgtcagatagtgcaaatattcttgatgaggtgcctttccctgcaagggtgctcaaatcctacagcgtcgtggaggttatcgccgggattagcgccgtactgggcggaatcatcgctcttaatgtagacgactctgtctcaggtccacacctgtctgtaacctttttctggattctggtcgcatgcttcccaagcgcaattgcctcacacgtagccgctgagtgccctagcaaatgcttggtcgaggtcctcattgctatctcttcactgacttcgccactcctcttcactgcttcaggatacttaagttttagcattatgcggatcgtcgagatgtttaaggattacccacccgcgatcaaaccttcatacgacgtgttacttctgttattattgctggtgctgctgctgcaggcaggactgaacacaggcaccgccatccaatgtgtgagatttaaagtgagtgctcggttgcaaggggcgagctgggacactcagaacgggccccaggaacggctggcaggcgaagtagcccgatcaccgctcaaagagttcgataaagagaaagcatggcgtgccgtagttgtgcagatggcccagtag

SEQ ID NO: 194579 - DNA, 672 bp, Artificial Sequence
  Description of Artificial Sequence: Synthetic coding sequence
atgacccaggagcccttccgggaggagctggcctacgaccggatgccaactcttgaacgaggaagacaggatcctgccagctacgcccccgatgccaaaccaagtgatcttcagctgtccaagagattaccaccatgcttttcacacaagacctgggtcttcagtgtgttaatgggttgcatccctagtgcaatagtgagctttaccgtatccaggcgcaacgccaacgtaatcccaaatttccagattctgtttgtgtctaccttcgcggtcacaaccacctgtctaatttggttcggctgcaagcttgtactgaatcctagcgcgattaatatcaattttaacctcatcttgttgcttcttctcgagctgctgatggcagcgactgtgattatcgccgcgcgtagtagcgaggaggactgtaaaaagaaaaaggggtccatgagtgatagcgccaacattctggacgaggtcccgttcccagctagggtattaaaaagttacagcgttgttgaagtgattgctggtattagcgcagtgttgggcgggatcatcgcgctgaacgtcgatgattccgtcagtgggccccacctgtctgttacctttttttggattctggtggcatgcttcccatcggcaattgcttctcacgtcgccgctgaatgtccgtag

SEQ ID NO: 194580 - DNA, 978 bp, Artificial Sequence
  Description of Artificial Sequence: Synthetic coding sequence
atgacccaggagcccttccgggaggagctggcctacgaccggatgcctactctagaacgggggcggcaggatccagcaagttacgctcctgacgccaagccgtccgatctgcaactgtctaaacggctccctccctgcttcagtcacaaaacgtgggtgtttagcgtcttgatgggcagctgtttattagttacaagcggtttctctctgtacctgggaaatgtttttccagccgaaatggactacctgagatgcgcagccgggtccattaatttcaatctgattctgctgctcttgttggagcttctgatggctgctaccgtgataatagcggcacggagttccgaagaggactgtaagaagaaaaaaggttcaatgtccgacagtgcaaacattttagacgaggtgccctttcctgcccgcgtcctcaaatcctatagcgtcgtagaagtgattgccggcatctcggccgtgttaggaggtattatcgctctaaacgtcgatgatagtgtgagcggcccgcacctctcagtgactttcttctggatcctggtggcctgtttccctagtgccatcgcgtctcacgtagccgccgagtgcccaagcaaatgtctggtggaggttttaatcgccatttcaagcttaacatcaccattgcttttcacagctagcggatatcttagtttttctatcatgcgtattgtcgaaatgtttaaagactaccccccagcgattaagcccagctatgatgtgctacttctgttactgttgctagtcctgctgctgcaggctggactgaacactggcactgccatccaatgtgtgcgctttaaggtcagcgctagattacagggcgcctcctgggatacacagaacggaccccaggaacggttggccggagaggttgctagatctccgttgaaggaatttgacaaggagaaagcatggcgtgcagtggtggtgcagatggcacagtag

SEQ ID NO: 194581 - DNA, 897 bp, Artificial Sequence
  Description of Artificial Sequence: Synthetic coding sequence
atggactacctgcggtgcgccgccggcagctgcatccccagcgccatcgtatcctttaccgtctcccggcggaacgctaacgtgattccgaacttccagattctttttgtaagtacattcgcggtcactaccacatgcctgatctggtttggctgtaagttggtcctaaaccccagcgccattaacattaacttcaacctaatacttcttttactccttgagttgttgatggctgctacagtaatcatagccgcacggtcttcggaggaagactgtaaaaagaaaaaagggagtatgtcagacagcgctaatattctggacgaggtgcccttccctgctcgggtgctgaagtcatactccgtggtggaggtcatcgcgggaatctcagcagtgctgggcgggattattgcattaaatgtagatgatagcgtctcaggaccccacctatcagtgacctttttttggatacttgtggcctgcttcccctccgccatcgcatctcacgttgccgcagagtgcccaagcaagtgtctcgtggaagtgcttatcgccatcagctctttgacctccccactactgtttaccgctagcggctatctgtcattttcaatcatgagaatcgttgagatgtttaaagactatccacccgcgatcaagcctagttatgatgtgctcttactgctgctcctgctcgtgttgctactgcaggctgggttaaacacgggtaccgctatccaatgtgtcagatttaaggtctctgccagattacagggtgccagttgggatacccagaacggaccccaggaacgccttgccggcgaagtcgccaggtcacctctcaaagagtttgataaagaaaaggcatggcgggctgttgtcgtgcaaatggcacaatag

SEQ ID NO: 194582 - DNA, 1032 bp, Artificial Sequence
  Description of Artificial Sequence: Synthetic coding sequence
atgacccaggagcccttccgggaggagctggcctacgaccggatgccgaccttagagcggggcaggcaagatcctgcctcatatgcacctgacgcgaaaccctcggacctgcagttgtccaaacggcttccaccatgcttctctcataagacatgggtattttccgtgctgatgggcagctgtctcttagtaacgtctgggttctccctttacctggggaatgtattccctgccgagatggattatctacgctgcgcagcaggttcctgtataccaagcgcgatagtgtccttcaccgtttcccggcgcaatgccaacgtgatcaacttcaatcttattctattgctgttacttgagttgctgatggcagctacagtcatcatagctgctcggagctccgaagaggactgtaaaaaaaagaaaggcagcatgtctgattctgcaaacatcctcgacgaggtgccgtttcctgctcgtgttcttaagtcttactccgtagtcgaagtgattgccgggatcagtgccgtgcttggcggaattatcgcccttaatgtggatgattccgtgagcgggccacacctcagcgtgaccttcttctggatcctcgtggcatgtttcccctcggcaatcgcctcccacgttgctgctgaatgcccctcaaagtgcctcgtcgaagttctaatcgcaatcagctcgctcacatccccgctcctgtttaccgcatctggatatctgagcttcagcattatgcgcatcgtcgaaatgttcaaggattatccacctgccattaagccctcctatgatgtactgttactgctgttactactggtcctgttgctccaggcaggcctcaatacgggcactgcaatccaatgcgtccgctttaaagtcagcgcccgtctgcagggagcatcctgggatacacaaaacggaccgcaagagaggctagccggagaggttgctcgcagccccctgaaggaatttgataaggagaaagcgtggagggcagtcgtggtacagatggcccagtag

SEQ ID NO: 194583 - DNA, 267 bp, Artificial Sequence
  Description of Artificial Sequence: Synthetic coding sequence
atggccagcagcgacgtgaagcccaagagcgtgagccacgccaagaagtggtcggaggagatcgagaacctgtacaggtttcagcaggcaggatatagagatgagactgagtaccggcaggtgaagcaggtgtccatggttgatcgctggcctgagaccgggtacgttaagaagctccaaaggcgagacaataccttctactactacaacaaacaaagagaatgcgacgataaggaagttcacaaggttaaaatttacgcatattag

SEQ ID NO: 194584 - DNA, 267 bp, Artificial Sequence
  Description of Artificial Sequence: Synthetic coding sequence
atggccagcagcgacgtgaagcccaagagcgtgagccacgccaagaaatggtcagaggaaatcgaaaatctctacaggtttcagcaggcgggctatagggatgagacagaatacagacaagttaagcaagtttcaatggtggacaggtggccagagaccggttatgtgaaaaagctccaacgcagggacaatacattctactattacaacaaacagagagaatgcgacgacaaagaagtgcataaggtcaagatctatgcctactag

SEQ ID NO: 194585 - DNA, 1488 bp, Artificial Sequence
  Description of Artificial Sequence: Synthetic coding sequence
atgggcagcaagcggcggaacctgagctgcagcgagcggcaccagaagctggtcgacgagaactactgcaaaaagctccacgtgcaggcccttaagaatgtgaatagtcagattcgcaaccagatggtccaaaatgaaaatgacaatcgtgtccaacgtaaacagttcctcagactgctgcagaacgagcagttcgagctagatatggaagaggcaatccagaaagctgaagaaaataaacggctgaaggaactacagctgaagcaggaggaaaagctggcgatggagttggcaaagctgaagcatgagtctcttaaggatgagaagatgaggcaacaggtgagagagaattccatcgagcttcgcgagctggaaaaaaaactcaaagccgcctatatgaacaaggagagagccgcccaaattgccgaaaaagacgctattaagtatgagcagatgaagagagacgccgagattgccaagacaatgatggaggagcataagcgtatcattaaggaggaaaacgccgccgaggacaaacggaacaaagctaaggcacagtattatctggacctggagaagcaactggaggaacaggagaagaagaagcaggaggcctacgaacaactgctgaaggaaaaactgatgattgatgaaatagtgagaaagatctacgaagaggatcagcttgaaaaacagcagaagcttgaaaagatgaacgctatgcgacgatatatcgaggagttccagaaagaacaagccctctggcgtaaaaaaaaacgagaggagatggaggaggagaacagaaagatcatcgagtttgccaatatgcaacagcagagggaggaggatagaatggccaaagtccaagagaatgaagagaaaagattgcaactgcagaacgctctcacccagaagttagaggagatgcttcgacaaagagaagatctcgaacaagtgaggcaggaactataccaggaggaacaagccgagatttataagtctaaactgaaggaggaagcagaaaaaaaattaaggaaacagaaggagatgaagcaggatttcgaggagcagatggcactcaaggaacttgtgctacaggcggcaaaggaagaggaagaaaactttcgtaaaaccatgttagccaagttcgccgaagacgataggatcgaactcatgaacgcgcagaaacagcgtatgaaacagctggaacaccgtagagccgtagagaagctgatcgaggagcggcgccaacagtttctggctgataagcagcgcgagcttgaagagtggcagctccagcagcgacggcagggcttcatcaatgctataattgaggaagagaggcttaaactcctcaaagaacacgccacgaatctcctgggatacctgcctaagggtgtatttaaaaaagaggacgatattgacttgctgggggaggaattcaggaaggtctaccagcagcgcagtgagatctgcgaggagaagtag

SEQ ID NO: 194586 - DNA, 1173 bp, Artificial Sequence
  Description of Artificial Sequence: Synthetic coding sequence
atggcccagcggtacgacgacctgccccactacggcggcatggacggagtaggaattccatcaacaatgtatggcgacccgcacgctgctcgctccatgcagccggtgcatcacctgaaccatggacccccattgcatagccatcagtatccacacaccgcccacaccaatgccatggctccgtctatgggctcgtcagtcaatgacgctctgaagagggataaagatgccatatacggccatccactctttcccctgctggccttaatcttcgagaaatgcgagctggcgacttgtaccccgcgggagcctggagtggcaggaggagacgtgtgcagctcggagtcatttaatgaggatattgccgtgtttgccaagcagatccgggcggaaaaacccctgttttcttcaaatcctgagcttgacaacctaatgatccaggctatccaggtgctcagattccatctcctggaactcgagaaggtgcacgagctgtgtgacaatttttgtcataggtacatcagttgtctcaagggcaagatgcccatcgacttagtgatcgacgaccgggaaggagggagtaagtccgactccgaagacatcacccgatcggccaatctgactgaccaacccagttggaaccgtgaccatgacgatactgcctctacaagatccgggggaacacctgggccttcctccggcggccataccagtcacagtggcgataacagcagcgagcagggggacggccttgacaacagtgttgctagcccgtctaccggtgacgatgacgatcctgacaaggacaagaaacgccataagaaaagaggcattttccccaaggttgccacaaatatcatgcgggcttggctattccagcacctgactcatccatatcctagcgaggagcagaaaaaacagctggcccaggatacaggactaactattctgcaggtgaataattggttcataaatgccaggaggagaatcgtgcagcccatgatagaccagagtaatcgtgctgtgtcgcagggcaccccttacaaccctgatggccaaccaatgggcgggttcgtcatggatggtcagcagcatatggggatcagagcaccaggacctatgtcaggtatgggcatgaacatggggatggagggccagtggcattatatgtag

SEQ ID NO: 194587 - DNA, 1392 bp, Artificial Sequence
  Description of Artificial Sequence: Synthetic coding sequence
atgcagtacgacgacctgccccactacggcggcatggacggcgtgggcatccctagtaccatgtacggggatccacacgccgctagatctatgcagcctgtgcatcacttaaaccacggtccccccctgcacagtcatcagtatcctcacactgcccacaccaatgccatggcgccgagtatgggaagttcagtcaacgatgcacttaagcgggataaggatgcgatctatgggcatcccctgtttcccctgttggcgctaatcttcgagaagtgcgaactcgccacatgtactccccgggagcctggggtggctggtggtgacgtatgctcctcagaatcattcaatgaggatattgccgtgtttgctaagcagattcgcgctgaaaaacctctgttctcttctaatcccgaacttgataatcttatgattcaggcaatccaggtactgagatttcatctcctggagctggaaaaagtgcacgagctgtgcgacaatttttgtcatcgttatatctcatgtcttaaggggaagatgcccatagacctggttatcgacgacagggaaggcggctcaaagagcgacagcgaggatattaccagatccgccaatctgaccgaccagccctcctggaatagggatcacgacgataccgcttcaactcgatcagggggaactcccggccctagctctggcggccatacatctcactcgggggataacagctctgaacaaggagacggtctggacaactcagtcgccagtccgagcacaggagatgatgatgatccagacaaggacaaaaagagacacaaaaagcgggggatattccctaaagtggccacaaatattatgagagcttggctttttcagcacctgactcacccctatccctcagaagagcagaaaaagcaactggctcaggacacagggttaaccattctacaggtcaataattggttcatcaatgcacggcggcgcatcgtacagcccatgatcgaccagtctaatagggcagtgagccagggaactccatacaaccctgacggccaaccaatgggcggctttgtgatggatgggcagcaacacatgggcatccgagcgcccggcctccaatccatgcccggcgagtatgtagcccgcggggggcccatgggagttagcatgggccagccctcttacacacaacctcaaatgcctccccacccggcccagcttcgacacggaccacccatgcacacttatatccctggacaccctcatcacccgacagtgatgatgcatggcggacccccacacccgggcatgcctatgtccgcgagctccccaactgttctgaacactggcgatcctacaatgagcggacaggtgatggatatccacgcccagtag

SEQ ID NO: 194588 - DNA, 762 bp, Artificial Sequence
  Description of Artificial Sequence: Synthetic coding sequence
atgatccaggccatccaggtgctgcggttccacctgctggagctggaaaaggtgcacgagctgtgcgacaacttttgtcacagatacatatcgtgccttaaaggaaaaatgcccatcgatttagtcatcgacgacagggaaggggggagtaagtccgattctgaggacattaccaggtcggcaaacctgaccgatcagccaagctggaatcgcgatcatgacgacacggcctcaacccgttctggcggcaccccaggaccctccagcggcggacacacaagccactcaggagataactcaagcgagcagggggacggactcgataatagcgtggcctccccgagcactggcgatgatgatgatcccgataaggacaagaagaggcataagaagagaggcatcttcccgaaggtggcaacaaatatcatgcgcgcctggttgttccaacacctgactcacccctatccttctgaggaacagaaaaagcagctggcccaagatactggtctaacaatactgcaggtgaataactggttcataaatgccagaagacgcattgtgcagccgatgattgatcagtcaaatcgggctgtctcacaggggacaccctataatcccgatggccagccgatgggggggtttgtgatggatggccagcagcacatgggcatcagagctccaggccccatgtctggaatgggcatgaatatgggccctccttgcatccggacattcctcgacacgctgactacccagcagtag

SEQ ID NO: 194589 - DNA, 1398 bp, Artificial Sequence
  Description of Artificial Sequence: Synthetic coding sequence
atggcccagcggtacgacgacctgccccactacggcggcatggacggcgtggggattccatctacaatgtacggcgaccctcatgcagccaggtctatgcagccagttcaccatcttaatcacggcccaccactgcattctcaccaataccctcataccgcccataccaatgccatggctccaagcatgggctccagcgttaacgatgccctgaaacgggacaaggacgctatctatggccaccccctgttccctctgctcgcactgattttcgagaaatgcgaattggctacttgcacacctagggagccaggggtcgctgggggtgacgtctgttcttctgagagctttaatgaagacatcgccgtgtttgcgaaacagatccgagctgaaaaacctttgttttcctccaatccggaacttgataatcttatgatccaggctatacaggtcctgcgttttcacctattggaactcgagaaggtacatgagctttgtgataatttttgccacaggtacattagttgcctgaagggaaaaatgcccattgatctggtgatcgacgacagagaaggtggttccaaatcggatagtgaggatatcacccggtccgccaacctaaccgatcagcctagctggaatagagatcacgacgacaccgcctcaacaagatcaggaggcacacctgggccttcttcagggggccacaccagccacagcggcgataatagctccgagcaaggagatggattggacaattccgtggccagcccttcgaccggcgacgatgatgatcccgacaaagataaaaagcgccacaaaaagcgtgggatttttcctaaagtggccactaacatcatgcgcgcttggctgtttcaacacctgacacatccttatccatccgaagaacagaaaaagcaactagcccaggacaccggcttaaccattctgcaggtgaataattggttcattaacgcccgcagaagaattgtgcagccaatgattgaccaaagcaatcgagcggtcagccaggggacaccatataatccggatggccaacccatgggcggattcgtgatggacggacagcaacacatgggaattcgggcccccggacttcagtccatgcccggggaatatgtggcccgcgggggcccaatgggcgtatctatgggacagccgtcttacacccaaccacaaatgcctccacatcccgcacaactaagacatggccctcccatgcatacctacatccccggccatcctcaccaccctaccgtgatgatgcacggcgggcctccacaccctggaatgccaatgtctgcatccagccccacggttctcaatactggcgaccccacgatgtcaggacaggtgatggacatacacgctcagtag

SEQ ID NO: 194590 - DNA, 423 bp, Artificial Sequence
  Description of Artificial Sequence: Synthetic coding sequence
atgaagaagaacggcgacgagaagagccccctgggcaccgagatcatgatgacaagacatctgttggtgcaggaggagccccaagctttgcctgctgtggccactaggcacacggttgggaccactgccgtttcaaaacacccttatccttccgaggaacaaaagaagcaactggctcaggacactggactaacgatactgcaagtcaacaactggtttattaacgcaaggaggagaattgtgcagcctatgatagatcagtctaacagggctgttagccaaggtacgccttataatccggacggacagccaatggggggcttcgtgatggatgggcagcagcacatgggaattagagcgcccggaccaatgagtggtatgggcatgaacatgggtatggagggccagtggcattacatgtag

SEQ ID NO: 194591 - DNA, 663 bp, Artificial Sequence
  Description of Artificial Sequence: Synthetic coding sequence
atgcagcccgtgcaccacctgaaccacggcccccccctgcacagccaccagtacccacatacggctcacacaaatgccatggcccctagcatgggtagttcagttaatgatgcactcaagcgcgacaaagacgctatctatggacatcctctgttccccctgttggcattgatcttcgaaaaatgcgagctggcgacatgtaccccgcgtgagccaggagtggcgggcggcgacgtttgtagtagtgagtcctttaacgaggatatcgccgtttttgcaaaacagataagagcggagaagcccttgttttcttccaaccccgagctcgataatctgatgatccaggccatccaggtgttgaggttccacctcctggaactggagaaggtacatgaattatgcgataatttttgtcataggtatatttcttgtcttaaggggaaaatgcccattgatctggtgatcgatgatagagagggcggaagtaaaagcgattccgaggacatcacacgcagcgccaacttgaccgatcaaccttcttggaaccgcgatcatgatgatacagcttccacccggtctggcggaacacctggcccttctagcggagggcacaccagccattccggagataattctagtgagcaggcacctctaccgttctag

SEQ ID NO: 194592 - DNA, 540 bp, Artificial Sequence
  Description of Artificial Sequence: Synthetic coding sequence
atgaagagcctgctgaccttctacaagtgcggcagcgagctgctgccagctgcagtgtggtccgcaggggggagtccctccctgttcagtgacctgaagagtaagaagggcaagaaattcagccgggatcacatagaggttacaatttccaactgtggcgtaaacggaaacgcgaaaggagacggcctggacaacagcgtagcgtcgccatcgacaggcgacgatgacgatcccgataaagacaaaaagcgtcacaaaaagaggggcatattcccaaaggttgccaccaatatcatgagggcatggctcttccagcacctgacacacccctaccccagtgaagagcagaagaaacagctagctcaggatacgggactgaccatcctgcaggttaacaactggttcatcaatgcccgccgtcggattgtccagccaatgatcgatcagagcaatcgcgcagtgtcccaggggacaccatataaccccgacggacaacccatgggcggattcgtcatggacggccagcagcatatgggctag

SEQ ID NO: 194593 - DNA, 978 bp, Artificial Sequence
  Description of Artificial Sequence: Synthetic coding sequence
atggcccagggcctgcggctgcagggcagccggcggaagggccggcaccctctgtttccgctcctcgctctgattttcgaaaaatgcgagctagcaacctgtaccccaagggagccgggtgtggcagggggagacgtgtgctcctccgaatccttcaacgaggacattgcagtatttgccaaacagatcagagctgaaaaaccactgttttccagcaaccccgagctcgacaatcttatgatacaggctattcaggtcttgcggtttcatctgctagaactagagaaggttcatgaattatgtgacaacttttgccatcggtacatctcttgcctgaaagggaaaatgcccatagatctcgtgatcgacgatagagagggaggttccaagagcgattcagaggatattaccagatctgctaatctgactgatcagcccagctggaatcgggaccacgacgacacagcatccactcgctcgggaggcacaccaggcccatcgagcggcggacatacaagtcactcaggagacaacagtagcgagcagggagatggccttgacaactcagttgcaagcccttccacaggtgatgacgacgatccagataaagacaaaaagaggcacaagaaaagaggcatcttcccaaaagtggcaaccaacatcatgcgcgcctggttgttccagcatttgacccacccgtacccctccgaggagcagaaaaaacaattagctcaggataccggcctgaccatcttgcaggtgaataactggtttatcaacgcccgacgacgtattgttcagcccatgatcgaccagtctaaccgggcagtttcgcaggggaccccatacaacccggatggccagcccatgggtggatttgttatggacggccagcagcacatgggcataagagcgcctgggcccatgagtgggatggggatgaatatgggaatggagggtcaatggcactacatgtag

SEQ ID NO: 194594 - DNA, 1113 bp, Artificial Sequence
  Description of Artificial Sequence: Synthetic coding sequence
atggcccagcggtacgacgacctgccccactacggcggcatggacggtgtgggcatccctagcacaatgtacggggatccacatgctgctcgctccatgcagcctgtacaccacctgaaccacggcccccccttgcactcacatcagtacccccacacggcccacactaacgccatggctccgagtatgggctcgtcagtgaatgatgcccttaagcgcgataaagatgccatctacggtcacccacttttcccattactggcgctgatttttgagaaatgcgagttggccacctgcaccccacgggaacccggcgtggctgggggtgacgtttgctcatccgagtcctttaatgaagacattgcagtgtttgccaaacagatcagggccgaaaagcctctcttctcaagcaaccccgagttagataacctgatgattcaggccattcaggttttaagatttcacctgctggaactggagaaagtacacgaactgtgcgacaatttctgccacagatatatttcatgtctgaaaggcaagatgcccatcgatcttgtgatcgatgatcgtgagggaggaagcaagagcgattcagaagatataacaaggagcgctaatctcaccgaccaaccatcatggaatagagaccacgacgatactgcttctacccgatctggcggcactcccgggccgtcctctggcggtcacacatcccatagcggcgacaatagtagtgaacagggcgacggcctggacaactcggtcgcctcaccttcaacaggggatgatgacgatcccgacaaggacaagaagaggcacaagaagagaggcatctttcccaaagtcgctacaaatatcatgcgtgcctggctatttcagcaccttacacatccctacccatcagaagaacagaagaagcagctggcacaggacactggacttactatattacaggtgaataattggtttatcaacgcaagacggcgcatagtgcagcccatgatcgaccagtctaatcgggccggtaaaagccctattgtaactgtgttcaaatccaggaagcggaagcctagttcatcccattcacctggcgggcccctgcctggaaagtag

SEQ ID NO: 194595 - DNA, 2259 bp, Artificial Sequence
  Description of Artificial Sequence: Synthetic coding sequence
accaccgccatggcccaccggaagctggagagcgtgggcagcggcatgctcgaccatagagtccgcccgggccctgtgccgcattctcaagaaccagaaagcgaggatatggaactccccttagaaggctacgttcccgaggggctggagctggccgcactccggccagagtcgccggccccggaggaacaggagtgccacaaccacagtccggacggtgactcttcgtccgactatgtgaataacaccagcgaggaggaggattatgatgagggacttcctgaagaggaggagggcatcacatactacataagatactgtccagaggacgacagctatctagagggaatggattgtaatggtgaggagtatctcgctcattcagcccatcctgtcgatactgacgaatgccaagaggcagtcgaggaatggaccgatagcgctgggccgcaccctcacggccacgaggccgagggctcccaggattacccagatggccagctcccgataccggaggatgaaccctccgtgctcgaggcgcatgaccaggaggaggacggtcactattgtgctagcaaggagggataccaggactactatcccgaggaagccaatggtaacaccggcgcttccccttatcgcctgcgccgaggtgacggcgatctagaagatcaggaggaggacatagatcaaatagtcgctgagattaaaatgagtctttccatgaccagcatcacatctgcaagcgaagcttctcctgaacatggaccagaaccaggcccagaagatagcgtggaagcttgtcctcctattaaggcatcctgctctccttcaagacatgaggcacgaccaaagtcactcaacttgctgcccgaggcaaaacaccccggcgacccacagagaggctttaaacctaagacacggaccccagaagagcgattgaagtggcctcacgagcaagtctgcaatggcctggaacagccccgaaagcagcagagatcagacttaaatggccccgtggataataataatatccctgagacaaaaaaagtcgcgtccttcccaagttttgtagcagtgccaggaccctgtgagccggaagatctgattgacggtatcatttttgctgccaactacctcggatccactcagcttctcagcgagaggaaccctagcaagaacataaggatgatgcaggcacaggaggccgtgtcacgagtaaagagaatgcagaaagcggccaagatcaaaaaaaaagctaattcagaaggagacgcacagaccctcaccgaagtcgatctgttcatcagcacacagagaatcaaagtgctaaatgctgacacgcaggaaacgatgatggaccatgccctgaggacaatttcctacatagctgatattggcaatattgtcgtgctgatggctagacggagaatgcctcgaagcgcctcacaagattgcatcgaaaccactccgggagcccaggagggcaagaaacagtacaaaatgatctgtcatgtgtttgagagcgaggacgcccagcttattgctcagagcattgggcaggcatttagtgtggcgtaccaagagtttctcagggcgaacggtatcaaccctgaggatctgagtcaaaaagagtattctgacattattaatactcaagaaatgtataatgacgacctcatacatttctcaaactcggagaactgcaaagaactgcagctggaaaagcacaagggcgagatcctgggcgtcgtggtcgtcgagtcaggatggggcagcatactgcctaccgtcatcctggccaatatgatgaacggagggcccgcagcccggtctggaaaactcagcatcggtgatcagattatgagtatcaacggcacctctttggtgggtttgccgctagctacatgccagggaattatcaaggggctgaaaaaccagacccaggtcaagctgaacatcgtttcttgtccgcccgtcactactgtgcttatcaaaagaccagacctcaagtaccagctggggttctccgtgcagaacgggattatctgtagccttatgcggggaggaatcgcagaacgggggggagttcgtgtgggacaccggattattgaaatcaacggacaatcagtagtggcaactgctcacgagaagatcgtccaggcactatctaattcggtgggcgaaattcatatgaagactatgcccgccgcaatgttcaggctattgaccgggcaggaaacacccttgtacatttag

SEQ ID NO: 194596 - DNA, 1413 bp, Artificial Sequence
  Description of Artificial Sequence: Synthetic coding sequence
atggcccagcggtacgacgagctgccccactacggcggcatggacggcgtcggcgtgccagcgagcatgtatggggacccccacgccccccgcccgattccgcctgtccatcatctgaaccacggtcccccacttcacgccactcagcactacggcgcccacgcccctcatcctaatgtgatgcccgcctccatgggctcagcagttaatgatgcccttaagagggacaaggatgccatttatggccacccattgttccctctcctggccctggtttttgaaaagtgcgaacttgctacgtgtaccccaagggagccaggggtcgccggcggcgacgtgtgcagcagtgacagttttaacgaagacatcgccgtgtttgcaaaacaggtaagggctgagaagccactcttctcttccaaccccgaacttgacaatctcatgattcaagccatccaagtactcagattccatttactggaactcgaaaaggtccacgaactgtgcgacaatttctgccatagatatataagctgtctcaaaggtaagatgccgattgacctggtgattgatgaacgcgatgggtcttcaaagagtgatcacgaagagctgagtgggtcaagcacgaacctcgccgaccacaatccttcaagctggcgtgaccacgatgacgctacctccacccactcagcgggtaccccgggtccatcctctggaggccatgccagccagagtggggataattcctccgaacagggtgatggcctggataactcagtcgcatcaccggggacaggcgacgacgacgaccccgataaggacaagaagaggcaaaagaaacgggggatctttcctaaagtcgccactaatattatgcgcgcatggctctttcagcatctgacccacccttacccgtcagaggagcagaaaaagcagctggcccaagacaccggtctgaccattctgcaggtaaataattggttcatcaatgcccggaggcggatcgtgcagcctatgatcgatcaatccaaccgagccgtgtcacagggggccgcatattcccccgaggggcagcctatgggctcattcgtgctcgatgggcaacagcatatgggtatacggccagctggccttcaatctatgcctggggactatgtgtcacagggcggtcctatgggtatgtccatggcccagcctagctacaccccacctcaaatgaccccgcatccaacccagctgaggcacggccctcctatgcattcctacctgccttcacacccacaccatccggccatgatgatgcatggcggaccacccactcatcccggcatgacaatgagcgcccagtccccaactatgctgaactcggtcgacccgaacgtgggaggccaggtgatggacatccatgctcagtag

SEQ ID NO: 194597 - DNA, 1146 bp, Artificial Sequence
  Description of Artificial Sequence: Synthetic coding sequence
atggacggcgtgggcgtgcccgccagcatgtacggcgacccccacgcccctcgacccatcccacctgtgcaccacctcaatcatggacctccactgcatgccacccaacactatggagctcacgccccccacccaaatgtcatgccggcatcaatggggtccgcagtcaatgatgctctcaaaagggacaaggatgctatctatggccaccccctgtttcccctcttagccttggtgtttgaaaagtgcgagttagccacgtgcacaccccgggaacctggcgttgccggaggagatgtatgcagttccgacagttttaacgaggacatagcggtgttcgccaaacaggtacgcgctgagaaaccactcttctcctcgaaccccgagcttgataatctcatgatccaagcgatccaagttcttaggtttcatctgctggagttagaaaaggtccacgaactctgcgataacttctgccatcgttacatcagctgcctcaagggtaaaatgccgattgaccttgttatcgacgagcgagacggcagcagcaagtctgatcatgaagaactgtccggatcctcaaccaacctggccgaccacaatccttcctcctggcgagatcatgatgacgcaaccagtacacactcagcaggaactcccggaccctcatcaggaggccacgccagccaaagcggagataacagtagtgagcagggagatggcctggataatagtgtggcctcccctggtacaggtgatgacgacgaccctgacaaggacaaaaagcgccaaaagaaacggggtatctttccaaaggtggcaacgaacatcatgcgggcctggttattccaacatctgacacatccatatccctctgaagagcagaagaaacaactcgcgcaggacaccggtctgaccattctccaggttaacaattggttcatcaatgccaggagaaggatcgtgcaacctatgatcgaccagtccaatcgcgccgtttcacagggagcggcttattccccagaaggccagcctatggggtccttcgtgttggatgggcaacagcacatgggtatccgcccagccggccccatgtccggaatgggtatgaatatgggtatggacggacagtggcactacatgtag

SEQ ID NO: 194598 - DNA, 1413 bp, Artificial Sequence
  Description of Artificial Sequence: Synthetic coding sequence
atggcccagcggtacgacgagctgccccactacggcggcatggacggcgtaggagtccctgccagcatgtacggagatccacatgcccccaggcccatccctcccgtccaccatttaaaccatgggcctccgctccacgcgacacagcattacggcgcccacgctccccatcctaacgtgatgcctgcatcgatgggcagcgctgttaatgatgcacttaaacgggacaaagacgctatctatggtcaccccctctttccattactggccctcgtgttcgagaaatgtgagcttgccacatgcacccctcgtgaaccgggcgtcgccggaggcgacgtctgctcctccgacagcttcaatgaggatatcgctgtgtttgctaagcaggtccgcgccgaaaagccactgttctcctcaaatccggaacttgacaacttgatgatacaggctattcaggtgctccggtttcatctacttgaattggaaaaagttcatgagttgtgtgacaatttctgccatagatatatttcgtgtttaaaaggtaaaatgcccatagacttggttatcgacgagcgcgatggatccagtaagagcgatcacgaggagctgagcggatcttcaaccaatctggccgatcacaatcctagtagttggagggaccacgatgacgctactagcacacactcagctggaactccgggtccatcctcaggaggtcatgcgtcacaatccggagataatagttccgaacaaggagatgggctggataactctgtggccagccccgggactggcgacgatgacgatccagataaagataagaagcgtcagaaaaagcggggcatcttccccaaagtggctaccaacatcatgcgcgcctggctgttccagcacttaactcatccctaccccagcgaagagcagaagaagcagctggctcaggacaccggtctcactatcctccaggttaataattggtttattaacgcacgccgccgtatcgtacagccgatgatcgatcagtcaaatagagcagtgagccagggagcagcttactccccagagggtcaacccatgggttcattcgtcctcgatggacagcaacatatgggaatcagaccagccggactgcagagcatgcctggggattatgtaagccagggcggacccatgggcatgagcatggcccagccatcatacacgcccccccagatgacaccccatccaacccagctaaggcacggtccccctatgcactcatatttacctagtcacccgcatcatcctgccatgatgatgcacggcgggccccctactcatcctgggatgaccatgtcagcacagtcgccaaccatgctgaatagcgtcgatcccaatgtcggcggccaagtcatggatatccacgctcagtag

SEQ ID NO: 194599 - DNA, 921 bp, Artificial Sequence
  Description of Artificial Sequence: Synthetic coding sequence
atggccctggtgttcgagaagtgcgagctggccacctgcacccccagggagccaggggtcgccggcggagacgtgtgcagctcggactcattcaatgaagacatcgcagtttttgcaaagcaggtgagggcggaaaaaccgctttttagttccaaccccgagctggataatctcatgattcaggccatccaagtgctcaggttccacttactggaactagaaaaagtgcatgaattatgcgataacttctgtcaccgatacatcagctgcctgaaagggaaaatgcctatcgacctggtgattgatgagagagacggttcgtcaaagagcgaccatgaagagttgtcaggctccagcaccaaccttgctgatcataatccgtcctcctggcgggatcatgacgacgctactagtacccacagcgcaggtacgcccgggccatcttcaggcggacacgcatctcaatccggggataactccagcgaacagggtgatggcctggacaactccgtggcttcacccggaacaggcgacgatgatgatcccgataaagataagaagaggcagaagaagcggggcatcttccctaaagttgcgactaatatcatgcgcgcctggttgttccagcatttaacacacccctatccttccgaagagcaaaagaaacagttggctcaggacaccggtctgaccattctccaggtcaacaattggtttatcaatgcgcgtaggcgaatcgtccagcctatgatcgaccagagtaatagagccgttagccaaggcgctgcttattcgccagaagggcagcctatgggatctttcgtgttggacggacagcaacatatgggtattaggcccgcaggccctatgtccggcatgggtatgaatatgggcatggacgggcaatggcactatatgtag

SEQ ID NO: 194600 - DNA, 921 bp, Artificial Sequence
  Description of Artificial Sequence: Synthetic coding sequence
atggccctggtgttcgagaagtgcgagctggccacctgcaccccccgggaaccaggcgtggccggaggcgacgtctgttctagtgactcttttaatgaggatattgcagtttttgccaaacaggttcgtgctgagaagcctcttttcagttctaaccctgaattagataatttgatgatccaggctatacaggtgctgagattccacttgttagaacttgagaaagtgcatgaactctgtgacaacttctgccatcggtacatctcgtgcctgaaaggtaaaatgccaatagatctggttatagacgaaagagatgggtctagcaaatctgatcacgaggaattaagcggaagttctacaaatctcgcggaccacaatcccagctcttggcgcgatcacgatgacgccacaagcacccattccgctggcacccccggccctagctccggagggcacgcctcccaatccggagacaatagctccgagcagggcgacggcctagacaatagcgtcgcctccccgggaacaggcgatgacgatgaccccgataaagataagaagcgacagaaaaagcgtgggatttttcctaaagtcgctacaaatatcatgcgggcatggctgtttcagcacctgactcatccctatccctccgaagaacagaagaagcagctagctcaagacactggtctgaccatacttcaggtgaataactggttcatcaacgctagaagacggattgtgcagccaatgattgaccagagcaaccgagccgtatcccagggggccgcctacagcccagaaggacagcccatgggtagttttgttctcgacggccagcagcatatggggattcgtcccgccggccctatgtccgggatgggcatgaatatgggaatggacggtcaatggcactatatgtag

SEQ ID NO: 194601 - DNA, 1206 bp, Artificial Sequence
  Description of Artificial Sequence: Synthetic coding sequence
atggcccagcggtacgacgagctgccccactacggcggcatggacggagttggcgtacctgcctcaatgtatggcgatccccatgcaccccggccaattcctcctgtacaccacctgaatcatggccccccactccatgcgactcagcactatggtgctcacgcaccacatcccaacgttatgccagcctctatgggatcagctgtgaacgacgcccttaaaagagataaggatgctatctatggccaccctctcttcccactgctggctctcgtgttcgagaagtgtgaattggctacatgcaccccccgagaacctggagtagcaggaggagatgtctgctcttctgactcatttaatgaagacatcgcggtattcgctaaacaagttcgggcagagaagccattgttctcttcaaaccccgagcttgacaatctgatgatacaggccatccaggtgctgagatttcatctgctggaattagaaaaagtgcatgagctttgcgacaatttctgtcaccgctacatatcatgtctgaagggcaagatgccaattgatctcgtcatcgacgagcgggatggcagttccaaatctgaccacgaggagctctctggctcgtcgacaaatctggccgatcataatccctcttcatggagagatcacgacgatgccacatcaacccactccgctggtactcctgggccttctagcggcgggcacgcttcgcagtccggtgataactcatctgaacagggtgacggtttagacaattcggtggcgagccctggtacaggtgatgatgatgatcccgacaaggacaagaagcggcagaaaaaacgaggcatttttcccaaggtcgcaacaaacatcatgcgggcctggctgtttcaacacttgacgcatccttaccccagtgaggagcagaagaaacagctggcccaggacactgggctgactatactgcaagtgaacaactggtttatcaatgcaagacgtcgtatcgttcagcccatgattgaccagtctaatagggccgggtttttgctggacccaagcgtgtcccagggcgctgcttatagcccagaaggccagccaatgggaagcttcgtgctggatggacagcagcacatggggatccgacccgcagggccgatgtccggtatgggtatgaacatgggaatggacggacagtggcactacatgtag

SEQ ID NO: 194602 - DNA, 1185 bp, Artificial Sequence
  Description of Artificial Sequence: Synthetic coding sequence
atggcccagcggtacgacgagctgccccactacggcggcatggacggagttggggtcccagctagtatgtatggcgatccgcacgcgcctagacctattccccccgtccatcaccttaaccacgggcctccactgcatgcgacccaacactatggcgcccacgccccccatccaaatgtgatgccagctagtatgggaagcgccgtgaacgacgcccttaaaagggacaaagacgcaatctatggccaccccctgtttccgctactggcgctagtgtttgagaaatgtgaattagccacctgtactcccagagagcctggtgtggccggaggcgacgtgtgttccagcgattcctttaacgaggacatcgcagttttcgccaaacaggtgcgagccgagaagccccttttcagttccaaccccgagttagataatctcatgatacaggcaatccaggtactccgttttcacctcctggagttggaaaaggtgcacgaactttgtgacaatttctgtcacaggtacatatcctgtctgaagggtaaaatgcccatagatctggttattgatgagcgtgacggctcatccaaaagtgatcatgaggagctgagtggctcgtccactaacttggctgatcacaatccaagctcttggcgagatcatgacgacgctacatcaacccattctgccggcaccccgggcccgtcaagtggaggccacgcttcccagtctggcgacaattcctcagaacagggtgatggcctagacaatagcgtcgctagtcccgggaccggcgacgacgatgatccggacaaggataagaagagacagaaaaaaagagggattttccccaaagtggcaactaatatcatgcgggcctggctgtttcagcacttgacccatccttacccctcggaggaacaaaaaaagcagctggcccaagacaccgggctcactatactgcaagttaataattggttcatcaatgcacgacgccgcattgtgcagccaatgatcgaccagagcaatcgtgccgtgtcacagggcgctgcctatagccctgaggggcagccaatggggtcattcgttttggatggacagcaacacatggggataaggcctgcaggtcctatgagcggtatgggaatgaatatgggaatggacggccagtggcattacatgtag

SEQ ID NO: 194603 - DNA, 717 bp, Artificial Sequence
  Description of Artificial Sequence: Synthetic coding sequence
atggacggcgtgggcgtgcccgccagcatgtacggcgacccccacgccccgaggccaatacccccagttcatcatctaaaccatggtccaccactgcatgcaactcaacattacggagcacatgcccctcatcctaatgtgatgcctgcctccatgggatccgccgtcaacgatgctctcaaacgtgataaagatgcaatatacggccacccactgtttcctttgctcgccctggtcttcgagaagtgcgaactcgctacttgtaccccacgcgaaccaggggtggcagggggagatgtgtgctcttctgattcctttaatgaagatattgcagtgtttgctaaacaggtgagagcagagaaacccctgttttccagcaaccctgaacttgataatctgatgatccaggccatccaggtcctgaggttccacctacttgaactagagaaggtgcacgaactctgcgataacttttgccatagatacatttcttgcttgaaaggcaagatgcccatagacctagtgatagacgagcgagacggatcctccaaatcagatcatgaggagctgtccggtagctctactaaccttgccgaccacaacccaagcagttggcgggaccacgacgacgcaacgagcacacactctgccggtacccccggaccttccagcggcggccatgctagccagtctggggacaatagcagcgaacagtag

SEQ ID NO: 194604 - DNA, 240 bp, Artificial Sequence
  Description of Artificial Sequence: Synthetic coding sequence
atggccctggtgttcgagaagtgcgagctggccacctgcacccccagagagcccggcgtcgcaggtggcgacgtctgtagttctgatagttttaatgaagacatcgctgtgtttgccaagcaggttagagctgaaaagcctctattcagctccaaccctgagctggacaacttaatgatccaggcgatccaggttctgcgcttccatctcctagaactggaaaaggtgtcacggaagtag

SEQ ID NO: 194605 - DNA, 1167 bp, Artificial Sequence
  Description of Artificial Sequence: Synthetic coding sequence
atggacggcgtgggcgtgcccgccagcatgtacggcgacccccacgcaccccgccctatcccccccgttcaccatctgaaccacggacctccccttcatgctactcagcactatggcgcacacgccccccaccccaacgtgatgcctgcgtcgatggggagcgccgtgaatgacgcgctgaaacgcgataaggacgcaatttatggacatccgctgttccctctgttagcactggtgttcgagaagtgcgagctggctacctgtactccccgcgagcctggagtggctgggggcgatgtgtgtagctccgattcatttaatgaggacattgccgtcttcgccaaacaggtgcgtgctgaaaaacccttgttctcttctaacccagaactggacaatctgatgatacaggcaattcaggtactgcggtttcacctgttagagttggagaaggtacacgagctttgtgacaatttctgtcataggtatattagttgtctcaaagggaagatgcctattgaccttgttattgacgagcgggatggcagttccaaatcggaccatgaagaactctccggaagctctacgaatttggccgatcacaatccgagcagttggagagaccacgacgacgctacttcgacccactcagcaggcacacccggaccttcctccggcgggcatgcatcgcagtctggcgacaacagctcagagcagggcgacgggctggacaactcggtcgccagccctggtactggtgatgatgatgaccccgacaaagataagaagaggcagaaaaaaaggggaatcttcccaaaggtggctacaaatattatgagggcctggctgttccagcacctcactcatccctacccttccgaggaacaaaaaaagcaactggctcaggatacaggactcaccatcctgcaggtgaataattggtttattaatgcccggcgaaggatagtgcaaccgatgatagatcagtccaaccgggccgggttcctgctggacccttctgtctcccagggcgccgcatacagcccagagggacaacctatgggatcctttgtgctggacggccaacagcatatgggaattaggccagccggccccatgagcgggatgggcatgaacatgggtatggatggccagtggcattacatgtag

SEQ ID NO: 194606 - DNA, 1185 bp, Artificial Sequence
  Description of Artificial Sequence: Synthetic coding sequence
atggcccagcggtacgacgagctgccccactacggcggcatggacggggtgggcgtacctgcatccatgtatggggacccacacgcaccgcgtccgattcctccagtgcaccatctaaaccacggacccccattgcacgcaacacagcactacggcgcccacgcaccacaccccaacgtcatgcccgcctctatgggatcagcagtaaacgatgctctcaaaagagacaaggacgcaatttatggccatcctctgttcccccttctcgctctggtgttcgagaaatgcgaactggctacatgcacgccgcgtgaaccaggagtcgcaggcggtgacgtgtgcagttcagactccttcaacgaggacatcgcagtgttcgctaaacaggtgcgggccgagaaacccctcttcagcagtaatccagagctggacaatttaatgattcaggcgatccaggtcctccggttccacctgttagagctggaaaaagtgcacgagctttgtgacaacttctgccatcggtacatctcttgtctgaaaggaaagatgccaatagatctggtcattgacgaacgcgacggatcatctaagagcgatcacgaagagttgagcggatcctcaactaacttggctgaccataaccctagctcctggcgggaccatgatgacgcaacctcaacacatagtgctggcactccagggccttctagtgggggacacgcttctcagtcgggagacaattctagcgaacagggagatggtctggacaactcagtcgcctcacctgggaccggagacgatgatgacccagacaaggataagaaaaggcagaagaaacgggggatattccccaaagtcgctactaacataatgcgagcctggctgttccaacacctgacacacccatacccttctgaagagcagaaaaagcagctggctcaggatacagggctgactatattgcaggtgaataactggttcattaatgcgagaagaaggatcgttcaaccaatgatcgatcagtccaaccgagctgttagccagggagctgcttatagtcccgaagggcagcctatggggagctttgtcttggatggtcagcagcatatgggaatccgccccgctggcccaatgagcggtatgggcatgaacatggggatggatggtcagtggcattacatgtag

SEQ ID NO: 194607 - DNA, 1434 bp, Artificial Sequence
  Description of Artificial Sequence: Synthetic coding sequence
atggcccagcggtacgacgagctgccccactacggcggcatggacggcgtcggagtgcccgccagcatgtatggtgatcctcacgcaccaaggcctatccccccagttcaccatctgaaccacggtcccccccttcacgcaacccaacactatggcgcacatgcgcctcacccgaacgtgatgcctgccagtatgggatcggccgtgaacgacgccctgaagagggataaggacgccatctatggtcatcctttattcccacttctcgccctggtgttcgagaagtgtgaactggctacctgcacaccccgagaaccaggcgtcgcaggcggcgatgtttgttcatctgattcgtttaatgaagacattgcagtgttcgccaaacaggtgcgagccgaaaagcctttgttttcgtcaaatcctgagttggataacttgatgatccaggctattcaagtgttaagatttcacctgttagaactggaaaaggtgcacgagctgtgcgacaatttttgtcaccggtatatttcttgtctgaaagggaagatgccaatcgacctggttattgacgaacgggacggctcctccaagtcagaccatgaggagctgtctggatcatccacgaatctcgccgaccataaccctagctcatggcgtgatcacgatgatgctacatccacccacagcgctgggactccaggccctagcagcgggggccacgcaagccagagcggtgacaatagctcggaacagggggacggactggacaactctgtcgccagcccaggcaccggcgatgatgatgaccccgacaaagataagaagcgccagaaaaagcggggtatctttccaaaggtggccaccaatattatgagagcgtggctgtttcagcacctgacacatccgtacccttccgaggagcagaaaaagcaattggcccaagatacaggcctcacaatactccaagtaaacaactggtttatcaatgctagacggcgcatcgtgcagccaatgattgatcagtccaacagagctggttttcttctggacccgtccgtctctcagggagctgcttacagtccagagggtcagcccatgggctccttcgtgttggacggacagcagcacatgggaattagacccgccgggctacagagcatgcccggcgactacgtgagccagggtggtccaatgggcatgtccatggcccaaccctcatacactcccccgcaaatgacgcctcatcctacacaactcaggcatggcccacctatgcacagctatctgccctctcaccctcaccatcctgctatgatgatgcatggggggccccccactcatcccgggatgactatgtctgcccaatcacctaccatgctcaattctgtggaccctaacgtgggtggacaggttatggatatacatgctcagtag

SEQ ID NO: 194608 - DNA, 1434 bp, Artificial Sequence
  Description of Artificial Sequence: Synthetic coding sequence
atggcccagcggtacgacgagctgccccactacggcggcatggacggcgttggagtccctgccagcatgtatggggaccctcatgccccacgcccaattcccccagtgcaccacctgaaccacggcccccctcttcacgctacccagcactatggggctcatgctccacacccaaacgtcatgccggccagcatgggcagcgcagtgaatgatgctctcaagagggataaagatgcaatatatggtcaccccttatttccactgctggcgttggtatttgagaagtgcgagctggctacttgcacccccagggagcctggcgttgctggtggagatgtctgctcctccgactccttcaatgaagacattgcggtgttcgcgaagcaggtccgtgccgagaagccattgttcagtagtaatcctgagttggacaacctgatgattcaagccatacaggtcctccgatttcacctattggagctcgaaaaggtgcacgaactatgtgacaatttctgtcatcggtatatttcctgcctgaaggggaaaatgcccatcgatctcgtgattgatgaacgggacggatcatccaagagtgaccatgaggaactttctggctcaagtactaatctcgccgaccacaacccctcctcatggagagaccatgacgatgcgacaagcacacattcagctggcacccctggccccagcagcggagggcacgcatctcagtcaggcgataattcctccgagcaaggcgatggtttagataattctgtagcctccccaggaacaggtgacgatgacgacccagacaaagacaagaagcggcaaaagaaacgcggaatatttcccaaagtcgcgactaatattatgcgagcatggctatttcagcacttgacacatccgtatccgagcgaagagcagaaaaaacaacttgcacaggataccgggttaacaatcctccaagtgaacaattggttcatcaatgctcggagaagaatcgtgcaacctatgatcgaccagagtaaccgcgctgggttcctcttggatccttctgtttctcagggggcggcctattcccccgaagggcagccaatgggaagtttcgtactagacggacagcagcatatgggaatccgtcccgcgggtctgcagagcatgcctggcgattatgttagccaggggggacctatgggcatgagcatggctcagccttcttacaccccgccgcagatgactccgcaccctacacagctgaggcacggcccacccatgcactcctacctcccatcacaccctcatcacccggcaatgatgatgcatggcggtcctcctacccatcccgggatgacaatgtcagcccaatcacccacaatgctgaacagcgtcgatcctaacgtgggaggccaagttatggacatccacgctcagtag

SEQ ID NO: 194609 - DNA, 357 bp, Artificial Sequence
  Description of Artificial Sequence: Synthetic coding sequence
atgccccgggaggacgcccacttcatctacggctaccccaagaagggacacggacacagttacacaactgccgaagaagctgccggaataggtatactgaccgttattctcggggtccttctcctgattgggtgttggtattgtcgaaggagaaatggctatcgggcattgatggacaaatctcttcatgtgggaacacagtgtgcactgacgcgccggtgtccacaggagggctttgaccatcgggactctaaagtgtctctccaagaaaaaaattgcgagccagttgtaccaaatgcccccccagcgtatgaaaaattgtcagccgagcagtctccacctccctacagcccttag

SEQ ID NO: 194610 - DNA, 357 bp, Artificial Sequence
  Description of Artificial Sequence: Synthetic coding sequence
atgccccgggaggacgcccacttcatctacggctaccccaagaagggacatggacacagctatactactgctgaggaagcggccggcatcggtatactcacagtgatattgggtgtgttgctgctaatcggctgttggtactgccgaaggcgaaatgggtacagggctctgatggacaaaagcctgcatgtgggcacacagtgtgctcttacccgaagatgcccacaggagggatttgatcatagagacagcaaggttagcctacaggaaaaaaattgtgagcccgtggtacctaacgcaccacctgcttacgagaaactgtccgctgagcagtccccaccaccctactcgccttag

SEQ ID NO: 194611 - DNA, 357 bp, Artificial Sequence
  Description of Artificial Sequence: Synthetic coding sequence
atgccccgggaggacgcccacttcatctacggctaccccaagaagggacacggtcattcgtatacaacagcagaagaagccgccggcattggaatccttaccgttatcctgggcgtgttattgctgatcggatgttggtactgtcgccggagaaatgggtatcgggctctgatggacaaaagcctccatgtgggcacacagtgcgccttgacccgccggtgtccccaggagggattcgaccacagggattcaaaagtgagcctgcaggagaaaaactgcgagccagttgtacctaatgctccccccgcttatgaaaagctgtccgccgagcagtcaccgcccccttatagtccatag

SEQ ID NO: 194612 - DNA, 1269 bp, Artificial Sequence
  Description of Artificial Sequence: Synthetic coding sequence
atgagcgtgggcgccatgaagaagggcgtgggccgggccgtgggcctaggcggaggctctggttgtcaggcgacagaagaggatccactacctaactgcggagcatgcgctcccggacagggcggcaggcgatggagactgccccagcccgcttgggtcgaaggttccagtgcccgcctttgggaacaggcgacagggacaggctggatggacctcgaagcgagtttactgcctactggtcccaatgctagcaatactagtgatggacccgataatttgaccagtgctggttccccaccaagaacaggtagtatttcttacatcaatatcatcatgccgagtgtctttgggacgatttgtctactgggaatcatcggcaattcaaccgtcatttttgcagtggttaagaagtctaaactgcactggtgcaataacgtgcccgatatctttattatcaatctaagcgtcgtcgacctcctgttcctccttggcatgccctttatgatccaccagcttatgggcaatggagtctggcactttggcgaaactatgtgcactctgattaccgccatggacgcgaactcccagtttacaagcacttacatcctcacagcgatggctattgatcgctacttggccacagttcaccccatttcttctacgaagttcaggaagccatccgtggcgacgcttgtgatctgtcttctatgggccctgtctttcatttccatcactccagtatggttgtacgcccggttgatcccctttccgggtggcgccgtgggctgcggaatacgactgcctaatcccgatacagatctctattggttcaccctgtaccaatttttcttggcgttcgcattgccatttgtcgttatcacggccgcgtacgttcgaatcttgcagcgaatgaccagctctgttgctccagcctcccaacgaagcatcaggttgcggacaaagagggtgactcgcaccgccatcgccatttgtttagtctttttcgtctgttgggctccgtactacgtcctacaactaacccagctgtccattagtcggcccacattaacgtttgtctacctctataatgctgctatcagtttaggatatgccaattcttgtctgaatccctttgtttatatcgtgctttgcgaaacttttcggaagaggctggtcctttcagtcaaacctgcggctcaaggccagttgcgggccgtctcgaatgcccaaactgctgacgaagagaggacagagtctaagggaacatag

SEQ ID NO: 194613 - DNA, 891 bp, Artificial Sequence
  Description of Artificial Sequence: Synthetic coding sequence
atgagcgtgggcgccatgaagaagggcgtgggccgggccgtgggcttgggtgggggaagcgggtgtcaagctaccgaggaggacccgcttcctaactgcggggcctgtgctcctggtcaggggggaagacgctggagactgccccagcccgcatgggttgaaggcagctcagcgaggctgtgggagcaagccaccggaactggctggatggatctagaggcctcactgctgccaacaggtccaaatgcaagtaatacttccgacggccctgacaacttgacgtccgcaggttccccaccaagaacaggctctattagttatattaacattataatgccttccgtctttggcaccatttgccttctgggaatcattggaaactccacagtcatcttcgccgtggtcaaaaaatctaaattacactggtgcaataatgtgcccgacatctttatcatcaatctgagtttctttttggcttttgccctgcccttcgtggttattactgcagcctacgtgcgcatcttgcagcggatgacatcaagcgtcgcgcctgccagccagaggagcatcaggctgcgcaccaagagggtcaccagaacggccatcgctatctgcttggttttttttgtttgttgggcaccttactacgtgttgcagctcacacagttaagcataagccgaccgactctcaccttcgtctacctgtataacgcggccatctcgctcggatatgccaacagctgcctgaacccatttgtttatatcgtcctgtgtgaaacatttcggaagcgattggtgctgtccgtcaagcccgctgcacagggacaactcagggcggtgtctaatgcgcagacagcggatgaggagaggaccgagtctaaaggaacatag

SEQ ID NO: 194614 - DNA, 1023 bp, Artificial Sequence
  Description of Artificial Sequence: Synthetic coding sequence
atgaaccccttccacgccagctgctggaacaccagcgccgagctgctgaacaagagttggaacaaggaattcgcatatcagaccgcgagcgtggtggatacagttattctccctagcatgatcggaataatttgcagtacagggctggtaggcaacatactaatcgtgtttactattatccggtcacgaaagaagaccgttccagatatttacatatgcaacctggcagttgccgacctggttcatatcgtcggaatgccttttctgatccaccagtgggcccggggcggcgaatgggtgtttggcggaccattgtgcaccatcattacatccctggatacctgtaatcagttcgcttgctctgcaatcatgaccgtgatgtcggtcgatcggtatttcgccttagtccagcctttcaggctcacaagatggcgaacacggtataaaaccatcagaatcaatttggggctctgggcagcctccttcatcctggcactgcctgtgtgggtctattcaaaagtgattaagtttaaggacggcgtggaatcgtgtgcttttgatcttacttctcctgatgacgttctctggtacacgctttacctgaccattacgacattcttcttccctttacccctgatactggtgtgctacatcttgatcctatgttacacgtgggagatgtaccagcagaacaaggacgcgcgctgttgtaatccatccgtgcctaagcaacgggtcatgaagcttacaaaaatggtactggtgctggttgtggtgtttattctgagcgccgccccttatcatgtaatacaactcgtgaacctccaaatggaacagcccacactggccttttacgtcggctactacctatctatctgcttatcctacgcttcaagttctattaacccattcctgtacatcctgctcagcggaaacttccagaaaagactacctcagatccagcgtagagcaactgagaaggagatcaataatatgggaaacactcttaaaagccacttttag

SEQ ID NO: 194615 - DNA, 1023 bp, Artificial Sequence
  Description of Artificial Sequence: Synthetic coding sequence
atgaaccccttccacgccagctgctggaacaccagcgccgagctgttaaataagtcgtggaataaagagttcgcttatcagaccgcttctgtcgttgatacggttatcctgcccagtatgatcgggataatctgcagtacaggactcgtcgggaacatcctcattgtattcacaattatccgctctaggaagaagacggtgccagatatctacatttgtaatctggccgtggctgacttagtacacattgtcggcatgccttttctgatacatcagtgggctcggggcggcgaatgggtgtttgggggtccattgtgtactattataacaagcctggacacttgtaatcaattcgcatgtagcgccatcatgacagttatgagcgtagatcgttatttcgccctggtccagcccttccggttgactaggtggcgtactagatacaaaaccatccgcattaaccttggtctttgggcagcatcttttatactcgccctgccagtgtgggtgtatagcaaggtgattaagtttaaagatggggtcgagtcttgcgcctttgacttgacctcaccggacgacgtcctttggtataccctgtatttaaccatcactacctttttttttccactgcctttgattttggtttgttatattttaatcctatgctatacatgggagatgtaccagcaaaataaagatgcccgctgttgcaacccttcagttccaaaacagcgcgtaatgaaactgaccaagatggtgctcgtgttggtggtcgtgttcatacttagcgcagccccgtatcatgttatacaactggtcaatctgcaaatggagcaaccaacactggccttctatgtcggatactacctgagtatttgcttatcgtatgcgagctcttccataaacccttttctctatattctgctgtctggcaattttcaaaagaggctgcctcaaatccagaggagggcgactgagaaagagatcaataatatggggaataccctcaagagtcatttttag

SEQ ID NO: 194616 - DNA, 1023 bp, Artificial Sequence
  Description of Artificial Sequence: Synthetic coding sequence
atgaaccccttccacgccagctgctggaacaccagcgccgagctgcttaacaaaagttggaacaaggaatttgcctaccagactgctagtgttgttgatactgtgattctgccctccatgatcggcatcatatgtagcactgggctagtgggaaacattctcatagtgtttacgatcattcgttctcggaagaagactgttcctgatatttacatttgcaacctggctgttgccgatcttgtgcacatagtgggtatgccttttttaatccatcagtgggctaggggcggtgaatgggtattcggtggtccactgtgtacgatcataacatccctcgatacttgtaaccagttcgcctgtagtgccattatgacggttatgtctgtggatagatattttgcattggtccagccctttcgcttgactagatggagaacgagatataagacaattcgaatcaacctaggcttatgggcggcttccttcatcctcgctttacctgtgtgggtctacagcaaggtcattaagttcaaggatggggtggagtcctgtgcgtttgaccttacgtcaccagacgacgttctttggtatacactctacctaaccattactacttttttctttccattgcccttaatcctggtgtgctacatcctgattctctgctacacctgggagatgtaccaacagaacaaggatgccaggtgttgcaacccaagcgtccctaaacagcgtgtgatgaagctgacaaagatggtgttagtcctggtcgtggtgtttattcttagcgccgcaccctaccacgtaatacagctagtgaacctgcagatggaacagcctaccctggccttctacgtcggctactatctgagcatctgcctgagctatgccagttcctctatcaatcctttcctctatatattgctgtccggaaacttccagaagcggttgccacagatccagagaagagcaaccgagaaggagattaataatatggggaatactttgaaatctcacttttag

SEQ ID NO: 194617 - DNA, 519 bp, Artificial Sequence
  Description of Artificial Sequence: Synthetic coding sequence
atggccaacggcaccaacgccagcgccccctactacagctacgagtattatctggactatctagatcttatacccgtcgacgagaaaaaattaaaggcccataaacacagtattgtaatcgccttctgggtgtctctggctgctttcgtagtgctgctatttctaatcctgttatatatgtcctggtctgccagcccccaaatgcggaattctcctaagcatcatcagacatgtccctggtcacatgggctcaacctgcacttatgcattcaaaagtgtctgccctgtcacagggagcctttggcgacatctcaggctcaggccagtagcgtagaacctgggtcccgcacgggacccgaccagcctctcaggcaggagagctcttccaccctgcctttgggaggcttccagactcacccgaccctcctctgggaattaacactgaatggagggcctctggtccgaagcaaaccttcggagcctccgccaggcgacaggacttcacagctccagagctag

SEQ ID NO: 194618 - DNA, 309 bp, Artificial Sequence
  Description of Artificial Sequence: Synthetic coding sequence
atggccaacggcaccaacgccagcgccccctactacagctacgagtactatctggactatctggacctaattcccgtggatgaaaaaaagctaaaagctcacaaacactctatcgtcatcgccttttgggtgtcgctagccgcttttgttgtactgctctttctgatcctgttgtacatgtcttggtcagcttccccacagatgagctttaacaccgacgaatccttgctacactcagaagttcttccacaaaccagggcgatttcctgcgatgaattgcaggccccaagggaggaaggagccgcttag

SEQ ID NO: 194619 - DNA, 519 bp, Artificial Sequence
  Description of Artificial Sequence: Synthetic coding sequence
atggccaacggcaccaacgccagcgccccctactacagctacgagtactacttggactatctcgatctaatccctgtggacgagaaaaagctgaaggcacacaagcatagcattgtgattgcattctgggtctcattagccgcttttgtcgtgttactctttctcattttgctttacatgagctggtccgcgtcaccccagatgagaaatagtccaaagcaccatcaaacatgcccttggtcacatggcctgaacctgcacctgtgcatccaaaagtgcctcccctgccacagggaaccactggcaacctcacaagctcaagcctcaagcgtcgagccaggctcccggacaggacctgaccagcctctcagacaagagagtagctctactctgccactcggcggcttccagacacaccccaccctgctgtgggagctcactctcaacggcggacctttagtgcgatcaaagccctccgagccgccacctggtgaccgcacttcccagttacagtcatag

SEQ ID NO: 194620 - DNA, 309 bp, Artificial Sequence
  Description of Artificial Sequence: Synthetic coding sequence
atggccaacggcaccaacgccagcgccccctactacagctacgagtactacttggactacctggatctgatccccgtcgacgagaagaagctgaaggctcataaacatagcatcgtgatcgctttttgggtctcactggcagccttcgtggttttgctgttcctcatcctgctctacatgagctggagcgcctccccccagatgtcattcaacacagatgagtccctgcttcactctgaggtgttgccacaaaccagggctatcagttgcgacgagttgcaggctcctcgcgaagagggtgctgcatag

SEQ ID NO: 194621 - DNA, 1110 bp, Artificial Sequence
  Description of Artificial Sequence: Synthetic coding sequence
atgccccgggcccccaagcggcagcggtgcatgcccgaggaggacttgcagagccagtcagagactcagggcttagagggagctcaggcaccgctggcagtcgaagaagacgccagcagtagtacaagcacctcatctagttttcctagcagcttccccagttcttcctcctctagctcttcctcctgttatcccctgattccatctacaccggaagaggtgtccgccgatgacgaaacccccaatccgccccagagtgcccagattgcctgttctagtcccagcgtggtcgccagtctcccacttgaccaatcagacgaaggctcttcgagccagaaagaggaatctccttctaccctccaagtcttgcctgacagcgagtctctccctagatccgagattgacgagaaggtcaccgacttggtgcagttcctgctcttcaagtaccagatgaaggaaccaataaccaaagcagaaattctggaaagcgtcattagaaactacgaggaccactttccgctgctgttctcagaggcttctgagtgcatgctgctagtttttggcattgatgttaaggaagtcgatcccactgggcatagcttcgtccttgtaaccagtctggggttgacctatgacgggatgctatccgacgtgcaatccatgcccaaaactggaatcttgatcctgatcctcagcatcgtgtttattgagggctattgcacacctgaagaggtgatctgggaggctctgaatatgatggggctgtacgatggcatggagcatctgatttatggcgaaccacgaaaattgctgacccaggactgggtgcaagagaattatctcgaatacagacaggttccaggctctgaccctgcacgatacgagttcctctggggcccacgcgcccatgctgagattcgaaaaatgagcctcctgaaatttcttgccaaagttaacggcagcgatccgagaagctttcctctctggtacgaagaagccctgaaggacgaggaggagcgggcccaggatcgtatcgccactaccgacgataccacagcgatggctagtgcgtctagttccgccacaggctcctttagttacccagagtag

SEQ ID NO: 194622 - DNA, 1110 bp, Artificial Sequence
  Description of Artificial Sequence: Synthetic coding sequence
atgccccgggcccccaagcggcagcggtgcatgcccgaggaggaccttcagagtcagagtgaaactcagggcttggagggagcgcaggcccccctcgctgtcgaagaggatgccagcagtagcacctcaacgagttcctcttttccaagttcctttccgagttcatccagctcctcatcgagttcatgctacccccttataccaagtacacccgaggaagtgtctgccgacgatgagactcccaatccacctcagtcagcccagatcgcctgttcttctccatcagttgtcgcatctctgccgttggatcagtccgacgaggggtccagtagccagaaagaagaatctccctcgaccttgcaggtgctgcctgattcagaaagcctgcctcggtctgaaatagacgagaaagtgacagacctagtacaatttcttctcttcaaatatcagatgaaagaacccattactaaggcggaaattctagagtccgtgatcagaaactacgaagatcatttccctctgctgttttccgaagcctctgagtgcatgcttctggttttcggaatcgacgttaaagaagtcgaccccaccgggcattcttttgtgctggttacatctttaggtctgacatatgatggaatgcttagtgatgtgcagtctatgccaaagacaggaattctcatcctgatcctgtccatcgttttcattgagggctactgcacccctgaggaggtgatatgggaggctctgaatatgatgggcctctatgacggcatggaacatttgatctatggcgaaccacgtaagttgcttacacaggattgggtacaagagaactacctggagtaccgacaggtgcccggttccgaccctgcccggtatgaattcctttggggtccccgcgcacatgcggagatacgaaagatgagtctgctgaagtttcttgctaaggtgaatgggtctgaccccagaagctttcccctgtggtatgaagaagcacttaaagatgaggaagaacgtgcccaggatcgtatcgctacaacagacgacacaaccgctatggcaagcgccagctcatcggcgacggggagcttttcataccccgagtag

SEQ ID NO: 194623 - DNA, 486 bp, Artificial Sequence
  Description of Artificial Sequence: Synthetic coding sequence
atgccccgggcccccaagcggcagcggtgcatgcccgaggaggacctgcagtctcaatctgaaacccaggggttagaaggagctcaagcacctcttgcagtggaagaggacgcttcgtcgtccacttccacttcttccagtttcccctccagcttccctagcagctcaagctcatcttcatcaagctgctatcctctgatcccatcaacacccgaggaagtttccgccgacgatgagacgcctaatcccccccaatctgcacaaatcgcctgctcctctccatctgtggtggcctccctgccactcgatcagtcagatgaggggtcctcaagccagaaggaagagtcaccaagcactctgcaggttctacctgatagcgaaagcctgccacggtcagaaatcgacgagaaagttaccgatcttgttcagtttttactttttaagtatcagatgaaggaacccataacaaaagccgagattctgtag

SEQ ID NO: 194624 - DNA, 573 bp, Artificial Sequence
  Description of Artificial Sequence: Synthetic coding sequence
atgccccgggcccccaagcggcagcggtgcatgcccgaggaggacctgcagagccagagcgagacacaggggctggagggggcacaggcccccctggctgttgaagaagatgctagctcctccacatcaaccagcagctcgttcccatcctcgtttcctagttcctcttccagtagtagctccagttgttatcccttgattccaagtacacctgaagaagtgtccgcagacgatgaaacgcctaaccctccgcaatctgcacaaattgcctgttcctctcctagcgttgttgcgtctttgcctctcgatcagagcgatgagggctcatcgtcccagaaagaggaatctccaagcactttgcaggtgctcccagatagcgagagtctaccccgatccgagattgatgaaaaggttaccgacctggtccagttcctcctgtttaagtatcaaatgaaggaaccgattaccaaagcagagatcttggaaagtgtgattcgcaactacgaagaccattttccactcctcttttctgaagcctcagagtgtatgcttctcgtttttggtatcgactag

SEQ ID NO: 194625 - DNA, 1203 bp, Artificial Sequence
  Description of Artificial Sequence: Synthetic coding sequence
atgagcaaggtgagcaccatgttcagcgaggacgacttccagagcaccgaaagggcgccatatggccctcagctgcagtggtcgcaggacctccctcgcgtccaggtcttcagggagcaagctaatttagaggatcgtagccctcggagaacccagcggattacaggcggcgagcaggttttatgggggcccatcacccagatcttccccacggtgagaccagcagacctgacacgtgtgatcatgcctcttgagcaacgatcacaacattgcaaacccgaagagggcctccaggcccaggaggaggacttgggcttagtgggagctcaggcactgcaggcagaagagcaggaggcagcttttttcagcagtacattaaacgttggaaccctggaggaactgccagctgccgaatcaccttcccctcctcagtccccccaagaggagtccttctcccccaccgcgatggatgcaatcttcggtagtctctccgatgaaggttcaggatcccaggaaaaagaaggcccctccacttcccccgacctgatcgatcccgagtccttctctcaggacatcctccatgataagattattgatctggtgcacctcctgttacgtaagtaccgcgtgaaggggcttatcacaaaggccgaaatgctagggtcagtgatcaaaaattatgaagactacttccctgaaattttccgggaggcatccgtctgcatgcagctactttttggcatcgacgtgaaggaggtagaccctacctcccatagttacgtactggttacatctctcaatctgtcttatgacggtattcagtgcaacgagcagtccatgccgaagtccggacttctaatcatcgtgctcggcgtgatatttatggaagggaattgcatccccgaagaggtaatgtgggaggtactgtccatcatgggcgtttatgccggtcgcgaacattttttgttcggtgaacccaagcgcttgctcactcagaactgggtgcaagagaagtacctggtttaccgacaggtgcctggtacggaccctgcttgttatgagtttctgtgggggccccgcgctcacgccgagaccagcaagatgaaagtcctggaatatatcgcaaacgccaatggtcgagatcccacctcctatccttccctctacgaggatgccctgagagaggagggggagggggtgtag

SEQ ID NO: 194626 - DNA, 1290 bp, Artificial Sequence
  Description of Artificial Sequence: Synthetic coding sequence
atggagacccagttccggcggggcggcctgggctgcagccccgcctcaatcaagcggaagaagaaacgtgaggatagcggggactttggactccaggtgagcacgatgttttcagaggacgacttccagtccactgagagagccccttacggaccacagctacagtggtcccaggaccttccacgggtccaggtgtttcgggaacaggctaaccttgaagataggagcccaaggcgaacacagcgaataaccggaggagagcaagtcttgtgggggcctattacccagatcttcccaaccgtccggcctgcggacctgacacgcgtcatcatgccccttgagcagcgttcccagcactgcaagccagaggaagggttacaagcccaggaggaggacctgggcctagtcggcgcccaggccctacaagccgaagaacaggaggcagcctttttttcctcaaccctaaatgtcggcacgctcgaggaattgcccgccgccgaatcaccatcccccccacagtcaccacaggaagaaagcttctctcctacggccatggatgccatcttcgggagcctttctgatgaaggaagcggcagccaagaaaaggagggtccatcaacaagcccagatctgatcgacccagagagctttagccaggatatcctccacgataagattatcgatctcgttcacctcctgctacgtaaatacagggtgaaaggcctgattaccaaggcagaaatgctgggttccgtgattaagaactacgaggactactttcccgagatattccgggaggcctccgtctgcatgcaactgttatttgggattgatgtgaaggaggtggacccaaccagtcatagttacgtgctcgtgacatcactgaatttaagctatgacggtatccaatgcaatgagcagtcaatgcctaaatccggcctgctgattattgtgctcggcgtgatctttatggaggggaattgtatcccagaggaggtcatgtgggaagtgcttagcattatgggtgtatacgcaggtcgcgaacacttcctgttcggcgaacctaagagactgttgacacagaattgggtccaggaaaagtatttagtttatagacaggttcccggcaccgaccccgcttgttacgaatttctgtggggcccccgcgcccacgctgagacatctaagatgaaagtactggagtacatcgctaacgctaatggacgcgacccaacaagctacccctctctgtacgaagatgcactccgagaagagggagagggcgtatag

SEQ ID NO: 194627 - DNA, 945 bp, Artificial Sequence
  Description of Artificial Sequence: Synthetic coding sequence
atgcccctggagcagcggagccagcactgcaagcccgaggagggcttggaggctcagggagaggcactaggcttggtcggagctcaagcgcccgccaccgaggaacaagaaacggcctcatcctcgagtaccctcgtggaggtgacgctcagggaagtgcctgccgccgagtcaccctctccgccccatagtccgcaaggggcaagcacccttcctacaactataaactataccctgtggagtcagtcagatgagggaagcagcaacgaagagcaggaaggcccatctacctttccagatctggaaaccagctttcaggtcgccctctcaaggaagatggccgagttagttcatttcctactgctcaagtaccgcgctcgcgaacccttcaccaaggccgaaatgttggggtccgttattcgcaacttccaagacttttttcctgtcatcttttccaaggcgtctgaataccttcagctcgtcttcggtatagaggttgtcgaggttgtaaggatcggccatctgtacattctagtgacctgtctcgggctttcctacgatggactgcttggggataaccaaatagtgcccaagactgggttactgattatagtgttagccattatcgccaaagagggggactgcgcgcctgaagagaaaatttgggaggaattgagcgttttggaggctagcgacggacgagaagactccgtgttcgcccatccaaggaagctgctcacgcaggaccttgtccaggagaactacttagagtaccgtcaagtgccgggctcggacccagcctgttacgagtttctgtggggccctcgtgctctggtcgagacctcatacgtgaaagtgttgcaccacttgctcaagataagtggagggcctcatatctcctacccgccacttcacgagtgggcatttagagagggcgaagagtag

SEQ ID NO: 194628 - DNA, 945 bp, Artificial Sequence
  Description of Artificial Sequence: Synthetic coding sequence
atgcccctggagcagcggagccagcactgcaagcccgaggagggcctcgaagctcagggcgaggctctcggattagtgggagcccaagcgcccgcaaccgaggaacaagaaactgcctcctcgtcttctactctcgtggaggtgaccttaagggaggtgcccgccgctgaatccccatcccctccccacagcccacagggggcctccacactccccacgacaattaattatacattgtggagccagtccgacgaaggttctagtaatgaagagcaggagggcccaagtacctttcccgatttggaaacgagctttcaggtggccctctcgcgtaagatggcggagctagtgcattttctgttgctcaaatatcgcgcaagagaaccattcacaaaggccgagatgttaggcagcgtgattagaaactttcaggatttcttcccagtgatttttagcaaggcctctgagtatttacagctcgtattcggcattgaggtcgtcgaagtcgtccgtatcgggcacttatacatcttggtaacatgcctgggcctaagctatgacggattgctgggcgacaatcagatcgtgcccaagactggattattgattatagttctcgctataatcgctaaggagggagattgcgccccggaagaaaagatttgggaggagctatccgtgctcgaagcatcggatggtcgcgaagatagcgtgttcgcacatcctagaaagctcttgacacaggacttggtgcaggagaattatctggagtatcgacaggtgccaggttcagatcctgcatgctacgaattcctctggggtccacgggcactcgtggagacttcctacgttaaggttctccatcacctgctcaaaatcagcggtgggccgcacatctcctacccccctttgcacgagtgggcatttcgagagggggaggagtag

SEQ ID NO: 194629 - DNA, 945 bp, Artificial Sequence
  Description of Artificial Sequence: Synthetic coding sequence
atgcccctggagcagcggagccagcactgcaagcccgaggagggcttagaggcccaaggggaagccctgggtctcgttggcgctcaggctccagcaacggaagagcaggagaccgcaagtagctcctcaaccctcgtggaagtgactctaagagaagtcccagcagccgaaagccccagcccccctcactcaccacagggtgcttccactctacccacaaccattaactacactctctggtcacaatctgatgagggaagcagcaatgaggaacaggaaggccctagcacttttccggacctggaaacaagcttccaggtggcactgagcagaaaaatggcggagctggtacacttcctgctgctcaagtatcgcgcccgagagccatttactaaagctgagatgctgggtagtgtgatccggaactttcaggatttcttccctgtaatttttagcaaagctagcgagtacctgcagctggtgttcggcatcgaggtggtggaggtggtcaggattggacatctttacatcctggttacgtgcctgggtctgtcctacgacgggttgctcggcgacaatcagatagtacccaagactgggctactaattatcgtcctggcaattattgccaaggagggagactgcgctccggaagagaagatctgggaagagctgagcgtgttggaagcgtctgatggcagagaggactccgtcttcgcccaccctcgtaaactgttaactcaggacttggttcaggaaaactatctggagtaccgccaggtccccggatcggatccagcatgctacgagttcctgtggggcccccgagcgttggtcgagacctcctatgtgaaggttctgcaccacctgttgaagatcagtggcggcccccacatttcttatccaccgctgcacgagtgggcctttagggagggagaggagtag

SEQ ID NO: 194630 - DNA, 945 bp, Artificial Sequence
  Description of Artificial Sequence: Synthetic coding sequence
atgcccctggagcagcggagccagcactgcaagcccgaggagggcctggaggcccgcggagaggcactcggtctggtcggcgcacaggctcccgccactgaggagcagcagacggcctccagcagttctacccttgtggaggtgacgttgggagaggtccctgccgccgattctccctctcctccgcatagccctcagggcgcctcttccttctccacgacaatcaactatacactctggcggcagagtgacgagggttcctcaaaccaggaagaggaggggccacgtatgttccccgatttggagagcgaattccaggcagccatctctcgaaagatggtggagttggtgcattttctgctgttaaaataccgcgcacgcgaacctgtgactaaagccgagatgttagaaagtgttttacggaattgccaggatttttttccggtcatcttctcaaaagccagtgaatatctacagctcgtgttcggcatcgaagtggttgaagtcgtccccatttctcacttgtacatcctggtcacttgcttaggcttaagttatgacggactcctcggagacaatcaagtcatgcccaaaaccggactcttgattattgtgctggcgatcatcgcgatcgaaggagattgcgcccccgaggagaaaatctgggaagagcttagcatgctggaagtcttcgagggaagggaagatagcgtattcgcccacccccgaaaattactaatgcaggatctcgtacaggaaaactacttagaataccggcaggtgcctggctcagaccccgcatgctacgaatttctttgggggcccagagccctcattgaaacgtcatatgtcaaagtcctgcatcacacgttgaagattggcggggaaccgcacatatcttatcctcccctccacgagcgtgctctccgcgagggggaggagtag

SEQ ID NO: 194631 - DNA, 945 bp, Artificial Sequence
  Description of Artificial Sequence: Synthetic coding sequence
atgcccctggagcagcggagccagcactgcaagcccgaggagggcttggaggccagaggcgaggccctggggctcgttggagcacaggcccctgccactgaagagcaacagaccgccagctctagttccactctggttgaagtgacgctcggggaagtcccggcagcagacagtccatctcctccgcactccccgcaaggcgcgtcaagtttttcgaccacaatcaattacactctgtggcgccagtccgatgagggttcctcaaatcaggaggaagagggccctcgcatgttcccagatctggaatcagagttccaggctgctatatcaaggaagatggttgaactggttcattttctgttgctgaaatatagagcaagagagcctgtcaccaaggcggagatgctggaatccgtgcttagaaattgtcaggacttttttcccgtcatcttctctaaagcgtctgaatacctgcagttggtgttcggaatagaagtggtcgaagttgtgccgatatctcacctctacatactggtgacctgcctcgggctgagttacgacgggctgctgggagataaccaagtgatgcccaaaacgggcttgctgattatagtgctcgccatcatcgcaatcgagggggactgtgcacccgaagaaaagatttgggaggagcttagcatgttagaagtgtttgaaggaagagaggactccgtctttgctcacccccgcaaattgctcatgcaggacctggtgcaagagaattatcttgagtatcgccaagttcccgggtccgacccagcatgctatgagttcttgtggggcccacgcgccctgatcgagacctcatatgtgaaagtcctccaccataccctgaaaataggaggggagccccatatctcctatcctcctcttcacgagagggccctgagagagggggaggagtag

SEQ ID NO: 194632 - DNA, 945 bp, Artificial Sequence
  Description of Artificial Sequence: Synthetic coding sequence
atgcccctggagcagcggagccagcactgcaagcccgaggagggcctcgaagcacgcggagaggctcttggactcgtcggcgctcaagctccagcgaccgaggaacaacaaacagcctctagcagctctacccttgtggaagtaacgctaggtgaagttcctgctgctgattcacctagtccccctcatagtcctcagggggcttccagtttttcgaccactattaattacacactttggcgtcagagcgacgaagggtcctctaatcaggaggaagaggggccgcgcatgttccctgatctggagtcagaattccaggcagccatatcccgcaagatggtcgagctggtacacttcctcttgctcaaatatcgcgcacgcgaacccgtgaccaaggcggaaatgcttgaaagtgtgcttcggaactgccaagactttttcccggtgatcttctcaaaagccagcgagtacctgcagctggtgtttgggattgaggtggtggaagtcgtccccatttcccacctgtacatattggtgacatgtttggggctgtcctacgacggcctactcggcgacaaccaggtgatgccaaagactggactgttgattatcgtcctggcgattatagccatcgaaggagattgcgcaccagaggagaagatttgggaggagctcagcatgctcgaggtgttcgaaggccgagaggactctgtcttcgcacacccacgaaagttacttatgcaggatttagtgcaggagaactaccttgaataccggcaggtgccaggcagtgatccggcatgttacgagttcctctggggcccccgggcgctgatcgaaacaagttacgtgaaggtgttgcaccatactctcaaaatcgggggagagccccacatttcttacccgcccctgcacgaacgggctcttcgcgagggcgaggagtag

SEQ ID NO: 194633 - DNA, 945 bp, Artificial Sequence
  Description of Artificial Sequence: Synthetic coding sequence
atgcccctggagcagcggagccagcactgcaagcccgaggagggcctggaggcccggggggaagcactggggctggtcggcgctcaggcccccgccaccgaagaacagcagaccgcgagctctagctctaccctcgtggaagtcaccctgggcgaagtgcccgctgcggactccccatccccaccccactcaccccagggagcatccagtttcagtactacgattaattacacgttatggcgccagagtgatgagggcagctctaaccaggaggaggagggcccgcgcatgttccccgacctggagagcgaatttcaggcagccatttctagaaaaatggttgagctggttcacttcctcctcctgaaatacagggctagagagccagtcacaaaggctgaaatgctggagtcagtgctgcgcaactgccaagatttttttccagttattttctccaaggcatccgagtacctgcagctggtgttcgggatagaagtcgtcgaggtggtgcccattagccatctttacatcctggtgacgtgtctgggtctgagttacgacggactgcttggcgataatcaggttatgccaaagacgggcctgttgattatcgtactcgcaattatcgccatcgaaggggactgcgccccagaagagaagatctgggaggagctctctatgctggaagtattcgagggccgcgaagactcagtgtttgctcatcctagaaaacttctgatgcaggacctcgttcaggaaaactacctggaataccggcaggtgcccggcagcgatcccgcttgttatgaattcctgtgggggccccgggccctgatcgaaacctcttatgtgaaggtgctgcaccatactcttaagattggaggcgagccccacatcagctatcctccacttcacgagcgcgccctacgggagggagaggagtag

SEQ ID NO: 194634 - DNA, 945 bp, Artificial Sequence
  Description of Artificial Sequence: Synthetic coding sequence
atgcccctggagcagcggagccagcactgcaagcccgaggagggcctggaagcccgcggtgaggctttaggtctagtgggagcccaagccccagcaaccgaggaacaagaagccgcatccagctccagtacactcgttgaagtgaccctgggagaggttcctgccgccgagtcacccgaccctccccagagtccccagggggctagttcgctccctactaccatgaactacccactctggtcccagagttacgaagattctagcaaccaggaggaggaggggcctagtacgtttccagatcttgaatcagagtttcaggctgccttgtctagaaaggtggcagaactcgttcactttctgttattaaaatatagagctcgagagcccgtcacgaaggccgaaatgttgggatccgtcgtcgggaattggcaatatttcttccccgtcattttcagcaaggcttcttccagcctgcagctggtgttcggaattgaacttatggaagttgaccccattgggcatctttatatctttgctacgtgcctcggtttgagttatgacggactcttaggggataatcagataatgccaaaagcgggcctgcttatcatcgtacttgctattattgcacgtgagggtgactgcgctcccgaggagaaaatctgggaggagctgtcagtgctcgaggtattcgaggggcgcgaggatagcatcctcggggatcccaaaaagttgctgactcaacattttgtccaagagaattacctggaatatcgccaggtgccgggatcggacccggcgtgctacgagttcctatggggcccacgcgccctagttgagactagctatgtgaaggtcttgcaccatatggtgaagatttctggagggccccacatttcctaccccccattgcatgaatgggttcttcgggaaggggaagagtag

SEQ ID NO: 194635 - DNA, 945 bp, Artificial Sequence
  Description of Artificial Sequence: Synthetic coding sequence
atgcccctggagcagcggagccagcactgcaagcccgaggagggcctggaagccagaggagaggcactggggctggttggcgcacaggcccccgcaaccgaggagcaggaagccgcctcgtcttcaagcactttagtagaagtgactctcggggaggtccccgctgccgagtcacctgatccacctcagtcaccccagggggcttcatctctgccaactactatgaactaccccttgtggagtcagtcttacgaggactcgtctaaccaagaagaggaaggacccagtaccttccctgacctggagtcggagttccaggcagccttaagcaggaaggtggccgagctggtgcattttctcttactgaaatatcgagctagagagcccgtgaccaaagccgaaatgttagggtccgtcgtaggcaattggcagtatttcttcccggtgattttcagcaaggcctccagctccctgcaactggtcttcggtattgagctgatggaggtggacccaatcgggcacctgtatatcttcgctacttgcttaggattatcttatgacggcttgctgggagacaaccagatcatgcctaaagctggcttgcttatcatcgttctagccataatcgcgagagagggggattgcgcccccgaggagaagatctgggaggaactgtccgtcttagaggtgtttgaaggcagagaagacagcatactgggcgaccccaaaaagcttctcacacagcactttgtgcaagagaactaccttgaatatagacaagtgccaggctccgaccctgcctgctatgaattcctctggggaccacgggcactggtagagacttcttacgtaaaggtgttgcaccatatggtcaaaattagcggcggcccgcacatctcttatccaccactgcacgaatgggtcctccgggagggtgaagagtag

SEQ ID NO: 194636 - DNA, 597 bp, Artificial Sequence
  Description of Artificial Sequence: Synthetic coding sequence
atgcccctggagcagcggagccagcactgcaagcccgaggagggcctggaagcccggggcgaagccctcggtctggtcggagctcaggcaccggccactgaagaacaagaggccgcctcctcaagttctacgctggtggaagtgaccttgggagaagtgccagccgccgaatcccccgatcctccacagtccccccaaggggcttcgagcctgcctaccactatgaattaccctctgtggtcccagtcttatgaagattcatcgaatcaggaagaagaagggcctagtacctttcctgacctggagtctgaatttcaggctgctttgagtaggaaagtggccgaactggtgcactttctgctgttgaaatatagagctagggaaccagttacgaaggccgaaatgctaggcagtgtggtcggcaactggcaatacttctttccagtaatattttccaaggcgagttccagtttgcagcttgtgttcgggatcgaattgatggaagttgacccaataggccatttgtatatttttgccacgtgcctgggactctcctacgacgggttgcttggcgataatcagataatgcccaagtag

SEQ ID NO: 194637 - DNA, 954 bp, Artificial Sequence
  Description of Artificial Sequence: Synthetic coding sequence
atgagcagcgagcagaagagccagcactgcaagcccgaggagggcgtggaggcccaggaggaagccctgggcctggtcggcgcgcaagcccctaccactgaagagcaggaggctgcagtgtcaagctcttctcccttggtgcctggaacgctagaggaggtgcccgctgcagaaagtgcgggaccgccccagtcacctcaaggtgcatctgcattgccaacaaccatctcattcacctgctggcgccaacccaatgagggctcaagtagtcaggaggaggaaggaccctcgacgagtcctgacgctgaaagcttgttcagggaggccctgagtaataaagttgatgagctcgcacatttccttctccggaaataccgggcaaaagaactcgttaccaaggccgagatgttggaaagagtgatcaagaactataaacggtgtttcccagtgattttcggcaaagctagtgagagcttgaaaatgatctttggaatcgacgtcaaggaggtggatccggcctctaacacgtacacactggtgacctgtcttggacttagctatgacggcctcttggggaacaatcagatcttcccgaagacaggcctcctgatcatagtgctcggaacgatcgccatggagggcgattctgcgagcgaagaggagatttgggaggagctgggcgtgatgggggtctatgatgggagagagcatacagtgtacggtgaacctcgcaagctgcttacacaggactgggtgcaggagaactacttggagtaccgccaggtacctgggtctaacccagcccggtatgagtttctatggggcccccgtgccctcgctgaaacttcgtacgttaaagtgctggaacacgttgtcagagttaacgccagagtccgaattgcctatccttctctcagggaagccgcactgcttgaggaggaagaaggtgtttag

SEQ ID NO: 194638 - DNA, 954 bp, Artificial Sequence
  Description of Artificial Sequence: Synthetic coding sequence
atgagcagcgagcagaagagccagcactgcaagcccgaggagggcgttgaagcccaggaggaggccctcgggctggtgggcgcccaggccccaaccaccgaagaacaggaagcggcagtgagttcttcgtcacccttggtgcccgggacgctcgaagaagtaccagccgccgaatctgcaggcccgccgcaaagcccacagggagccagcgcactcccaacaaccatctctttcacctgttggcgacagccaaatgagggttcaagttcacaagaagaagaaggtcccagcacctctccagacgcagaaagtctatttagagaagccctttccaataaggtggatgagttggctcatttcctgctgcggaaatacagagcgaaggagttggtgacaaaggccgagatgctggagagagtgattaaaaattacaagaggtgctttcccgtcatcttcggaaaggcctcagagtcactcaaaatgatatttgggatcgacgtgaaggaggtggaccccgcctcaaacacatacacactagttacttgcctgggccttagctacgacggcctgctcggcaacaaccaaatattcccgaagactggcctcctgattatcgtcctgggtacgatcgccatggagggtgacagcgccagtgaggaagaaatttgggaggagctgggcgtcatgggggtctacgatggacgagagcacacggtatacggggagcctcgaaaattgttaacgcaagattgggtacaggagaattatctcgagtaccgccaggtgcccggcagcaaccccgctaggtatgaattcttgtggggcccacgtgcgctggccgaaacctcttatgtgaaagtattggagcacgtagtcagagttaatgctagggtgagaatcgcttacccctctctgcgcgaggctgccctgttagaagaagaagaaggagtatag

SEQ ID NO: 194639 - DNA, 954 bp, Artificial Sequence
  Description of Artificial Sequence: Synthetic coding sequence
atgagcagcgagcagaagagccagcactgcaagcccgaggagggcgtggaggctcaagaggaggctctcggtcttgtcggggctcaggcacctacaacagaagaacaggaagccgcagtaagctccagttctcccttggtgccaggcactcttgaggaggtccccgccgccgaaagcgcgggaccaccccagtcccctcaaggcgcatccgccttgccaacaaccatatccttcacctgttggcggcagcctaatgagggttccagttcacaggaagaagaaggcccgtcaacttctcccgacgctgagtcattgttccgggaggcattaagtaataaagttgacgaactggcacacttcctgctgcgaaagtacagggccaaagagttggtcaccaaggccgagatgctagaacgcgtcattaaaaattataagagatgcttccccgttatttttggaaaggcctcagagtccttgaagatgatctttggcattgacgtgaaggaagtcgaccctgcttctaacacttacacgttggtgacttgtctcggcttgtcttatgatggactgttgggcaataatcagatcttcccaaaaaccgggctgctgattattgtattaggcacgatcgctatggaaggagattccgcctccgaggaggagatttgggaggagctcggagtgatgggagtgtacgatgggagagaacatacagtatatggtgagcccaggaaactcctgacacaagattgggtgcaagaaaattatttggagtacagacaagtgccaggatctaatccagcccgttatgagttcctgtggggtcctcgggccctggctgagacgtcctatgtaaaggtgcttgaacatgttgtccgtgtcaatgcccgggtgcggattgcctatccttcccttcgggaggccgcacttctagaggaggaagaaggcgtctag

SEQ ID NO: 194640 - DNA, 954 bp, Artificial Sequence
  Description of Artificial Sequence: Synthetic coding sequence
atgagcagcgagcagaagagccagcactgcaagcccgaggagggcgtggaggcacaggaggaagctctggggctggtcggcgcacaggcccctaccacggaggaacaagaagctgcagtctcaagttcttcacccctggttccggggaccctggaagaggtccccgccgctgagtctgccggccccccacagtcccctcaaggtgcctccgcactacctaccacgatctcatttacgtgttggcggcaacccaacgaaggatctagctcccaggaggaagagggtccgagtaccagccctgatgctgaatcgctattccgagaggcccttagtaataaagtggacgaattagctcatttccttctgcgcaagtatcgggcaaaggagctggtgactaaagccgagatgctggagagggttatcaagaactataagcggtgcttccccgtcatattcgggaaagcttcagaatctctcaagatgatctttggaatagatgtgaaggaggtggatccggcctcaaacacttacacccttgttacctgcttaggactgtcatatgacggtctgctggggaacaatcaaatatttcctaaaactggactgctgattattgttctcgggacgattgctatggagggcgattcagcaagcgaagaggaaatctgggaggagctcggggttatgggagtttatgatggaagggaacacacggtctatggagaacctagaaagctgctcacacaagattgggttcaggaaaattacctagagtacaggcaggtgcccggcagtaatcctgccagatacgagtttctctggggtcctcgcgccctcgccgagacgagctacgtgaaagtcctggaacatgtggttcgagtgaacgcacgtgtgcggattgcctatccttctctgcgcgaggccgccctccttgaagaagaggaaggtgtgtag

SEQ ID NO: 194641 - DNA, 954 bp, Artificial Sequence
  Description of Artificial Sequence: Synthetic coding sequence
atgagcagcgagcagaagagccagcactgcaagcccgaggagggcgttgaggcacaggaggaagccctgggattggtcggtgcgcaagccccaaccaccgaggaacaggaggctgcggttagctcgtcctcccccttagtgcctggtaccttggaggaagttccggccgctgaatcggctgggcctcctcagtctcctcagggggctagtgcactcccaaccaccatctctttcacttgttggagacagccaaatgagggcagctcttcccaggaagaggagggcccgtcaacaagcccggatgctgagagccttttcagggaggccctgagcaacaaagttgatgagttggcacattttctactcaggaaatatcgcgctaaagagcttgttaccaaggccgaaatgctggaaagggttattaaaaattacaaacgctgcttccccgtcatcttcggtaaagccagtgagagtctgaaaatgatattcgggattgacgtgaaggaggtggaccccgcctctaatacttatacattggtaacctgcttgggactgtcatatgatggcctgttggggaacaatcagatctttcctaagaccggcctgctgattatcgtcctcggtacaatcgcaatggaaggcgattcagcatcagaggaggagatttgggaggagttgggggtcatgggcgtgtacgatggacgtgaacacactgtctatggggaaccacgcaagctgctgacacaagactgggtgcaagaaaattatctagaatataggcaggttcctggaagcaatccagccagatacgagtttctgtgggggcctcgggccctcgccgagaccagctatgtgaaagttttggagcatgtagtgagggttaatgctcgggtgagaatcgcatacccttctctgcgggaggccgcccttctggaagaagaggagggggtgtag

SEQ ID NO: 194642 - DNA, 954 bp, Artificial Sequence
  Description of Artificial Sequence: Synthetic coding sequence
atgagcagcgagcagaagagccagcactgcaagcccgaggagggcgtggaagcccaagaagaagccctgggactggtgggagcacaggcccccaccaccgaagaacaagaggccgccgtcagttctagctctccactggtgccaggcactttggaggaagtgcccgcagctgaatccgctgggcccccccagagcccacaaggtgcaagcgccttaccgacaactatcagtttcacctgttggcgtcagcctaacgagggcagttcatcacaggaggaagagggtcctagcaccagcccggatgccgaatccctttttagagaagctctctcgaataaagtcgacgagcttgctcattttttgctgcggaagtatcgggctaaggagttagtaactaaagctgaaatgttggaaagagtgatcaagaactataagcggtgctttcccgtcatatttggcaaggccagcgaatctctgaagatgatcttcggcatcgacgtgaaggaagtggaccccgcaagtaacacctacaccctagtgacctgcctgggccttagctatgatgggctcctgggaaacaaccagatcttccccaaaaccggtctcctaataattgtgttgggtactattgccatggaaggagactccgctagcgaagaagaaatctgggaggagctgggagtgatgggagtgtatgatgggagggaacacaccgtttatggcgaaccgcgaaagctcttgacccaagattgggtgcaggaaaattatcttgagtaccggcaggttcctgggtcaaacccagctcgctatgaattcctctggggtcccagagcactcgcagagacatcctatgtgaaggtgctagagcacgtggtcagagtcaacgctcgcgtgagaatagcctatccatccctgcgcgaggccgcgcttctggaggaagaggagggcgtctag

SEQ ID NO: 194643 - DNA, 954 bp, Artificial Sequence
  Description of Artificial Sequence: Synthetic coding sequence
atgagcagcgagcagaagagccagcactgcaagcccgaggagggcgtcgaggcccaggaagaggccctgggactggtgggtgcacaggctccgacgaccgaagaacaagaggcagcggtgtcatcctccagccctctggtgccagggacattggaggaggttcctgccgccgaaagcgcaggtccccctcagagtcctcagggagcttctgctctgcctacaaccatctcctttacatgttggagacagcccaatgaaggcagctcctcccaggaggaggagggaccgtccacatcacctgatgccgagtctcttttccgggaggccctttctaacaaagtcgatgagctagcacactttttattacgtaagtacagagcgaaagagttggtgacgaaggcagaaatgctggaaagagttatcaagaattacaagagatgctttcccgtcatctttggcaaagcaagcgaaagcctcaaaatgattttcggtattgacgtcaaggaggttgatcccgccagcaacacgtacaccttggtgacatgcctgggattatcatatgatggtttactgggcaataatcagatcttccccaagacagggttgctgatcatcgtgttgggaacgatagccatggagggggacagcgcatctgaagaagagatttgggaggagttgggcgtgatgggagtctacgacggaagagagcatacagtgtatggcgaaccgcgcaaactattgacccaggattgggttcaggagaattacttggagtatcgacaggtacctgggtccaacccagcgagatacgaatttttgtggggccctagagccctcgcagagacttcatacgtcaaggtgctcgagcatgtggtgcgtgtcaacgcccgggtgcgcatagcctacccctcactgagggaagctgcgcttctagaggaggaagaaggcgtgtag

SEQ ID NO: 194644 - DNA, 693 bp, Artificial Sequence
  Description of Artificial Sequence: Synthetic coding sequence
atgagcagcgagcagaagagccagcactgcaagcccgaggagggcgtggaggcccaggaagaagccctaggcctcgtgggcgcacaggctccaaccactgaggagcaagaggccgccgtctctagctccagcccactcgtgcctgggactctggaggaagttcccgcagctgagagtgcagggccaccacagtcaccgcagggggcgagcgccctgcccactacgatctcatttacttgctggcggcagcctaatgagggctcctcgagccaagaagaggaaggcccctccacttctccggacgctgaatctctcttcagggaggcgctcagcaataaggtagatgaactggcccattttctcctaaggaagtatagggccaaggaactcgtgaccaaggccgaaatgttagaaagggtgataaagaactataagcggtgcttccctgttatttttgggaaggcgtcagagtcccttaagatgatcttcggtattgacgtcaaagaagtggacccagcctccaacacatacactttggtgacatgcctgggcctgtcttacgacggactcctgggaaataaccagatctttccaaaaaccggcttattgatcatagtgctgggtaccatagcaatggagggagacagtgccagcgaggaggaaatctgggaggagcttggtgtgatggggtag

SEQ ID NO: 194645 - DNA, 654 bp, Artificial Sequence
  Description of Artificial Sequence: Synthetic coding sequence
atgagcagcgagcagaagagccagcactgcaagcccgaggagggcgtcgaagctcaggaggaggcgctagggcttgtgggagctcaggcgcccaccaccgaggaacaggaagccgccgtaagcagctcctctccattagtacccgggactctggaagaagtaccagctgccgagtccgccggccccccccagagccctcagggagcaagcgcccttcccaccactataagttttacttgttggaggcaacctaacgagggctcttcaagtcaagaggaggaaggaccatccaccagccctgatgccgagtcactcttccgcgaggctctgtcaaataaggtagatgagctcgctcattttctgctgcgtaaatatcgggctaaggagctggtgaccaaggctgagatgcttgagcgagtcatcaaaaactataagcgttgttttccagtcatctttggcaaagcaagtgagtccctgaagatgattttcggcattgacgttaaagaagtagatcccgcctcaaatacatatacgctggtaacctgtctgggcttatcgtatgatggcctcctggggaataatcaaatatttcctaagaccgggctactgataatagtgctgggtacaattgccatggaaggcgattctgcatag

SEQ ID NO: 194646 - DNA, 726 bp, Artificial Sequence
  Description of Artificial Sequence: Synthetic coding sequence
atgagcagcgagcagaagagccagcactgcaagcccgaggagggcgtggaggcccaggaggaagcgctgggccttgtgggcgcacaggccccaactaccgaggagcaagaagctgccgtgtcgagttcatcacctcttgtccccggtaccctggaggaggttcctgctgctgagagtgcaggcccaccccagtcaccacagggagccagcgccctccccaccacaatatctttcacatgctggcggcagcccaacgagggttcatcttctcaggaggaggagggcccgtctaccagccctgacgcagagtcactcttcagagaagctctatccaataaggtggacgagttagctcacttcctgctgcgtaaataccgggcaaaagaactggtcacaaaggctgaaatgctcgaacgtgtaatcaagaactacaagcgatgtttcccggtaatctttgggaaggcatccgaatctctgaagatgatcttcgggatcgatgtgaaagaagtggatcctgcaagcaatacctacactcttgtgacatgcctagggcttagctatgacgggctgctgggtaataatcagatcttccccaaaaccggccttctaattattgtgctcggaacgatcgcaatggagggggacagcgcaagtgaggaagaaatctgggaggaattaggcgtaatgggagtatatgacgggcgggaacacactgtttatggttag

SEQ ID NO: 194647 - DNA, 519 bp, Artificial Sequence
  Description of Artificial Sequence: Synthetic coding sequence
atgagcagcgagcagaagagccagcactgcaagcccgaggagggcgttgaggcacaagaggaagccttaggcctggtgggcgcacaggcgccaaccacggaagagcaagaggcagccgtgagctcaagcagtcccctggtccccggaactctggaggaagtcccggctgctgaatccgccggccccccccagtccccacagggcgcaagcgctctgccaaccactatcagcttcacttgctggcgccagccaaatgagggatcaagttctcaagaggaagagggccctagtacttcccccgacgctgagagcctcttccgagaagctctgtcgaataaggtggacgaactcgcccacttcctgctgaggaagtatcgggctaaggaactggtgactaaggctgagatgctcgagagagtgatcaagaattataaacggtgtttccccgttatcttcgggaaagcttctgaatcattaaagatgattttcggaatcgacgtgaaggaggtggacccctag

SEQ ID NO: 194648 - DNA, 726 bp, Artificial Sequence
  Description of Artificial Sequence: Synthetic coding sequence
atgagcagcgagcagaagagccagcactgcaagcccgaggagggcgtagaagctcaggaggaagccctggggctggtgggggcccaggcgccgacgacggaagaacaggaggcagccgtttcttcttcctctccgctggtacccggcacactggaagaggtccccgccgcagagtccgctggcccgccacagtccccgcagggagcatcggccctgcctaccacaatatcatttacctgttggaggcagcctaatgagggctcatccagccaggaagaggagggacccagtactagcccagatgccgaatccctctttcgagaggctctaagcaataaagtggatgaactagcccacttcctgctccgaaagtaccgcgcaaaagaactggtgacaaaggcggagatgctggaaagggtgattaaaaactacaaacggtgcttccctgtgatcttcggcaaggcaagtgagtcactgaagatgatttttggcattgacgtgaaagaggttgaccccgcttccaacacatataccctcgtgacttgtcttggtctgtcttacgatgggctgctgggtaacaaccagatattccccaagactggactgcttataatcgtgcttgggactatcgcaatggagggagactccgcttcggaggaggaaatctgggaggaattaggcgttatgggagtctacgacgggcgcgaacacaccgtgtatggctag

SEQ ID NO: 194649 - DNA, 726 bp, Artificial Sequence
  Description of Artificial Sequence: Synthetic coding sequence
atgagcagcgagcagaagagccagcactgcaagcccgaggagggcgtagaagctcaggaggaagccctcggactcgtgggagcccaagcacctactaccgaggaacaggaggctgctgtaagctctagctctcccctggtgccagggactcttgaggaggtccctgccgcagagagcgcaggacctcctcaatctcctcaaggcgcatcggctctacctaccaccattagctttacgtgttggcgccagcctaatgagggctcatcctcacaagaggaggagggacctagcacctcaccagacgccgagagtctgttccgtgaggcactcagtaacaaggtcgatgagctggcccattttctcttaagaaagtaccgggccaaagagctcgtgacgaaggccgagatgctggagcgggttattaagaactacaagagatgttttcccgtcatctttggtaaagcctccgaatctctgaagatgatcttcggcatcgatgtgaaagaagtggatcccgcgtccaacacctatacgttggttacttgtctgggtctgtcgtacgacggattactggggaacaaccagatctttcccaaaaccggtctcctgattattgtgctgggtaccattgccatggagggagactctgcctcggaggaggaaatttgggaggagctgggcgtgatgggcgtctacgatgggcgtgagcacaccgtgtacgggtag

SEQ ID NO: 194650 - DNA, 654 bp, Artificial Sequence
  Description of Artificial Sequence: Synthetic coding sequence
atgagcagcgagcagaagagccagcactgcaagcccgaggagggcgtagaagctcaggaagaagctctcgggctggtgggcgcacaggctccgacgactgaagagcaggaggcggcggtatcaagctccagtccccttgtccctggcaccctcgaggaagtgcctgcggcggaaagtgcaggaccgccccagagccctcagggtgcctcggccctgccaacaactatatcctttacttgctggcggcagcccaatgagggcagcagtagtcaggaggaggagggcccgtcaacaagtcccgacgccgagtctttgttccgagaggctctgagtaataaggtggacgaacttgcccattttctgctgagaaagtatcgcgctaaggagttagtgaccaaggcagaaatgctggagcgcgtgataaaaaactacaagagatgttttcccgtgatttttggtaaggcaagtgaaagcttaaagatgatctttggaatcgacgttaaagaggtggacccggctagtaatacatacactctcgtcacgtgcctcggcctgtcttatgacggcctcctgggtaataaccaaatttttcccaaaacaggactcttaatcatcgtcctgggaactattgccatggaaggggattccgcctag

SEQ ID NO: 194651 - DNA, 726 bp, Artificial Sequence
  Description of Artificial Sequence: Synthetic coding sequence
atgagcagcgagcagaagagccagcactgcaagcccgaggagggcgtagaggcccaagaggaggcacttggattggttggagcccaggctccaacgacggaggagcaggaggcggccgtttcctcatcctcgccacttgtccctgggactttggaggaagtccccgccgccgagagcgcagggccccctcagtcacctcagggggcctcagcactccctacaacaatatcctttacatgctggaggcagccaaatgagggttctagctcccaagaagaggaaggaccctctacgagtcccgatgctgagagcctgtttagagaagctctgtcaaataaagtagacgaattggcccactttcttcttcgcaagtacagagcgaaagagctagtgactaaagcggagatgttagagcgggtcattaagaattataagcggtgctttcctgtaatttttggcaaggcctccgagtctctgaagatgatcttcggtatcgatgtaaaggaggtggaccccgcttcaaatacttatacactggttacttgcctgggactgagctatgacgggctgttaggcaataatcagatctttccgaagacgggtctgctaataatcgttctcggcactattgccatggagggcgacagcgcaagcgaggaggagatctgggaagaactgggggttatgggcgtgtacgacggacgagaacatacagtgtacggctag

SEQ ID NO: 194652 - DNA, 945 bp, Artificial Sequence
  Description of Artificial Sequence: Synthetic coding sequence
atgcccctggagcagcggagccagcactgcaagcccgaggagggccttgaagccaggggcgaagcgctcgggctcgtcggcgcccaggcacccgccacggaagagcaagaggccgcatcaagttctagtactctggtggaggtgaccctgggtgaagtgcctgctgccgagtccccggatccaccacagtccccccagggagcctctagccttcccaccactatgaattaccctttatggtctcagtcctatgaagactcatctaatcaagaggaggaaggccccagtacgttcccagacctggagtccgagttccaggctgctctgagccgcaaggtagctaaattggttcattttctgctgctgaaataccgggcacgtgagcctgtgacgaaagccgaaatgctcggatctgtagtgggcaactggcaatacttctttcctgtaatcttttctaaagcgtctgacagcttacaactggtgtttgggattgagctaatggaggtggatccaatcggccacgtgtacatatttgctacttgtcttggactctcctacgacggcttgctaggtgataaccaaatcatgcccaagacaggctttcttataatcatattagctattattgcaaaagagggtgactgcgcccctgaggagaaaatctgggaagagctctctgtactcgaggtctttgaaggacgagaggattctatttttggggatccaaaaaagctgctcactcagtacttcgtgcaggagaattatctcgagtaccggcaggtgccaggcagcgatccagcatgctacgaattcctctggggaccgagagctctcattgaaaccagttacgtgaaggtactccatcatatggtgaagatcagtgggggaccacggataagttacccattactgcatgaatgggctctgagagagggtgaagagtag

SEQ ID NO: 194653 - DNA, 606 bp, Artificial Sequence
  Description of Artificial Sequence: Synthetic coding sequence
atgcccctggagcagcggagccagcactgcaagcccgaggagggcctcgaggcaaggggtgaagcacttgggctcgtgggcgcacaagcaccagctacggaggaacaggaggctgcctccagctcctcgaccctggttgaggtcaccctcggagaggtgcccgctgcagaatcacccgatcctccacaatctccccagggagcttcctccctcccaactaccatgaactacccattgtggagccagtcctatgaggacagtagcaatcaagaggaagaaggccctagtacatttcccgatctggaatctgaatttcaggctgctctgtccagaaaagttgcaaaactcgttcatttcttgctgctcaagtacagagctagagaaccggttaccaaggccgagatgctaggctcggtcgtgggtaactggcagtattttttccccgtgatcttctcgaaggcgtctgacagcctgcagcttgtgttcggaatcgaactcatggaagtggatcccatcggacatgtttacatttttgcgacctgtctcggattaagttatgatggcctattgggggataatcaaataatgcccaagacagggttctag

SEQ ID NO: 194654 - DNA, 708 bp, Artificial Sequence
  Description of Artificial Sequence: Synthetic coding sequence
atgcccctggagcagcggagccagcactgcaagcccgaggagggcctcgaggcgcgcggggaggcgctggggcttgtcggagcccaggcgccagcaaccgaagaacaggaggcggcgtcctcttcttctactttggttgaggttaccctcggcgaggtccctgcggcggagtccccagatcctcctcagtccccccaaggcgcgtcctccctgcccaccacaatgaactaccccctgtggtcccagagttacgaagatagctccaaccaggaagaagaagggccctcgacatttccagacctggaatcggagttccaggcagcactaagtcgaaaagtggccaagctggtgcatttcttgctgctgaaatatcgggcacgggagcctgtgactaaggccgaaatgctagggagcgtagtgggcaattggcagtattttttcccagtgatctttagcaaggcatcagattctctccaactggtgtttggcatcgaactgatggaggtggatccgattggacatgtgtatatattcgccacttgtttggggctgtcttacgatggcctgcttggcgacaatcagataatgcccaaaacaggattcttgataataattctggcaatcatcgccaaggagggtgattgcgcacctgaagaaaaaatctgggaagaactgagcgtcctggaggtgtttgaaggtagggagtag

SEQ ID NO: 194655 - DNA, 957 bp, Artificial Sequence
  Description of Artificial Sequence: Synthetic coding sequence
atgctgctgggccagaagagccagcggtacaaggccgaggagggcctccaggctcaaggggaggcccccggactcatggacgtgcagatcccgactgctgaagagcaaaaggcggcatcatcttcaagcactctgataatgggcactttggaggaagtaactgatagcggctctccttcccctccccaatctccagaaggggcatccagtagtctgactgtgacagattcaactctgtggtcccaatccgatgaagggtcttctagcaatgaggaagagggcccatctactagtccagatcctgcgcatctggaatccctcttccgggaggcactcgacgagaaggtggcagagctggtgcgcttcctgctgagaaagtaccaaattaaagaacccgtgacaaaagctgagatgctggaatctgtcatcaagaattacaagaaccactttcctgacatattttcgaaggcatcagagtgtatgcaggtgatatttgggatcgatgtgaaagaagttgatccagccggacactcctatatccttgttacctgcctgggactcagctacgacggcctcctgggcgatgaccagtcaacccctaaaacggggctgctgataattgtcttggggatgatcctcatggagggatcacgggctccagaggaggcaatatgggaggctctgagtgtgatgggcctctacgacggcagggagcactctgtgtactggaaacttagaaagctgcttacgcaagagtgggtgcaggagaactatctcgagtatcgccaggccccaggctccgatccggttaggtacgagttcctctgggggccccgggccttagcagagactagctatgtaaaagtcctggaacacgtagtccgtgtgaatgcacgagtaagaatttcctacccctcattgcacgaggaagcacttggtgaggagaaaggggtgtag

SEQ ID NO: 194656 - DNA, 957 bp, Artificial Sequence
  Description of Artificial Sequence: Synthetic coding sequence
atgctgctgggccagaagagccagcggtacaaggccgaggagggcctccaggcccagggggaggctccagggctgatggacgtccagatcccgaccgccgaggaacaaaaggccgccagttcgagctcaaccctgatcatgggtactctggaagaagtaactgacagtggaagccctagcccgcctcagtctcccgagggggctagcagcagcttgacagtgaccgactcgactttgtggtcacagagtgatgaaggcagttcttcaaatgaggaggaaggtcctagcacatccccagatcctgcccacttggagtccctgtttagagaggcactggatgagaaggtggctgaattagttagattcctgctcagaaaatatcaaattaaggaacctgtcaccaaggcagaaatgcttgaaagtgtgattaagaactacaaaaaccacttcccagacatttttagcaaagcaagcgaatgtatgcaggtaattttcggcattgatgtgaaagaagtggatcccgcagggcacagttatatactcgtgacatgcttgggtctgtcatacgatgggctcctgggcgacgatcaaagcactcctaaaactggcctcctcatcattgttctaggaatgatcctaatggagggctcccgcgctcctgaggaggcaatctgggaggcactatcagttatgggcctgtatgatggtcgcgaacacagcgtgtattggaagctgcgaaagctgttaacacaagagtgggtacaggagaactatctggaatacaggcaggccccaggctcagaccctgtgagatatgaattcttgtggggacctagagccttggccgagacctcttatgtgaaagtgctagagcatgttgtaagagtgaacgccagagtgcgcatctcttatccatctctgcatgaggaggctctcggcgaggagaaaggcgtatag

SEQ ID NO: 194657 - DNA, 957 bp, Artificial Sequence
  Description of Artificial Sequence: Synthetic coding sequence
atgctgctgggccagaagagccagcggtacaaggccgaggagggcttacaggctcaaggagaagcccccggccttatggatgtacagattcccacggcagaagagcagaaggctgctagttcttcctctacgctcataatgggcaccctggaggaagtgactgatagtggaagtccctctcccccccaatcccccgagggggccagctcctcactgacagtaacagactctacattatggagtcagagtgatgaggggagttctagcaacgaggaagagggcccaagtacctctccagacccggcacacttagaatctttattcagagaggctctggacgagaaggtggccgagttagtgcgcttcttgctccgcaaatatcagatcaaggagcctgttacaaaggccgaaatgttagagagtgtgatcaaaaactacaagaaccactttccagatatcttcagcaaagcctctgagtgtatgcaggttatctttggcattgacgtgaaggaagtggacccagctggacacagctatatcctcgtaacatgtctgggcctttcatacgatggactgctgggggatgatcagtctaccccaaagactggactgctgatcatcgtgctggggatgatacttatggaggggagccgggcgcccgaggaggccatttgggaagccttgtccgtcatgggcctttacgacgggcgcgagcattcggtgtactggaaattgaggaaactgttaacccaggaatgggtgcaagaaaactacttggagtacagacaggccccggggtcagatcccgttcggtatgagtttttatggggtccccgcgccctggccgagacttcttacgtaaaggttctcgagcacgtggtccgggttaatgctcgggtgcgcatcagctaccctagtctacacgaggaggctttgggtgaggaaaaaggagtgtag

SEQ ID NO: 194658 - DNA, 948 bp, Artificial Sequence
  Description of Artificial Sequence: Synthetic coding sequence
atgagcctggagcagcggagcccccactgcaagcccgacgaggacttggaggctcagggagaagatctcggcctcatgggggcccaggaaccgacaggtgaggaagaggagaccaccagctcgtctgattcaaaagaggaggaggttagtgccgctggctcctctagtccaccccaaagcccccagggaggcgcctctagcagcatctccgtctattacacgttgtggagccagtttgatgaaggaagctccagccaggaagaggaggaacccagctcttcagtcgatcccgcccagttagaattcatgttccaggaggcgctcaaacttaaggtggccgagctggtccattttctgctacacaagtaccgggtaaaggagccagtgacgaaggcagaaatgctggagagtgtcattaaaaactataagaggtatttccccgttatcttcggaaaagctagcgagttcatgcaggtaatttttggcacagacgtgaaagaagtagatcctgctgggcattcttatattcttgtgaccgctctgggcctcagttgcgatagtatgctgggtgatgggcatagtatgcccaaagctgcattgctgattatcgtgcttggagtgatcctgaccaaggacaactgcgccccagaagaggttatttgggaggccctgagcgtcatgggagtttatgtgggaaaggagcacatgttttacggagagcctcggaagctgttgacacaggactgggtacaggagaactatcttgaatatcgccaagtccctggctctgaccctgcccactacgagtttctgtggggttcaaaggcccatgccgaaacatcttacgaaaaggtcatcaactacttagttatgctgaatgcccgagaacccatctgctacccttctctgtacgaggaagtgttaggcgaggagcaagaaggcgtctag

SEQ ID NO: 194659 - DNA, 345 bp, Artificial Sequence
  Description of Artificial Sequence: Synthetic coding sequence
atgagcctggagcagcggagcccccactgcaagcccgacgaggacttagaggctcagggcgaggacttggggctgatgggggctcaggagcccactggggaggaagaagagaccacctctagcagtgacagtaaggaggaggaagtctccgctgctggatcctcctcccccccgcagtctccgcaaggtggtgcctcaagcagtataagtgtttactacacgctttggagtcagtttgatgaggggtcctcatctcaggaggaagaggagccgagctcatccgtggacccggcccaactggaatttatgtttcaagaggcgctcaagcttaaggttgcggaatag

SEQ ID NO: 194660 - DNA, 930 bp, Artificial Sequence
  Description of Artificial Sequence: Synthetic coding sequence
atgagcctggagcagcggagcccccactgcaagcccgacgaggaccttgaagcccaaggcgaggacctggggttaatgggggcccaggaacctaccggcgaagaggaggagacgactagttctagcgatagcaaagaggaagaggtctctgctgctggctcttcatctccacctcagtctccacagggcggtgcaagcagttcaatctcagtgtattatacattatggtctcagtttgacgagggctcctcttctcaggaggaggaagagccttctagcagcgtggatccggcccagcttgaattcatgttccaagaggccctgaaactgaaggtggccgagctggtccattttctactgcataaatacagagttaaggaacccgtcactaaggccgaaatgctggagtcagtgatcaagaactacaagcggtactttcccgttatcttcggaaaggcatcagagttcatgcaggtcatctttggtactgatgtcaaggaggtggatccagcaggtcattcatacatcttagtgactgcactgggattatcctgcgactccatgctcggtgacggtcacagtatgcccaaagctgccctgctgatcatagtgctaggcgttattctgacaaaggacaattgcgcccctgaagaagtgatctgggaggccctctcagtcatgggagtgtatgtgggcaaggagcatatgttctatggggagccgagaaagttactgacgcaggactgggtccaggagaattacttggagtaccggcaggtgccaggctccgaccccgctcattacgagtttctgtggggcagtaaggcacacgctgagacatcctacgaaaaagtgattaactacctggttatgctgaacgcacgcgaaccaatttgctatccaagcctttatgaagaggttctggggtag

SEQ ID NO: 194661 - DNA, 591 bp, Artificial Sequence
  Description of Artificial Sequence: Synthetic coding sequence
atgagcctggagcagcggagcccccactgcaagcccgacgaggacctggaggcacagggcgaggatctcgggctgatgggagctcaagagccgacaggcgaggaggaagagacaacttcctctagcgactccaaggaagaggaggtctccgcagcagggtcatcttccccacctcagagtccccaggggggggcaagctcctcaatctctgtgtattacactctttggagccagttcgacgagggcagtagctcccaagaggaagaagagccctctagctctgttgacccggctcagctggagttcatgttccaagaagctctgaagctgaaagtggctgagttggtacattttttactccataaatatcgggtaaaggagccagtgaccaaagctgagatgctcgaatcagtgattaagaactacaagcggtacttcccagtgatctttggcaaggccagtgaatttatgcaagtgatctttgggactgacgtgaaagaagtcgaccctgcaggccatagctacatcctggttacagctcttggcctgtcctgtgactctatgttgggagatgggcactcaatgccctag

SEQ ID NO: 194662 - DNA, 294 bp, Artificial Sequence
  Description of Artificial Sequence: Synthetic coding sequence
atgagcctggagcagcggagcccccactgcaagcccgacgaggacctggaggcacagggggaggatctggggcttatgggtgctcaggaaccaactggcgaggaggaggagacaacatccagtagcgactccaaggaagaagaggtgagcgccgccggttcctcttcgcctccacagtcaccgcagggtggggcctcatcctctatcagcgtttattataccctgtggtcgcagttcgacgaggggtctagttctcaggaagaggaggaacctagctcctcagttgatccgtag

SEQ ID NO: 194663 - DNA, 948 bp, Artificial Sequence
  Description of Artificial Sequence: Synthetic coding sequence
atgagcctggagcagcggagcccccactgcaagcccgacgaggacttggaggcccaaggcgaagacttgggcttgatgggagcacaggagcctaccggagaggaagaagagacgacgtcatctagtgactctaaagaagaggaggtgagcgctgccgggagttctagtcccccccagtcacctcagggtggcgcgtcaagcagcatcagcgtctactacaccctgtggagccagtttgatgaggggtcaagctctcaagaggaggaggaacctagttcgtctgtggatcctgctcaactcgagttcatgttccaggaggccctgaaactgaaagtggccgaactggttcacttcctgctgcacaaatatcgggttaaggagcctgtgacaaaggcagagatgctagaaagtgtgataaagaactataagcgctatttcccagtaatcttcggtaaagcttctgagttcatgcaggtgatttttggcactgatgtgaaggaagtcgatccagctggccactcgtatatcttagtcacagctctcggacttagttgcgatagcatgctaggcgatggacactctatgcccaaagccgctctattaattatcgtacttggggtgatcttaactaaggataactgcgctccagaggaagttatctgggaggcactgagtgtgatgggggtgtacgttgggaaagaacatatgttctatggggagccccgcaagctgctgacccaagactgggtgcaggaaaattacttggagtatcggcaggtgcccggatccgatcccgcccactacgagtttctatggggaagcaaggcccatgccgaaacgtcttacgagaaagtcataaattacctggtcatgcttaatgctagagaaccaatctgttacccgagtctgtatgaggaggtactgggcgaggaacaagaaggggtatag

SEQ ID NO: 194664 - DNA, 1044 bp, Artificial Sequence
  Description of Artificial Sequence: Synthetic coding sequence
atgccccggggccagaagagcaagctgcgggcccgggagaagcggaggaaagctcgcgaagaaacacagggactcaaggtagcccatgccacggctgctgagaaagaagaatgccctagctcgtccccagtactaggtgatacaccaacttcctctcccgccgctggaattccccaaaaaccgcagggtgctccgcccaccaccacagccgccgccgccgtgtcctgtactgaatccgacgagggtgctaagtgtcagggagaggagaatgcctctttttcccaggccactactagtacagagtcttcagtgaaggatcccgttgcctgggaggctggcatgctaatgcatttcatcctccgaaagtacaagatgcgtgagcccatcatgaaagccgacatgctgaaagtggttgatgagaagtacaaggatcactttacagaaatactcaacggagcatctaggagactggagctcgtgtttggcctcgatcttaaagaggacaaccccagcggacacacgtatacattagtgtccaagctgaatctgaccaatgatggtaacctgagtaacgactgggacttccctcgcaatggcctcctcatgcctcttctgggcgttatcttcctgaagggaaactctgctactgaggaagagatatggaaatttatgaacgtgttgggggcctatgatggcgaggagcacctgatatacggcgaacccagaaaattcatcacacaggacctcgtacaggagaaatatttgaagtatgagcaggtgccaaatagcgacccacccaggtatcagtttctttggggcccaagggcatatgcagaaaccaccaaaatgaaggtgcttgagttcttggccaagatgaacggtgccacgcctagggactttccctcccactatgaggaggctctgcgcgacgaagaggaacgagctcaggtgcggagcagtgtgagggctaggagacgtaccaccgctaccacattcagagctagaagtcgcgctccgttcagtcggtcttcccacccaatgtag

SEQ ID NO: 194665 - DNA, 1044 bp, Artificial Sequence
  Description of Artificial Sequence: Synthetic coding sequence
atgccccggggccagaagagcaagctgcgggcccgggagaagcggagaaaagcccgggaagaaacacagggtttgaaggttgctcacgcgacagctgcggagaaagaagagtgcccatcttcatcaccagtgttgggggatacccctacatccagcccagccgcaggcattccacagaaacctcagggtgcacctcccacaacaactgctgccgctgccgtgtcgtgtaccgagtctgatgaaggggccaaatgccaaggggaggagaacgcttcattttctcaggcaaccacatcgaccgaatcaagcgtgaaggatcctgtcgcttgggaggccggcatgctcatgcactttatactgaggaaatacaaaatgcgcgagcctataatgaaagcggacatgctgaaagttgtcgatgaaaagtacaaggaccacttcacggagatcctcaatggcgcaagtcgaagactcgagttggtgtttggcctggacctgaaagaggacaaccctagtggccatacatacaccctggtctctaagttaaatcttactaatgatggcaacctgagcaatgattgggacttcccaagaaatgggctgctgatgcctctgctcggcgtgatctttcttaagggcaatagcgctaccgaagaagagatctggaaattcatgaatgtccttggcgcctatgacggtgaggagcacctaatttacggcgagccgcggaagttcattacacaggaccttgttcaggagaaatatctcaaatatgaacaggtacctaattcggacccaccacgttaccaattcctgtggggacctcgagcctacgccgaaacaacaaaaatgaaggtcctggagtttctggccaaaatgaacggagcgacaccccgagattttcctagccattatgaagaggccctacgggacgaggaggagagggctcaggtccggtcatccgtgagagctcgcagacggacaacagccacaacctttcgagcaaggagcagggcccctttcagccgctcttcacatcctatgtag

SEQ ID NO: 194666 - DNA, 1044 bp, Artificial Sequence
  Description of Artificial Sequence: Synthetic coding sequence
atgccccggggccagaagagcaagctgcgggcccgggagaagcggaggaaggcccgggaggagacccaaggacttaaggttgcccacgccacagctgccgagaaggaagagtgtccatccagcagcccagtcctcggggatactcccacctccagtcccgcagccgggataccacagaagccgcagggggcccctcccacaaccacagcggctgccgccgtttcatgtaccgaatcggacgaaggggccaaatgtcagggagaggaaaacgcctccttctcgcaggctaccacatccacagaatcgtccgtcaaggatccggtggcatgggaggcggggatgctgatgcactttatcctaaggaagtacaagatgcgcgagcctatcatgaaggccgacatgctcaaggtggtggacgaaaaatacaaagatcattttacagagatactgaacggcgcctcccgcagactggaactcgtctttggtctcgacctcaaggaggataatccttccgggcatacatacaccctcgtcagtaaacttaatctgaccaatgacggaaatcttagtaacgattgggactttccgcgcaatgggttactaatgccactcttgggcgttatcttcctcaaaggaaacagtgccaccgaagaggagatttggaagttcatgaacgtgctaggcgcgtacgacggagaagagcatttaatatacggcgagccccgcaaatttatcacccaggacttggtacaagagaaatacctaaagtacgaacaggtgcctaattctgatcctccacgctatcagttcttatggggacccagggcctatgctgagacaaccaagatgaaggtgttagaatttctagctaaaatgaacggcgccacgcctcgcgacttcccgagccattacgaggaggctttgcgggatgaagaggaacgggcccaggtgagaagctctgtgcgggcccggcgaagaactacagctaccaccttcagagctagatcaagggcacccttttctagatccagtcatcctatgtag

SEQ ID NO: 194667 - DNA, 1044 bp, Artificial Sequence
  Description of Artificial Sequence: Synthetic coding sequence
atgccccggggccagaagagcaagctgcgggcccgggagaagcggcgacaggcccgaggaggtctggaggatctgattgatgccctggacattctcgaagaagaggaggaaagtcctcctagtgcaagtgcatgtctcaaggacgtgtttcaaagctcgctggacggtgctagcaacaacccccacggcttgcgggaagctcaatccaccagtacatctgctaccgccgcttctcatactagacaccccgagggggtaaatgaccaaatggaggagaggccaatctgcacacaggacctggaagccacagactcgtttcctaggggcccagtggacgaaaaggtgatcatcctggtgcactacctgctgtataagtatcagatgaaggagccaattacgaaagcggatatgctgcgaaacgtgacccaaatgagcaagagccagtttccggttattctttcacgtgcctccgagcacctggagctgatcttcgggctcgacttaaaggaggtggaaccaaacaagcacatttacgtgctggtgaacaagcttgacttgggctgtgatgcaaagctgagcgacgagactggggtgcctaaaacagggcttctaatgactgtcctgggaattatctttacaaatggcaattgtgtggctgaagaggaggtctggaaggtcttcaacaccatgggcctctacgatggcatcgaacacttcatgtttggcgaacctcgtaaattattaacaaaggacttagtgaaagaaaactacttggaataccagcaggttcccaactctgatccacccaggtatcagtttctctggggtccccgggcccacgccgagacaagtaagatgaaggttcttgagtttttggccaaagtgaacgacactgcaccctcagagttctcgaactggtacactgaagcgcttcaggacgaagaagaaagggcccgggctagggtggcagctaaagcccgggtcagcgccacggctggcgcaagatcaaaggtgaagagtagcaagagttcgcagctccagtag

SEQ ID NO: 194668 - DNA, 975 bp, Artificial Sequence
  Description of Artificial Sequence: Synthetic coding sequence
atgagccaggaccaggagagcccccggtgcacccacgaccagcacctgcaaactttcagcgaaacacagtctctggaggtggcgcaggtgagcaaggcccttgaaaagacattattgagcagctcccacccgctggtgcccggcaaacttaaggaggctccagcagccaaagcggaatcgcccctggaggttccacagagtttctgttctagctccatcgccgtaacaactacgtcctcaagcgagtcagatgaagcatcgtctaatcaggaggaggaggacagccccagcagctctgaagatacctcagacccccgcaacgtccctgccgatgccctcgaccagaaggtggctttcctagtgaattttatgctacacaagtgtcagatgaagaagccgatcactaaggctgatatgttgaagattatcataaaagacgacgagtcacacttttccgagattctgcttcgggccagtgagcatttagaaatgatcttcggtctggacgtggtggaagtagaccctactacgcactgctatggtctcttcattaagttagggttgacctacgatggcatgctgtccggtgagaagggagtgcctaagacaggcctgctcataatagtcctaggcgtgattttcatgaaggggaatagggctaccgaagaggaggtatgggaggtgttgaaccttaccggggtttactccgggaagaaacactttatctttggagaacccaggatgctgattacaaaggatttcgtgaaggaaaagtacctggagtatcagcaagttgcaaacagcgatccggctcggtatgaattcctctggggaccacgcgccaaggctgaaacatccaagatgaaagtcctggagttcgtggcaaaagtccatggttcatacccccactcatttcctagtcagtacgccgaagcactgaaagaagaggaagaacgggctcgcgctcggatctag

SEQ ID NO: 194669 - DNA, 975 bp, Artificial Sequence
  Description of Artificial Sequence: Synthetic coding sequence
atgagccaggaccaggagagcccccggtgcacccacgaccagcaccttcagactttctctgaaacccagagcctggaagtggcgcaggtcagcaaggccctcgaaaagacccttttgtcaagctcacacccattagtgccgggtaagctgaaagaagctcccgccgccaaagctgaaagtcccctggaggtgccccagagcttttgcagctcttcaatcgcagttactaccacttctagcagtgaaagcgatgaagcctcatcgaaccaggaagaggaagacagccccagttcctctgaggatacctccgatccaagaaatgtgcctgccgacgcgctggaccagaaagttgcgttcttggtgaactttatgctgcataagtgccagatgaagaagcccatcaccaaagcggacatgcttaagatcatcattaaagacgacgagtcccacttttcggaaattctcctgagggctagtgaacacttggaaatgatcttcggactggacgtcgtcgaagtagatccaactacccactgctacggactgttcattaaactcggcctgacttatgacggcatgttgtcaggggaaaagggcgtgccgaagaccgggctgctcatcatcgttttgggcgtgatttttatgaagggcaatagagccaccgaagaagaagtgtgggaagtgctgaacctgactggtgtgtacagcggaaaaaagcacttcatctttggagaaccacgcatgctgattactaaagattttgtcaaggaaaaatatcttgaataccagcaggtcgccaactctgatcccgccaggtacgaatttctctggggcccccgcgctaaagccgaaacctccaagatgaaggtccttgagttcgtggccaaggtgcacggctcctatccccactctttcccttcccagtacgcagaggctttgaaggaggaggaggagcgagctagagctagaatatag

SEQ ID NO: 194670 - DNA, 975 bp, Artificial Sequence
  Description of Artificial Sequence: Synthetic coding sequence
atgagccaggaccaggagagcccccggtgcacccacgaccagcacctccagaccttctcggaaactcagtccttggaggttgcgcaggtttccaaggcactagaaaagaccctcctttctagctcgcaccctctggtgcctggtaagctgaaggaggccccggctgcgaaagcagagtctccactggaggtcccccaaagcttctgtagttcctccatcgcggttacaaccacaagctcctccgagagcgacgaggcctcgtctaaccaggaggaagaggactcgccctcttcttcggaagacacgtctgaccctcgcaacgtgccagccgatgctctggaccagaaagtagccttcctggttaatttcatgcttcacaaatgtcaaatgaaaaagcctatcacaaaggccgacatgctcaagatcataatcaaggacgacgagtcccatttcagcgaaatattactgcgcgcttcagaacatttggagatgatcttcggtttggatgtggttgaggtcgacccaaccacccattgctacgggctctttattaagctagggctgacgtatgacggaatgctgagtggggaaaagggcgtgcctaagaccggcttgctgatcatcgtgctgggagtcattttcatgaaggggaaccgagcaaccgaggaagaggtgtgggaagttctgaacctaactggcgtatactccggcaagaaacacttcatcttcggagaacctcgcatgcttataacaaaagatttcgtaaaagagaaatatctggagtaccagcaggtcgcaaactccgatcctgccagatatgaattcctgtgggggccaagagcgaaggccgagacatctaagatgaaggttctcgaattcgtggctaaggtgcatggctcatacccacactcatttccgagtcagtatgctgaggctctgaaagaagaagaggaacgggcccgggcccggatttag

SEQ ID NO: 194671 - DNA, 975 bp, Artificial Sequence
  Description of Artificial Sequence: Synthetic coding sequence
atgagccaggaccaggagagcccccggtgcacccacgaccagcacctacagacatttagtgagacccagagcctggaggtagcccaagtgagtaaggccctagagaagaccctgcttagctccagtcatcctctggtaccagggaagttgaaggaagcacctgcggctaaggcagaatcacccttggaggtgccgcaatcattctgctcatcttcgatcgccgtcaccaccaccagtagcagcgagtccgatgaggccagctctaatcaggaagaagaggatagcccaagttcatcagaggataccagcgatccccgcaacgtgcccgctgacgcactggaccagaaggtggcttttcttgtgaacttcatgttgcacaagtgtcaaatgaagaaaccaatcacgaaggcagatatgctcaagattatcatcaaggatgatgaatctcacttctcagagatcctcctgcgggcaagcgaacacttggagatgatttttggtctcgacgtggtcgaggtggacccaacaacccattgttacggcttgtttattaagctcggacttacctatgatggaatgctctctggcgaaaaaggggtacccaagaccggattgttaattatcgtgctcggggtaatctttatgaagggtaatcgagccaccgaggaggaagtctgggaagtgttgaatctgacaggtgtttactcaggcaaaaagcatttcatattcggagagccacggatgctgatcacgaaggacttcgtgaaggagaagtatctggaataccaacaggtggccaatagtgatccagcgcgatatgaattcctctggggacctcgcgcaaaagcagaaacttccaaaatgaaagtgctggaattcgtagcaaaagtgcacggtagttatccccattcttttccaagtcagtatgccgaggctctgaaggaagaggaggagagggcaagagccaggatttag

SEQ ID NO: 194672 - DNA, 1071 bp, Artificial Sequence
  Description of Artificial Sequence: Synthetic coding sequence
atgggcaccgaggcccagcccgtggtgaaggccgtgatcctgcactgtctgccctcctgtccccactcgtgcttgcttcctccaacccgcgttatcatgtcccaggaccaagaatctccccggtgtacgcatgaccagcatctccaaacgttttctgaaacccagagccttgaagttgcgcaggtctccaaagcgctggagaagaccctgctgagctcaagccatccattagtgcctgggaagttgaaagaagctcccgcagccaaagcagagagccccctcgaggtcccacagagtttctgcagctcttctattgccgttacaaccacgtcaagctctgaatccgacgaggcgtctagcaaccaggaggaggaggactccccctcttctagcgaagacacatccgacccacggaatgtgccagcagatgccctcgatcaaaaagtagctttccttgtgaacttcatgctccataagtgtcagatgaagaagcctattacaaaggctgacatgctgaagatcattattaaagatgatgagtcccacttctctgagatcctgctgagggcctctgaacacttggagatgatcttcggtctggacgttgtggaggttgatccgacaacccattgctatggcctgtttatcaagctgggtctgacgtatgacggaatgctcagcggcgagaaaggtgtgcccaagaccggattactcataatcgtgctgggcgtgatctttatgaagggtaatcgggcaaccgaagaagaggtgtgggaggtgcttaacctgacaggcgtatactcaggaaaaaagcatttcatctttggagaaccccgaatgcttattaccaaggatttcgtgaaggagaaatacctggaatatcagcaagttgcgaatagtgacccggcccggtatgagttcctgtgggggccccgcgccaaagctgagactagcaagatgaaggtcctggagttcgtcgccaaagtgcatggctcttatccacacagtttcccgagccaatacgccgaggctttgaaagaggaagaagagagagcccgagctcgtatctag

SEQ ID NO: 194673 - DNA, 996 bp, Artificial Sequence
  Description of Artificial Sequence: Synthetic coding sequence
atgccccggggccaggccagcaagcggcgggcccgggagaagcggcgccaggccaggggtgaggaccaatgcctgggcggtgcacaggccacggcagctgagaaggagaaactcccttcctcgtcatcccctgcgtgtcagagcccaccacaaagttttccaaacgctgggattccacaagaaagccaaagggcgtcttacccttctagccccgcgtcagctgtgagcctgacatcaagtgatgagggcgccaaaggccagaagggtgaatcccctaatagcttccatggcccctcatctagcgagtccacagggcgggatctgctcaataccaaaactggggagctggtccagttcctgcttaacaaatatatcagaaaggaacctatcacgagggaggcaatgcttaaagtgatcaacagaaagtacaaacaacacttcccagagattcttaggcgcagtacagaaaatgtagaggtagttttcggtctgtacctgaaggagatggatccgtctcggcaatcctatgttctagtgggaaaactggactttcctaatcaggggagtttgtctgacggcggcggattcccgctcagtggattgctcatggtactgctgtcaactatttttatgcacggcaatcgggccactgaggaagagatgtgggagtgtctcaacgccctcggcatgtacaaaggacgcaaacacttcatctacggcgagccgcaggaacttgtgacaaaagaccttgttcgagaaggctatctggagtatcaacaggtgccttcaagcgaccctccaaggtatgagttcctgtggggcccacgggcccgggcagagacatccaagatgaaggtgctggaattcgtcgcgaagttgaacgacaccgtcgctagtacatataagtctagatatgaggaagccctgcgcgaggaggaggaacaggctagggcacgtgccgttgctagggactcagctagggcccgcgcctcatag

SEQ ID NO: 194674 - DNA, 1011 bp, Artificial Sequence
  Description of Artificial Sequence: Synthetic coding sequence
atgccccggggccaggccagcaagcggcgggcccgggagaagcggcgtcaggcacgcggcgaagaccaatgtctcggtggcgctcaggccactgccgccgaaaaggagaagctacctagctccagctcaccagcatgccagagccccccccagtctttccctaatgctggtatcccgcaagaaagccagcgcgcctcttatccatcgtctccggcttccgcagtgagccttaccagttccgatgaaggcgccaagggccagaagggcgagagtcccaactcttttcacggccccagctcaagtgaatctacgggtagggacctcctcaatacaaagaccggagaactagtgcagttcttgctcaataagtatatccgaaaagagcctatcacgcgagaagctatgctgaaagtcataaatagaaaatacaagcagcactttcccgaaattctgagacgatctacagagaatgtggaggttgttttcggactgtaccttaaggagatggatcctagtagacagtcatatgtgctggtcgggaaacttgatttccccaatcaaggatccctttcagatggcgggggatttcccctctcagggttgctcatggtgctgctgtctactatcttcatgcatgggaaccgggccaccgaggaggaaatgtgggaatgcttgaacgcactcggcatgtacaagggacggaagcactttatctacggggagccccaggagcttgtcaccaaagatctggtgagggaggggtacttggaatatcagcaggttccttcttccgatccccctagatacgagttcctctggggacctcgcgctcgggctgagacaagcaagatgaaggtgctcgagtttgtggcaaagctcaatgacactgtggcctcaacctacaaaagtagatacgaagaggccctgagagaagaagaagaacaggcccgggctcgcgccgtggcccgtgatagcgctcgagcacgcgcgtcgcgatcctttcagccttag

SEQ ID NO: 194675 - DNA, 1011 bp, Artificial Sequence
  Description of Artificial Sequence: Synthetic coding sequence
atgccccggggccaggccagcaagcggcgggcccgggagaagcggagacaggctcgaggagaggaccagtgcctcggcggagcacaagcaactgcagctgagaaggaaaaattgccgtccagttcaagccctgcatgccaatcgccccctcagagcttcccaaatgccggaattcctcaagagtctcagagggcctcatatcccagtagtcctgcttccgcagttagcttgacatcaagtgacgagggagctaagggtcagaagggtgaaagtcctaactccttccacggaccctcctcatcagaaagtaccgggcgggatctgctgaataccaagaccggggagctcgtccagttcctgctcaacaaatatattaggaaggaacccatcacaagggaggcgatgctcaaggtcatcaacaggaaatacaagcagcattttcccgagattctgaggcggagcacggagaacgtggaagtggtgtttggactctacttgaaggagatggatccgtcccggcaatcctatgtgctggttggtaaattagatttcccgaatcaaggttcactaagcgatggcggcggcttccctttatccggtctactgatggtgctactgagcacaatattcatgcacgggaaccgggcgactgaggaggagatgtgggagtgtctaaatgccttaggaatgtataagggacgcaagcatttcatctatggcgagcctcaggaacttgttactaaggatctggtgcgggaaggatacttggaataccagcaagtgcctagctccgaccctcctcggtacgagttcctttggggaccaagagcgcgggccgagaccagtaaaatgaaggtcctggaatttgtagccaagttgaatgatacagtggcatccacctacaagagccgatatgaggaggctctccgtgaagaggaggaacaagccagggcccgagcggtagccagggatagcgcacgggcacgcgcttccaggtcattccagccatag

SEQ ID NO: 194676 - DNA, 960 bp, Artificial Sequence
  Description of Artificial Sequence: Synthetic coding sequence
atgccccggggccagaagagcaagctgcgggcccgggagaagcggagaaaagctcgtgacgagacacggggactgaatgttccccaggtgactgaggccgaagaggaagaggcaccctgttgttccagctccgtatcgggaggcgctgcttcctcaagtccggccgccggaattccacaggagccgcagcgggcaccaactacagcagccgccgccgccgcgggcgtatcctcaacgaaatcaaagaagggggccaagtcacatcagggtgaaaaaaacgcaagcagctctcaagcctctacaagcactaaaagcccctccgaagacccgctcacacgcaagagcggctcactagtccaatttctcttgtataaatacaaaattaagaagagtgtgactaagggcgagatgctgaaaattgtgggtaagaggtttagggaacattttcctgaaatcttgaagaaagcgtcagaaggcctgtccgtggtgttcggacttgagctgaataaggttaacccgaatggtcacacatatacctttattgataaggtggatcttaccgatgaggaatccctcttgtcttcctgggatttcccacgtcgcaagttactgatgcctttgctaggcgtgatatttcttaatggcaactccgctaccgaggaggagatttgggaatttctcaatatgctcggggtttatgacggcgaagaacactccgtgttcggtgaaccgtggaagctgataactaaagatctagtccaggagaaatacttagagtataaacaggtccccagcagcgatcctcccaggtttcaattcctgtgggggcccagggcttacgcggagacaagtaaaatgaaggttctggagtttttagccaaggtgaatgggacaactccttgtgccttccctactcattatgaggaagcactgaaggacgaggagaaagccggtgtatag

SEQ ID NO: 194677 - DNA, 1041 bp, Artificial Sequence
  Description of Artificial Sequence: Synthetic coding sequence
atgccccggggccagaagagcaccctgcacgcccgggagaagcggcagcagacaagaggacagacccaggaccatcaaggggcccaaataacagccaccaacaagaaaaaagtttcctttagtagcccactgatacttggcgctacaatccagaagaaatcagccggacggtcgcgcagcgccctcaagaagccacagcgggccctcagcacaactacctctgttgacgtgtcatataagaagagttataaaggggctaatagcaagattgaaaagaaacagagcttttcccagggtctgtcctccaccgtccagtcacggaccgacccactcatcatgaaaacgaacatgttagttcagttccttatggaaatgtacaaaatgaagaagcccatcatgaaggctgacatgttaaagatcgtccagaaaagccataaaaattgtttccctgaaattttgaagaaggccagcttcaatatggaagtggtgttcggagttgacctgaaaaaggtggactcgaccaaagattcctatgtgctggtgtccaaaatggatctccctaataacggaaccgtgaccaggggaagagggttccccaagacgggcctgcttctcaatttgctgggagtcatctttatgaagggcaattgtgcaactgaagagaaaatctgggagttccttaataagatgcgtatctacgacggaaagaagcactttatttttggtgaaccccgaaagctcatcacccaggacctggtgaagctgaaatatttggaatatcggcaggtgccgaattcaaaccctgctaggtacgaattcctgtggggcccaagggcccacgcagaaactagtaagatgaaagtgttagaattttgggccaaggtcaataaaaccgtacccagtgctttccagttttggtatgaagaggccttgcgcgacgaggaagagcgtgttcaggctgcagcaatgctgaacgacggcagcagtgcaatggggcggaaatgttctaaagccaaggcgagtagctcttcccatgcctag

SEQ ID NO: 194678 - DNA, 1041 bp, Artificial Sequence
  Description of Artificial Sequence: Synthetic coding sequence
atgccccggggccagaagagcaccctgcacgcccgggagaagcggcagcagacccgtggacagacccaggaccatcaaggagcccagatcacggccacgaataaaaagaaagtctccttctccagccctcttatcctgggggccactattcaaaagaagagcgctggcagatcccgatctgccctgaagaagcctcagagagctcttagtactacgaccagcgtggacgtgtcatataaaaagtcttataaaggcgcaaatagcaaaattgaaaaaaagcagagtttttcccaaggcctcagcagcacagttcagagccgcacggacccactgatcatgaagacaaacatgctggtgcagtttctgatggaaatgtacaaaatgaagaagcccattatgaaggccgatatgctaaagattgtccaaaagagccataaaaactgcttccccgaaatcctgaagaaagcatctttcaacatggaggtggtgtttggtgtcgacttaaagaaggtggactccaccaaagacagttatgttctagtatccaagatggacctgcccaacaatggaacggtgactcgaggccgaggcttcccgaaaactggcttactgctaaatctactgggggttatcttcatgaaaggcaattgtgcaactgaagaaaaaatctgggagttcctgaacaaaatgcggatctacgatggaaagaagcattttatttttggcgagcccagaaaacttatcacacaggaccttgtgaagcttaagtacctcgagtaccgtcaggtcccaaactctaatccagccagatatgagtttttgtggggcccaagggctcatgcggagacatccaagatgaaggtgctggagttctgggctaaggtcaacaagacagtgccgagcgcttttcagttttggtacgaagaagcacttagggatgaggaggagagagtccaggccgctgcaatgcttaacgatggctccagcgccatgggtagaaagtgttccaaagctaaggcaagtagctccagtcatgcctag

SEQ ID NO: 194679 - DNA, 1041 bp, Artificial Sequence
  Description of Artificial Sequence: Synthetic coding sequence
atgccccggggccagaagagcaagctgcgggcccgggagaagcggcagaggaccagaggccagacacaagatctgaaggttgggcagcctacggctgcagaaaaggaggagagcccctcctctagttcttctgtgctgagggatacagctagttcttcgttggcctttggtattccccaggaaccacagcgagaaccaccaacaactagcgcagccgcggccatgagttgcacaggctctgataaaggggatgagtcccaggatgaggaaaatgcatcgtcgagtcaggccagcacaagcacggagaggtctctaaaggattccctgaccagaaaaaccaaaatgctcgtacagttcctgctatacaagtataagatgaaagaaccgaccaccaaggcggaaatgctgaagatcattagcaaaaagtataaagagcactttcctgaaatctttagaaaagtctctcaacgcacagaattggtttttgggttagccctgaaggaggtgaaccccactactcatagctatattcttgtgagcatgctcggccctaacgatggaaatcaaagctccgcttggacgctccccagaaacggcctactgatgccccttctgtctgttattttccttaatgggaattgtgcaagagaggaagaaatctgggagtttctgaacatgttaggcatctatgatgggaagcgtcacttaatttttggtgagccaagaaagctgattactcaggacctggtccaggaaaaatacctggagtaccagcaggtgccaaacagcgaccctcccaggtaccagtttctgtggggcccaagagcgcacgcagagacgagtaagatgaaggttctcgagtttctggccaaggtcaacgacacaacgcctaataatttcccccttctttatgaggaggccttacgcgacgaggaggagcgggccggagcccgacctagggtagcagccaggcggggaacaaccgctatgaccagtgcatactcacgtgccactagctccagtagctcccagcccatgtag

SEQ ID NO: 194680 - DNA, 828 bp, Artificial Sequence
  Description of Artificial Sequence: Synthetic coding sequence
atgaccagcgccggcgtgttcaacgccggcagcgacgagcgggccaattcccgggatgaagagtatccttgttcttctgaagtgtctccgtctactgaatcatcctgtagcaacttcataaatattaaagttggcttactggaacaatttttgttatataaattcaaaatgaaacagcggatcctgaaggaggacatgctgaagatagtcaacccaagatatcagaaccaattcgccgagatccataggagagccagtgagcacatcgaggtggtgttcgccgtggacctgaaggaggtcaacccaacctgccacctgtatgacctggtgtctaaacttaaactgcccaataatggccgtattcacgtgggtaaagttctccctaaaaccggactgctcatgaccttcctcgtggtgatcttccttaagggtaactgtgctaataaagaggatacgtggaagttcctggacatgatgcaaatctacgatgggaaaaagtattatatttatggagagccacgtaagctgatcactcaggactttgtaagattaacctacctcgaatatcatcaggtcccctgcagctaccctgcccactaccagttcctgtggggccccagggcctacaccgagacctctaagatgaaagtgcttgaatatctggcaaaggtaaatgacatagcaccaggcgccttttcttcccagtacgaagaggccttgcaggatgaggaggagtcgccctctcagcgctgctctcgcaactggcactactgttctggacaggattgtcttcgggccaaattctcctccttcagtcagccttactag

SEQ ID NO: 194681 - DNA, 1224 bp, Artificial Sequence
  Description of Artificial Sequence: Synthetic coding sequence
atgccccggggccacaagagcaagctgcggacctgcgagaagcggcaagagactaatggacagccccagggcctgaccgggccccaggcgacagctgagaaacaggaagaatcacacagctcttcttcttcgtcaagagcatgtctcggagactgcaggcgcagctcagatgctagcattccgcaggaatcacaaggggtgagtcctactggctcccccgatgctgtggtgagttattccaaaagcgatgtggctgccaacggtcaggacgaaaagagtcccagcacgtcccgtgatgctagcgtacctcaggagtctcagggcgcgtcaccgactggatcgccggatgccggcgtgtcagggtccaagtacgacgttgcagccaacggtcaggatgagaaaagtcctagtacatcacacgacgtttcagtgcctcaagagtctcagggggcttccccgacgggctctcccgacgccggtgtgtccggatctaagtatgacgtagccgcagaaggagaggacgaagagagtgtgagcgcatcacaaaaagctataatcttcaagaggctctcaaaggatgctgtaaagaaaaaggcctgcaccctcgcccagtttctgcagaagaaatttgaaaaaaaagagtctatcctgaaagctgatatgctgaagtgcgtgcgtagggaatataagccatacttcccacagattcttaatcgcacttcccagcatctggtggtggcctttggtgtagaactgaaagaaatggattcctcaggggaaagctacactctggtttccaaactgggactaccatccgaagggattctaagcggagacaacgctttgcccaaatcaggcttacttatgagtctactcgtggtcatttttatgaatggcaattgtgccacggaggaggaggtctgggaattcctcggattgctcggaatctacgacggtattttacactccatctacggcgatgcccggaagatcatcacagaggacttggtgcaggataagtatgtggtataccggcaagtatgtaatagtgatcccccttgctatgagttcctatgggggccccgggcatacgcagagacaaccaagatgcgcgtgcttcgggtgctggccgattcatctaatacttcgcctggactgtacccccacttatatgaggacgcccttatcgatgaagtggagcgggccttgagactccgagcatag

SEQ ID NO: 194682 - DNA, 3429 bp, Artificial Sequence
  Description of Artificial Sequence: Synthetic coding sequence
atgggcgacaaggacatgcccaccgccggcatgcccagcctgctgcagagttcgagcgaatcaccccagagctgtccggaaggagaggactcgcagtctcccttgcagatccctcaaagcagccctgagtccgacgacacactttatcctctacagtccccgcagtcacggtccgaaggggaagattcctctgatcccctccagcgtcctccagaaggaaaggatagccagtcgcccctgcagatcccgcagagcagccccgaaggcgacgatacacagtccccacttcagaactcccagtcttcccccgagggaaaagactctctcagccccctggagataagccagtctcctccagaaggtgaagacgtgcagagccctctacagaatccagcctccagcttcttcagttccgccctgttgagcatcttccagagttcacctgaatcaacgcagtctcccttcgagggctttccccagagcgtgcttcaaataccagtttcggccgcctcttctagcaccttagtttctatcttccagagttcgccagagtcaactcagtctccattcgagggtttcccacagagtcccttgcaaattccagttagtcgatccttctcatctaccctcctctctatcttccagtccagcccagaacggacccagagtacgtttgaaggatttgcccagagtccactgcagatccctgtttctccctcaagcagtagtacactgttgtctctgttccagtcattttccgaaagaacccagtctacattcgaaggctttgcgcagtctagcctgcagattccagtgtctccaagctttagttctacattggtatcgctgttccagtcatccccagagcgcactcagtccacctttgaggggttcccccagagtcctctgcagattccagtgagcagcagcagtagttctacccttctgtcattattccaaagttctcctgagcgcacacatagtacctttgaagggttccctcaatctcttttgcagatcccaatgactagctcatttagtagtacactactgtcaatcttccaatcttcacctgaaagcgctcaatctacatttgaggggtttccacagtctccgctacaaatccctggttctccctcatttagctctactttgttgtctctcttccagtcctccccggaaaggacgcactccaccttcgagggttttccgcagtcaccactgcaaattcccatgacatcttccttctctagcactctcctttcgatcctgcagtctagccccgaatctgctcagtctgctttcgaggggtttccgcaatctccattgcagattcccgtctcctcctcattcagctacacccttctcagcctcttccaatcctcacctgagcgcactcatagtacttttgagggattcccccaatctccccttcagatccctgtgtcgtcttcgtcctcaagctcaactctgctgtctctttttcagagtagtccagaatgtacccagagtacatttgaggggttcccccagagtccattgcagatcccccagtctccaccggagggagaaaatacacactcccccttgcagattgtcccaagtctccctgagtgggaggactccctcagcccccactatttcccacaaagccctccccaaggcgaggactccctgagcccacactacttccctcagagccccccacaaggcgaggactctctgagccctcactactttcctcagtctccgcagggcgaagactcactgtccccacactactttccccagtcaccacctcagggggaggattccatgtccccactttatttcccccagagccccctacagggagaagaatttcagtcttcactccagagcccggtgtctatctgcagttcgtccacaccttcctcactcccacagagctttcccgagtcctcacagtctccaccggagggacctgtgcagagtccactgcactctccacagtccccccctgaggggatgcactctcagagccccctacaatcacccgagtctgcacccgaaggggaagactctcttagcccattacagatccctcagtctcccctggaaggagaggatagccttagcagccttcacttcccccagtcccctcccgagtgggaagacagcttgagccctctccatttcccgcagttcccacctcagggagaagattttcagtctagtctccagagccctgtatccatctgtagctccagtacgtcactgtccttaccgcagagcttcccggaatccccacaaagtccaccagaagggcccgcccagagtcccctccagcgcccagtcagtagttttttctcctataccctggcatcgctgctgcaatcctcacatgagagcccgcagtccccccccgaaggtcctgctcagtccccccttcaatctcctgtaagtagttttcccagctcaacatctagctcattgagccagtctagcccagtgtctagtttcccttcctccacatcttcctccctgagcaagagcagcccagaatccccgctgcaatcgccagttataagcttcagctctagcaccagcctcagtccattcagcgaagaatccagttcgcctgtggacgagtacaccagcagctctgatacactgctggaatctgattccctcacagacagtgagtccctcatagagagcgaaccgctctttacctacacactagatgagaaggttgacgagcttgctcggttccttctgctcaaatatcaggtcaagcagcccattacgaaagcagagatgctcaccaatgttatatctagatataccggctatttcccagtaatttttaggaaggccagggaatttattgagatactttttgggatctccttgcgcgaagttgatcccgatgattcgtacgtgttcgtaaatactctggatttaaccagcgaaggatgtctgtcggacgagcagggtatgtctcagaaccggctacttattctgattctgtcaatcatattcatcaaaggcacgtacgcctctgaagaggtgatttgggatgtgctctctggaataggggtcagggctggcagggagcactttgccttcggcgaaccacgggagcttttgaccaaggtgtgggtccaggagcactacctagagtaccgggaagtgcccaactctagtccacctcggtatgagttcctgtggggaccccgcgcccattccgaggtgatcaaaaggaaagtcgtggagttcctcgctatgctgaagaacacagtgccaattacattccccagcagttacaaggatgcccttaaagatgtcgaggagcgcgcccaggcgattattgacacaaccgacgacagcactgcaacagagagcgcatcctcttctgtcatgtctccatcattctcctcagagtag

SEQ ID NO: 194683 - DNA, 354 bp, Artificial Sequence
  Description of Artificial Sequence: Synthetic coding sequence
ggcgacaaggacatgcccaccgccggcatgcccagcctgctgcagtcatcttcagaatctcctcagtcatgtccagagggcgaggatagccagtctccattacagatcccagtctctcccagcagctccagcaccctgctgtctcttttccagagtttttcagagcgcacccaaagcactttcgaaggttttgctcagagctcgctccaaatcccagtgagtccgtccttttcttccactttggtcagcctgttccaatcatcacccgagcggactcagtccaccttcgagggttttccccagagccccctccaaatccccgtgtccagctcttcatccagtacactgctgtag

SEQ ID NO: 194684 - DNA, 357 bp, Artificial Sequence
  Description of Artificial Sequence: Synthetic coding sequence
atgggcgacaaggacatgcccaccgccggcatgcccagcctgctgcagtccagtagcgagtcccctcagtcttgtcccgagggtgaagactcccaatcacccttgcagatcccggtctcgccctcctcctcttcaactctgctgtccctcttccagtcgttttcagaacggacgcagtctacttttgagggctttgcacaatcctccctgcaaatcccagtcagtcccagtttcagcagcaccctggtttcactctttcagtctagtcccgaacggactcagagtacattcgagggtttcccccagagcccgttgcaaatacccgtctcgtcatcatcttcctccactctactgtag

SEQ ID NO: 194685 - DNA, 630 bp, Artificial Sequence
  Description of Artificial Sequence: Synthetic coding sequence
atgctgaccaacgtgatcagccggtacaccggctacttccccgtgatcttccggaaggcgcgagaattcatagagatattgttcggaatcagcctgcgggaggtggaccctgacgactcgtatgtatttgttaacacactggatctaacgtcagagggctgcctgtctgacgaacagggcatgtcccagaaccgtctcttaatcttgatcctgtctatcatcttcatcaaaggcacatatgctagtgaggaggttatttgggatgtattgtcaggcatcggagtaagagctggtcgtgaacacttcgcctttggggagcctagggaactactgaccaaggtgtgggtccaagagcactatttagagtacagggaggtgcccaattcatctcctcctcgatacgaattcctctggggtcctcgggcacactccgaggtgattaagaggaaggtggtcgaattcctagcaatgttaaagaacacagtcccaattacatttcccagtagttacaaggatgcactgaaggatgtggaggaaagggcccaggccatcattgatacaactgacgactcaactgccactgaaagcgcttcttcaagcgtgatgagtccctcattcagctccgagtag

SEQ ID NO: 194686 - DNA, 1122 bp, Artificial Sequence
  Description of Artificial Sequence: Synthetic coding sequence
atgccccccgtgcccggcgtgcccttccggaacgtggacaacgactctcccaccagcgtggagctggaagattgggttgacgctcagcatccgacagacgaagaagaggaggaggcttcgtccgcttctagcaccttatacttggtcttcagcccctccagcttcagcaccagttcaagcctgattctgggggggcccgaggaggaggaagtgccgtccggtgtgatcccgaatttaaccgaatccatacctagttccccccctcaaggacccccacagggtcctagccagtcccccctttcgagctgttgcagctccttctcatggtcctctttttcggaagaaagtagttctcagaagggcgaagatactggcacatgccaaggcctgccggactcagagagctctttcacgtatactcttgatgagaaagtggcagagttggtagagtttttgctcctgaagtacgaagcagaagagcctgtcacagaagcggaaatgctgatgatcgtcattaaatacaaagactattttccagtgatcttaaaacgagcgagagagttcatggaactgctcttcggactcgctctgatcgaagtcgggcctgatcacttttgcgtcttcgccaatacggtggggctcaccgatgaagggagcgacgatgaagggatgcccgagaatagcttgttaattatcatcctgtctgtcatttttattaaaggtaattgtgctagcgaagaggtcatttgggaggtccttaacgccgtgggggtctacgcgggcagggagcattttgtgtacggagaaccccgcgaactgttgactaaggtgtgggtgcagggtcactacctggaatatcgagaggtgcctcattcctcccctccctattatgaattcctatgggggccaagggcacacagtgagtcaatcaaaaagaaagtgctcgaattcctcgctaagcttaacaatacagtgcccagtagttttccttcttggtacaaagatgctctgaaggatgttgaggaaagagtgcaggctaccattgacaccgcagatgacgccactgtcatggctagtgagtccctgtcagttatgtcctctaacgttagcttctctgaatag

SEQ ID NO: 194687 - DNA, 1932 bp, Artificial Sequence
  Description of Artificial Sequence: Synthetic coding sequence
atgctgctgccctgccactgggtgctggacgccaccttcagcgacggaagtctcggccagtgggtgaagaatacctgcgccacatacgctctcagtcccgtggtcttacctccccaaccacagccacgaaagaaagcaactgataaggattacagtgccttccacctgggccatttgcgcgaggtcaggctgttcctgaggggcggcacttccgatcagcgcatggatagcctggtcctgtgccccacctacttcaagttgtggaggactctgtccggatctcctggcctacaacttagtgatctgcacttcggaagtcagccagagggcaagttctctctgcggcgggctgtgagcgtcaagcagagagaggagccccaggactggcccctgaatgagaagcgcaccttgtggaaagattccgacctgccaacatggcgaagggggaccgggtacactctgtccctccccgctgtttccccaggaaagagactttggggcgaaaaagctggctctttacccgagagcgagcctctctttacatatactctcgacgaaaaagttgacaagctcgtccagttcctccttttgaaataccaggccaaagagccattgacccgcgcggaaatgcagatgaatgtgatcaatacctacactggatacttccctatgatcttcaggaaagctagggagtttatcgagatcctgttcggcatttcactcaccgaagttgatccggatcacttttatgtctttgtgaatacattagatctgacttgcgagggatctctgagtgacgaacaggggatgccccagaatagattgctgattctcatcttgtctgtcatcttcatcaagggcaactgcgcttccgaagaggttatatgggaagtactaaatgccataggcccctggtccgccttggctggcttcgctgatgtcctgagtcgcctggcgttatgggaatctgagggcccagaagccttctgcgaggagtcaggtttaagaagcgcagagggatcggtcttagatttggctaaccctcagggcctggctggtcaccggcaggaggacggtcgaaggggactgactgaggccagcccccaacagaagaaaggaggcgaggatgaggatatgccagcagccgggatgcccccgctgccccagtcccctcctgagatccctccgcaaggtccccctaagatctccccacaaggacccccgcagagccctccccagtctcctctggattcatgttcttcacctctgttatggacaaggctcgatgaggaatcctcaagcgaagaggaagataccgcaacctggcacgctctccccgaaagcgaatcactccccaggtatgccctcgatgaaaaagtcgcagagttggtgcagttcctgctgctgaaataccagactaaggagccagtaaccaaggcggagatgctgacaactgtgatcaagaagtacaaggattatttcccaatgattttcgggaaggctcacgagttcatcgagttaatttttggcatcgccctgacagacatggaccccgataatcactcttacttcttcgaggacacgttggacctgacgtatgagggttccttaattgatgatcagggtatgcccaaaaattgcctgcttatcttgatcctgagcatgatattcataaaagggtcatgcgtgcctgaagaggtcatttgggaggtgctgagcgctatcggccccatccagcgccctgcccgcgaggtcctagagttcctcagtaaactgtcgagcattatcccgagtgcctttccttcctggtacatggacgctctgaaggacatggaggaccgcgcgcaggcaatcattgacacgaccgacgatgcgaccgccatggcttcagcgtccccatcagtgatgagcacaaacttttgcccggagtag

SEQ ID NO: 194688 - DNA, 801 bp, Artificial Sequence
  Description of Artificial Sequence: Synthetic coding sequence
atgcccgccgccggcatgccccccctgccccagagcccccccgagataccaccacagggacctccaaaaatctccccccagggaccaccgcagtcccccccgcagagccctctagactcgtgtagtagcccccttctgtggacccgacttgatgaggaatctagtagtgaagaagaagatacagctacttggcacgccctgcctgagtctgagagcttgccacgttacgcgctggatgagaaagtggcggaacttgtccagtttttgctgttaaagtaccagaccaaagaacccgtcacgaaggccgaaatgctaacaacggtaatcaagaagtacaaggactacttccccatgatctttggaaaagcccacgagtttatcgagttgatatttggcattgccctgaccgacatggatcccgacaaccattcatattttttcgaagataccttagacttaacctacgaagggagcctgatagatgaccagggcatgcccaaaaattgtctgctcatcctgatcttatctatgatatttattaagggtagttgtgttcctgaggaggtaatctgggaagttctgtcagctattggtgtctgcgcaggtcgggagcattttatttatggtgacccaagaaagctgcttacgattcactgggtgcagaggaagtatctggaataccgagaagttcctaattccgctccacctagatatgagttcctttggggacccagagcacactctgaagcttcaaaacgatctctgcgcgtgtttattcaggcgatccaataccacccttag

SEQ ID NO: 194689 - DNA, 381 bp, Artificial Sequence
  Description of Artificial Sequence: Synthetic coding sequence
atggacaccggccagctgcagctgagccgggagcggagccccggcgcaggtcaacaggctagacgcgaactgtgcgggcggatcgctatcagccaacacggggggaaggcgcaggcatcaccatcacactccttgttaagccctctagataaaaccgacggggagccttggtctgccctggccggatttgctgatgtgctttcccgccttgccctttgggagtccgaaggtcccgaagccttctgcgaggagtctggattgaggtcggctgaaggtagcgtgttggatttggcaaatccccaaggaaagggaccaaagggcgagctaagagacttcgcaccacgtactgaggaagccccggtttgccccgccctgccctag

SEQ ID NO: 194690 - DNA, 1041 bp, Artificial Sequence
  Description of Artificial Sequence: Synthetic coding sequence
atgcccctgttccccaacctgccccggctgagcttcgaggaggactttcaaaatccaagtgtaactgaggacctcgtggacgcccaggattcaattgatgaagaggaggaagatgccagttcaacttcctcgtcgtcattccactttctcttccccagctcatcctctctttctagcagcagcccgctgtcctctcccctgcccagcaccctgattctcggggtacccgaagacgaagacatgccagcagctggtatgccaccactcccacaatcaccccccgaaatccccccccagggtcctcccaagatttccccgcagggtccccctcagagtccaccgcagagcccgctggatagctgttccagcccactgctttggacacgcctcgacgaagagtcttcctctgaggaggaagacactgctacctggcacgccctgccggagtccgagtccctcccacgctacgcgctggatgagaaagtggctgagctggtgcaattcctcctgctgaaataccaaacaaaagagccagtgacaaaagcagaaatgcttacaaccgtgatcaagaaatacaaagactatttccccatgatttttggcaaggcccacgaatttattgagctgattttcggtatagcacttacagacatggatcctgataatcattcctattttttcgaagatacactggatctgacctatgaagggagtctgatcgatgatcagggaatgccgaaaaactgcctgctgatactgatcctcagcatgatcttcataaagggtagctgtgtccctgaggaggttatctgggaagtcttgtccgctatcggcgtgtgcgctgggcgtgagcactttatttacggggatccccggaagctccttaccatccattgggttcagcgcaagtatctggaatatcgggaagtccctaactccgccccacccagatacgaatttctctggggaccaagagcacattcggaggccagtaaaagatcactgagggtattcatccaagccatccagtaccacccatag

SEQ ID NO: 194691 - DNA, 1041 bp, Artificial Sequence
  Description of Artificial Sequence: Synthetic coding sequence
atgcccctgttccccaacctgccccggctgagcttcgaggaggactttcagaacccaagcgtgaccgaggacttggtcgacgcacaggactctatcgacgaagaagaggaggacgcctccagtacctcttcatcctcgtttcatttcctgttcccttcttctagtagcctgtccagctcatcacccctgagtagtccgctgccctcgacactgattctaggggtgccagaggatgaggatatgcctgccgccggtatgccacccttgccacagtctccaccagagatcccgccgcaaggccctccaaaaatatccccccagggccccccacagtccccacctcagagccctcttgacagctgtagttccccacttttgtggactcggttagatgaggagagtagttcggaagaagaggataccgcaacctggcacgccttgccagaatctgaaagcttgccacggtatgcgctcgatgaaaaggtggccgaactggtccaatttttgctcttaaaatatcagaccaaagaacccgtgaccaaggccgagatgctcaccaccgtgataaaaaaatacaaagactacttccccatgattttcggcaaagcccatgaattcatcgagttgattttcgggatcgccctcaccgatatggatcctgataatcacagctatttctttgaggacactctggacctgacctatgagggttctcttattgacgatcagggtatgcccaaaaactgccttctgattctcatcctgagtatgatttttatcaagggcagctgcgtgccagaagaggtcatttgggaggtgctgtctgcaataggagtatgcgctggacgtgaacacttcatctatggggatccccgcaaattgcttacaatccactgggtgcagcgtaagtacctcgaataccgagaagtgccgaattcagcccctcctagatacgagttcctctggggtccacgtgcccactccgaggcatcgaagaggtcgttgcgggtgtttattcaggctatccagtaccacccctag

SEQ ID NO: 194692 - DNA, 2337 bp, Artificial Sequence
  Description of Artificial Sequence: Synthetic coding sequence
atggcccagaagatggactgcggcgccggcctgctgggcttccaggcagaagcttccgtggaagattctgcccttttgatgcagacgctaatggaggctatccagatcagcgaagcacctcctacgaaccaggctaccgccgctgcaagcccacagtcatcccagcctcctacagctaatgagatggctgatatccaggtcagtgccgccgctgctcgaccaaagtccgccttcaaggtgcaaaacgccacaacgaaagggcccaatggcgtgtatgacttcagccaggcccataacgccaaagatgtcccaaacacacaacctaaagcagcttttaaatcccagaacgctacccctaaaggtccgaacgccgcctatgatttttcacaggctgctacaaccggtgagttggcggctaacaagtccgagatggccttcaaagcccagaatgccaccaccaaagtgggcccaaacgccacctacaacttcagccaatccctgaatgcgaatgatttagcaaacagcagacccaagactccgtttaaagcatggaatgacacaacgaaggcccctacggccgacacgcagacccagaatgttaaccaggccaagatggctactagccaggctgatattgagactgatcctggcatcagcgagccagatggtgcaaccgcgcagaccagcgcggatggttctcaggcacagaatctcgagtccaggacgattataagaggtaagagaactaggaagattaacaatctcaatgttgaagagaattctagcggagatcagcgacgcgcaccactagccgcaggaacctggagaagtgcgcccgtgccggttacgactcaaaatcctccaggagctccacctaatgtgctgtggcagacaccactggcctggcagaatccctcagggtggcagaatcagactgctcggcagaccccgcccgcccgtcaatcgccgccagcacgccagaccccgccggcctggcagaatcccgttgcatggcagaatcctgtaatttggcctaaccctgttatttggcagaaccccgttatatggcccaatcccatagtgtggccgggaccggtcgtgtggcccaatcccctggcctggcaaaatcctcccggctggcagacacctcccggatggcaaacccctcccggttggcagggccccccagattggcagggtcctccagattggcccctcccgccagactggcccctgccccctgattggccgctccctactgattggccattgccccccgattggatacctgccgactggcctattccaccagattggcaaaaccttcggcccagccccaacttacgcccgtcacctaatagtagagcctcccagaacccaggagccgctcaacctcgcgacgtggctcttctgcaagaaagggctaataagcttgtaaagtaccttatgctgaaggattacacaaaagtgccgatcaagcggagtgagatgctgagggacattattcgggagtataccgatgtttatcctgagatcatcgaaagggcatgtttcgtcctggaaaaaaaatttggaattcagctgaaggaaatcgataaagaagagcatctgtacatcctgatctccactccggaaagcttagctggaattctagggacaacgaaagataccccaaagttaggcctgctgctggtgattcttggagtcatcttcatgaatgggaatagagctagcgaggcggtgctgtgggaagccctccgaaagatgggcttgagaccgggagtacgtcatccactgctcggcgacctgcggaagcttttgacctacgagttcgtcaagcaaaagtacctggactacaggcgggttccgaattcaaaccctccagagtacgagttcttgtggggcctgaggtcttaccacgagacctccaaaatgaaggtgttgcggttcatcgcggaggttcagaagcgtgacccccgggattggaccgcccagttcatggaggcggccgacgaggcgctggacgcccttgacgctgcagcggctgaagcggaagcccgggcagaggctcgcaccagaatgggtatcggcgacgaagccgtctcaggaccttggagttgggacgatatcgaattcgaacttctgacttgggatgaagagggggattttggcgatccatggtccaggataccattcacgttctgggcaagataccaccagaacgcccgctcacgctttccccagactttcgccgggcccattatcggccccggtggaactgcttcagccaatttcgcagccaattttggtgctatcggctttttttgggtggagtag

SEQ ID NO: 194693 - DNA, 2505 bp, Artificial Sequence
  Description of Artificial Sequence: Synthetic coding sequence
atggcccagaagatggactgcggcgccggcctgctgggcttccagaaccctgacgcttgtagggcagtctgtcatccgctgccccaacctccagcttctaccctgcccttgtccgctttcccgacgctttgtgaccctccatattcacagcttcgggatccccccgcagtactgagttgctattgcaccccactcggcgcctcacctgccccggccgaagcaagcgtagaggacagtgccctgctgatgcagacactaatggaggctatacagatctccgaagccccacccactaaccaagcgacagccgcagcgtcgccccaatctagccaacccccaacagctaacgagatggctgatatccaggtctctgccgcagcagcacgccctaagtccgccttcaaagtacaaaacgccaccacaaagggaccaaatggggtttacgactttagtcaggcacataatgctaaggatgtgccaaatactcagccgaaggccgcattcaagagtcaaaatgccacaccaaagggccccaacgcagcctacgacttcagccaggcggctactaccggggagctagctgcaaataagagcgaaatggctttcaaagcgcagaatgctacaacaaaggtcggtcctaacgcaacttacaatttcagccagtcactcaacgctaatgacctagccaacagtcgtcctaaaacaccctttaaggcctggaatgatacaacgaaagccccaactgctgacacacaaacacagaatgtgaatcaggcaaagatggcaacctcacaagccgatatagagacggaccctggcatttctgaaccggatggtgctactgctcagaccagtgccgacggatcgcaagcacagaatcttgaatctcgcaccatcatacggggaaaaaggacccgcaagattaacaatctgaatgtcgaagagaactctagtggggatcaacgaagagccccgctcgcggccgggacatggagatccgctcccgtgccagtcactacacagaatccgcctggcgccccccctaatgtgctttggcagacacccctcgcttggcagaatccaagcgggtggcagaatcagaccgctagacagaccccccctgcacggcagagcccacccgcaagacagacacctcctgcctggcagaaccccgtggcctggcaaaacccggtgatctggcccaacccggtgatttggcaaaaccctgtgatttggccgaacccaatagtgtggccaggaccagtggtgtggcctaatccgctcgcctggcagaaccctcccggctggcagaccccaccgggctggcaaactccaccaggttggcagggaccacccgactggcaggggcccccggactggccactccccccagattggcccctgcccccagactggccgctgcctactgattggcctctgccccccgactggataccggctgactggcccattcctcccgactggcaaaatttgagacctagccccaatctgcgaccaagccccaattccagagcctcccagaatccaggagccgcacaaccgcgagatgtggctttgctccaggagcgcgccaataaattagttaaataccttatgttaaaggactacacaaaggttcccatcaagaggtcagagatgttacgtgacattatccgcgaatacaccgacgtctaccctgagatcatcgagagagcctgttttgtactcgaaaagaaattcgggattcagcttaaagagatcgataaagaggagcatctgtacatattgatctccactccagagtccttagcaggcattctgggaaccaccaaggataccccaaagctgggcctgctcctggtgattctcggggttatctttatgaatgggaatcgcgcttccgaggctgttttgtgggaagcgcttcgcaagatgggattaaggcctggggtgcggcatccgctgctgggcgacctgcgcaaactactgacatacgaattcgtgaagcagaagtacctggactatcggcgggtgcctaactcaaatcctcccgaatacgaattcttgtggggcctgcggtcatatcacgaaacatctaaaatgaaggtacttagattcattgcggaggtccagaaacgtgatcctcgggactggaccgcccagttcatggaagccgcggacgaagctctagacgcactcgatgccgcagctgccgaggcagaggcccgcgctgaagcccggacgcggatgggaattggtgacgaggcagtgagtgggccctggagctgggatgacattgaattcgaactgctaacatgggatgaggagggagatttcggggacccttggtcccgaattcctttcaccttctgggctagatatcaccagaatgccaggtctcgcttcccacagacctttgccggtcccataataggcccagggggaacagccagcgcaaactttgcggccaacttcggagcaatcgggttcttttgggttgagtag

SEQ ID NO: 194694 - DNA, 2337 bp, Artificial Sequence
  Description of Artificial Sequence: Synthetic coding sequence
atggcccagaagatggactgcggcgccggcctgctgggcttccaggcagaggcctctgtcgaagacagcgccctcctgatgcagacgctgatggaggccatccagattagcgaggcacctcccaccaaccaggctaccgctgctgctagtcctcagagtagtcagccaccgacggccaacgagatggcggatatacaggtaagcgctgccgctgcacgcccaaaatcggcgtttaaagttcagaatgccacaacgaagggcccaaatggggtttatgatttttctcaggcccataacgccaaagacgtacccaacactcagcccaaggccgccttcaaatcacagaatgccacccccaagggccctaatgcagcgtacgacttcagccaggccgcaacaactggcgagctggcagctaacaagagtgagatggccttcaaggcccagaacgccaccacaaaagtcggacctaatgccacttataacttttctcaatcactgaatgcgaacgacttggctaattcacgccctaaaaccccttttaaggcctggaatgataccacgaaagcacctacggcagacacccagacacagaatgtgaatcaggctaagatggccacctcacaggccgacatcgagacagacccaggcatttcagagccggatggcgctacagctcagacatccgcggacgggagccaggctcagaacttggagtcgagaacaatcatcagagggaagaggacgcgtaaaatcaacaatctgaacgttgaagaaaattcttcgggagatcaacgaagggctcccctggcggccgggacatggcgatctgcccctgttcctgtcaccacacaaaatccacccggggccccgcccaatgtgttgtggcaaacacccctcgcttggcagaacccatcaggctggcagaaccaaactgcgagacagacgcctcccgctagacagagcccacccgcccgccagaccccacctgcctggcagaatcctgtggcctggcagaatcccgttatctggccaaacccggttatatggcagaaccctgtaatatggcctaatccgatcgtctggccaggtccagtcgtgtggcccaacccactggcctggcagaatcctcctggatggcagacgcctcctggctggcagacacctccagggtggcagggacctccagactggcagggtccaccagattggcccctccccccagattggcccttgcctccggactggcccctgccaacagactggcctctacccccagactggattcccgctgattggcccatcccccctgattggcaaaatctgcggccatcaccaaacctgaggcccagccccaacagccgcgccagtcagaatcctggggcagcccaacctcgcgatgtcgcactgctgcaagaaagggctaacaagctggtgaaatatttgatgctgaaggattatacaaaggtgcctattaagcggagtgaaatgctccgagacatcatccgggaatataccgacgtgtacccagaaatcattgaaagagcatgcttcgtactcgaaaagaagtttggcattcagctgaaggaaatagacaaggaggagcacctctacattctcatttcaacccctgagtcactggctggcatccttggaaccacaaaggacacccccaagctgggactgctgctggtgatcttaggtgttatatttatgaatggaaaccgggcctccgaagcagttttgtgggaagccctgagaaagatgggactgaggccaggtgtgcgacaccccctcctgggcgatctgcgtaagttgttaacatacgagtttgtgaagcaaaaatatctggattaccggcgtgtgccaaacagtaacccacccgaatacgagtttctgtggggcctacgatcataccacgagacaagcaagatgaaggtgttgagattcatcgcggaagtgcagaagagggatcctagggactggacagcccagtttatggaggccgccgatgaggctcttgatgccctggatgcagcagccgcggaagccgaggccagggccgaggccagaacacggatgggaatcggggacgaggctgtgtccggcccatggtcttgggacgatatcgagtttgaattattgacatgggatgaagagggggattttggcgatccctggtctcgtataccattcacattctgggcccgttaccaccagaatgcgcgtagccggttcccccagacttttgctggtccaatcatcggccccggcggaacggcgagtgcaaacttcgctgccaattttggagctatcggattcttctgggttgagtag

SEQ ID NO: 194695 - DNA, 2337 bp, Artificial Sequence
  Description of Artificial Sequence: Synthetic coding sequence
atggcccagaagatggactgcggcgccggcctgctgggcttccaggctgaggcgtctgtagaggactctgccctactgatgcagactctgatggaggccatccaaattagcgaggcccctcctaccaatcaggcaacagcggctgcgtctccccagtctagtcagccacctacagccaatgaaatggcagatatccaggtctctgcagccgccgcacgtccaaaatccgcgttcaaggtgcagaatgccactacaaaagggccaaacggcgtctacgatttctctcaggcgcacaatgctaaggatgtgccgaatacccagcctaaagctgcgttcaagtcacaaaacgctacacccaagggtcctaacgcagcctacgatttttcccaggcagcgacaacaggggagttggctgctaacaagtccgagatggccttcaaagctcagaatgccactactaaggttggccctaacgcgacctacaacttctctcagtctctcaatgctaacgatcttgcgaattccagaccaaaaactccttttaaggcctggaacgacaccaccaaggctcctacagctgatacgcagacccagaatgtgaaccaggccaagatggccacatctcaggcggacatcgaaacagatcccgggatttccgagcccgatggcgctaccgcccagacatccgccgacgggagccaggcacaaaatctagaaagccgcaccattatccgcggtaagcgcacaaggaagatcaataatttgaacgtggaagagaactctagtggagaccaacgacgggcccctctagcagcaggcacctggaggtctgcacctgtgcctgtgacaactcagaatccacccggcgcacccccaaacgtcctgtggcaaacacccttagcttggcagaaccctagcggatggcagaaccaaaccgcccgccaaacacccccggcacgccaaagcccaccagccagacagacccctcctgcatggcagaaccctgtcgcgtggcagaacccagttatatggcccaacccagtaatatggcaaaaccctgtcatctggcccaatcctatcgtatggccagggccagttgtttggcctaatccactggcttggcagaatccgccgggttggcagactcctcccggatggcagacacccccgggctggcagggccctcccgattggcaaggacccccggactggcctctgccaccagactggcccctgcccccggactggcctctccctactgattggccgctgcctcctgattggatccccgctgattggccgatcccaccagactggcagaacctccgtccctccccaaaccttaggccttcccccaactccagggccagtcagaaccccggagccgcccagcctcgggatgttgccctgctgcaggaaagggcgaataaactggtgaagtacctgatgctaaaagattacacaaaggtcccaattaagaggtccgaaatgctacgagatatcatccgggagtacacagacgtataccccgaaatcatcgagcgtgcttgcttcgtgctcgaaaagaagtttggaattcagctgaaagagatcgacaaggaggaacacctgtatattctgattagcacgcctgaaagcctggccgggatcctgggtacgacaaaggacacccccaaactggggctcctcctagttatactaggcgtcatctttatgaatggcaaccgggcttcagaggcagttctgtgggaagcgctccggaaaatgggcctccgtcctggcgtgcggcatcctctcctgggagacctccgcaaattgctgacatatgagttcgtaaagcagaaatatttagattaccgacgggtgcctaacagtaatcctcctgagtacgagttcctttggggccttcggtcctatcatgaaacgagcaagatgaaggtgttgagatttatagccgaagtgcaaaaaagggatcccagggattggacagcccagtttatggaggccgcggatgaagctctcgacgccctggacgctgccgcggctgaggcagaagccagggctgaggcgcggacccggatgggtattggagacgaagccgtgagcgggccttggtcctgggatgatatagagtttgaactgctgacatgggacgaagaaggagacttcggcgatccctggtctagaatccccttcaccttctgggcacggtaccatcagaacgctcgaagccgctttccgcagacctttgccggccccataattggtcccggaggcaccgcatctgccaacttcgcggcaaactttggagccatcgggttcttctgggtggaatag

SEQ ID NO: 194696 - DNA, 414 bp, Artificial Sequence
  Description of Artificial Sequence: Synthetic coding sequence
atggcccagaagatggactgcggcgccggcctgctgggcttccaggcggaggcttctgtggaagactcagcactgctgatgcaaaccctgatggaggcaatacagatatcagaggccccaccaacaaatcaggccacagccgcagcctctccccagtctagccagccccccaccgcaaacgagatggctgatattcaggtcagcgccgccgcggcccggcctaagtccgcatttaaggttcagaacgcaaccacaaaaggccccaacggagtctatgatttctcacaaagtctgaacgcaaacgatttggcgaatagccggcctaagacacaagtgagcctcaacctcacagtacagctacatcgacatcagcagatggtccctagactcagaatttggagccccggccagtag

SEQ ID NO: 194697 - DNA, 3942 bp, Artificial Sequence
  Description of Artificial Sequence: Synthetic coding sequence
atgagcggctggcggtacctgatctgcgtgagcttcctgctgaccatcctactggaactcacatatcaggggcctcctgtgccggcttcttcaagtactaagttactcatgacttcctattcgatgaggtctacagttgttagccgctacgctcatacgctggtgacatccgttctgttcaaccctcacgccgaggcccatgaagccattttcgacctcgatctgccacacttggcctttatctccaacttcactatgaccatcaataataaggtatacattgcggaagtgaaggagaagcaccaggccaaaaagatatacgaagaggcgcaccagcagggaaaaacagctgcccatgtcggtattcgggatcgcgagagtgagaagtttcggataagcacatcactcgcagcagggacagaagtaacattttccttagcttacgaagagctgctccagcgtcaccagggccaataccaattagttgtctctcttcgtcctggtcagttagtgaagaggctgtctatcgaggtgactgtaagcgagagaaccggcattagctacgtccacattcctccgctaagaacgggccggttaaggaccaacgcccacgcttctgaagtcgactcacctcccagcacacggatagaaaggggggagacatgcgtgagaatcacatattgccccacccttcaggaccagtcatccatcagtggctctggaatcatggctgacttcctcgtccagtacgacgtggtcatggaggacatcattggtgatgtgcagatctatgatgattactttatacattacttcgccccacgggggctgccccctatggagaagaatgtggtgtttgtgatagatgtgtcgtccagcatgtttggtacaaagatggagcagaccaaaacggcaatgaatgtcattctgagtgacctccaggccaatgattacttcaatattataagtttctccgacacagtgaacgtgtggaaggccggggggtccattcaggccacaatccagaatgtgcactcagcgaaggactatttacattgcatggaggctgatggctggactgatgtgaattctgctttgctcgcagcagcaagcgttcttaaccacagcaaccaggagcctgggagaggtccatccgtgggcagaatcccacttattatattcctgaccgatggcgaacccaccgccggcgtcacaacaccatccgtgatcctctcaaatgttagacaggccctgggccacagagtgagcctatttagtctagcattcggcgacgacgcagactttacactccttcgaaggttgagtctcgaaaacaggggtattgcgaggaggatctatgaagacacagacgcagccttgcagctgaaagggctgtacgaagagatctccatgccgcttctggcagatgttcgtctcaattatttgggaggattggtcggcgcttccccctgggcagtgttccccaattatttcggggggtcagagctggttgttgctggacaggtgcagcccggtaaacaagaacttggcattcatctagccgcccgaggcccaaaggatcagttactggtggctcatcatagtgagggtgccaccaacaactcccagaaggcatttgggtgcccaggagagccagcccccaatgtggcacactttatcagacgcctctgggcctatgttaccattggagagctgctggacgcccatttccaggcgcgtgacactactacccgacacctgttagctgctaaggtgctgaacctcagtcttgaatacaacttcgttacaccactaacaagtcttgtgatggtccagccaaaacaggcatcagaggaaactcggagacagacatctacatccgcgggacctgacacaatcatgccatcttcttcatccagacacggcctgggtgtctctacagcacaacctgccctggtgccgaaggtgatcagcccaaagagcaggccagttaaaccaaagttctacctctccagcacgaccactgcatcaacgaagaagatgctgagttccaaggaactcgagcccctgggtgagtcaccccatactctgagcatgccaacatatcccaaggccaaaatccccgcgcagcaggactccgggactcttgctcaaccaactctgcgcactaaacctacgattctggtcccaagtaatagtggaaccctgctgccattgaaacccggatctctgagtcaccagaatccagacatcctgccaacaaactccagaactcaagttcccccggtcaaacctgggattcctgcctcacccaaagctgatactgtcaaatgcgtcacgcccctccattctaagccgggcgccccctcacacccacagctgggtgcgttgacctctcaggcacccaaaggactcccgcagtcacgccctggagtctctacactgcaggtgcccaaataccccctgcacacaagaccccgcgtgcctgccccaaagactcggaacaatatgccccatctgggaccaggcatcctccttagcaagacaccaaaaatactcctttcgctcaagcctagcgctccccctcaccaaatcagtacgtccatttcactgtccaaaccagagacccccaatcctcacatgcctcagacccccctgcccccaagacctgatcggcctcgacctcctctaccagagagcctatccacttttcctaataccatctctagcagcacaggcccttcctctactaccactaccagcgtccttggcgagccattgcctatgccattcacccctacgcttcctccgggacgcttctggcaccagtacgatctgcttcccggcccccagcgcaccaggcaggtgcttggaccctccaggccaggagtgcccaccatgtccctcctcaacagcagccggcctactcccgagggatcaccacctaatctacccatcctgctgccatcgtccatcctcccagaagccatctccctgctactcttacccgaggaacttgaactcttaagtgagtccatggtggagtccaaatttgtggagtcattgaacccacccgcattttacacattcctgacgccagatgaggatggaagtccaaattgggatggaaattcagaggagatactcggtggtgcagggggcagtatggagtcgcagggttcttctgtcggccttgccaagggtactttaccttccatcttcaccttctcttcttccgtagatggggatccacattttgtgattcagatccctcacagcgaagagaagatctgctttacccttaatggccatcccggggacctgctccagctgatcgaagatcccaaggcaggactccatgtgtcaggcaagctgctgggagcacctccaaggccagggcataaagaccaaacccggacctattttcagattattacagtgactacggataagccccgggcttatacaataaccatcagccgatcctccatcagccttcggggcgagggaaccctgagattatcctgggaccagcccgccctccttaagagaccccagctagagctgtatgtggccgccgctgcccgcctgactctccgactgggaccttacctggagttccttgtgctaaggcaccggtacaggcatccctctacgctgcaactgccccaccttggcttctatgtagctaatggatcgggtttatctccttccgcccggggactgatcggccagttccagcacgccgatatccgactggtgactggtccaatgggcccctgcctcagacggcaccacgggccagatgtgcccgtaatcctgggcaaaagattgcttaaggacagtcctcgtcttttaccacggtgggcttcctgctggttagtcaagaggtcccatgtggagttgttgctgggccacccgtacctctcttacgttctgtag

SEQ ID NO: 194698 - DNA, 1767 bp, Artificial Sequence
  Description of Artificial Sequence: Synthetic coding sequence
atgagcgacaccagcgagagcggcgccggcctgacccggttccaggctgaggcttccgagaaagatagcagctcaatgatgcagactcttctgacagtcacacagaacgtggaggtccctgagactcccaaggccagcaaagcaaccgaagtgtctaagacacccgaggctagagaggcccctgctacacaggctagttctacaacacagttgacagatacccaggtgctggccgcggagaacaagtctctggctgccgacactaaaaaacagaacgccgatccacaggctgtcaccatgcccgctactgaaaccaagaaggttagccatgtagctgacaccaaggtaaacactaaagcccaggagacagaagcagcccccagccaagcacctgctgacgagcccgagccagagtctgcggcggcgcagtcccaagagaatcaggatacaaggcctaaagtgaaagcgaagaaagcccggaaggtgaaacaccttgatggtgaagaggacggctcatccgatcagtcacaggcgagcggaacaacagggggcagacgggtatcaaaggccctgatggcatcaatggcaaggcgtgctagtagggggcctattgcattctgggccagacgggcttcacggactcggctggctgcttgggctcggcgcgccctgctgtcccttcgcagccctaaagcacggagagggaaagctcgcaggagggcagccaagctgcaatcctcacaggagccagaagccccaccgccgcgggacgtggcgttgctgcagggaagggctaacgacttggtgaagtatctacttgctaaggaccagacaaagatccccatcaaaagatctgacatgctgaaagatatcatcaaagagtatacagacgtgtatcccgagattattgagcgtgcgggctactccctggagaaggttttcggcattcaactaaaagagatagataagaatgaccatctatatatcctgttgtctacgctggagccgacagacgctggaatactagggaccactaaagattctcctaaactgggactccttatggtgctgctgagcatcatctttatgaacggtaatcggagctctgaggctgtcatctgggaagttctccggaaactcggactgagacccggcatacatcactccctgttcggggacgtgaaaaaactaatcaccgacgagtttgtgaaacagaaatacctcgattatgccagggtgcccaacagcaacccgccagaatatgagtttttttgggggcttcggagttactacgagacttccaagatgaaagtacttaaatttgcatgcaaggtgcagaaaaaggacccaaaggagtgggctgcccagtacagggaggccatggaggctgatctgaaagccgccgccgaggcggcagccgaggcgaaagcgcgggccgagatcagggcaagaatgggaattggattaggcagtgagaatgccgctgggccctgcaactgggacgaggccgatatcggcccatgggcaaaggcccggatccaggcgggggcagaagccaaggccaaggctcaggagagcggcagcgcttctacaggggcctcgaccagcaccaacaactccgcatccgcgtccgcatccacctctggagggttttccgctggggcttctctaacagcaacactaacttttggactgttcgccgggctgggaggcgccggggcgagcacctcaggcagctccggcgcgtgtgggttcagttataagtag

SEQ ID NO: 194699 - DNA, 1653 bp, Artificial Sequence
  Description of Artificial Sequence: Synthetic coding sequence
atgtggcggagccagcggcaccggcggccccagcgggtgagcaagacacccgaggcccgcgaagccccagcgacccaggcatcttcaacaacccagctcacagatacccaggtgctggcggccgagaataagtcacttgccgccgacacaaagaagcagaatgctgatccacaggccgtgaccatgccagccacagagacgaagaaggtgtcgcatgtggccgacacaaaagttaatactaaggcacaggagaccgaagctgccccatcccaggcaccagctgatgagcccgagccagaatccgccgctgcccagagccaagagaatcaggatacacgaccaaaagtcaaggctaaaaaagctaggaaggtaaaacatctcgatggcgaagaggacgggtcttcagatcagtcccaggccagcggaacaacaggcggccggcgcgtgtccaaagccttaatggccagcatggcccgcagggcaagcaggggaccaatagccttctgggcacggcgtgcaagtcgcactcgactcgccgcttgggctcgccgtgccttactctcgttgcggtcccctaaagctcgcaggggaaaagcgcggcgacgggcagctaaacttcagtcttcacaggaacccgaggcccccccaccccgcgacgttgccttgctgcaggggcgagccaatgacctcgtgaaatatctcctcgccaaagaccagaccaagatccctataaagaggtctgatatgctgaaggatatcatcaaagagtacaccgacgtttaccccgagattattgagcgggcaggatactctctcgagaaggtctttgggatccagttgaaggagatagacaagaatgaccatttgtatattctgttatccacattagaaccaactgatgccgggattttgggcaccacaaaggacagccctaagctgggcctcctcatggtgctgttatcaattattttcatgaatggcaatagatccagcgaggccgttatatgggaagttctcaggaaactgggcctccgaccaggaatccaccactccctatttggtgacgtcaaaaagttgattacagacgagttcgtgaaacagaagtatctggattatgcaagggtgccgaacagcaacccgcctgagtacgaattcttctgggggctgcggtcatattatgaaacgtcgaaaatgaaggttctaaaatttgcatgcaaggtgcagaaaaaagacccaaaggagtgggccgcacaatacagggaggctatggaggcagatctcaaagccgccgctgaagcggcagctgaagcaaaagcacgcgccgaaatccgagcccgcatggggatcggcctgggctctgagaatgcagctggtccatgcaactgggacgaggctgacatcggcccatgggccaaagctcgcatacaggccggcgccgaagccaaggcaaaagcccaggaaagtgggtctgcatccaccggcgcttcaacctccactaataattcagcttcggcttctgcctctacatccggaggcttcagtgcgggggctagcctcacagcaaccttgacatttggattgttcgcaggactgggaggggctggagctagcacttctggcagctctggcgcatgtgggttcagctacaaatag

SEQ ID NO: 194700 - DNA, 1821 bp, Artificial Sequence
  Description of Artificial Sequence: Synthetic coding sequence
atgagcgacaccagcgagagcggcgccggcctgacccggttccaggccgaggcttcggagaaggatagctctagcatgatgcagacattgctgacagttacccagaacgttgaggtgcccgagacacctaaagcctcaaaagctctggaagtcagcgaggacgtcaaagtttcaaaagcttctggcgtgagcaaggccaccgaagtgagtaagacacctgaagcccgagaagctccggccactcaagcctccagcaccacacagctaaccgatacccaggtgctagccgccgaaaacaagagcctggctgcagatacaaaaaaacagaatgccgacccacaggctgttaccatgcctgcaacagagactaagaaagtgtctcatgttgcggataccaaggtcaatacaaaggcccaagagactgaggctgcccccagtcaggctccagccgatgaaccggagcccgagagcgccgcagcccagagtcaggagaaccaggatacccgtcctaaggtcaaagcgaagaaagcccgaaaagtgaagcacctcgacggcgaggaggatgggtcctccgatcaatcacaggcctccggaacgacaggcggcaggagggtctcaaaggcgctcatggccagcatggccagaagagcttcgagaggccccattgctttctgggcacggcgcgccagtaggaccaggcttgccgcctgggctcggagggccttattgtccctgaggagtccaaaagctcggagaggcaaagccagaagacgagcggcaaagctccagagcagtcaggaaccagaagcccctcctcctagagacgtggctctcctgcagggacgagccaacgacctggtcaaatacctgctcgcaaaggatcagacaaaaataccaatcaaaaggtctgacatgctcaaggacatcattaaggagtataccgacgtgtatcctgagatcatcgagagagctggctattcactggaaaaggtctttggcattcagctcaaagagatcgataagaacgaccacctctatatcctgctgtctacattggaaccaaccgacgccggaatactgggaacaacaaaggattcccccaagcttggtctactgatggtgctactgagcatcatcttcatgaatggtaatcgtagctctgaagccgtcatctgggaggttctgaggaagttaggcttacgcccgggaattcaccacagcctcttcggggatgtcaagaagctgatcacagacgagttcgtgaagcagaagtatctggattacgcccgcgtgcctaactcaaacccaccagaatatgagtttttctggggattgaggagttactatgaaacaagcaagatgaaggtgctcaagtttgcatgtaaggtacaaaagaaagatccgaaagaatgggctgctcaatatagagaagccatggaggcagacctcaaagccgcggccgaagccgccgctgaagctaaggcgcgcgccgaaattcgagctcgaatggggatcggcctgggatccgagaatgccgccgggccatgcaactgggatgaagccgacatcggaccctgggccaaagcaaggattcaggctggggcggaggcaaaggcaaaggcacaggaaagcggcagcgcttcgacaggtgcgtccacctcgacaaataacagtgcatcagcgtctgctagtacatcagggggcttcagtgcaggggccagcctgaccgccaccctgactttcggcctctttgcaggcttaggcggggcaggggcctccacctccggaagttcaggagcctgcgggttctcatacaaatag

SEQ ID NO: 194701 - DNA, 1821 bp, Artificial Sequence
  Description of Artificial Sequence: Synthetic coding sequence
atgagcgacaccagcgagagcggcgccggcctgacccggttccaggcggaagcttcagagaaggattcctcctccatgatgcagactcttcttactgttacccagaacgtcgaggtcccggagacgccaaaggccagcaaggcccttgaggtgtctgaggacgttaaggtctcaaaggcttcaggtgtgagtaaggctacagaagtatccaagacgcctgaggcccgcgaggctcctgcaactcaagcctcgtcgacaacccagctcacagacacccaggtcctggctgcggaaaacaaaagcctggctgccgataccaagaagcaaaacgcagatccacaggcagttaccatgcccgccaccgaaacaaagaaagtctcgcacgttgcagacactaaagttaatactaaggcacaggagactgaggcagctccatcacaggctcctgcagatgaacccgaaccagaatctgccgctgcccaatcacaggagaaccaggacactcgacccaaggtgaaggccaagaaagctcggaaagtgaagcatctcgatggggaagaggatggtagttctgaccagtcccaggcttcaggaactacaggtggaaggagggtgtctaaagccctcatggcttccatggccagaagggcttctaggggcccaattgccttttgggctcgtagggcttctaggacgcgcctggcggcctgggcccgtcgggccttgctgtctctgaggagccccaaagcaagacgtggtaaagcccgcaggcgggccgcaaaattgcaatccagccaggagcctgaagcccctcccccgcgtgatgtggctctattacagggtcgtgccaatgacctggttaagtacctgctagcaaaggaccagaccaagataccgatcaaaaggtcagatatgctgaaagatataattaaggagtacaccgacgtctatcctgagattatcgagcgcgctggatattcactggagaaggtttttggaatccagctaaaagaaatcgataaaaatgatcatttgtatatattgctcagcactctcgagcccactgacgccggcattctgggaacaaccaaagattccccaaagctcggccttctgatggtgctgttaagcataatcttcatgaacggaaataggagctccgaggctgtcatatgggaggtgctaagaaagctgggcctgcgacctggtattcatcattcactgtttggagacgtgaagaagttgatcactgatgaatttgtgaaacagaaatacctagattacgcacgagtcccaaactcaaacccccctgaatacgagttcttttgggggctacgctcatattacgagacctccaagatgaaggtccttaagtttgcttgcaaggttcagaagaaggaccctaaagagtgggctgcacagtatcgtgaagccatggaagccgacctgaaggctgcggctgaagccgctgctgaagccaaggcgcgagctgagattagggcacggatgggaatagggctggggagtgaaaacgctgccggaccctgtaattgggatgaggcagacattggcccctgggctaaagcacggatacaggctggcgccgaagccaaggcaaaagcacaagagtccggaagcgcatcaacaggggctagcacatctacgaataattcagcgagcgccagcgccagcaccagtgggggtttctctgctggcgcctcccttactgccactctgactttcgggctctttgctgggctgggcggagccggagcatcaacttccgggtcttccggcgcctgcggattcagctataagtag

SEQ ID NO: 194702 - DNA, 1566 bp, Artificial Sequence
  Description of Artificial Sequence: Synthetic coding sequence
atgagcgacaccagcgagagcggcgccggcctgacccggttccaggcggaggcctctgaaaaggattccagctccatgatgcaaacgcttctcacagttactcagaacgtggaggtccccgagactccgaaggccagtagcacaactcagcttacagacactcaagtgctcgcagccgaaaataagtctctggctgctgacaccaaaaaacaaaacgctgacccacaggccgtgactatgccagctaccgaaaccaaaaaagtgagccatgtggcggatactaaggtaaacactaaagcgcaggaaaccgaggccgccccatctcaggcacccgccgatgagccagagcctgagtcagcagcagcacagtcccaagagaaccaggatacgcgcccaaaggtcaaagctaaaaaggctcgaaaagtgaaacacctggatggggaggaggacggaagtagtgaccagtctcaagcctcaggtacaacaggcgggcggcgggtgtccaaagcacgtagaagagcagccaagcttcagagctcacaggaacccgaggccccaccgcctagagacgtggccctgcttcagggacgcgccaatgatcttgtgaaatacctgttggcaaaggatcaaacgaagatcccaataaagcgcagcgacatgctgaaggacattatcaaggaatacactgacgtttatcctgagataattgaacgcgctgggtattccttagagaaggtatttggaatacagctgaaggagatagataaaaacgatcatttgtacatcctgctgagcacactcgaacccaccgacgctggtatcctcgggactacaaaggactctcccaagcttggactgttgatggtgctactgtccatcatctttatgaacgggaatagaagtagtgaagcagtaatctgggaagtgctgagaaaactggggctcaggcccgggattcatcattctctgtttggggacgttaagaagctcatcactgacgagttcgtgaaacaaaagtacctggactacgcaagagtgcccaactctaatccccccgaatacgagtttttttggggtctgcgtagttactacgagacatctaagatgaaagttctgaagttcgcctgtaaggtccagaagaaggaccctaaggagtgggccgcacagtacagggaagcaatggaggctgacctgaaggccgctgctgaggcggctgccgaagcaaaggcacgggctgaaattcgggctaggatgggcatcgggcttggctccgaaaacgccgcaggcccgtgcaactgggacgaggctgacatcggaccatgggcaaaggcgaggatccaagctggtgccgaggccaaggccaaagctcaggagagtggcagcgcttcaactggagcctccacctcaacaaataattcagcctccgcctctgcaagtacatctggagggttctcagcaggggccagtctgactgccacgttgacattcggattgttcgccggcctgggaggcgctggagccagcacgtccgggtccagcggcgcctgcgggttctcctacaaatag

SEQ ID NO: 194703 - DNA, 1566 bp, Artificial Sequence
  Description of Artificial Sequence: Synthetic coding sequence
atgagcgacaccagcgagagcggcgccggcctgacccggttccaggccgaggcttccgagaaagacagttccagcatgatgcagaccttgctgactgtcacccagaatgtcgaggtcccagagactccaaaggcttcgtctaccacccagctcacagatactcaagtgcttgccgcagaaaataagtcactagccgccgacactaagaaacagaacgccgatccccaggcggttaccatgcccgctactgagaccaaaaaggtcagccatgtcgccgacactaaggtgaacaccaaagcacaagagaccgaagccgccccctctcaggctcctgcagatgagccagagcctgagagcgcagccgcgcagagccaggaaaaccaggatactcgcccgaaggtgaaggctaagaaggcacgtaaagtgaaacaccttgatggggaagaggatggctctagtgaccagtctcaagctagtggcacaaccggggggaggcgcgtgtccaaagcacgcagacgcgccgccaaactgcaatcatcacaggagccggaggctcccccacccagagacgtcgccctgttacagggtcgcgcaaacgacctcgtgaagtatttgcttgctaaggaccaaacaaagatcccaattaagagaagcgacatgctgaaggatattattaaggaatatacggacgtctatccggaaattatcgagagagcggggtattctctggaaaaggttttcggtatccagctgaaggagatcgataagaacgaccatctgtacattctgctatcaacgttagagccgaccgatgccggaattctaggaaccactaaggactcgccgaagttgggcttgctaatggttctgctcagcatcatctttatgaatggcaacaggtcatccgaggctgttatttgggaggtcctgaggaagttggggctcagaccgggaattcatcacagcctgtttggtgatgtcaagaagttaatcaccgatgagttcgtgaagcagaaatatttggattacgctcgcgtaccaaacagcaatccccctgagtacgagttcttctgggggctgaggtcttactacgagacgtctaagatgaaggtgctgaaatttgcgtgcaaagttcaaaaaaaggatccaaaggaatgggcggcccagtatcgcgaggccatggaggccgaccttaaagctgctgccgaggcagctgcagaagccaaggcccgagccgaaattagggcgagaatgggaataggcctcggaagcgagaacgccgccggtccatgcaactgggatgaggctgatatcgggccttgggcgaaagcccgcatccaggccggagccgaggccaaggccaaggcacaagagtcgggttctgcttccacaggggcaagtactagtaccaacaattcagccagtgctagcgcatcaacgtccggcgggtttagcgccggcgccagtttaaccgctacactaaccttcgggctgttcgccgggcttggtggggcaggcgcaagcaccagcggatcatctggcgcatgcggcttctcatacaagtag

SEQ ID NO: 194704 - DNA, 1821 bp, Artificial Sequence
  Description of Artificial Sequence: Synthetic coding sequence
atgagcgacaccagcgagagcggcgccggcctgacccggttccaggcggaggcctccgaaaaagacagttctagtatgatgcagacactgctgactgtgacccaaaacgttgaggtgccagaaactccaaaggcatccaaagccttggaggtctccgaggatgtgaaggtatctaaggcgtctggcgtgtcgaaggcaacagaagtgagcaagactcccgaagcccgtgaagcccctgcaacccaggcttccagcactacacagctgactgatactcaagtactggctgcagagaataaatcccttgcggccgataccaagaaacaaaatgccgaccctcaggccgtcaccatgcctgccacagagacaaaaaaagtttcacacgtggcagataccaaggtgaacacaaaggcccaggagacagaagcggccccctcccaggcaccagctgatgaaccggagcctgagagcgccgctgcccagagtcaggagaatcaggatactcggccgaaggtgaaggctaaaaaggctcgcaaggtcaagcacctcgacggagaagaggacggatccagcgatcagtctcaggcttcaggcactaccggcggtcggagagtgtcaaaggcactcatggcttcaatggcccgtagggccagtcgcggtccaatcgcattctgggcgagacgagcatcacgcactagattagccgcatgggcccgaagggctttattgagtctccggtctccaaaagcacgtcggggtaaagcccgacgccgggctgctaaactacagtcatcgcaagagcccgaggctccacctcctcgagacgtcgccttgctccaggggcgagccaacgacctggtgaagtatctcctcgccaaggatcaaacaaagattccgatcaaaaggtcggacatgctgaaggatataattaaggagtacactgacgtgtatcccgagattatcgaacgcgcaggatattccttggaaaaagtgttcgggatacagctcaaagaaatcgacaagaacgatcatctatacattctcttatccaccctggaaccaactgacgccggaatccttgggaccaccaaggactccccgaagcttgggctgttgatggtgctcttgtcaatcatcttcatgaacgggaatagaagtagtgaggctgttatttgggaagtgctcaggaagctgggcctgagacctggtattcatcatagcctgttcggggacgtgaagaaattgatcaccgatgagttcgtgaaacagaagtatctggattacgcccgggtccctaacagcaacccccccgagtatgagttcttctggggcttgcgcagctactatgagacatccaaaatgaaagttctgaagttcgcctgtaaggtgcagaaaaaagatccaaaggagtgggcagcccagtaccgcgaggctatggaagcagatctgaaagccgccgccgaggccgctgctgaggctaaggcacgagccgaaatccgagcaaggatgggaatagggctgggctccgagaacgccgcaggcccttgcaattgggatgaagcagacattggcccttgggccaaagctaggatccaggccggagcagaagccaaggccaaggcacaagagtcaggcagcgcaagtactggcgccagtactagcacaaacaactccgcttccgcgtcagccagcactagcggaggattcagcgcaggggcttctttaacggcaacacttaccttcggactcttcgccggcctagggggtgccggggccagtacttcaggttcatcaggcgcctgtggcttcagctataaatag

SEQ ID NO: 194705 - DNA, 1821 bp, Artificial Sequence
  Description of Artificial Sequence: Synthetic coding sequence
atgagcgacaccagcgagagcggcgccggcctgacccggttccaggcagaggcgagcgagaaagactcttctagcatgatgcaaaccctcttaacagtaacccaaaacgtggaagtgccggagacacctaaggcaagcaaagccctggaagtaagcgaggatgtgaaagtgtctaaagctagtggcgttagtaaagccactgaagtgtcaaagacacctgaagcccgcgaggctcctgctacccaagcaagctctactactcagttgacggacacacaggtgctggccgccgagaataagtcactcgctgctgacaccaagaagcagaacgcagacccgcaggccgtgacgatgcccgccacggagactaagaaggtcagccatgtggctgatacaaaagtgaataccaaagcccaggagactgaagccgccccaagccaagccccggccgacgaaccagagcctgagtcagcggccgcacagagccaggagaaccaggatactaggcctaaagttaaggcaaagaaggccagaaaagtgaagcatcttgatggagaggaagatggtagcagtgatcaaagtcaggcgtccggcacaaccggcggtcgccgggtttcaaaggcactcatggcttccatggcgcgcagggcaagtcgaggacctatcgctttttgggctagaagagcaagccgcactcggctcgctgcttgggccagacgtgcacttttgagcttaaggtccccaaaggccagaagggggaaggcacggagacgagccgcaaagctgcagagctctcaggagcccgaggctccccctcctcgggatgtggccctccttcagggcagagcgaacgacttggtgaagtatcttctggccaaagaccaaacaaaaattcctattaagcggtctgacatgcttaaagatatcataaaggaatacacagatgtgtaccccgaaatcatcgaacgtgccggatactctctggagaaggtcttcggtattcagctgaaggagatcgacaaaaacgatcatttgtatatcttactaagcacactggaacccactgacgccggaatccttggtactactaaagactctccgaagcttgggcttctcatggtgcttttgtccatcatttttatgaacgggaatcggtccagcgaggccgtgatctgggaggtgcttaggaaattaggcttgaggcctggaatccaccacagcctgttcggtgatgtgaagaaactgattactgatgagttcgtgaaacagaaataccttgactatgctcgcgttccgaattcaaatccccctgagtacgagttcttctggggactcagatcctactatgaaactagcaagatgaaggtcctcaaatttgcctgcaaggtccagaaaaaggaccccaaagagtgggcagctcagtaccgcgaagctatggaggctgatctgaaagcggccgctgaggcagccgcagaggctaaagcaagggccgagatccgagcgcgcatgggaatcggactgggcagtgaaaatgcagccggtccttgcaattgggatgaggcagacatagggccatgggccaaagcccgtatccaagccggcgctgaggcaaaggccaaagcccaggaatctggttcagcaagcaccggtgcctcaacttcaacaaacaactcagccagtgcatctgcatctacaagcggcggcttctccgcgggcgccagtttaaccgctacactgacatttggccttttcgccggacttggaggcgctggcgcctctacaagtgggtctagcggcgcatgcgggttctcttacaaatag

SEQ ID NO: 194706 - DNA, 2220 bp, Artificial Sequence
  Description of Artificial Sequence: Synthetic coding sequence
atggccgagggcagcttcagcgtgcagagcgagagctacagcgtggaggatatggatgagggtagcgacgaagtaggagaagaagaaatggtggagggcaacgattatgaagagtttggagccttcggaggttacggaaccctgacatcttttgatattcacatcctgcgcgcatttggaagtttgggccctggcctgaggattttatcaaacgagccgtgggaattggagaaccctgtgctggcccaaacgctggtggaggcccttcagttggatccagagaccttggcaaacgaaacagcagcccgcgctgcgaatgtggccagggcggccgcctctaacagggcggcacgcgccgctgccgcagcagctagaactgccttttcgcaagtggtagcttcgcatcgcgtggcgaccccgcaggtgtcaggagaggatacacagccaacaacatacgcagctgaggctcagggccctactccggagccccccctcgctagtcctcagaccagccagatgctcgtgacctcaaagatggctgcacctgaggcacctgcgactagcgcacagtctcaaaccggatcacccgcccaggaagctgcaaccgagggaccctcgtccgcctgtgcattctcccaagcaccttgtgcacgtgaagttgacgctaaccggccctcaactgccttcctggggcagaacgacgtgtttgatttcacacagccagccggcgtaagcggcatggccttcccacgccctaagagacccgcacctgctcaggaggccgccacagaaggtccgagcgccgcctcaggcgtgccacagacgggccccggcagggaggttgccgccacacggccgaagaccactaagtccggtaaggcactcgctaaaacccgttgggtggaaccccagaatgtcgtggccgcagctgccgctaaggcaaagatggctaccagcattccagaacctgaaggggcggcggccgcaacggctcagcatagcgcagaaccatgggcccggatgggagggaaacgcacaaagaaatctaagcatctagatgatgaatacgaatcatccgaggaagagagggaaacgcccgccgtccctccaacttggagggcctcccaaccaagcctgactgtgcgagctcagctcgctccccggccccctatggcgcctcggtcacagatcccttccagacacgtattatgtctgccccctcgaaatgttacactgcttcaggagcgagccaacaagctggttaagtatcttatgatcaaggattacaagaagatcccaatcaagcgggctgatatgcttaaggacgtgatccgagaatacgacgaacattttcccgaaataatcgagcgagccacatacaccctggaaaaaaaatttggaatacacctgaaggaaatcgacaaggaggagcacttatacatcctggtgtgtaccagggatagcagcgctcgcctgctgggcaagaccaaggacacacctcggttgtcccttctactcgtcatcctgggagtcatcttcatgaatggtaatagggccagcgaggccgtcttgtgggaggctctgaggaagatgggcctacgtccgggggtccgccacccattcctcggcgacctgcgaaaattaattacggacgacttcgtgaaacagaaatatctcgagtacaagaagatacccaacagcaaccctcccgagtatgaatttctgtggggattgagggcccgacacgaaaccagcaagatgcgcgtgctccgcttcatagctcagaaccagaaccgcgaccccagagagtggaaagctcattttttagaggccgtcgatgatgccttcaagacgatggatgttgatatggccgaggaacatgcaagagctcagatgagggcccaaatgaacatcggagatgaggcattgatcggtcgatggtcctgggatgatatccaggttgagctgctgacctgggatgaagacggcgatttcggagatgcctgggccagaattccgttcgctttctgggcgcgctatcaccagtatatcttgaactcgaacagggctaataggcgggcaacctggagggcaggtgtcagttctggtaccaatggtggcgcctccacctccgtccttgatggcccatcaacaagttcgactatccgaacccgaaacgcagcccgggccggcgcaagttttttcagctggatacaatag

SEQ ID NO: 194707 - DNA, 2274 bp, Artificial Sequence
  Description of Artificial Sequence: Synthetic coding sequence
atggccgagggcagcttcagcgtgcagagcgagagctacagcgtggaggatatggacgagggctccgacgaggtaggagaggaggagatggtggagggaaacgattacgaagagttcggtgcctttggtggttacggtaccctcacgtcctttgacatacatatactgcgagcctttgggagcttgggtcctggcctgcggatcctctcgaacgagccttgggagctggaaaatcctgttctcgcacagacattggtagaagctctgcagctggatccagagacactggctaacgaaaccgccgcccgcgccgccaatgtcgcacgcgccgccgcctcaaatagagcagccagagcagcggcagctgcggcgaggactgccttttcccaagtggtggcgagccaccgcgttgctacacctcaggttagcggcgaggacacacaacccacaacatatgccgccgaagcacaggggcccacgcccgagcctcccctggcctcaccccagacatctcagatgctcgtaacttctaagatggccgcccccgaggcacctgccacgtctgctcagagccagaccggaagccctgcgcaggaggccgcgaccgaaggtccgtcatcagcctgcgcctttagccaggcgccctgtgcccgggaggtggatgcaaataggccttccactgcctttttaggccagaatgatgtttttgatttcacacagccagctggggtgtccggcatggcctttccgcgccccaaaaggcccgctcccgcgcaggaggctgccactgagggaccatcggcggcctcaggcgtcccacagaccggcccaggtcgtgaggtggcagccaccagaccaaaaactacgaaaagcggaaaggctctagccaagacccgctgggtagagcctcagaacgtcgttgccgctgccgccgccaaagccaagatggctaccagtatccccgagcctgagggggctgccgcagcgactgcccagcatagcgctgaaccttgggcccgtatgggtggcaagcgtactaagaagagcaaacacttagacgacgagtatgaatcatctgaagaggaacgagagactcctgctgtcccacctacctggcgggcctcacaaccgtctttaactgtgcgagcacaactagcacccagaccaccaatggcaccgagatctcagattcccagccggcatgtattgtgcctgcccccgcgtaatgttactctgttgcaggaacgtgcaaataagctagtcaaatatctcatgattaaggattataagaagatcccaatcaagagggccgatatgctgaaagacgtgatccgagaatatgatgaacattttcccgagattatcgagagagctacatacacactggaaaaaaaatttggcattcacctgaaagagattgataaggaagagcacctgtatattttagtttgtacccgtgacagctctgcccgcttgttgggtaaaacaaaagacacccccaggttgtctttgctgctggtcatcctcggcgtcattttcatgaatggcaaccgcgcgtccgaagccgttctctgggaagccctgagaaagatggggcttcgacctggtgtgcggcacccatttctgggcgatctacgaaagctcataacagacgactttgtcaaacagaagaaccctgagctgagggaagagactcctctgagtatggctcctagctggtacctggagtataagaaaatacccaattccaacccacctgaatatgagttcttgtggggcctgcgtgcccgacacgagacctcaaaaatgcgtgtccttaggttcattgctcagaaccagaacagggaccctagagaatggaaagcccatttcctggaggcagtcgacgacgccttcaaaaccatggacgtggacatggcagaggagcacgcccgcgcccagatgcgagcccagatgaatatcggcgacgaagccctgatcgggcggtggagctgggacgatatacaggtcgagctcctcacttgggacgaggatggggatttcggggacgcctgggcacgaattcctttcgctttctgggctcgctaccaccagtacatcctgaactctaacagggctaaccggcgggccacgtggagagccggtgtttccagtgggacaaacgggggggcttcaacttcagtcctcgacggccccagcacttcaagcacaataaggaccagaaacgccgcgagagccggcgcctcctttttctcttggatccagcatcgttag

SEQ ID NO: 194708 - DNA, 2226 bp, Artificial Sequence
  Description of Artificial Sequence: Synthetic coding sequence
atggccgagggcagcttcagcgtgcagagcgagagctacagcgtggaggatatggatgagggttccgatgaggtaggagaagaagagatggttgaaggtaatgactacgaagaattcggtgcattcggaggatacggaacactgacctcttttgacattcacattttaagagcttttgggagccttggccctggtctgaggatcctttctaatgagccttgggagttagaaaatccagttctcgctcaaactctagttgaggctctccagcttgaccccgagaccctggctaacgagacagcggctagagccgcaaacgtggctagggctgctgctagcaaccgcgccgctagggctgctgccgccgcggccaggactgccttttcccaggtggtcgcctcacaccgggtggccaccccgcaggtcagtggagaggacacccagcccaccacctatgctgctgaagctcagggaccgacacctgaacctcctctcgcctcaccccagaccagccagatgctggtgacatccaaaatggcagctccagaggctcccgcaaccagcgcacaatcacaaactggcagccctgcccaagaagctgcaaccgagggaccctcttctgcatgtgcattttcccaagccccttgcgcccgcgaggtggatgcaaatcgcccttccacagcttttctgggccagaatgatgtcttcgattttacccaaccggcgggggtgtccggtatggcctttccgcgccccaaacggccggcacccgcccaggaagccgccaccgagggaccctctgcggcttcaggcgtgcctcaaactggccctggacgggaggtggcggcgactcgacccaagaccaccaaatcagggaaagcgctagccaagacaagatgggtggaaccgcagaatgtggtggccgccgcagctgcaaaagcaaagatggcaacgtcaatcccagaaccagaaggcgccgccgccgcaacagcccaacactcagcagagccctgggcgcgaatgggtggcaaacgcacaaaaaaatccaaacatctcgacgacgagtatgagagctccgaggaagagcgcgagacacccgctgtgcctccaacttggagggcttcacagcctagtcttaccgtcagagcccaactcgcgccacggccacctatggcccccagatcacagatcccatctcgccatgtgctgtgtctgcctcctaggaatgtaaccctcctgcaggaacgcgctaataaattggtcaaatacctcatgattaaagattacaagaaaattcctattaagcgtgccgatatgctcaaagacgttatccgggagtatgacgagcattttccagagataatcgaacgagctacctatactcttgagaaaaagttcggcattcacctgaaggaaatcgataaggaagagcatttgtatattctggtgtgtaccagggattcctcagccaggctactagggaagacaaaagacacgcctcgacttagtctactccttgttatattgggggtcattttcatgaacggcaatagggccagcgaggccgtgctgtgggaggcgttacgcaaaatgggtttgcggcccggcgtcagacacccgttccttggggacctaagaaaactgataactgatgatttcgtgaagcaaaagtatctggagtataagaaaattcccaattcgaatccacccgaatatgagttcctgtggggactgagggctcggcatgagaccagcaagatgagagttttaagattcattgcgcagaatcaaaaccgagaccctcgtgaatggaaggcccactttctcgaagcagtggatgacgcttttaaaaccatggacgtggacatggccgaggagcatgcacgcgcacaaatgcgcgcacagatgaatattggggatgaagccctgatcggaagatggagctgggacgacatccaggtggagctactgacttgggacgaggacggcgactttggagatgcatgggcgaggatcccctttgcgttctgggccagataccaccaatatatcctgaacagcaatcgggctaaccgcagagcaacatggcgagccggcgtcagcagtggaacaaatggcggggcctccacatcagtgctggacggcccaagtacctcttctaccattcggaccaggaacgcagcgcgtgctggcgcttcttttttttcctggattcagcaccggtag

SEQ ID NO: 194709 - DNA, 2220 bp, Artificial Sequence
  Description of Artificial Sequence: Synthetic coding sequence
atggccgagggcagcttcagcgtgcagagcgagagctacagcgtggaagacatggatgagggatcggacgaagtaggcgaggaagagatggtggaagggaatgattacgaggagttcggcgcattcggcggctatggtaccctgacttcctttgatattcacatactgagagcattcggaagccttggacctggcctgcgcattcttagcaacgaaccttgggagctggagaatcctgttctcgcacagacactcgtggaagctttgcagttggacccggaaacactggccaacgagaccgcagcacgcgcagcgaatgtcgcccgcgccgctgccagtaacagggccgccagggcagccgccgccgcagcccgaaccgcgttctcccaggtggtggcctcccaccgggtcgccaccccccaggtgtcaggcgaagacacgcagcccacaacgtatgcagctgaggcacagggcccgacccctgagccaccacttgcatcgccccagaccagtcagatgctagtcacctctaagatggccgccccggaggcccccgctaccagcgctcagtctcagaccggcagccccgctcaagaggctgctacagaagggccctctagtgcgtgcgctttttcgcaagccccatgtgcccgcgaggtagacgcaaaccggcctagcacagctttcctcggacaaaatgatgtcttcgattttacacagcccgctggggtgtccggcatggctttcccccgacccaagcgccctgccccagctcaggaagcagcgaccgaggggccttcggctgcctccggcgttccacagaccggtccaggacgcgaagttgccgcgacccggccaaaaactactaaaagcggcaaagcactcgctaaaacccgttgggttgagcctcaaaatgtcgtcgccgctgctgcagcgaaggccaagatggccacttcaatccccgaacctgaaggcgccgccgctgcaactgctcagcactctgccgagccttgggcccggatggggggaaaacgtaccaaaaagtcgaagcatctggacgacgagtacgaatcatccgaagaagagcgtgagaccccggcggttccccccacatggcgtgcctctcagccgagtttaaccgttcgcgcacaactggccccaaggccccccatggcccccaggtctcaaatcccttctagacatgtgctctgtctcccccccagaaacgtgactctgctgcaggagagggcgaataagctggtgaaatatctgatgatcaaggactataagaaaattcccatcaagagggccgatatgttaaaggacgtgattagagagtacgacgagcatttccctgagattattgagcgtgcaacatacactttagaaaaaaaatttggtatacatctgaaagagattgataaagaagaacatctgtatatcctcgtatgtactcgggactcttccgcaagattgctcggcaagacaaaagacaccccgcgcctgtctcttttgctggttatccttggagtgatctttatgaacggtaatagagcttctgaggcagtgctgtgggaagctctgaggaagatgggcctacgacctggggtgaggcaccccttcctcggtgatctccggaagctcattacagacgactttgtaaagcagaagtacctcgagtataagaagattcccaactccaacccaccggagtacgaattcctgtggggcttaagagccaggcatgagaccagcaagatgagggtcctccggttcatcgctcagaaccagaatagagatcccagggagtggaaggctcactttctggaagcagtggacgatgcttttaaaacaatggacgttgacatggccgaggagcatgcgcgcgctcaaatgagggcacaaatgaacatcggcgatgaagcactgattgggagatggagctgggacgacattcaggtggaactcctgacctgggacgaagatggcgacttcggggatgcctgggctcgcataccttttgcattttgggcaagatatcaccagtatatcctgaacagcaatcgcgccaacagaagagccacatggagggccggagtctcttccggcacgaatgggggagcttctacttctgtgctcgacggaccgagcactagttctacaattcgaacgcggaatgccgctcgggcgggggcctcgtttttctcctggatccagtag

SEQ ID NO: 194710 - DNA, 2274 bp, Artificial Sequence
  Description of Artificial Sequence: Synthetic coding sequence
atggccgagggcagcttcagcgtgcagagcgagagctacagcgtggaggacatggacgaaggatctgatgaggtcggagaggaggaaatggtggaaggcaatgattatgaagagttcggcgccttcggcggttacggcaccctgacctcatttgatattcatatccttcgcgcatttggatcactgggcccaggactgcgaatcctctctaatgaaccctgggagctcgagaacccagtcctggcccaaacgctcgtggaagccctgcagcttgatccagaaacacttgccaatgaaaccgccgccagagcagcaaacgttgctagagcagctgccagtaatagggctgcgagagcagccgcagcagctgctcgcacggctttctcccaggtggttgccagccatcgagtagcaactccacaggtgtctggagaggatacccagccaaccacttatgcagctgaggcccagggtccaaccccagagccccctctcgcctcccctcagacctcacagatgcttgtgaccagcaaaatggccgccccagaagcccccgccacaagtgctcagtctcagacaggatctccagctcaggaggccgccaccgagggcccctcatccgcatgtgccttcagtcaagccccttgcgcaagggaagtcgatgcaaatcgccctagcaccgctttcctagggcaaaacgacgtcttcgactttacacagcccgccggtgtgtctgggatggcatttcctaggcccaaacggcccgcccctgcccaagaggccgccaccgagggcccctctgctgcttccggcgtgcctcagaccgggccaggcagagaggttgcagcgacgcgtccaaaaactactaagtcgggaaaggctcttgctaaaacaaggtgggttgaaccacagaatgtggtcgccgctgcagctgcaaaagctaaaatggccacatcaattcctgagccagagggtgccgccgctgccacagcacagcactcggccgagccctgggctcggatgggggggaaacgcactaaaaaatcaaaacatctcgatgacgagtatgaatcctcagaggaggaaagggagacgccagctgttccccctacttggagggcctcccagccttcccttacggtgagggcccagctggcacctcgaccacccatggcaccccgcagccagattccctctcggcatgtgctttgcctgccgcccagaaacgttaccttactccaagaacgtgctaataaactggtgaagtatctcatgatcaaggattacaagaagatacccatcaagcgggccgatatgctcaaggatgtaatccgagagtacgatgaacacttccctgaaattatcgagagagctacctacactttggaaaagaaattcgggatccacctcaaagaaattgacaaggaggagcacctttacattcttgtatgtacaagggatagctccgcacgactgctgggaaagacaaaggatacccccagactgtcactgctgctggtcattctcggagtgattttcatgaacggcaatcgggcctccgaggcagtgctatgggaggctctccggaagatgggacttcgcccaggtgtgcgccaccccttcctcggcgatctgcggaaattaattacagacgatttcgtcaagcaaaagaatcctgagttgcgtgaggaaactcccctgagcatggccccttcatggtatttagaatacaaaaagatacccaacagtaaccctcccgagtatgagttcctatgggggttgagggcacgccacgaaactagcaaaatgcgcgtgctgcgttttattgctcaaaaccagaatcgggacccccgcgagtggaaagcccatttcctagaggcggttgacgatgccttcaagactatggatgtcgatatggccgaggagcacgctcgtgcccagatgagggcccaaatgaatattggcgacgaggctctcattgggaggtggagctgggatgacattcaggtggaactgctaacctgggatgaggatggcgatttcggcgatgcttgggctagaattcctttcgccttctgggctagataccatcagtatattctgaatagcaatcgagcaaatcgaagagctacttggcgtgcaggcgtgagtagtggcacaaacggaggcgcctccacttctgttctggatgggcctagcaccagcagcactataagaacaaggaatgccgcccgcgcgggtgcatcctttttctcatggatacaacacaggtag

SEQ ID NO: 194711 - DNA, 2226 bp, Artificial Sequence
  Description of Artificial Sequence: Synthetic coding sequence
atggccgagggcagcttcagcgtgcagagcgagagctacagcgtggaggatatggacgagggcagtgacgaagtcggggaggaggaaatggtggaaggcaacgactatgaagagttcggggcttttggagggtacggtacactgacgagttttgacatacacatcctccgtgccttcggcagcctagggcctggactccgaatactttccaacgaaccttgggaacttgagaatcctgtgctcgctcaaacactggtggaagccttgcagctggaccctgagactctggccaacgagactgctgctagggccgcgaatgtggctcgagcagccgcatccaatcgagccgctagagccgcagccgctgccgcgaggaccgccttttcacaagtggtggcctcacacagggtcgcaactccccaggtgtcaggggaggacactcagcccacaacgtatgctgcagaggcacaaggtcctactcctgagcccccactcgcaagtcctcagactagccaaatgttggtgaccagcaagatggcagcccccgaagcccccgccacgagtgcacagtctcagacaggctcccctgcccaggaagctgcaacggagggtcccagtagtgcttgtgcattctctcaagccccttgtgctagagaagtggacgccaacagaccctctaccgctttcctgggtcagaatgacgtattcgatttcactcaacccgccggcgtttcagggatggcctttccccgtcccaaacgaccagcccccgcccaagaggcagccacggaaggacctagcgcagcatccggagtaccacaaacaggtccaggcagagaggtagcggctacacgccccaaaaccaccaagtccggtaaggccctagcaaagactaggtgggtggagccacagaacgttgtcgctgcagccgccgccaaagccaaaatggctaccagcatcccggagccggagggagcagccgctgctaccgcccaacacagcgcggaaccctgggcccgaatgggcgggaaacgaaccaagaaatccaagcacctagatgatgaatatgagtccagcgaagaggaacgtgagactcctgccgtgcccccgacttggcgagccagccagccatctttaaccgttcgtgcacagttagccccccgtcccccgatggctcctaggagtcagattcctagtagacacgtcctgtgtctccctcctcggaatgtgaccctgctgcaggagagagcgaataagttggtaaagtacctgatgatcaaagactataagaagatccccatcaaacgggcagacatgctcaaagatgtcatccgggaatacgacgagcacttcccagagattatcgagcgggctacatacaccctggagaagaaattcgggatccatcttaaagaaatagacaaagaggaacacctttacatcctcgtctgcactcgcgacagttcagctcgtctgctgggaaaaacaaaagatacaccccggctttccctcctactcgttatcctgggggttatattcatgaatggcaatcgcgccagcgaagctgtgctgtgggaagccctgaggaaaatggggttgcggcccggggtgcggcatccctttctgggcgacctccggaagctgatcaccgacgattttgtaaagcaaaagtatctggaatacaagaagatccctaattctaaccctcctgagtacgagttcctttggggcttgcgggcacgccacgaaactagcaaaatgcgtgtgctcaggttcatcgcgcagaatcagaaccgagaccctagagaatggaaggcgcactttttagaggcggtggacgacgcttttaagaccatggacgtggacatggccgaagaacatgccagggcacagatgcgcgctcagatgaatatcggtgatgaggctttaattggacggtggtcttgggatgacatacaggttgaattactcacatgggatgaggacggggactttggagatgcttgggctagaatcccgtttgcattttgggctagataccatcagtacattctcaatagtaacagagctaaccgtcgagctacgtggcgggctggggtatcaagcggaaccaacggcggtgcctcgacctccgtgctggatgggccttctacgagttcaaccatcaggactcgaaacgccgcccgagccggggcttctttcttttcatggattcagcatagatag

SEQ ID NO: 194712 - DNA, 2874 bp, Artificial Sequence
  Description of Artificial Sequence: Synthetic coding sequence
atgagcctggtgagccagaacagccggcggcggcggcggcgggtggcaaaggctacggctcacaacagctcttggggagagatgcaagcaccaaacgcacccgggctgcccgccgatgtgcctgggtctgacgtgcctcagggaccaagcgactcccagatcctccagggactgtgcgcttccgaggggccttcaacctcagtcctgccaacatctgcagagggacctagcacatttgtgcccccaaccataagtgaggcgtcaagcgccagtggccagcccacaattagcgaagggccgggcaccagtgtattacctacccccagcgaaggattgtccacaagtgggcctcccactatcagcaagggtttgtgtacctctgtcactctggcagctagcgaaggccggaataccagtcgcccccccacgagttccgaggagccttctacctccgtgcctcccacagcgagcgaggtcccatctacaagtcttccccccacacctggggaaggcacatcaacctctgtgcccccgacagcttatgagggcccctcaacttcagtagttccaactcctgatgagggaccaagcactagtgttttgccaaccccaggagaagggccgggcacctcagtgcctttggccgcaactgagggactttcaacatcagttcaggcaaccccggatgaggggccctctacaagcgtacccccaacagctaccgagggccttagtactccagtgccccccacaagggatgaaggtccctcaacttctgtgcccgctactcctggtgagggaccaagcacgtcagttttgcctgcagcctcggatggtcagtccataagtctggttccaactcgcggtaagggaagtagtacaagtgtgccccctacagccactgaaggactatctactagtgtgcagccgaccgcgggtgaggggagcagcacaagcgtgccaccgacccccggtgggggactgtccacctccgtcccccccacggctactgaggagctgagcacctccgtcccccccacacccggggaaggacctagtacttcggtgttgccaatcccaggtgagggactctcgacatccgttccccctaccgcttcagatggcagcgataccagtgtgcctcctacacccggggaaggtgcgtcgacgctggtgcaaccgacagcacccgacggcccaggctccagtgtcctgccaaatcccggtgagggccctagtacattgttttcttcttccgccagcgtggatcggaaccctagcaaatgctccctggtgctgccaagtcccagagtgaccaaggcctccgtggattcggactctgagggcccgaaaggggctgaggggccaattgaatttgaggtacttcgggactgcgagagccctaattccatcagtatcatgggcctgaataccagtcgggtcgccatcactctcaaacctcaggaccccatggagcagaacgttgcggagctcttgcaattcctgctggtgaaagaccaatcaaaataccccatcagggagtccgaaatgcgtgagtacatcgtgaaggagtatcggaatcagttcccggagatcttacggagagcagcagcccacctcgagtgcattttccgcttcgagctgagggaactggatccagaggcccatacctacatcctcctcaataaattgggtcctgtcccattcgaaggactcgaagaaagcccgaacgggccaaaaatgggattgttgatgatgattttgggacagatcttcttgaacggtaaccaggccaaagaagctgaaatatgggaaatgctgtggcgtatgggcgttcagcgcgaaaggaggttaagtattttcggcaacccaaaacgcttgctcagcgtagagtttgtgtggcagcggtatctagattacagacctgtcactgattgcaagcccgtggagtacgagttcttctggggtccgcgatctcacctggagacgacaaagatgaaaatactcaaatttatggccaagatttataacaaagatccaatggactggccggagaagtacaatgaggcccttgaggaggacgctgcgagagcatttgcggagggatggcaagcgctgccccactttaggagacctttctttgaggaggctgccgctgaggtcccctctcccgactcagaagtttcctcttatagttcaaaatatgccccgcactcatggccagagtccagattggagagtaaggctcgcaaattggttcaactcttcctcctgatggatagtactaagctacctatccctaaaaagggcatcctctattatattggaagagagtgctccaaagtatttccggacctgcttaaccgcgctgcgagaaccctaaaccatgtttatggaacagaactagtcgtcttagaccctcgcaaccattcctacacgctctataatcgccgcgaaatggaagagactgaagaaatagttgatagccctaaccggcccggcaataactttctgatgcaagtactgagttttatcttcatcatgggcaatcatgcccgagaatccgcagtttgggcattcctgcgggggctgggagtccaggcaggccggaaacatgtaattacctgtagatacctgtctcagcgttatatcgatagcctgagagtgcccgactcggacccagttcagtacgaattcgtatggggtccccgtgctaggttggagacgagtaaaatgaaggcgctgaggtacgtggcccgcatccatagaaaggaacctcaggactggccccagcagtatcgcgaagcgatggaggatgaagcgaatcgtgccgacgtcggccatagacagatctttgttcacaacttcagatag

SEQ ID NO: 194713 - DNA, 1572 bp, Artificial Sequence
  Description of Artificial Sequence: Synthetic coding sequence
atgagcctggtgagccagaacgcccggcactgcagcgccgagatcaccgccgattacggcgatggccgcggagaaatacaggccacaaacgccagtggatcccccacatccatgctggtcgtagatgccccccagtgtcctcaagccccgataaacagtcagtgtgttaatacttctcaggctgtgcaggaccccaatgatcttgaagttctgatagatgagcagtctcgacgcctgggcgctcttcgcgtgcacgaccctttagaagaccgctccattgcgttagttaactttatgcggatgaagagtcaaaccgaggggagcattcagcaatcagaaatgcttgaatttctgagggaatactctgaccaatttccagaaatcctgcggcgggccagtgcacatttggaccaggtcttcggcctgaacctaagagtgatagacccccaagccgacacctataacttagtttcaaaacgcggcttccaaatcactgataggatagccgagagtctggatatgccaaaagcaagcctgcttgcactggttctcggccatattctgctgaatggaaatagggcacgggaggccagtatctgggatcttttgctcaaggtagatatgtgggataagccccaaagaattaacaatttattcggtaataccaggaacttgctgaccaccgactttgtctgtatgcggttcttggagtactggcctgtgtacgggaccaatcctttagagttcgaatttctatggggcagcagagcccatcgggaaatcacaaagatggaggcgctaaagttcgtgtccgatgcacatgacgaagaaccttggagttggcctgaggaatataacaaagccctcgaaggggataaaacaaaggaacgatctctgaccgctggattagaattttggagtgaggacaccatgaatgataaggccaatgacctggttcagctcgccatctcagttaccgaggaaatgctgcccatccatcaagatgagttacttgcccacacagggaaggaatttgaggacgtcttcccaaatatcctaaatcgcgccaccttaatcctggacatgttctacggactttcactgatcgaagtggatacgtcagagcacatttacctgctggtgcagcagccagaatctgaggaggagcaggtaatgctggaatctctcggaagacccacccaggaatatgtgatgcccattttgggtttgatctttctcatggggaatagagtaaaggaggctaacgtgtggaacctgttgcgtaggttttcggtggacgtgggtcgtaagcacagcataacccgtaagttgatgcgccaacggtaccttgagtgccgccctctctcgtactctaaccctgttgagtatgagctgctgtgggggccgcgcgcccaccatgaaacgataaagatgaaggtgctcgaatacatggctcggctgtatcggaagcgcccccagaattggcctgaacagtatcgagaggccgttgaggacgaggaggctcgcgcaaaaagtgaagccacaattatgttcttcctcgatcctacgtag

SEQ ID NO: 194714 - DNA, 924 bp, Artificial Sequence
  Description of Artificial Sequence: Synthetic coding sequence
atgctgcagacccccgagagccggggcctgcccgtgccccaggccgagggtgagaaagacggaggccacgacggggagactcgagcccctactgcatcccaggaaagacccaaggaggagctgggagctgggcgagaggaaggtgcagccgaaccagctctgacccgcaaaggagctagagcactcgccgcaaaggcactggctagaagaagggcctaccgccgcctgaaccgtaccgtggccgaactggttcagttcctgttggtgaaggataagaagaagtctcccattacacggtccgaaatggtcaagtatgtgatcggcgacttgaagatcctgttcccggacatcatcgctcgggctgccgagcatctgcgttatgtgttcggcttcgagttaaagcagtttgaccggaaacaccacacctatattcttattaataagctgaagcccctcgaggaggaagaggaagaggacttgggtggggatggtccaagactgggcctgctgatgatgattttaggccttatttatatgaggggcaatagcgccagggaggcacaggtttgggaaatgctgaggaggctgggagtccagccatcaaaatatcacttcctgtttgggtaccccaaaagactgataatggaagactttgtgcagcaacggtatctgtcctacagaagggttcctcacacaaatcccccagagtatgagttctcttgggggccacgcagcaatctagagatttccaagatggaagtgttggggtttgttgcgaagctccacaagaaggagccacaacactggccagtgcagtaccgtgaagctctggcggacgaagccgatcgcgctagggcaaaggcgagggccgaagcgagcatgagagccagggcctcagctcgagctggcatacatctttggtag

SEQ ID NO: 194715 - DNA, 396 bp, Artificial Sequence
  Description of Artificial Sequence: Synthetic coding sequence
atggcccggagcctggtgtgcctgggcgtgatcatcctgctgagcgctttcagcgggcctggtgtgcgtggcggccccatgcccaagctggcagatcgcaagctttgcgctgatcaggaatgttcacatcccatttccatggcagtggccctacaggattacatggctcccgactgccgtttcctgaccattcacaggggtcaggtggtctacgtgtttagcaagctgaagggcaggggtaggttgttttggggcggctcagtgcaaggggattattatggagatctggccgccaggctgggctactttcccagctccatagtgagagaggaccagaccctgaaaccaggtaaagtcgacgtcaagaccgacaagtgggacttttactgtcagtag

SEQ ID NO: 194716 - DNA, 642 bp, Artificial Sequence
  Description of Artificial Sequence: Synthetic coding sequence
atggccgagacctacgacttcctgttcaagttcctggtgatcggctctgcaggaaccggtaaaagctgtctgctgcaccaatttatcgagaacaaattcaagcaagattcaaaccacactattggggttgagtttggaagtcgcgtcgtaaatgtcggcgggaagaccgtaaagctgcagatttgggacactgcagggcaggagcgttttcgctcagttacacgtagctattaccgcggggctgcaggcgctttgctggtttacgatataacttctcgcgaaacttacaatagcttagcagcatggctgacagatgcacggacacttgcctcacccaatattgttgtcattctgtgcggtaacaaaaaggacctggatccggaaagggaggttacatttctggaggccagtaggttcgcgcaggaaaatgagcttatgttcttagaaacctccgccttaactggggagaacgtcgaagaggcattcctgaagtgcgcgcgaaccattcttaataaaattgatagtggggagctggatcctgagcgaatgggatctgggatccagtacggggatgcctcattgagacagctcagacagcccaggagcgcccaggcagtcgccccacagccatgtggctgttag

SEQ ID NO: 194717 - DNA, 366 bp, Artificial Sequence
  Description of Artificial Sequence: Synthetic coding sequence
atggccgagacctacgacttcctgttcaagttcctggtgatcggctcggccgggacaggaaaaagttgtttattacaccaatttatcgaaaataaatttaaacaggatagcaaccatacaatcggggttgagtttggcagcagggtggtgaatgtgggcggaaagactgtgaagttgcagatctgggacactgccggacaggagaggtttcgtagcgtgactagatcttattaccgtggggccgccggagcactgctcgtctacgatattaccagagccgatgtgccgggagaccagaggtctcaccggagggaacggggcgggggagttcctcaggtgtgccctcactaccctcagcaggactag

SEQ ID NO: 194718 - DNA, 396 bp, Artificial Sequence
  Description of Artificial Sequence: Synthetic coding sequence
atggcccggagcctggtgtgcctgggcgtgatcatcctgctgagcgcattttccggcccaggggtccgcggaggcccaatgcccaagttagctgaccggaaactgtgtgcagaccaggagtgttctcacccgattagcatggctgtggctctccaggattatatggccccagactgtaggtttctcactattcataggggccaggtagtgtatgtcttctccaaactgaaaggccggggacgcctgttctggggaggatccgtgcagggtgactattacggcgacctggcggccagattagggtactttccatcaagtatcgtccgcgaggaccagaccctgaagcccggcaaagttgatgtgaaaaccgatacatcctcttccaactcttggtag

SEQ ID NO: 194719 - DNA, 2358 bp, Artificial Sequence
  Description of Artificial Sequence: Synthetic coding sequence
atggacagcgtgcccgccaccgtgcccagcatcgccgccacccccggcgatcccgagttggttggcccactgagtgtgctgtacgctgcatttatcgccaagttgcttgagcttgttgctacgctgccagacgatgtgcagccagggccggatttctatgggctaccgtggaaacccgtctttatcacggctttcctggggatcgcgtccttcgcgatctttctttggcgcacagtccttgttgtcactgataccttagttagcgtaacagagcagcagattagtgaaaaactgaaaactattatgaaggaaaacaccgagttggtgcagaagctgtctaactacgagcagaaaataaaggagagcaagaaacacgtgcaggagactagaaagcaaaacatgatcttaagcgatgaggcgatcaaatataaggataagataaagaccctcgagaagaatcaagaaattctcgacgacactgctaagaatcttcgcgtgatgctggagtcagaaagagaacagaacgtgaagaatcaagacctgatttcagagaataaaaaaagcatcgagaaacttaaagacgtgatcagtatgaacgcctcagagttttcagaagtccagattgcccttaacgaggcaaagctctccgaagaaaaagtcaagtctgagtgccaccgcgtgcaggaagaaaacgcccgcttgaagaagaaaaaggaacaactgcagcaggaaattgaggattggagtaagctgcacgcagaactgagtgagcaaatcaagagcttcgagaagagccagaaggatctggaggtcgccctgactcacaaggatgataacatcaacgccttaaccaattgtattacgcagttaaatttgcttgagtgcgaaagcgagtctgaaggtcagaacaaaggaggcaatgactcagatgagctcgccaatggagaagtaggcggtgataggaacgagaagatgaagaaccaaatcaaacaaatgatggatgtgagcagaactcagaccgcaatcagcgtagtggaagaggacctgaaattactgcagctcaaattacgcgcatctgtgtccaccaaatgcaatctagaggaccaggtcaagaaactggaagatgatcgcaattcattacaagccgccaaggctggtctggaggacgaatgtaagacactcagacaaaaggtcgagatcttaaacgaactgtaccagcagaaagagatggccctgcaaaagaaactttcacaagaagagtatgaaagacaggagcgtgaacaccgcttgagcgctgctgatgagaaggcagtttcagccgcagaggaggtaaaaacctacaaacgacgaattgaagaaatggaggacgaattgcagaagaccgagcgctctttcaagaatcagatcgcgactcatgaaaagaaggcccatgagaattggctaaaagcccgcgctgcggaaagagcaatagcggaggaaaagagggaagccgcgaacttacggcacaaactgctggagctgactcagaaaatggcaatgctgcaggaagaaccagtaattgtgaagcccatgcccggcaaacctaatacccagaatcccccgcggcgaggcccactctctcagaatgggtcattcggcccttctcccgtgtccggcggcgagtgtagtccgccactcacggtcgagccgcctgtgcgcccccttagcgccaccctgaaccgaagggatatgcctcgcagcgaatttggctcagtggatgggccgcttccccatccccggtggtctgctgaggcaagtggtaagccttctccttcagacccgggttcaggcacggccaccatgatgaactccagctcacgggggagctcccctacacgagtgttggatgagggcaaagtgaatatggctccgaaagggccccccccctttcccggtgtccctctgatgtccacccccatgggcgggcctgtcccacctcccatccggtatggcccaccaccgcagctgtgcggaccatttggcccccggcccttgcctccaccctttggacccgggatgaggccacccctgggactgcgggaatttgctccgggggtcccaccaggaaggcgggatttgccacttcacccccgcggcttcttgcctggacacgcccccttccggcccttgggcagtcttggacctcgggaatacttcatcccaggcacaaggctacctcctcccacccacggcccgcaggaatacccacccccacctgccgttcgcgacctcctgccaagcggctcaagggatgaaccgcctcccgcctcccagtccacatcacaggactgttcccaggcgctgaaacagagtccgtag

SEQ ID NO: 194720 - DNA, 5547 bp, Artificial Sequence
  Description of Artificial Sequence: Synthetic coding sequence
atggccgccgcccccggcctgctggtgtggctgctggtgctgcggctgccctggagggttcccgggcaactcgatccctcaacaggaaggcgtttttctgaacacaaactgtgtgccgacgacgaatgttccatgctcatgtatcggggcgaggcactcgaagactttaccgggcccgactgtcggttcgtaaattttaagaaaggcgacccagtctatgtatattataaacttgccagaggctggcctgaagtctgggcaggtagtgtgggacggaccttcggctattttccaaaggacctcatccaagtcgtgcacgaatataccaaagaagagttacaagtcccaacagatgagacagatttcgtttgtttcgacggaggtcgcgatgatttccataattataatgttgaggaacttctcggtttcctggaactttataacagcgccgccacagattctgagaaggccgtcgaaaagactctgcaggacatggaaaagaaccccgaactcagcaaagagagggaaccagagccagagcccgtggaggccaatagtgaggagtcggatagcgtcttctctgagaatacagaagatctgcaggaacagtttacaacgcaaaagcatcattctcacgccaatagccaggccaatcacgctcagggggaacaggcctcatttgagtcctttgaggagatgctgcaggacaagctaaaagttcctgaatcagagaacaataagacttctaactcctcccaggtctctaatgaacaggacaaaattgatgcttacaagctgctcaagaaggagatgaccctggacctgaagactaaatttgggtcaaccgcagacgctctcgtgtcagacgatgagaccaccaggctggtgacatccctggaggacgattttgacgaagagttagacactgaatattatgccgtaggaaaggaagatgaggagaaccaagaagacttcgatgagctcccattgctaaccttcactgatggagaggatatgaagaccccagccaagtccggggtggaaaagtaccccaccgacaaggaacagaattctaatgaagaggacaaggttcagctcacagtgccacctggtatcaagaatgacgataaaaacatattgacaacgtggggtgacacgatcttcagcattgttacagggggtgaagagacccgggatacgatggatctggagtctagctcctctgaggaggagaaagaggacgatgacgatgccttggttccggattcgaagcagggtaagccacagagtgcgaccgactatagcgacccagataacgtagatgatggtttattcattgttgacatcccaaagactaacaacgataaggaagttaatgctgaacaccacatcaaaggaaaagggcggggcgtgcaagagtccaagcgaggcctagtacaggacaagacagaactcgaggacgagaatcaggaaggtatgacagttcactcctctgttcactcaaataacctgaattctatgccagccgccgagaagggaaaggatacgctgaagagtgcctatgacgatacagagaatgacctgaaaggagcggcaatccatatctctaaggggatgttgcatgaagaaaagcccggcgagcagatcctggagggtggaagcgaatcggagtctgcccagaaagctgccggcaatcagatgaatgaccgaaaaattcagcaggagtctcttggaagcgctccattaatgggggatgatcatcctaacgcctcaagagatagcgtggaaggcgatgccttagtgaacggtgccaaattgcacaccctctcagtcgagcaccaaagggaggagctcaaagaagagctggttctgaagactcagaaccaaccgcggttctctagtcccgacgagatagacctgccacgtgagctcgaggacgaggtacccatcctgggcaggaaccttccatggcagcaggaacgagatgtggcagccacagctagcaaacagatgtccgaaaaaatcagactgagcgagggggaggccaaggaagacagcctggacgaagagttcttccatcataaagccatgcagggaaccgaagttggacagactgaccagacagacagcaccggcggtcccgccttcctaagcaaggtcgaggaggacgattaccccagcgaagagcttctcgaggacgaaaatgcaataaatgctaaacggagtaaggaaaagaatcctggaaatcagggcaggcagtttgacgtaaacctgcaagttcccgaccgagctgtattaggaacaatccatccagaccctgagatagaggaatcaaaacaggaaacatctatgatactagatagcgagaaaacctcagagaccgcagcgaagggcgtgaatacgggcggcagagagccaaatacgatggtagaaaaagaaaggcccctcgctgataaaaaagcccaacgcccttttgagagatctgacttcagcgactcaatcaagatccagactccagagctcggggaggttttccaaaacaaggactcagattacctgaagaatgataacccagaggaacacctgaagacttcgggtcttgctggggaacctgagggcgaattatccaaggaggatcacgagaatacagaaaagtacatgggaaccgaatcacagggaagtgccgctgctgagccagaagatgactctttccattggaccccccatactagcgttgagcctggacactccgacaagcgggaggacctactgatcatttcctccttcttcaaggagcagcaatccctgcaacgtttccaaaagtacttcaacgtacacgagcttgaggccctgctccaggaaatgtccagcaagctcaagagcgcccaacaggagagcctcccatataatatggaaaaagtcttagacaaggtgttccgtgcctccgaatctcagatcctcagcatcgcagagaaaatgttagacacccgagtggcagagaaccgggatttggggatgaatgaaaacaacatatttgaagaagcagcggtcctggacgacattcaggatctgatatattttgtgaggtataagcattcgaccgctgaggagaccgcgacactggtcatggctcctcctctggaggaaggcttaggaggagctatggaggaaatgcagccactgcatgaggacaacttctctcgtgagaagacagctgaactgaacgtccaagtccctgaggagcccacacacttggaccaacgggtgattggggacactcacgcatccgaggtgagccagaagcctaatacagagaaagatctcgatccaggtccagtcaccaccgaggacactccaatggacgctatcgacgcgaacaagcagccggagaccgctgccgaggagccagccagtgtcaccccactagagaacgcaattctgctgatttatagtttcatgttttacctgacgaagtcactcgtagccaccctgccagatgacgttcagcctggacccgacttctacgggctaccttggaaacccgtgttcataactgcctttctggggattgcaagttttgctatctttctgtggaggacagtattggtggtgagcaacactgtttattatgtgacagaacagcaaatctccgaaaaactgaagacaattatgaaggagaacaccgagttagtccagaagctatcaaattacgagcagaaaattaaggagtccaaaaaacacgtacaggagacccggaaacaaaacatgatcctgtccgacgaagccatcaagtataaagacaaaattaagactctggagaaaaaccaggaaatcctggatgataccgctaaaaacctaagagtcatgttggagagcgagagggagcaaaacgtaaaaaatcaggacctgcttcaacaggagattgaagactggagtaagcttcatgccgagctctcggagcagatcaaaagttttgagaagagccaaaaagacctcgaggtggcactgacacacaaagatgacaacataaacgctctgacaaattgtattacacagcttaatctcttagaatgtgagtccgaatcggagggccaaaataaaggtggcaacgactcagatgagttagctaacggtgaggtgggcggagaccgcaacgagaagatgaagaaccagataaaacaaatgatggatgtatcccggacacagacagccatcagcgttgtggaggaggatctcaagctgcttcagctaaagctgagagcctccgtgtctaccaagtgtaatctggaagaccaagttaagaaactagaggacgacaggaattcgctccaggcagccaaagcaggcctcgaggacgagtgcaaaactttgcgccagaaggtggagatactgaatgaattgtaccagcagaaagagatggctctgcaaaaaaagttaagtcaggaagagtacgagaggcaggaacgagagcaccggttaagcgcagctgatgaaaaagcggtatctgccgcagaggaggtaaaaacctacaagaggagaatcgaggaaatggaagacgaattacagaaaactgaaaggagctttaaaaatcagatcgccactcacgagaagaaagcccatgaaaattggcttaaagcccgcgccgcagaaagggcaatcgctgaagaaaagagggaagctgccaatctaagacacaagttgctggagctaacgcagaagatggccatgctccaggaagaacctgtcattgtgaaaccgatgcctggcaaacctaatacacaaaatcctccgcgtagagggccactgtcacagaacggctccttcggtccaagccccgtgagcggaggcgaatgttctcctcccctcaccgttgagcccccagttcgccctctgagcgcaacactgaaccgccgggatatgccgcgaagtgaattcggttcggttgacgggcctcttccacatccaagatggtctgctgaagccagcggaaagcctagtccatctgatcccggatccggcactgccacgatgatgaacagcagtagcagggggagctctccaacccgcgttctggatgagggaaaggtgaatatggccccaaaaggccctccacccttccctggggtccctctcatgtcgaccccaatgggaggtcccgtgcccccaccaatacgctacggtccaccaccccaactctgcggaccattcggcccgagacccctgccccctcctttcggaccgggaatgaggcctccgcttggactgagggagtttgctccaggcgtcccgcccgggcgcagagacttaccgctacatcctcggggtttccttcctggccacgcgccattccggcctctggggtcactgggcccacgcgagtacttcatacctgggaccaggctgcctccaccgacacatggaccgcaagagtaccccccgccccctgcagtgcgggatctgctgcccagcggtagtagagatgagccacccccagccagccagtcaacctctcaggactgtagccaggccctaaagcagtctccgtag

SEQ ID NO: 194721 - DNA, 2358 bp, Artificial Sequence
  Description of Artificial Sequence: Synthetic coding sequence
atggacagcgtgcccgccaccgtgcccagcatcgccgccacccccggagatcctgagctcgttggacccctttcggtcttatatgccgcctttatagcgaagctattggagctcgtggcgacactaccggatgacgtacaacccggccccgacttctatgggctgccctggaaacctgtgtttattactgccttcctgggaatagccagttttgcaatttttctctggcgaaccgttcttgtggttaaggatagggtctatcaggtgactgaacaacaaattagtgaaaagctaaagacaataatgaaagaaaatactgagctggtccagaagctctctaattacgagcagaagatcaaggagtcgaaaaaacacgtccaggagacaagaaaacagaatatgatattgagcgatgaagctatcaaatataaagataagattaaaactttagagaaaaatcaggagatactggacgataccgccaaaaatctgcgggtgatgcttgaaagtgagcgagagcagaacgtcaaaaaccaggaccttatttcagagaacaagaagagcattgaaaagctgaaggacgttatcagtatgaacgcgtcagaatttagcgaggtgcagatcgccctcaatgaggccaagcttagcgaagagaaagttaaaagtgagtgtcatcgggtgcaggaagagaacgcgagactgaagaagaaaaaggagcagctccagcaggagattgaggactggtctaagttgcatgcggagctttctgagcagataaagtccttcgagaaatcccagaaagacttagaggttgctctgacccataaggacgacaacattaacgcactaaccaactgcatcactcagttaaatctgctagaatgtgaatcggagagtgaaggacaaaataagggagggaacgactccgacgagttggcgaacggcgaagtagggggtgacaggaatgagaagatgaaaaatcagatcaagcagatgatggatgtaagtagaacccagactgccataagcgtcgtggaagaagatctgaaactcttgcagctgaagctacgggccagtgtgtccaccaaatgcaatttggaagatcaggtgaaaaaattagaggatgacaggaacagtctgcaggccgccaaagcgggtctcgaagacgagtgcaaaactctcagacagaaagtggaaatcctcaatgagctgtaccaacagaaggagatggccctccagaagaaattgagccaagaagagtacgagcgccaggaaagggagcatcgtttgtcagccgctgacgagaaggctgtcagcgcagccgaagaggtcaaaacgtataaacgaagaatagaagagatggaggatgagctgcagaagaccgagcgaagcttcaagaatcagattgctacacacgaaaagaaggcccacgaaaattggctaaaggcccgagccgcagagcgggctattgcagaggagaagagggaagctgctaacctgaggcataaacttttagagctgactcagaaaatggctatgctgcaggaggagcccgtgattgtcaagcctatgcccggaaagcccaatacacagaatcctcccaggcgtgggcccctctcacagaatggctccttcggccccagccccgtcagtgggggagagtgcagtccgccattaacggtagaaccacctgttagacctctatcagccacccttaatcgtagggatatgcctcggtcagaattcggaagtgttgatggccctcttccccatcccaggtggtccgctgaggcgagcggaaagcccagcccttctgatcccgggagcggcaccgccactatgatgaatagtagcagtcgaggctccagcccaacgagagtgctggacgaggggaaagtcaacatggcacccaagggaccccctccctttcctggggtgcccctaatgtcgacgcccatgggtggacccgtgccccctcccattaggtacggccccccacctcagctctgcggcccatttggacctcgacccctgccacccccttttggccccggcatgagaccacctttgggcctgcgggaattcgccccaggcgtgccacccggtaggcgcgacttacccctccatccacgagggtttttgcccggccatgctccatttcgcccactgggttcactaggcccacgagaatacttcataccaggaacccgactacccccccctacgcacggtccacaggagtaccctcctccccctgccgttcgcgatcttctgccgagtggttcgagagacgagcctccgccagccagccaatcaactagccaggactgtagccaggcgctgaaacagtccccgtag

SEQ ID NO: 194722 - DNA, 5724 bp, Artificial Sequence
  Description of Artificial Sequence: Synthetic coding sequence
atggccgccgcccccggcctgctggtgtggctgctggtgctgcggttgccctggagagtaccagggcagctcgaccccagtactggaaggaggtttagcgagcacaagttatgcgccgatgacgagtgctctatgctcatgtacaggggggaagctctggaagactttacaggccccgattgtagattcgtgaattttaaaaaaggagatcctgtttatgtctattacaaattagcaagaggttggcccgaggtgtgggctggttcagtggggaggacattcgggtatttccctaaggatctgattcaggtagtgcatgagtacaccaaagaagaactgcaggtgcctacagacgagacggattttgtgtgtttcgatggggggcgggacgacttccataactataatgtggaagagttgttaggcttcttagaactgtacaatagcgctgccacagactccgaaaaggcggttgagaagacactccaagacatggagaagaatcctgaactgtcaaaagaacgcgaacccgagcccgagccagtcgaggcaaattcggaggaatctgattccgtctttagcgagaatacagaggatttacaggagcagttcacaactcagaaacatcatagtcacgcaaacagccaggcgaatcatgctcagggcgaacaggcctcttttgaatctttcgaagagatgctgcaggacaaattgaaagtgccagaatccgagaataacaagacgtcaaacagcagccaggtgtctaacgagcaggacaagatcgacgcgtataagctattgaaaaaggagatgaccctagacctcaagaccaagtttgggagtacggccgatgccctggtgagcgatgacgagacaactaggctcgtgacgtccctcgaagacgattttgatgaagaacttgatacagagtactatgccgtagggaaagaggatgaagaaaatcaggaagatttcgatgaactacccctgctgacctttactgacggtgaagacatgaaaactcccgccaagtccggggtagaaaagtaccccacagacaaggagcagaactctaacgaggaggataaagtgcagctgacagtgccccctggcatcaaaaatgacgacaagaatatcctgacaacatggggagatactatcttctcaattgtgaccggcggagaagaaacacgggacactatggacctcgagtctagcagcagtgaggaggaaaaagaggacgacgatgacgcactggtgcccgattccaagcagggcaaacctcagagcgccacggattacagcgatcccgacaacgtagatgacggcttgttcattgttgatatccctaaaacaaacaatgataaggaagtaaacgctgaacaccacattaaaggaaaaggaagaggggtccaagaatcaaaacggggtttggtgcaggataaaactgaactggaggatgagaatcaggaggggatgacagttcactcctccgtgcacagcaataatctcaactcgatgccagccgctgagaaaggcaaagataccttaaagtccgcctacgatgacactgaaaacgatctgaagggagctgccattcacatttccaaagggatgttacacgaagagaaacctggagagcagatcttggaaggagggtccgaatcggagagtgcacagaaggctgccgggaaccagatgaacgataggaaaattcaacaagaaagcctaggaagcgctcccctgatgggggacgatcatccaaacgcctccagagattctgtagagggagatgcgctagttaatggcgccaaacttcataccttaagcgtggagcaccagagagaggagctgaaggaagaactagttctgaaaactcagaatcaaccaagattcagtagtccggacgagatagacttgccccgggaattggaggacgaggtcccaatccttgggcggaacctcccttggcagcaagaacgggacgtcgcagccactgccagcaaacagatgtccgagaagattcggctgtccgagggcgaggccaaagaggacagcctcgacgaggagttcttccaccacaaggccatgcaggggaccgaggtcgggcaaacagatcaaactgatagcaccggaggaccagcctttttatctaaggtcgaggaagatgactatcctagcgaggaactcctcgaggacgagaacgccataaacgcgaaaagatcgaaagagaagaacccgggtaaccagggcagacagtttgatgtcaatttacaggtgcctgatagggctgtgctcggaactatccatcccgatcccgagatagaagaaagcaagcaggagacttctatgatcctcgacagcgagaagacctcagaaacagccgcgaagggggtaaacactggcggacgggagcctaacaccatggtcgagaaggagcgccctctcgcggataagaaagcgcagagaccttttgagcggagcgacttttcggatagtattaagatccagacacctgagctaggcgaagtcttccagaacaaggatagcgattatctgaagaatgacaatccagaggagcacttgaaaacttccggcctggctggagagcccgaaggggaattaagcaaagaagaccacgaaaacacggaaaagtacatggggaccgagtcccagggttccgcagcggctgagccagaggacgattcttttcactggaccccgcataccagcgtggaacctggccacagcgataagagagaagacctgctaatcatatcatctttctttaaagagcaacaaagtctgcaacgctttcaaaaatacttcaatgtgcatgaattggaagcattgctccaagagatgtccagtaagctgaaatccgcgcaacaagagtcactcccgtataacatggagaaggtgctagataaagtgttccgggcctccgagagccagatcctgtccatcgccgagaaaatgttggatactcgagtggccgagaacagagacctcggcatgaatgaaaataatatttttgaagaagcggcagtgctggacgatatacaggacctaatttacttcgtgcgctataagcactcgacagcagaagagacggccacactggtgatggcaccaccactagaggagggactcgggggggcaatggaggaaatgcagccactgcacgaagataacttttctagagagaaaaccgccgaactgaatgtgcaggtccctgaagagcctacccacttggaccagcgcgtgattggagacacccacgcttccgaggtgtcccagaagcccaacacagagaaggatctggatccaggcccagttacgactgaggatacaccgatggatgcaatcgatgctaacaaacagccagagacagcagccgaagaacctgccagcgtgaccccgctcgagaacgctatcctgctaatatattcctttatgttttacctgaccaaaagtctcgtcgcaacgctgcccgacgacgtgcagcccggacccgacttctacggcctgccgtggaagcctgtattcatcaccgctttcttaggcatcgcatccttcgccatattcctgtggaggaccgtcctggtagtgtccaataccgtctattatgtgactgaacagcagatcagcgaaaaactcaagacaataatgaaggaaaacaccgagctggtgcagaaactgagcaactacgaacagaagatcaaagagagcaagaaacacgtccaggaaacgcgaaaacagaacatgatcctcagcgacgaggctattaagtataaagataaaatcaagactctcgaaaagaaccaggaaatcctggacgatactgccaaaaatctccgggtcatgctggaatctgagcgagaacaaaatgttaagaaccaggatctgatctccgagaacaagaagagcatcgaaaaactcaaagatgttatctccatgaacgcaagcgaattttctgaagtccaaatcgctctgaacgaggctaagctctcggaggaaaaagtgaagagcgaatgccatcgcgtccaggaggaaaatgctcggctgaaaaagaagaaagaacagctacagcaggagattgaagattggtcaaagctccatgccgagctctccgaacagataaagtcattcgagaagagccagaaagacttggaagttgctctcacccacaaggatgataatattaatgcactaactaattgtattactcaattgaatcttcttgagtgtgaatctgagtcagaggggcagaacaagggcggtaatgattccgatgaactggctaacggggaggttggcggagaccggaacgaaaagatgaaaaatcagattaaacagatgatggacgtgagccgcacccagactgcaatcagcgtggtcgaggaggacttgaagcttctccagctgaaactgagggctagcgtgtcgaccaagtgcaatttggaggatcaggtcaaaaagctcgaagatgaccgcaactctctgcaggcagcaaaagccgggctggaagatgaatgcaagacactgaggcagaaggtcgagatcttaaacgaactgtaccagcagaaggagatggctctccagaaaaagttgagccaggaggaatacgaacggcaggagagggagcatcggcttagcgccgctgacgagaaagcagtgtctgcagcagaagaagtgaaaacatataagaggagaattgaagaaatggaggacgaactacaaaagaccgaaagatcctttaagaaccaaatcgcaactcacgagaaaaaagcccacgagaactggttgaaagctcgcgctgccgagcgggctatagccgaagagaaacgagaggctgctaacttaaggcataagctcctcgaactgactcagaagatggctatgctgcaggaggagcctgtgattgttaagcccatgcccggcaagcctaacacccaaaatcctcccagacgagggccactcagtcaaaacggatccttcggaccctctcccgtgagtggaggcgagtgttccccgcccctgaccgttgaaccacccgttaggccactctccgctaccctgaatcggagagacatgccccgaagtgagttcggaagcgtagatggcccacttccgcatcctcgctggagtgccgaagcctcaggtaaaccgtccccttccgacccgggatcaggcacagctacgatgatgaattcttcaagccggggcagcagcccaaccagggtgctggatgagggcaaagtgaatatggccccaaaagggcccccgcccttcccaggtgttcctcttatgtcaacccccatgggtggacctgttccacctcctatccgctatggcccccctcctcagctgtgcggaccatttggaccccggcccctgccgccacccttcggccccgggatgcggcctcccttaggcctgagggagtttgctccaggcgtcccaccaggccggcgggacctgccactgcatccaagaggcttcctgcctggacacgctccatttcgaccgttgggctctctgggtccccgcgaatatttcatccctggtacaagactccctccccctacacacggacctcaagagtatccccctcctccggcagtgcgagacttactcccttctgggtctagggatgagccacctccggcctcccagtccactagtcaagactgctcgcaggctctcaaacagtccccgtag

SEQ ID NO: 194723 - DNA, 1503 bp, Artificial Sequence
  Description of Artificial Sequence: Synthetic coding sequence
atggccgccgcccccggcctgctggtgtggctgctggtgctgcggctgccctggagggtgcctggtcagctggaccccagcaccgggaggagattctctgagcataagctctgcgcagatgatgagtgtagtatgctgatgtatagaggggaggcattggaggattttacaggtcccgactgccgcttcgtcaacttcaaaaagggggacccggtgtacgtgtactataagctagcccggggctggcccgaggtctgggctggatccgtcggccgcacgttcggctacttcccaaaggacctgatccaagtagtccacgagtacactaaagaggagctgcaagttccaactgacgagaccgacttcgtgtgttttgacggcggcagggacgactttcacaattacaacgttgaagaactgttgggcttcttggagttgtataattccgcggcgaccgattccgaaaaagctgttgagaagactctgcaggacatggagaagaacccagagctaagcaaagaaagagagcctgagcccgagcccgtggaagcaaatagtgaggaaagcgattccgtattctccgaaaatactgaggatctacaggaacagtttacaacccagaagcatcattcacacgcaaatagtcaagccaatcacgcccaaggagaacaggcctcatttgagagttttgaggagatgttgcaggacaaattgaaggtcccagagagtgaaaacaataagactagcaattcctcacaggtttccaatgaacaggataaaatagacgcttataagctgctaaagaaggagatgaccctggacctaaaaaccaaatttgggtccactgcagacgccctcgtctctgacgacgagacgactcgcctggtgacatccctggaggatgattttgacgaggagctggacacagaatattatgcagtagggaaggaagatgaagagaatcaggaggacttcgatgaactgcctctcctcacgtttactgatggtgaggacatgaaaactccggcgaagagtggcgtggagaagtatccgacagacaaggaacagaatagcaacgaggaagataaagtccagctaactgtgcctcctggcatcaagaacgatgataagaatattcttacaacatggggcgacacgatattttccatcgtaactggaggcgaagagacccgggacacaatggacctagagagcagcagctccgaggaggagaaggaggatgatgatgatgctttagtgccagacagcaagcagggcaagccacagtccgctacggattacagcgatcctgacaacgtggatgacgggctgtttattgtggatatcccaaagacaaacaatgacaaggaggttaacgcagaacaccacattaagggcaaaggacgtggagtgcaggagagcaaaaggggcttggtgcaggacaagaccgagcttgaagacgagaatcaggagggcttcaagaccgaaccgatcaaattgtag

SEQ ID NO: 194724 - DNA, 5724 bp, Artificial Sequence
  Description of Artificial Sequence: Synthetic coding sequence
atggccgccgcccccggcctgctggtgtggctgctggtgctgcggctaccctggcgagttcccggccagttagatccgtccactggtaggagattcagtgagcataagctgtgtgccgacgatgagtgttccatgctgatgtaccgcggggaagccctggaagatttcactggcccagattgccgcttcgttaattttaaaaaaggagacccggtctatgtttattataaactcgcccgcggctggccggaggtctgggccggctccgttgggcgtactttcgggtacttcccgaaggatttgattcaggtcgttcacgagtacacaaaggaagaacttcaggtgccaaccgatgagaccgacttcgtgtgttttgatggaggcagagatgacttccacaactataatgtggaagagctgttaggctttctggagttgtacaattccgctgctacagattctgagaaagccgtcgagaaaaccctacaggacatggagaaaaaccccgaactcagcaaagaaagggaacctgaacccgagccagtggaagccaacagcgaagagagcgactcagtctttagtgagaacacggaggacctgcaggaacagtttactactcagaaacatcacagccacgctaactcacaggcaaatcacgcccagggagaacaggccagctttgagtccttcgaggaaatgctccaggataaactcaaagtacctgagagcgaaaataataaaacaagcaacagctctcaggtgtctaacgaacaagacaaaatcgatgcctataaacttctcaagaaagagatgacattagatttgaagaccaaatttggcagcaccgctgatgccctcgtgtccgatgatgaaactactcggttagttacctccctggaggacgattttgacgaagaactggacacagaatactatgcagtgggtaaggaagacgaggaaaaccaagaggacttcgacgaattacctttgctcaccttcaccgatggggaggatatgaaaacccctgcaaaatctggagtcgaaaagtaccctacagacaaggagcagaactcaaatgaagaggacaaagtccagttgaccgtgcctcccggcatcaagaacgatgataagaacattctcaccacgtggggtgacaccattttctccattgttacaggcggagaggaaacacgggataccatggacctcgaatctagctccagtgaggaggaaaaagaggatgacgacgacgccctcgtaccggatagtaagcagggcaagcctcagagtgcaaccgactactccgacccagataacgtggacgatggactttttattgtcgacataccgaaaaccaataatgataaggaagtcaacgccgagcaccatattaaggggaagggccgcggagtgcaggagtcaaagcggggccttgttcaggacaagaccgagctggaggacgagaatcaggagggtatgacagtacattcttccgtccattctaataatctgaattccatgcccgccgctgagaagggtaaagacactctcaagtccgcatacgacgatacagagaacgatcttaagggggcggcaatccacatctcaaagggaatgctgcacgaagagaaacccggcgagcaaattctggagggcgggagcgaaagcgagagcgctcagaaggccgcggggaatcagatgaacgaccggaagatccagcaggagagcctggggagcgctcccctcatgggggatgaccaccccaatgccagtagggatagtgttgaaggcgacgcgctcgtcaacggggcaaaactgcacaccttgtccgttgagcaccagcgagaggaactgaaggaggaattagttttgaaaactcaaaatcagcctaggttctctagccccgacgagatcgatctacccagagaactcgaggacgaggtccctatcctaggccggaatttgccctggcagcaggagcgcgatgtggctgcaaccgcctcaaaacaaatgtctgaaaagatcagactgtctgagggggaagctaaggaggattcccttgatgaggagttcttccaccacaaggcgatgcaggggactgaagtcggccaaacagaccaaacagattctaccgggggccccgcattcctgtccaaggtggaggaggatgactaccctagcgaagagctattagaagacgagaatgctattaatgccaaacgcagcaaagagaagaatccaggcaaccaaggaagacagtttgacgtaaacttacaggttcccgatagggctgtgctcggtacgatccatcccgaccctgaaatcgaagagagcaagcaggaaacaagcatgattcttgattcagagaagacatcagagaccgctgcaaagggtgttaacacaggcggccgggagcctaatacaatggtggaaaaggagcgtcccctggctgacaaaaaagcacaaagaccctttgagcgtagcgatttctcagactcaattaagatccaaaccccagagctgggggaggtatttcagaataaggactcagactacctgaagaatgacaatccagaggaacacttgaagacctccggacttgctggggaacccgaaggcgagctcagcaaggaggaccatgagaatactgagaagtatatgggaactgagtcacagggatcagcagccgcagaaccggaggacgactccttccactggacaccccatacctcagtggagccaggtcactccgataagagggaagatttactcatcatatcgagtttctttaaagagcagcagagccttcagagattccagaagtattttaacgttcatgaactggaagccctgttgcaggagatgagtagcaagttgaaatcggcgcagcaagagtctctgccctacaatatggagaaggtcctggataaggtgttccgggcctccgagtcacagatcctctctatcgctgaaaagatgctggacacacgggtggctgaaaacagggacctcgggatgaatgaaaataatattttcgaagaggcggctgtattggatgacatacaggatctgatctatttcgttcggtataagcatagtactgccgaagaaacggccactctcgtcatggccccccctctagaagaagggttgggcggagccatggaggagatgcagccactacatgaagacaatttctcccgcgaaaagacggccgagctcaatgttcaggtgccagaggagccaactcatctggaccaaagagtcatcggcgacactcacgcttcagaagtctcccagaaacccaatactgaaaaggatctggaccccggtcccgtgactaccgaggatacgcctatggatgccattgatgccaacaagcagcccgaaaccgccgcagaggaaccggcctctgtcacacccctggagaatgctattttgctgatatacagctttatgttctatttgacaaaatcactcgtggccaccttgccagatgacgtgcagccagggcccgatttctacggcttaccctggaagcccgtgtttatcactgcattccttgggattgccagcttcgctatctttctttggcgtaccgtcctcgtggtgaaagaccgagtttatcaagtaaccgaacagcagatttctgaaaagctgaaaactatcatgaaagagaacactgagctggtgcaaaagctgtccaattatgagcagaaaattaaagaaagcaaaaagcatgttcaggaaacgcgcaaacagaacatgattctttccgacgaggccattaagtacaaggacaagataaagaccctcgaaaagaaccaggaaatacttgacgataccgcaaaaaacctcagagtcatgctggaaagcgaacgcgaacagaatgtgaagaaccaggacctgatttcagagaacaagaaaagcatcgagaaactcaaggacgtgatttcgatgaacgccagcgagttttcggaagtccagatcgctttgaacgaggcaaagcttagcgaggagaaagtgaagagtgaatgccaccgggtacaagaggaaaatgccagactaaaaaagaaaaaggaacagttacagcaggagattgaggactggagtaagcttcatgctgagctgagcgagcagatcaaatcatttgagaaaagccagaaagacctggaggtggcgctgacccacaaggatgacaacattaatgcactgacaaactgtattacccagctgaacctactggaatgtgaatcggaaagcgaaggccagaataaaggtgggaatgattcagatgagctggcaaatggtgaggtgggcggtgatagaaacgagaagatgaagaatcagattaaacagatgatggatgtttcaagaacacaaactgcgatctccgtggtggaagaagaccttaagcttctacagcttaagttacgcgcaagcgtatccacgaaatgcaacctagaggatcaggtgaagaagctcgaggatgataggaattcactacaggcagccaaggccggcctggaagacgaatgcaagactcttcgtcagaaagtcgagatcctgaacgaactttatcaacagaaagaaatggccttgcagaagaagctgagccaggaagaatacgaacggcaggagagagaacatcgattgagcgcggccgacgagaaggcagtgagcgctgccgaggaagtaaaaacttacaagagacgtatagaagagatggaagatgaattgcaaaaaactgagaggtccttcaagaatcagattgccacgcacgagaaaaaggcccatgaaaactggttgaaggcaagggccgccgagcgggccattgcagaggagaagcgggaggctgcgaatttgagacataagttacttgagcttacccagaagatggctatgttacaggaggagcccgtcatcgtcaagcctatgcccggaaagcctaatacgcaaaacccaccgcgccggggtcccctttcacaaaatggcagctttggacctagccccgtcagtggtggggagtgtagccccccactaactgttgagcctcccgtgcggcccctcagcgcaaccctgaaccgcagagatatgccgaggtctgagtttgggagcgtggatggcccactgcctcatccgaggtggagtgctgaggcctcgggcaaaccctcgccgtccgatccaggatcaggaacagccaccatgatgaattcgtcttctcgcggctcgtctcctacaagggtgctcgacgaggggaaagtgaacatggccccaaagggaccgccccctttccccggagtccccttgatgtccacccccatgggcggccctgtcccacccccaattaggtatgggcccccacctcagctctgcggcccattcgggccacggcccttacctccaccctttggtcctggcatgagaccacccctcgggcttcgagagttcgctcctggagtgcctcctggcagaagggacctccctcttcacccccggggcttcctccccggccatgcgccattccgtcctttgggcagcttaggcccgcgagaatacttcataccggggactagactgcccccaccaacccacggaccgcaggaatacccccccccacctgccgtgcgagacctgctaccaagtggaagtcgggatgagccaccgcccgcaagccagagtacctcgcaggattgctctcaagccttgaagcagtctccttag

SEQ ID NO: 194725 - DNA, 3051 bp, Artificial Sequence
  Description of Artificial Sequence: Synthetic coding sequence
tgactggtgcccgacagcaagcagggcaagccccagagcgccaccgactacagcgatccagataacgtggatgacggcttgtttatcgtggacatccctaaaaccaacaacgacaaggaagtgaacgcagagcaccacataaaaggaaagggcagaggcgtgcaggaatccaagcgggggctcgtgcaggataagaccgagctggaggacgaaaaccaggagggaatgaccgtgcacagtagcgtacacagcaataatctcaattccatgcccgcagccgagaaaggcaaagatactcttaagagtgcttatgacgacacagaaaacgacctcaagggggcagcaatccacatctctaaagggatgttgcatgaagagaagccgggcgaacaaattctggaggggggcagcgaaagcgagagcgcacagaaagcggccggcaatcagatgaacgatcgcaaaatccagcaggagtccctcggaagcgcgcctctaatgggcgatgaccaccccaacgcgtcaagagactcagtcgaaggagacgctctcgtgaacggtgccaaattacatactctctctgtggagcaccaaagagaggagctgaaggaagaactggtactgaaaactcaaaaccagcctcgcttctcatccccagatgagatcgatctgcccagagaactggaggacgaggtcccaatcctgggtcgcaacttaccgtggcagcaggaacgagatgtggccgccaccgcctctaaacagatgtcagaaaaaatcagactctcagagggcgaggccaaagaagatagcctggacgaagagttctttcaccataaggcgatgcaaggaactgaagtgggacagaccgatcagactgatagtacaggtggcccagcatttctgtctaaagtggaagaagacgattatcctagcgaagagttgcttgaggatgaaaatgctattaacgcaaagcgatctaaggaaaagaatcccgggaaccagggccgacagtttgacgttaatctccaggtgcctgatagggccgtccttgggaccatccacccagaccccgagatcgaggaatcaaaacaggaaaccagtatgattctcgattccgaaaaaacatcagagacggcggctaaaggggtgaataccggggggagggagcccaatacaatggtggaaaaagaacgtcccctggcggacaagaaagcccagaggccattcgagaggagcgacttcagtgattccattaaaatccagacaccggaactcggcgaggtgttccagaataaagacagcgattacctgaagaatgataatcccgaagagcatctgaaaacctctggactagccggagagccagaaggcgagctcagtaaggaagatcacgaaaataccgagaaatatatgggtactgagagccaaggatctgctgccgccgaaccagaagacgattcctttcattggacacctcacaccagcgtggagcctggacactccgataagcgcgaagatctcctgatcatcagctcattttttaaagaacagcagtcgctacaaagattccagaagtatttcaacgtgcacgaactggaggccctcctccaggaaatgtcctccaaactgaagtccgctcagcaggaatccctgccctataacatggagaaagtgctcgataaagtattcagggcctccgagtcacaaatcctaagtatagccgaaaaaatgctagatacaagggtagccgagaaccgggacctcggaatgaacgaaaataacattttcgaggaagccgcggtgctagatgacatccaggatctcatctacttcgtgcggtacaagcactccaccgccgaggagacggccaccctcgtgatggcccctcctctcgaagagggcctcggcggggccatggaagaaatgcagccactgcacgaggacaacttctcgcgagaaaagacagcagaactgaacgtgcaggtaccagaagagcccacccacttggaccagcgtgtgatcggggacacccacgcatctgaggtgtcacaaaagcccaatacagaaaaagatcttgaccccgggccggtgacaacagaagacacccccatggatgccatcgatgcaaataagcaacccgagactgccgcagaagagcccgcttcagtgacccctctggagaatgccatcctgttgatttactccttcatgttttacttaaccaagtctctcgtcgctacccttccggacgatgtgcagccgggaccagacttctatggcctcccttggaaaccggtgtttatcacagcatttctcggcattgcttcatttgcaattttcttgtggcgaactgtactggtcgttaaggatcgcgtgtaccaagtaaccgagcaacaaatcagcgagaagcttaagaccattatgaaggaaaacaccgagctggtgcagaaactgagtaactacgaacagaaaatcaaggagtcaaagaagcacgtccaggaaacaaggaagcagaatatgatcctatccgatgaggccattaagtataaagataagatcaaaactctcgaaaaaaatcaggagatactcgatgataccgcgaaaaatttgcgagtgatgcttgagtctgagagagagcagaacgtcaagaatcaagatctgttgcaacaagagatagaagattggtcaaaactgcacgctgagttaagcgagcagataaagtcctttgagaagtctcaaaaagacctcgaggtggccctgactcataaagatgacaacataaacgcacttaccaactgcattacacagttgaatctcctcgaatgtgaatccgagagtgaaggacaaaacaagggagggaacgacagcgacgagctggccaatggcgaagttgggggagacagaaatgaaaagatgaaaaaccagatcaagcaaatgatggacgtctccagaacgcagacagcgataagtgtagtggaggaggaccttaagctgttacagttgaagctgcgcgcatctgttagcactaaatgtaacctggaggatcaggtctag

SEQ ID NO: 194726 - DNA, 324 bp, Artificial Sequence
  Description of Artificial Sequence: Synthetic coding sequence
tgaagcgccgaggccagcggcaagcccagccccagcgaccccggcagcggtacagccactatgatgaatagctctagtcgcggatcgtctccaactcgagttcttgatgaggggaaagttaacatggcacccaagggcccacccccattccccggcgtccctctgatgtcgacccccatgggcggacctgtgcccccccccatacgttacgggcctcctcctcaactctgcgggccctttgggccaaggcctcttccgcccccttttgacaaggatgggcgcccaggaaccgtggctcatgcatgtaacccatctaccctctag

SEQ ID NO: 194727 - DNA, 1803 bp, Artificial Sequence
  Description of Artificial Sequence: Synthetic coding sequence
atgggcaagaagctggacctgagcaagctgaccgacgaggaggcccagcatgtgcttgaggttgtacaacgggactttgacctgcgacgtaaggaggaggagcggctggaagccctgaaaggtaaaatcaagaaggagagcagcaagagagagcttctcagcgacacagcacaccttaacgagacgcattgtgcacgctgtctacaaccataccagttactggtgaactccaagcggcagtgtctcgaatgtggtctgtttacctgcaagtcctgcggccgggtgcaccccgaagaacaggggtggatctgcgatccctgtcacttagctagagttgtaaaaatagggagtctggaatggtattacgaacacgtgaaagcaaggtttaaaagattcgggtctgcaaaggtcatccgatcactacatgggaggctccaggggggggccggtccagagctgatctcagaggaacggtcaggggattctgaccagacggacgaagacggtgaaccaggttctgaagcccaagcgcaagctcagccgttcggcagcaagaaaaaaaggctactgagtgtgcacgattttgacttcgaaggcgactcagatgatagtactcagccccaaggacactctctccatctgagcagcgtgccagaggcccgggatagtcctcagtcactgaccgatgaaagctgttcagagaaagccgcgccgcacaaagcagagggcttggaagaagccgacacaggtgcctcaggttgccatagccatccggaggagcagcctacatccatatcaccttctcggcacggtgccctggccgagctgtgtcctccaggcggctcacaccgaatggccctcggaaccgccgctgccctgggatctaatgtgatccgtaatgagcagcttccactgcagtacctcgctgatgtggacacttccgatgaggagagcatcagggctcacgtgatggcatcacaccactccaagcgcagaggacgcgcctcgagtgaaagtcagatatttgagctgaacaaacacatctcagccgtagagtgtctgcttacttatctagagaacacagtcgtcccgcccctggccaaaggcttaggcgccggcgtgcggactgaggccgatgtggaagaggaggccttacgaagaaagttggaggagcttacctccaacgtcagtgaccaggagactagtagcgaagaagaggaagccaaggacgagaaggccgaacctaatcgcgacaaaagtgtcggtccactgccgcaggccgatcctgaggtgggtactgcagcccaccagacaaaccgtcaggaaaaatcccctcaggacccaggcgacccagtgcagtacaaccggacgaccgatgaggagctgtcagagctcgaagatcgagtggccgtcacggcctccgaagtccagcaggcagagtcagaagtgtctgatatcgaatcccggatcgctgctctgagagccgccggcttgaccgtgaaacctagcggcaagccaagaaggaagtctaacctcccaatctttctccctagagtggcaggcaaattaggcaagcgaccagaggatcccaacgcagatccttcctccgaggccaaggcaatggccgtgccctacctattacggcgcaaattctctaatagcttgaaaagccaaggcaaggatgatgattcattcgataggaaatccgtttacagggggtccttaacgcagcgcaatcctaacgcccggaagggaatggcttctcacacttttgctaaacccgttgtggcccaccagtcttag

SEQ ID NO: 194728 - DNA, 1719 bp, Artificial Sequence
  Description of Artificial Sequence: Synthetic coding sequence
atgggcaagaagctggacctgagcaagctgaccgacgaggaggcccagcacgtactggaagtcgtccagcgggactttgatctgcggaggaaagaagaagagcggctggaggcgctcaagggcaagattaagaaagaatcttctaagcgcgagcttctgagtgacaccgcccacctgaacgaaacgcattgcgccagatgccttcaaccttaccagcttttggtgaattcaaagagacagtgtctcgagtgcggcctgttcacctgtaagagttgcggacgggtgcatccagaagagcaggggtggatctgtgatccatgtcacttggcgagagtggtgaaaatcggcagcctggaatggtactatgagcatgtcaaggccagattcaaacgattcggctccgccaaagttatccggagcctccacggacggctgcaaggcggagccggcccggagctgattagcgaggaacgatccggagattcagatcagactgacgaggacggggagccgggctccgaagcacaggcacaggcacaaccctttggaagcaagaaaaaaaggctgctgagcgtccatgactttgactttgaaggggattcagatgattccacacagccgcaaggacactctttgcacctctcttcggtcccagaggccagagactcgccccagtcactgacagacgagtcctgcagtgaaaaagccgcaccacacaaagctgaggggttggaggaggcagatactggagcgtctggctgccacagccaccccgaggagcagccgacatccattagcccctcgaggcacggtgcgctggctgaactgtgtccaccaggcggctctcaccgaatggccctaggcaccgcagccgctctgggctctaacgttataagaaacgaacagctgccactgcaatacctggctgacgttgacacaagcgacgaagagtccattagagctcacgtgatggcaagtcaccattcaaaacgccgagggagagcctcatccgagtcgcaaggcctaggggccggggtgcgcacagaagcagatgtggaagaagaagctctcaggagaaagctggaggagctcacctcaaatgtcagtgatcaggaaacaagttcggaggaagaagaagctaaggatgaaaaggcggaacctaatagagacaagagtgtggggcccttaccccaggcggaccccgaggtaggcaccgctgcccatcagaccaaccgccaggaaaagtcaccccaggacccgggtgatcctgttcaatataatcgcactaccgatgaggagctgtctgagttagaagatcgtgtggcagtgacagctagcgaggttcaacaggccgagtctgaggtttctgacatcgaatcccgaattgcagctctgagagccgctgggctaacggtcaagcccagcggcaaacctcgacgaaaatcaaatttgcctatctttctgcccagggtggccggaaagctgggtaagagaccagaagatcccaatgccgatccaagtagcgaagcaaaggctatggcggtgccttacctgctccggaggaagttctctaattcactgaaatctcaaggcaaggatgatgattcctttgacaggaaaagtgtctaccgtggatcactcacgcagcgtaatccaaacgcgcggaaggggatggccagccacacctttgctaagccagtcgtggcccaccagtcctag

SEQ ID NO: 194729 - DNA, 396 bp, Artificial Sequence
  Description of Artificial Sequence: Synthetic coding sequence
atgggcaagaagctggacctgagcaagctgaccgacgaggaggcccagcacgtgctggaggtggtgcaacgggatttcgatcttagaagaaaagaggaagaaagactggaggccctcaagggcaagattaagaaggagagtagcaagcgcgaactactctcagacactgctcacctcaatgaaacacactgtgctcggtgcctacagccttaccaactacttgtgaactccaagaggcagtgtctcgagtgtgggctcttcacctgcaagagctgtggcagggtgcatcccgaggaacagggatggatctgcgacccgtgtcacctggcccgcgtggtaaagataggatcattggagtggtactatgagcatgtcaaggcgaggttcaaacgatag

SEQ ID NO: 194730 - DNA, 213 bp, Artificial Sequence
  Description of Artificial Sequence: Synthetic coding sequence
atgggcaagaagctggacctgagcaagctgaccgacgaggaggcccagcacgtcctggaagtggttcagagagacttcgacctccgcagaaaagaggaggagcggctagaggcgctgaaaggcaagatcaaaaaggaatctagcaaaagagaactgttatcagacaccgcccaccttaatgaaactcactgcgcacggtgcctgcagccgtag

SEQ ID NO: 194731 - DNA, 1656 bp, Artificial Sequence
  Description of Artificial Sequence: Synthetic coding sequence
atgggcaagaagctggacctgagcaagctgaccgacgaggaggcccaacacgtgctcgaagtggttcagcgcgactttgacctacgcaggaaggaagaggagcgcctggaggctctcaagggcaagatcaagaaggaatccagcaagcgagagttgctgtctgatacagcccatttgaacgaaacacattgcgcacgctgcctgcaaccgtaccaactgctcgtgaactcaaagaggcaatgcttggagtgcgggctttttacatgcaaaagttgcggacgagtgcacccagaggaacagggttggatttgtgatccatgtcatcttgctcgagttgtaaagattggttctttagaatggtactacgaacacgttaaggcccgatttaagcggttcggaagtgctaaggtgatccggagtctgcacggtcggcttcagggaggagcaggccctgaactcatttccgaggaacggtccggcgattcagaccagacagacgaggacggagaacctggaagcgaggcccaagcccaagcacagcccttcgggtccaagaaaaaacgcctactgagtgtgcacgatttcgactttgagggagattcagatgattccactcagcctcagggccactcactccacctgtctagcgtacccgaagcaagggattctcctcaatccctgaccgacgagtcatgcagcgaaaaggccgccccccacaaagctgaaggattagaagaggccgatactggggctagcggttgtcactctcatcccgaagaacaacccacgtcaatatctccctcaagacacggcgctcttgcagagctgtgtccgccaggcggctcacacaggatggccttgggcacggctgcggcattgggctctaatgtcattagaaacgagcaacttcccttgcagtacctggcagacgtcgacaccagtgatgaagaaagcatcagggcgcacgtcatggcgtcgcaccactctaagcgccgcggccgcgcttccagcgaatcacagatatttgagctgaataaacacatctccgcagtcgaatgtctcctgacataccttgagaatacggttgtgccccctctagccaagggacttggggcaggggtgaggacagaagccgacgtcgaagaagaggctcttagaagaaaattggaagaactgactagcaacgtctctgatcaggagaccagttctgaggaggaggaagccaaagatgagaaggcagaaccaaacagggacaagtcggtgggcccattgccccaagctgaccctgaggtgggcactgccgcacaccagacgaataggcaagagaagagcccacaggaccctggggaccctgtgcagtacaataggactaccgatgaggagctttccgaattggaggatagggttgctgtgacggcctccgaagtacagcaggcagaatctgaagtcagcgacattgagtcccgtatagccgcactgcgggcagcaggcctgaccgtgaagccatccggcaaaccaagaagaaagtcgaatctgcctgctctctatgaagggacgctgtccctttgttcggaggatcttaagcatacgcacccagactcggtgaagagtaaacggtctcggttaaatcacgtagcttcatgtggtaatccatag

SEQ ID NO: 194732 - DNA, 675 bp, Artificial Sequence
  Description of Artificial Sequence: Synthetic coding sequence
atgggcctgcgggactggctgcggaccgtgtgctgctgctgcggctgcgaatgcctcgaggaacgcgccttaccggagaaagagccactggttagtgacaacaatccatatagcagttttggtgccacactagtcagggatgatgaaaaaaatctgtggagcatgccccatgatgtaagtcacaccgaagctgacgacgatagaaccttatacaacctgatagtaatacggaatcaacaagctaaagattcagaggagtggcaaaagctgaattacgatattcacactcttaggcaggtcaggcgcgaggtgcggaaccggtggaaatgtattctggaggatctggggtttcagaaagaagccgacagcctactgtccgtcacaaaactctcaacaattagtgactcgaaaaatacccggaaagcaagggaaatgctgctgaagctggccgaagagactaatatctttccgacgtcttgggaactatctgaaagatacctatttgtggtggatagattaattgctctcgatgctgcggaagaatttttcaaactggcaaggcgtacatacccaaagaaaccaggggtcccatgtttggcagacgggcagaaagagctccacttatggggggacctgtcttgcaggctcgctcacatgcagggagtgcttcattag

SEQ ID NO: 194733 - DNA, 645 bp, Artificial Sequence
  Description of Artificial Sequence: Synthetic coding sequence
atgggcctgcgggactggctgcggaccgtgtgctgctgctgcggctgcgagtgtttggaagagagggctctgccagagaaggaacccctagtgagcgacaacaatccgtacagctcatttggagctactctcgtgagagatgacgaaaagaacctttggtctatgccacacgatgtgagtcacacggaagccgacgatgacaggaccctctataatctgatcgttatccgcaaccagcaggcaaaagactcggaggaatggcagaaactgaactacgacatccacacccttcgccaggtgagaagggaagtgaggaaccggtggaagtgcatactggaggaccttgggttccagaaagaggctgactctctgttgagcgtgaccaaattgtcgactatatccgacagtaaaaacacccgaaaagcccgggagatgctgctgaaactcgccgaggagacgaacatatttccaacctcatgggagctctctgagaggtacctgttcgtggtggataggcttatcgccttggatgctgctgaagaatttttcaaattggctcgtcgcacctatccaaaaaagcctggagtgccttgcctggctgacggccagaaggaactccactacctgcctttcccaagcccttag

SEQ ID NO: 194734 - DNA, 645 bp, Artificial Sequence
  Description of Artificial Sequence: Synthetic coding sequence
atgggcctgcgggactggctgcggaccgtgtgctgctgctgcggctgcgaatgtctggaagaacgagcactcccggaaaaagaacctctcgtgtctgacaacaacccctatagcagcttcggggctactcttgtacgagacgacgaaaaaaacctttggtccatgccccacgacgtttctcataccgaagccgacgatgataggactctgtacaatctgattgttattaggaaccagcaggccaaggactccgaagagtggcagaagctgaattacgatattcataccttgcgccaggtgcgaagagaggtgagaaacagatggaaatgcattctcgaggatctagggtttcagaaggaggccgacagtttactctccgttaccaagctgtcgacgatctctgattccaaaaacaccaggaaagcgagggagatgcttctgaaactggctgaggaaacgaacatcttccctacatcctgggaattatccgaaaggtacttattcgtcgtggatcggctcatagcacttgacgcagcagaggagttcttcaagctggccaggagaacgtaccccaagaagcctggcgtcccatgcttagcggatggacaaaaggagctgcactacctgccattcccctcgccatag

SEQ ID NO: 194735 - DNA, 1053 bp, Artificial Sequence
  Description of Artificial Sequence: Synthetic coding sequence
atgcagggcaacggcagcgccctgcccaacgccagccagcccgtgttgcgcggagacggtgctcgcccgtcatggctcgcgtccgcattggcctgtgtgctaatcttcaccatcgttgttgacatcctgggaaatctcctggttatcctatcagtctacaggaacaaaaagctgcggaatgcagggaatatctttgtggtcagtctcgccgtagctgacttggtcgtcgctatctacccctaccccctagttctgatgagtatttttaacaacggatggaatctaggctacctgcattgccaagtctctggctttctgatggggctcagtgtgatcggatcgatcttcaacatcacaggaatcgccattaataggtactgctacatctgtcattcattgaaatatgacaagctttactcctccaagaacagcctgtgctatgtgcttctgatatggttgctcaccctggccgcagtgctacctaacctgagagcgggaaccctccagtacgacccaagaatctatagttgcaccttcgcccagagcgtaagttcggcctatactattgctgttgtggtcttccactttttagtgccaatgattatcgtgatcttttgttaccttcgcatttggatcctggttcttcaggtgcgccagcgagtgaagccagaccggaagccaaagctgaaaccacaggatttcaggaatttcgttacaatgttcgtagtgttcgtcctgttcgcgatttgctgggctcctctcaatttcatcgggttggccgtcgcttctgatcctgcctctatggtcccacgaattcccgagtggctcttcgtggctagttactatatggcctacttcaactcctgtctcaatgctattatttatggccttctgaatcagaatttcagaaaggagtaccgtcgaatcattgtgagcctgtgtactgctcgagtgttcttcgtcgattcgagtaatgacgtggctgatcgagtgaagtggaagccaagccctctgatgacgaataacaatgtggttaaggtcgacagcgtttag

SEQ ID NO: 194736 - DNA, 1089 bp, Artificial Sequence
  Description of Artificial Sequence: Synthetic coding sequence
atgagcgagaacggcagcttcgccaactgctgcgaggccggcggctgggcagtcagacctggctggtccggcgccggaagcgccaggccctccagaacaccacgtccaccgtgggtcgcgccagctctttccgccgtgctaatcgtcaccaccgccgtcgatgtggtggggaacctgctcgtgatcctgagcgtcctccggaacagaaagctacgaaacgcaggaaacctgttcctcgtgtccctggcactggcagacctggttgtcgccttttacccttaccctctcattctcgtagccatcttctatgatggctgggcccttggcgaggaacactgtaaggcctcagcttttgtgatggggctatctgtcatcgggtctgtctttaatattactgcgattgccatcaaccgctattgctatatctgtcatagcatggcataccaccgtatttaccgtcgctggcacacgccacttcatatttgcttaatctggctcctcacggtcgttgcgctgctgcccaatttctttgttggctccttagagtacgatccacgtatctatagctgtacattcattcaaacagcaagtacacagtacactgctgccgtggtggttatccactttctgctgcccatcgccgtggttagtttttgctacctgagaatctgggtccttgtgcttcaagcaaggaggaaggccaagcccgagtctaggctgtgtctgaagccctccgatctgcgatccttcctcactatgttcgtggtgttcgtgatcttcgctatctgttgggcacccctgaattgcattggtttggccgtcgctataaaccctcaagagatggccccgcaaatccccgaggggttgttcgtgacatcttacctgttagcctacttcaatagctgcctgaatgctattgtttatgggctcctgaaccaaaactttcgtagggagtacaagagaatcctattggcactctggaacccaaggcactgcatccaggacgcaagtaaggggtctcacgcagaggggctccaatcccccgccccccctatcatcggtgtgcaacaccaggccgacgccctgtag

SEQ ID NO: 194737 - DNA, 3864 bp, Artificial Sequence
  Description of Artificial Sequence: Synthetic coding sequence
atgagcaaggtgatccagaagaagaaccactggaccagccgggtgcatgagtgcacagtgaaacgaggcccccaaggcgagctaggggtgaccgtgctgggtggcgctgagcacggagaattcccctatgtgggagcggttgcagctgtggaagcggccggactgcctggcggaggagaaggcccccggctcggagaaggagaactgctgctggaggtgcagggggtgagagtctccggcctaccacggtacgacgtgctgggcgttatcgactcatgcaaagaggccgtgacgtttaaggcagtcaggcagggtggtcgattgaacaaagacttgaggcactttctcaaccagcggtttcaaaaagggtctcctgaccatgagctccagcaaaccattcgcgataatttgtatagacatgcggtcccttgtaccactcgaagccctcgagaaggcgaggtgcctggtgtagactacaacttcttaacagtgaaggagtttctggatctggaacagtccggtaccctgctggaagtcggcacgtacgagggaaattattacggcaccccaaagccaccctctcaaccagtatcaggaaaggttatcacaactgacgctctgcatagtcttcagtcagggagtaagcagtccaccccaaagcgaactaaatcctacaacgatatgcagaacgcggggatagtacacgctgaaaatgaggaagaagatgatgttcccgagatgaactcgtcttttacagcagactctggtgagcaagaggaacacacattgcaggaaaccgctctgccgccagtgaactcctcaataatcgccgcgccaatcaccgaccccagccagaaatttccgcagtatcttcctttgtccgccgaagacaacctcggccctctgcccgagaattgggagatggcatacacggagaacggggaggtgtacttcattgatcacaacaccaagacaacgagctggttggaccccagatgccttaataagcagcaaaaaccgctggaggaatgtgaggatgacgagggagttcacacagaggagctggattctgaactagagctacccgcaggctgggagaaaattgaggatccggtgtacgggatttactatgttgatcatatcaaccgcaaaacccaatacgaaaacccggtgctggaagctaagcgaaaaaagcagcttgagcaacagcagcagcagcaacaacagcaacagcagcaacaacaacagcagcagcagcaacagacagaggaatggaccgaagatcacagtgcactggtgcccccggtaattcccaaccatccaccatcgaatcccgaacctgcacgggaagtgcctctgcaagggaagcccttctttacgcggaacccaagcgagcttaaaggtaagttcatacatactaagctcaggaaatcttcccgcggatttggattcaccgtcgtcgggggggacgaaccggacgagttcctgcagatcaaatccctggtgctagacggacctgctgctcttgacgggaaaatggagacaggagatgtgatcgtgagcgttaatgatacctgcgttcttggtcacacccacgcccaggtggttaagattttccagagtatcccaatcggggcaagcgtggacctggagctgtgccgtggttatcctctcccctttgatcctgacgatcctaacaccagtctagtgaccagcgtcgctatcttggacaaggaaccaattatcgtgaacggccaggagacctacgacagtcccgccagccacagctccaagaccggcaaagtgaacgggatgaaggacgctcggccaagctctcccgctgacgtggccagtaattcgtcccacgggtaccccaacgataccgtgtccctggcgtctagcattgcgacccagcctgagctgattacggtgcatatcgtcaaggggccgatggggttcggctttaccattgctgactcccctggtggaggcggtcagagagtgaagcagatagtggacagccccaggtgccgagggctgaaagagggagatctcattgtggaggtgaacaagaagaatgttcaggcactgactcataatcaggtcgttgacatgctggtcgaatgtccaaagggtagtgaggttaccctgctggtgcagagaggaggccttcccgtaccgaaaaagtcaccgaaaagccagcctttggaacggaaagactctcagaactcttcccaacactccgtctcctctcaccgctcgcttcatacagctagtccctcccattccacccaggtgctgcccgaattccccccagcagaggcccaggctcctgaccagacagatagcagcgggcagaaaaagcccgacccattcaaaatctgggctcagtcaagatcaatgtatgaaaataggcccatgtccccaagtcccgcttcaggtctaagcaagggggagcgagaacgggaaattaattctactaacttcggcgagtgtcccatcccagattaccaggagcaggacatttttttgtggcgaaaggaaacgggctttggttttaggattctggggggcaacgaacctggcgagccaatttacatcgggcatattgtgcccctgggcgccgcggacacagacggccgcctaaggtccggtgatgaactgatttgcgtggacgggacgcccgtcatcggaaaatcccaccaactagtggttcaattgatgcagcaggctgccaagcagggacacgtgaatttgacggtgagaaggaaggtggtctttgcagttcccaaaacagaaaacgaggtacctagccccgcatctagtcaccactcttcaaatcagcccgcaagtctaacagaagaaaaaagaacaccacagggcagtcagaacagtctcaacaccgtgtcttccggctccggatctacctccggaatcggctcgggcggtggaggaggaagcggcgtggtgtcaactgtggtacagccatacgacgttgaaattcggaggggcgagaacgaaggcttcggctttgtgatcgtctcctcagtgtcaagacccgaagcagggacaacattcggcaatgcttgtgttgccatgcctcacaaaattggcagaattattgaggggtcgccagcggaccggtgcggtaagctgaaggtgggcgacaggattctggcggttaatggatgctctatcactaataaatctcacagcgacattgtgaacctaatcaaggaagcagggaacaccgtgactttaaggataatcccgggagatgagagcagcaatgccacattgttgaccaacgcagagaagatcgcaaccatcactaccacccacactcctagtcagcagggaacacaggagacacgaaatacaacaaaacccaaacaggagagccaatttgagttcaaagcaccccaggccacccaggagcaagacttctataccgtggagctagagcgcggcgctaaaggcttcggattctcgctgcgagggggcagggaatacaacatggacctctacgtccttagactggcagaggatggacctgctgaaaggtgtggtaaaatgagaatcggcgatgaaatcctagaaattaacggggagaccactaaaaacatgaagcacagcagggccattgagcttattaagaatgggggtcgtagggttcggctcttcctcaagcggggtgatggctctgttcctgagtatgctatgatcccgccaaacatcgccgcttgcatgcgaaatgaaaagctgggggaagcgtgcttttacctcatgggacacaatcagaccactacaccagccgccactgccactgcccctccgccagttcataaagtcttcaggaagtag

SEQ ID NO: 194738 - DNA, 4389 bp, Artificial Sequence
  Description of Artificial Sequence: Synthetic coding sequence
atgagcaaggtgatccagaagaagaaccactggaccagccgggtgcacgagtgcacagtaaagcgaggaccacaaggggaattgggtgtcactgtcctgggcggtgcggagcacggcgaattcccgtacgtgggcgctgtggccgccgttgaggcagccggcctgccaggcggtggggagggaccccgccttggggaaggggagcttttgctggaggttcagggagtccgcgtcagcggcctgccccggtacgatgtgctcggcgtaatcgacagctgtaaggaggcagtgacattcaaagcagttaggcagggcgggagactcaacaaagatcttcgccattttctaaatcagcgcttccaaaagggctctccagaccacgaactgcagcagacgattagagataacctctaccgacacgccgtgccatgcactactcggagccctagagagggagaagtgccaggtgtggactataatttcctgacagtgaaagaattcctggacctcgagcaaagcggcacactgttagaagtcgggacatacgagggaaattactacgggacaccgaagcctcccagtcagccggtctccggcaaggtgattaccacagatgcactgcatagccttcagtctggcagcaagcagtctactccgaaaaggactaagtcatataatgacatgcagaacgcaggtatcgtccatgccgaaaacgaggaagaagacgacgtcccagagatgaatagctccttcactgctgattcaggagaacaggaggagcacactctccaggagaccgccctgcctcctgttaatagctcaattattgccgcgcctattactgacccttcccagaagtttccgcagtacctgcccctgagcgcggaagacaatctagggcctttgccggaaaactgggagatggcctatactgaaaacggagaggtgtactttatcgatcacaacacaaaaaccactagctggctggacccccgctgcctcaacaaacagcaaaaaccgctggaagaatgcgaagacgacgagggcgtgcacaccgaagaactggattcggagttagaattacctgctggttgggaaaagattgaagacccggtgtatggcatctactatgttgatcacattaacaggaagacccagtatgaaaaccccgtactggaagctaagcggaagaagcagctggagcaacagcagcagcagcagcaacagcaacagcagcaacagcagcagcaacaacaacagcagacggaggagtggacagaagatcacagcgcgctggtgccccctgtgatccctaaccatcctccgtcaaatcctgagcctgcacgcgaagtaccacttcaagggaagccattctttaccaggaatccctcggaacttaaaggaaaattcatccatactaaacttcgcaaatcctctagaggcttcggtttcacagtcgtaggcggtgatgagccagatgagtttctgcagattaaatcgttggtgctggacggacctgctgccctagacgggaagatggagacaggggatgtgatcgtctcagtcaacgatacttgcgttttggggcacacccacgctcaggttgtgaaaatctttcagtcgattccaataggcgcctctgtggacctcgaactctgtcggggatatccactgccattcgatcctgacgatcctaatacttcgctggtgactagcgtggccatcctggataaagaacctattatcgtgaatggccaggaaacttacgactcaccagcaagtcatagcagcaagactggaaaggttaatgggatgaaagacgccaggccaagctcccccgccgatgtggcaagcaattccagccacggctacccaaacgacaccgtatctctggcatccagtatcgcaactcagcccgaactgattacagtgcacatagtaaagggacctatgggattcggattcactatagcggacagcccgggtggaggcggacagcgagtgaagcagatcgttgatagtcctcgctgtcgggggttaaaggagggcgacctcatcgtggaagtgaacaagaagaacgtgcaggccctcacccataatcaggtcgtagacatgttggtagagtgtcccaagggatcagaggtcacactcttggtccagcgcgggggactccccgttcccaaaaagtcccccaagtcccagccactagaacgcaaggacagccagaacagcagccagcactcagtttcatcacacaggagtctgcacaccgcatctccttctcactctactcaagtgctccccgaattcccccccgccgaggcgcaggctcctgaccagacagactctagcggtcaaaaaaagcccgaccccttcaagatttgggcgcagtccagaagcatgtacgagaatcgcttgccggactatcaggaacaagacatattcctctggagaaaggagacaggatttggctttcgaatcttaggaggcaatgaacctggggagcccatatacattggtcacatagtgcctttaggggcggccgacactgacggtcggctgcgcagcggagatgagctgatatgtgtggacggtacaccagtcattggaaaatcgcaccagctcgtcgtacaactgatgcagcaggcagctaagcagggccacgtgaaccttacagtgcgcagaaaagtcgtattcgccgtcccaaagacagaaaacgaggtcccttcccctgcctcctcccaccattcttctaaccaacctgctagcctgaccgaagaaaagcgtaccccccagggcagtcagaacagcctaaataccgtgtcttcaggaagcgggtccacaagtggaatcggctccggcggagggggcggatccggtgtggtttcaaccgtggtgcagccttacgatgttgagattcggcggggagagaacgaggggttcggattcgtcattgtgagttcagtaagccgtccagaagcgggtacaacctttggcaatgcttgcgtggctatgcctcacaagattggacgaatcatagaaggaagtcccgccgaccgatgtggtaagctgaaagtgggcgacagaatactcgccgttaacggttgttccatcactaataaaagtcatagtgacattgtgaatctcatcaaagaagcaggtaataccgtgacacttcgaattatcccaggggatgagtcgagtaacgctaccctgctcacgaatgccgagaagatagccaccataacgaccacccacaccccctcacagcagggaacgcaggagacacggaacacaacgaagccgaagcaggaaagtcaattcgaatttaaagctccccaggcaacccaggaacaggacttctacactgttgaattggaacgcggcgccaagggatttgggtttagcctccgcggaggtcgggaatacaatatggatctctacgtgctgcgactggccgaagacggcccagcagaacgctgcggcaaaatgagaattggcgacgaaattttagaaatcaacggggagacgactaagaacatgaaacactctcgggcaattgaattaatcaagaatgggggaaggcgcgttcggctgttcctgaagcgtggcgacgggagtgtgcccgaatacgaccccagctcagaccgccatggacctgccaccggtcctcaaggcgtccccgaagtgagagccggccctgataggcgccagcatccttctttggagagttcctatcctcctgatctgcacaagagttcacctcacggggaaaagcgcgctcacgcacgggatccgaagggttcgagagaatattcaaggcagccgaacgagcaccatacctggaatgggacttccaggaagcctgacagcggcgcatgcagacctaaagacagggcacccgagggaaggagggatgcccaggccgagcgagcagccgctgctaatgggccgaaacgtcggagccccgaaaagcgacgtgaaggtactagaagtgctgataacaccctcgaacgccgagaaaagcacgaaaaaagacgagacgtcagtcctgaacgtcggagagagcgcagtccgaccagacgacgagatggcagtccctctaggaggcgcaggtctctagagcgtcttctagagcagcggcgcagccccgagaggagaagaggtgggagccctgagcgccgagctaaatccaccgatcgcaggcgagctagatccccagagagaaggagagagcgaagtctggacaagagaaaccgagaagaccgtgcctcacatagagaacgcgaggaagccaacctgaagcaggatgccggccggtcctcccgccaccctcccgaacagcggcggagaccatacaaagagtgttccactgatctgagcatctag

SEQ ID NO: 194739 - DNA, 3552 bp, Artificial Sequence
  Description of Artificial Sequence: Synthetic coding sequence
ggcggccggctgaacaaggacctgcggcacttcctgaaccagcggtttcagaagggctcccccgaccacgaattgcagcaaactatcagggacaatctctaccggcacgccgtgccttgtactactcgcagcccacgggagggtgaggtcccaggcgtggattacaatttcctgacagtgaaagagttcctggatctcgaacagagtggcacgttgctagaagtgggcacttacgaggggaattactatggtacacctaaacctccatcccagccagtgtcaggaaaggtgatcacaactgatgcccttcattcccttcagtccgggtctaagcaatccactcccaaaagaactaagagctacaatgatatgcagaacgccgggattgtgcacgctgagaacgaggaggaagatgacgttccggagatgaatagtagcttcacagcggattcgggggagcaggaagaacacacattgcaagagactgcactgccaccagtcaattccagtattattgccgccccaataaccgatccatcacagaagtttccccagtatttgcccctgtccgccgaagacaatctgggtcctctgcctgaaaactgggagatggcttataccgaaaacggagaagtgtactttatcgaccataacaccaagacaaccagctggctggaccctaggtgtttaaataaacagcaaaagcccctcgaggaatgtgaagacgacgaaggagtgcatacagaggaactggacagtgaactggaacttcctgccgggtgggagaagatcgaggatccagtatatgggatatattatgtggaccacatcaatcggaaaacgcagtacgagaatcctgtgctggaagcaaaacgcaagaaacagctggagcagcagcagcagcagcagcagcagcagcagcagcagcagcagcagcagcaacagcagcagaccgaagagtggaccgaggatcatagtgccttagtaccaccggtaatccctaatcacccgcccagtaaccctgaacccgctagggaagtgccgctccagggaaaaccctttttcaccaggaatccaagcgaactgaagggtaagttcatccacacaaagcttcgcaagagttcacgaggcttcggctttacagttgtgggcggagatgagcccgatgaattcctccagatcaagagtttagtgttagatggccctgctgctcttgacggaaagatggaaacaggggacgtcatagtatctgttaatgacacatgcgttctgggccacacccacgcacaggtggtgaaaatcttccagtcgattcctattggcgcctccgtcgatcttgagctttgcagaggatatcctctgccgtttgatcctgatgatcccaatacaagcctggtcacttcagtggccatcttggataaggagcctattattgtaaatggccaggagacatatgactcccctgctagccacagcagtaagaccggtaaagtaaatggcatgaaggatgcacgtccttcctcacccgcggacgtcgcatcgaactccagccacggataccccaatgacaccgtttctctcgcctcatcaatagctacacaacccgaactgataaccgtgcacattgttaagggacccatggggttcggctttaccatagcggactcccccggtggcggggggcaaagagttaagcagatcgtagactcaccccgctgccggggtctgaaggagggcgacctgattgtcgaggtgaacaagaagaatgtacaagctctgacccataaccaggtagttgacatgctcgttgagtgccccaagggctcagaggtgacactcctggttcagaggggcggactgccagttcctaaaaaatcacccaagtcccaaccccttgaaaggaaagatagccagaatagctctcaacatagtgtgtcctctcataggtctcttcacacagcgagccctagtcactctactcaggtactccccgagtttcccccggccgaagcccaggcacctgatcagaccgacagctctggacagaagaagccagatcctttcaagatctgggctcaatctaggtcaatgtatgaaaacaggcccatgtctccgagccccgcctccggtctgtcaaagggcgaacgggaaagagagatcaactccacgaatttcggagagtgccccatccctgattaccaggagcaggatatattcttgtggcgaaaggagacagggttcggattcaggatcctggggggtaacgagcctggagagccaatttacattggccacatcgttcccctgggggcagcagatacagacggcaggctgcgctccggagacgaactaatctgcgtggatggaacacctgtgattggaaagagccaccaattagttgtgcagctgatgcagcaagccgccaaacaaggacacgtcaacctgactgtgcgtcgcaaggtagtctttgctgttcctaagacggagaacgaggttccctctccggcttcaagccaccactcatctaaccagccagcttcccttaccgaagaaaagcggacacctcagggatcacagaacagtttgaacacagtgagcagcggcagcggttcaacctccggcatcgggagcggtggcggaggcggaagcggagttgtatccactgtcgtccagccttacgacgtggagatccggaggggcgaaaacgaaggatttggattcgtcatcgtaagctctgtctctagacctgaagccggaaccactttcggcaatgcttgtgttgcaatgccccataaaatcggccgtattatcgaaggttctccagcagaccggtgtgggaaactcaaagtgggagatcgtatactcgccgtgaatgggtgtagtataaccaacaaaagccattctgatatcgttaacctgattaaagaggccggaaacaccgttactctccgcatcatacccggagacgagagttccaacgctactttgctaaccaacgcagaaaagatcgcgactatcactaccacccataccccttcccagcagggtacccaagagacccgtaacaccacgaagcccaagcaggaaagccagttcgaatttaaagcacctcaggccactcaagagcaggacttttacacagtggaactagagcggggcgccaaagggtttggcttcagcctgagaggcggtagggaatacaatatggacctgtatgtgctgcgtctggctgaggatggccccgcagagaggtgtggcaagatgcgaataggcgatgagatattggaaatcaacggtgaaaccacaaagaacatgaagcactcacgtgccattgagcttattaagaatggaggcagacgagtgcgcctcttccttaaacgcggggacggaagcgtacccgagtatgccatgatccctcccaatattgcagcttgtatgcgaaatgagaaactaggtgaggcatgcttctatctcatgggacacaaccagaccacaactccagcggctactgccaccgccccccctccggtgcacaaagtgttccgaaaatag

SEQ ID NO: 194740 - DNA, 3771 bp, Artificial Sequence
  Description of Artificial Sequence: Synthetic coding sequence
atgagcaaggtgatccagaagaagaaccactggaccagccgggtgcatgagtgtaccgtgaagagggggccacaaggcgaactgggtgtgaccgtgctgggcggcgccgaacacggagaattcccctatgttggggccgtggcagcagtggaggccgcagggctgcccggcggcggcgaaggaccaaggctcggggaaggtgagttgctgctggaagtgcagggcgttagggtgtctggcctgccccggtacgacgttctgggggtaatcgatagctgcaaggaggccgtaacattcaaggcagtcaggcaagggggaaggctgaataaagacctgcgccattttctaaaccaacggttccaaaaaggatcccctgatcacgagctgcaacaaaccatccgggacaacctatacaggcacgctgtgccatgcaccactcgctcccccagagagggagaagtgccgggagtagactataatttcttgacagttaaggagtttctggatctggaacagagcggaaccttgcttgaggtcgggacgtatgagggtaactattatggaacgcccaagccacctagccaaccagtctccggaaaagtaatcactactgatgcgctgcatagtctgcagtccggatctaagcagtccaccccaaaaagaaccaaaagttataacgatatgcaaaatgccgggattgtacacgctgaaaatgaagaggaggatgacgtgcccgaaatgaactcatccttcaccgcagacagcggtgagcaagaagagcacaccctacaagagactgccctgccacccgtgaactcttccatcatagccgctcctattaccgacccgtctcagaaattcccccagtatcttcccctttctgctgaggataacttaggtcccttacccgagaattgggagatggcctatactgaaaatggggaggtgtactttatcgatcataacaccaagaccactagttggctcgatccacggtgtcttaataagcaacagaagcccctcgaagaatgtgaagacgatgaaggagtgcataccgaggagctggatagcgaactggaactgcccgccgggtgggaaaaaatcgaggatcccgtctatggcatctactacgtagaccatattaataggaagacccagtatgagaatcctgtgttagaagcaaaaaggaaaaagcagttagagcaacaacaacaacagcagcagcagcagcagcaacagcagcaacagcaacagcagcagcagactgaggaatggaccgaggaccactctgctctggtgccgcccgtgataccaaatcatcctccctctaaccccgagcccgcaagagaggtgcctctgcagggcaaacccttctttacacggaatcctagcgaacttaagggcaagttcattcatacaaagttacgaaaatcatcacggggcttcggatttaccgtcgtgggaggcgacgagccggatgagttcctccaaatcaaatcactggttctcgatggtcccgcggccctcgatggaaagatggagacaggagatgtgatagtgtccgttaatgatacctgtgttttgggccacacccatgcccaggtagtgaaaatctttcagtctatccccatcggagcatccgtggacctcgagctgtgcagaggttatcccctaccttttgatccggacgacccgaataccagtctggttacaagtgtagccatccttgacaaagaaccaatcatcgttaatggccaggaaacatacgactcccccgctagccactcttcgaagacgggcaaggtgaacggcatgaaagatgccagaccttccagcccagccgatgtcgcgagtaactcgtctcatgggtatccaaatgatactgtgagcctggccagctctattgccactcagcccgaactcataacagtgcacattgtcaagggaccaatgggctttggattcacaattgccgactcccctggcggtggagggcagcgagtcaagcagatcgtcgactctcccagatgccgcggactgaaggagggcgacttaatcgtggaggtgaacaagaagaatgtccaggcgctgactcacaatcaggtagtggatatgctggtagaatgccctaaaggcagcgaagtcacattattagtgcaacggggaggacttccagtccccaagaaatccccaaaatcgcagccacttgagcggaaagacagtcagaatagcagtcaacatagcgtgagctcacatcgcagtttacacacggcaagtccttcccacagcacacaggtgttgccagagtttcctccagcggaagcccaggcccctgaccagactgactcaagcggacaaaaaaaacctgatccgtttaaaatctgggcccagagcagaagtatgtatgagaatagacccatgagcccctctcctgcctcagggctcagcaagggcgagcgagagcgagaaattaattccactaacttcggagagtgccccattccagactaccaggagcaagatatcttcttgtggaggaaagagactgggttcggatttaggatattgggcggtaatgagcccggtgaacccatctatattgggcacatagtccctctgggggccgccgataccgacgggcgactgaggtctggcgatgaactcatatgcgttgacgggacccccgtgatcggaaaaagccatcagctcgtggtccagctgatgcagcaggccgctaagcagggccacgtgaatttaacagtaagacgaaaggtcgtgtttgccgtgcccaaaaccgagaacgaagtccctagccccgccagctcgcaccactctagcaatcagcctgcttccctgaccgaggaaaaacgtacacctcagggctcccagaatagcctgaatacggtatcgtccggcagcgggtctacctccggtatcggctcagggggcggtggcgggtccggggtggtatcaaccgtcgtccagccatacgatgttgagatcagaaggggagagaacgaggggttcggcttcgtaatagtctctagtgtaagcaggcccgaggcagggacaacttttgctggcaacgcgtgcgtcgcaatgccacataaaattggtagaattatcgaggggagccccgctgaccgttgtggaaaactgaaagtcggtgaccgcatccttgctgtcaacggatgctccattactaataagtctcactccgacatagtgaacttgatcaaagaagcgggcaatacagtaaccctgaggatcatccctggagacgaaagtagtaatgcaacccttctgaccaatgcagagaagatcgctacaataacaacaacacatacgccaagtcaacagggaacccaagagacccggaatactactaagcctaagcaagagtcccagtttgaatttaaggccccacaggctacccaagagcaagacttctataccgtcgagcttgaacggggtgcaaagggtttcgggttttccctgagggggggcagggaatataacatggatctgtatgtgctcaggttggctgaggatggacccgctgagcggtgtggtaagatgcggatcggagatgaaattctggaaattaacggtgagaccaccaagaacatgaagcacagccgcgccattgaactgataaagaatggggggcgacgggtacgcctttttctcaagcgtggagatgggtccgtacctgaatacgggggtagcaactacgagaacattccttcatttcctggcatgactccctag

SEQ ID NO: 194741 - DNA, 1488 bp, Artificial Sequence
  Description of Artificial Sequence: Synthetic coding sequence
atggccgccgagccccagcccagcagcctgagctaccggaccaccgggtcaacctacctgcatcccctgtctgagctgctcggcatccctctggatcaagtgaacttcgttgtgtgccagctggtggctctgtttgcggccttctggttcagaatctatctgagaccagggactacgtccagtgatgttagacacgccgtggcaactattttcggcatttattttgtgatattttgttttggctggtatagcgttcacctatttgtgctggttctcatgtgctatgctattatggtgacagcctccgtgtctaatatccataggtatagcttcttcgttgctatggggtacttaaccatctgtcatatatccaggatttatatcttccactacggcatcctgacaactgatttttccggccccctgatgattgtgacacagaaaattaccaccctcgcattccaggtgcacgacggactgggcaggcgagccgaagatttgagtgctgagcagcaccgactggccattaaagttaaacctagttttcttgagtacctgtcatacctgttgaatttcatgtccgtgattgccggcccgtgtaacaacttcaaggactacatagcattcatagaggggaaacacattcacatgaaactgttagaagtcaattggaagcgaaagggatttcactccttgccagagcccagccccaccggcgcagtgattcacaagttggggattactttggttagccttctcctcttcctcaccctgacaaaaaccttccccgtcacttgccttgtggacgattggtttgtccacaaagcctcatttcccgcccgactgtgctacctttatgtcgtaatgcaagccagcaaaccgaaatattacttcgcttggacccttgccgacgcagtcaataacgcagccggctttggctttagtggcgtcgataagaacgggaacttctgctgggacctactctccaaccttaatatctggaaaattgaaactgcgaccagctttaagatgtacttggagaactggaatatacagacagcaacttggctgaagtgcgtttgttaccaacgcgtgccctggtacccaactgtcctgaccttcatcctttctgccctgtggcatggggtgtatccaggatactatttcacatttctgaccggtattctcgttactctggccgccagggccgtgaggaacaattacaggcattatttcttgtcaagcagggctttaaaggcagtatatgatgccggaacatgggctgtgacgcagctcgccgtatcctacacagttgccccctttgtgatgctggcggtggagccaaccatctctctgtacaagagcatgtacttctatctccatataatcagcctgctgatcattctgtttcttcctatgaagccccaggcccacacacaacggcggccacagaccctcaacagtattaacaagcgcaagacagactag

SEQ ID NO: 194742 - DNA, 726 bp, Artificial Sequence
  Description of Artificial Sequence: Synthetic coding sequence
atggccgccgagccccagcccagcagcctgagctaccggaccaccgggtcaacctaccttcatcctttatccgagttgttaggaatcccacttgaccaagttaattttgttgtctgccagctggtcgccctcttcgctgccttttggttccgcatctatctgaggcctggcaccacctcatccgatgttcgccacgctgtagccacaatatttggcatatactttgttatcttctgcttcggatggtattccgtgcatctgttcgttttagtgctaatgtgctatgctatcatggtgaccgcatcagtctctaacatccacagatactccttcttcgttgccatggggtatcttaccatttgtcatataagtcgtatatatatttttcactacggcatcctcactacggacttctctggaccattgatgatcgtgacgcagaagattaccaccctggctttccaggtgcacgatggcttgggtagaagagctgaagatttatctgccgaacagcatcgattggctattaaggtgaagccttcttttctcgaatacctcagttatctgctgaattttatgtctgtgatagcaggtccctgtaataacttcaaggactacatagccttcatcgaagggaagcacatacatatgaaattattagaagttaattggaaaagaaaaggctttcactcgctgcctgagccgtcacctactggacatctctag

SEQ ID NO: 194743 - DNA, 1041 bp, Artificial Sequence
  Description of Artificial Sequence: Synthetic coding sequence
atggagttcagcctgcggatcttcctgggcctgggccggcgggccgaagatctgagcgcggaacagcatcggctggcaatcaaggtcaagccctcatttcttgagtacttgtcatatttgctgaatttcatgtccgtgatcgctgggccgtgcaataattttaaggactacattgccttcattgaagggaagcacatccatatgaaactgctagaggtcaactggaagagaaagggcttccactctttaccagagccctcgccgacaggcgccgtcattcacaagttgggcatcacgcttgtgagtttgctgctgttcctgactctaacaaagacattcccggtcacctgcttggtagatgactggttcgtgcataaggccagctttcccgcccgcctatgttacctctacgtggtcatgcaggctagcaagcctaaatattattttgcttggacgttggcagacgccgtcaacaacgcagctggctttggcttttcaggagtcgacaagaatggcaatttctgttgggatttactgtctaaccttaatatctggaagatcgagacagccacatctttcaaaatgtacttggagaactggaacatccagacagcaacctggctaaagtgtgtgtgctaccagcgggtgccgtggtaccctacggtgttgacttttatcctgagcgccttgtggcatggcgtgtaccccgggtactacttcacatttctgactggcattctggtcacactggcggcacgcgctgtcagaaataattataggcactacttcctgtctagccgagcgctcaaagcagtgtacgacgccggtacctgggccgtaacacagctggccgtgtcctacacagtagcacccttcgtcatgttagctgttgaacccaccatttcactgtacaagagcatgtatttttacttgcacatcataagcctactgataatcctctttcttccaatgaagccacaggcacacacccagaggcgcccacagaccttgaactccatcaataaacgcaagacggactag

SEQ ID NO: 194744 - DNA, 1563 bp, Artificial Sequence
  Description of Artificial Sequence: Synthetic coding sequence
atggccaccaccagcaccaccggcagcaccctgctgcagcccctgtccaacgctgtgcagctgcccattgatcaggtcaatttcgtggtctgtcagttgttcgctctgctggccgccatttggtttaggacatatctacattcttctaagacttctagcttcatcaggcacgtggtggcaacactactgggtctgtatttggccctattctgcttcggctggtacgccttgcactttttagtgcaatctggcattagctattgcatcatgattatcatcggtgttgagaacatgcacaattattgcttcgtattcgccctcggctatctaacagtgtgtcaggtgactcgagtatatatcttcgactatggccaatactccgctgacttctccggtccgatgatgattatcacacagaaaattactagcctggcttgtgagattcacgacgggatgttcagaaaagacgaggagctaaccagtagccagcgcgatttggctgttaggaggatgccgtcgctgctggagtacctgtcctataattgcaactttatggggattctcgcagggcctctctgctcatacaaggattacattacctttatcgaagggcggtcttatcacataacacagtccggagaaaacggaaaagaggagactcagtatgaaagaaccgagccttcccctaacaccgctgtcgtacagaagcttctcgtttgcgggctgtccttgttgtttcatttgaccatttgcaccactctccctgttgagtataatatcgacgagcacttccaggccaccgcaagttggcccacgaaaattatatatctgtatatatcactgctcgcagctaggccgaaatactactttgcctggacactcgctgacgccattaataacgccgcaggctttggcttcagggggtatgatgagaatggcgccgcacgttgggatttaatttcaaatctccggattcagcaaatcgagatgtctacctcgtttaagatgttcttagataattggaatatccagaccgcactgtggctgaagagggtgtgttacgagcggacatccttctcaccaactatccaaacattcatactatcggcaatctggcacggagtataccccggctattacttgacgttcctgactggggtcctaatgaccctggcagccagggccatgaggaataatttccgtcattattttattgagccctcccagctgaagttgttttatgacgtgatcacgtggatagtaacacaggttgccatctcctataccgtcgtgcccttcgtgttgctgtcaatcaaaccatccctgacgttctacagctcgtggtactattgtcttcatatactcgggattttggtattgttgttgctgcctgtgaagaagacacagagacggaagaacacccacgagaacatccagctgtcacagtcaaagaagtttgacgagggagaaaacagtctgggacaaaattcgttttctacgacgaacaatgtgtgcaatcagaatcaggagattgcatctaggcacagctccctgaaacagtag

SEQ ID NO: 194745 - DNA, 1308 bp, Artificial Sequence
  Description of Artificial Sequence: Synthetic coding sequence
atggagtggctgtggctgttcttcctgcaccccatcagcttctaccagggtgccgccttcccttttgcgctcctgttcaattatctgtgtatcatggactctttcagtaccagagcccgataccttttcctgctgacaggcggcggagctcttgctgtggctgcaatggggtcttatgcggtcctagtttttaccccggcggtatgcgctgtggctctgctgtgtagtcttgcccctcaacaagtgcaccgatggaccttctgcttccagatgagctggcagaccttgtgtcatttaggactgcattataccgagtactatcttcatgagccaccctccgtgcgattttgcattacacttagctccctgatgctgctaacacagagagtgacttcattaagtctggacatatgcgaagggaaggtgaaggcagcttctggaggatttcgaagtcgatccagcttgtctgaacatgtatgcaaagccctaccatatttttcatatctcctgtttttccctgccctgctaggtggcagtctgtgttcctttcagagattccaagcacgagttcaaggtagttcagccctacaccctcggcactctttctgggccctctcttggcgtggcctgcagattctgggactagagtgtctgaatgtagccgtgtcacgggtcgtggacgccggcgccggcctgacagattgccaacagtttgagtgcatatatgtcgtgtggaccacagccggcctcttcaaacttacctactattcccactggattctcgacgattcccttctgcacgctgctggattcggtcctgagcttgggcagagccccggcgaggaggggtatgtgccagatgccgacatttggacacttgagaggacccacaggatctccgtgttttctaggaagtggaaccaaagcacagctcggtggctgagacgcttggtgttccaacattcccgagcatggccgctgttgcaaacctttgctttctccgcctggtggcatggactccaccctggtcaagtctttggattcgtatgctgggccgtgatggtggaagcagactatttgatccacagctttgcaaacgaatttattaggagctggcccatgcggctcttctacagaacacttacctgggcccacacccagctgattatcgcctacatcatgctggccgtggaagttagaagcctgagcagtctctggctgctctgtaatagctataattctgttttccctatggtgtactgtatcttactcctgttgctggccaagaggaagcacaagtgtaactag

SEQ ID NO: 194746 - DNA, 1341 bp, Artificial Sequence
  Description of Artificial Sequence: Synthetic coding sequence
atgaccctgaaggccagcgagggcgagagcggcggcagcatgcacacagccttaagcgacctctatctcgaacacctccttcagaaacgcagcagacctgaagcagtgtctcatcccctgaacaccgtgaccgaagatatgtacaccaatgggtctcccgctccaggctcaccggctcaagttaaggggcaggaagttcgaaaagtccggctgatccaattcgagaaggtcaccgaggagcccatgggcattaccttaaagctgaacgagaaacagtcttgcaccgtcgcgcggattcttcacgggggaatgattcatagacagggtagtttacatgtgggggatgagatactagagattaatggaactaacgtgaccaaccattcagttgaccagctccaaaaagcaatgaaagagaccaagggcatgatctctctgaaggtgatccctaaccagcagtcacgcttgcctgcccttcaagaggctggtctcaagtttgctactggggacatcatccaaataattaacaaggacgacagtaattggtggcaggggcgcgtggagggatcaagtaaggagtctgcaggtctgataccgtctccagaattgcaggagtggcgggtcgcctccatggcacagtccgcgccatctgaggccccttcctgtagcccctttggaaagaaaaagaagtataaagataagtacctggctaagcattcctcaatcttcgatcagcttgatgtcgtgtcctacgaggaagttgtgcggctccccgctttcaagaggaagactttggttttgatcggggcctctggcgtcggacgatcccatataaagaatgccctgctgagccaaaatcccgaaaaattcgtgtaccccgtcccctatactactagacctcccagaaaaagcgaagaagacgggaaagaatatcacttcatctccacagaagaaatgactcgcaacatctctgctaatgagtttctggagttcgggtcttaccagggtaatatgtttggaacgaagtttgaaaccgtgcaccaaatccataagcagaacaagattgcaatactggacatcgagccgcagacactgaagatagttcgtaccgccgaactatctccttttatcgtgttcatcgctccgaccgaccaagggacgcaaaccgaagctctgcagcagctgcagaaagattctgaggcaatcagatctcagtacgcccactatttcgacctgagtctggtgaataacggcgttgacgagactctgaaaaagctgcaggaggccttcgatcaagcctgctcatcccctcagtgggtccccgtgtcatgggtttactag

SEQ ID NO: 194747 - DNA, 1401 bp, Artificial Sequence
  Description of Artificial Sequence: Synthetic coding sequence
atgaccctgaaggccagcgagggcgagagcggcggcagcatgcacactgcactgagcgacttgtacctggagcacctcttgcagaaaaggagtcgccctgaagcagtgtcccaccctctgaacacggtcacagaggacatgtatacgaacggctcaccagcccccggcagccccgcccaggtgaaggggcaggaggtcagaaaagtgcggctcattcagttcgaaaaggttacagaggagccaatgggcatcactcttaagttaaacgagaagcagagttgcaccgtcgcgcggattctccatggtgggatgatccaccgtcaagggagcttgcacgtcggggacgagattctggagattaacggtactaatgtcacaaatcacagtgtagaccagctgcagaaggctatgaaggagacgaaaggcatgatctcactcaaggtgatccccaaccagcaaagtcgtctgcccgcccttcagatgttcatgcgggcccagttcgattacgatcccaaaaaggacaatctaataccatgcaaggaagcgggcctgaagttcgccacaggagacattattcaaatcattaataaggatgattccaattggtggcagggacgagtggagggcagctcgaaggaaagcgccggattgatcccgtcaccagaattacaagaatggcgcgttgcaagcatggcgcagtccgcccccagcgaagcaccttcatgttctccatttggcaagaagaagaaatataaagacaagtatctggctaagcacagcagtatctttgatcagcttgatgttgtctcttacgaagaggtagtgcggctgcctgcgtttaaacggaagaccctggtcctcatcggcgcctctggggtcgggaggtcacacatcaagaatgctttactgagtcaaaaccctgaaaagttcgtttatcccgtcccctataccacccgacctccacgcaaaagtgaggaggatggcaaggagtaccacttcattagcacggaggagatgactaggaacatttcagctaatgagttcttagagttcggttcctatcagggaaacatgtttggaaccaagttcgagacggtgcaccaaatccacaaacaaaataaaatagccatactcgatattgagcctcaaacgctgaaaatagtgcgaacagcagagttatccccatttatagtttttatcgcaccgacagaccagggaactcaaactgaggccttacaacaattgcagaaggatagcgaggcaatccgaagccaatatgcacactacttcgatctcagtctagtgaataacggagtggacgagacattaaaaaagctccaagaagccttcgaccaggcttgttcctcaccccagtgggtgcctgtgtcttgggtctactag

SEQ ID NO: 194748 - DNA, 1311 bp, Artificial Sequence
  Description of Artificial Sequence: Synthetic coding sequence
atggagagctgggccgtgagccaccccctgaacaccgtgaccgaggatatgtacaccaacggctccccggcgccggggtccccagcacaggtgaaaggtcaggaagtgaggaaagtgcgactcatccagttcgaaaaggttacagaagaacccatggggatcacattgaaattaaatgagaaacaatcatgcaccgtggcaaggatcctgcacggcggaatgattcatcggcagggttctcttcacgtgggtgatgaaatcctggaaataaatggaactaatgtcacgaatcacagtgtggaccaactacagaaagcaatgaaagaaaccaaaggcatgatctctttgaaggtcatcccgaatcagcagtcccgccttcctgccctgcagatgttcatgcgagctcaatttgactatgatcccaaaaaggataatctcataccctgcaaggaggctgggctgaagtttgctaccggcgacatcatccagatcatcaacaaagatgatagcaattggtggcagggcagagtggagggcagctcaaaggagagcgccggacttatcccaagccctgagttacaggagtggagagtcgcctcaatggcccagagcgccccgtccgaggcaccttcttgcagccctttcggcaagaagaagaagtacaaggacaagtacttggctaagcactcttctatttttgatcaacttgacgtggtgagctacgaggaggtggtccggcttcctgcctttaaacgcaagaccttagtgctgattggtgcctctggagtgggccgctctcacatcaagaacgccttgctatcccagaatccggagaaatttgtttatcctgttccctacacaactcgtcctccccggaaaagtgaagaggacggcaaggagtaccattttatttctaccgaggaaatgacacggaatatctctgccaacgaattcttggagtttggctcatatcaaggaaacatgttcggcactaagtttgagactgttcatcaaatccataagcagaacaaaattgctatcctcgatatagagccacaaacattaaagattgtccgaacggcagaactgagtccttttattgtgttcatcgctcctaccgatcagggaactcaaacggaagctttacagcagctccagaaggattccgaggccattaggtcccaatacgctcattacttcgatctgtctctagtgaacaatggggtcgacgagacgctaaaaaaactccaagaggccttcgatcaggcgtgctcatccccccaatgggtccctgtgagttgggtatactag

SEQ ID NO: 194749 - DNA, 1659 bp, Artificial Sequence
  Description of Artificial Sequence: Synthetic coding sequence
atgcccgtggccgccaccaacagcgagaccgccatgcagcaggtgcttgacaacctgggaagcctcccgagcgcaactggtgcggccgagctcgacctgattttccttagaggcattatggagagcccaatagtaagatcactggctaaagcccacgaaaggcttgaagaaactaaactggaggcagtccgggacaataatctggaacttgtgcaagaaattttgagagacctggcccatgtcgctgaacagtcaagcacagccgctgaactagctcacattctgcaggaacctcacttccaatccctgttggagacccacgatagcgtagcttcaaaaacgtatgaaacccctcccccatcacctgggctcgatcccacgttctccaatcagccagtgcccccggacgccgtaagaatggtcggtataagaaaaaccgcgggcgagcaccttggtgtgacatttcgcgttgaaggaggtgagctcgtaattgcccgcatcctgcacggcgggatggtggctcaacaaggcctcctgcatgttggtgatatcattaaggaagtgaacggccagccagtaggatcggacccaagagctctgcaggaactgttacggaatgcttccggcagcgtgatcctgaagatacttccaagctatcaagaaccacacctgcccaggcaggtgtttgtcaagtgtcacttcgactacgacccagctagggatagcttgattccttgcaaggaggccggcctgcgtttcaacgccggagacttgttacagatcgtgaatcaagacgacgccaactggtggcaggcttgccatgtggagggcgggtccgcagggctgataccctctcaactcctcgaagagaaacgcaaagctttcgttaagcgcgatctggagctcactcccaattctggaacactctgtggatctctatccgggaaaaaaaagaagcgtatgatgtacctgactactaaaaacgcggaatttgatcgacacgaactgttgatctacgaggaggtcgctaggatgccgccatttagaagaaagaccctggtgctgatcggtgcacagggagttggcaggaggtcgctgaagaacaaactcattatgtgggacccggatcgctacggtactacagtgccatatacctcacgcaggcccaaggattccgagagggagggtcaagggtactctttcgttagtcggggggagatggaggctgatgtacgggctggcaggtatctggaacacggtgaatatgagggtaatctgtacgggacccgcattgactctatacgaggcgtggtggccgcaggaaaagtatgcgtgctggacgtgaacccccaggctgtcaaggttcttaggacggctgaatttgttccatacgtggtctttatagaggctcccgatttcgagacactgcgggctatgaatcgggctgccttagaaagcggtattagtacaaagcagctgaccgaagctgacctgaggcggaccgtggaggaaagttctagaatacagcgaggctatggccattattttgacctctgtttggtgaacagtaaccttgagaggacgttccgagagctgcagacagctatggagaaactgagaactgagcctcaatgggtgccagtaagttgggtgtattag

SEQ ID NO: 194750 - DNA, 1731 bp, Artificial Sequence
  Description of Artificial Sequence: Synthetic coding sequence
atgcccgtggccgccaccaacagcgagaccgccatgcagcaggtgctcgacaaccttgggtctctgccctccgctactggtgccgcagagctggacctgattttcctccgtggaataatggagagcccaattgtgagaagcctagccaaagttatcatggtgctgtggtttatgcagcagaacgtgttcgttcctatgaagtacatgctcaagtacttcggcgcccatgaaagacttgaggagaccaaactggaggctgtccgagacaataacctggaattggtccaagaaatactgagagacctggcccacgttgcagaacagtcctctaccgccgcggaactggctcatattttacaggaaccacattttcagtccctgctagagacccatgacagcgtagcttcaaaaacctacgaaaccccacccccaagcccaggactggatcctactttttcaaatcagcccgttccccccgacgccgttaggatggtgggcatccgaaagacagcaggagagcaccttggggtgacatttagagtggagggcggggagctagtgatcgcccgcatacttcatggcggtatggtagcccaacaggggttacttcatgtgggggacatcattaaggaagtgaacggccagcccgtgggatctgacccccgggccttacaagaacttctgagaaatgcttccgggagcgttattctgaagattttgccatcttaccaggaaccacacttgcctcgtcaggtatttgtgaaatgtcactttgattatgatccagctcgggacagcctgataccgtgtaaggaggccgggcttagattcaatgccggcgatcttctccagattgtgaaccaggacgatgcaaattggtggcaggcctgccacgtcgagggaggttccgctggcctgattccttcacaacttctggaggagaagcggaaagccttcgtaaaacgggatctcgaactgactccaaattcagggacattatgtggatctctgtcaggaaagaagaagaagcgtatgatgtatctcactacaaaaaatgccgagttcgaccgccacgagctgttaatctacgaggaagtcgccaggatgcctccattccgccgaaagactctggtgcttatcggcgcccaaggtgtgggacggcgttctcttaagaataaattaatcatgtgggatcctgatcgctatggaacaactgttccttacaccagtcgtaggcccaaggactcggaacgtgagggacaaggctattcgttcgtcagcaggggggagatggaggcagatgtccgcgcgggacgatacctggaacatggagaatacgaaggtaacttgtacggtacacggatcgactctattcgcggtgtggtggccgcagggaaggtctgtgtgctggacgtcaacccgcaggctgtcaaagtgctgaggaccgcagaatttgttccatatgtggtgtttattgaggcacctgacttcgagactcttagagccatgaaccgagccgccctggagtcaggaatttctactaaacagctgacagaggcggacttgcgccgtacagtcgaagaaagtagtaggatccagcggggatacggacattattttgacctgtgcctggtcaactccaaccttgagaggacattccgcgaactgcaaaccgcgatggagaagctgaggaccgaacctcagtgggtgccagtgagctgggtctattag

SEQ ID NO: 194751 - DNA, 96 bp, Artificial Sequence
  Description of Artificial Sequence: Synthetic coding sequence
atgcccgtggccgccaccaacagcgagaccgccatgcagcaggtgctggacaacttgggcagccttcccagtgcaactggagccgccgagctttag

SEQ ID NO: 194752 - DNA, 456 bp, Artificial Sequence
  Description of Artificial Sequence: Synthetic coding sequence
atgcccgtggccgccaccaacagcgagaccgccatgcagcaggtgctagacaacttagggagtctcccatctgcaaccggtgcagccgagctcgatcttatcttcctgagggggatcatggaatcaccgattgtcagatccctggccaaggcacatgagcgactcgaggagaccaaattggaggctgtgagggataataacttagaactggttcaagaaattctacgagatttggctcatgtagccgaacagtccagtacagcggcagaacttgcccatatactgcaggagccccactttcagagcctgctggaaactcacgatagcgttgcctccaagacctacgagacccctcctccatcacccggactcgaccctacattttctaaccagcctgttccgccagatgctgttcggatggtcggcattcgcaagaccgcaggggaacacttgtag

SEQ ID NO: 194753 - DNA, 381 bp, Artificial Sequence
  Description of Artificial Sequence: Synthetic coding sequence
atgcccgtggccgccaccaacagcgagaccgccatgcagcaggtgctagataatcttggttcactcccgagtgccacgggagcagctgaactggatctgatttttctaagaggaatcatggagtcccctattgtccggtcattggcaaaagctcatgagaggttagaggagacaaaactggaagctgtgcgcgacaacaatttagagctggtgcaggaaattctccgcgacctggcacacgttgctgaacaatcgtctactgccgccgaactggcccacatactacaggaaccacattttcagagcttactcgagacacacgattccgtcgccagcaagacgtacgagacccccccacctagtcctggcttggacccctag

SEQ ID NO: 194754 - DNA, 222 bp, Artificial Sequence
  Description of Artificial Sequence: Synthetic coding sequence
atgcccgtggccgccaccaacagcgagaccgccatgcagcaggtgctagataacctgggttccctgccgagcgctaccggggctgctgaactcgatctcatctttctcaggggaattatggagtctccaatcgtccggagtttggcaaaggcccacgaacggctcgaggagactaaactggaggccgtgcgggataacaatttagagctcgttcaggaatag

SEQ ID NO: 194755 - DNA, 447 bp, Artificial Sequence
  Description of Artificial Sequence: Synthetic coding sequence
atgcccgtggccgccaccaacagcgagaccgccatgcagcaggtgttggacaatctcgggagtttgcctagcgcaacgggggctgcagaactagacctcatctttctgcgagggatcatggagtcgccaatcgttcgctccttggctaaagctcatgaaaggctggaagagaccaaactggaagctgtgagagacaacaatttagagctggtgcaggagatcctgagggatcttgctcacgttgctgagcagtcttccacagccgccgaactcgcgcacattcttcaggaaccacactttcagtcgctgctagagacccacgattctgtcgctagcaagacctacgagacaccgccaccgagtcccgggctggatcccacctttagtaaccagccggtgccgccggacgctgttagaatggtgggcataagaaagaccgccggatag

SEQ ID NO: 194756 - DNA, 1626 bp, Artificial Sequence
  Description of Artificial Sequence: Synthetic coding sequence
atgcagcaggtgctggacaacctgggcagcctgcccagcgccaccggggcagccgaactggacttaatcttcctgcgcggaatcatggaatccccgatcgtgagaagtttggccaaggctcatgaacggctggaagagactaagctggaggcagtccgagacaacaacttggagctggtgcaggagattctgagagacttagctcacgtcgccgaacagtcatctaccgcagcagagctcgcccacattttacaggagccgcatttccagtctctgttagagacacatgattcagttgcctctaaaacctacgagactcctccacccagtcccggcctagacccgacattcagcaaccagcctgttccacccgacgcagtaagaatggtgggcatacgaaaaactgccggagaacacctgggcgtcacattccgcgtggaaggaggcgaactcgtgatcgctcgcattttgcatggcggcatggtcgcccagcagggactgctgcacgtcggcgatatcataaaggaggtgaatggccagcctgtaggatctgaccctagagctctgcaggagttgctacgaaacgcttccggtagcgttattttaaaaatcctaccttcgtaccaggaaccacacctgcctaggcaggtgtttgtcaagtgtcactttgactacgatccagcaagggatagtttgattccttgcaaggaggcgggtttgcgttttaatgccggcgatctgcttcagatcgtgaatcaagatgacgcgaactggtggcaagcgtgccatgttgagggcggatccgcggggcttattccttcccagctccttgaggaaaaacggaaggcatttgtcaagcgcgacttggagctcacccctaacagtggcaccctgtgcgggagtctgtcagggaagaaaaagaagagaatgatgtacctgacgaccaaaaacgccgagttcgaccggcacgaactcctgatttatgaggaggtagccagaatgcccccctttcggagaaaaacgttagtcctgattggcgcccagggagtgggcagaaggtctctgaaaaacaaattgattatgtgggaccccgaccgctatggtactacagttccttacactagccggcgaccgaaggatagcgaaagggaagggcaggggtatagcttcgtgtcaaggggcgagatggaggccgacgttagggcaggtagatatctggagcacggtgaatatgaggggaatctctacggcacccgaatagactccataagaggagttgtggccgcaggaaaggtgtgtgttctagatgtgaatccacaggctgtcaaggtgttacgtacagcggagttcgtgccatacgtcgtctttattgaagctccagatttcgaaacacttcgagcgatgaaccgggccgctctcgaatccggcatcagtacaaaacagcttaccgaggccgatctgcgccgcacagtcgaagagtcctcaagaatccagcggggctacggacactacttcgacctttgcctcgttaatagcaatttagagcgcacgttccgtgagctgcagaccgccatggaaaaactccggactgaacctcaatgggtcccggtgtcctgggtctactag

SEQ ID NO: 194757 - DNA, 1167 bp, Artificial Sequence
  Description of Artificial Sequence: Synthetic coding sequence
atggagctgcagtaccccccccccccccccagcccccggatctgccgtgagagatccggcggagacaatgccagcatgcccgtgctcagtgaggatagcggtttgcatgagactcttgcgttgctgactagccagctgagaccagattcaaaccataaagaagagatgggatttttgcgcgatgtgtttagcgagaagtctctgagttacctcatgaaaatacatgaaaagctccgttactatgagaggcagagcccaacccccgtgctgcacagcgcggtggcacttgcagaggacgttatggaggagctgcaggcagccagcgtccacagcgacgaaagagagctgctgcagttactctccactccccacctgcgagctgtgctgatggtacacgacacagtcgctcaaaaaaacttcgacccggttctgccaccactacctgacaatattgacgaagacttcgacgaggaaagcgtcaagattgtcaggctggtcaagaacaaggaacccctgggagccacaatcagaagagatgagcactcgggtgccgtcgtggtggcccgcatcatgcgggggggcgcggctgaccgctcgggcctggtccacgttggcgatgagttgcgagaagttaacggtattgcagtgctccacaagaggccagacgaaatcagccagatcctggctcagagccaaggcagtattacgcttaaaatcattcccgccacacaggaggaagatcgcctgaaggagtccaaagtgttcatgcgagccctgttccactacaatccgagagaggatcgcgccatcccttgtcaggaggcaggcctgccttttcagcgaagacaggtgttggaagtggtgtcacaggacgaccccacctggtggcaggccaaacgggtgggagacacaaatctgcgagcaggcctcattccgtctaaggggtttcaggaacggcggctgtcctataggagagcttacggcacacccatctccccacagttctctcagcccaagcaagagctatcactgcctcgtcactgggccccgacacagctgctcccctcctgcggggcacactgtccggggggaaagggaactcacactccaacccttataccaatcctgctcagcccaagccttcagcttgagtttattcagtactag

SEQ ID NO: 194758 - DNA, 1758 bp, Artificial Sequence
  Description of Artificial Sequence: Synthetic coding sequence
atgcccgtgctgagcgaggacagcggcctgcacgagaccctggccctcctgacatcacagctgcgcccagactccaatcacaaagaggagatggggttcctgcgggacgtattcagtgaaaagtctctgagctacctgatgaagatccacgaaaagctgaggtactacgagcgtcagtcgccaaccccagtactccattcagcagtggccctggccgaggatgttatggaagaactgcaggccgcctcggtccatagcgatgaaagagagttattacaacttctctccaccccccatttgcgcgctgtgttgatggtccacgacaccgtcgcacagaaaaactttgaccccgtcttgccaccccttccagataacatcgatgaggatttcgatgaggagagtgtgaagatcgtcaggttagtgaagaacaaagaaccactgggagccacaattcgccgggacgaacactctggcgcagtcgtcgtggcgaggattatgaggggtggcgccgccgatcgctcaggactcgtgcatgtgggggatgaactgagggaggtgaatggtattgcggtactgcataaacgccctgatgaaatttcacagattcttgctcagtcgcagggatctattacgctaaagattataccggccacacaagaagaggacaggctaaaggagagtaaagtgtttatgcgcgccctgttccactacaatcctcgcgaagaccgggctataccttgccaggaagccggactacccttccagcgccggcaggtcttggaagttgtgtcccaggacgatcccacctggtggcaggctaagcgcgtcggagataccaaccttagagccggcctaatccccagcaagggatttcaagagcgacgcttgagctaccgaagggccgccggaacactgccctcgccgcagtccctgcgtaaacctccatacgaccaaccctgtgataaggaaacctgcgactgcgagggatatctgaaaggccactacgtcgcagggctcaggaggagtttccgcttggggtgtcgagagcgcttgggtggcagccaggagggtaaaatgtctagcggcgctgaatccccggaactgctaacgtacgaggaagttgctcgctatcaacatcagcccggcgagcggccccgtcttgtcgtactgataggctcactgggggcgagactccatgagctcaaacagaaagtggtcgccgagaatccacagcattttggtgtggctgtccctcacaccaccagacctaggaaaagtcatgagaaggagggggtggaatatcacttcgtgtctaaacaggcttttgaagctgacctgcatcacaacaagttcctggagcacggagagtataaggagaacctatatggcacatctctcgaggctatacaggccgtaatggctaagaataaggtgtgcctcgtggacgtcgagccagaagccctaaagcaactgagaacaagtgaatttaaaccttacatcatttttgttaagcctgccatccaagagaagagaaagacaccccccatgagtcctgcgtgtgaggacaccgcagccccgtttgatgaacagcagcaggagatggctgcaagcgcagcatttatagatcgccactacgggcacctagtcgatgccgtgctggtgaaagaagatctgcaaggagcctatagccagctgaaggtggtactggagaagctgtcaaaggacacacattgggtacctgtttcctgggtgaggtag

SEQ ID NO: 194759 - DNA, 1833 bp, Artificial Sequence
  Description of Artificial Sequence: Synthetic coding sequence
atggagctgcagtaccccccccccccccccagcccccggatctgcagggaaagatccggtggggataacgctagtatgcccgtcctttccgaggactctggactccacgaaacgttagccctacttacctctcaacttcgacccgattctaatcataaagaagagatgggatttctgcgagacgtattctctgaaaaatcgttaagttacctcatgaaaattcacgagaaactgcgatattatgagagacaatctcccacacccgttctccactccgcagttgctctggcagaggatgtgatggaagaacttcaggctgcttcggtgcacagtgatgagcgcgagctcctccaactcttgtccactccccaccttcgtgctgtgttaatggtgcacgataccgtcgcccagaagaacttcgatccagttctcccccccctgccggacaacattgatgaggatttcgatgaagaatctgtcaagatagtgcgcctggtgaaaaacaaagaacccctgggagccaccattcgcagggacgaacactcgggcgctgttgtggttgcccggataatgcgtgggggcgccgccgacaggtctggcctggtgcatgtgggtgacgagctaagggaggtaaacggtatcgccgtcctccacaagcgcccagacgaaattagtcagattctggcgcaatctcagggctctataacattgaaaatcattccggctacacaggaggaggataggctgaaggaatctaaggtctttatgagagcattgtttcattataaccccagggaggatcgtgccattccatgccaggaagccggactgccgttccagcggaggcaggtcctcgaagtcgtatcacaggacgatcccacttggtggcaagccaaacgcgtgggggatacaaatctcagggctggactgatcccgagcaaaggctttcaggaaagacgacttagttaccgcagggcagccggcactcttccgagccctcagtctctccggaagcctccatatgaccaaccttgcgacaaggaaacgtgcgactgcgaaggatacctaaagggtcactatgtggccggactcaggaggtctttcaggttaggttgtcgcgaacgcctcggaggctcccaagaaggaaaaatgtcaagtggagcagagtcccccgagctcctaacctatgaggaggtcgcacggtatcagcaccagccgggcgaacggccaagactggtggtactgattgggagcctcggagcccggctccatgagttgaaacagaaggttgtcgccgagaatccacagcattttggtgttgcggtaccacacacaactagaccccggaaatcgcacgaaaaggagggagttgagtaccatttcgtgtctaagcaggcattcgaggcagacttgcatcacaacaagttcttggagcacggcgaatataaggagaacctctatggaacttcgctggaggcaatccaagctgtcatggccaaaaacaaggtgtgtcttgtggacgtggagccggaggcgctcaagcagcttcgaacgagtgaattcaagccctatatcatctttgtgaagccagcaatccaagagaaacgcaagactccccccatgtctcccgcctgtgaagatacagcagcccccttcgacgagcagcagcaggaaatggccgcatcagccgccttcatcgacaggcactatggccacctcgtggacgccgtgctggtgaaggaggacctccagggagcctactcccagctcaaagtggtccttgagaaacttagcaaggatactcactgggtgcctgtaagttgggtgcggtag

SEQ ID NO: 194760 - DNA, 1782 bp, Artificial Sequence
  Description of Artificial Sequence: Synthetic coding sequence
atgatccagagcgacaagggcgccgacccccccgacaagaaggacatgaagctctctactgcaaccaacccccagaacggcttgtcccaaatcttaagactggtcctgcaagagctaagcctgttctatggcagagatgtgaatggagtgtgcttactgtacgacctcctccacagtccttggctccaggcgctgctgaagatatatgattgtttacaagagtttaaagagaaaaaattggtcccagccacccctcatgcacaggttttgtcatacgaggttgtagaattgctcagggaaacacccacctctcctgagatccaagaactgcgccagatgctgcaagctcctcactttaaagccctcttgtctgctcacgatactatcgctcagaaggactttgagccactgctcccaccgttaccagataatatacccgagtccgaggaagcaatgcgcattgtgtgcttggttaaaaatcagcagcccttgggcgccaccatcaaaaggcacgaaatgacaggcgacatcctcgtggctcgcatcatccacggcggacttgctgagaggtcagggctgctgtatgccggcgataaactggtggaggtaaacggagtgagcgtcgagggccttgatcccgagcaggtgatccacatactagcaatgagtcgcgggaccattatgtttaaggtcgtcccggtctcagacccccccgtgaactctcagcagatggatccggacattccttgtatggacgccggcttgcctttccaaaaaggcgacatattgcagatcgtggatcagaacgatgccctgtggtggcaggcacgtaaaatctcagaccctgcaacctgcgccggcctggtgccttccaaccacctgctgaagcggaagcagcgggagttttggtggtcacaaccgtaccagccgcatacatgtctgaagagtacactgtataaggaggaattcgtgggctacggtcagaaattctttatcgccggatttcgcagatcaatgcgattatgtcggcgtaagtcacacctgtcgcctctgcacgcaagtgtatgttgcaccgggtcttgttactctgctgtgggggcgccatatgaggaggttgtgcggtatcaaaggagaccaagtgataaataccggctaatagtcctgatggggccatccggcgttggagttaacgagttacgtaggcagctgatcgaattcaatcccagccatttccagagcgccgtgccccataccacgcgtaccaaaaagagctacgaaatgaatggaagagagtatcactatgtgtctaaggaaaccttcgaaaacctcatctattcccacaggatgctggaatatggtgagtataaaggccacctgtatggtacaagtgtcgacgctgtgcaaactgtcctggtagaagggaagatctgtgtcatggacctagagcctcaggacattcagggcgtgcggactcatgagctgaagccttatgtgattttcattaagccctctaatatgagatgcatgaaacagagccggaaaaatgccaaagtcatcacagactactacgttgacatgaagtttaaggatgaggatttacaggagatggaaaaccttgctcagcggatggagacccaatttggacagttttttgatcatgtcatcgtaaacgatagcctgcacgatgcctgtgcccagctgttaagtgctatacagaaagcccaggaggagccccagtgggtgccggcaacctggatctcatccgatacggagtctcagtag

SEQ ID NO: 194761 - DNA, 1809 bp, Artificial Sequence
  Description of Artificial Sequence: Synthetic coding sequence
atgatccagagcgacaagggcgccgacccccccgacaagaaggacatgaagctgtctactgccaccaaccctcagaacgggctgtcccaaatcctccgtctcgtcctccaggaacttagcctgttctatgggagagatgtcaatggagtgtgtctgctgtatgacttgctccacagcccatggttacaggccctgctaaaaatttacgactgtttgcaggagttcaaggaaaagaagctcgttccagccaccccccatgcccaggtgctgtcttacgaagtggtggagttgctccgcgaaactccaacttcgcccgagatccaggaactccgacagatgctccaggcccctcatttcaagggcgcgactataaagaggcatgagatgaccggagacattctggtagcccgtatcatacacgggggcttagccgagcgtagtggcctgctctacgccggggataaactcgtggaagtgaatggagttagcgtggagggccttgaccccgaacaggtgatacacatccttgcaatgtctaggggcactattatgtttaaggtagtgcctgttagtgaccctcccgtcaattcccagcagatggtttacgtgagagcaatgaccgaatactggccccaggaagaccctgacatcccgtgtatggacgccgggttgcctttccagaagggagatatcctccagatagtcgaccagaatgacgctctgtggtggcaggcgaggaagataagcgatccagctacctgtgccgggctggtcccctctaaccatcttctgaaacggtggagtttcgctttagtggctcaagctggcgtacagtggcactatctggacagcttacagcccctccctcccggctttaagaggttttcctgccttagcctgcccaggagctgggattatatcgaggacgacatgaaaatcgacgaaaagtgcgtggaggctgagaaggaatctatcgagactgacaaggaggagttcgtagggtacggtcaaaaatttttcattgccggattcagaaggtccatgcgtctgtgtcgacggaagtcgcacctgtcccctctgcacgcttccgtttgttgtactggttcttgctattccgctgtaggcgccccatacgaggaggtggtgcggtatcagagacgacccagtgataaatatagactgatcgtccttatggggccatcgggcgtcggcgtcaatgagcttaggaggcagctgatcgaatttaacccttcacatttccagtcagcagtgccccacaccaccagaacaaagaaaagttatgaaatgaacggaagagagtaccattacgtatccaaagagacttttgagaaccttatttactcccatcgcatgttagaatatggggagtacaagggccacctgtacgggacctccgtggacgcagtccagaccgtactggtagaaggaaaaatctgtgtgatggatctcgaaccacaggacatccaaggagtgcgcactcacgagcttaagccttatgtgatctttataaagccgtctaacatgcgatgtatgaagcaaagccgaaagaatgcaaaggtgattactgattactatgtagatatgaaatttaaagacgaagacctgcaggaaatggaaaacctagctcagaggatggagacgcaattcgggcagtttttcgatcatgttattgtgaatgatagcctccacgacgcttgcgcacagcttttgtccgccatccagaaagctcaggaggagcctcaatgggtgccagccacctggatttcctctgatactgagagtcaatag

SEQ ID NO: 194762 - DNA, 1914 bp, Artificial Sequence
  Description of Artificial Sequence: Synthetic coding sequence
atgatccagagcgacaagggcgccgacccccccgacaagaaggacatgaagctctcaacagcaactaatccccagaacggcctgtcccagattctacgtttggtgcttcaggagctctcactcttctatggtcgtgatgttaatggagtgtgtttgctctatgatttattgcattctccctggctgcaggccttgcttaaaatttatgattgtttacaggagtttaaggaaaaaaaactagttcctgcaactcctcatgcacaggtgctcagctacgaagtcgtggagctgctgcgcgagactcccacatcccctgaaatacaggagctacggcagatgttgcaggctccacatttcaaagcactcttgagcgctcatgatacgattgctcagaaggatttcgagccgctgttgccccctctcccggacaatattccggagtcagaggaagccatgcgtatcgtctgtctggtgaaaaaccaacagccgctgggcgcaacgataaagaggcatgaaatgaccggagacattctggtggctagaattatccacggcggactagctgagcgtagtggactgctgtacgctggtgataagctggtggaggtgaacggggtgagcgtggagggccttgatcctgagcaggttattcacatcctggctatgagtcgcggtaccattatgttcaaggtcgtccctgtctccgatccccccgttaacagccagcaaatggtgtatgtgagggcaatgaccgagtactggccacaggaagatccggacattccatgcatggacgctggcctgcctttccagaagggcgatatcctccagattgtagatcagaatgatgccctgtggtggcaagctaggaaaatcagtgacccagccacctgtgcagggcttgtccctagcaatcaccttcttaaaagaaaacagcgggaattttggtggtcacagccttaccagccacacacatgtctgaaatccactttgtccattagcttgaaaggagaagacgacatgaagatcgacgagaagtgcgtcgaagcggaaaacagcacagccgaatccgaagagttaaactccgacaaggaagagttcgtgggatatgggcagaaattttttatcgccggtttccgacgctctatgcgtctctgtaggcgcaagagtcatctgtctccactccatgcaagcgtctgctgtacaggtagctgttacagcgcagtgggggccccatacgaggaagttgtgcggtaccagagaaggccctctgataagtatagactgatagtattgatgggaccaagtggggtcggcgtcaatgagctgcggaggcagctgatcgagtttaacccctcacatttccagtcagccgtcccacataccaccagaacaaagaaaagttacgagatgaacgggcgcgaatatcattacgtgagcaaggagactttcgaaaaccttatttactctcaccgcatgctggagtatggtgaatataaaggtcacttgtatggaacatcggtggacgcggtgcagactgtcctggtggagggaaaaatttgtgtgatggacctagaacctcaagacatccaaggggtgaggacccatgagctgaagccctacgttatctttatcaagccttccaatatgcgttgcatgaagcagtcccggaagaacgccaaagttattacagactactacgtggacatgaagtttaaggacgaagacctccaggagatggagaatctggcacagcggatggagacccagtttggccagttcttcgaccatgtaatagtgaacgattccctccatgatgcttgtgcgcaactgctctccgcaatacagaaagctcaggaagagccgcagtgggttcctgctacctggatatcctctgataccgagagccaatag

SEQ ID NO: 194763 - DNA, 1701 bp, Artificial Sequence
  Description of Artificial Sequence: Synthetic coding sequence
atgatccagagcgacaagggcgccgacccccccgacaagaaggacatgaaactcagcactgcaaccaacccgcagaacggactctcacagatacttagactggtgttgcaggaactgtctctgttctacggaagggatgtaaatggggtctgtctgctctacgatcttctccactctccgtggctgcaggcccttctcaaaatatacgactgtttacaagagttcaaagagaaaaagcttgttccagccacacctcacgcccaggtcctaagttatgaaggcgctaccataaagcgccacgagatgaccggtgatatcctcgttgcacgtataatccacgggggcttggctgagagaagcggcttgctgtacgccggagataaactggtcgaggtgaacggcgtgtctgtcgagggtctggatcccgagcaagttattcacattctggccatgtctcgcggtacaataatgttcaaagtagtgccagttagtgacccccctgtcaactcacaacaaatggtgtacgtcagagcgatgacagagtactggccccaggaagatccagatattccatgtatggatgctggtctgccattccagaagggcgacatcttgcaaattgttgatcagaacgatgctctttggtggcaagctcggaagatctctgaccccgccacatgcgcaggcctggttcccagtaaccacctgctgaaacgcaagcaacgagagttttggtggagtcaaccctaccaacctcatacctgtctgaaatctaccctcagtatttccttgaaaggagaggacgatatgaagatcgacgaaaagtgtgtagaggccgaaaattcaaccgcggaaagtgaggagctcaacagcgacaaggaggagtttgttggatacggacagaagttcttcattgcgggctttaggcggtccatgcggctatgtcgaagaaaatcgcacctgtccccactgcatgcttcggtatgctgcaccggaagctgttacagtgctgtcggagcaccgtacgaagaagtcgtcagatatcaacggagacctagtgataaataccggctgatcgtcctgatgggaccaagcggggtcggtgtgaacgaactccgtcggcagttgatcgagtttaatccatcacactttcagtccgcagttcctcatacaactcggaccaagaaatcttacgagatgaatgggcgggagtaccactacgtgtctaaggagaccttcgaaaatctgatttattcacacaggatgctggaatacggagagtataaagggcatctgtatgggactagcgttgacgcagtgcagacagttctggttgagggaaagatctgtgtgatggacctagagccacaggatattcagggcgtgagaacacacgaactgaagccatacgtcatctttatcaaaccttctaatatgagatgtatgaaacagtccagaaagaatgccaaggttattacggattactacgtagacatgaagtttaaggatgaggacttgcaagagatggagaatttggcccagcgcatggagacacaattcggccaattcttcgatcatgtgatcgtcaacgacagtctgcacgacgcgtgtgcacagctgctaagtgcaatccaaaaagcacaggaggagccacaatgggtgccggctacttggatctcaagcgacacggaatcacagtag

SEQ ID NO: 194764 - DNA, 1914 bp, Artificial Sequence
  Description of Artificial Sequence: Synthetic coding sequence
atgatccagagcgacaagggcgccgacccccccgacaagaaggacatgaagctgtctaccgcaacaaacccccaaaatggcctatcacagatcttaaggctggtgctacaggaactcagcttgttctatggtcgggacgttaacggagtttgcctgctgtacgaccttttacatagcccatggctgcaggctctgctaaagatctacgattgtttgcaggagtttaaggagaaaaaactggttcctgctacaccccacgctcaggtcctgtcttatgaagtagtggagctcctgcgggagacgcccacctcccctgaaatccaagagctgcgacagatgctgcaggcgccgcactttaaggccctgctgtccgcccacgacacgattgcccagaaggattttgagcctctcttgccgcccctccctgataacatccctgaatctgaagaagccatgcggatcgtgtgcctggtgaagaaccagcaacccctaggcgcaactatcaaacgccatgaaatgacgggagatattctggtggcccgcatcatacatggtggcctcgcggaaagaagtgggctgctgtatgctggggacaaactcgtggaggtcaatggggtgagtgtggaaggcctcgatccggaacaagttatccacatcctggccatgagccgagggacaattatgtttaaggtcgtgcccgtgtcagaccctccagtgaattcacaacagatggtatatgtgagggccatgactgaatactggccgcaagaagaccccgatatcccatgcatggatgccggcttgccttttcagaaaggggatatccttcagattgttgatcagaacgatgcattgtggtggcaggctcggaagatttctgacccagccacatgtgccgggctggtgccctctaatcacctgctcaagagaaagcaaagggaattttggtggagtcaaccctatcagccccatacgtgcctgaaatctactctgtccatcagcatggaggaagaagatgatatgaagatcgatgagaagtgtgtcgaagccgacgaagaaacctttgaatccgaagagttgagtgaggacaaggaagagtttgtagggtacgggcagaagtttttcattgcaggattccgccgctccatgagactgtgtaggcggaagtctcacctcagcccactgcatgccagtgtgtgttgcacagggtcctgttacagcgctgttggcgctccgtacgaagaggtggttcgttatcaacgtaggccctctgataagtacaggttgatagtgctaatgggaccatccggtgttggcgttaatgagctgaggcggcagctgatcgaatttaaccccagccactttcagtctgctgtcccccacacaacccgtaccaaaaagagctacgaaatgaacggtcgagaataccactatgtgagtaaagagacttttgaaaacctgatatactctcacaggatgctcgaatacggggagtacaagggacatttgtatgggacaagtgtagacgctgttcagactgtcctcgtggaggggaaaatctgcgtcatggacctggagccccaggacatccagggtgtaaggactcacgagctaaaaccatatgtgatttttatcaagccttccaacatgcgttgtatgaagcagtcgagaaagaacgcgaaggttataaccgattactacgtggatatgaaattcaaagatgaggatctgcaggagatggagaacctggcccaacgaatggagactcagtttggccaatttttcgatcatgtcatagtgaatgacagcctgcatgatgcctgtgcacagctactgagcgcgatccaaaaggcacaggaggagccccagtgggtgcctgccacctggatctctagtgatactgagagccagtag

SEQ ID NO: 194765 - DNA, 2028 bp, Artificial Sequence
  Description of Artificial Sequence: Synthetic coding sequence
atgaccaccagccacatgaacggccacgtgaccgaggagagcgactcagaagtgaagaatgtggacctggcaagtcccgaagagcaccaaaagcacagagagatggcggtggattgtcccggggatctgggcactcggatgatgcccattaggagatcggctcagctggagcggatccggcagcagcaagaagatatgaggcgccgaagagaagaggaaggaaaaaagcaggagcttgatctgaattcctctatgagactgaagaaactcgcccagatcccaccaaagactggcatcgacaatcctatgtttgacacagaggaaggaatcgtactggagtctcctcactatgctgttaaaatcttggagatcgaggacctgtttagttccttaaagcacattcaacacacactggttgatagccagtcccaagaagacatctcgcttctactccagctcgtgcagaacaaagattttcagaacgcttttaaaatccataacgctatcacagttcacatgaataaagctagtccaccctttccactcatttctaacgcccaggatctggcgcaagaggtgcagactgtcctgaagcctgtgcaccataaggaaggccaagagctcaccgccttacttaatacaccccatatccaggcccttctgttggcccatgacaaagttgcagagcaggagatgcagcttgagccaatcactgacgaaagagtttatgagagcattggccagtacggcggagaaacagtgaagatcgtgaggattgagaaagcccgggacatcccactcggggccacagttagaaatgagatggattcagttataatttctcgcatagtgaaaggaggagctgccgaaaagtctggattgttacacgagggggacgaggtactggaaatcaacggcatcgaaatcaggggcaaagacgtgaacgaggtgtttgatctcctgtcagacatgcacggcaccctcaccttcgtcctcatcccatcccagcagatcaaacccccccccgcgaaggaaactgtaattcatgtgaaggctcatttcgactacgatccttcagacgatccctatgtgccatgtagggaattgggactgtctttccagaagggcgacatcttgcatgtgatttcccaggaagatcccaattggtggcaagcgtaccgcgagggggacgaagacaatcagcccctagccgggctggttcccgggaagagctttcaacaacagcgcgaggctatgaagcagacaatagaagaggataaagagccggaaaaaagtggtaagctatggtgtgccaaaaagaacaagaagaagaggaagaaggtgctctataacgccaataagaacgatgactacgacaacgaggagatcctgacctatgaggaaatgtctctttatcaccagccggctaatagaaaaagaccaataattctgatcggacctcaaaattgcgggcagaatgaacttcggcagcgactcatgaacaaggagaaagatcggttcgctagcgccgtgccccacaccacccgaagccggcgcgaccaggaagtcgccgggcgcgattaccacttcgtcagcaggcaagcattcgaggcagacatcgcagccggtaagtttattgaacacggcgagttcgagaagaacctgtatggaacctcgattgattccgtccgccaggtgataaactctggcaagatttgcctgctgtctctccgaacacaatctctgaaaaccctccgcaacagtgacttgaaaccctatataattttcattgcccctccttctcaggagagattacgagccctcctggccaaggaagggaaaaatccaaaaccggaagaattgagagagattatcgagaagacccgggagatggaacagaataacgggcattatttcgacaccgcgatcgtcaacagcgacctggacaaagcatatcaggaactgttgcgattgattaacaaactggacactgagccgcagtgggtgccttcaacctggctcagatag

SEQ ID NO: 194766 - DNA, 1926 bp, Artificial Sequence
  Description of Artificial Sequence: Synthetic coding sequence
atggccgtggactgccccggcgacctgggcacccggatgatgcccattaggaggtccgcacaactggaaagaatccgccagcagcaggaagatatgcggaggcgtagagaagaagaaggaaagaaacaggagttagatctgaactcctcaatgcggctgaaaaagctagcacaaatacctcccaagacaggaatcgataatcccatgttcgacacggaggaggggattgtgctggagagcccacactatgcggtgaagatcttagagatcgaggatctcttctccagtctgaagcacatccaacacactttggtcgatagccagtcccaggaggacattagcttacttctgcagctggttcaaaacaaggattttcagaacgccttcaaaatccacaatgccataaccgtacacatgaataaagcctcccctcctttcccactgatttccaatgcccaggacctcgctcaggaggtgcagaccgtgcttaagcccgtccaccacaaagagggccaggagctcacagcactgttgaataccccacatatacaggccctgctgctggcccatgataaagtggctgaacaagaaatgcagcttgaaccgattacggacgaacgagtgtacgaaagtatcggacagtatggaggggaaaccgtgaagatcgtgagaatcgaaaaggcgagagatatccccctgggcgcgactgttcggaatgagatggactctgtcatcatctctcgaatcgtcaaaggaggtgctgccgagaagtcaggacttttgcacgagggcgacgaagttctggaaatcaacggaatcgagattagaggcaaggatgttaatgaggttttcgacctcctttccgatatgcatgggacactgacgttcgtactgattccaagtcagcagatcaagcctcctccagccaaagagactgttatccacgtgaaggctcattttgattacgacccatctgacgacccatacgttccgtgccgggagctgggtcttagttttcagaagggtgacattttgcatgtgatttctcaggaggaccccaattggtggcaggcttatcgtgaaggagacgaagacaaccagcccctcgccgggctggtgcccggtaagagtttccaacagcaacgggaagccatgaaacagacaattgaggaagacaaagagcctgaaaagtcgggaaagctctggtgcgcgaaaaagaataagaaaaaacggaagaaggtcctgtacaacgctaacaaaaacgatgactatgataacgaagagatcctgacgtatgaagagatgtctctttaccaccagccagctaaccgaaagagacccatcattctgatcgggccacagaactgcggacaaaatgaactaaggcaacggctgatgaacaaggagaaggatagatttgcctctgctgtcccgcacactacaagatcacgcagggaccaggaggtagccggcagagattatcatttcgttagccgtcaggcctttgaggccgacatcgctgcgggtaagttcattgaacacggtgaattcgaaaagaatttatacgggacttccattgattcagttcggcaagtgattaacagcggtaaaatttgcctcttgtcactccgcactcagagccttaaaacgcttaggaattccgatctgaaaccatacatcatctttatcgctcctccttctcaagaacggttgagagcactgttggccaaagagggcaagaatccaaagccggaggagctcagggagatcatagaaaaaaccagagagatggagcagaacaacggccattattttgatacggctattgtgaacagtgacttagataaagcctatcaagagttactgcggctgatcaataaacttgatacggagccgcagtgggtaccgtccacctggctgcgctag

SEQ ID NO: 194767 - DNA, 15 bp, Artificial Sequence
  Description of Artificial Sequence: Synthetic coding sequence
atggccgtggactag

SEQ ID NO: 194768 - DNA, 450 bp, Artificial Sequence
  Description of Artificial Sequence: Synthetic coding sequence
atggccgtggactgccccggcgacctgggcacccggatgatgcccattcggcgctcagcccaacttgaaagaatacgacagcaacaggaggatatgcgcagaagaagagaggaggagggtaaaaagcaggaactggacctcaattcatcgatgcgcctgaagaaattggcccagatcccgccgaaaaccggcatcgacaatccaatgtttgacacagaggaagggatcgtgctcgagagtccacactatgctgtcaagattctcgaaatagaggatttattttctagcctgaaacatatacagcacactcttgtggacagtcaatcacaggaagatattagccttctgctccagctggtacaaaacaaagatttccagaatgcattcaagatacacaatgcgataactgtccacatgaacaaggcttctccccctttccctttgatttag

SEQ ID NO: 194769 - DNA, 870 bp, Artificial Sequence
  Description of Artificial Sequence: Synthetic coding sequence
atgaccggcgtgttcgaccggcgggtgcccagcatccggagcggcgacttccaggcaccatttcagacgagcgccgccatgcaccaccctagtcaagagagccctaccttacccgaaagcagcgccacagatagcgactactattcacctaccgggggcgccccgcacggatattgcagtccaactagcgcctcgtacggaaaagccctgaatccttatcagtaccaataccacggcgttaacggaagcgcaggctcctacccagccaaggcctacgccgactactcctatgcctcctcttaccaccagtatgggggcgcgtataatagggttcccagtgccaccaatcagccagagaaggaagtgactgagcccgaggtacggatggttaacggtaagccaaaaaaggtccggaagcccagaacaatctatagcagtttccagcttgcggcacttcagagacggtttcaaaagactcagtatttagctctccccgagcgcgcggagctcgcagcatcactgggactgactcagacccaagtcaagatctggtttcagaataagcgatctaagataaagaagatcatgaaaaacggcgagatgcccccggagcattctccttccagctctgatcctatggcttgcaactcaccacagtccccagccgtgtgggagccccaagggtcttctaggtcacttagccatcatccccacgctcatccaccaacctcaaatcagtctccagcatccagttatttggagaactctgcatcgtggtacacttctgcagcttctagcatcaactcccacctgccacccccagggagcctacaacatcctctagcgctcgcctctgggacgttatactag

SEQ ID NO: 194770 - DNA, 1623 bp, Artificial Sequence
  Description of Artificial Sequence: Synthetic coding sequence
atgcagcaggtgctggagaacctgaccgagctgcccagcagcaccggcgccgaggagattgatttaatctttctcaaagggattatggaaaaccccatcgtgaagtcattagcaaaggcccacgagcggctcgaagatagcaagctggaagctgtgtctgacaacaacttggaactggtcaacgaaatacttgaggacatcacacctttaattaatgtggatgagaatgtggctgaactggtgggaattctgaaggagccacatttccagagtctactggaagcccacgacattgttgcttctaaatgctacgatagcccaccttctagtcctgagatgaacaattcaagcatcaataaccaattgctccctgttgatgcaattaggattctcggcattcacaagcgcgctggggagcccctgggagttacgttccgcgtcgaaaataacgacctggtcatcgctaggatccttcatggggggatgatcgatcggcagggactcctgcatgtgggcgatattatcaaggaggtgaatggccacgaagtgggaaacaatccaaaggagctccaggagttacttaagaatatcagcggtagcgtcactctcaagattctgccctcatatcgggataccatcacacctcaacaggtgttcgtaaaatgtcatttcgattacaatccgtacaacgataatctgatcccttgcaaggaggcgggacttaagttctctaaaggagagatcctgcagatagtgaatcgggaggacccgaattggtggcaggcaagccacgtgaaggagggcggatcagccggcctgatcccctctcagtttctcgaggaaaagcggaaagcctttgtgcggcgcgactgggacaactcaggccccttctgtggcaccattagctctaaaaagaagaaaaagatgatgtatttaacaacacgcaacgcagagttcgaccggcacgaaatacagatatatgaagaggtagcgaagatgccccccttccagaggaaaaccctggtgttgatcggggcacagggagtgggcagacgctccctgaagaaccgttttatcgttcttaatcctacacgcttcggcacaactgtgccatttacgtcgaggaagccccgggaagacgagaaggatggtcaggcgtacaagtttgtctctcggtctgaaatggaggccgatatcaaagctgggaagtatctggagcacggtgagtacgagggaaatttatatggcacaaaaatagactctattctggaagtggtccagacaggtagaacgtgtatcctcgacgtgaaccctcaagctctgaaggtgctgagaacatcggaatttatgccctatgtggtgttcattgctgctcctgaattagaaacactcagggccatgcataaggcagtggtcgatgccggcatcaccaccaaattgctaacggatagcgatctcaagaagacggttgacgagagcgcgcgtatccaacgggcttataatcattatttcgacctgatcattatcaacgacaacttggacaaggcattcgagaagctgcagacagcaatcgaaaagttacgcatggagccccagtgggtcccaatttcttgggtgtattag

SEQ ID NO: 194771 - DNA, 1287 bp, Artificial Sequence
  Description of Artificial Sequence: Synthetic coding sequence
atgaacaacagcagcatcaacaaccagctgctgcccgtggacgccataaggattcttggcattcacaagcgagcaggggagcccctcggggtaaccttccgcgtggagaataacgacctggtaatcgctaggatcctgcatgggggcatgattgacagacaggggctgttgcatgtgggagacatcatcaaggaggtcaacggacatgaggttggcaacaaccctaaggagttgcaggaacttttgaaaaatatcagtgggtcggtaaccctgaaaatcctgcctagctatcgcgataccataactccacagcaagtttttgtcaagtgccacttcgactacaacccttataacgacaatctcatcccttgtaaagaggctggccttaaattcagcaaaggagaaattcttcagatagtcaatagagaagaccctaactggtggcaggcatctcatgtgaaggaggggggtagcgctggactcatcccctcacagtttctggaagaaaagagaaaggcattcgtccggcgcgattgggataattccggaccgttctgcggcacaatatcttcgaagaaaaaaaagaagatgatgtacctgacgacacgtaacgccgaattcgacaggcacgaaatccagatttacgaagaggtcgcaaagatgccgcccttccaacgcaagacactggtacttatcggcgcgcagggtgtggggcgtagatcgctcaaaaaccgctttattgttttgaaccccacccgattcggtacgacagtgcctttcacgtcccggaaaccccgggaggacgaaaaagatggccaggcatataagttcgtgtctagatctgagatggaagccgatatcaaagcaggaaagtatctggagcatggcgagtacgaggggaacctgtatggaacaaaaatcgatagcattcttgaagttgtccagacgggcaggacttgtatattggatgtgaacccacaggctctaaaggtgctgcggaccagtgagttcatgccatatgtggtgtttatcgcagctccggagcttgagaccctgagggcaatgcacaaggccgtggtggatgcaggaataaccacgaaattattgactgattccgatttaaagaagacagttgacgaaagtgcccgaatccagcgggcctataaccactacttcgacctgatcattatcaacgacaaccttgataaggcttttgagaaactccagacagctatcgaaaagttgagaatggagcctcaatgggtaccaattagctgggtgtattag

SEQ ID NO: 194772 - DNA, 924 bp, Artificial Sequence
  Description of Artificial Sequence: Synthetic coding sequence
atgcagcaggtgctggagaacctgaccgagctgcccagcagcaccggcgcagaggaaatcgacttgatcttcctgaagggaattatggagaaccctatcgtgaaaagcttggccaaagcacatgagagactggaagattcaaaactcgaagctgtgtccgataacaatcttgagctggtaaatgagattctggaggatatcacgcccctgatcaacgtggatgagaatgtagctgagctggttggaattcttaaagaaccccacttccaaagccttctcgaagcgcatgatattgtggcatcaaaatgttacgattccccaccctcgtcccctgaaatgaacaactcttccatcaataaccagcttctaccagtggatgccatccgaatacttggcattcataaacgtgctggcgaacccctgggcgtcacctttagggtggaaaacaatgatttggtgatcgcccggatcctccatggtgggatgatcgacagacaaggcctgcttcacgtaggggatatcatcaaagaggtcaatggtcacgaagtgggaaataaccctaaggaactacaagagctgcttaaaaacatcagtggatcagttactctgaagattctgccttcctatcgagacaccatcactccccaacaggtgtttgtcaagtgtcactttgattataatccttacaatgataacttgataccatgcaaggaggccggtctaaaattttccaaaggcgaaatactccagatcgtgaaccgtgaggatcctaattggtggcaggcgagccacgttaaggaagggggcagcgctggccttattcccagtcaatttctggaggaaaagcgtaaagcctttgttaggagggactgggacaacagtgggccattctgcggcactataagcagtaagaagaagaagtag

SEQ ID NO: 194773 - DNA, 654 bp, Artificial Sequence
  Description of Artificial Sequence: Synthetic coding sequence
atgcagcaggtgctggagaacctgaccgagctgcccagcagcaccggagctgaggaaatcgatctgatatttctgaaagggataatggaaaatcctattgtaaagagcctcgcaaaagcgcatgaacgtttagaggattctaagctggaagccgtatcagataataacctggagctcgtcaacgagatcctggaggacatcactcctctaattaatgtcgatgagaacgtagccgaactggtcggtatcctgaaagaacctcacttccaaagcctgctggaagcacacgatattgtggcttcgaaatgctacgattcgccaccttcttcacccgagatgaacaactcatccatcaataaccagctcttgcctgttgatgccatcagaatccttggcattcataagagagctggcgagcccttgggagtgacatttcgggtggagaacaacgacctcgttattgctaggattctccatggtgggatgatcgatcggcaaggcctgctccatgtgggcgatattattaaagaggttaatgggcatgaagtgggtaataatcctaaagaactacaggagctactgaaaaacatcagcggaagcgttacactgaaaatcctcccgtcctaccgggacactatcactccccagcaatag

SEQ ID NO: 194774 - DNA, 1731 bp, Artificial Sequence
  Description of Artificial Sequence: Synthetic coding sequence
atgcccgccctgagcaccggcagcggcagcgacaccggcctgtacgagttgctggccgcacttcctgcccagctccaaccccacgtagacagccaggaggacctgactttcctgtgggacatgtttggcgagaagtctctgcatagcttggtgaagattcacgaaaaactacactattatgagaagcagtctccagtgcccatcctgcatggagctgcagcactggcagacgacctcgcggaggagctgcaaaataagcctcttaacagtgagatacgggaactgctgaaacttttatccaagcctaatgtgaaagcactcctcagcgtgcacgatacagtggctcagaagaattacgacccagtgctgcccccgatgcctgaggatattgacgacgaagaggattcagtcaaaatcattcgcctcgtgaaaaacagagagcccctcggcgccactatcaagaaggatgagcagaccggagccataatcgttgccaggattatgcggggcggggcagccgatcgcagtgggctgatacacgtgggagatgaattgagagaggtcaatggcataccagttgaagataagcgcccggaagaaattattcagatcctggcacagagtcaaggcgcaatcacgttcaaaatcattccgggcagcaaggaggagaccccaagcaaggagggcaaaatgttcatcaaggccctgtttgattacaatcctaatgaggacaaagcaataccttgtaaggaagccggactttcgtttaaaaagggggatatcctgcaaataatgtcacaggatgacgcaacctggtggcaggctaaacatgaagccgatgcaaacccccgggccggcctcatcccttccaaacattttcaagagagaaggctggcactgagacggcccgagatactggtgcagcctctcaaggtctccaatcgcaaatctagtgggtttaggaaaagcttccgactatcacggaaagataaaaagaccaataagagtatgtacgagtgtaagaagtccgaccagtatgacaccgctgacgttcccacatatgaggaggtgacaccctatcgacggcagactaatgaaaaatacaggcttgtcgtgctagtggggccagtgggagtcgggctgaacgagcttaaaagaaagcttctcatttccgatacacagcattacggggtgacggtaccacacactacacgggcccgacgtagccaggagtcagatggagtggaatatattttcatttcaaaacacctgttcgagaccgacgttcagaacaacaaatttatcgagtacggagaatataaaaacaattactatggcacctctattgacagtgtccggtctgtgctggccaagaataaggtgtgtctcctggacgtccaaccacatactgtcaaacacctgcgcactctcgaattcaaaccatacgtaatattcatcaagcccccgagcattgagcgtttgagggaaactcgcaaaaacgccaaaattatcagcagtagagatgaccaaggcgcagcgaagcccttcacggaagaggacttccaggagatgatcaagtctgcccagattatggagtcccagtatgggcatctgttcgacaaaattattataaatgacgacctcaccgtggcatttaacgaactgaagacgactttcgacaaactagagacagagacacactgggtacccgtctcctggctgcacagctag

SEQ ID NO: 194775 - DNA, 1731 bp, Artificial Sequence
  Description of Artificial Sequence: Synthetic coding sequence
atgcccgccctgagcaccggcagcggcagcgacaccggcctgtacgaactcctggctgcgctgcccgcccaacttcagccccacgttgactcgcaggaggatttgaccttcctgtgggacatgttcggggagaaatcgctgcacagtttggttaagattcatgagaaactacactactacgaaaaacaatccccagttccgattttacacggggctgctgcattggcagacgacctggccgaggagctccagaataaaccgctgaattcagagatccgggagcttctgaagcttttatccaagccgaatgtcaaagcattgctttcagtccacgacaccgttgcgcagaagaactacgatcctgttttgccgcccatgccggaagacatcgacgatgaggaagactcagtcaaaataatccgcttggtaaaaaaccgggagcccttgggagctactatcaagaaggacgagcaaactggcgctatcattgtggcccgcatcatgcggggcggcgctgctgaccgcagtggtcttattcacgtgggagatgaactgcgggaggtgaatggcatccctgttgaggacaagagaccagaagagatcatccagattctagctcagtcccagggcgctattactttcaaaataatccccggcagcaaagaggaaactccatcgaaggaaggcaaaatgttcatcaaggcgctatttgattataaccccaacgaggataaggccataccctgcaaggaagccggcctgtcttttaaaaagggggatattctgcaaataatgtcacaggacgatgccacctggtggcaggccaagcatgaggccgacgcaaacccacgggctgggttgataccttccaaacactttcaagaaaggaggctggccctcaggcgacctgaaatcctggtccagcctctgaaggtgtccaatcgaaaaagttcgggatttagaaagtccttccggctgagccgaaaagacaagaagactaataagagcatgtatgagtgtaaaaaatcggatcaatacgacacagcagacgtacccacctacgaggaagtcactccttaccggagacagaccaacgaaaagtaccgcctggtcgtcttggtgggccctgttggagtgggcctgaacgagctgaaacggaagctgttgatctccgacacccagcactacggagtcacggtcccacatactactagagctaggaggtctcaggaatcagatggagtggagtatatttttatcagcaaacatctgttcgaaacagatgtacagaataacaagttcatagagtacggtgaatataagaataactactatggaactagcatcgattccgttagatccgttcttgcgaagaacaaagtgtgcctgctggacgttcaaccgcacacggtcaagcaccttcggaccttagagtttaaaccctacgtcatattcattaagcctcccagtattgagcggctgcgagagactcgcaagaatgctaagataatcagctcgcgagatgatcagggagcggccaagccattcaccgaagaagactttcaggagatgatcaaaagtgcgcagattatggagtcccagtacggacacctgttcgacaagatcataatcaatgatgaccttaccgttgcattcaacgagctgaaaaccacgttcgataaattggaaactgagacccactgggtgcccgtgagttggctacatagttag

SEQ ID NO: 194776 - DNA, 1731 bp, Artificial Sequence
  Description of Artificial Sequence: Synthetic coding sequence
atgcccgccctgagcaccggcagcggcagcgacaccggcctgtacgaactgctcgccgccctgcccgcacagcttcagccacatgtcgatagccaagaggacctgacttttctctgggacatgttcggagaaaagagcctgcatagtctagtgaaaatacatgagaagctgcattattacgaaaaacagtcccctgttcccatactgcacggcgccgcagcattagccgacgatctggctgaggagctgcagaacaagccgctgaatagcgagatccgcgaactgttgaagctactctccaaacccaacgttaaggccttgctgagcgtgcacgatacagtagcacaaaaaaattacgacccggtgttacctcctatgcctgaggatatcgatgatgaggaagactccgtgaagataatccgtctggtgaaaaatagagaaccattgggagccaccatcaagaaagatgaacaaacgggtgctatcatcgtggccagaattatgagaggaggagccgccgatcggagtgggctgatacacgtcggtgatgagctgagagaagttaatgggatcccagttgaagacaagcgacctgaggaaatcatacaaattctggcccaatctcagggagccatcaccttcaaaattatcccgggctccaaggaagagaccccctcgaaggaaggaaaaatgtttatcaaggctttgttcgactacaaccctaacgaggacaaagccatcccgtgcaaggaagcgggcctgtcctttaaaaaaggtgacattttgcagatcatgtcccaagatgacgcaacttggtggcaggccaaacatgaggctgacgcgaatccccgggctgggctgattccatccaaacacttccaggaacggaggttggccctaaggcggcccgaaatactcgtgcagccccttaaggtctccaacagaaaaagctcgggctttcgcaaatcctttaggctgtccagaaaggataagaaaacaaataaatctatgtatgaatgcaaaaagtcggatcagtacgataccgctgatgtgcctacatatgaggaggttacaccctaccggcgtcagacgaacgaaaaatatcgccttgtggtattggtgggccccgtgggggttggcctgaacgagctgaagcgaaaactgttgatttccgatacccagcactacggcgtcacagtaccacacactacgcgtgcccggcgatcacaggagtccgacggcgtcgagtacatctttatctccaagcatttgtttgaaacagacgtacagaacaataagtttatcgagtacggcgaatataaaaacaactactatggcacctcgatagactcagtgcggagtgtcctggccaaaaacaaagtctgcctcctggacgtgcaaccccacaccgttaagcacctaagaaccctagaattcaagccctacgttatcttcatcaaacctcccagtattgaaagactccgggaaacaaggaaaaatgccaagatcattagctcccgggatgaccagggggccgcaaagccttttaccgaggaggatttccaggaaatgatcaagtctgcccagataatggagtctcagtacggccatctcttcgacaaaataatcatcaatgacgacctcactgtggcattcaacgagctgaagacgacctttgacaaactggaaactgaaactcattgggtgcccgtgagctggctccactcctag

SEQ ID NO: 194777 - DNA, 939 bp, Artificial Sequence
  Description of Artificial Sequence: Synthetic coding sequence
atgcccgccctgagcaccggcagcggcagcgacaccggcctgtacgaactattagctgctctgccggcacagctccagccgcacgtcgattcccaagaggatctgacatttctttgggatatgtttggtgagaagagccttcatagcctggtgaagcatttccaagaaagaagactggctctgcgacgcccggagattttggtccagcccctgaaggtctctaatagaaagagcagcggattccgaaagtctttcagactgtcccggaaagacaagaagaccaataagagtatgtatgagtgcaagaagagcgaccagtatgacactgcggacgtacctacctacgaggaagttacaccttatcgcaggcagaccaatgagaaataccgattagtggtcctggttggaccggtcggtgtcgggcttaacgaacttaaacggaagctccttatcagtgatactcaacattatggagtcaccgtgccacacacaacgcgggcaaggcgctcacaagaaagcgacggggttgaatatatttttatctccaaacatctcttcgaaacggatgtgcagaacaataaattcatcgagtacggcgaatacaagaacaactactacggcacttctatcgattccgtgcgcagcgtgctagcgaagaacaaggtatgtctattggacgtgcagccacacaccgttaaacatctgaggacgctggagtttaaaccctacgtgatcttcatcaaaccaccatctatcgagagactcagggagacacgcaaaaatgccaagatcatctcttcgcgcgatgaccagggcgctgccaaaccattcactgaggaagacttccaggaaatgatcaagtctgctcagatcatggagagccagtacggccatttgtttgacaagattattatcaacgatgatctgaccgtcgcgtag

SEQ ID NO: 194778 - DNA, 1125 bp, Artificial Sequence
  Description of Artificial Sequence: Synthetic coding sequence
atgcccgaggacatcgacgacgaggaggacagcgtgaagatcatccgtcttgttaagaaccgcgagcccttaggcgcaaccatcaagaaggatgaacagacaggggccatcatcgtggcccggattatgcgaggcggtgcagctgaccgatcaggtctgatccatgtgggcgacgagttgcgggaggtgaacggcattccagtggaggacaagagaccagaagaaatcatccaaatactggcacaatcccaaggggcaattacttttaagatcattcccggtagcaaggaggaaactcctagcaaggagggaaaaatgtttataaaagctctcttcgattataaccccaacgaggataaggccattccatgcaaggaggcaggccttagcttcaagaaaggagatatcctgcagattatgtcccaggatgacgccacatggtggcaagccaagcacgaggctgatgctaacccaagagctggactaatcccttccaagcactttcaggagcgccgcctggctctccggcgcccagagatcctggtgcaacctctcaaagtatccaataggaagtctagcggattcaggaagagttttcgcctgtcacgcaaagataaaaaaaccaataagtccatgtacgagtgcaagaaatctgatcagtacgataccgctgatgtgcctacgtatgaggaagtgacaccatatcgtaggcagacaaatgagaaataccgcttagttgtcctggtaggccccgttggagtcggtctcaatgagcttaaacgcaagctcctgatatccgatacacagcattacggggtcactgtaccccatacgaccagagctaggaggtctcaggaaagtgacggagttgagtacatcttcatctctaagcacttatttgaaactgacgtccagaataataaatttatcgaatatggcgaatataaaaataattactatggtactagcatcgattcagtgcgctccgtactggccaagaataaagtatgcctgctggacgtgcagccccacggaccttggttcctgctccctttgatggccgtaccttggggagccaaaccaccaaatgcgaggatgacttgcggctcccccctggatctgtag

SEQ ID NO: 194779 - DNA, 1731 bp, Artificial Sequence
  Description of Artificial Sequence: Synthetic coding sequence
atgcccgccctgagcaccggcagcggcagcgacaccggcctgtacgagctgctagccgccctgcccgcacaacttcagccccacgtggattcacaagaggatttaacattcctgtgggacatgtttggcgagaagtctctgcactccctggtaaaaatacatgaaaagcttcattactacgaaaagcaaagccctgttccgatcctccacggagctgctgctcttgctgatgacctggccgaggagctgcaaaataaacctctaaacagcgaaattcgcgagctgctgaagttactttcaaaaccaaacgttaaggcccttctcagtgtccacgacaccgtcgcccagaaaaactatgacccggtattacctcccatgcccgaggatatagatgacgaggaggatagcgtgaaaattatccgtctcgtcaagaatcgcgagccattaggcgccaccattaaaaaagatgagcagacgggagcaataatcgtggcacgcatcatgcgcggtggagctgccgatcgtagtggcttaattcacgttggggatgagctgcgggaagtgaacggtataccagtggaagataagcgacctgaggaaattatccagatcctcgctcagtctcagggagctattacgtttaaaattatccccggttctaaagaggaaacacctagcaaggaaggcaaaatgtttattaaagccctgttcgattacaacccaaacgaggataaggcaatcccgtgcaaagaagcagggctgagctttaagaagggagacattctgcagatcatgtcccaggatgacgccacttggtggcaggcaaaacacgaggcagatgccaacccgagagccgggctgatcccttccaagcactttcaggagcgccgcctagccctgcgccgacctgaaattttagtacagcccctcaaagtcagcaataggaaatcttccggctttcgaaagtcattccgcctgagccgcaaggataaaaagactaacaagagcatgtatgaatgtaaaaagagtgatcagtacgacactgccgatgtgcccacatatgaagaagtgactccctacagaaggcagactaatgaaaagtaccggttagtggtccttgtcgggccagtgggggtgggacttaatgagctgaagcggaagctactgatctctgatacccagcattatggtgtgaccgtcccccatactacaagagcgagacgctcacaagagtccgatggtgtggaatacatttttatcagcaaacacctcttcgagacggacgtgcagaacaataagttcatcgagtacggcgaatataagaacaactattacggcacatctatcgattccgtgaggtcagttttggccaaaaacaaagtctgccttctggacgtacagccccatacagttaagcatctgaggactcttgaatttaagccctatgtgatctttatcaaacccccatctatcgaacgactgcgtgagactcgcaagaatgctaaaattatttcctcacgagacgaccagggcgctgcaaagcccttcaccgaagaggactttcaggagatgatcaagtctgctcagatcatggagtcgcagtatggccacctgttcgataagatcataattaacgacgacctgacagtggcctttaatgagttgaagactacttttgacaagctggagacggagacgcactgggtgccagtatcttggcttcatagctag

SEQ ID NO: 194780 - DNA, 870 bp, Artificial Sequence
  Description of Artificial Sequence: Synthetic coding sequence
atgctgggctggtgcgaggccatcgcccggaacccccaccggatcccaaataacactcgaacccccgaaatatctggggaccttgccgacgcaagccagacatcaaccttgaacgaaaaaagccccggtcggtctgcctcccggtcctcaaatattagcaaggccagttcacccaccacaggaaccgcccctcggagtcagagtcggctgtcagtgtgcccttccactcaggacatttgtcgtatttgtcattgtgagggggacgaggaatcgcccttgatcaccccttgcaggtgcacgggcaccttgagatttgtgcaccagtcgtgtctacaccagtggattaagtccagtgatacgcggtgttgcgaactttgtaagtatgactttatcatggagacgaagctcaagcccctccgaaaatgggaaaagcttcaaatgaccacaagtgagcgccggaagatcttttgctccgttacatttcacgtcatcgcaatcacttgcgtggtgtggtcactgtacgtactaatcgaccgcaccgctgaggaaatcaaacaaggaaacgataacggagttttggagtggcctttctggacaaagctcgtcgtggtggccataggattcacagggggtctggtcttcatgtacgtgcaatgcaaggtctatgtacagctgtggcggcgcctcaaagcctataatagagtcatattcgtgcaaaattgtcctgataccgccaaaaaactggagaagaattttagctgtaacgtgaacacagatataaaggacgctgtggtagtgccagtcccccagacaggcgctaactccctcccaagcgccgaggggggccctcccgaggtggtgtcagtttag

SEQ ID NO: 194781 - DNA, 819 bp, Artificial Sequence
  Description of Artificial Sequence: Synthetic coding sequence
atgaccagcagccacgtgtgctgcaacttcctgaacatgtggaagaaatccaaaatatcaacaatgtattaccttaatcaagatgccaaactgtctaacttgtttctgcaggccagcagcccaactaccgggaccgcaccaaggtcacagtcacggctgtctgtgtgtccatccactcaagatatctgcaggatctgccactgtgagggcgacgaagaaagtccccttatcactccctgcaggtgtacagggaccttacgctttgttcaccagtcttgcctgcatcaatggattaagagtagcgacactagatgctgtgagctgtgcaagtacgatttcattatggagactaagttaaagcctctccgcaagtgggagaagctacagatgacaacatctgaacgccggaaaatattctgttcagtcaccttccatgtgatcgccattacttgcgtcgtatggtcgctctatgtgctgatagatcgcaccgcagaagagattaaacagggtaacgataatggagttctggaatggcctttctggaccaagctggtagtcgtggctatcgggtttacgggggggctggtctttatgtatgtgcagtgcaaggtgtatgtgcagctgtggcgcagattaaaggcctacaatagagtgatatttgtgcagaattgtccagataccgctaagaaactcgagaagaacttctcttgcaacgtaaatacggacattaaagatgctgtggtggttcccgtgccacagacaggggccaattcattgccctcagccgagggaggccctccggaagtggtgtctgtctag

SEQ ID NO: 194782 - DNA, 870 bp, Artificial Sequence
  Description of Artificial Sequence: Synthetic coding sequence
atgctgggctggtgcgaggccatcgcccggaacccccaccggatcccaaacaacactagaacaccagaaatctccggcgatctagccgatgccagtcagacatctaccctgaatgagaaatctcccggcaggtccgcttcccgttcttcaaatatcagcaaagcatcatctcctacaacgggcaccgctcccaggagccagagcagattgtctgtttgtccctcgacccaggacatttgtcggatttgccactgtgaaggagatgaagagagccctttgattactccttgcagatgtacaggaactctgcggttcgtccatcagtcgtgtctgcatcagtggataaaatccagcgacacacggtgctgtgagctttgcaagtacgacttcattatggagacaaagctgaaaccactccgaaaatgggaaaaactgcagatgaccacttccgaacgaagaaagatattttgcagtgtcacatttcacgtgatagccattacgtgcgtggtttggtcactctatgtgctgatagacagaaccgctgaagagatcaagcagggcaacgacaatggcgtcctggagtggcccttctggactaaactggtagtcgtggccatcgggttcaccggcggcctggtgtttatgtatgtacagtgtaaagtgtatgtacaactctggcgccgactcaaagcctacaaccgcgtcatctttgtgcagaactgtcccgataccgctaaaaagctggaaaagaacttttcgtgcaacgttaatactgatattaaagacgccgtggtcgtgccggtgcctcagaccggcgccaactctctgccttcagctgagggcggaccccccgaagtcgtgagcgtttag

SEQ ID NO: 194783 - DNA, 426 bp, Artificial Sequence
  Description of Artificial Sequence: Synthetic coding sequence
atgctgggctggtgcgaggccatcgcccggaacccccaccggatcccaaacaatacaaggaccccagaaatcagtggggatctcgctgacgcgagtcagacatctactttgaacgagaaaagcccaggcagatcagcttctcgaagctctaatatatccaaggcgtcctcacccaccactggcaccgcccctcgttctcagtccagattatcggtgtgcccgagcactcaggatatttgccggatctgccattgcgagggagatgaagagagccctttgatcacaccatgcaggtgtaccgggaccctgcgctttgtgcaccaatcttgtctgcaccagtggattaagtcatccgacactcggtgctgcgaattgtgtaaatacgacttcattatggaaacaaagctaaaaccactgcgtaagtag

SEQ ID NO: 194784 - DNA, 2427 bp, Artificial Sequence
  Description of Artificial Sequence: Synthetic coding sequence
atgctgcacgacgcccgggaccggcagaagttcttcagcgacgtgcagtaccttcgggatatgcaacacaaggttgactctgagtaccaggcgtgcttgcgccggcaggaatacagacgcgaccctaacgagaagaaaagggaccaattttggggacaggagaccagttttgaaagatctcgattttcttccagatcctcctccaaacagagttccagtgaggaagatgcactgactgagccgcgctcatctattaaaatcagcgcattcaaatgtgacagcaagcttccagctattgatcaaacctctgtgaagcagaaacataaaagcactatgacagtcagaaaagctgagaaggtggatccctctgagccatctcccgcggaccaggcaccaatggtactactgaggaaaagaaagcccaatctgcggcgcttcaccgtctcccctgaaagtcactctccgagagcctccggcgaccgatcccgccagaagcagcagtggccagctaaagtgcctgtccctagaggggctgatcaggtagtacagcaggagggactgatgtgtaacacgaaattgaagagaccgaaccaagagcgtaggaacctggtcccgtccagccagcctatgaccgagaacgctccagacagggctaaaaagggggacccatcagctccctcacagagcgagctccaccctgcactgtcgcaggcttttcagggaaagaacagtccgcaggttctgtctgagttttctgggcctcccctgacacctactactgtgggcggaccacgtaaagcttcctttcgttttagagacgaagacttttacagcatcctttcccttaacagtcggagggagagcgatgacaccgaagaggagacacagtcagaagagtgtttatgggtgggagtccgctctccctgttcaccctcccaccacaagaggtcccgattcgggggaacaagtactccccaggcaaaaaacaaaaattttgaggaaaacgccgagaattgtcgcggccattctagtaggcgatcagagccatcacatgggtcactcagaattagtaatgctatggagcccgccacagagagacctagtgctggtcagcgactcagtcaagatccgggattgcctgaccgtgaaagcgccaccgaaaaggaccgcggcggttccgaaaatgccaagaagtcacccctttcttgggatactaaatcggagccgcgccaggaagtcggcgtgaatgccgagaacgtgtggtccgactgtatttctgtagagcaccggcccggcacccatgactctgagggatactggaaagattacttaaacagctcccagaatagcctcgactacttcattagtggccgccctatatctccacggagcagcgtcaactcttcatataacccacccgcatcatttatgcactccgccctaagggacgacattccagtggatctgtccatgagctctacaagcgttcacagttctgacagtgaaggcaattccggcttccatgtgtgtcaaccactttccccaatcagaaacaggactcctttcgcatcggccgagaatcacaactacttcccagtgaattccgcgcatgagttcgccgtgagagaggcagaggacactacgctgacctcacaaccacagggagccccactgtatacagacctgttgctgaacccgcagggcaatttgtctttggttgattcgagctcctcctcgcctagcagaatgaactcagaaggccacctacacgttagcgggagtctgcaagagaacacaccgtttactttcttcgcggtctcgcactttcccaaccagaacgacaatggaagcagaatggccgccagcggattcacagatgagaaggagacaagtaagatcaaagcagatccagagaagttgaagaagcttcaggaatcactcctagaggaagactctgaagaggaaggggacctgtgcagaatatgccaaattgctggaggatccccaagcaatccgctgttggagccttgtgggtgtgtcggctcactccaattcgtacatcaggagtgtctgaagaaatggctcaaggtgaaaatcacttcaggagcagatctgggagctgtaaagacctgtgagatgtgcaaacaggggctgttagtggatcttggtgatttcaatatgatcgagttttaccagaaacaccagcagagtcaggcacagaacgagcttatgaatagtggactttatcttgtcttgctcctgcatctgtacgagcagagattcgctgagctgatgcggcttaaccacaatcaagttgaaagagaacggttatcccgtaattaccctcagccccgcaccgaagagaatgagaactctgagctgggggacgggaatgaaggcagcatatctcagagccaggttgtctag

SEQ ID NO: 194785 - DNA, 2427 bp, Artificial Sequence
  Description of Artificial Sequence: Synthetic coding sequence
atgctgcacgacgcccgggaccggcagaagttcttcagcgacgtgcaatacctgcgcgatatgcagcacaaggtggattccgaatatcaggcctgcttgcgccgacaggaatatcgaagggaccctaatgagaagaaacgcgaccagttttggggacaggagaccagttttgagagatcacgattcagtagtcgcagctctagcaagcagtctagctccgaagaagacgccttaacagagccacgcagctccattaaaatttctgcgttcaagtgcgattccaaactgcccgcaattgaccagacctcagtgaaacagaaacacaaaagcaccatgactgtgaggaaggccgagaaagtggacccctccgagccttcgccggctgatcaggcccctatggttctcctgcgcaagaggaagccgaatctgagaaggttcacagtctcccctgagagtcacagccccagagcctcaggcgaccgaagccggcaaaaacagcaatggccagcaaaggtcccagttccgagaggcgctgaccaggtggtgcaacaggaggggttgatgtgtaatactaagctgaaacgccccaaccaggaacggagaaacctggtaccttccagtcaaccgatgaccgaaaatgcccctgaccgggccaaaaaaggtgacccaagtgcccccagccaaagcgagcttcacccagctctgtcccaagctttccaaggcaagaacagcccacaggtgctcagcgagttctccgggcctcccctgacaccaacaacggtcggtgggccacgaaaagcaagttttaggttccgggacgaagacttttacagtatcctgtccctcaattccagaagggagtccgatgacacagaagaggaaacacagtccgaagagtgtctgtgggtaggcgtaaggagtccatgttcgccatctcatcacaagagatcacggtttgggggaacttcgaccccccaggctaaaaataagaactttgaggagaacgcagagaactgccggggccatagctctagaaggagcgagccatcgcatggtagtctgcggatcagtaacgcgatggagccagccacggagagaccatcagccggacagcgcttaagtcaggatccaggtctcccagatcgtgaatctgccaccgaaaaggatcgaggaggaagtgaaaatgccaaaaagagccctctctcctgggatacgaaatccgaaccacgacaagaagttggagtgaatgctgaaaacgtgtggagtgactgtatctccgtggaacaccgcccagggacacatgactccgaaggttactggaaggactacctcaattctagccagaacagcctggactacttcataagcggacgtccgatcagcccccgatcatctgtgaacagctcttataatcccccagcctcattcatgcatagcgctcttcgtgatgacataccagtggacctgtcaatgtcttccacatccgtgcactcgtctgattccgaggggaactccggatttcacgtgtgtcaacctctaagccctatccgcaatcgcacaccattcgcctccgctgagaaccacaactattttccagtgaactccgcccacgagttcgcagtgagggaggcagaagatactacgctgacctcacagcctcagggtgccccactgtacaccgatctcttgctgaaccctcagggaaatctgtccctcgtggactcttcatcttcctctccatctagaatgaactctgagggacacctgcatgtgtccggttccctccaggaaaataccccgttcacgttctttgcagtgagccacttcccaaaccagaacgataacggcagccggatggcagcgtccgggtttaccgacgaaaaagaaacctcgaaaatcaaggctgacccagaaaaattaaagaaattacaggagtcactcctggaagaagattctgaagaagaaggtgatctctgccgaatctgccaaatcgcgggtggtagtcctagcaatcctttattggagccttgtggatgtgtggggtcgctgcagttcgtacatcaagagtgtctcaagaaatggctgaaggtaaagatcacaagcggcgcagatctcggagcggtcaagacctgtgaaatgtgcaagcaggggcttctggtggacttgggagacttcaacatgattgaattctatcagaaacaccagcaatctcaagcccagaacgagctaatgaatagtggattatacctggtattacttctccatctttacgaacaacgtttcgctgagctgatgagattgaaccacaatcaagtagagcgcgagcgattgtcaagaaattatccccaacccagaaccgaggagaatgagaatagtgaattgggagatggaaatgaggggtccatctctcaaagccaggtggtatag

SEQ ID NO: 194786 - DNA, 2400 bp, Artificial Sequence
  Description of Artificial Sequence: Synthetic coding sequence
atgctgcacgacgcccgggaccggcagaagttcttcagcgacgtgcagtacctgagggacatgcagcacaaggtggactctgaataccaagcttgtttgcgcaggcaggaatatcgtcgggatcctaacgagaagaaacgcgaccaattctggggtcaggaaacaagcttcgaacgaagccgattctcatctagaagtagttctaagcagtcttccagcgaggaggacgctctgacagagccccgatcctccatcaagatttcagcttttaaatgcgactccaagctccctgccattgatcagacctcagtgaaacagaagcacaagagcactatgaccgtgcgcaaggctgaaaaggtcgatccttctgagccatcgcccgaccaggctcccatggtcttgttgcgcaaacgtaagcctaacttgagacgattcaccgtttccccggagtctcattcaccccgcgcttcaggggaccggagtcgacagaagcagcagtggccggccaaggtgcctgtcccaagaggcgctgatcaggtcgtccagcaggaggggctgatgtgtaacaccaagctcaaacgacctaatcaggagaggaggaatctcgtgccatcttcacagccaatgactgagaacgcccccgacagggcgaagaaaggcgacccatccgccccttcacagagcgaacttcatcccgccctctctcaggcatttcaggggaagaactctcctcaggtgctgagcgaattttcgggcccccccctcactccaacaacagtcggcggccctaggaaagcgtcgttccgctttagagatgaggatttctactctatcctgtcgctcaacagcaggcgcgagtcggatgacactgaggaagagacgcagtctgaggagtgtctgtgggtgggagtacggagcccatgcagcccatcccaccacaaacgaagcagatttggcgggaccagtactccacaggcaaagaataaaaactttgaggaaaatgcagagaactgtcggggtcactccagtagacggtctgagccttcccacggctctctgcggattagtaatgccatggagcccgcaaccgaaagacccagcgctggtcagagattaagtcaggaccctggcctgccagacagagaatctgcgacagagaaggatcggggagggtcagagaatgctaagaagagcccgctgagctgggacacaaagtccgaaccaagacaggaggtgggcgtgaatgcggagaatgtatggagtgactgcattagtgtggagcacaggcctgggacccatgacagcgaagggtattggaaagattatctgaactcttcccagaattctctcgactactttataagcggtcggcccatttcgcctcgctccagcgtcaacagttcttacaatcccccagcctcttttatgcacagcgctctgagggatgatatacctgtggacctgtctatgtcctctacttcagttcacagcagtgatagcgaaggcaactcagggttccacgtgtgtcagcccttaagccctattcgcaatcggacccctttcgcgtcagcggaaaatcataactacttcccagtcaattccgcccatgaatttgccgtacgcgaggcagaagacacgacgctcacttcccaaccacagggggctcccctgtacacagatctgctgttgaatccacaaggaaatctcagtctcgtggactcctcctcctcctcgcctagccgcatgaatagcgaggggcatctccacgtatccggctcccttcaggagaacacgcccttcacattttttgccgtctctcacttcccaaatcagaacgataatggttcacggatggctgcttcaggatttaccgacgagaaggaaacaagtaagatcaaggcagatcctgaaaaactcaagaaactgcaggagtccttactagaggaggacagcgaggaagaaggagatctctgtcgcatctgtcagattgctggaggctcccctagtaacccattgctggaaccttgcggctgcgtgggatccttgcagttcgtacatcaagagtgtcttaaaaagtggctgaaagtcaagataacttcaggcgcagatctcggcgccgtgaaaacatgtgagatgtgtaagcaagggctcctggttgacctaggagatttcaatatgattgaattctatcagaagcaccaacagtcccaagcccagaacgaattgatgaatagcggactgtacctggtcctgctgctccatttatacgagcaacgtttcgcagagctgatgaggctaaaccacaatcaggtcgaaagagaacgtctgtcacgaaattacccccagcctaggacagaggagaatgagagtaggttttggggtccagtcctgcccttctag

SEQ ID NO: 194787 - DNA, 1209 bp, Artificial Sequence
  Description of Artificial Sequence: Synthetic coding sequence
atgagcttcgagggcggccacggcggcagccggtgccggggcgccgagtctggggacgctgaacctccgccgcagccccctcccccgcccccaccaactccaccacctggggaacctgctccggtgcctgcagcccctcgttatctgccgcctctcccagcttcccccgaaacgcctgaaagagccgcggggccatccgaacctctcggagaagtggcccctcggtgtcggggggctgatgagcttcccccacctcccttacccttgcagcccgcaggccaagaagtagctgcggcaggagatagtggcgagggaccaagaagacttcctgaagctgccgccgcaaagggcggacctggggagtcagaggctggcgccggtggcgagagagaaaggaggggggccggagatcagcctgaaactaggtcagtctgttctagcaggtcaagttcttcgggaggcggagatcagcgagctggacaccaacatcaacaccaccagcctatttgcaagatatgctttcagggcgctgaacagggcgaacttttaaatccctgtcggtgtgacgggtcagtgagatacactcaccagttatgcttgctcaaatggatttccgagcgcggcagctggacttgcgagctctgctgttaccgatatcacgtaatcgccattaagatgaagcagccctgtcagtggcaaagtatcagcatcaccctcgtggaaaaagtgcagatgatcgccgtgatcctcggtagcttattccttatcgcctccgttacatggctcctgtggtcagcattttcaccttacgctgtgtggcagcgtaaggatatcttgttccagatatgctatggaatgtacggcttcatggatctggtctgtatcgggttaattgtgcatgagggagctgctgtgtacagggtcttcaaacgctggcgggccgtcaacttgcattgggacgttctgaactatgacaaggccaccgatatcgaggaatcctcgcgcggagaatctagcacgtccaggacgctttggctgcccctgacagcactgagaaataggaatctggtgcaccccacccagctgacgtcacccaggttccagtgcggatacgtattactgcatctgtttaatagaatgcggccacacgaagatctcagcgaagataattcttcaggggaagttgtgatgcgcgtgacaagtgtgtag

SEQ ID NO: 194788 - DNA, 1818 bp, Artificial Sequence
  Description of Artificial Sequence: Synthetic coding sequence
atggccctgcggaagggcggcctggccctggccctgctgctgctgagctgggtggctcttgggccgaggagcctcgagggcgcggaccccggaactcccggcgaagccgagggccccgcatgccctgccgcttgcgtgtgctcgtatgatgacgacgctgatgaattgagcgtcttttgctcctcaagaaatctcacccggctccctgatggcgtgcctggcggcacacaggctctatggctggacggtaataacctcagctcagtccctcctgccgcgttccagaatctgagcagtcttggcttcctaaatctgcaggggggccagctcggatcgctggaaccccaagctctgctgggtctcgaaaacttatgccacctgcatctggagcggaaccagctgcgtagcttagcgttggggactttcgcgcacacccccgcccttgcatccctgggcctttccaacaacaggctttctagactggaggatggcctttttgaagggttgggatcactctgggacctgaacctggggtggaattcacttgctgttcttcctgacgccgcctttcgcgggctcggatcgttacgggagcttgttctggccggaaatcgactcgcttatctacagccagctctgttttctggcctggctgagctacgtgagctagatctgtcgcgtaatgccctccgagcaatcaaagctaatgtgttcgtgcagttgccgaggcttcagaagctgtacctcgaccgcaacctgatcgctgccgtggcaccgggcgccttcttggggctcaaggctcttcgctggttagatctgtcacataatcgcgtcgcgggtctgctggaggacactttccctggtctgttgggcttacgcgtgctgaggttgtcccataacgctatcgcatccctgaggcccagaacctttaaagatctccattttcttgaggaactccagttgggacataatcgcattagacagctggcagagaggtcatttgaaggcctcggtcaactcgaagtgttgaccttagaccataatcagctccaggaagtgaaggcaggggcttttctcgggcttacaaatgtggccgtgatgaacctctcaggcaactgtcttagaaatctccccgaacaggtgtttcggggccttggtaagctgcactccctgcacctggagggcagctgtctgggtcgtatcaggccgcacaccttcacaggtttatctggcttgcgacgtctgttcctcaaggacaatggcctggtaggaatcgaggagcagagcttgtggggtctcgccgaactgctcgaactggatctcacatcaaaccagctaactcacctgccccacaggttgtttcaaggccttggtaaacttgagtatctgttgctgtccaggaatagactggcagagttgccagcagacgcccttggtcccttgcaaagggcattctggctggacgtgagtcataacaggctggaggctttgccaaattctctgttagcccctcttgggcgcttgcgatacctgtcccttcgtaataactccttacggacgttcaccccccagccacccgggctggagaggctgtggttggaaggaaatccatgggactgtggatgccccctcaaggccttgagggactttgcccttcaaaatccatctgcagtgccccggttcgttcaggccatctgcgagggagatgactgccagccacctgcttacacctataacaatattacttgtgccagtcctcctgaagtggtgggactggatctcagggatctttccgaggctcacttcgcaccttgctag

SEQ ID NO: 194789 - DNA, 531 bp, Artificial Sequence
  Description of Artificial Sequence: Synthetic coding sequence
atgaccaccggcgactgctgccacctgcccggcagcctgtgcgactgctcaggctcacctgctttcagcaaggtcgtcgaagcgaccggactgggccctccacaatatgttgcacaggtaacttcgcgagacggtaggctcttgagcaccgtgatccgggccttggatacaccttccgatggccccttctgtcgtatttgccacgaaggggcaaacggggagtgcctgctgtcaccatgcggatgtaccggcactctgggcgccgtgcacaaatcatgcctggagaaatggcttagcagctctaatacaagctactgtgaactctgccacaccgagtttgctgtggaaaaacggcctcgaccactaactgaggtcagcttcagatatcactgtcagctatacagtgagtggcggaagactaatcagaaagtgcggctcaaaattagagaagctgactcaccagagggcccccagcacagtcctctcgcagctggtttactcaagaaggtggctgaggaaactcccgtatag

SEQ ID NO: 194790 - DNA, 741 bp, Artificial Sequence
  Description of Artificial Sequence: Synthetic coding sequence
atgaccaccggcgactgctgccacctgcccggcagcctgtgcgactgttctggaagccccgccttttctaaggttgtggaagcaaccggtcttgggcctccccagtacgtcgcgcaggtgacatcacgcgatggcaggttgctctccacagtaatcagagccttggacacacccagtgacggaccattctgccggatttgccacgagggcgcaaatggcgaatgcctgctctctccatgtgggtgcacgggcaccctaggagccgtgcataagtcttgcctggagaagtggctctccagttcaaacactagctactgtgaattatgccacacagagttcgcagttgagaaaaggccgcgaccactcacagaatggttgaaggatccaggaccacgtacggagaagagaaccctttgctgcgatatggtatgtttcttgttcataacccctctggctgccatctctggatggctgtgccttcgtggggctcaagaccatctgcgtctccacagccagctggaagccgtgggcctcatcgctctcacaattgcactttttaccatatacgtgctttggaccttggtatcctttagatatcactgtcagttatactccgagtggagaaagactaatcaaaaagtgaggctgaaaatcagggaggcagacagccctgaggggcctcaacatagtccattggccgccggcctgctgaagaaggtggctgaggagacccctgtgtag

SEQ ID NO: 194791 - DNA, 762 bp, Artificial Sequence
  Description of Artificial Sequence: Synthetic coding sequence
atgaccaccagccggtgcagccacctgcccgaggtgctgcccgactgcaccagtagtgccgcgcccgtggtgaagaccgtggaggattgtggcagcctggtcaacggtcagccccagtatgtgatgcaggtctctgcgaaggacgggcagttactatcaactgtggttaggacacttgccacccagagcccttttaatgacagacctatgtgccgtatatgccacgaaggtagctctcaggaagacctgcttagtccttgtgaatgcacagggactctgggcacaatccatcggtcctgcctggaacactggttgagctcttctaacacttcctactgtgaattgtgccacttccgatttgccgtcgagcgcaaaccacgacctctcgttgaatggctaaggaatcctggaccccaacacgagaagagaacactgttcggagatatggtgtgctttttgtttatcaccccgctggcgactatcagtgggtggctttgcctgcgaggcgctgtggatcatctccacttcagctcgaggctggaagccgtggggttaattgcactgactgttgctctgttcacaatttacctgttttggacactcgtctcgttcaggtatcattgtaggctgtacaatgagtggagacgcaccaatcagcgagtcattttgctgattccaaagtcagtaaatgttccatccaaccagcccagcctgttagggctgcactccgtcaaaaggaattcaaaggaaacggttgtgtag

SEQ ID NO: 194792 - DNA, 1233 bp, Artificial Sequence
  Description of Artificial Sequence: Synthetic coding sequence
atgctgatgcccctgtgcggcctgctgtggtggtggtggtgctgctgctctggctggtactgctacgggttatgcgctccagccccacagatgctcaggcaccaggggcttcttaagtgcaggtgtaggatgctgttcaacgatctcaaggtgttcctgctgcgtagacctccccaagcgccactgcctatgcatggcgaccctcagcctcctggcctcgcagccaacaatacactgcctgcccttggggccggtggttgggcgggctggaggggcccacgggaggttgtcgggcgggagcccccccctgtcccacctcctcctccactgccaccaagctccgtggaggatgactggggcggccccgccactgagcctcctgcttcactgctcagcagcgctagcagtgatgatttttgtaaagagaagactgaggacagatactccctggggtcgtcattggactccgggatgcggaccccactctgcaggatctgttttcagggccctgaacaaggggaactactctctccatgccggtgtgacggaagcgtcaagtgcacccatcagccttgtcttatcaagtggatttcagaaagaggttgttggagctgcgaactttgctattacaaatatcacgtcatcgctatatccacaaaaaaccctttgcaatggcaggctatatccctcactgtgattgagaaagttcaagtggcagccgccatactcggctccttatttttgattgcctccataagctggctcatctggtccacgttcagccccagcgctcggtggcagcgccaagatctactgttccagatttgctatgggatgtacggttttatggacgtggtctgtataggactgatcatacacgaaggaccctccgtgtatagaatttttaaaagatggcaggctgttaaccaacagtggaaggtactgaattatgacaagacaaaggacctggaggatcagaaagcaggtggacggacaaacccacgtacctcgtcatcgactcaagctaatatcccctcgtcagaggaggagaccgccgggacacctgctcctgagcaggggcccgcccaggcggctgggcacccttctgggcccctgtcccatcaccactgtgcatacacaatcttacacatactgagccacctgcgacctcacgagcagagatcacctcccggaagttcgagggaacttgttatgagagtgactaccgtttag

SEQ ID NO: 194793 - DNA, 837 bp, Artificial Sequence
  Description of Artificial Sequence: Synthetic coding sequence
atgcccgaccaggccctgcagcagatgctggaccggagctgctgggtgtgctttgccacagacgaagacgataggaccgccgagtgggtgcgaccatgccggtgtcgcgggtccacgaaatgggtccaccaagcttgtctgcagagatgggtggatgagaaacagagagggaacagtaccgccagggtagcttgtccccagtgcaatgcagaatatctgattgtcttccctaaactggggccggtggtgtatgtattagacctggccgatagactcataagtaaagcctgtccttttgctgcagccggcattatggttggaagtatatactggacagccgtgacctatggggcggttactgtgatgcaggtagtgggccataaggagggtcttgacgtcatggagagagcagacccgctcttcctcctgattggccttcccacaattcccgttatgctgatcctcggtaagatgattcggtgggaggactacgtcttaaggttatggcgtaagtacagtaacaaattgcagatcctgaactccattttccctggaatagggtgccccgtgccgcggatccctgcagaagccaatccacttgccgatcatgtctcagccacgaggatcttgtgtggggctctcgtattccccactatcgctactatcgtcggaaagctcatgttctccagtgtcaacagtaatctgcagaggaccatcctcgggggcatcgcctttgtggctattaaaggcgcctttaaggtttacttcaagcagcagcagtaccttcgacaggcacacagaaagattctgaactatcccgagcaggaggaggcttag

SEQ ID NO: 194794 - DNA, 2733 bp, Artificial Sequence
  Description of Artificial Sequence: Synthetic coding sequence
atggacaccgccgaggaggacatctgccgggtgtgccggagcgaggggacacctgagaagcccctataccacccatgtgtgtgtaccggcagcattaagtttatccaccaggaatgcttagtgcagtggctgaaacatagccgcaaggagtattgtgagctgtgcaagcaccggtttgcattcacacctatctactctcccgacatgcccagccgcctgcctatccaggacatatttgccgggttggtgaccagtatcggaactgctattaggtattggttccactacacgctggtcgccttcgcgtggcttggcgtggtgccgctgacagcatgtcgaatctataaatgcctgtttaccggtagcgtgtctagcctgctcaccctgcccctcgatatgttgagtactgaaaacttgctggcagactgcctccagggatgtttcgtggtgacctgcaccctctgtgccttcatctcactcgtgtggttgcgagagcagattgtccacgggggggcgcccatctggctggagcatgctgctcctccatttaatgccgccgggcatcatcaaaacgaagcccccgctggcggaaatggggcagaaaatgtggcagcagaccagccggccaatccacccgctgaaaacgcggtggtcggagaaaaccccgacgcacaggatgatcaagcagaagaggaagaggaagacaacgaggaggaagatgatgcaggtgttgaggacgcagcagacgcaaacaacggggcccaggatgatatgaattggaacgctttggagtgggatagagccgcagaagaattgacgtgggaacggatgcttgggttggacggctctctcgtgttcctggagcacgtgttctgggtggtttcactaaatacgttgttcatactagtgtttgccttctgcccttatcatatcggacatttcagcctggttggcctggggttcgaggagcacgtccaggcaagccactttgaaggcctgatcaccactatcgtcgggtatattctgctggcaataaccctgataatttgtcacggcctcgctacactggtgaaatttcaccgctcccggagactgctgggcgtgtgctacatagtggtcaaggtaagtttactcgtggtcgttgaaatcggcgtgtttccgcttatatgcggatggtggctcgacatctgtagtctggagatgttcgacgctacactgaaggatcgcgaactgtcatttcaatcagcacccggaacaacaatgttcctgcactggctcgtcggaatggtgtatgtcttctactttgcctctttcattctcctgctgagggaggtgcttcgacccggagtgttatggttcttgaggaatctcaatgaccccgacttcaatccagtgcaggagatgattcatcttccgatatatcggcatctgaggagatttatcctatccgtcattgtattcggatctatcgtcctgctgatgctctggctcccaatacggatcattaagtcggtgctgcccaacttcttaccttacaatgttatgctgtacagtgacgctcccgtgtctgagctctctctcgagttactgctgcttcaggttgtgcttcctgcactcctggagcagggacatactagacagtggctgaaggggcttgtaagggcctggaccgtaacagcgggttatctgctggacctacatagctacttattgggagaccaagaggaaaatgaaaactctgcaaaccagcaggtgaacaacaatcaacatgcccgcaacaacaacgcaatccccgtcgtcggcgagggacttcatgcagctcaccaggccattctgcaacaggggggaccggtgggattccagccttaccgtcggcctctgaatttccccctgagaatattcttattaatcgtgtttatgtgtatcactctgctgatcgcgtcacttatatgtcttaccctcccagtgttcgctggcagatggttgatgagcttttggacaggtacagccaagattcacgagctttatactgccgcatgtggactctatgtttgctggttgaccattagagcagtgacagtgatggtggcgtggatgccccaaggaaggagagtgatattccagaaagtgaaagaatggagtctcatgatcatgaaaactctcattgtggcagtgctgctggccggcgtggttcctctgttactggggctcctctttgaactagtcatcgtggccccattaagagtgccccttgatcagaccccgttgttttatccatggcaggattgggctttaggggtactccatgctaaaatcattgcggccattacacttatgggcccccaatggtggttaaagaccgtcatagagcaggtttacgcaaacggcataaggaatatcgaccttcattacattgtgaggaaactggcagcccctgtgatcagtgtgttgctgctcagcctgtgtgtgccatatgttatagccagcggagtggtaccactcctgggagtgactgcggaaatgcaaaatttggtgcatcggcgcatctacccattcctgttaatggtcgtggttctaatggcgatcttatccttccaggtgcgtcagttcaagcgcctttacgaacacatcaagaacgataaatacttagtgggccagagactagtcaactatgagaggaagagcgggaaacagggatcatctccaccaccaccacaaagctctcaggagtag

SEQ ID NO: 194795 - DNA, 2115 bp, Artificial Sequence
  Description of Artificial Sequence: Synthetic coding sequence
atggagagcaagcccagccggatcccccggcggatcagcgtgcagcccagttctagccttagtgccaggatgatgagtggttctcgcgggagctctctgaacgacacgtaccactctagagattcatcttttcggttagactcagagtaccagagcacaagtgccagtgccagcgcctccccatttcagagcgcctggtactctgagagcgagatcacacagggtgctaggtcacgatcacagaatcaacagagggatcacgatagcaagcgtcccaaattaagctgcaccaattgtacaactagcgcagggcgcaatgtgggcaatgggctcaacacactgagtgatagctcttggagacactcccaggtcccaagatcttcctcaatggtactggggagctttggtacagacctgatgagagaacgaagggatctggaaaggaggacggattcaagtattagcaatctgatggattattctcacaggtcaggggacttcaccactagttcttatgtgcaagatagagtgccatcttattcgcaaggggcacgccccaaggaaaacagtatgtcaaccctgcagttgaatacctcttcaaccaaccatcagttgccttcagaacatcagactatcctctcctctcgagactctagaaattcgctcaggagcaacttcagcagccgcgaatctgaatcaagtagaagcaacacacagcctggtttcagctactcgtccagcagagatgaggcccccatcatctcaaactcagaaagggtggttagctcccagaggccctttcaggagtccagcgacaatgaaggacggaggacaacaagacgtcttcttagtcgaattgcgagttccatgtcttccactttttttagccgccgttcctcgcaggacagtctgaacacaaggagcctaaacagtgaaaactcgtatgtgtctccacgtatcctaacagcttcccagagcaggtctaacgttccctccgcctctgaggtgccagacaacagggcctctgaggcaagccagggatttaggttcctgcgacgcagatggggactttcatccctctcccacaaccactcctctgaatctgacagtgaaaatttcaaccaggagagcgaggggcggaacactggaccgtggctgtcttcaagcctcaggaataggtgcacaccactgttctctcgcagacggcgcgaaggaagggacgagtccagtcggattccaactagcgacacctcgtcacgatctcatatcttccgtcgcgagagcaatgaggttgttcatttggaggcccaaaatgaccctttgggggccgctgccaatcgtccacaggcctccgccgccagctctagcgctaccactggaggctcaacgagcgatagcgctcaggggggccggaacactggcatatctggcattttaccgggttcactgtttaggttcgctgtgccacccgccttaggctcaaacctcactgacaatgtcatgatcaccgtagacatcattccctctggttggaactcagctgatgggaagagcgacaaaaccaagagcgccccgtcccgggaccccgaaaggctgcagaagataaaggaaagcctgctcctggaggattctgaggaggaagaaggcgacttatgtagaatttgccagatggccgcagcttctagctccaatctgctgattgaaccttgtaagtgcacgggaagtctacagtatgtgcaccaagactgcatgaaaaagtggctccaagctaagatcaactctggttcatctctcgaggcagtcacgacatgtgagttgtgtaaggagaagctggagctaaatctggaagacttcgacattcatgagcttcacagggcccacgcaaacgaacaggctgaatatgaatttatctcctcaggtctatacctagttgtacttctccacctctgcgagcagtcattctcagatatgatgggaaacactaatgagccaagcacccgagttaggttcattaatctcgccaggacactgcaagcgcatatggaagatctggagacgtcagaagacgattccgaggaagatggggaccacaaccggaccttcgatatcgcctag

SEQ ID NO: 194796 - DNA, 2115 bp, Artificial Sequence
  Description of Artificial Sequence: Synthetic coding sequence
atggagagcaagcccagccggatcccccggcggatcagcgtgcagccaagttccagcttaagcgcccgcatgatgtcagggtcacgggggagttccctcaacgacacttaccacagccgggatagctcgtttcggctggactccgaatatcagagcacatctgcctcagcatcggcttctcctttccagagtgcatggtacagcgagtccgaaattacacagggcgctagatctagatctcagaaccagcagagagatcacgactccaaacgacccaagttgagttgtactaactgcactacgtctgccggccggaatgtcggaaatggactgaataccctgtcagattcttcatggcgacactcacaagttcctagatcatcttcgatggtccttgggagctttggcactgatctcatgcgagagcggagagatctcgagcggcgaaccgatagctcaatcagtaatctgatggattattcccatagaagcggagattttaccaccagcagctatgtgcaggaccgagtgccctcatattctcaaggagcccggcctaaggaaaatagcatgtctacgctgcagctgaacacctcatctactaaccaccagcttccatcagagcaccaaacaattctgagctctcgcgattctagaaacagcctccgtagcaactttagctcccgggagagcgaatcatctaggagcaacactcagccaggatttagctacagtagcagtcgcgacgaagctccaattatcagtaattccgaaagagtcgtgagcagtcagcggccatttcaggagtcctccgacaacgagggaagacgtactacccgcaggctcctgtccaggattgcatcatctatgagttcaaccttttttagtcgccgaagtagccaggatagcttgaatacccggagcttgaactccgagaattcttatgtgtcaccacgcatactgactgcatcccagtccagatctaatgtgccatccgctagtgaggtgcccgacaacagagcgagtgaagccagccagggattcagatttttgagaagacgatgggggctttctagtctgtcacataatcacagtagcgagagtgactccgaaaacttcaaccaggaatcagaaggtcgaaacactggaccatggcttagcagctctctgcgcaacagatgtactccactgttttctagacggcgcagggagggtcgagacgagagcagcagaatacctactagcgatacttcgagccgtagccacatttttagacgcgaatctaatgaggtagtacatctggaggcccaaaatgaccccctgggtgccgccgcaaacaggccccaggcgagcgcagcttcttcatctgccactactggcgggtccacctctgatagtgctcaaggggggaggaacaccggaatctccggaatcctcccaggttcgctgtttagatttgctgtgcctccagctctgggctctaacctgacagataacgtgatgatcactgttgacattattcccagtgggtggaactccgcagatggcaaaagcgacaagacaaagagtgcaccctcccgggatcctgagaggctgcagaagatcaaggagtcactgctgctggaggattccgaggaggaggagggcgacttatgcaggatttgccagatggcagccgccagttcaagcaatctgctaattgagccatgtaagtgcacaggatcattacaatatgtccaccaagactgtatgaagaagtggcttcaggctaaaataaactctggtagctccctcgaagccgtaactacttgcgagttgtgcaaggaaaaactggaactgaatttggaggattttgacatacacgagctccaccgagcccacgccaacgagcaggcggaatacgaatttatatcgtcaggactgtatctggtcgttctgctccacctgtgcgagcagtctttttcagatatgatgggaaatacgaatgagccatcaactcgggtccggttcatcaatctggcacgcactcttcaggcgcatatggaggacctggaaacatctgaagatgactccgaagaggatggtgatcataacaggacgttcgacattgcttag

SEQ ID NO: 194797 - DNA, 306 bp, Artificial Sequence
  Description of Artificial Sequence: Synthetic coding sequence
atggagagcaagcccagccggatcccccggcggatcagcgtgcagccttcatcaagcctcagcgcccgtatgatgtccggatcccgaggttcatctttaaatgacacttatcactctcgagacagctctttcaggctggacagcgagtaccagtctacatccgcctctgccagcgcctcacctttccagtctgcctggtattctgaatccgagatcacccagggcgcacgaagccgatcacagaaccagcagagagatcacgatagcaagaggcccaagttgtcctgtaccaattgcaccacgtag

SEQ ID NO: 194798 - DNA, 1908 bp, Artificial Sequence
  Description of Artificial Sequence: Synthetic coding sequence
atggagagcaagcccagccggatcccccggcggatcagcgtgcagcccagttccagtctgtctgcccgtatgatgtccggatcacgaggttctagtctcaatgacacctaccacagcagagactcttcatttaggttggattccgaatatcagtctaccagcgcctccgcatcggcctcacctttccaaagtgcatggtactccgaatcagaaatcacccaaggcgcccgctctcgctcccagaaccagcagcgcgatcatgactccaaacggccgaagctgtcttgcaccaactgtaccacatcagctgggcggaatgtggggaacgggcttaatactctttccgatgtgcaggaccgtgtgccatcttactcacagggggcccggcctaaggaaaattctatgtccaccctgcagcttaatacttcctccactaaccatcaactgcccagcgagcaccagaccattctgtcctcgagagacagtcgcaattctctcagaagcaatttcagcagccgggagagcgagagctcacgtagcaatacacagcccggcttttcttactcgtccagcagagatgaagcacctattatcagcaattctgaacgcgtggtcagttcccagcggccctttcaagaatcatccgacaacgagggccgccgcacgaccaggcgactgctgtccaggatcgcaagctccatgtcaagcacattcttcagcaggcgcagctctcaggatagcttgaacactcggtctctgaatagcgaaaattcttacgtgtctccaaggattctgacggcctctcagtcaaggtccaacgtgccatccgcatcagaggtccccgataacagagccagtgaagcctcccagggctttagatttttgcgtcgcagatggggcctcagcagcctcagtcacaaccattcctcagaaagcgacagcgagaatttcaatcaggaatctgagggaagaaacacgggtccgtggttgagctcttctttacgaaatcgttgcactccactattcagccgaaggcgaagggagggacgggacgagtcttcaagaatcccgacgtccgatacaagctcaagatcacatattttcagacgcgagagcaacgaagtcgtgcacctcgaagcgcagaatgatccactgggcgccgccgcgaacagaccacaggcatcagctgcatcaagcagcgccaccacaggcggcagtacctccgactcagcccagggggggcgaaatactggtatttccggaatcctcccagggtctctgtttcgtttcgctgtgcctcctgcactgggcagtaatctgacagataatgttatgatcacagtcgacatcatcccttcaggttggaacagtgctgacgggaaaagcgacaaaacgaaatctgctcctagccgggaccccgagcgcctccagaaaatcaaggagtcactgctcctcgaagactccgaggaggaggaaggtgacctttgccggatatgccagatggcagccgcttcgagcagtaatcttctgatagagccgtgcaagtgtactggcagtctgcagtatgtgcaccaggattgtatgaaaaagtggttgcaggctaaaattaactccgggagctcactcgaggctgttaccacatgcgagctctgcaaggaaaaactggaattaaatctggaggattttgacatccacgaattacatcgtgcccatgccaacgagcaggcagagtatgaattcatcagtagcgggctgtacttggtggtgctgctgcacctgtgtgagcagagctttagcgatatgatgggtaacactaatgaaccctccacacgcgtgcgactgcagagaatgatccccaaaaaaaccgaaacgatcaccgggcaccttattttgccaaactttatatag

SEQ ID NO: 194799 - DNA, 876 bp, Artificial Sequence
  Description of Artificial Sequence: Synthetic coding sequence
atgagcatgcccctgcaccagatcagcgccatccccagccaggacgcaatatctgctcgggtctaccgctccaaaactaaggagaaggagagggaggagcagaatgaaaagactctgggccacttcatgagccacagtagcaacatcagcaaagctgggtccccgcccagtgcatccgccccagctcctgtgtcctcatttagtcggacaagcatcacaccctccagccaggatatttgcagaatctgccattgtgaaggggacgacgagagccctctgattaccccctgtcattgtacaggatcactccatttcgtccatcaggcttgtttacagcagtggatcaaaagctccgatacacggtgttgcgagctctgcaaatatgaattcattatggagaccaaactgaagccactgcgcaaatgggagaaacttcaaatgacatcctccgagaggagaaaaatcatgtgttccgttactttccatgttattgccattacttgcgtagtttggagtttgtacgtgctcattgataggactgccgaggagatcaaacaaggccaggcaacggggattttggaatggccattctggactaaactggtggtcgtggcaatcggcttcacagggggcctgctcttcatgtacgtacagtgcaaggtttatgtgcaattgtggaagcgcctgaaggcctacaacagggtaatctatgtgcagaattgcccggaaacctccaagaagaatatatttgaaaaatctcctttgactgaacccaattttgagaacaagcacggctatggcatttgtcactccgacacgaattctagctgctgtactgagccggaggacaccggcgcagagattatccatgtttag

SEQ ID NO: 194800 - DNA, 876 bp, Artificial Sequence
  Description of Artificial Sequence: Synthetic coding sequence
atgagcatgcccctgcaccagatcagcgccatccccagccaggacgcaatttctgccagagtctatcgtagcaaaactaaggaaaaggagagagaagagcaaaatgaaaaaacccttgggcacttcatgtctcattcctccaacatctccaaggcaggcagcccaccttcagcatcggcccctgccccggtgtcctcctttagtagaacttctatcacaccttcctctcaggatatctgccgaatctgccattgtgaaggagacgatgaaagtccacttattacaccgtgtcattgcacaggatccctgcatttcgtgcaccaggcttgcttgcaacagtggatcaaaagctctgacactagatgctgtgagctgtgtaaatacgagttcatcatggagaccaagcttaagcccctcagaaagtgggagaagctccagatgacatcatctgagagaagaaaaattatgtgtagcgtgacgtttcacgtcatagccattacttgtgtcgtctggagcttatacgtactgattgataggaccgcagaggagatcaagcagggtcaggcaaccggcatactggaatggcctttctggacaaaactggtggttgttgccattggctttactggaggcctgctcttcatgtatgtacaatgcaaagtgtacgtgcagttatggaaacgactgaaagcatataaccgcgtaatctacgtccaaaactgtcctgaaacctcgaagaagaacatttttgaaaaatctcctttaacagaacccaactttgaaaataagcacggatacgggatttgccacagcgataccaacagttcgtgctgtacagaacctgaagatacgggagccgaaataattcatgtgtag

SEQ ID NO: 194801 - DNA, 876 bp, Artificial Sequence
  Description of Artificial Sequence: Synthetic coding sequence
atgagcatgcccctgcaccagatcagcgccatccccagccaggacgctatatccgcacgcgtctaccgcagcaaaacaaaagagaaagaaagagaagagcaaaacgagaaaactttgggccatttcatgagtcacagtagtaatatcagcaaggctggttctccgcccagcgcatctgcgcctgccccagtctcctccttcagtcgaacctctatcactccttcctcacaggacatctgtaggatttgccactgtgagggcgatgatgaatccccactgattacaccctgtcactgcacagggtccttgcattttgtacatcaggcttgcctacaacaatggatcaagtcctccgatacacggtgttgtgagttatgcaagtatgagttcataatggaaactaagttaaagcccctgcggaaatgggagaaacttcagatgacttcttctgagcggcggaaaatcatgtgctccgtgaccttccacgtaatagcgattacgtgtgtagtatggtccctttacgtcctcatagacagaaccgcggaggagatcaaacagggccaggcaacaggaatcctcgaatggccattttggacgaaattggtggtcgtagccataggctttacaggcggcttgctgttcatgtacgttcaatgcaaggtgtatgtccaactttggaagcgtctgaaagcatacaatagagtgatctatgtacagaactgcccagagacaagtaagaagaatatctttgaaaagtctccgctaacagaacctaatttcgagaataaacacgggtacggcatttgccatagtgacacaaacagctcctgctgcaccgaacccgaagatactggagctgagattattcacgtctag

SEQ ID NO: 194802 - DNA, 1371 bp, Artificial Sequence
  Description of Artificial Sequence: Synthetic coding sequence
tgaatctgcaaggacaccctgcaggccagcaagcggaacagcttcgggtctgagtgggcacaggcactcaaaccagcgaaaaacaccaaagctaggcgtacattgaaatttagcaggtcactcaacgacgtaggggaaaaggcccaagataccagtgagtccttcgcctacgttgagcggacttgtagtgaggggaaactgatcctgccccaagatacatgtttgagaacgaaccgatttcaccataaagaaaagcggacattgaaccacaaacccctggggaattctaagcactcctgtgtgtcctgtctgtccgcgggccgtagtacagccagtgaggtagaagcaggaaagggcggaaggcccggactgctcctcgaggagaaagcagacggagaggctacctctagaagccggcagctgctgcagtatctgttttctctcagccacgggcttagcgcttcttctctgcatcgattccacgagctggaatcctgcgccgcccgtctgcataccgcaaagtccagctctggcctcgctgggtccatgggattctgtagcgatgagatgggcgatgacgacgtctttgaagactctacatcagccaagctgaaatctagagtgttgagagctcccttgtgttccaccgagaaagactctgatctagattgcccaagccctttctccgagaaactaccgcctatctcccccgtgtccacatcaggtgatgtctgtcgcatctgtcattgcgagggggacgatgagtcaccactcatcacaccttgccactgcaccggcagcctacactttgtccaccaggcctgccttcagcaatggatcaaatcctccgataccagatgctgcgaattgtgtaagtacgagttcataatggaaaccaagctgaagcctctgcggaagtgggagaaattacagatgacaagctcagaaagacgaaagataatgtgctcagttaccttccacgtgattgcaatcacctgtgtggtttggtcactttatgtcttgattgaccggaccgccgaagaaatcaaacagggccaggctacgggaattctagaatggccgttctggacaaagctagtggtggtggcaattggttttaccgggggtctgctgtttatgtacgtgcagtgtaaggtgtacgtccaactgtggaaacggctgaaggcctataaccgggtgatttacgttcagaattgtcccgaaacatctaaaaagaatatctttgagaagtcacccttgacagagccaaacttcgaaaacaagcatggatacggtatttgtcactctgacaccaattccagctgttgtaccgaacctgaggacactggggctgagattatccatgtctag

SEQ ID NO: 194803 - DNA, 270 bp, Artificial Sequence
  Description of Artificial Sequence: Synthetic coding sequence
atgagcatgcccctgcaccagatcagcgccatccccagccaggacgctatttccgcaagggtctaccgtagtaagacaaaggaaaaagaacgagaggaacagaatgaaaaaaccctgggccatttcatgagccactcaagtaacatctctaaagctggatctccaccatccgcttctgccccagcccccgtgtcatcattcagcaggacctcgattactccatctagtcaggatatttgcagaatatgtcactgtgagggtgatgactag

SEQ ID NO: 194804 - DNA, 1041 bp, Artificial Sequence
  Description of Artificial Sequence: Synthetic coding sequence
atgctgaagagccggctgcggatgttcctgaacgagctgaagctgctcgtactgacaggaggaggccggccacgagccgaaccgcaaccccgtggagggaggggcggcgggtgcggctgggctccttttgctggctgctccacaagggatggggatggggatgaggaagagtactacgggtccgagcctagagcccggggcctcgctggcgacaaggaacccagagcagggccgctgccccctccagctccgcctctgcctccacctggggcgctcgacgcgttaagtctcagcagttctctcgatagcggcctgagaactcctcagtgcagaatttgctttcagggtccagagcagggtgagcttctctccccctgtcgatgcgacggcagtgtgcggtgtacccatcagccatgtttgattcgctggatcagcgagcgcggctcttggtcctgcgagctgtgctacttcaagtatcaggtgttagcaatctccaccaagaatccactacagtggcaagccatctctctgacagtcattgaaaaggtgcaaattgcagcaatcgtgctggggtccttattcctggtcgcttcgatcagctggctgatctggtcctctctgtctccatccgctaagtggcaaagacaagatttgttgtttcagatatgctacgggatgtatggcttcatggatgtggtgtgcataggcctgattatccatgaaggatcatcggtgtaccgaatctttaagcggtggcaagcagtaaaccagcagtggaaagtgctgaactatgataagactaaagatattggaggggacgccggtggtggcaccgccggaaaaagcggccccagaaactctcgtaccggaccgacctccggagcaacttccagaccaccagcagctcaacggatgcgtaccctgttgccacaacggtgtgggtatacgattcttcacctgctgggtcagctccggcccccagatgctcgcagctctagtcattcagggcgggaggtggtgatgagagttaccactgtatag

SEQ ID NO: 194805 - DNA, 702 bp, Artificial Sequence
  Description of Artificial Sequence: Synthetic coding sequence
atggtgagcgacaagtgccacatcctggacctgatcaaggcccagcgccgccaaatgctcattctgcccgagggattccgagagggaagttggagcaccctgctgttcagagcaacacaccacctggcacttcatccctttctgggtctgttcggggccctgagccccactcagtggcaggcgatctcactgacagtcatcgaaaaagtgcagattgcagcgatcgtcttgggcagcctcttcctggtagcttccatctcgtggctcatctggtcatcactgtcaccaagcgcgaagtggcaaagacaggatctgctttttcagatctgctacggtatgtacggattcatggatgttgtttgcattggcttaatcattcacgaaggtagttccgtataccggatcttcaagcggtggcaagcagtaaaccaacagtggaaggtgttgaactatgataaaactaaagatattggaggagatgccgggggcggaacagctggaaagagcggcccacgcaattcccgtacaggtccgacatctggagctacctcccgccctcccgcagctcaacgtatgcggactctgctgccccagcggtgcgggtacaccatcctacacctcttggggcaacttagacctcccgacgctcgatccagttctcatagcggccgggaggtggttatgagagtgacgacagtatag

SEQ ID NO: 194806 - DNA, 3159 bp, Artificial Sequence
  Description of Artificial Sequence: Synthetic coding sequence
atgaagctggtgaacatctggctgctgctgctggtggtgctgctgtgcgggaagaagcacctgggcgatcgattagaaaagaagagttttgagaaggcgccctgtcccggatgttctcatcttactctgaaggtcgaattttcgtcaactgtagtggaatacgaatatatagttgccttcaacggttactttaccgcgaaagcccgcaacagctttatctctagcgcgctgaagtcctccgaagtggacaattggcggatcatccctcgaaataacccctcttctgattacccttcagactttgaagtaatacagatcaaagagaagcaaaaagctggcctgttaacattggaagaccacccaaacataaagagggttacccctcaaaggaaagttttcagatccctgaagtacgccgagtctgatcccactgtaccgtgcaatgaaacccggtggtcccagaaatggcagtctagccgtcccctccggagagcctcgttgagtctgggatctgggttctggcacgccacagggagacactcatccaggcgacttcttcgggcaatccctagacaggtggctcagacactgcaggcggacgtgttatggcagatggggtacactggcgctaatgttcgggtggctgtcttcgatacgggcttatccgaaaaacatccccacttcaaaaacgttaaggaaagaaccaattggaccaacgaaagaacgctggacgatgggctgggacacgggacgtttgtggctggggtgatagccagcatgcgggaatgccagggattcgcacctgacgcagagctccatatctttcgggtctttacaaacaatcaggtgagctacacctcatggtttctcgacgcttttaactacgcaatattaaagaagatcgatgtgcttaatctgtcaatcggcggccccgattttatggaccatccctttgtagataaggtctgggaactcactgcgaacaacgtgattatggtgtcggcaattggcaacgatggtcccctgtacgggacgctcaataacccagccgatcagatggatgtgattggggtgggcggtatagacttcgaagacaacattgcccgcttttcttctcgcggaatgaccacctgggagttacctggcggatatggccgaatgaagcctgatatcgttacctatggtgcgggcgtacgcggatcaggagtcaaggggggttgccgcgcgctgtcgggcaccagtgttgcatcccccgttgtggctggtgccgttacattgttggtctctacagtgcagaagcgtgagctggtgaaccccgccagcatgaagcaggccctgattgcgtctgctcgacggctccctggcgttaacatgtttgaacagggacatgggaagctcgacctgctgcgggcctaccagatcttaaactcttataaaccccaggccagtctgtcccccagctacatcgaccttaccgagtgtccatatatgtggccttattgcagtcagccgatctactatggtggcatgcctactgtggtaaatgtgactattcttaatgggatgggcgttactggcaggatcgtggacaagcccgattggcagccttaccttccccagaatggtgataatattgaggtcgcattctcatattcgtcagttttgtggccctggagcggctatttggcgatttccattagtgtaacgaagaaggctgctagctgggagggcatcgcccagggacacgtgatgatcacggtggcttcaccagcggagactgagtccaaaaacggcgccgagcagactagtaccgtgaaactccccatcaaggtgaagatcatacccacacctccacggtcaaagagggtgctgtgggaccagtaccataacctcagatacccgccagggtatttccctcgcgataatctgaggatgaagaatgatccgctggattggaatggagatcatatacacacaaactttagggacatgtatcagcacctccgctccatgggctatttcgtagaagttctcggcgcccccttcacctgctttgatgccagtcaatacggaaccctgctgatggtggattctgaagaagagtactttcccgaagaaatcgctaaacttcgcagagacgtggataatggactcagcctcgtaatattttctgattggtacaatacatccgtaatgagaaaggtgaagttctatgatgagaacactcgccaatggtggatgcctgacaccgggggagccaatataccagcccttaatgagcttctatctgtttggaatatgggatttagcgatggattgtacgaaggagaattcaccctggccaatcatgatatgtattacgccagcggctgctcaatagccaaattccccgaggatggtgtagtgatcactcaaacctttaaggaccagggcctggaggtgctgaagcaagagaccgccgtggtcgagaacgtgccaatcctgggtctgtatcagatccccgccgaaggagggggccgaattgttctctatggggattcaaattgcctggacgactcccacagacagaaggattgtttttggctccttgacgcactgctgcagtacacttcttacggtgtgactcccccctcactttcccactcagggaatcgccagcgacctccaagcggggcaggctcagtaaccccagaaagaatggagggcaaccatctacatagatacagtaaggttctcgaggcccatttaggagaccccaaaccgagacctctgccagcgtgcccgagactctcatgggctaagccccagcccttgaacgagaccgctcccagtaacctttggaagcaccaaaaactactgtccattgatctggacaaagtggttcttccaaatttccgaagtaaccggccccaggtgcgtccactatcccctggtgaaagtggtgcctgggatattcctggtggcatcatgcccggccgttataaccaggaagtcggccagactatcccagtgtttgcttttttgggggccatggttgtgctggccttcttcgtggtgcaaattaataaggcgaaatcacggccaaaacggcgaaagccaagagtaaagaggcctcaactgatgcagcaggtccacccaccgaaaaccccgtcagtgtag

SEQ ID NO: 194807 - DNA, 1494 bp, Artificial Sequence
  Description of Artificial Sequence: Synthetic coding sequence
atggccctggtgggcctgcccggccacctgcacttctgcgaccaggaatccggctttcttggaagacactgctccggaccctgccacgatcactgcgggttcccctctcgggaccgggtgaagaagtggtgtcggacagatttcaacagcaagctgcctattaaggtcaagatcattcccacgcccccccgaagcaaacgtgtgttgtgggaccaatatcataatcttcggtacccccccggatactttcccagagataacctgcgtatgaagaatgacccactagactggaacggggaccatatccacacaaacttcagagatatgtatcagcaccttcgttccatgggatattttgtagaagtgctcggcgccccttttacttgcttcgatgcatcccaatacggcaccttgcttatggttgactccgaggaagagtacttccctgaggaaatagctaaacttaggcgtgatgttgataacgggctctctctggtgatcttctctgactggtacaacacttcagtcatgaggaaggtgaagttttatgacgagaacactaggcaatggtggatgcccgacacgggtggcgcgaacatccccgctctgaacgagttgctctcggtatggaacatgggatttagtgacggtctttacgagggtgagttcaccctggctaaccatgacatgtattacgcatccgggtgttccatcgctaaatttcctgaggacggcgtagtgatcactcaaacatttaaagatcagggccttgaggttctgaaacaggagacagctgtggtggagaatgtgcccattcttggactgtatcagatccctgccgagggaggcggtagaatcgttttgtatggggactctaactgcttggatgattcgcacaggcagaaggactgcttttggctcctcgacgctctgctgcaatataccagctacggagtcacgccacccagcctttctcattctggaaaccgtcagcggccccctagtggggccggaagcgtgaccccggagaggatggaagggaaccacctgcaccgatacagcaaagtacttgaggcacacctgggtgatcctaagcccaggcctcttcctgcttgcccccggttgtcttgggccaaaccacagcccctcaatgagacagctccaagtaacctgtggaaacaccagaaacttctgtctattgacttggataaagtggtcctcccaaatttcaggagcaaccgcccccaggtacggccactctctcctggcgagtctggggcctgggatattccaggcgggattatgccagggaggtataatcaggaagtgggccagactatcccagtttttgccttcctgggagccatggttgtcctcgcatttttcgtggtccagatcaacaaagcaaagagccgtcccaagcgcagaaaaccaagagtcaagagaccacagcttatgcagcaggtccacccccctaaaaccccatcagtttag

SEQ ID NO: 194808 - DNA, 993 bp, Artificial Sequence
  Description of Artificial Sequence: Synthetic coding sequence
atgatccccgtgagcctggtggtggtggtggtgggcggctggaccgtcgtgtatctaacagacctcgtgctgaaatcttccgtgtatttcaagcactcttacgaagactggttggaaaacaatggcttgtcaatcagcccatttcacattcggtggcagacagccgtcttcaacagagctttctatagctgggggcgccggaaagccaggatgctgtaccagtggttcaactttggcatggttttcggggtaatcgccatgttctccagttttttcctgttaggcaaaacgctgatgcaaaccctggcccagatgatggcagacagtccctcttcctactcttcatccagtagcagctcctctagcagttcatcctccagttccagcagctcaagctccagttcctcccttcataatgagcaggtgctgcaggtcgtcgtgcccggtattaatctacctgtaaaccagttgacctatttttttacagcagttctgatctctggggtcgttcacgaaataggccacgggatcgcagccatcagggagcaagtaaggtttaacggattcggtatcttcttgttcataatttacccgggggcctttgtggatttgttcacaactcatcttcaattaattagtcccgtgcaacagttgcggattttttgtgctggaatatggcacaatttcgtgttagccctgctcgggattctggctcttgtgctcctgccagtaatcctgctaccattctattatacaggggtgggggtcctgatcacagaggttgcagaggatagcccagccatcggcccacgcggtctgtttgtgggtgacctggtcacccacctccaggattgccctgtcacaaatgtgcaagattggaacgagtgtctggacaccatcgcctacgaaccccagatcggctactgtatcagtgcgtctacattgcagcagttgagcttccctgtgcggggggtatatatttcctctatctag

SEQ ID NO: 194809 - DNA, 1560 bp, Artificial Sequence
  Description of Artificial Sequence: Synthetic coding sequence
atgatccccgtgagcctggtggtggtggtggtgggcggctggaccgtggtgtacctcactgatctggtcctcaagagtagcgtctatttcaaacattcatacgaggactggctcgaaaataacgggctgtctattagcccctttcatatccggtggcagacagctgtgtttaatcgtgcgttctattcgtggggcagaaggaaagctcgcatgttgtatcagtggttcaacttcggtatggtctttggagtaatcgctatgttctccagcttctttctgctgggtaagaccctcatgcagaccctggctcagatgatggctgacagcccatcaagctatagcagtagttcctcgtctagcagctccagcagcagctctagctcttcctcttcttccagctccagctctcttcataacgagcaagttctgcaggtggtggtaccaggaatcaacttacctgtgaaccagttaacatattttttcactgcagtgctcatcagcggtgtggtacatgagattgggcatggaattgccgctattagagaacaagtgcggttcaatggttttggcatctttctcttcatcatctaccctggagcctttgtggatctcttcactacccacctgcagcttattagccccgtacagcagctcaggattttctgtgcggggatctggcacaatttcgtgctagctttgctgggcatacttgctctcgtgctgctgccagtgatactgctgcctttctactacaccggcgtaggtgtgctaatcacagaagttgcggaagactctcccgcaataggcccccgcgggttgttcgtaggagacctagtaacccatctccaggattgtcctgtcaccaatgtgcaggactggaatgaatgcctcgacactatagcctatgagccacagatcggatattgcataagtgctagtacactgcaacagttgagctttcctgtccgcgcctacaagcggctagacggtagtactgagtgctgcaataaccactctttaacggacgtgtgcttctcctatagaaataattttaacaagaggctgcatacgtgtctgcctgcccgcaaggctgtagaagccacacaagtgtgtagaaccaacaaagattgcaaaaaaagttcgtctagctctttttgcatcatcccgtccttggaaacccacactaggctgataaaggttaaacatcctccacaaatcgacatgttgtacgtggggcaccccctgcatctgcactacacagtctcaatcacatccttcataccccgctttaacttcctgagtattgacctacccgtggtggttgagacctttgtgaaatatctcatctctctctctggcgccctggcaatcgtgaacgctgtcccgtgtttcgctttggatgggcaatggatactgaattcattcctcgatgccaccttgactagtgtcatcggagataacgacgtgaaggatctgattggattttttatcctcctgggcggtagcgtactgctcgctgctaatgttaccctgggcctctggatggtgacagctcggtag

SEQ ID NO: 194810 - DNA, 207 bp, Artificial Sequence
  Description of Artificial Sequence: Synthetic coding sequence
atgcaccagacctacagccggcactgccggcccgaggagcggtggtcgcaggaggggtggaatatccctgctaacgggttcaacatttgtcgatgtttgaacattgggatgaaactgcgactctggaataatctgaacaaaagcaacatcctgggggccctgaaaatcaagagacgggaaatcagggccccgttcctgttgccgtag

SEQ ID NO: 194811 - DNA, 762 bp, Artificial Sequence
  Description of Artificial Sequence: Synthetic coding sequence
atggtgctgctgaagctgctggaggtgtaccggaagggcagcgccggcactttccataaatccacgattttcggcaacactattatgacttctcagcccgtgccaaatgagaccattatagtgcttccctccaatgtgatcaacttctcgcaggctgagaagcccgagcccacgaaccagggacaggactcccttaagaaacacctgcacgccgaaattaaggttataggcacaattcagattctttgtggcatgatggtgcttagcctcggcatcatcctggcctccgcgtctttttccccgaatttcacgcaagtgacttctacactcttgaattctgcctaccctttcattggtccgttttttttcattatcagtgggagccttagcattgcgactgaaaagcggctaacaaagttgctcgttcacagttcgttggtgggttccatcctctctgccctgagcgccctggttggattcatcatcctgtctgttaaacaggctacactgaaccccgcatctctgcagtgtgagcttgataaaaataacatacccacaaggagttacgtgtcctatttctaccatgattcgctatacacaactgattgctatactgcaaaagcaagtctggcaggcaccctgtcgctgatgttgatttgcacccttttagagttttgcctggctgtgctcaccgctgtgttgcgttggaagcaggcctattctgattttcctggagtgtccgtcctggccggttttacgtag

SEQ ID NO: 194812 - DNA, 804 bp, Artificial Sequence
  Description of Artificial Sequence: Synthetic coding sequence
atgaaggccgaggccaccgtgatccccagccggtgcgcccggggcttgcccagctggcaggtgctctcccctgtacagccatggcaaacaagcgctccacagaatactactcaaccaaagctattagctccccaccaacatgaaaagtctcagaagaagtctagtctgctgaaggaactgggggctttccatatcaccattgcgctgttgcacctggttttcggaggctatttggcaagcatcgtgaagaacctccatttggtagttctgaaatcttggtaccctttctggggggctgcctcgtttctaataagcgggatcctggcaatcacaatgaagactttctcgaagacctatctgaagatgctgtgtctcatgaccaacctgatcagcttattctgcgtgctgagtggactgttcgttataagtaaagatctgttcctggagtccccattcgagtctccgatctggcgcatgtaccctaactctaccgtgcacatccagcgattggaactggccctcctgtgctttacagttctggagttgttcctgcctgtccctaccgccgtgactgcgtggagaggcgactgcccatcagcgaagaacgatgacgcgtgcctggtgcctaacacccccctgcaccttaaaggcctcccagtcgaaccaccccccagctaccagagcgtgatacagggagacgcccagcacaaacagcaccagcgactacgggaggtgaagcaggtggcccctgacacttggattgtgaccgatggtgcagcaatttggactcagacagccaattag

SEQ ID NO: 194813 - DNA, 804 bp, Artificial Sequence
  Description of Artificial Sequence: Synthetic coding sequence
atgatgagcagcaagcccaccagccacgccgaggtgaacgagaccattccaaatccctatccccccagttccttcatggcgcccggctttcagcaaccactcggcagcatcaatctcgagaaccaggcgcagggggctcagcgcgctcagccctatggaattacatcacctggcatctttgcctcaagtcaacccggacagggtaatattcagatgattaacccttcggttggtaccgctgttatgaattttaaggaagaagctaaggccctgggcgtgatccaaatcatggtcggactcatgcatatcgggtttgggattgtcctatgcctgatatctttctcatttcgggaggtccttgggtttgcatccactgcagtgattggtggctaccctttttgggggggcctctcatttatcatttctgggagcctgtccgttagtgctagcaaggaactttccaggtgcctggtcaaaggaagccttggcatgaacattgtgagttccatcctcgcctttataggtgtgatcctcctcctggtcgacatgtgtattaacggggttgccggtcaggattactgggccgtattatccggaaagggaatatctgccacactgatgattttctcgttgctcgaattcttcgtcgcatgtgcaacggcacactttgctaaccaggcaaacaccacgaccaatatgagcgtcctggtgataccgaacatgtacgagtctaatccagttactcccgcctcctcatcagcccctccacgatgcaataattacagcgccaatgcgcctaagtag

SEQ ID NO: 194814 - DNA, 345 bp, Artificial Sequence
  Description of Artificial Sequence: Synthetic coding sequence
atgatgagcagcaagcccaccagccacgccgaggtgaacgagaccatacctaacccatacccccccagctcattcatggctcctgggtttcagcagcctttgggatctatcaacctcgaaaaccaagcccaaggtgcccagagagctcagccttacgggatcacttctcccggtatttttgcttcgtcccaacctggccaaggtaacatccaaatgatcaacccgtcagtaggcacagccgtcatgaacttcaaggaagaggcaaaggctctgggtgttattcagatcatggttggactgatgcatatagggtttgggatcgtgttatgcttgatcagcttttag

SEQ ID NO: 194815 - DNA, 666 bp, Artificial Sequence
  Description of Artificial Sequence: Synthetic coding sequence
atgatgagcagcaagcccaccagccacgccgaggtgaacgagaccatacccaatccctaccccccatcaagcttcatggcccccggctttcagcagccccttggctcaataaatttggagaatcaggcccagggcgcgcagcgcgctcaaccttatggcatcaccagtcctggcatcttcgccagctcacagcctggccagggaaacatccaaatgatcaaccctagcgtgggaactgctgttatgaatttcaaggaagaggctaaagctctcgggttcataattagcggctcccttagcgtctctgcttcaaaagagttgtcccggtgccttgtcaaaggctccctgggcatgaacatagtgagctccattctggcctttattggcgtaatcctcttacttgtggacatgtgtataaacggagtggccggtcaagattattgggctgtactctccggaaaggggatttccgccaccctcatgatcttttccctcctcgagttcttcgtggcttgtgctactgcacatttcgcaaaccaagccaatactactacaaacatgtctgttttggtcatccccaatatgtatgagtcaaatcctgttacccccgcgagttcatccgcaccgccgcgatgcaacaactactctgccaatgcgcctaagtag

SEQ ID NO: 194816 - DNA, 972 bp, Artificial Sequence
  Description of Artificial Sequence: Synthetic coding sequence
atgaccgagcaggtgatcggcgccaacagcgtgcccggcatcatcgccccggacaacgtgcacgttattcagccttcaaatccagttgcatcaggaaatcatctgcagcccagcgaggtgacaacttacccaatctcacccaaagtgatccattgcgatactgggagagccaatctccagaatctcctggtggtaaaccagaactccgccgccggcgtgcagtcccagcccattggctatcagcggcaataccctgtcggcaccgcttcgctccagaccgtgcctggcgtcatccagtatacacaaggtacaacaaacctccaaacctggcctggggacctgcaaaatcccttaaatgccaaccccggcctgacacatacttctaattcaagtcaatggaataccagttttgctagcttcacaagctttaatcctaaaaaattcatcaatgaggaagttcgtacactgggcgccatccaaattcttataggactcactcacatcttctccgcaatcaatcccgttttgtattattaccccttcgtcacttggctcagcggatatcctttatgggggggcctgtcctatatcgtgtctggctccctgagcgtatgggctgctaaggacccttccccatgtgtcgtgaattcgtctattagttttaacattatcagcgcgctgttcgcgtttgcaggaatattcataattattaccgatctgtccctgtattacgtgactacctattcaaaagctgtgagcggaggcctgctcccgtttgcgctgctggaatttattttgacttgcgtggtttcccacttcggctgccaggccacgtgctgccgccaattcgagaacgttgctgtgatccccaccgttttctcttttaatccagcaaatacaaccacttctcctgtaaacgcaaccacgggtcccgtgaatgcggccacgggcccagtctccgccacaaattag

SEQ ID NO: 194817 - DNA, 735 bp, Artificial Sequence
  Description of Artificial Sequence: Synthetic coding sequence
atggacaccgagagcaaccggcgggccaacctggccctgccccaggagccgtccagtgtccctgcctttgaggttctcgaaatcagcccacaagaagtgagtagcggaaggctcttgaagagtgcttcttcacctcctttacacacctggctgacagtgctaaagaaggagcaggagttcttaggggttacacaaatactaaccgccatgatttgtttgtgtttcggaacggtagtgtgctcagtgttagatatcagtcacatcgagggagacatcttcagcagttttaaggccggctacccgttttggggagctatcttcttctctatctctggaatgttaagtattatctcagagagaagaaacgctacatatctggtccgtggctctttgggggccaacaccgcatccagtattgctggaggaacgggcatcactatacttattattaaccttaagaaatccttagcatacattcatatacactcctgtcagaaatttttcgagacaaagtgctttatggcatcttttagcacggagatcgtggtgatgatgttgttccttaccattttagggctgggaagtgctgtctcactcactatctgcggtgccggagaagaactgaaggggaacaaggtgcccgaagacagggtgtacgaggagctcaacatatacagcgccacctacagcgagctggaggaccccggagagatgtcaccccccattgacctgtag

SEQ ID NO: 194818 - DNA, 126 bp, Artificial Sequence
  Description of Artificial Sequence: Synthetic coding sequence
atggacaccgagagcaaccggcgggccaacctggccctgccccaggagccatctagtgttccggccttcgaggttctcgaaattagtccccaggaggtgagctccgggagattgctaaagagctag

SEQ ID NO: 194819 - DNA, 645 bp, Artificial Sequence
  Description of Artificial Sequence: Synthetic coding sequence
atggccagccacgaggtggacaacgccgagctgggcagcgccagcgcacacggaacccccggaagtgaagcgggccccgaggaactgaatactagcgtgtatcagccaattgatggcagtcccgactaccagaaggccaaattgcaggtactaggggcaatccaaattctaaacgccgctatgattctggccctaggcgtcttcctcggttccctgcagtacccataccactttcagaaacacttctttttttttacgttttacactgggtaccccatctggggcgcagtgtttttctgttcctctggaaccttatccgtggtagctggaattaagccaacccgcacatggattcagaacagtttcgggatgaatatcgcttccgcaactatagccctggtggggacagctttcctgagcctgaatatcgcagtgaacatccaatccctgagatcctgtcattcctccagcgaaagccccgatctgtgcaattatatgggcagtatctcaaacggcatggtgtcgctgttactgattctcaccctgctggaactctgcgtcaccattagtaccattgctatgtggtgcaacgcaaactgttgcaactctcgtgaggaaatttcatccccacctaatagtgtctag

SEQ ID NO: 194820 - DNA, 507 bp, Artificial Sequence
  Description of Artificial Sequence: Synthetic coding sequence
atggccagccacgaggtggacaacgccgagctgggcagcgccagcgcccatggcaccccgggcagtgaagccggcccagaagagcttaatacatcagtgtaccagcctatcgatggtagtccagactatcagaaagcaaaactacaggttctgggcttctgttcaagcggcactctctccgttgtagccggaattaagccaacccggacctggatccaaaatagtttcggcatgaacatcgccagtgccacaatcgcactggtgggtaccgcatttctcagcctgaacatagcagtcaatatacagtctctgcgttcttgccacagtagctccgaaagccctgacctgtgcaattatatgggcagtatttctaatgggatggtgagcctgctgcttatcctgacgctcttggagctgtgcgtaaccatctcgaccattgccatgtggtgtaacgctaattgctgcaattcccgggaggagattagctcaccaccgaactcagtctag

SEQ ID NO: 194821 - DNA, 276 bp, Artificial Sequence
  Description of Artificial Sequence: Synthetic coding sequence
atgaacatcgccagcgccaccatcgccctggtgggcaccgccttcttgtcactaaacatcgccgtgaatatacaatcccttcggtcctgccattcaagctcggaatctcctgatctgtgcaactacatgggctcaatctctaacggcatggtcagcctgttattgattctgactctgctcgaactctgtgtgacgatatcaacgattgctatgtggtgtaacgctaattgctgcaatagtagggaagaaatttcctcacccccgaactctgtgtag

SEQ ID NO: 194822 - DNA, 507 bp, Artificial Sequence
  Description of Artificial Sequence: Synthetic coding sequence
atggccagccacgaggtggacaacgccgagctgggcagcgccagcgcccatgggacccccggttccgaggctgggcctgaggagcttaatactagcgtctatcagcccattgacggatcgcctgactaccagaaggccaagttacaggtgcttggcttctgctcctctgggactctgtccgtggttgcaggcattaagcccacccgaacatggattcagaattcctttggaatgaatattgcgtcagctactatcgccctagtgggaaccgccttcctctctctgaatatagcagtgaatatccaatccctgcgatcctgccacagttctagcgagagcccagatctctgtaactacatggggagcattagtaacgggatggtctctcttctcttaatcctaacactgctagaactttgtgttaccattagtacgattgcaatgtggtgtaatgctaattgctgcaattctcgagaggaaataagtagcccacctaattctgtctag

SEQ ID NO: 194823 - DNA, 720 bp, Artificial Sequence
  Description of Artificial Sequence: Synthetic coding sequence
atgcaccagacctacagccggcactgccggcccgaggagagcaccttttcagccgcaatgacaaccatgcaaggcatggagcaggccatgcctggggccggccccggcgtgcctcaactgggaaatatggctgtcattcactcgcatttgtggaagggcttgcaggagaagtttcttaagggtgagccaaaggtgttgggcgtggtgcagatactgacggcactgatgagtctatcaatgggcatcaccatgatgtgtatggcctccaacacatacggatccaatccaatttcagtctacatcgggtacaccatctggggctccgttatgttcatcattagcgggtccctgtctatcgccgccggcataaggaccacgaaagggctggtgaggggctctttggggatgaatattacctcaagcgtcctagctgcctccggcattctcattaacaccttctctctggccttttatagctttcaccatccttattgtaattattacgggaattctaacaattgtcacggtaccatgtccatccttatgggcctggatggtatggtgctgcttctgagcgtgctggaattttgcatcgcagtttccctatccgcatttggttgtaaagtcttgtgctgcacaccaggcggcgttgtactcattctgccctctcactcccacatggctgagaccgcatccccaactccactcaatgaggtgtag

SEQ ID NO: 194824 - DNA, 663 bp, Artificial Sequence
  Description of Artificial Sequence: Synthetic coding sequence
atgaccaccatgcagggcatggagcaggccatgcccggcgccggccctggcgtccctcagcttggcaatatggcagttatccatagccacttgtggaaaggcctccaggagaagtttctgaaaggagaacctaaagtgctaggcgtcgtccagatcctcaccgccttgatgtcccttagtatggggattaccatgatgtgcatggcttctaacacatatggttcgaaccctatttccgtgtacattggatacacaatatggggctctgtgatgtttattatcagtgggtctctgtcaattgccgcaggtattcggacgactaagggcctcgtccgcggctcattggggatgaatataacatcttcagtgctggcagccagcggtatcctgattaacacattttctttggcattttatagcttccaccacccctactgcaactattacggaaatagcaataattgccatggcacaatgtctatcctcatggggctggatgggatggtcctgctgcttagcgtactggaattttgtatcgcggtaagcctgtctgcattcggatgtaaggtgctgtgctgtacgccaggcggcgtggtactgattctcccctcacactcgcatatggctgaaacagcctcacccactccactgaatgaggtatag

SEQ ID NO: 194825 - DNA, 663 bp, Artificial Sequence
  Description of Artificial Sequence: Synthetic coding sequence
atgaccaccatgcagggcatggagcaggccatgcccggcgccggccccggggtgccgcaactaggaaacatggccgtcatccactcacacttgtggaaagggctgcaagagaaatttttgaagggcgagcccaaggtattgggagtagtccagatccttaccgccttaatgtcgctgagcatggggatcacaatgatgtgtatggcttcaaatacatacgggtcgaacccaattagcgtctacattggttataccatatggggcagtgtaatgttcataattagcggttcattgtccattgctgcagggattcgtactaccaagggtctggtgcgtggaagcctgggaatgaacattacaagtagcgtcctcgcggcctctgggatcctcatcaacacgtttagccttgccttttactcctttcaccacccctactgtaattactacggtaattctaacaattgtcacggcacaatgtcgatcctcatgggtctcgatgggatggtgttactgttaagcgtgctcgaattctgtattgcagtgtcactttctgcctttggctgtaaggttctttgctgtaccccaggcggagtggtcctcattctaccctctcacagccatatggcggaaacagcctcccccacacctctgaatgaagtgtag

SEQ ID NO: 194826 - DNA, 561 bp, Artificial Sequence
  Description of Artificial Sequence: Synthetic coding sequence
atgcaccagacctacagccggcactgccggcccgaggagagcaccttctctgccgcaatgacgacgatgcaaggaatggaacaggcaatgccgggggcagggcccggcgtgcctcagctaggcaatatggctgtgattcattcacatttatggaaaggcttgcaagaaaaattcttgaagggagagcccaaagtgctgggcgtggttcaaattctgacagccctgatgtcactgagcatggggatcaccatgatgtgcatggccagcaacacatacggctccaatcctattagcgtgtatatcggatacactatttggggttctgtcatgttcattatttccgggtccctctcgattgccgctggcatccggacaactaagggcctcggacttgatggtatggtcttactgctgagcgtgttagagttctgcatcgcggtctccctatctgcgttcgggtgcaaggtgctgtgctgcactccgggaggggtagtgttaatactgccatcccactctcacatggccgaaactgcctctccaacgcccctaaatgaggtgtag

SEQ ID NO: 194827 - DNA, 399 bp, Artificial Sequence
  Description of Artificial Sequence: Synthetic coding sequence
atgaccaccatgcagggcatggagcagaccacccccggcgccggcccagatgtgccacaactcggaaacatcgatgttatccactcatatctgtgcaaaggactccaggaaaagttctttaaaaggaagccaaaggtgctcggggttgtgcgtatactgatcgccctcatgagcttatctatgggaatcataatgatgtgcgtggcattcagcagctacgaagagcacccaatctttgtttacgtcgcttataccatctggggtagtgtgatgtatccttatcagctgcagcaagaactagaacagcaaaaagtatggaattacctgaagaatttgagctggcgcattatgggttcttatctgtgcttcggggagcgctcggagctcaaacctctctag

SEQ ID NO: 194828 - DNA, 333 bp, Artificial Sequence
  Description of Artificial Sequence: Synthetic coding sequence
atgaccaccatgcagggcatggagcagaccacccccggcgccggcccggatgtgcctcaactcggaaatatagacgtgatccactcctacttatgcaaagggttgcaggagaagttctttaaacggaaaccgaaggtgttaggcgtcctttgcgggcacaaattctctacgcacagcgtcagtctgagcgtggccgcaggaataagaactaccaaggggctcgagctatccgaggagtttaaactagagaacaacggcataatctttgtcttctggcgagagattcgggtggaaaccacaattaggcggcaggtaagacgattgttgaaatag

SEQ ID NO: 194829 - DNA, 615 bp, Artificial Sequence
  Description of Artificial Sequence: Synthetic coding sequence
atgagctacatccacatctgcgtgaaggactgcaagcggagcagctcgcgcggaaatccaaagtctctgggtttttgtgtcgatatttccttccagctcatccgtgtggtccgcatactgattgctcttatgagcctgagcatgggcatcattatgatgtgcgtggccttttcttcttacgaggagcatcccatatttgtgtacgtggcatatacaatctggggctcagttatgtacccctaccagctgcaacaggagttggaacaacagaaagtgtgcatctatcgagtgctgaacggcgcgcaagcaggcgtccagtggagggaccttgggtctttacagccccctcctcccagccggctcccttggcctccaaaagttccgagagttcagccgctaccaggtagacatccagtgtgggaggttagatctgtgtcagcgtggccccccatcgtctgggatgtgcgctccccatctgcatggctgccctcccttgagtccgaagaacgcttatgccccgcagccatccctagcagaaagtggggagctcctttgccgggccatcatccaatctgggaggtgagatcagtctcggccagacccccaattttctag

SEQ ID NO: 194830 - DNA, 399 bp, Artificial Sequence
  Description of Artificial Sequence: Synthetic coding sequence
atgaccaccatgcagggcatggagcagaccacccccggcgccggcccagatgtgccacagctaggcaatatcgacgtgattcattcctacctctgtaaaggcttgcaggaaaaattcttcaagcgaaagccaaaagtcctgggggtggtcaggatactgatcgcccttatgtctctaagcatggggatcattatgatgtgcgtcgccttttccagctatgaagagcacccaatctttgtttacgtggcctacaccatttggggctcggtcatgtatccgtaccagctccagcaggaacttgagcagcagaaggtgtggaattatctgaagaacttgtcttggagaataatgggatcatatctttgctttggcgaacgctctgagttgaagccattgtag

SEQ ID NO: 194831 - DNA, 603 bp, Artificial Sequence
  Description of Artificial Sequence: Synthetic coding sequence
atggacagcagcaccgcccacagccccgtgttcctggtgttcccccctgaaattacggcaagcgagtacgaatcaaccgaactatccgcaacgaccttttctactcagtcgcctttgcagaagctcttcgccaggaagatgaagatcttgggcactattcagatcctctttggcattatgactttttcctttggcgtaatcttccttttcacattgttaaagccttaccctaggttcccatttatcttccttagtggatatccattctggggatccgtccttttcattaatagcggagcatttctgatcgccgttaagcggaagacaactgagacgctcatcatcctgagtcgcataatgaattttctcagcgctttgggcgccatcgccgggatcattctcctaacctttggattcattctggaccagaattacatctgcggctactcccatcagaactctcaatgcaaagctgtcacggtcctcttcctggggattcttataacgctgatgaccttcagtattattgaattgttcatcagtcttcccttctccatcttgggctgccactcagaagattgtgactgtgagcagtgctgttag

SEQ ID NO: 194832 - DNA, 747 bp, Artificial Sequence
  Description of Artificial Sequence: Synthetic coding sequence
atgaccagccagcccgtgcccaacgagaccatcatcgtgctgcccagtaatgtaattaatttcagccaagctgagaaacccgagcctactaaccagggccaggattcacttaagaaacacctccacgccgaaattaaagtgatcggaaccatccagatattatgcggcatgatggtcttgtcactgggaatcatcctggcctcagcttcattcagcccaaattttactcaggtcactagcactctcctgaactctgcttacccctttatcggccctttcttcttcatcatcagcggaagcctgagcattgcaaccgaaaagaggctgacaaaactcctggttcactcgtccctggtgggtagcatcctatccgctctctcagccctggttgggtttatcattttaagcgtcaagcaggccacgcttaatcccgcctctcttcagtgcgaacttgacaagaataatattcctacacgtagctacgtcagctatttctaccacgactccttatataccactgactgttatacggctaaagccagtcttgctggcacccttagtctgatgcttatctgtactctgctggaattctgtctcgccgtgctgacagctgtgctacggtggaaacaagcatattctgattttccggggagcgtcttgtttctcccccactcatatatcggcaatagcgggatgtcttcaaagatgacccacgactgtggttatgaagagcttctcacttcgtag

SEQ ID NO: 194833 - DNA, 537 bp, Artificial Sequence
  Description of Artificial Sequence: Synthetic coding sequence
atgaccagccagcccgtgcccaacgagaccatcatcgtgctgcccagcaacgtgatcaatttcagccaggccgaaaaacccgaacctactaaccaagggcaggactcactgaaaaaacacctgcatgccgaaatcaaagtgatcggtactatccaaattttgtgtggcatgatggtgctctccctgggtatcatcttagcttcagcctctttcagtccaaacttcactcaggtgacgagcactctgctcaactctgcgtatccatttattggccctttcttctttattatcagcggctcgctcagcattgctactgagaagcgattaaccaagctgttagtgcattcctcgctggtcggttctattctctcggctcttagtgctttggtaggatttattattcttagcgtgaagcaggctaccttaaaccctgcatccctgcagtggaattcgttatcggatgccgacctccactcagcagggattctgccgtcttgtgcacactgttgcgctgcggttgagaccggcttgctttag

SEQ ID NO: 194834 - DNA, 543 bp, Artificial Sequence
  Description of Artificial Sequence: Synthetic coding sequence
atgaccagccagcccgtgcccaacgagaccatcatcgtgctgccctccaatgttattaatttcagccaggcggaaaaacctgagcccaccaaccagggacaggacagcctaaagaagcatcttcacgctgagataaaagtcatcgggttcataatttccggaagccttagcatcgccacggagaagagacttaccaaattacttgtgcacagcagcctggtgggttccattctatcagcgttgagtgctctcgtgggatttataatcctcagtgtcaagcaggcaacgctcaatcctgcttccctgcagtgcgagctcgataagaataacatacctacaaggagctacgtttcatatttctatcacgacagcctgtatacaacagactgttataccgctaaggcatctctagcaggtaccctctctttaatgcttatctgtacccttctcgagttttgtctggcagttctgacagccgttctgcgttggaagcaagcttactccgactttcccggcgtgagtgtcctggccggattcacttag

SEQ ID NO: 194835 - DNA, 678 bp, Artificial Sequence
  Description of Artificial Sequence: Synthetic coding sequence
atgaccagccagcccgtgcccaacgagaccatcatcgtgctgcccagcaacgtgattaacttcagccaagctgagaaacccgaacctactaaccaagggcaggacagcctgaaaaagcatttgcacgccgaaatcaaagtgattggaacaattcagatcctgtgcggcatgatggtgctgagcttggggatcatcttggcgagcgcttcattctcacccaatttcacccaggttacaagcaccctactcaatagcgcttacccttttataggcccattctttttcattataagcggttctctgtccattgcaacagagaagcgcttgacgaagctgcttgtgcacagctccctcgttggaagtatactcagtgccctgtccgcccttgtgggctttatcatactgagtgtcaagcaggccaccttgaatcctgcctcgctgcagtgcgaattggataagaacaatatcccgacgcgctcctatgtcagttatttttatcacgactccctttataccaccgactgctacaccgctaaggcttccctggctgggacgctatctctgatgttgatctgtactctgctggaattttgcctcgccgtgctgacagccgtgttacgttggaaacaagcgtatagtgattttcccggtgtaagtgtgctggccgggttcacatag

SEQ ID NO: 194836 - DNA, 831 bp, Artificial Sequence
  Description of Artificial Sequence: Synthetic coding sequence
atggtgctgctgaagctgctggaggtgtaccggaagggcagcgccggcacctttcacaagtcaaccattttcggaaataccatcatgacctcacagcccgttcctaatgagaccataatcgtcttgccaagcaatgtaatcaacttctctcaggctgaaaagcctgaaccaactaatcagggtcaggacagtctgaagaaacacctccatgctgaaatcaaagtgattggcactatccagatcctctgcgggatgatggtgctcagcttaggaatcatactggcgagcgcgagcttcagccctaacttcacccaggtgacctccactcttctcaactccgcgtacccattcatcggcccatttttcttcattatctccggttccctcagcatcgctacagagaaaaggctcacaaagctgctggtgcactcttcacttgtcggatcgattttatccgccctttcagccctggtgggtttcattatcctgagtgtaaaacaggcaaccttgaacccggccagtctccagtgtgaattagacaagaataatattccaacccgttcttacgtgagctatttttaccatgacagcttgtataccacagactgctatactgcaaaagcatcactggcaggcaccctgagccttatgctcatctgcaccctcctcgaattctgcctggcagtattgaccgcagtactgagatggaagcaggcttactctgacttccccggttctgtgctgttcctaccgcattcttacatcggcaatagcgggatgagcagtaaaatgactcacgattgcggatacgaagagctcttgactagctag

SEQ ID NO: 194837 - DNA, 747 bp, Artificial Sequence
  Description of Artificial Sequence: Synthetic coding sequence
atgaccagccagcccgtgcccaacgagaccatcatcgtgctgccctccaatgtgattaattttagtcaggccgagaagccagagccgacgaatcagggccaggactccctgaaaaaacaccttcacgccgaaatcaaggttataggcactattcaaattctctgcggtatgatggtgctctctctcgggataattcttgcctccgcaagcttttcccccaactttacccaggtgacttctaccctactaaacagcgcctatccttttatagggccattcttctttattatctccggatctctatcaattgcaaccgagaaacggctgaccaaactcctggtccattcaagcttagtcggctccattctttccgccctgagcgccttagtcggcttcatcattctcagtgttaagcaggccactttgaatcccgcatcacttcaatgtgaactggacaagaacaacattccgaccaggagctatgtatcttacttctatcatgatagtctgtacacgaccgattgttacacagctaaagcatctcttgccggtaccctctctttgatgttgatatgtacattactagagttctgcctcgcggtgctgacagctgttctccgctggaaacaggcatacagcgatttccccgggagtgtcctcttcctgccacattcgtatatcggcaattcgggcatgtcaagtaaaatgactcacgactgcggttacgaggaactcctcaccagctag

SEQ ID NO: 194838 - DNA, 72 bp, Artificial Sequence
  Description of Artificial Sequence: Synthetic coding sequence
atgaccagccagcccgtgcccaacgagaccatcatcgtgctgccctccaacgtaatcaacttcagccaatag

SEQ ID NO: 194839 - DNA, 444 bp, Artificial Sequence
  Description of Artificial Sequence: Synthetic coding sequence
atgaccagccagcccatcagcaacgagaccatcatcatgctgccctccaacgtgatcaactttagtcaagcagagaaaccagaaccgaccaatcagggccaggactcactaaagaaacggcttcaagcaaaagttaaggtgattggcgtgcatagctccctcgcaggctccatcctgtccgctctgtcggccctcgtggggtttattctgttatcagtcaatcccgccgcgttaaatcccgcgtctctgcagtgtaagctggatgagaaggatatccccaccagattgctcctatcttacgattaccactccccttatactatggactgccacagggcaaaggcatccttagctgggaccctctcactcatgctggtgagtaccgtgctggagttctgcctcgccgtgttaactgcagtcctgcagtggaagcagactgtgtag

SEQ ID NO: 194840 - DNA, 723 bp, Artificial Sequence
  Description of Artificial Sequence: Synthetic coding sequence
atgctgctgcagagccagaccatgggcgtgagccacagcttcacccccaaagggatcaccatcccacagcgggaaaagccaggacatatgtatcagaatgaagattatctgcaaaacggactgcctaccgaaacaacggtcctggggaccgttcagatcctttgctgcctcctaatctcttctctcggcgccatcctggtgttcgctccctacccttcccacttcaatccggctattagcaccacgctgatgtctggctatccttttctgggagctttatgctttgggattactggtagcctctctatcatatctggcaagcagtcgaccaagccttttgacctatcctccttgacttctaatgctgtgtcctctgttacagcaggtgccggcctgtttctgctggctgattctatggttgccctgcgaacagcttcacagcactgcggatccgaaatggactaccttagcagccttccgtacagtgagtactattatcctatctacgagatcaaggattgcctccttacatcggtctctctcactggcgttttggtcgttatgcttatttttaccgtcttggagctgctccttgctgcttactcttccgtgttctggtggaagcagctctattctaataacccagggagcagctttagctccactcagtcacaggatcacatccagcaggtgaagaagtccagctctaggtcctggatttag

SEQ ID NO: 194841 - DNA, 588 bp, Artificial Sequence
  Description of Artificial Sequence: Synthetic coding sequence
atgctgctgcagagccagaccatgggcgtgagccacagcttcaccccaaagggcatcaccattcctcagagggaaaagcctggccacatgtaccaaaacgaagattatcttcagaacggcttaccgacagaaacaaccgtcctcgggtttgggatcacgggaagtctgagcatcatatccggaaagcaaagcaccaaacccttcgacctgagcagcctgacaagcaatgcggtgtcttctgtaacggcaggggctggcctgtttttgctagcggatagcatggtggcattgcgcacagcttcacaacactgcggtagcgagatggactatctgagctccttaccgtactccgagtattattatccaatttacgaaataaaagactgtcttctgaccagcgtgtcactaacaggagtgctcgtggtcatgctgatcttcaccgttctcgagctgcttctggccgcctactctagtgtgttctggtggaaacagctgtactcaaataaccctggctcttctttctcaagcactcagtcccaagaccacatccaacaggtgaaaaaatcatcctctagatcttggatctag

SEQ ID NO: 194842 - DNA, 510 bp, Artificial Sequence
  Description of Artificial Sequence: Synthetic coding sequence
atgctgctgcagagccagaccatgggcgtgagccacagcttcacccccaaaggcattacaattccccagcgggaaaaacctgggcacatgtaccagaatgaagactacctgcagaatggcttgccaactgagactacagttctaggattcggcatcaccggatcgttgagcattatttccggcaaacaatctactaagccattcgatctctcatcccttacgagtaatgctgtcagttcagtgacagccggggccggactgtttctgttggcggattcaatggtggctctcaggacagcatcccaacactgcggatcagagatggattatctgtcttcattgccatattccgagtactattatccaatatatgaaatcaaggactgtctgctgacctccgtgtctctgaccggtgtgttagtcgttatgctgatcttcaccgtccttgagcttctcctcgccgcttacagttcagttttctggtggaagcaattgtattccaataactag

SEQ ID NO: 194843 - DNA, 588 bp, Artificial Sequence
  Description of Artificial Sequence: Synthetic coding sequence
atgctgctgcagagccagaccatgggcgtgagccacagcttcaccccgaagggaattaccatcccccagagggaaaagcctgggcacatgtaccagaacgaggactaccttcagaacggccttcctacagagaccacagtactgggttttggcataacaggcagtctctctatcatatctggtaagcagagtaccaagccttttgatctgtccagcctcactagtaacgctgtcagctcagtgactgcaggagccggccttttcctgctcgctgactctatggtagcattgcggaccgccagccagcactgtggctctgaaatggactatttgagctctctaccgtacagtgagtactactacccgatttacgagataaaggactgtctgctgacaagcgtgtcactgaccggtgtcctggtagtgatgctgatctttactgtgctggagctactgctcgctgcttactcttctgtgttttggtggaaacagctttactccaataacccgggttcctccttttccagcacacagtcacaggaccacattcaacaggtaaagaaatctagcagtagatcctggatctag

SEQ ID NO: 194844 - DNA, 753 bp, Artificial Sequence
  Description of Artificial Sequence: Synthetic coding sequence
atgaacagcatgaccagcgccgtgcccgtggccaacagcgtgctggttgttgcaccccataacggctatcccgtgacaccaggaataatgtcccatgtgcccctctatcccaatagtcaaccccaggttcacctggtgcccggtaacccacccagccttgtcagcaacgtgaatgggcagccagtccagaaagcacttaaggagggcaagacgctgggtgccattcagattatcataggtctggcgcacatcggcctcgggagcataatggccaccgttttggtgggggagtacctctccataagtttttacggcggcttccctttctggggtgggctgtggtttatcatctctggtagcctgtcggtcgcagctgagaaccaaccctacagctactgtcttttaagtggtagcctcggtttaaacatcgtgtcagcgatctgtagcgctgtcggagtgattttattcataacagacctgtcaattccccatccttacgcgtacccagactattacccatacgcatggggggtcaatcccggcatggctatctcaggagttttgctggtattctgtctactagaattcggcatagcatgtgccagtagccatttcggttgccaacttgtctgctgccagtcctctaatgtgagtgtcatctaccctaatatctacgccgcaaacccggtcatcaccccagagccggttacatccccaccctcctatagctctgagatccaagcaaataaatag

SEQ ID NO: 194845 - DNA, 2550 bp, Artificial Sequence
  Description of Artificial Sequence: Synthetic coding sequence
atggtgcagaaggagagccaggccaccctggaggagcgggagagcgaactgtcctctaatcctgccgcctcagccggggcctcactggagccacccgccgcgcccgcgcccggcgaggataatcccgctggtgctggaggggccgccgtggcaggggcggccggaggcgcacgccgcttcctgtgcggcgtggtcgagggcttttatggaaggccctgggtcatggagcagcgaaaagaactcttccgtcggctgcagaaatgggaactcaacacttatctctatgcgccaaaggatgactataagcaccgaatgttttggagggagatgtacagcgtggaggaggccgagcagctcatgacgttgatatctgctgcgcgggagtacgagatagagtttatttacgcgatctctccgggcctggatattacctttagcaatccaaaggaggttagtacactgaaacggaaactggatcaggtatcccagtttggttgccggtcatttgccctgttatttgatgatatcgatcataacatgtgcgccgcggataaagaggtttttagtagctttgctcacgctcaagtgtcaatcacaaacgaaatttatcagtatctcggggaacccgaaacgttcctgttctgccctaccgaatactgcggcacattctgctaccccaatgttagccagagcccatacctgcgcacagtgggggagaagttgctgcctgggatagaagtgttgtggaccggccccaaagtggtgtccaaagaaatccccgtcgagtctattgaagaggtcagtaagattatcaaacgagcccccgttatttgggacaatattcacgccaacgactacgaccaaaagcggcttttccttggtccctacaaagggaggtcaaccgagcttatccctcgcctgaagggagttctcaccaatccaaactgtgagttcgaggctaattatgtcgctatccacactctggctacatggtacaaaagcaacatgaacggagtccgcaaggacgtggtgatgtcgcgtcaggtagcacactcaggcgccaaagcttcagtggtcgacggcacgcctctggtggccgccccctctctgaacgccactactgtggtgacgaccgtttaccaagagccaattatgtcccagggggccgctctgagcggagaacctaccactctgaccaaggaggaggaaaaaaagcaacccgatgaggaaccaatggacatggtcgttgagaagcaggaagaaacagatcataagaacgacaatcagatcctgagcgaaatcgtggaggccaaaatggcggaggagcttaagcctatggacaccgacaaagagtcgatcgctgagtccaaaagtcctgagatgtcgatgcaggaggactgcatctctgatatcgctcctatgcaaactgacgagcagactaacaaggagcaattcgtacccggtcctaatgaaaagccactgtacacagcggagcccgtaacattagaggacctgcagcttctcgccgacctgttttatcttccttacgagcacggtcccaagggcgctcaaatgctcagagagtttcagtggctgcgagcaaactcctccgtagtctctgtgaactgtaagggaaaagattctgagaagatagaggagtggaggagccgggccgccaaattcgaagagatgtgtggattggtcatgggtatgttcacaaggctatctaattgcgccaatcgtaccatcttgtatgatatgtactcgtatgtgtgggatattaagtctattatgtccatggtcaaatccttcgtacaatggctgggatgtagatcccacagctctgcccagttcctgatcggcgatcaggaaccatgggccttcagaggcggcctggcaggtgagttccagccaccccctcttacgccaactagcaaagtgtatacgatcaggccatatttccccaaggacgaagcatccgtttataagatctgccgagagatgtacgacgatggggtgggcctgccttttcagagtcagcctgatcttatcggagataaactggttggaggtctgttgagccttagcctcgattactgctttgtccttgaggatgaggacggtatctgtgggtatgccctgggcactgtggatgtgactccatttattaagaagtgcaagatctcctggatcccatttatgcaagaaaagtatacgaaacctaacggggataaggagttatctgaggccgagaaaataatgctcagttttcacgaggaacaggaggtgctccccgagacttttttggccaatttcccctccctgatcaagatggacatacacaagaaagtgaccgatccctctgttgccaaatcgatgatggcctgtctgctgagcagtttaaaggcaaatgggtccagaggtgctttctgcgaggtgcgcccagatgataagcggatactcgagttctacagtaagttgggctgctttgagatcgcaaagatggagggctttccaaaggacgtggtgatcctcggaagatccctgtag

SEQ ID NO: 194846 - DNA, 2751 bp, Artificial Sequence
  Description of Artificial Sequence: Synthetic coding sequence
atggtgcagaaggagagccaggccaccctggaggagcgggagagcgagttgtctagcaatccagctgcctccgcgggggcaagcctcgaacctcccgcagcgcctgccccaggagaagacaaccctgccggagctggcggtgcagccgttgccggcgctgccgggggggcccgccgcttcctctgcggggtggtggaaggcttctacgggcggccttgggtaatggaacagcggaaggagttattcagaaggcttcagaaatgggaactaaatacctacctctacgctccaaaggacgactacaaacacagaatgttctggagggaaatgtattctgttgaagaggcagagcagttaatgacactgataagtgcagcgagagaatatgaaatcgagttcatttacgctatatccccaggactcgatattactttctcaaatccaaaagaggtcagtacattaaaacgcaaactcgaccaggtcagccagtttggatgtcgtagttttgccctgctgttcgatgatattgatcataacatgtgcgctgctgacaaggaggtcttttcaagtttcgcccacgcgcaggtttcaatcacaaacgaaatttaccaatatctgggggaaccagagacattccttttttgcccgacagagtattgtggtaccttctgctatcccaatgtctcgcagagtccttatcttaggacagtcggagagaagctcttgcctggcatcgaagtcttgtggaccggacctaaagtggtgagtaaggagatccccgtcgaaagcatagaggaggtcagcaagattattaaaagggccccagttatttgggacaacatccacgctaatgactatgaccagaaaagactttttctgggtccttataagggccgaagcactgagttaattcctcggctgaaaggggttctcaccaatcccaactgtgaattcgaagccaactacgtcgccatccacactctggccacatggtacaaatccaacatgaatggggtgcgcaaggacgtagtgatgaccgacagcgaagattcaactgtctctatccaaatcaaactggagaatgagggtagcgacgaggatatcgagacagacgtgctatattccccccagatggctctgaagttggcgcttaccgagtggctccaggagtttggcgtcccccaccaatatagctcccgccaggtggcgcactctggcgctaaagcaagcgttgtggatgggacccccctagtcgcagccccctctctgaatgctacaactgtcgtaacaacagtttatcaagagcccattatgagtcagggtgctgccttaagcggggagcccactacactcacaaaggaagaagagaaaaaacagcccgacgaggaacccatggacatggtggtggagaagcaggaggagaccgaccacaagaatgacaaccagatcctgtccgagattgttgaggctaagatggcagaggaattgaagcccatggatactgataaagagtccattgcggagagtaagagtcccgaaatgagcatgcaagaggattgcatttcagatatcgccccgatgcagacagatgagcagaccaacaaggaacaatttgtgcccgggcccaacgagaagccactgtacactgcagagcccgtgacactcgaagatcttcagcttttggctgaccttttttatttgccatacgaacacggacctaagggggctcagatgctacgggagttccagtggcttcgagctaatagcagtgttgtaagcgtcaattgcaaggggaaagacagcgagaaaattgaggagtggagaagccgagcggccaagttcgaagaaatgtgtgggctggtgatggggatgttcacccgcctttccaactgtgcgaatcggaccatcctttacgatatgtactcatacgtctgggatattaagagcatcatgtccatggtaaaatcttttgtgcagtggctgggatgtcggtctcatagctccgcccagtttctgattggcgaccaggagccctgggcatttaggggcgggttggcgggcgagttccagaggctgctaccaattgacggtgcgaacgacctgttcttccagcctccccccctgaccccaaccagcaaggtttataccattcggccatatttcccaaaagacgaggccagtgtgtacaagatttgtcgggagatgtatgacgacggggtagggctgccgttccagagccaaccggacttaattggcgataaattggtcggtggtttgctatccctgtccctggactattgtttcgtgttggaggacgaggatggcatctgtggttacgccctcggcactgtggacgtgaccccctttatcaagaagtgtaagatatcttggatccctttcatgcaggagaaatacacgaaacccaatggcgataaggaactgtctgaggccgagaagatcatgttaagtttccatgaagaacaggaggtacttcccgagacctttctggccaacttccccagtctaattaaaatggacattcataagaaagtaactgacccatcggttgctaagtctatgatggcgtgtctactgtcctcattaaaagcaaacggctcaagaggcgcgttctgtgaagtcaggcctgacgataagcggattctagagttttactccaaactgggctgcttcgagattgccaagatggaaggcttccccaaagacgtagtgatcctcggacgatcattgtag

SEQ ID NO: 194847 - DNA, 2034 bp, Artificial Sequence
  Description of Artificial Sequence: Synthetic coding sequence
atggtgcagaaggagagccaggccaccctggaggagcgggagagcgaactcagctctaatccagccgcatcagccggcgcgtcactggagccccccgctgcaccagcccctggcgaggacaatcctgccggtgcgggtggagccgcagttgctggagctgcgggaggtgccagaagatttctgtgtggggttgtggagggattctacggaaggccttgggtgatggaacaacgcaaagagttgtttcggcgcctgcagaaatgggagttaaacacctacctgtatgctccaaaggacgactataagcacaggatgttctggagagagatgtacagtgtggaagaggccgaacagctgatgaccttgatctctgcagcgcgggaatatgagatcgagtttatctatgcaatcagtcccggtctggatatcacattttcgaacccaaaggaagttagtactttaaagaggaagctggaccaggtcagtcaatttggctgccggtcttttgcccttctgttcgatgacattgaccataatatgtgcgcggcagacaaagaagtattctcatccttcgcccatgcacaggtgtccattaccaatgaaatctatcagtacctgggcgagcccgagacctttctgttctgcccaaccgaatattgtggcaccttctgctatcctaacgtctcacagagcccgtatctccgcacagtgggcgaaaaactgctgccaggtatcgaggtcctgtggacagggcctaaggtcgtaagcaaggagatcccagtggaatctatcgaggaggtgagtaagatcattaagcgcgcacctgtgatttgggataacattcacgcgaatgactacgatcagaaaagactcttcctgggcccatataaaggccggtccaccgagctgatcccccgacttaaaggagtgctcacgaacccaaattgcgagttcgaggctaattacgtcgctatacacaccctggcaacctggtacaagagcaatatgaatggagtgagaaaggacgtagtgatgactgactctgaggactcaactgtgagcattcagattaaactggagaatgaaggaagcgatgaggacattgagacagatgtgctttatagcccacagatggctctgaaactcgcacttaccgagtggctgcaggagttcggggtgcctcaccagtactcctccagacaggttgcccactccggagcaaaggcgtcagtggtcgatggcacaccacttgtggctgcaccaagtctcaatgcaacaactgtagtgacaacggtttatcaggagccaataatgagtcagggagccgccctgtcaggagagccaaccaccttgacaaaggaggaggaaaagaaacagcccgacgaagagccaatggatatggtcgtggaaaaacaggaggaaacagaccataagaacgataaccagattctttccgagattgtggaggcgaaaatggcggaggagcttaaaccaatggataccgataaggagtctatcgctgagtctaagagcccagagatgagtatgcaggaggactgtatcagcgacatcgcaccgatgcaaactgatgaacagactaataaagagcagtttgtgcctgggccgaatgaaaagcccctctacactgctgaacccgttacactggaagacctacagctgcttgccgacctgttttatcttccctatgaacacgggccgaagggtgctcaaatgctgcgggaatttcagtggctgcgcgcaaacagcagcgttgtaagcgtgaactgcaaagggaaagatagcgaaaagattgaagagtggcgcagccgcgccgccaagtttgaagagatgtgcggcctggtgatggggatgtttactagactgtctaactgtgctaacagaacaatcctgtatgacatgtattcttacgtgtgggatatcaagtctataatgtctatggtgaagagcttcgtccagtggctgggtcgctgtacccgtaacaatcttttctcatcaaacattctgtctttgtag

SEQ ID NO: 194848 - DNA, 456 bp, Artificial Sequence
  Description of Artificial Sequence: Synthetic coding sequence
atggtgcagaaggagagccaggccaccctggaggagcgggagagcgagctctcttccaatcccgccgcgtctgccggtgcttccctggaaccccccgcggcacccgctcctggtgaagacaaccccgcgggagcaggtggcgctgcggttgctggcgctgccgggggggcgcggaggtttctctgtggagtggtggagggattctatggtagaccttgggtgatggagcagcgcaaagaactttttaggagactgcagaaatgggagctcaacacctacttatatgctccaaaggacgactacaagcataggatgttttggcgggagatgtactcagtggaggaggccgggagcttcttgtttttctacttggtaacaatacagctggctgaaattgagcgtgtactttgcgccagcaaggtgatgactatttgtgtgatttcctgggcatgttag

SEQ ID NO: 194849 - DNA, 771 bp, Artificial Sequence
  Description of Artificial Sequence: Synthetic coding sequence
gccgccggcggcgcccggcggttcctgtgcggcgtggtggagggcttctacgggaggccttgggtgatggagcagcggaaggaattgtttcggcggctccagaagtgggaattgaatacatatttgtacgcgcctaaagatgattataagcataggatgttctggcgggagatgtattcagtcgaagaggctgaacaactgatgaccctgatttctgcagcccgcgagtacgaaattgagtttatctatgccattagccctggcttggacataaccttctctaatccgaaggaggtgtctactctgaagaggaaactggaccaggtcagccagttcggctgccgaagcttcgccctgctgttcgacgacatcgaccacaatatgtgtgcagctgacaaggaagtgtttagttcctttgctcacgctcaggtaagtataaccaacgagatatatcaatatcttggagagcccgagacattccttttttgtcccacaggacccaaggtggtgagcaaagaaattcccgtggagagcattgaagaagtttccaagattataaaacgcgcccctgttatttgggataatatccacgccaacgactatgaccagaagaggctgttcttagggccctacaagggacggtctacggaactgattccacggttaaaaggagtcctgacaaatccgaactgtgaatttgaagctaactacgtggccattcacacattggccacttggtacaagtcaaacatgaatggggtacggaagtag

SEQ ID NO: 194850 - DNA, 2592 bp, Artificial Sequence
  Description of Artificial Sequence: Synthetic coding sequence
atggtgcagaaggagagccaggccaccctggaggagcgggagagcgaactgtcctccaatcctgccgccagtgcaggcgctagtctcgagccgcctgccgcgcctgcacctggcgaagacaaccctgccggagccggtggggcagcggtcgcaggagccgccggcggagctaggcgatttctgtgcggtgtggtcgagggcttttacgggagaccctgggttatggagcagcggaaagagctgtttcgaagattgcagaaatgggaactgaatacatacctttacgcacccaaagacgactacaaacacaggatgttctggagagagatgtattctgtagaggaggcagagcagctcatgactttgataagtgctgcaagagagtatgagattgaatttatatatgcgattagtccaggtctcgacattacgttttcaaacccgaaagaggtcagtactctcaaaagaaagctggatcaggtctctcaattcgggtgccggtcgtttgctttgctgtttgacgatattgatcacaatatgtgcgctgcagacaaggaggtcttctcgtccttcgcccacgcccaggtgagtattacaaacgagatctatcagtatctgggggagcccgagacctttctgttttgccccactgaatactgtgggacattctgttatccaaatgtgagtcaatcaccatatctccggaccgtgggcgagaagctcctgccgggcatcgaagttctgtggactgggcccaaggttgtgtcgaaagagattcccgtcgagagtatagaggaagtttctaagattattaagcgagcaccagtgatctgggataatatccatgccaacgattacgatcagaaacgcctgttcctgggcccttacaagggcagatccactgagttaatccctcgtctgaaaggtgtgctgacaaaccccaattgtgaattcgaagctaattatgtcgcaattcatacactggctacttggtataagtctaacatgaatggcgtgagaaaggatgttgttatgtcgcggcaagtggcacactcaggggcgaaggcttctgtggtggacggtacgccactggtggctgccccgtctctaaacgctacaacagtcgtcaccaccgtgtatcaggaaccgatcatgtctcagggagcggccttaagcggggaacccaccaccctgaccaaggaagaagagaaaaagcagccggacgaggagcctatggatatggtcgtggaaaaacaagaagagactgatcataagaacgacaatcagatcttgtccgagattgttgaagccaagatggcggaggagctgaagccaatggacacagataaggagtctattgccgagagcaagtcacctgaaatgagcatgcaggaggattgtatcagcgacatcgcccccatgcagaccgacgaacagaccaataaggagcagttcgtgcccggacccaacgagaagcctttatataccgcagagcctgtcaccctggaggacttgcagcttttggcggacctgttttacttaccttatgagcacggccccaagggcgctcaaatgctgcgtgagttccagtggctccgggccaatagttccgtggtgagtgtaaactgtaagggtaaggattccgagaagatagaggaatggcggtcaagagcagccaagttcgaggagatgtgcggacttgtgatgggcatgttcacaagactgtccaactgtgccaatcgtacgattctgtacgatatgtatagttatgtctgggacattaagagtataatgagcatggtgaagtctttcgttcagtggctaggctgtcggtctcatagcagcgcccagttcctcatcggtgaccaggagccttgggccttccggggtggtcttgcaggcgaatttcagcgcttattgccaattgacggcgccaatgaccttttttttcagcccccaccgttaacgccgaccagcaaagtgtatacgatacgtccctactttcccaaggacgaggcttccgtttataagatatgtcgggagatgtacgatgacggggtaggactgccttttcagtcgcagcccgatctgattggcgacaaactcgtaggaggtctgctcagtctgagtcttgactattgtttcgtcctggaggacgaagacggcatttgcggttatgccctcggtacagtcgacgtgacaccattcattaaaaaatgtaaaatatcgtggattcccttcatgcaagaaaagtatactaagccgaacggagataaagagctttcagaggccgagaagatcatgctgagttttcacgaggagcaggaggtgctccccgagactttcctagctaatttccctagtctgatcaaaatggacatacacaaaaaggttacagacccatccgtggctaagagcatgatggcgtgcctcctaagcagtctgaaggccaacggttcgagaggggccttttgcgaagtccggcctgatgacaaacggattctggagttttactcaaagctgggctgctttgagatcgccaaaatggaggggttccccaaggacgtggtgattctcggacgatcactgtag

SEQ ID NO: 194851 - DNA, 1545 bp, Artificial Sequence
  Description of Artificial Sequence: Synthetic coding sequence
atggccgtgtggctggcccagtggctgggccccctgctgctggtgagtttatggggccttttggcgcctgcctccctgttgcggaggttgggcgagcacattcagcagttccaggagtcgagtgcccaggggctgggtctcagcctggggcccggtgccgctgcactccccaaagtcggatggctggagcagttgctggatccatttaacgtgagcgaccggcgctcttttctgcagcgctactgggtcaacgatcagcactgggtaggacaggatggcccgatttttttacaccttggaggcgagggatccctaggacccggttccgtgatgaggggacacccggcagcactggcccctgcctggggcgctttggtaataagcctcgaacatcgattttatggcttatccatacctgccggaggcctggagatggcacagttgaggtttttgagcagtcggctggcattggcagacgtggtgtccgcgcgattggccctgtcaagactttttaatatcagcagctcctctccttggatctgctttggcggctcttatgccgggagcctggccgcatgggctagactaaagtttcctcacctgatctttgcctcagtggcgtcctccgccccagttagagccgtactcgacttttctgaatacaatgatgtggtgtcaaggtccctcatgtctacggcaattggcgggagtctggagtgtcgtgccgcagtgtccgtggccttcgctgaggtggagcgacgattacgttcagggggtgccgctcaagccgcactgagaacagagctgagcgcctgtggcccactggggcgggctgagaaccaggccgaattgctgggtgctctccaggctctggtcgggggcgtggtgcagtacgacgggcaaacgggcgctccactctccgtccggcaactgtgcggccttctgctgggaggaggcggcaacaggtcgcacagcaccccttattgtgggctgcggcgggcagtgcagatcgttttgcatagcctcggccagaagtgcctgtcgttctcccgcgctgaaacagttgcccagctccgaagtacagagccgcagctctctggagtgggtgatcggcagtggctctaccagacctgtacggaattcggcttttacgtcacttgtgagaacccgcgttgtcccttctctcagttgcctgctctgccatcacagctcgatctttgtgagcaggtttttgggctgagtgcactgtccgtcgcacaggccgtcgcccagactaactcctattatgggggacagactcctggcgccaataaggtgctgtttgtgaatggtgacaccgacccatggcatgtcttgtcggtgacacaggctctaggttctagtgagagcaccctgctaattcgcaccgggagccactgcctggacatggcccctgagaggccatccgatagccccagcttacggctaggacgacagaatattttccagcagctgcagacctggctcaaattggccaaagagagccaaatcaaaggcgaggtatag

SEQ ID NO: 194852 - DNA, 2106 bp, Artificial Sequence
  Description of Artificial Sequence: Synthetic coding sequence
atggacctgtggaacctgagctggttcctgttcctggacgccctgctggtaatcagcgggctggctacccccgagaattttgacgtggacggcggaatggaccaggacatcttcgatatcaacgaaggcttaggactcgatctttttgaaggcgatattcggctggacagggcgcagattagaaacagcattattggggagaagtatcgctggccccataccatcccgtatgtgttagaagactccctagagatgaatgccaagggggtgatactgaacgcatttgagcgctacagactaaaaacttgcatcgacttcaagccctgggctggggagactaactacatttctgtgttcaaaggaagtggctgctggagtagtgtgggaaacagacgggtgggaaaacaggagttatctataggtgcaaactgcgaccggattgccaccgtccagcacgagttccttcacgcgctgggcttctggcatgagcaaagtagaagcgaccgcgatgactacgtgcggatcatgtgggatcgaattctcagcgggcgggaacataattttaatacctactccgacgatatctccgacagtctgaacgtcccatatgattacacttccgtcatgcactatagtaagactgcctttcagaatggtacagagccaaccatcgtgacgcgaatttccgacttcgaggacgtcatagggcagagaatggacttttccgacagtgatttgctcaagctcaaccagctgtataactgctcgagcagtctgtcatttatggattcatgctcctttgaactggaaaatgtgtgcggtatgattcagtcttcaggtgacaatgccgactggcaacgggtgtctcaggtgccccggggccccgagtccgatcattccaacatgggtcagtgtcagggcagcggttttttcatgcattttgattcctccagcgtcaatgtgggcgccaccgccgttctggagagccgcaccctgtacccaaagaggggcttccagtgcttgcaattctacttgtacaattccgggagtgagagcgatcagctgaatatctacataagggagtactccgccgataacgtagatggtaacctgacgttggttgaggagatcaaggagatcccaacgggttcttggcagctgtatcatgtaactcttaaggttactaaaaaatttcgcgtagtcttcgaagggagaaagggatcaggggcttccctcgggggactcagcatagacgatattaatttgagcgagactaggtgcccacaccacatatggcacatccgcaactttacccagtttattgggtctcctaacggaactctttactcccctccattttactccagcaaaggatatgctttccagatttaccttaatctggcccatgtgactaacgccggtatctattttcatctgatttccggggccaacgatgatcagctacagtggccttgtccttggcagcaagcaacaatgactctgctcgatcagaatccggacattcgtcagcgcatgtctaatcaaaggtccattacaacagacccatttatgacaactgataacggcaactacttttgggacagaccaagtaaggtggggacagttgcactgttctctaacggcacccagttccgcagaggtggaggctacgggacttctgcgttcataacccatgaaaggctgaaatcacgtgactttatcaaaggtgacgacgtgtacattctgcttactgtggaagatatttcacaccttaatagtacccagatacaactgactcctgcccccagtgtccaggatctctgctctaagaccacatgtaaaaatgatggtgtatgcaccgtgagggacggcaaagccgaatgcaggtgccagtccggagaagattggtggtacatgggagagcgctgtgaaaagcgagggagcacaagagacactattgtcatcgctgtaagtagcaccgttgcggtcttcgccctgatgctcataattacactggtctccgtctactgcacccgtaagaaatatcgggagcgtatgtcatccaacagaccgaatctgacaccccagaaccaacacgccttttag

SEQ ID NO: 194853 - DNA, 894 bp, Artificial Sequence
  Description of Artificial Sequence: Synthetic coding sequence
atggccagcccccagctgtgccgggccctggtgagcgcccagtgggttgctgaagctctgcgagcgccacgggccggccagcccctacagctgctggacgccagctggtatctcccgaaactgggccgcgacgctcggagagaatttgaggaaaggcatatccccggggctgccttcttcgacatagaccaatgcagtgatcgaaccagcccatacgatcacatgctcccaggggcagagcattttgcggaatatgccggtcgcctgggagtaggagctgctactcatgtggtgatatatgatgcctcagatcagggcctctatagcgccccacgggtgtggtggatgtttcgtgcctttggtcatcacgccgtatccctactggacggtgggctgaggcattggctgcggcaaaatctccccctctcctctgggaagtcacagcccgctccagctgagttcagggcccaactagatccggccttcatcaagacctatgaagatataaaagaaaatctcgagtcacggagatttcaggtagtcgattctagggcaaccgggcgtttccgaggaactgaacctgagccccgcgacgggattgagccaggccacatcccggggaccgtgaatatacctttcacggactttctctcacaggaagggctggagaaatccccagaggaaataagacacctcttccaggagaagaaagtcgacctgtccaaacctctcgtggcaacctgtggctccggggttaccgcttgtcatgtagccctcggggcttacttgtgtggcaagcccgacgtgccaatctatgacggaagctgggtagaatggtacatgcgggcccgacccgaggatgtgatttccgagggcaggggcaaaacccactag

SEQ ID NO: 194854 - DNA, 954 bp, Artificial Sequence
  Description of Artificial Sequence: Synthetic coding sequence
atggccgagcccggcagccgggagagcgagacccgggcccggagccccagcgtggcagcgatggcctcccctcagctctgtcgggccctggtcagcgctcaatgggtggcagaagcactacgagcccctagggcaggccagcctctccagcttctggacgccagctggtacctgccaaaactcgggcgcgatgctcgccgtgagttcgaagagagacacatccccggcgcagcatttttcgacatagaccagtgctccgataggacatccccgtacgaccatatgctgcctggggcagaacacttcgctgagtacgcggggcggctcggcgtaggtgcggctacccacgtagtgatatacgacgcatcggaccagggactgtattcggcccccagagtgtggtggatgttcagagcgttcggtcaccacgctgtgagccttctggatgggggccttagacactggctgaggcagaatctgccgctgtcctctgggaagtcgcagcctgcccccgccgaattccgggcgcagctcgatccggcatttattaaaacctacgaggacatcaaagagaatctcgagtcccgccgctttcaagttgtcgatagccgggccaccggcaggttccgggggacggaacctgagcctcgtgatggcatagaaccagggcacatcccaggaactgtgaatatccctttcaccgatttccttagccaggaaggcctggagaagtcgccggaggagatcaggcatctgttccaggagaagaaagttgacctttccaagcctctggtggccacgtgtggttcgggcgtcacggcttgccacgtggccctgggagcgtacctgtgcggcaagccggacgttcctatttacgatggctcatgggttgagtggtacatgagagcaaggcccgaggacgtgatcagtgagggaagaggcaaaacacattag

SEQ ID NO: 194855 - DNA, 894 bp, Artificial Sequence
  Description of Artificial Sequence: Synthetic coding sequence
atggccagcccccagctgtgccgggccctggtgagcgcccagtgggtggcagaggctctgagggcaccgcgggccggtcagcctttacagctgttggatgcctcttggtacctcccaaaactggggagagatgctcgacgggagttcgaggagcggcatattccaggggccgctttcttcgacattgaccagtgttcagatcgaacctctccctatgatcacatgcttccaggcgctgagcacttcgcggagtatgctggccgtctgggggttggtgccgccacccatgttgtgatttatgatgcctctgaccagggcttgtattcagctccacgcgtctggtggatgtttcgcgcttttggccaccacgccgtgagcctattggatggcggcttgcgccactggctgagacagaatctgccactgtcgtcaggtaaatcacaaccagccccggctgaatttcgcgctcagctggatcccgccttcatcaaaacctacgaggacatcaaagagaatcttgagagccgccgattccaggtggtggactctcgagccacaggccgcttccggggtacggaaccagaacccagggacgggattgaacctggtcacatccctggaacagtgaatatcccatttacggacttcctctcccaggagggcctcgaaaagagcccagaagagataaggcatttgttccaggaaaagaaggtcgacttgagcaaacctcttgtggctacttgtggctccggcgttacagcttgccatgtggcacttggcgcatacctgtgcggaaaaccagatgtccccatctacgacgggtcctgggtggagtggtacatgcgcgcccgccccgaggacgtgattagcgagggccgaggtaagacacactag

SEQ ID NO: 194856 - DNA, 894 bp, Artificial Sequence
  Description of Artificial Sequence: Synthetic coding sequence
atggccagcccccagctgtgccgggccctggtgagcgcccagtgggttgcagaagccttgagggccccccgagccggccagcctctgcaattactggatgcttcctggtatctgcctaagctgggccgcgacgcgagacgtgagtttgaagagcgccatatcccaggcgccgctttctttgacatcgaccagtgctctgacaggacctccccatatgaccacatgctgcccggagccgaacacttcgctgaatacgctggacggcttggcgtgggcgctgccacacatgtcgtcatctatgacgccagtgaccaggggctatattctgcaccccgcgtatggtggatgtttcgcgcatttggccaccatgcagtctcccttcttgatggaggtctgagacactggttgcggcagaatctgccgctgtctagtggcaagtcccaacccgccccggccgaattccgggcccaattggatccagcttttattaagacctatgaagatatcaaggagaatctcgagagccggcgatttcaggtcgtggacagccgggctacgggaagatttcggggcactgaacccgaaccccgggacggaatcgaaccaggccacatacccggcacggtaaatattccttttactgacttcctgtcccaggaaggcctcgagaagtcgcctgaggagatcagacatctctttcaggaaaagaaggtggatttgagtaagccgttagtcgccacctgtggatccggcgtcactgcgtgccatgtggcacttggcgcctatctgtgcggtaaacccgatgtccctatttatgacggctcctgggtggaatggtatatgagagcacgacctgaagatgtcatctccgagggccgcgggaaaacccattag

SEQ ID NO: 194857 - DNA, 894 bp, Artificial Sequence
  Description of Artificial Sequence: Synthetic coding sequence
atggccagcccccagctgtgccgggccctggtgagcgcccagtgggtggctgaagcactgcgggctccaagagctggacagccactgcagcttttagacgcttcttggtacctgccaaagctgggacgggatgccagacgggagttcgaggagagacacatcccaggcgcagccttctttgacattgaccaatgctcagacaggacctccccatacgatcacatgctacccggggcagagcattttgctgagtatgccggcaggttgggagtcggcgccgcgacacacgtggtaatatacgatgcaagcgatcagggcctttacagtgccccccgagtgtggtggatgtttcgcgcgttcggacatcacgccgtgagtttgctcgacgggggcctgaggcactggctacgccagaatctcccactttcctctgggaaatcccaaccggcccccgctgagtttcgcgcccagttggaccccgctttcatcaagacatatgaggatataaaagaaaatctggagtccagacgattccaggtcgtcgactcccgagcgactgggcgatttcgcggaaccgaacccgaacctcgggatggtattgagccgggtcacatccctggaaccgtgaacatccccttcacagattttttgagccaggaagggctcgaaaagtcccccgaagagatcagacatttgtttcaggagaagaaagtagacctcagcaagccccttgtcgcaacctgtgggagcggggtgactgcctgccacgtggccttaggcgcctatttgtgtggcaaacccgatgtgcccatatacgatggtagttgggtcgaatggtacatgagggcccggcctgaggacgtaatcagtgaaggacggggcaagacccattag

SEQ ID NO: 194858 - DNA, 894 bp, Artificial Sequence
  Description of Artificial Sequence: Synthetic coding sequence
atggccagcccccagctgtgccgggccctggtgagcgcccagtgggtggcagaggccctgcgcgctccccgtgccggacagccattacagctcttggatgcaagctggtatctcccaaagctgggccgtgatgcccgtcgggaatttgaagagaggcacattcctggggccgctttttttgacatagaccagtgctcggataggactagcccctacgatcatatgttaccaggcgctgagcacttcgctgagtatgccggcaggttgggggtaggggctgccactcatgtcgttatctatgatgcctccgaccaggggctgtatagtgcccctcgggtgtggtggatgtttcgggccttcggtcaccatgctgtttccctgttggatgggggcttgaggcattggcttaggcagaatctccccctgagtagcggcaagtcccagccagcccctgcagaattccgggctcaactggaccccgcctttatcaagacatacgaggatataaaggagaatctagaatcacggcgtttccaggtcgtggattcaagagctacaggcagatttagaggcacggaacctgaaccaagggacgggattgaaccaggacacattccaggtactgtgaacatccccttcactgattttctgtcccaggagggtctggaaaagtcccccgaggagattcgacacctatttcaggagaaaaaagtggatctatccaagcccttagtggcaacatgcggcagtggagtaacagcttgccatgttgccctaggcgcatatttatgcggcaagcccgatgtgccaatttatgatggaagctgggttgagtggtatatgagagcccggccagaggacgtgatctccgaggggcgcggaaagactcattag

SEQ ID NO: 194859 - DNA, 738 bp, Artificial Sequence
  Description of Artificial Sequence: Synthetic coding sequence
atggccagcccccagctgtgccgggccctggtgagcgcccagtgggtcgctgaagccctaagagcacctagggctggacagccgctgcagctgttggacgccagctggtatcttccaaagctagggcgggacgctagacgagagttcgaggaacgccacatcccgggcgcggccttcttcgacatcgaccagtgcagcgatcgaaccagcccttacgatcatatgctgccgggcgcggagcactttgctgagtacgcaggacgcctgggcgtgggggccgcgacgcacgtcgttatctatgatgcgagtgatcaaggcctgtattcagcacctcgagtctggtggatgttcagagcgtttggccatcatgccgtgagtctgctcgacgggggactcaggcattggctgagacagaacctgcccctttctagtggcaagtcgcagcctgcccctgccgagtttagagcccaattagatcccgcttttattaaaacctacgaagatatcaaggagaacctggagtcgcgcaggtttcaggtggtggacagccgagcaacaggcagatttaggggtaccgagccagaacctcccgctgtcgggatcgagcccgggcacattcccggcacagtgaacatccccttcactgacttcttgtctcaagatggaagctgggtggaatggtacatgcgcgctcgacctgaggacgtgataagtgagggcagaggaaaaactcactag

SEQ ID NO: 194860 - DNA, 765 bp, Artificial Sequence
  Description of Artificial Sequence: Synthetic coding sequence
atggaccccgccgccagcagctgcatgcggagcctgcagccccccgcaccagtttgggggtgtctgcggaacccacattcggagggaaatggggcatctgggctaccgcactatcctcctactccattctcatttcaccagaagcccgactttcttgctacggccaccgctgcctatcccgattttagcgccagttgcctggcggctactccccactccctgccacaggaagagcatatttttactgaacaacatccagcctttcctcagtcacctaactggcacttccctgtttccgatgcccgcagaaggccgaattctggccccgctggcggatctaaggaaatgggaacaagctcactcggcctggtcgatacgaccgggggacccggcgacgactacggagttctgggcagtacggccaacgagacagaaaaaaagtcttcaaggcggcgcaaggagtctagtgataatcaagaaaatagggggaagcctgaagggtctagcaaagcaaggaaggagaggactgcctttacaaaggaacagttgagggagttggaggcagagttcgcccatcataattatctcactcgcctgcgacggtacgagatcgctgtaaatctggaccttagcgaacgccaagttaaggtgtggtttcagaaccgccgaatgaagtggaagcgcgtgaagggcggacaacccatttccccaaacggtcaggaccctgaggacggggacagtacagctagcccttcctccgagtag

SEQ ID NO: 194861 - DNA, 555 bp, Artificial Sequence
  Description of Artificial Sequence: Synthetic coding sequence
atggaccccgccgccagcagctgcatgcggagcctgcagccccccgcccctgtttgggggtgccttcggaaccctcactcagaaggcaacggggccagcggcctgccccactaccctcccactccatttagctttcaccagaaaccggactttcttgcaacggctactgcggcataccccgacttcagcgcctcatgcctggctgcaacccctcatagcctgccacaggaggaacatatctttactgagcagcatccggctttccctcagtctcccaactggcactttcctgtctctgacgccagacgacggcctaactccggacccgcaggcggaagcaaagagatgggcacaagttcgttggggcttgttgacaccacaggtgggccaggggatgattatggggtgctaggctcgacggccaacgaaactgagaaaaaaagctccagacgtaggaaagagtcctcaggtcaatccgttgtgcccgaaccaaaggacgaggtagaagcatgtgaaggcagatctgcgcacctccctcagtgggctggaccctag

SEQ ID NO: 194862 - DNA, 420 bp, Artificial Sequence
  Description of Artificial Sequence: Synthetic coding sequence
atgggcaccagcagcctgggcctggtggacaccaccggcggccccggagacgactatggcgttctcggtagtaccgcaaatgagactgagaagaaatcctcacgacgccgcaaggagagttccgacaaccaggagaatagggggaaacctgaaggatcttccaaagcacgcaaagagcgcaccgccttcaccaaagagcaacttagagagctggaggcagaatttgcacaccataattatttgacccgcttgcgacggtacgaaatcgccgtcaatttggatttatctgaacgccaggtaaaagtgtggttccaaaatcgtaggatgaagtggaagcgggtgaaagggggacagcctatcagtcccaatggccaggatcccgaggacggcgacagcaccgcgagcccttctagcgagtag

SEQ ID NO: 194863 - DNA, 915 bp, Artificial Sequence
  Description of Artificial Sequence: Synthetic coding sequence
atggagcaccccctgttcggctgcctgcggagcccccacgccaccgcacagggtctccacccgttcagtcagtccagcctggcgctccatggaaggtcagaccacatgtcttaccccgagctcagcacatcctcatcatcttgcatcatcgctgggtatccgaatgaagaaggcatgtttgctagccagcaccacaggggccatcatcaccatcaccatcatcaccaccatcaccaccaccagcagcaacagcatcaggctctgcagacgaactggcatcttccccagatgagcagcccaccctctgccgctcggcattctctttgcctgcagcccgacagcggtggacccccggagctggggtcaagtccaccagtgctttgttccaactcctccagcttagggtcaagcacacccactggtgccgcgtgcgcccccggggactatgggcgtcaggccctgtctccagccgaagctgaaaaacgaagtggaggcaaacgcaaaagtgattccagcgattctcaagaaggcaactataagtctgaggtgaacagtaagccccggaaggaacgaactgcatttaccaaggaacaaattcgtgaactggaggcagaatttgcccaccataattacttgaccaggctcagacggtacgagatcgccgttaatctggatctgaccgaaagacaagtgaaggtatggtttcagaaccgaaggatgaagtggaagagggtgaagggtggacagcaaggagctgccgcgcgcgaaaaagaactagtgaatgtgaaaaagggtacgctcctcccctccgagctgagcggcattggcgctgctacgcttcaacagaccggagattctatcgctaacgaggatagtcacgatagtgatcactcctccgagcacgcgcacctgtag

SEQ ID NO: 194864 - DNA, 705 bp, Artificial Sequence
  Description of Artificial Sequence: Synthetic coding sequence
atggccgccagccggtgggcccggaaggccgtggtgctgctgtgcgcctcggacctcctcctactgttactgttgctccctcctcccggatcttgcgccgccgaaggatctcctggtactcctgacgagagtacaccccccccaaggaagaaaaagaaagatatccgcgactataatgacgccgacatggcgaggctcctggaacagtgggagaaggatgatgatatcgaagagggagacttaccagagcataagaggccctctgctccggtggatttttcaaaaatcgatcccagtaagcccgaatccattcttaaaatgactaagaagggcaaaactctgatgatgttcgtaacagtgagcggctcccccacagagaaggagacagaggagatcaccagtctctggcagggttcattgtttaatgccaattacgatgtgcagagatttatagtgggatcagatagagctattttcatgctacgagacggcagctacgcctgggagattaaggatttcctggtaggccaggataggtgtgcggacgtcaccctggagggccaggtttaccccgggaaggggggtggcagtaaggagaaaaataagaccaaacaggataaagggaagaaaaagaaggagggagacctgaagtccaggagctctaaggaagagaatagagctgggaataagcgcgaagatctgtag

SEQ ID NO: 194865 - DNA, 705 bp, Artificial Sequence
  Description of Artificial Sequence: Synthetic coding sequence
atggccgccagccggtgggcccggaaggccgtggtgctgctgtgcgcttccgacctgctgctgctcctgctgctgcttcccccacccggtagctgtgcagcagagggatcaccaggaactccggacgaaagcaccccgcctccccgtaaaaagaaaaaagacatccgcgattataacgatgccgacatggccagactgctagaacagtgggagaaagacgacgatatcgaagagggagacctgcccgagcacaagagacctagcgcacccgtggatttcagcaaaattgatccctccaaaccagaaagcatcctgaaaatgactaagaaggggaagactctcatgatgttcgtgactgtttcaggctcccctacggaaaaagagaccgaggaaataacgtctctgtggcaggggagcctattcaatgcgaattatgacgtccaacggttcatcgtgggcagcgaccgggccatcttcatgctccgggacgggtcctacgcctgggagataaaagattttctagtggggcaggatagatgtgcagacgtaacgctggaggggcaggtgtatccgggcaagggcggcggcagcaaagaaaaaaataaaacaaagcaggacaagggcaaaaagaaaaaggaaggcgaccttaagagtcggtcctccaaagaggagaaccgagctgggaataagagggaggacctctag

SEQ ID NO: 194866 - DNA, 1194 bp, Artificial Sequence
  Description of Artificial Sequence: Synthetic coding sequence
atggcccagagcccccccccccagagcctgctgggccacgaccactggatctttgcacaggggtggggttgggccgggcactgggacagcacatctccagcaagcagtagtgactcgtcaggtagctgcccctgcgacggagcacggggactaccacagccgcagccccccagctgtagtagtcgagctgctgaggcagccgcgactacacctcggcgagctaggaccggcccagctggcggacagcggcagagcgcttccgaacgtgaaaaactgcggatgagaactcttgctagagccctgcatgagctcagaaggttcctccctccatcactggcaccggctggtcaatctctgacgaagatcgagacccttagacttgccatccgatacatcggccatctcagcgctgtgctgggcctctcagaagagtccctccaatgcaggaggcgacagaggggtgacgccggcagtccctggggttgccccctttgccctgaccgcggaccggcggaggctcaaacgcaggctgagggccagggacagggtcagggccaaggtcagggtcagggtcagggtcaggggcagggacaaggccaaggccagggccagggacgacggccggggctcgttagtgccgtcctggccgaggcctcctgggggtctccttctgcctgccccggcgcccaggcagcccccgaacgactgggcagaggcgtgcacgatacagatccgtgggccacacccccgtactgtcccaaaattcagagccccccatatagctctcaggggaccactagcgatgcctcgctctggactccaccccagggttgtccttggacccagtcttcgcctgagcctcggaatcctcccgtaccttggactgctgccccagccacactcgagctggctgcggtgtaccagggtctgagcgtgtcacccgaaccatgtctctcactaggggccccatccctgttacctcatccaagttgccagcgactacagccccaaacccccggcaggtgttggtcacattccgcagaggtggtgcccaatagcgaagatcaagggcctggcgcggcttttcagttaagcgaagcctctccaccccagagctcggggcttagattttccggctgtccggagctttggcaagaggatcttgagggtgctagactgggtattttttactag

SEQ ID NO: 194867 - DNA, 3510 bp, Artificial Sequence
  Description of Artificial Sequence: Synthetic coding sequence
atggagccccgggagagcggcaaggcccccgtgaccttcgacgacattacggtgtatctcctccaagaggaatgggttctgcttagtcagcagcagaaagagctctgcggctctaacaaactcgtggcccctttaggacctaccgttgctaacccggagcttttccggaaattcgggagaggccccgaaccgtggctggggtcagtacaagggcagcgaagcctgctggagcaccacccaggcaaaaaacagatggggtacatgggtgagatggaggtgcaaggtcctaccagagagtcaggtcaaagtctgccgccacagaagaaggcctatctatcacacctgtccactggatcaggacacatcgaaggggactgggcaggtagaaatcgcaagttgcttaagccaagatccattcaaaagagctggttcgtgcagtttccctggcttattatgaatgaggaacaaactgccctattctgcagcgcatgcagggaatatccctctatccgggacaagagatccaggttaatagagggatacacaggacccttcaaagtggagaccctcaagtatcacgctaagagtaaagcccatatgttttgtgttaatgcactcgcggctcgcgatccaatctgggccgccagattccggtccatccgtgaccctcccggggacgttctcgccagccctgaacccctgttcaccgccgattgtcccatcttctacccacctgggcccctgggcggtttcgactccatggctgaactgctgccttcaagccgggccgagttagaagatcccggtggggatggtgccattcccgccatgtatctcgactgcatcagcgacttacggcagaaggaaattaccgatgggatccacagttcatcagacatcaacatcctgtataatgatgcagtcgagagctgcatccaggatcccagcgccgaaggactgtccgaggaagtgcctgtcgtgttcgaggaacttcctgttgttttcgaggatgttgccgtttactttactcgagaggagtgggggatgctcgataagaggcagaaagagctgtatcgtgatgttatgagaatgaactatgagcttctggcatccctgggccccgctgccgccaagccagatctcatcagcaaactggagcggcgagccgctccctggattaaagacccaaacggcccaaaatggggcaaggggcgtccacctggcaataagaaaatggtcgccgtaagagaggccgatacacaggcctcagctgccgatagtgccctcctgcccggatccccagttgaggcccgagcctcatgctgctcatccagtatttgtgaggaaggggatgggccacggagaatcaagaggacgtataggcctaggtctatacagcgatcttggttcggacagtttccctggctggtcattgatcctaaagagaccaaattgttctgttcggcgtgcatagagcgaccaaatctacatgacaaaagctccaggctggtccgtggctataccgggcccttcaaggttgagactttgaagtatcacgaggtgagcaaggcccaccggttatgtgtcaacacagtggagatcaaagaggacactcctcacactgctctcgtcccagaaatttctagcgaccttatggccaatatggaacacttctttaatgctgcctatagcattgcataccacagccgaccactcaatgattttgagaaaattcttcagctgctccaaagtactgggactgtaatcttggggaagtacaggaataggacagcatgtacccagtttatcaagtacatcagtgagaccctaaagcgcgagattcttgaggacgtgcgaaactctccatgtgtgtccgttttgctggattcctctaccgatgcctctgagcaggcctgtgtggggatttacatcaggtattttaagcagatggaagtgaaggaaagctacatcaccctcgctccgctgtacagcgaaacggctgacggttacttcgaaaccatcgtcagcgccctggatgagcttgatattcctttcaggaaacccggctgggttgtaggcttgggcactgatggatccgccatgttgtcttgcaggggcggtcttgtagagaagttccaagaggtgatcccacagttgctgcctgtgcactgtgtggcccacagactacacttagctgtggtggacgcttgtggttcgatcgaccttgtgaagaagtgtgaccgacacatccgaactgtatttaagttttaccagtcatctaataaacggctgaacgagctgcaggaaggagctgccccattggagcaagagatcattagactcaaggacctaaatgcggtgcgctgggtagctagtcgaaggcgcaccctccatgcattactcgtgtcgtggcctgccctggctcggcacttgcagagggtggccgaggcaggcggccagatcgggcaccgcgccaagggcatgttgaagctgatgcggggctttcatttcgtcaaattttgtcattttctattggattttctctcgatctaccggcccctgtctgaagtctgccagaaggaaattgtgctgatcaccgaagtcaatgctaccctagggagggcttatgtcgccctggagagccttaggcaccaggcggggccgaaggaagaagagttcaacgcatcttttaaggatggaagattacatgggatctgcctggacaaactcgaggtcgccgaacagagattccaggcggatagagaacggaccgttcttaccgggatcgagtatctccagcagcgcttcgacgcagatcggcccccacagctgaagaatatggaggtgttcgatactatggcgtggccttctgggattgaactggctagttttggaaacgatgatatcctcaatctggccagatattttgagtgttctcttcctactgggtactcagaggaagccctgttagaagagtggctgggcttaaaaacgatcgcgcagcacctgcccttttctatgctctgtaaaaacgcgctcgcgcagcattgtcgattcccattactttctaagttaatggccgtggtggtgtgcgtgccaatctcgacttcctgctgcgaacgcggctttaaggcaatgaaccgtatccgtacagacgaaaggaccaaactgtctaatgaagtgttaaacatgctgatgatgacagccgttaacggcgtggccgtaacggagtacgatccccagcccgcaatacagcactggtacctgacctctagcggtcggcgattctctcacgtttacacttgcgcgcaagtgccggcacgaagcccggcatcagcaagattgcggaaggaagagatgggagctctatatgtagaggaacccagaacccaaaaaccacccattctgccttcccgcgaggccgctgaggtactgaaggattgcattatggagcctcctgagaggctattgtaccctcacacttctcaagaggcacccggcatgtcctag

SEQ ID NO: 194868 - DNA, 981 bp, Artificial Sequence
  Description of Artificial Sequence: Synthetic coding sequence
atgcgggagtggtgggtgcaggtgggcctgctggccgtgcccctgctcgctgcttatttgcatatcccgcccccacagctctctcctgcactgcattcctggaaatcctcagggaaattctttacctacaagggcctcagaatcttttaccaggatagcgtaggggttgtggggagccccgaaattgtggttttgcttcatggctttcccacttccagctatgactggtacaaaatttgggagggactgactctcagatttcatagggtcattgctctcgactttttaggattcggcttttcggataaaccacgtccccaccactattccatcttcgaacaggcctcaatcgtggaggccttactgcgacatttgggtcttcagaataggcggattaacctgctgtcccatgactacggcgacatcgttgcccaggagctcctctatcgctacaaacaaaatcgtagtggtcggctgactattaagtccttatgtctctccaacggtggaatcttccccgaaacacaccgtccactactcctgcaaaagttgctcaaagacgggggggttctgtctccgattctgactaggctgatgaatttttttgtattctcaagaggcctgacccctgtgttcggaccgtacacaaggccctcagaatctgaattgtgggacatgtgggcaggaattcggaacaatgatgggaacctggtcatagattctctgctccaatatattaatcagcggaagaaatttaggcgacgttgggtcggggcactggcaagcgtcacaatcccaattcatttcatctacggtcctctggatcctgtgaatccttatcccgaattccttgagctgtataggaaaaccttaccccgcagcacagtcagtatactggacgaccacatttcacattaccctcaacttgaagacccgatgggttttcttaacgcgtatatgggcttcatcaattcattttag

SEQ ID NO: 194869 - DNA, 981 bp, Artificial Sequence
  Description of Artificial Sequence: Synthetic coding sequence
atgcgggagtggtgggtgcaggtgggcctgctggccgtgcccctgctggccgcatatctgcatattcccccgcctcagctcagtccggcattgcattcttggaagtcaagcggcaagttctttacttacaaaggtctgaggattttttatcaggactcggtgggcgttgtggggagcccagaaatagttgtcctgctgcacggcttccccacaagcagctatgactggtataaaatctgggagggattgacactcagattccatcgggtgatcgcgctcgactttctcggctttggattttccgacaagccaagacctcaccattattccatctttgagcaagctagtatagtggaggccctactgagacacctgggtctgcagaaccgccggataaatctgctgagccacgactacggcgacatcgtagcgcaggagctgttgtaccgatataaacagaaccgcagcggcaggctaacaatcaagagcctgtgcctgagtaatggcggaattttccctgagactcatcgtcccctcctcctgcagaaactcctgaaagatggcggtgtgctgtcccccatactgacgcggctgatgaacttcttcgtgttctcaagagggctgacacccgtatttggcccatatacacggcctagtgaaagcgaactttgggatatgtgggcaggaattcgcaataacgacggtaacctcgttattgattccttgttgcagtatatcaatcagagaaagaaatttaggcgcagatgggtgggcgcacttgccagcgtgaccatcccaatacacttcatttatgggcctttggatcccgtgaatccataccctgagtttctggaactctacaggaagaccttgcctagatctacggtaagcatcctggatgatcatattagtcattatccccagttggaagatcctatgggattcttaaacgcttatatggggtttattaactccttctag

SEQ ID NO: 194870 - DNA, 357 bp, Artificial Sequence
  Description of Artificial Sequence: Synthetic coding sequence
atgcgggagtggtgggtgcaggtgggcctgctggccgtgcccctgctagccgcatatctccatatccctccaccccaactctccccggccttacacagttggaagtcttcaggaaagttcttcacctacaagggattaaggatcttctatcaagacagcgttggagtagttgggtctcccgagatcgtggtcctgctccacggatttcccacatctagctatgactggtacaagatttgggagggcctcacactgcgttttcaccgcgtcatcgctcttgattttctgggatttggcttcagcgacaaaccacgtccacatcactactcaatattcgagcaggcatccattgtatag

SEQ ID NO: 194871 - DNA, 624 bp, Artificial Sequence
  Description of Artificial Sequence: Synthetic coding sequence
atgcgggagtggtgggtgcaggtgggcctgctggccgtgcccctgctggccgcttatctacatattccccccccacagctatctccagcactccactcctggaaatcatccggaaaattttttacatacaaagggctccgcattttttaccaggactctgtgggggtggtgggaagccctgaaatagttgtgctgctccatggatttcctacatcctcttacgactggtataaaatctgggagggcttgaccctgaggtttcaccgggttatcgctctcgacttcctgggatttggattttcggacaagccaagaccacatcattactcaatcttcgagcaggcatccattgtggaggccctgctccgccacttgggactacagaaccggagaattaatctgttatcacacgactacggagatatagttgctcaggaactgctttatcgatataagcagaataggtccggtagactcactatcaagagtttgtgtctcagcaatggtggcatattcccggaaacgcatcggcctctgttgctgcagaaactgctcaaggatgggggcgtgttgagcccaatcctgaccaggttgatgaacttttttgtgtttagccgtggctag

SEQ ID NO: 194872 - DNA, 483 bp, Artificial Sequence
  Description of Artificial Sequence: Synthetic coding sequence
atgcgggagtggtgggtgcaggtgggcctgctggccgtgcccctgctggctgcgtacctccacatccccccaccccaactaagcccagcgttacactcttggaaatcatctggcaaattcttcacatacaaggggttacgtatcttctatcaagatagcgttggagtggtggggagcccagagatagttgtgttgctccatgggtttcccacttccagttacgattggtacaaaatctgggaaggccttactctgcggtttcaccgagtcatcgcactggacttcctgggcttcggattctcagacaaaccaagaccccaccactacagtatcttcgaacaggctagtattgttgaggctctactgcgccatctgggactgcagaatagaagaattaatttattgtcccacgattatggggacattgtggcccaggaactgttgtaccgatacaaacagaaccgcagcggcagactgacctag

SEQ ID NO: 194873 - DNA, 384 bp, Artificial Sequence
  Description of Artificial Sequence: Synthetic coding sequence
atgcgggagtggtgggtgcaggtgggcctgctggccgtgcccctgctggcggcctacctgcatatcccaccgccacaactttcccctgccctgcatagctggaaatctagcggaaagtttttcacctacaaaggcctccgcattttttatcaggattctgttggcgtagtgggctccccagaaattgtggtactcctgcacggatttcccaccagctcttacgattggtataagatttgggagggcctgacactaagatttcatagagttatcgctctggatttcttaggcttcggattcagcgacaagccacgaccacaccactatagcatattcgagcaagcctccattgtggaggcattgctgcgccatctgggcctgtag

SEQ ID NO: 194874 - DNA, 522 bp, Artificial Sequence
  Description of Artificial Sequence: Synthetic coding sequence
atgcgggagtggtgggtgcaggtgggcctgctggccgtgcccctgctggccgcctacctacacatcccacccccacagctgagcccggcactccacagttggaaaagctcaggcaagttcttcacgtataagggcctcaggattttctaccaggactcagtgggagtggtaggaagccctgagatcgttgttcttctccatggctttccaacttcttcctatgattggtacaaaatttgggaaggtctcacactgcgatttcaccgcgtgatcgcccttgacttcctcggcttcgggttttcagataagcctaggcctcatcactactcaatcttcgaacaggccagtatcgtggaagcgctgcttcgccatctggggttgcagaatagacggattaacctgcttagtcatgactatggcgacatcgttgcccaggagttgttgtaccgatacaagcagaacaggagcgggcgtctcaccatcaaaagcctctgcctcagcaacggcggtaattgcctttag

SEQ ID NO: 194875 - DNA, 879 bp, Artificial Sequence
  Description of Artificial Sequence: Synthetic coding sequence
atgcgggagtggtgggtgcaggtgggcctgctggccgtgcccctgctggcggcatacctacacatccctccaccccagttgagtccagcgttgcattcttggaagtcttctgggaagtttttcacctacaaaggcctgagaatcttttatcaggactctgtcggtgtggttgggagtccagaaattgttgtgctgctccatgggttccctaccagctcttacgattggtacaaaatctgggagggcttgacattgcgattccatagggtgatcgcactagacttcctgggcttcggtttcagcgacaagccccggccgcatcattactccatcttcgagcaggcgtccatagtcgaggcacttctgaggcatcttggcctccagaacaggcgaatcaacctgttgagtcacgattacggtgacatcgtggctcaagagctgctgtacagatacaagcagaatagaagtggcaggctaacaattaagtcgctatgcctgtctaacggtggtatttttcccgagacccatcgcccattgctcttacaaaagctcctcaaagatggaggcgttttgtctccaatcctgaccaggctgatgaacttctttgtgtttagcaggggactgttgcaatatattaatcaacggaaaaagtttagacgtcgttgggtcggagctttagccagcgttaccattccaattcactttatatacggccccttggacccggttaacccttatccggaattcctcgagctctacaggaagactttaccgcgctctacagtctctatcctggatgatcacattagtcactacccccagctggaagacccaatggggttcctgaacgcgtatatggggttcataaattctttttag

SEQ ID NO: 194876 - DNA, 879 bp, Artificial Sequence
  Description of Artificial Sequence: Synthetic coding sequence
atgcgggagtggtgggtgcaggtgggcctgctggccgtgcccctgttagctgcttatttgcatatcccaccaccgcagctctctccagctcttcactcctggaagagtagtggtaagttttttacttacaaggggcttaggatattttaccaagacagtgtgggagtcgtcggtagcccggaaatagtcgttttgcttcacggctttcctacgtctagttacgactggtataagatctgggaggggctgactctgaggtttcatcgggtcatcgctctggattttctggggttcggattctccgataagccccgcccacaccactacagcattttcgagcaagccagtattgtagaggcactgctgcggcatctgggcctgcagaataggagaattaatctgctctctcacgactatggagacatcgtggcccaagagttgctgtatcggtataaacagaacaggagtggtcggttgacaatcaaatccctgtgtctcagcaacggtggaatctttccagagactcatcggccactcctcctccagaaactactgaaggacggaggtgttctttctcctatcctcacccgcctgatgaatttctttgtattttcgcggggcttgctgcagtatattaatcaaagaaaaaagttccggaggcggtgggtgggagctctcgcaagcgtgacaatcccaatccattttatctatggcccgctagaccctgtgaatccataccccgaatttctggagctgtaccggaagaccctgcccagaagcaccgtctctatcctggacgaccatatctcccattatcctcaactggaggacccaatgggattcctgaacgcctatatggggtttatcaacagtttctag

SEQ ID NO: 194877 - DNA, 582 bp, Artificial Sequence
  Description of Artificial Sequence: Synthetic coding sequence
atggacaacctgcgggagaccttcctgagcctggaggacggcctgggatcctctgactcacccggcctgctgagcagctgggattggaaggaccgcgctggcccattcgaactgaatcaggcaagccccagccaatcactgtccccggctccgagtttggagagctattcctcttcaccatgtcccgctgtggcagggttgccttgtgagcacgggggggctagctccggcgggtctgaaggatgctctgtcggtggtgcatccggcctggtggaagtggactacaacatgcttgccttccaacccacgcatcttcaggggggcggaggcccgaaagcgcagaaaggaactaaggtgcggatgtctgttcagcggcgccggaaagcctccgaaagggagaaactgcgaatgaggactctggccgacgccttgcacacgctgaggaactatcttccccccgtttatagccaaagagggcaaccactaaccaaaatccaaacattgaaatatactatcaaatatattggcgagctgactgacctgttgaaccggggaagagagccccgcgctcagagtgcctag

SEQ ID NO: 194878 - DNA, 1893 bp, Artificial Sequence
  Description of Artificial Sequence: Synthetic coding sequence
atggccctgcccaccgcccggcccctgctgggcagctgcggcacccccgctttgggctcattgctcttcctgctgttctctctgggatgggtccagccctccaggacactcgctggggagacaggccaggaagccgcccccctggatggagtgctggcaaatcctccaaacatctcaagcctgtcaccccgtcagctgcttggatttccttgtgcagaggtgtccggcctcagtacagagagagtgagagagctggccgtggctctagcccagaaaaacgtgaagctgagcaccgagcagctccgctgtttagctcacagactgagtgagccacccgaagacctggatgccctgccgctcgatttattgttatttctgaaccccgacgctttttctggacctcaagcttgcactaggtttttcagccgaattactaaggccaatgtggacctgctgccccgcggtgcacccgagcgccaaagattgctcccggccgcactggcctgctggggcgttcgagggtccctgttaagcgaggctgatgtgcgggcattgggcgggttagcatgcgacctgcccggtcgattcgttgctgagagtgccgaggtactcttacctagattagtaagctgccccggtcccctggaccaggaccaacaggaagcagctagagctgcattgcaggggggtggccccccttacggtccgccaagcacatggtccgtgagcaccatggacgccctcaggggcctgctgcccgttctgggccaacctattattaggtcaataccccagggcatcgtcgccgcctggcggcagagaagttcacgtgatccatcttggcgacagccggaaagaacaatcttaagaccccgcttccgtcgtgaggtagagaagaccgcttgcccttctggaaaaaaggctcgcgagatagacgaaagtctgatcttctacaagaagtgggagctggaggcctgtgtggatgccgccttgctagcaacacagatggaccgcgtcaatgcaattccattcacatatgaacagctggatgtgctgaaacataagttggacgaactgtatcctcagggctacccggagtcagtgatccagcacctaggctacctgttcttgaaaatgtctccagaggatattagaaaatggaacgttacatccctggaaaccctcaaagcgctcctcgaggtgaataagggtcacgaaatgtctccccaagctcctagacggccgttacctcaggtagcgactctcatagaccgatttgtgaaaggacgcgggcagctggacaaagacacactagacacgctgacagcattttatccagggtatctgtgtagtctgtccccagaagagctatcttccgtccccccctcttctatatgggctgtgagaccccaggatcttgatacgtgtgacccccggcagctggatgtcttgtatccaaaggccagactcgccttccagaacatgaatggttccgaatacttcgtaaaaattcaatctttcctcggcggagctccaactgaggatttaaaggccctcagtcaacaaaatgtgagtatggatctcgctacatttatgaaactcagaacagacgccgtgctcccactgacagtggccgaagtgcagaaactgctgggccctcatgttgagggcttaaaagccgaggagagacaccgtcccgtgcgtgactggatcttacgccaacgccaggacgatttagatacacttggcctcggcctccagggggggattcctaatgggtacctggtcctggacctgagtatgcaagaggctctgtccgggactccctgtttgctcgggcccgggccggtgctgactgtgctggccctgttgctcgcgtcaaccttggcctag

SEQ ID NO: 194879 - DNA, 1869 bp, Artificial Sequence
  Description of Artificial Sequence: Synthetic coding sequence
atggccctgcccaccgcccggcccctgctgggcagctgcggcacccctgcactgggaagcctcctgttcttgctcttcagtctcggctgggtgcagccaagcagaaccctcgccggagaaacaggccaggaggctgccccactggatggcgtgctggccaatcccccaaacattagcagcctctctcctaggcagctgttgggtttcccttgcgcagaggtgtccggactttctaccgagcgggtgagggagctggccgtagccctggcccagaaaaacgttaaattgagtaccgagcagctgagatgcttggcacaccgactcagcgaaccacccgaagatttggacgcgcttcccctcgaccttctcctattcctcaatccggacgccttctcgggaccccaggcctgtactcgcttcttcagcaggattacaaaagccaatgtcgatctactccctcggggagctccggaacgccaacgcctgctacctgcagcactggcttgctggggggtgcgtggctctctcctgagtgaagccgatgtacgggcactagggggtttggcctgtgatctgcccggcaggtttgtcgctgagagcgccgaggttttactaccccgactagtgagctgcccaggccccctggaccaggatcagcaggaagccgctcgggctgcattacagggcggcggcccaccatacggaccaccctctacatggtcagttagcaccatggatgctcttcgtgggttactgcccgtgttgggacagcccatcattaggagcatccctcagggtattgtggctgcatggcggcagagatcatctagggacccttcttggagacagcccgaaagaacaatactaagacccaggtttcgcagggaagtggagaaaacagcctgcccaagcggtaagaaggccagagagattgatgaatctctgatattttataagaagtgggaactcgaagcctgcgtagacgcagccctcctggccactcaaatggacagggttaacgctatcccctttacgtacgaacaactcgatgtcctcaagcataaactagatgagctgtaccctcagggctatccggaaagtgtgattcagcacctggggtacctatttctgaagatgagtcctgaggatatcagaaagtggaatgtcacatccctggaaaccctgaaagcgctactggaagtgaacaaaggtcacgagatgtctccgcaagtggctactcttattgatcgcttcgtgaagggcagagggcagctcgataaagacactctggatacactgaccgccttctaccccggatatctgtgctcattaagccctgaagaactgagcagcgtccccccctcgagcatctgggccgtgcggccacaagacctggatacctgtgatccgcggcaactggacgttctctatcccaaagctcgcctggccttccaaaacatgaacggatcagagtattttgtgaaaattcaatcgttcctcggaggggctccgacagaggaccttaaagccttgtctcaacaaaatgtgtctatggacctggccactttcatgaaactgcgtaccgacgcggtgcttcctttgaccgtggccgaagtccaaaagttactcggaccacacgtggaagggctgaaagccgaggaacgccaccgccccgtgcgggactggatactgcgacagcgccaagatgatcttgatactcttgggctgggtctgcagggggggattcccaacggttacctggtcctggacttgagtatgcaggaagcactgagtgggactccttgcctactcgggcctggaccggtgctgaccgtgctcgctttgttactggcgtcgactctcgcatag

SEQ ID NO: 194880 - DNA, 1893 bp, Artificial Sequence
  Description of Artificial Sequence: Synthetic coding sequence
atggccctgcccaccgcccggcccctgctgggcagctgcggcacccctgccctgggcagcctgctatttctgctgttttcactgggctgggtgcagccaagccgcactttagctggggagactgggcaggaggcagctcccctggacggagtgctggcaaacccgcctaacattagctccctgtctccccgacagctcctaggatttccttgcgcggaggtgtccggtctcagtacggagagggtgagagagctagccgtagccctggctcagaagaacgtgaagctgagcaccgaacagctaagatgcctggcgcacaggctcagcgaaccaccagaagacctggatgccttgccgttggatttattactgtttctgaaccctgacgccttctcaggtccccaggcctgtaccagatttttttcacggatcactaaggccaatgtcgatctgctgccccgcggtgccccagaacggcagagacttttgcctgcagccctagcttgttggggtgtaagaggcagcctcttgtctgaagccgacgtcagagccctgggggggctggcctgtgatctaccaggtcgattcgtagcagaatcagcagaagtcctgctgccccgcctggtctcttgtcccgggccattggaccaggatcaacaagaagccgcgcgagcagcgctgcagggcggcggacccccctatggcccaccttctacctggagtgtgtccaccatggacgccttaagaggtctgttacccgttttggggcagcctatcattcggtcaattccccaaggaatcgtcgctgcatggcgccaacgatcgtctcgtgatccgtcttggaggcagccagagcgcaccatactgcgtcctcgcttccggagggaggtagagaagactgcttgcccctctggcaaaaaggcgagggagatcgacgaatctttgattttttataaaaaatgggaactcgaggcttgcgtcgacgctgctctcctcgccacgcagatggacagagttaatgcaataccatttacctatgagcagctagacgtcctcaagcacaagctggatgaactgtacccccagggatacccagaatccgtgattcaacatctgggatacttgttcctgaaaatgagcccagaagatattcgcaaatggaatgtgaccagtctcgagactctaaaggcactccttgaggtgaataaaggccatgagatgtcaccacaggccccgagacgacccctgccacaagtagccactctcatagaccgattcgtgaagggcagaggtcagctggacaaggacacactcgataccctgacagccttctatcctggctacctctgttctctcagtcccgaggagctcagcagcgttcccccctcttccatatgggcggtgcgaccacaggaccttgatacttgtgacccccggcagttggacgttttgtacccaaaggcccgactggcgttccagaacatgaatggctccgaatatttcgtgaagatacagagcttcctcggtggcgcccccaccgaggacttaaaggctctcagtcagcaaaacgtgtcaatggatctcgccacatttatgaaattaaggaccgacgcggtgctcccccttacagtggccgaagttcagaaactgctcggaccgcatgttgagggcctgaaagccgaggaacgacacaggcccgttcgggactggattctccggcagcggcaagatgacctcgataccctcgggctcggcctccagggcggtattcctaacgggtacctggtgttggatcttagcatgcaggaagcattaagcggaactccctgcctgctgggccccggtcccgtcctcacagtccttgctctgcttttggcctccactctggcatag

SEQ ID NO: 194881 - DNA, 1869 bp, Artificial Sequence
  Description of Artificial Sequence: Synthetic coding sequence
atggccctgcccaccgcccggcccctgctgggcagctgcggcacccctgctctgggatccctcctgttcctgctgttctccttgggttgggtgcagccttcacgcaccttggcaggcgagaccggacaggaagctgctcctctagacggggtgcttgctaaccctccaaacattagcagcctgagcccgagacagctgctgggtttcccttgcgctgaagtgagcggcctcagcacggaaagagtgagggagctcgccgttgcccttgctcagaaaaacgtgaagcttagcaccgagcagcttagatgtctggcccatcgactcagtgaaccccctgaagatctggatgccctccctctggacctgctcctgtttctgaatcctgacgctttttctggcccccaggcctgtacacgcttttttagccggatcaccaaggccaatgtggacctgctgccccggggcgcccccgagcggcaacgattgctgccagcggctctggcgtgctggggagtgcgcggatcccttttgagcgaagccgacgtgcgagctctgggcggcctggcgtgtgatctgccaggacgctttgtggcggaatctgccgaagttctcctccccaggctcgttagctgtccaggaccactcgaccaggatcagcaggaggccgcccgggcggcgcttcaggggggaggccctccttatggtcccccctctacctggtctgtgtccaccatggatgcattacggggactgctcccagtgctcggacagccaattatccgatccattccgcaggggatcgtggcagcttggcgccagaggtcgtctcgcgatccctcctggcggcagcctgagcgcaccattttgagacccagatttagaagagaggtggagaagacagcctgccctagtggaaagaaggccagggaaatcgatgagtcccttatcttttataaaaaatgggagttggaagcctgtgtcgatgcagcactgctggccactcagatggaccgggtcaatgctattccgtttacctatgagcagctggacgtgctaaagcacaaacttgatgaactgtacccccagggatacccagagagcgtcattcagcacctgggctatttgttcctgaagatgtctcccgaggacatcagaaagtggaatgttaccagcctggaaacattaaaggctttgctcgaggtcaataagggccacgagatgtcaccccaggttgccacgctgatcgacagatttgttaaaggccgaggccagcttgacaaagacactctggacacactgactgccttctatcctggatatctgtgctctttgtctcctgaggagctgtcttccgtgcctcccagttccatctgggcagtgcgcccccaggatctggacacttgtgaccctcgccagcttgacgtgttgtacccgaaagctcggttagctttccagaacatgaatggatccgagtacttcgtgaagatacagtcatttctgggtggcgctccaaccgaggacctgaaggctcttagccaacagaacgtgtctatggacctggccacttttatgaaactaagaacagacgccgtgcttcctctcactgtcgcggaagtacaaaagctgctgggacctcacgtcgaaggcctgaaggccgaggagaggcatcgacccgtccgcgactggatcttacgccagcggcaggatgacttggacacactgggccttggactgcagggcggcattccaaatggctacttagtacttgatctgtctatgcaagaggcactttccggcactccttgcctgttagggccagggcccgtattgaccgttttagcactgctgctggcgagcacactcgcctag

SEQ ID NO: 194882 - DNA, 1869 bp, Artificial Sequence
  Description of Artificial Sequence: Synthetic coding sequence
atggccctgcccaccgcccggcccctgctgggcagctgcggcacccctgccctgggttctctcctcttcttgttgtttagccttgggtgggttcaaccgtccaggaccttggcgggcgaaacagggcaagaagctgccccccttgatggggttctggcgaaccctcccaatatctcgagcctgagccctcgccagctgcttggctttccttgcgccgaggtgtcagggttgtccacagaacgggtacgggagttagccgtcgctctcgctcagaagaacgtgaaactgtctacggagcagcttcgctgcttagcccaccgcctgagtgagcccccagaggatttggacgcgctcccgctcgatctgctgcttttcttgaaccccgacgctttctctggccctcaggcgtgcacaaggttcttttcaaggatcacaaaggccaacgtggacttgttgcctagaggggcccccgagagacagagactgctgccagccgccttggcatgttggggggtacgggggtccctgctatcagaagcagacgtgagagcgctcggggggttggcgtgcgaccttcctggcagatttgtagctgagtcagctgaggtgctgttgccccgcctagtgtcgtgcccagggcctctggatcaggatcaacaggaagccgccagagcggctctacagggcgggggcccgccctacggcccccccagtacttggtctgtcagtaccatggatgcactgcgcggacttctaccagtcttagggcagcctataatcagatctatcccacaaggcattgttgccgcatggcgtcagcgttcaagcagggatccttcatggcgccagcccgaaaggacaatactgcgtcctcggttccgacgggaggtagagaagaccgcctgtccctcaggaaagaaggccagagaaatagatgagtcccttattttctataagaaatgggaattagaagcctgcgttgacgccgccttgctcgcgacgcagatggaccgtgtgaatgccattccatttacctacgagcagctagatgttctgaaacacaagctcgacgagctttaccctcagggctaccccgagtctgttattcagcacctggggtacctgtttctcaagatgagccccgaagatataaggaaatggaacgttactagcttagagacccttaaggcattgctggaggtgaataaaggtcatgagatgtcccctcaggtggctacgttgatcgatcgcttcgtgaagggtagggggcagctcgataaagatactttggatactctcacggctttttatcccgggtatttgtgtagcctcagtcctgaggagctaagtagtgtccctccaagttcgatctgggcagtgaggcctcaggacttggatacatgtgatccccggcagctggacgtgctgtaccccaaggcccgactcgcctttcaaaatatgaatgggtccgaatatttcgtaaagattcaatctttcttaggcggcgctccaaccgaggacctcaaagccctcagccagcaaaatgtatccatggacctagcaactttcatgaagctaaggacggacgcagtcctcccactcaccgtcgctgaggtccagaagctgcttgggccccacgttgaggggttgaaggctgaagaacgccaccgcccagtcagagattggatcctccgccagagacaggatgatctcgatacacttggtctggggcttcaaggcggaatccccaatggctacctggtactcgacttaagtatgcaggaggctctgagcggtactccttgtcttctggggccagggcccgtcctcacagtgctggctctgctgctagccagcaccttagcctag

SEQ ID NO: 194883 - DNA, 1782 bp, Artificial Sequence
  Description of Artificial Sequence: Synthetic coding sequence
atgcgggacagcaccggcgccggcaacagcctggtgcacaagcggagtccactcagaaggaatcagaaaactcccacgtcgctgaccaagctgtccctgcaggacggacacaaggcaaagaaacctgcttgcaaattcgaggagggtcaagacgtcctggcccggtggagtgacggactgttctacttgggaacaattaaaaagatcaacattctgaagcagtcatgctttattatcttcgaggattcttccaagtcatgggttctatggaaggacatccagacaggcgccactggaagcggggaaatggtgtgtaccatctgtcaagaagagtattctgaggcgccaaatgaaatggtcatttgtgacaagtgcggacagggctatcaccagctctgccacactccacatattgattgttcagttatagatagtgatgaaaaatggctgtgcaggcaatgcgttttcgccactaccacaaagagggggggcgcattaaagaaaggccccaacgctaaggccctccaagtgatgaaacagacactgccatattcggtggcggacctcgagtgggatgccggtcacaaaaccaacgtccagcagtgttattgttactgcggcggccctggtgattggtacttgaagatgctccaatgttgtaaatgtaaacagtggttccatgaggcctgtgtccaatgtcttcagaaacccatgctgttcggggatcggttttacacctttatttgttccgtgtgtagctccggcccggagtacctgaaaagattacctctgcagtgggtagatatcgcccacctgtgtctgtacaacctttctgtgatccacaagaagaagtacttcgactcagagctcgaactcatgacatatatcaatgaaaactgggaccggctccacccaggggagctagctgacacccccaaatctgagaggtatgaacatgtgctggaggcacttaatgattataagacgatgttcatgtccggaaaagaaattaagaagaaaaagcatctctttggactcagaatccgtgtaccccctgtgcctcctaacgtggcctttaaggcagagaaggagcccgagggaacttcgcacgaatttaagatcaagggacgcaaggcttctaagccaatcagcgattctcgggaggtgtccaatggtatcgagaaaaagggcaagaagaagagcgtgggcaggccaccgggcccttacacgcgaaagatgatccaaaagaccgccgaaccactcttagataaggagtctatttccgaaaaccccacattagaccttccctgtagcatagggagaactgagggaacagcccattcaagcaacactagtgatgtcgattttacgggagcctcgtcagcaaaggagaccaccagttcatccatatccagacactacggactcagcgacagtcgcaaacgaactaggactggccgctcttggcctgctgcgattccacatctgcgccggaggcgcggtagactccctagacgcgccctgcagacccagaactctgagattgtaaaggacgatgagggcaaggaagattaccaattcgacgaattaaatacagagatcctgaacaacttagccgaccaggagctgcaactgaatcacctcaagaattccataacatcttatttcggggcggctggaaggattgcttgcggagagaagtaccgcgtgttggcgcggcgggtgactctggacggaaaggtgcagtacctggtggagtgggaaggcgcaaccgccagttag

SEQ ID NO: 194884 - DNA, 1611 bp, Artificial Sequence
  Description of Artificial Sequence: Synthetic coding sequence
atgcgggacagcaccggcgccggcaacagcctggtgcacaagcggagtccactgcgccggaaccagaagacacctacgagtctcactaaactcagcctccaggatggacacaaggctaagaaaccagcttgcaaatttgaagaaggtcaggatgttctggcccggtggagcgacggcctgttttatttaggcaccatcaagaagatcaatatcctcaaacagtcttgtttcatcatcttcgaagactcctctaagtcctgggtgctttggaaggatatccaaactggtgctacaggcagcggagagatggtgtgcacaatttgccaagaagagtacagcgaggccccaaacgaaatggtgatttgtgacaagtgtggacagggctaccaccagctatgccatacaccgcatatagactgttccgttattgactccgatgaaaaatggctgtgccgccagtgcgtgtttgccaccacaactaagcgcggaggcgcacttaaaaaaggtcccaatgccaaagccttgcaggtcatgaaacaaactttgccatacagtgtggctgacttagaatgggatgcaggacacaagacaaacgttcagcaatgctattgctattgcgggggccctggcgactggtatctgaaaatgcttcagtgttgtaaatgtaagcagtggtttcacgaggcctgtgtccagtgtctccaaaaaccaatgctgttcggggatcgcttctatacttttatatgcagcgtgtgctcttctggtcctgagtatctcaagcggctgcccctgcagtgggtggacatagctcacctctgcctgtacaacttatcagtgatccataagaagaaatactttgatagcgagctggagctcatgacctatattaacgagaactgggatcgtctgcatcctggcgaactggcagacacgccaaagagcgagcgctacgagcatgtcctagaggcattgaacgactataagacaatggaagtgagcaacggtatagaaaaaaagggaaagaaaaaaagcgtgggtcggccccctggaccttacactcgcaaaatgatccagaaaacagctgagcctctcctggataaagagtctatctctgagaacccgactctggatctaccctgtagcataggtcgaacggagggcaccgctcattcttctaataccagtgacgtggattttactggggcttcatccgcaaaggagacgacaagttcttccatctctcgccactatggactgtctgacagtcgcaagcgaaccagaacgggccggagctggcctgctgctattcctcatttgaggagaaggaggggccggcttcctcggagggccctccagactcaaaatagtgagatcgtgaaggacgatgaaggcaaagaggattatcaattcgatgagttaaacaccgaaatcctgaacaatcttgctgaccaggagctgcaacttaatcatctcaaaaattctattacatcgtacttcggtgcagcaggacggattgcctgtggagaaaaatatcgcgtcctcgcccgcagagtgaccctcgatggtaaagtgcagtatctggtggaatgggaaggggccaccgcctcatag

SEQ ID NO: 194885 - DNA, 861 bp, Artificial Sequence
  Description of Artificial Sequence: Synthetic coding sequence
atggtgtgcaccatctgccaggaggagtacagcgaggcccccaacgagatggtgatttgtgataagtgtggacaggggtatcaccaattgtgtcacaccccacatatcgattgcagcgtaattgactccgatgaaaagtggctttgtcgccaatgcgtctttgctactaccacgaagcgtggcggagccctcaaaaagggcccaaacgctaaagcgctgcaagttatgaaacagactctgccctacagtgttgccgacctggagtgggacgctgggcataaaacaaatgtgcagcagtgctactgctactgtggggggccaggcgactggtatctgaagatgttgcagtgctgcaaatgtaaacagtggtttcacgaggcttgcgtacagtgtctgcagaaaccaatgttgttcggagaccggttttacaccttcatttgcagtgtctgttcgagcgggcctgagtacttgaaacgcctcccgctccagtgggtcgatattgcccacttgtgcctctataacctcagcgttatacacaagaaaaaatacttcgattccgagcttgagcttatgacgtacattaatgaaaactgggacaggctgcatccaggcgagttggctgacactccgaaatctgagcgatacgaacacgtcctggaggcattaaacgactataagaccatgttcatgtccggtaaggagattaagaaaaagaagcatctgttcggactgagaatcagggttcctcccgtcccccccaacgtggccttcaaagccgagaaggagcccgaggggacatcacacgagttcaaattgaaggccgagcggcatccaaacctttacctgatccagggtaaatag

SEQ ID NO: 194886 - DNA, 1476 bp, Artificial Sequence
  Description of Artificial Sequence: Synthetic coding sequence
atggtgtgcaccatctgccaggaggagtacagcgaggcccccaacgagatggtaatctgcgacaagtgcggtcagggctatcatcagctgtgccacactcctcacatagattgtagtgtgatagattcagacgagaaatggctgtgcagacagtgtgtgtttgccacaacgacaaagagaggaggcgccctcaagaaagggcccaacgccaaggccctgcaggtgatgaagcagaccctgccatattcagtggctgacctggaatgggatgcaggccataagacaaacgtccagcagtgctactgctactgcggtggtccaggggactggtacctcaaaatgctccagtgctgtaaatgcaaacaatggtttcacgaagcttgtgtgcagtgcctccagaagcccatgttgttcggggatagattctatactttcatttgtagcgtgtgttcatccgggcctgaatatctcaagcgtcttcccttacagtgggtagacattgcccatctgtgcctgtataatctcagcgtcatccacaaaaagaagtactttgattctgagcttgagcttatgacctatatcaacgaaaactgggaccggcttcaccccggcgaactcgcagacaccccaaaatccgaaagatatgagcacgtcctcgaggcccttaacgactacaagaccatgttcatgagtgggaaagagatcaagaagaaaaagcatctatttgggctgagaatacgcgtgcccccagttcctcctaacgtcgcctttaaggcagagaaagaacccgaagggacaagccatgaattcaagatcaaaggacgcaaggcttccaagcctatctcagactctagagaggtgtcaaacgggatcgaaaagaaagggaagaagaaaagcgtcgggcggcctcccggcccttacaccagaaaaatgatacagaagactgccgaaccgctcctggataaggaaagcatttctgagaatccaacactggatctgccttgctctattggacgcactgagggcaccgcccactcaagtaacacaagtgatgttgactttaccggcgccagttccgccaaagagaccactagttcaagcatctctcggcattacggcctgagtgatagtcggaagagaacacgcacggggagaagctggccagccgcaatacctcacctccgccggaggagaggcaggttgccgcgtcgcgccctccagacccagaactctgagatcgtgaaggacgacgaagggaaggaggattaccagttcgatgaactgaacaccgagattctgaacaacctggcggatcaggagctgcagctaaatcatctgaagaactccatcacaagctatttcggcgccgcaggtcgcatcgcgtgcggcgagaagtaccgggtgctggccagaagggtgactctggacgggaaggtacaatacctcgtggaatgggaaggagccaccgcttcttag

SEQ ID NO: 194887 - DNA, 1476 bp, Artificial Sequence
  Description of Artificial Sequence: Synthetic coding sequence
atggtgtgcaccatctgccaggaggagtacagcgaggcccccaacgagatggtgatctgtgataaatgtggacagggttatcaccagctatgtcacactcctcatattgattgttctgttattgattcagatgaaaaatggttgtgtagacagtgtgtcttcgccactacgaccaagcgcggtggggctcttaagaaaggaccaaacgccaaggctttacaggtcatgaaacagactttaccgtattccgtagctgatctggaatgggacgccggccataagaccaatgttcagcagtgttattgctactgtggcggaccaggcgattggtatctgaaaatgctacagtgctgcaaatgtaagcagtggttccatgaggcttgtgtgcaatgtctgcagaaacctatgttgttcggagacagattctacactttcatctgctctgtgtgcagctcaggccccgaataccttaagcggctacccctacaatgggtggatatcgcacatctgtgcctgtataatctttcagtgatccacaagaaaaaatatttcgactccgagttggagcttatgacctacattaatgaaaactgggataggctgcatcccggtgagcttgcggatactccaaagagtgagaggtacgagcatgtcctggaggcactaaatgactataagacaatgttcatgtccgggaaagaaattaagaagaagaaacacctgtttgggctgaggatacgagtccctccagtcccgcctaacgtggcttttaaggccgaaaaggaaccagaaggcacatcacatgagttcaaaataaaaggtagaaaagccagtaagccaattagcgattccagagaagttagcaatggcatcgaaaagaaaggaaaaaaaaagagcgtcggtcggccccccgggccctacacccggaagatgattcagaagaccgcagagcctctactagacaaggagagcatcagcgagaaccctacactggatttgccttgtagcattggtaggaccgaaggcactgctcattccagcaatacgtcagacgtggattttacaggtgccagctccgctaaagaaacgactagctcaagtatctcgcgacattatggattgtcagacagtaggaagcgcacaaggactggcaggtcctggcctgcggcaatccctcacctgagacgacgacggggaaggttgcccaggcgggctctgcagacccagaattcggaaatcgtgaaggacgacgagggcaaggaggattaccaattcgacgagctgaacaccgagatcctgaacaacctggctgaccaggagctccagttaaaccacctgaaaaactccataaccagctacttcggagccgccggacgtatcgcctgtggagagaagtacagggtgctggccaggagggttacgctagatggaaaggtacagtacctggtagaatgggaaggcgccactgcatcttag

SEQ ID NO: 194888 - DNA, 1191 bp, Artificial Sequence
  Description of Artificial Sequence: Synthetic coding sequence
atggccatgatcgagctgggcttcggccggcagaacttccaccccttaaaaaggaaaagttcactcctcctgaagctgatcgccgtagtttttgctgtgctgctgttctgcgaatttctcatctactacttggccatttttcagtgcaattggcctgaagtgaagactacagctagcgacggcgaacagactacccgggagccagtacttaaggccatgtttctggctgatacccacctgcttggagagtttctaggccattggctggacaagctgaggcgggagtggcagatggagagagctttccagacggccctctggcttttacagcccgaagtagtttttatcttaggggacatttttgatgaagggaagtggtcaacacctgaagcttgggcagatgacgtagagaggtttcagaagatgttccgccaccccagtcacgtgcagctcaaagttgtggccggtaatcacgatattggattccattacgagatgaacacctacaaagtggagcgcttcgagaaggtgttttcatccgagcgcctgttttcctggaagggcatcaacttcgtcatggtgaacagcgtggccttgaatggcgacggttgcggcatttgctccgagaccgaggccgagttgatagaagtttcacatcgactgaactgttcccgggaggctcggggctccagtaggtgcgggccagggcccctgctccccaccagcgcccctgtcctactccagcactatcccctttatcgtcgcagcgacgctaactgcagcggcgaagacgctgcccccgccgaagagcgagatatcccgttcaaagaaaactatgatgtgttatcccgggaggccagccagaagttgctgtggtggctccagcctcgtctagtattaagcggtcacacacatagcgcttgtgaggtgcatcacggagggagagtaccagaactttctgtcccatcattttcttggagaaaccggaataaccctagtttcattatgggctcaattacccctacggattacaccttgagtaagtgttatctcccgcgcgaagatgtcgtgctgatcatttattgcggggtggtcggctttcttgtggtgctgactctcacccattttggtctcctagctagcccctttctctccgggctgaatctgctgggaaagaggaaaacgagatag

SEQ ID NO: 194889 - DNA, 1002 bp, Artificial Sequence
  Description of Artificial Sequence: Synthetic coding sequence
atggccatgatcgagctgggcttcggccggcagaacttccaccccctgaagaggaaatcaagcctcctgctgaaactgattgccgtagtttttgcagttcttctcttctgtgaattcctaatttactatctcgcgatttttcaatgcaattggccagaagttaagaccacggcttcagatggggagcaaaccacaagggagcccgtactcaaagctatgtttctagcagacacacacctgcttggggaattcctggggcattggttggataaactgcggagggagtggcagatggaacgagcattccagactgcgctgtggttactgcagcccgaagtggtgtttatcctaggcgacatcttcgatgagggcaagtggtcaactcccgaagcgtgggcagacgacgtcgaacggtttcaaaagatgtttcgacatccttcgcacgtgcaactgaaggttgtcgctggcaatcatgatatcgggttccactatgagatgaatacatataaggtggagcgctttgagaaagtctttagctccgagaggctgttttcatggaagggaattaatttcgtcatggtgaactctgttgcattaaacggggacggatgcggtatctgttccgagaccgaagctgaattgattgaggtttctcatcgtttaaactgctctagagaactcttgtggtggttgcagcccagattggtgctgtccggtcatacgcactccgcctgtgaagttcaccatgggggccgggtgcctgaactgagtgtgccatccttttcctggagaaacagaaataatccgagttttatcatgggcagtatcactcccacagactataccctgagcaagtgctatctgcctagggaggatgtggtgttgatcatttattgcggggtggtgggatttcttgttgtgcttaccttgactcacttcgggttgctggcaagcccctttttgtctgggctgaatcttctagggaagagaaagactcggtag

SEQ ID NO: 194890 - DNA, 732 bp, Artificial Sequence
  Description of Artificial Sequence: Synthetic coding sequence
atggagcgggccttccagaccgccctgtggctgctgcagcccgaggtggtgttcatactgggcgacattttcgacgaaggtaagtggagtacacctgaggcctgggcagatgacgttgagcgcttccagaagatgttccgacatcctagccatgtgcaactcaaagtcgtcgctggcaatcacgacattggattccactacgaaatgaacacgtacaaggttgaacgatttgagaaagtctttagttctgagagactgtttagctggaagggcattaattttgtcatggtgaacagtgtcgccctgaacggagacggctgtggtatctgttcagaaaccgaagctgagctgatcgaggtctcccatcggctcaactgctcaagggaagcacgcgggtcctcccgctgtggccccggtccccttttgcccacaagcgccccagtcctccttcagcactaccctctgtaccgccggagcgatgccaattgctccggcgaggacgccgctccagcggaggaacgggacattccattcaaagaaaattacgatgtgctgtcgagagaggctagccagaaactactctggtggttgcaacctaggctggtgctgagtgggcacacacacagcgcctgtgaggtccaccacggcgggcgtgtcccggaactctctgtcccttcattcagctggagaaaccgaaacaaccccagtttcataatgggtaccgatgcatag

SEQ ID NO: 194891 - DNA, 1194 bp, Artificial Sequence
  Description of Artificial Sequence: Synthetic coding sequence
atggccatgatcgagctgggcttcggccggcagaacttccaccccctgaagagaaagtcatctctcttactgaagctgatcgcggttgtcttcgcggtgctgctgttttgtgagttcttgatttactacctcgccattttccagtgcaattggccggaggtcaagaccacagcctccgacggtgagcagaccacgcgcgaacccgttctgaaggccatgtttctggctgatacacacctccttggcgagttcctgggtcactggcttgataaacttcgcagggagtggcagatggagcgagctttccagacagcactgtggctgttgcagccggaagtggtcttcattctaggggatatctttgacgaggggaaatggtccaccccggaagcctgggccgacgacgtggaaaggtttcagaaaatgtttagacatccatcacatgtgcaactgaaagtagtggcaggaaatcacgatattggcttccactatgagatgaatacttataaagtagagagatttgaaaaagttttctcctctgaaaggctgttctcatggaaaggaatcaacttcgtaatggtgaattctgtggcattaaatggcgacgggtgtgggatctgctccgagacagaggcagaacttatagaggtctcccacaggctcaactgctcccgtgagcaagcccggggcagttctagatgcgggcccgggccactgctccctacttccgcaccagtcctgctgcaacactatcctctgtaccgacggtccgacgccaattgctctggcgaggatgccgccccagccgaagaaagagacatcccttttaaggagaattatgacgtgctgtcacgcgaagcatctcagaagttactttggtggcttcaacccaggctggtgctgtccggacacacccacagtgcttgcgaagtccatcatggaggacgggtgccagagcttagtgtaccttcattctcttggcggaacaggaataatccttcattcatcatgggttctatcacgccaaccgactacactctgtccaagtgctatctgccaagggaagatgtagtccttatcatctactgcggagtggtggggtttttggtggtgctgacgctcacccattttgggctgctggcaagtccatttctaagcggcctgaatttattgggcaaaagaaagacacgttag

SEQ ID NO: 194892 - DNA, 1026 bp, Artificial Sequence
  Description of Artificial Sequence: Synthetic coding sequence
atggccatgatcgagctgggcttcggccggcagaacttccaccccctaaaacgcaagtcatcattgctgctgaaacttatcgccgttgtgtttgcggtactccttttttgtgaatttcttatatactacctagctatatttcagtgtaactggcctgaagttaaaacaacggcctctgacggcgaacagacaaccagagagccagttcttaaggctatgttcctggctgatactcacctcttaggcgaatttctgggacactggctcgacaagctgcgacgggagtggcagatggagcgcgccttccagacagctctgtggcttctgcagccggaagtggtgtttatcttgggagacatctttgatgaaggaaagtggtcaacacctgaagcgtgggccgatgacgtggaacggttccagaaaatgtttcgccacccaagtcacgttcaactcaaagtggtggctggaaaccacgacattggatttcactatgagatgaatacttacaaggtggagaggttcgaaaaggtgttctcttcagaacggttgttttcatggaaagggatcaactttgtaatggtaaattccgtggccttgaatggggacggctgtgggatttgcagtgagacggaagccgagctaattgaggtttctcatagactgaactgtagtcgtgagcaggcccgcgggtctagccgctgcggccctggccccctgctccctacatccgcccctgtcctattacagcactacccgctgtaccgaaggtctgatgccaattgctctggggaagatgcagctcctgccgaggagcgcgatattcctttcaaggaaaattacgacgtgctcagccgcgaggcttcccagaagctcctatggtggcttcagccaagattggtcttgagtggtcatacacacagcgcgtgcgaagtgcatcatggaggtagagtccccgagttatcagtcccatctttctcttggcgcaaccggaacaacccgagctttattatgggcacagatgcctag

SEQ ID NO: 194893 - DNA, 1191 bp, Artificial Sequence
  Description of Artificial Sequence: Synthetic coding sequence
atggccatgatcgagctgggcttcggccggcagaacttccaccccctcaaacggaagtccagtctgctcctgaaactgatagctgtggtgttcgctgtgctgctgttctgcgaattcctgatttactacctcgctatttttcagtgcaattggccagaggtaaaaacgactgccagtgacggagaacagacaactcgcgagccagtcctgaaggccatgtttctggcggatacccatctgttgggcgagttcctgggccattggctggacaaattgcgtagagagtggcagatggagcgcgcttttcagactgccctttggttgctacagccggaggtggttttcattcttggcgatatctttgatgaaggtaaatggtccaccccagaagcctgggccgacgatgttgaaagattccagaaaatgttccgccacccatcgcacgtgcagctcaaggtggtggccggcaatcacgacatcggatttcactacgaaatgaacacgtacaaggtggagcgttttgagaaagtgttttcttccgaaaggctgttctcatggaaaggaattaatttcgtaatggtgaattctgtcgccctcaatggagatggatgtggtatttgcagcgagaccgaagccgagcttattgaggtttcccacaggttgaattgttctagggaagcacgaggatcatccaggtgcggacctggccccctcttgccaacatcagcgccagtccttctccagcactaccctctctaccgccgaagtgacgcaaactgttccggggaagatgcagctcccgctgaagaacgggacatacccttcaaagaaaactatgatgtgctaagtcgcgaggcatcacaaaaactcctttggtggctacagcctcgcctcgttctgagcggtcacacccattccgcgtgcgaggtgcaccacggtgggcgcgtcccggagttgagcgttcctagtttctcatggaggaacagaaacaacccatcatttatcatgggcagtataacacccacagattatactctcagcaagtgctatctccctcgggaggacgtcgtgctgattatctactgcggcgtggttggctttttagtcgtcctgacacttacccatttcgggttgctggcctctccttttctctccggcttgaacctgctgggcaagcgcaagacacgttag

SEQ ID NO: 194894 - DNA, 360 bp, Artificial Sequence
  Description of Artificial Sequence: Synthetic coding sequence
atgtggcggagccggtgggacgccagcgtgctgaaggccgaggccctcgccctgcttccttgcggcttagggatggcatttagccagtctcatgtgatggccgctaggcgtcatcaacactcacggcttattattgaagtagacgaatacagcagtaatcctacccaggccttcacgttttataatattaaccagggaagatttcagccaccccacgttcagatggtggatccggtcccacatgatgctcctaagccccctggctatacgcgcttcgtatgtgtctccgacacacattcccgcaccgacccaatccaaatgccctacggcgatgtgcttatccacgccggagacttctag

SEQ ID NO: 194895 - DNA, 663 bp, Artificial Sequence
  Description of Artificial Sequence: Synthetic coding sequence
atgccctacggcgacgtgctgatccacgccggcgacttcaccgagctcggcttgcccagtgaagtgaagaagtttaacgaatggcttgggtctctcccatatgagtacaagatcgttatcgctgggaaccatgagttaaccttcgatcaggaattcatggccgatctgataaagcaggatttctattattttcccagtgtaagcaagctcaagccggaaaattacgagaatgtgcagtcactgttgaccaactgtatttacttacaggacagtgaggtcaccgtccggggcttccgtatctatggaagtccctggcagccctggttctacgggtgggggttcaacctcccgcgtggccaggcactgctggagaagtggaacctgattccagagggcgtggatatcttgattactcacggccctccactgggcttcctggactgggtgccgaagaaaatgcagcgcgtgggctgcgtggaactgctgaataccgtacagagaagggtccagcccagactgcacgtgttcggccacatacatgagggctacggggtgatggcggacggcaccacaacatatgtgaacgcctctgtctgcaccgttaactaccaacctgtgaaccccccaattgtaatcgatctgcctacaccaaggaacagttag

SEQ ID NO: 194896 - DNA, 981 bp, Artificial Sequence
  Description of Artificial Sequence: Synthetic coding sequence
atgtggcggagccggtgggacgccagcgtgctgaaggccgaggccctcgcactcttgccttgcggactgggcatggcgttttcccaatcccacgtaatggcggctcggagacatcaacattcccgcttgatcatcgaagtggacgaatactcctccaacccaacccaggccttcaccttctacaacatcaaccagggccggtttcagccccctcacgtgcagatggtggaccctgtcccacatgatgctccaaaaccacctggatatactagattcgtttgcgtgagtgacacccactctcgaaccgatccaattcaaatgccctatggggatgtcctcattcatgcgggcgacttcactgagcttggcctgccctctgaggttaaaaagttcaatgaatggctcggctccctgccttacgagtacaaaatcgtcatcgccgggaaccacgagctgacctttgaccaagaattcatggcagacttgatcaagcaagacttctattactttccctctgtgagcaagctgaaaccagaaaactatgaaaacgttcagtcccttttgaccaactgcatctaccttcaggactctgaagttacagttcggggcttcaggatttacggcagtccatggcagccgtggttctatgggtggggattcaacctgccccgcggacaggcccttctggagaagtggaatctgattcccgaaggggttgatatcctaataacacacggaccaccactgggctttctggattgggtaccaaagaaaatgcagcgggtgggatgcgtcgaactcttgaataccgtgcaacggagggttcaaccccgattgcacgtctttgggcatatccatgaaggctacggtgtcatggctgatggtaccaccacctacgtgaacgcgtccgtttgtactgtaaactaccagccagttaaccccccgattgtgatcgaccttccaacccctcgcaattcatag

SEQ ID NO: 194897 - DNA, 507 bp, Artificial Sequence
  Description of Artificial Sequence: Synthetic coding sequence
atggccgacctgatcaagcaggacttctactacttccccagcgtgagcaaactgaaacctgagaattatgagaacgtgcagagtctgctcaccaattgcatctacctccaggattcagaggtgaccgtccggggcttccggatctatgggtccccttggcagccgtggttctatgggtgggggtttaacctgccccgcggacaggctttgctggaaaagtggaacctgatccccgaaggcgtcgatattttaatcacacacgggcctcccctcgggtttcttgattgggtgcctaagaagatgcaacgagtgggatgcgtggagctccttaacactgttcagcgtcgagtccagccaaggctccacgtattcggccacatacacgagggctatggcgtgatggccgacggaacgacaacatatgtcaacgcctcggtgtgcaccgtgaactaccagccggtaaacccacccatcgttatcgatctcccaaccccaaggaattcctag

SEQ ID NO: 194898 - DNA, 981 bp, Artificial Sequence
  Description of Artificial Sequence: Synthetic coding sequence
atgtggcggagccggtgggacgccagcgtgctgaaggccgaggccctagccctcctgccctgtggcctggggatggccttctctcagtcacacgtgatggctgcgaggcgtcaccagcactcccggttgatcattgaggtagacgagtattcgagtaaccccacccaagcattcacattttacaacatcaatcaaggacggtttcagcctccccatgtccagatggtcgacccagtgccgcacgacgctccgaagcccccggggtatacccgcttcgtttgtgtgtccgacacccacagtcggactgacccaatccaaatgccctacggcgatgtactaatccacgccggagatttcaccgagctgggcctgccatcagaggttaaaaagtttaatgagtggcttgggagcctgccctacgaatacaagatagtcattgccggaaaccacgagctgacattcgatcaggagtttatggccgaccttattaagcaggacttttattactttccatctgtaagcaaattgaaacctgaaaattacgagaatgttcagtctctgttgacgaattgtatttacctccaggactcggaagtcaccgtgcgggggttccgcatctacggcagcccttggcagccgtggttctacggctgggggtttaacttgccccggggccaggcgcttctcgaaaagtggaacctgatccctgagggggtcgacatcctcattacccatggccccccacttggatttctcgattgggtccccaagaaaatgcaacgagtcggttgcgtggaattgttgaacactgttcagagacgggtgcagcctcgcctccacgtattcggccacatccatgaaggttacggtgtcatggccgacggcactacgacatatgtgaacgccagtgtttgtactgtcaattatcagcctgtgaacccccctatcgttatagacttgccaaccccgagaaatagctag

SEQ ID NO: 194899 - DNA, 225 bp, Artificial Sequence
  Description of Artificial Sequence: Synthetic coding sequence
atgtggcggagccggtgggacgccagcgtgctgaaggccgaggccctggccctgctgccatgcggactggggatggctttttcccaatcccacgtaatggcagcccggcggcaccagcatagccgcctaattatcgaggttgatgaatattccagcaaccccacacaggcatttactttctacaacatcaaccaaggacgattccagcctcctcacgttcagtag

SEQ ID NO: 194900 - DNA, 1080 bp, Artificial Sequence
  Description of Artificial Sequence: Synthetic coding sequence
atgaacggccgggagacccagagcgtgagccggagcggcggcggccccgggtgtggtggaggcagcggcggtcgttgcaggggaggcagacgccgctccatgtggcggtctcgttgggacgcgagcgtgctgaaggctgaagctctggcactgctgccatgcggcctagggatggccttcagccaatctcacgtcatggccgcaaggcgtcaccagcatagccggttaattattgaggttgacgagtactcttcaaatcctacacaggctttcactttctataatattaaccagggtagattccagcccccacacgtacagatggtggatcccgtgccacatgatgcacctaagccgccggggtacacccgtttcgtatgtgtgtctgacactcatagccgaacagatccaatccagatgccgtacggcgacgtcttgattcacgccggtgacttcaccgagctgggattgccctcagaggttaagaagtttaatgaatggttgggctccctaccttatgagtacaagatcgtcatcgctggcaaccacgagttgacctttgaccaagaatttatggctgatttgattaaacaagacttttactacttcccctccgtgtccaagctcaaaccggagaactacgagaacgtgcaatccttactcactaattgtatctacctgcaggactcggaagtcacagtaagaggattcaggatctacggctccccctggcaaccatggttctacgggtgggggttcaatctgccaagggggcaggccctgctcgagaagtggaacctgatccccgagggggtggatatcctaattacccatggaccgccgttgggattccttgactgggtgcccaaaaagatgcagcgagttggatgcgttgagctccttaatactgtgcagcggagagtccagcccaggctgcacgtgttcggacacatacacgagggctacggggtgatggctgacggaaccacaacttatgtgaatgcctcagtgtgcaccgtgaactaccaacctgtgaacccccccatcgtcattgatcttcctaccccaaggaattcatag

SEQ ID NO: 194901 - DNA, 981 bp, Artificial Sequence
  Description of Artificial Sequence: Synthetic coding sequence
atgtggcggagccggtgggacgccagcgtgctgaaggccgaggccctggctctcctaccctgcggtctgggtatggcattttcgcaatcacacgtaatggcggccaggagacatcagcattcccgccttatcatagaggtggatgagtactctagtaaccccacccaggccttcacattctataacattaatcagggtagatttcagcctccccatgtgcagatggtcgaccccgtgcctcatgacgccccgaagcctcccggctacacaagattcgtctgtgtctcagatacacatagccgcaccgatccaatccagatgccatacggggatgtgctgattcacgctggggattttactgaactcggcttgccctccgaggtcaagaagtttaacgaatggctgggcagcctcccgtacgagtataagatcgttatagccggtaatcatgaactaacctttgaccaagagttcatggcggatttaataaagcaggacttctactatttcccttccgtgtcaaaactgaaacctgaaaactacgaaaacgtgcagtcactgctgacgaattgtatttacctgcaggattcggaagttaccgttagaggcttccgcatttatgggagtccgtggcagccatggttctacggctggggctttaatcttcccagaggccaggcgcttttagagaaatggaatttgatacccgagggggttgatatacttataacccacgggcccccgcttggctttctcgactgggtacctaaaaagatgcagcgagtgggatgtgttgagctgctcaacaccgtgcagcgaagggttcagcccagactccacgtcttcggacacatccacgagggatatggcgttatggccgatggcacaactacatacgttaacgcatccgtgtgtactgtgaattaccagccggtcaatcccccgattgtcattgacctcccaacgcctaggaactcctag

SEQ ID NO: 194902 - DNA, 915 bp, Artificial Sequence
  Description of Artificial Sequence: Synthetic coding sequence
atgtggcggagcttcagccagagccacgtgatggccgcccggcggcaccagcacagtagattgatcatagaggttgacgaatacagtagcaacccaacccaggcgtttactttctataatatcaaccagggtcgttttcaaccacctcacgtgcagatggttgatcctgtgccacatgatgcccctaagccgcctgggtatacacggttcgtttgcgtgagcgacacccattccagaactgatcccattcagatgccctacggcgatgtgctgatacatgccggggatttcaccgagctgggtttgccaagtgaagtaaaaaagttcaatgagtggttagggagcttgccttatgagtataagatcgtcattgcagggaatcacgaattgacctttgatcaggaattcatggcagatctgatcaaacaagacttttattatttcccgtccgtcagtaagctgaagccagagaattatgagaacgtgcagagcctgttgaccaactgcatctacttgcaagactcagaagtgacagtcagaggcttcaggatttatggctctccctggcagccctggttctatggatggggattcaacttgccacgggggcaggctctcctcgagaaatggaaccttattcccgagggagtggacatactgatcacccacgggcctcccctggggtttctggattgggtgcccaagaaaatgcagcgtgtcggctgcgtcgaactgcttaatacagtgcagcgcagagtccagccccgcttgcatgtatttggacatatacatgaaggatatggcgtaatggcggatggaactaccacctacgtaaacgccagtgtctgcaccgtcaattatcagcccgtcaatcccccaattgtaatcgacttacccaccccaagaaatagctag

SEQ ID NO: 194903 - DNA, 885 bp, Artificial Sequence
  Description of Artificial Sequence: Synthetic coding sequence
atggcccacggcatccccagccagggcaaggtgaccatcaccgtggatgaatacagctccaacccgacacaggcattcacccattacaatattaaccagagccggtttcaacccccccacgtgcacatggtggacccgattccatacgacactcctaaacccgcagggcataccagatttgtttgcatatcagatacccattcccgaaccgacgggatccaaatgccgtacggtgatatccttctgcatactggagatttcaccgagctgggtctgccgagcgaggtcaaaaagtttaatgattggttaggaaatctcccttatgagtataagattgtcatcgccggaaatcacgaactgacttttgacaaggagttcatggcggacttggtcaaacaggattactatcggttcccctctgtcagtaaactaaagcctgaggatttcgataacgtgcagagcctactaactaactccatctatctccaagacagcgaggtcacagtaaagggtttccggatctacggagctccatggacaccttggttcaatggctggggcttcaatctccctcgcggccaatccttactcgacaaatggaatcttatacctgaggggattgacattctgatgacacacgggcctccactgggttttagagactgggttcccaaggagctgcaacgcgtcggttgcgtggagttgctgaacacagtgcaaaggcgggtgcgccccaagctccatgtattcggaggaattcacgaggggtatggcataatgactgatggctacaccacctatattaacgccagtacatgtacagtatcattccagccgactaaccctcccattatttttgaccttcctaacccacaaggaagctag

SEQ ID NO: 194904 - DNA, 834 bp, Artificial Sequence
  Description of Artificial Sequence: Synthetic coding sequence
atggcccacggcatccccagccagggcaaggtgaccatcaccgtggatgagtatagttcaaacccaacccaggcctttactcactacaacataaaccagagccggttccagcctccccatgtgcatatggtagaccccattccttacgatacaccaaagcctgctggtcataccaggtttgtgtgcatcagcgacacccactctcgaacggacggaatacagatgccttatggcgacattttgctgcatacaggtgatttcacagagcttggcctgcctagtgaagttaaaaagttcaacgattggctcggaaatttgccctatgagtacaaaatagtgatcgccggaaatcatgagcttacctttgataaagagtttatggcagatctagtgaagcaggattactataggttcccttctgtatcgaaacttaaacctgaggacttcgacaatgtgcagtctctcctgaccaattccatctatcttcaggattccgaagtgacagtgaaaggttttcgcatttacggagctccatggacgccctggtttaacggctggggttttaatttacctcgtggacaatctctgttagacaagtggaacctcatccctgagggaatcgatatcctgatgactcacggcccccccttaggctttcgggattgggttcctaaggagctacaacgcgtgggctgtgttgagttactgaacaccgtacagcgcagggtgagacccaagctacacgtctttggggggatccatgaggttaatcctgtgagcatttcaaaagcgttgcggacaaagatctgctcactaccatccaaaacatcatag

SEQ ID NO: 194905 - DNA, 132 bp, Artificial Sequence
  Description of Artificial Sequence: Synthetic coding sequence
atggcccacggcatccccagccagggcaaggtgaccatcaccgtggacgaatacagtagcaatccgacacaggcctttacccactacaacatcaatcagagtagattccagccaccccatgtacacatgtag

SEQ ID NO: 194906 - DNA, 186 bp, Artificial Sequence
  Description of Artificial Sequence: Synthetic coding sequence
atggaccccaactgcagctgcgccaccggcggcagctgcacctgcaccgggtcctgtaaatgtaaggagtgtaaatgtacgtcatgcaagaaaagctgctgttcctgctgcccaatgtcttgcgctaagtgcgcccagggctgcatctgcaagggcgcaagtgaaaaatgttcctgttgtgcctag

SEQ ID NO: 194907 - DNA, 186 bp, Artificial Sequence
  Description of Artificial Sequence: Synthetic coding sequence
atggaccccaactgcagctgcaccaccggcggcagctgcgcctgcgctgggtcttgtaagtgcaaagaatgcaaatgtactagctgcaaaaaatgttgctgctcatgttgccctgtgggctgtgcaaagtgcgcccaggggtgtgtgtgtaagggctcttcagaaaagtgccgatgctgtgcatag

SEQ ID NO: 194908 - DNA, 186 bp, Artificial Sequence
  Description of Artificial Sequence: Synthetic coding sequence
atggaccccaactgcagctgcgccaccggcggcagctgcacctgcgctggctcctgtaagtgtaaggagtgcaagtgcaccagctgtaagaagtcctgttgcagttgttgcccagtaggctgcgcgaagtgtgcgcagggatgtgtgtgtaaaggcgcatccgaaaagtgttcttgttgcgcctag

SEQ ID NO: 194909 - DNA, 384 bp, Artificial Sequence
  Description of Artificial Sequence: Synthetic coding sequence
atggaccccaactgcagctgcgccaccggcggcagctgcacctgcgcagggagctgcaagtgtaaagaatgcaagtgtacatcctgtaaaaagtctgagtgtggagcgatttcccggaacctgggactatggctccgactcggcggcaattctcgactggccctctccgcctctttctggggcactggcctcagcctgccgtcactgccggtgtcttttcctctgcaggccttctgtccaaaatttcgatggggtagaaccgcattcttcagttgggacaccaacccgaactgtactccctacggttttcggacagaactttgtcagacgaagaaaagtattctgtgggtctgggtgctttcctccagtcaggcttgctactag

SEQ ID NO: 194910 - DNA, 186 bp, Artificial Sequence
  Description of Artificial Sequence: Synthetic coding sequence
atggaccccaactgcagctgcgccgccggcgtgagctgcacctgcgcaggttcctgtaagtgtaaggagtgcaagtgtacctcttgcaagaaatcctgttgttcctgctgccctgtcggctgcagcaagtgcgctcaaggatgtgtttgcaaaggggccagcgagaagtgtagttgttgtgattag

SEQ ID NO: 194911 - DNA, 189 bp, Artificial Sequence
  Description of Artificial Sequence: Synthetic coding sequence
atggaccccaactgcagctgcgccgccgccggcgtgagctgcacctgcgccgggtcctgcaagtgcaaggaatgtaaatgcactagttgtaagaaatcatgttgcagttgctgtcctgtggggtgtagtaagtgtgcccaggggtgcgtctgtaagggtgccagtgagaagtgttcctgttgcgactag

SEQ ID NO: 194912 - DNA, 189 bp, Artificial Sequence
  Description of Artificial Sequence: Synthetic coding sequence
atggaccccaactgcagctgcgccgccgccggcgtgagctgcacctgcgcgtcctcatgcaagtgcaaggagtgcaagtgcaccagttgcaagaaatcttgctgctcttgttgcccggtcggctgtgccaagtgtgcccagggctgcatttgcaagggtgcgtccgaaaaatgtagctgttgtgcatag

SEQ ID NO: 194913 - DNA, 186 bp, Artificial Sequence
  Description of Artificial Sequence: Synthetic coding sequence
atggaccccaactgcagctgcgccgccggcgtgagctgcacctgcgccagcagctgcaagtgcaaggaatgcaagtgcacatcctgcaagaagagctgttgctcctgctgtccagtagggtgtgctaagtgcgctcagggctgcatctgcaaaggagcaagcgaaaagtgtagttgttgtgcatag

SEQ ID NO: 194914 - DNA, 186 bp, Artificial Sequence
  Description of Artificial Sequence: Synthetic coding sequence
atggaccccaactgcagctgcgaggccggcggcagctgcgcctgcgccggcagctgcaagtgcaagaaatgtaagtgcacgtcttgtaaaaaatcatgttgcagctgctgtcccttaggatgtgcaaagtgtgcccagggatgtatttgtaaaggggcgagcgagaagtgttcatgctgtgcgtag

SEQ ID NO: 194915 - DNA, 186 bp, Artificial Sequence
  Description of Artificial Sequence: Synthetic coding sequence
atggaccccaactgcagctgcagccccgtgggcagctgcgcctgcgcaggaagctgtaaatgcaaagaatgcaaatgtacgagctgtaaaaaaagttgctgctcttgctgtcccgtaggatgcgccaaatgtgcccaggggtgtatatgcaaggggactagtgacaagtgttcctgttgtgcttag

SEQ ID NO: 194916 - DNA, 186 bp, Artificial Sequence
  Description of Artificial Sequence: Synthetic coding sequence
atggaccccaactgcagctgcgccgccggcgacagctgcacctgcgccggttcatgtaaatgcaaggagtgtaaatgcacaagttgcaaaaaatcctgctgctcatgctgcccagtggggtgtgccaagtgcgcacagggatgcatctgtaagggtgctagcgataagtgcagctgctgcgcatag

SEQ ID NO: 194917 - DNA, 207 bp, Artificial Sequence
  Description of Artificial Sequence: Synthetic coding sequence
atggaccccgagacctgcccctgccccagcggcggcagctgcacctgtgcggatagttgtaagtgtgagggttgtaagtgcacaagttgcaagaaaagttgctgcagttgttgccctgccgaatgcgaaaaatgcgctaaggactgtgtatgtaaagggggagaggctgcagaagccgaggccgagaaatgcagctgctgccagtag

SEQ ID NO: 194918 - DNA, 687 bp, Artificial Sequence
  Description of Artificial Sequence: Synthetic coding sequence
atgaagatcaagcccggcttcatgggcaaggccacccccccctacgacgtacagttccatatggaggccagtgtggagaactgcatcattgtgtcgatgaatacagcagatcctggctcgcaggggatcacccactcattgcttctccaggtgatcgatgataagggctccatcctgccaccgaacactgaagggaacattggtatcaggatcaagcccgtgagaccggtctccctgtttatgtgctacgagggggatcccgagaaaacggccaaagtagagtgcggcgatttttataatactggagaccggggcaagatggatgaggagggctacatctgcttcctgggtcggtccgatgacatcatcaatgcttcaggttaccggattggcccagctgaagtcgaatctgcactggtagaacatcccgccgtggctgagtctgccgtggtgggttctccagaccccattaggggcgaagtagtgaaagctttcatcgtcctaaccccacagtttctctcccatgacaaagaccagctcacaaaggagttacagcaacacgtcaagagtgtcaccgccccatataaatacccccgtaaggtagagtttgtctcggagcttcccaagactatcactgggaaaatagaacggaaggagttgaggaagaaggagactggccagatgtag

SEQ ID NO: 194919 - DNA, 1527 bp, Artificial Sequence
  Description of Artificial Sequence: Synthetic coding sequence
atggaggagggccccctgcccggcggcctgcccagccccgaggacgcaatggtgacagaactgctgtcacccgagggcccttttgcatccgagaatatcggcttgaaggcgcccgttaagtacgaagaagacgaatttcacgtatttaaagaagcttaccttggccctgcagaccctaaggagcctgtgctccacgctttcaaccctgcactgggcgccgactgtaaagggcaggttaaggccaagctcgccgggggtgactccgacggcggcgaactgctgggcgaataccccgggattccagaactttctgcactggaagacgttgcactcctgcaggccccccagcctccggcatgtaatgtgcactttctgagcagcctattaccggcccatagatcccctgccgtgttgccactcggggcatgggtactggaaggtgcgagccatcctggcgttcggatgatacctgtggaaattaaggaggctggcggaaccactacaagcaataaccctgaggaagccactttgcagaacctgttggcccaggagagctgttgtaagtttccaagctctcaagaactggaagacgcctcatgttgttcactcaagaaggactcgaaccctatggtcatctgccagcttaagggaggaacacagatgctctgtatcgataacagcaggactcgggaactcaaggctcttcatttagtgccacaataccaggaccaaaacaattacctacagagtgatgtgcctaagcccatgactgccctggtgggccgctttctccccgcttctaccaaactgaatttgatcacgcagcaacttgagggagccttaccttctgtcgtgaacggaagtgcatttccctcaggcagcaccctgcctggaccccccaaaattacactggccggatactgtgattgtttcgcctcaggtgatttttgtaataactgtaattgcaacaactgctgcaataacctgcaccacgacatcgagcgcttcaaagccatcaaagcgtgcttaggaaggaacccagaagctttccagccaaagataggcaaaggtcagctgggcaatgtcaaacctcagcataataaaggatgtaactgtaggagatctggctgcctgaagaactattgcgaatgttatgaggctcagatcatgtgtagcagcatttgtaaatgtatcggttgcaaaaattatgaggagagccccgagcggaagacactgatgagcatgcccaattacatgcagacaggggggctagaaggaagccactacctcccccccaccaagttctccggactgccaaggttttctcatgatcggaggccctcctcgtgtatttcctgggaagtggtggaagctacttgcgcctgcctcctggcacagggcgaagaagccgagaaggaacattgtagcaagtgtttggctgagcagatgatcctggaggaattcgggaggtgtctttcgcagatactccatactgaattcaagagtaagggtttgaaaatggagtag

SEQ ID NO: 194920 - DNA, 756 bp, Artificial Sequence
  Description of Artificial Sequence: Synthetic coding sequence
atggaggagggccccctgcccggcggcctgcccagccccgaggacgccatggttaccgaactccttagccccgaagggccttttgcgtcagaaaatatcggcttgaaagccccagtaaagtatgaggaagacgagtttcacgttttcaaggaggcatacttgggtccagccgaccctaaggaaccagtgcttcatgcattcaaccccgccctgggcgcagactgcaaaggccaggtcaaggccaaactggcgggtggcgacagcgacgggggggagctgctgggtgagtacccgggaatccccgagttgagcgccctggaggatgtcgctctccttcaggccccccagccacccgcatgtaatgtacattttctcagcagtctgctgccggcacatcgatcccctgcagtgctgcccctaggagcctgggtactcgagggtgccagtcacccaggcgtgagaatgatccccgttgagattaaggaagccggcggaacaacaacatcaaacaacccggaggaggcgaccctgcagaatctattagcgcaggaaagctgttgcaagttccccagcagtcaagagttagaggatgccagctgctgttccctgaagaaggacagcaacccaatggtcatttgccagctaaaaggaggcacccagatgctctgcatcgacaattcccgcacgagagagttgaaggcactgcatttggtgccacaatatcaggatcagaataactacctgcagagcgcatag

SEQ ID NO: 194921 - DNA, 921 bp, Artificial Sequence
  Description of Artificial Sequence: Synthetic coding sequence
atggaggagggccccctgcccggcggcctgcccagccccgaggacgccatggttacagagctgctgtctcctgaggggccgttcgcgtcagagaacattgggctcaaggccccagttaaatacgaagaagacgagttccatgtctttaaagaggcctacctaggccccgctgacccaaaggagcctgtcctgcacgcatttaatcctgcccttggtgctgactgtaaaggacaggtgaaagcaaagctagctggaggtgatagtgacggaggagagctcttgggagaataccccgggatccccgagctgagcgctctagaagacgttgccctgcttcaggccccacagccacccgcatgtaacgtgcatttcctctcatccctactcccagcacatcgaagccctgccgtgctgccccttggagcttgggtgttggagggggcaagccaccctggggttcgaatgattcccgtcgaaattaaagaggcggggggaacaacaacatccaacaatcctgaagaagctactctgcagaacttacttgcccaggaaagctgctgtaagtttcctagttcccaggaactagaggacgcatcctgctgcagtctgaaaaaggactctaatcccatggtcatctgccagctgaaagggggtacccagatgctatgcatcgataactcccgcacaagagagctaaaagccctccacctggtccctcagtaccaggatcaaaacaattacctacaatccgacgtgcctaaacccatgactgccttagtcggccgcttcctgcctgcttctacaaaactgaaccttattactcagcaactggaaggagccctgcctagcgtcgtaaatgggtcagcctttccctctgggtcaaccctgcctgggccccccaagatcactctggcggggtag

SEQ ID NO: 194922 - DNA, 2262 bp, Artificial Sequence
  Description of Artificial Sequence: Synthetic coding sequence
atgggcgagcacagccccgacaacaacatcatctacttcgaggccgaagaagacgagctgaccccagacgacaagatgctgcggttcgtggacaagaacggcctggtgccatcttcgtccggaaccgtttacgatcggaccacagtcttaatagagcaggaccccggaactttagaagacgaggatgacgatgggcagtgtggcgagcacctccccttcctggtgggcggggaggagggctttcatcttatcgatcacgaagccatgtctcagggttatgtccagcacataataagccccgaccagattcatttgactatcaatccgggttcaaccccaatgccaaggaatatcgagggtgcaaccctgacactgcagagcgagtgcccggaaaccaagagaaaagaggtcaagcggtatcagtgcaccttcgaaggatgtcccagaacatattccaccgccgggaacctccggacacatcagaagacgcacaggggggaatataccttcgtgtgcaatcaggagggctgcggcaaggccttcttgacaagctattccctgcgcatccatgttagggtgcataccaaggaaaaacccttcgagtgcgacgtgcagggatgtgagaaggcgtttaacacactgtacagattgaaagcacatcagaggctgcataccggcaagacctttaactgcgagagtgagggctgttctaaatactttaccaccctgtccgatttacgaaaacatattcgcactcatactggagagaagccttttcgatgcgatcacgacggatgcggaaaggccttcgctgcctcacatcatttaaaaactcacgtgcgcacacacacgggcgaacgtcctttcttctgccccagtaacgggtgcgagaagacatttagcacccagtattcactgaaaagtcacatgaaagggcatgataataagggccactcatataacgcccttccgcaacataacggatcagaggatactaatcatagtttatgcctgtctgatctaagtctgctttccaccgacagtgaactgagagagaacagttccaccacccagggacaggacctgtcgacaatcagcccggctattatcttcgaatcaatgtttcagaactcagacgatacggctatccaggaggatccacagcagacagcttccctgactgaatccttcaatggtgacgccgaatcggtctccgacgtgcctccatctacgggcaactcagccagcctgagtttgccgcttgtgctacagcccggactctccgagcccccccagccactgctccctgctagcgcaccatccgcgcccccacctgctccctctttagggcccggatcccagcaggctgcttttggaaacccaccggccctgctacaaccacctgaggtgcctgtcccccatagtacacagttcgctgctaaccaccaggagtttctgcctcacccacaggcgcctcaacccatcgtgcccgggttgagtgtggttgcaggggccagcgcctccgctgccgcagtcgcctcagccgtggcagcccctgcacccccccagtccacaaccgagccattaccagcgatggttcagacactccccctcggagcaaacagcgtgttgacaaacaaccctaccatcacaatcacacctacaccgaacactgctattctgcagtcctctctcgtcatgggagagcaaaatcttcagtggattttgaatggagctaccagcagtccccagaaccaagaacagatccagcaggcgagcaaggttgaaaaggttttctttactaccgccgtgcccgtggctagctcccctggcagcagcgtgcagcaaattggcctatctgtgcccgtgatcatcattaaacaagaagaggcgtgccagtgccagtgtgcctgcagggacagcgccaaagagagggccagcagccggaggaaaggctgctccagtccacctccacccgaaccctcgccccaggcgccagatggacctagtttacaactgcctgcgcaaacatttagttctgcacccgtacccggtagttcatctagtacactgccgtcgtcttgtgaacagtctcgccaggccgaaacaccttctgatccacagaccgaaaccctgtccgccatggatgtgagcgagttcctgtcgctacaaagtcttgacacaccatcaaatttaattcccatcgaagcactgctgcagggtgaagaggagatgggcttgacatctagtttcagtaagtag

SEQ ID NO: 194923 - DNA, 603 bp, Artificial Sequence
  Description of Artificial Sequence: Synthetic coding sequence
aagcagagccaggtgaagcggtaccagtgcaccttcgagggctgcccacgcacctactccacagccggcaatctgcgcacacatcaaaagacccatcgaggcgaatacaccttcgtgtgtaatcaggagggatgcggaaaagcctttctgacgtcctatagcctgcgaatccacgtgcgagtgcacaccaaggaaaagccattcgagtgtgacgtgcagggttgtgagaaggcctttaacaccctgtatcgcctcaaggcacatcagcggctgcatacgggcaaaacattcaattgcgaaagcgagggatgtagcaaatactttacgacactgtctgacctgcggaaacatattcggacccacacaggcgagaagccatttcggtgtgatcatgacggatgtggaaaagctttcgcagcatcacaccacctgaaaactcacgtccggacacacaccggagagagaccattcttttgtccatccaacggatgtgagaagacattctcaacacagtatagtctcaaatctcatatgaaaggccatgataataagggtcacagctacaatgcactgccccagcacaatggaagtgaatccacttag

SEQ ID NO: 194924 - DNA, 2559 bp, Artificial Sequence
  Description of Artificial Sequence: Synthetic coding sequence
atgctgatcaccgagcggaagcacttccggagcggccggatcgcccaatccatgtccgaggccaatctgatagacatggaagccggaaagcttagcaagtcttgcaacatcaccgagtgccaggatcccgacctactgcataattggcccgatgccttcaccctgcgaggcaacaatgcgtctaaagtggcgaaccccttctggaatcagctctcagcctccaacccttttttagatgatatcacacagctgaggaataaccggaaacggaacaatatttcaatcctgaaagaagacccttttttgttttgtcgggaaattgaaaatgggaattcatttgacagcagtggggacgagcttgatgtgcaccaattgctgcgacagacaagttcccgaaactccggcaggagcaagtcagtctccgaactattagatattttggatgacacagcacatgcccatcagtcaattcacaatagtgaccagatactccttcatgatctggaatggctgaagaatgatagggaggcgtataagatggcatggctctcccagcggcagctggcgcgcagttgcttggacctgaatactatttctcaatctccaggttgggcccagacacaactcgctgaggtgacaatcgcctgcaaggtgaatcaccagggcggcagtgtgcagttgcccgaaagcgacatcacagtccatgtgcctcagggccacgtggctgtgggagaattccaggaagtgagcctgagagcattcctcgatcctccacacatgctgaatcacgaccttagctgtactgtctccccacttttagaaataatgctgggtaatctgaataccatggaggccctgctccttgagatgaagattggcgccgaagtgagaaaagatccctttagccaggttatgaccgaaatggtgtgtcttcattctctggggaaggagggtccattcaaagttctgtctaactgctacatttataaagacacaatccaggtcaagctcatcgatctgtctcaagtgatgtaccttgtagtcgcggcacaggccaaagctttgccaagtcctgcggcgacgatctgggactacatccacaagacaacctcgatcggtatttatgggcctaagtacattcaccctagcttcactgtggtgcttactgtgtgcggacacaactatatgccgggccaactgactatctctgatatcaagaagggcgggaagaatatttccccggtcgtattccagctttgggggaagcaaagtttcttacttgacaaacctcaggacctctccataagtattttctcctgcgacccagatttcgaggtgaagacagagggagagcggaaggaaattaagcaaaaacagctcgaggctggggaggtggtacaccagcagtttttatttagcctcgttgaacatcgcgaaatgcacctgtttgacttttgcgtgcaggtcgagccccctaacggagaacctgtagcacagttcagtataacgacccccgacccaacccccaacctgaagagattgtccaatcttcctggctacctgcaaaaaaaagaggaaatcaagtccgccccactgagtccaaagatcctggtcaaatatcccacgttccaagacaagacactcaacttttctaactacggggtgaccctgaaggccgtgctccggcagtcaaagattgattattttctggaatacttcaaaggggacactatagcactactgggcgagggcaaggttaaggctattgggcaatctaaagtcaaagagtggtatgtaggagtgctccggggtaaaatcggactggtacactgtaagaacgtgaaagtgatttcaaaggagcaagtaatgttcatgagcgacagtgtgtttaccacccgtaacttgcttgagcaaatagtattaccactcaagaagctcacctatatttacagcgtcgtgttgacgttggtttctgagaaagtgtacgattggaaagtgctcgcggatgttctaggatactcccacctgagcctggaggattttgaccagatccaggcagacaaagaatcagagaaggtctcctacgtcatcaagaagcttaaagaagactgccatacagagagaaacacccgcaaatttctgtacgagttgatagtggccctgctaaagatggattgtcaggagttagtagccagacttatccaggaagcggccgtgctaaccagcgctgtgaagctggggaagggctggcgggagctggctgagaaactggtcaggctgacaaagcagcagatggaagcgtacgagatcccccacagggggaacaccggagacgtggctgtggagatgatgtggaagcctgcatatgacttcctgtacacatggtctgcgcactacggaaacaactatagggacgtgctccaagatctccaatctgccctggaccgtatgaaaaaccccgtgacgaaacattggcgcgagctcaccggggtactgatcctcgtcaattcactggaggtgcttagagtcacagctttttcaacaagtgaagaggtttag

SEQ ID NO: 194925 - DNA, 2559 bp, Artificial Sequence
  Description of Artificial Sequence: Synthetic coding sequence
atgctgatcaccgagcggaagcacttccggagcggccggatcgcccagtcaatgagcgaggccaacctgattgatatggaggcaggcaaactgagcaagtcatgcaacatcactgaatgtcaggatccagacctgttacataattggcctgatgcttttaccctgcgaggcaacaacgcatctaaggttgccaatccgttctggaaccagctgagcgcgagcaacccatttctagatgatatcactcagttgagaaataatcgcaaaaggaacaatatatccattttgaaggaggatccttttctattctgccgcgaaattgagaatggtaactcctttgattcttctggcgacgagctcgacgtccatcagttactaagacagacttcatctcggaattcaggccggagcaagtccgtgagcgagttacttgatattctcgacgataccgcccacgcgcaccaatccatacataattccgaccaaattctccttcatgatttagagtggcttaaaaacgacagggaggcctataaaatggcttggcttagtcaaaggcagctagcacggtcctgtctggatctcaatactattagccaatccccggggtgggctcagactcagcttgcggaggtgacaattgcctgtaaagtgaaccaccaaggcggctcagtgcagcttccagaatcggatattaccgtccacgtcccccagggccatgtcgccgtaggcgaatttcaggaggtgagcctccgggcattcctggacccccctcatatgctaaatcacgacttatcatgtaccgtgagccccctcctggagattatgctcggaaacctcaacacgatggaagccttgttgctcgagatgaagattggtgctgaggtgagaaaagatcctttcagccaggttatgactgaaatggtgtgcctgcattccctgggcaaagaaggccctttcaaggtcctgagtaactgctatatctataaggatacaatccaggtgaagcttatcgatctgtcgcaggttatgtatctcgtggtggccgctcaggctaaggcactgccctctcccgctgctacaatttgggactatattcacaagacaactagcattggcatttatgggcccaaatatatccacccttcctttactgtggtcctcacagtgtgcggccataattacatgccggggcagctgactatctccgatatcaaaaagggaggtaaaaacataagccctgtggtgttccagctgtggggcaagcagagctttctgcttgataaaccccaggatctgagcatctctatcttctcttgtgatccagatttcgaggttaaaaccgagggggaacggaaagagatcaagcagaagcaactcgaggctggagaggttgtccatcaacaattcctcttctcccttgttgaacaccgcgaaatgcatctctttgatttttgtgtgcaggtggaacctccgaacggcgagcctgtggcccaattcagtataaccacccctgatccaacccctaacctgaaacgcctgtcaaatctgccaggctatctgcagaaaaaggaggagatcaaaagcgcacccctgagtccaaaaatactggtaaagtaccccacctttcaggacaaaactctcaacttctccaactatggcgtgactttgaaggccgttcttcgtcagagcaagattgattacttccttgagtactttaaaggggacacgatcgcactgcttggcgagggtaaggttaaagccatcgggcagagcaaagtgaaagagtggtatgttggagtgctgcggggcaagatcggcctcgttcactgtaagaacgttaaagtgatctccaaagaacaggtcatgttcatgagtgacagcgtttttactactaggaacctcctggagcagatcgtgcttcctctgaagaagctgacctacatttatagtgtcgtcttaacattggtttccgagaaggtgtatgattggaaggtgcttgcagacgtcctgggctatagccatctttccctcgaagattttgatcagatacaggctgacaaggagtctgagaaagtgtcctatgtcattaaaaagctgaaagaagactgccatactgagcgaaatactcgtaagttcttgtacgagctaattgtggcgcttctgaaaatggactgtcaggagctagtggcgaggctgattcaggaagcagctgtcttgaccagtgccgttaaacttggaaaggggtggagggagttggctgagaagctggttcggcttacaaagcaacagatggaggcctacgagataccccatcgaggaaataccggagatgtggccgttgagatgatgtggaaacctgcatacgacttcctttacacatggtccgcccactatgggaacaactatcgagacgtcctccaagacctacaaagcgctctagacaggatgaaaaaccccgtcacaaaacactggcgggagctcaccggagtcctgatattggtcaacagtcttgaggtcctgagggtcacagccttctccacctccgaagaggtatag

SEQ ID NO: 194926 - DNA, 1308 bp, Artificial Sequence
  Description of Artificial Sequence: Synthetic coding sequence
atgctgctgggcggccccccccggagcccccggagcggcaccagcccaaaaggaccatggtcatccacaggacatgtacaattcggcaagtcccctcagacctggcctagaagaactcgccctaggtcaccagaacccgctgcaccatcgggggttcggggttcaacgtggaccaggcgccgggacacgcctcggcgcgccggcccaactgctctgtccagatacgtgggacatctgtggatgggcagacgacccccgtctccagaagctcgcggcccggtaccccgctcctctgccgccagtagggccaggagatctctagcttccccagggatctccccaggcccccttacggccacaatcggcggtgccgtggctggggggggccccagacagggaagggctgaagcacacaaggaggtgttcccgggccagagggtcggaaaaatggctgcacccatggagctgttttgttggagtggagggtggggccttcccagtgtcgatctcgactctctggcagtgctcacatacgcccggtttactggtgcacctctaaaggttcataaaatctcgaacccctggcaatccccatccggcaccctgccggcacttcgtacttcccacggagaagtgatctctgtgccacacaaaatcatcactcatcttagaaaggaagtccacacattttggatcgacaccaaaaattacgtggaggtaacgaggaagtggtacgcagaagccatgcctttccctctgaactttttcctgccgggaagaatgcaacggcagtatatggagaggttgcagcttctcactggagagcaccgaccagaggacgaggaggagttggaaaaggaactttacagggaggcgagggagtgccttacgctgctgagccagcggctgggaagtcaaaaatttttctttggcgacgccccggcaagcttggacgcgttcgtgttcagttacctcgcgctcctccttcaagcaaaactcccatctggaaagctgcaggtacacctgagaggacttcacaatttatgcgcttactgcacccatatcctctctctgtatttcccttgggatggcgccgaggtgccccctcagcgccaaacaccggcaggaccagagacagaggaagaaccttatagaagacgtaatcagattcttagcgtgcttgctggactcgccgcaatggtgggttatgcactgctgagtggcatcgtttccattcagagagcaacaccagccagagcacctggaaccagaaccctggggatggctgaggaagatgaggaggagtag

SEQ ID NO: 194927 - DNA, 1401 bp, Artificial Sequence
  Description of Artificial Sequence: Synthetic coding sequence
atgctgctgggcggccccccccggagcccccggagcggcaccagcccaaagggcccatggtctagtactggccatgtgcagttcgggaagagccctcagacctggccgaggcggacacggcctcgatcccccgagcctgcagccccttcaggggtgcgaggctccacttggacacgccggagggatactcccaggcgcgcaggccctaccgctctctctaggtacgtggggcatctgtggatggggagacgccccccaagtccagaggcaagaggcccagtgccccgaagcagcgcggcttctcgtgccagacggagcctggcatcccctggaatatcccccggccctctaacagcgaccatcggtggcgctgtcgccggaggcgggccacggcagggcagagctgaagcccataaagaggtgtttccaggacaacgagtgggcaagatggccgcgccaatggagctcttctgctggtccggcgggtgggggctccccagtgtcgatttggactcattagcagtcctaacatacgcgcgttttacaggcgcccccctgaaggtccacaaaatcagcaacccctggcagagcccatctggtacactgcccgctctccggacctctcatggggaagtcatttcagtgcctcataagataattacacacctaagaaaggaaaagtacaatgccgattacgatctcagtgctaggcaaggagccgatacccttgctttcatgtctctgttagaggagaagctactgcccgtgttagtgcatactttctggattgacacaaaaaattacgtcgaggtcacccgaaaatggtatgccgaagcgatgccattcccattgaacttcttcctgcccggtcgcatgcagagacagtacatggagcggctccagctgttaactggcgaacatagacccgaggatgaagaggaacttgagaaggagctgtacagggaagccagggaatgcttgaccctgctcagtcaaagacttggcagtcagaaattcttctttggggatgccccagcttcacttgatgcctttgtgttctcttatctggccttactgttgcaagcaaagcttcccagcggtaagctgcaggttcacctgagaggactgcacaatctgtgtgcttattgtacacacattctctccttatactttccctgggatggcgctgaagtgcctccccagcgccagacgcccgctggtccagaaaccgaggaagagccttatcgacgccgaaaccagatactgtccgttcttgcgggtctagccgctatggtcggctatgctctgctgtctggtatcgtgtccatccagagagcgacacctgccagggccccaggaacccggaccctgggaatggctgaggaagacgaggaggagtag

SEQ ID NO: 194928 - DNA, 951 bp, Artificial Sequence
  Description of Artificial Sequence: Synthetic coding sequence
tgagagggcggccaggacggcggcgcccacggcgccgtgctgctggtgagagggctcggcgctgctgtcagcggaccaggacagcctggtcgtgctgatttgtgccagatctactggtgtagcaccgaaggcacccaggatcagcagcccttggccgaaccatttagatacccagtgtctctgggtggaacactgcctgccctcagaaccagccatggggaagtcatctccgtcccacacaagatcatcacccatctgagaaaggagaagtacaacgccgactacgacctgtccgcccgtcagggagctgataccctggcctttatgtcgctgctcgaagagaagcttctgccagtcctcgtacacaccttctggatagacaccaagaactacgtcgaggtgactcgcaaatggtacgctgaggcaatgccgtttcccctcaactttttcttgcctgggaggatgcaacggcaatatatggaacgcctgcagcttcttaccggtgagcaccgacccgaagacgaggaagagctagagaaggaactttatcgggaggctagggaatgtctaacactgttgtcgcagcgcctgggtagccaaaagtttttctttggtgatgcccctgcatccctcgacgcttttgtgttttcttatttagcactcttacttcaggccaaactaccctccgggaagctgcaggtacacttgcggggcctgcataacctgtgtgcttattgcactcacatcctttccttatattttccttgggacggagcggaggtacctccccaacggcaaactcctgccggacccgagaccgaggaagagccttacagaaggagaaatcaaattttgtcagttttggctggcctcgccgccatggttgggtatgctctcctgtcaggcattgtttccatccaacgcgctacacccgccagggcaccaggctag

SEQ ID NO: 194929 - DNA, 1188 bp, Artificial Sequence
  Description of Artificial Sequence: Synthetic coding sequence
atgaacggccccgtggacggcctgtgcgaccacagcctgagcgagggggtctttatgtttacttctgaatccgtcggcgagggccaccccgataagatctgcgaccagatctccgacgctgtcttagacgcccacttgaagcaggatcctaacgctaaggtagcttgcgagaccgtgtgtaagacgggcatggtgttgctctgtggggagattacaagcatggccatggtggattaccagcgtgtggtgcgtgacacaatcaagcacattggttacgatgacagcgccaaggggtttgatttcaaaacatgcaatgtgctggtggccctcgaacaacagagccctgacatcgctcagtgcgtccacctagatagaaacgaggaggatgtcggcgctggcgaccagggactgatgtttggttatgccactgatgaaaccgaagagtgtatgccattaaccattatcttggcccacaagctgaatgcacgcatggccgatcttcggagatctggcttgctgccctggctgcgccctgatagcaagacgcaagtgacggtacagtatatgcaagacaacggagcagttatccctgtgagaatacacaccatagtgatctccgtgcagcacaatgaagacatcacccttgaggaaatgcgccgggcgctaaaggagcaggtgattcgggcagttgtccctgcaaaatacctagacgaggacactgtgtatcacctgcagccatcaggacggtttgttataggaggacctcagggagatgctggcgttacaggacgcaagatcattgttgacacttatggcggctggggagcccatgggggcggtgctttttctggcaaggactacacaaaagtcgatcgctccgccgcctatgccgccagatgggtggctaaatcattggtgaaggccggtttgtgccggcgggtgttagtgcaggtgtcgtatgcaataggagtggcggagcctctgtctatctctatctttacctatggaaccagtcagaaaacggagagagagctgctggacgtagtgcacaagaacttcgacctcagacctggagtgattgtccgcgatctggatctcaagaagccaatatatcagaagaccgcttgctacggccacttcggccgatcggaatttccatgggaagtaccccgtaagcttgtgttctag

SEQ ID NO: 194930 - DNA, 1188 bp, Artificial Sequence
  Description of Artificial Sequence: Synthetic coding sequence
atgaacggccccgtggacggcctgtgcgaccacagcctgagcgagggtgtctttatgtttacatctgaatctgttggcgaggggcatcctgacaagatttgtgatcagatctctgacgctgtgctagacgcccacctgaaacaagaccctaacgcaaaagtggcttgcgagacagtgtgcaagacaggtatggtacttttgtgtggtgaaattacctcaatggcaatggttgactaccagagagtggtgagggacactatcaaacacataggatatgacgactctgccaaaggatttgattttaagacttgcaacgtgctggtggctctcgagcagcaatctccagacattgcccagtgcgtgcacttagacaggaacgaggaagacgtgggcgcaggtgatcaggggcttatgtttggctacgctacagacgagactgaggagtgtatgccactcacaatcatcttagcgcacaagctcaacgctagaatggctgatttgcggcggagtggcctgctgccttggctgcgacccgattccaagacacaggtaaccgtccagtacatgcaagacaatggagccgtcattcccgttcgaatacacactatcgtgatctctgtgcagcacaatgaggacatcactctggaggagatgagacgggctcttaaagaacaagtgatcagggccgtagtcccagctaaatacttggatgaagacactgtgtaccatctacagccttcaggccgtttcgtgatcggagggccccagggagacgccggtgtaaccgggcgcaaaattattgtggacacttacggcggttggggcgcacatggcggcggtgcattctcgggcaaagactataccaaagtggaccgctcagctgcttacgcagcacggtgggtggccaaatcactcgtcaaggctggcttatgtcggcgcgttttggtacaggtctcctatgccataggggtagctgagcccctatccattagtatctttacatacggaacctcccaaaaaaccgagagggaactgcttgatgtagttcacaaaaacttcgatctgagacccggggtgattgttcgtgatctcgatcttaaaaaacccatctaccagaaaactgcatgctatggacacttcggcaggtcagagttcccatgggaggtcccacgcaagctcgtcttctag

SEQ ID NO: 194931 - DNA, 438 bp, Artificial Sequence
  Description of Artificial Sequence: Synthetic coding sequence
gagagcgtgggcgagggccaccccgacaagatctgcgaccagatctcagatgcagtactcgacgctcacttgaagcaggatccaaacgctaaggtggcatgtgggtttgactttaagacttgcaacgtccttgtggccctggagcagcaaagcccagatatagcccaatgcgtgcatttggaccggaatgaagaagatgttggtgccggagatcagggcctgatgttcgggtatgccactgacgagacagaggagtgcatgcccctcaccatcattttggcacacaaactcaacgcaagaatggctgaccttcgtcgctcaggcctgttgccctggctgcggccggatagcaaaactcaggtcacagttcaatacatgcaggataacggagctgtaatcccagttagaattcacacgatagtcatctcggtccagtag

SEQ ID NO: 194932 - DNA, 1188 bp, Artificial Sequence
  Description of Artificial Sequence: Synthetic coding sequence
atgaacggccagctgaacggcttccacgaggccttcatcgaggagggtaccttcctttttacctctgaatccgtgggagaaggccacccagacaagatctgtgaccaaatatccgacgccgtcctcgacgcgcatcttcagcaggatccagacgctaaggtcgcctgtgagactgtcgccaaaacgggcatgatcctgctggcaggagagattacatcccgcgcagccgtcgactaccaaaaggtggtgagagaagctgtgaagcatatcgggtatgacgactcctctaaaggctttgactacaagacctgtaacgtcctcgtggccttggagcagcagagtcccgatatcgctcaaggcgttcatctggacaggaatgaggaagatatcggagcaggtgaccaagggctgatgttcgggtacgcaaccgatgagactgaagaatgcatgccactgactattgtgctcgcacataaattgaatgccaagcttgctgaattacggcggaatggcaccctaccctggttaagacctgactctaagacacaagtcacggtccagtacatgcaagaccgaggcgcagtgttgcctataagggtacatactatagtaataagcgtgcagcatgacgaggaagtctgtcttgacgagatgagagacgcattgaaagagaaggtcattaaggctgttgttcccgccaaatatctggacgaggataccatatatcacctgcagccctccggccgctttgtaattggcggccctcagggggatgcaggcctgacagggcgcaagatcatcgttgacacttacggtgggtggggggcacacggcggcggggccttttccggtaaagactatactaaggtggaccggagtgccgcttatgctgcgcggtgggtcgcgaagtcactagtaaaggggggactgtgtagacgagtgctggtccaggtctcttacgcaattggtgtcagccatccactctcaatctccattttccactatggcacaagccagaaatctgaacgagagttattagagatcgtcaaaaagaactttgatctccgcccgggcgtcatcgttagagaccttgacttgaagaagccaatataccagcgcactgcggcttatggtcactttggtagggactccttcccctgggaggttcccaaaaaacttaagtactag

SEQ ID NO: 194933 - DNA, 531 bp, Artificial Sequence
  Description of Artificial Sequence: Synthetic coding sequence
atgaacggccagctgaacggcttccacgaggccttcatcgaggagggcaccttcctctttacctctgaatccgtgggtgagggccacccagacaagatctgcgaccagatcggggatgctgggttaactggaaggaaaatcatcgtggatacatacgggggctggggtgcgcacggcggcggcgcattctctgggaaggattataccaaagtggataggtccgcagcctacgctgcgcgttgggtggcaaaatcattagtgaaggggggcctgtgccggagggttttggtgcaggtgagctatgctatcggcgtgtcccaccccttaagtatatctatatttcactatgggaccagccagaaaagcgaaagggagctgcttgaaatagttaagaagaattttgatctcaggccaggggttatcgtacgtgatttggacctcaaaaaacctatttaccagagaacagccgcctatgggcatttcggtcgcgattcttttccatgggaggtgcctaagaaactgaaatattag

SEQ ID NO: 194934 - DNA, 549 bp, Artificial Sequence
  Description of Artificial Sequence: Synthetic coding sequence
atggcccggctgctgtggctgctgcggggcctgaccctgggcaccgctccacggcgggctgtgaggggccaggctggcggcggtggaccaggaactggacccggcctgggagaggcaggcagcctggctacctgtgaactcccactcgcaaagtccgaatggcagaagaaattgacgccagaacagttctacgttacccgagagaaagggactgagcctccattctccggaatttaccttaataacaaggaggcaggtatgtatcactgcgtgtgctgcgattctcctcttttcagctcagagaaaaagtattgttccggcaccgggtggccctcattcagtgaagcccacgggaccagcggatcagacgaaagtcacacaggcatactgcgtcgtctcgacaccagccttgggagtgcacggaccgaagtggtctgcaagcagtgcgaagcacatctggggcatgtgtttccagatgggcctggccccaatggacaacgcttctgtatcaactcggtagcactcaaatttaaaccaagaaaacactag

SEQ ID NO: 194935 - DNA, 558 bp, Artificial Sequence
  Description of Artificial Sequence: Synthetic coding sequence
atgagcgccttcaacctgctgcacctggtgaccaagagccagcccgtcgcactccgggcttgcgggctgccgtcaggctcttgtcgtgataaaaagaattgtaaggtggtcttctcccaacaggaattacgcaagcggctcacacccctccaatatcacgtgacccaagaaaagggcacggagtctgcatttgaaggtgagtatacacatcataaagatccaggaatctacaagtgcgtggtgtgcggtaccccattattcaagtctgagacgaagttcgactctggtagtggttggccaagtttccacgacgtaatcaatagcgaagcaataacttttactgatgacttctcttacggtatgcaccgagtcgagacttcctgttcccagtgtggggcccacctgggccacatttttgatgacgggcctaggccgacgggcaagagatactgcataaacagtgcagccctcagcttcacaccagcagattcgtccggcacagccgagggaggctccggcgtggctagccccgctcaggcagataaagctgagctgtag

SEQ ID NO: 194936 - DNA, 579 bp, Artificial Sequence
  Description of Artificial Sequence: Synthetic coding sequence
atgagcccccggcggaccctgccccggcccctgagcctgtgcctgagcctctgcctctgcctatgtctcgcagctgccttggggtccgcgcagtcaggttcatgtagggacaagaagaactgtaaagtcgtcttttcccagcaggagttaaggaaaaggctgactccactgcaatatcacgtgacacaggaaaagggtaccgaatctgccttcgagggcgagtatactcatcacaaagatcccggtatttacaagtgtgtagtctgcggtactccccttttcaaaagcgaaacaaaatttgacagcggatccggctggcccagtttccacgacgtcatcaattctgaggcaatcacattcaccgacgattttagttacggcatgcacagagtagagacttcctgctcccagtgtggagcgcacctgggccatatcttcgacgatggtcctcgccccaccgggaaacggtactgtatcaattctgctgccctatcattcacacccgctgactcctcaggcactgccgagggcgggagcggggtggcaagtccggcccaggcagataaggcagaactttag

SEQ ID NO: 194937 - DNA, 495 bp, Artificial Sequence
  Description of Artificial Sequence: Synthetic coding sequence
atgagcgccttcaacctgctgcacctggtgaccaagagccagcccgtggctctcagagcgtgcggcctgccttctggaagctgccgcgacaagaagaattgcaaggtggtctttagccagcaggagctcaggaagaggctcaccccgctgcaatatcacgtgactcaggagaagggcaccgaatccgcctttgagggggagtacacccatcacaaggaccctggcatctacaagtgcgtggtttgcggcactccgctctttaagtccgagactaagttcgactccggatctgggtggccatcctttcacgacgtgatcaactcggaggctattacattcacggacgatttctcttacggaatgcaccgggtcgagactagctgttcacaatgtggcgcccatctggggcatatttttgatgatggccctcgaccaactgggaagaggtattgtattaactcggccgcgttaagttttacaccagccgactcctag

SEQ ID NO: 194938 - DNA, 558 bp, Artificial Sequence
  Description of Artificial Sequence: Synthetic coding sequence
atgagcgccttcaacctgctgcacctggtgaccaagagccagcccgtggcgctcagggcctgcggactcccaagcggatcttgtcgcgacaaaaagaactgcaaagtcgttttttcacagcaggaactgaggaagaggttaaccccactccagtaccacgttactcaagagaaggggacagaaagcgctttcgagggagaatacacccatcacaaggaccccggaatctacaagtgcgttgtttgcggcacaccactcttcaagagcgagactaagttcgacagtggctcaggatggccgtcgttccacgacgtgattaactctgaagctataactttcaccgacgacttctcctatgggatgcatagagtggaaactagctgcagccagtgtggcgcccatcttggacacatctttgatgatgggccccgacccaccggcaagaggtactgtatcaactcggcagccctgtcctttacgccggcagacagttctggaacggcagagggcggaagtggcgtggcgtcgcccgctcaggcggacaaagctgaattgtag

SEQ ID NO: 194939 - DNA, 354 bp, Artificial Sequence
  Description of Artificial Sequence: Synthetic coding sequence
atgagcgccttcaacctgctgcacctggtgaccaagagccagcccgtggccctgcgcgcatgtggactgccatctggctcctgtcgggataaaaaaaactgcaaggtcgtgttctctcaacaagaattgagaaagcggctcacacctctccaatatcacgtcacgcaggaaaagggaaccgagtccgctttcgagggtgaatacacacaccacaaagatccaggaatttataagtgcgtcgtatgcggaactccccttttcaagtcggaaactaagtttgactctgggtctggatggccttctttccatgatgtaatcaactccgaggccattacttttacagacgatttttag

SEQ ID NO: 194940 - DNA, 2703 bp, Artificial Sequence
  Description of Artificial Sequence: Synthetic coding sequence
atgcggctgttcgtgagcgacggcgtgcccggctgcctgcccgtgctcgcggcagcaggaagggcacgggggcgagccgaggtcctgattagcacagtgggaccggaggactgcgttgttccgttcctgacaagaccgaaggttccggtgcttcagttagacagcggcaactatcttttttctacatccgctatctgccggtacttttttcttctgtccggatgggagcaagatgatttgacgaatcagtggctcgagtgggaggctacagaactgcagcctgccctcagtgcagcactctactatctggtggtgcaggggaaaaaaggtgaagacgttctcggatccgtccggcgggccctgacccacatcgaccactcactttctagacaaaattgcccgttcctcgcaggtgaaactgagagcttagctgacattgtgttatggggggcactctatcccctgctccaagatcccgcatacctgcccgaggaactatccgccctgcacagttggttccaaacattgtcaactcaagagccgtgtcagcgcgcggccgagaccgtgctcaaacagcaaggggtcctggcccttagaccttatctgcagaagcagccacagcccagcccggctgaggggcgagcggtgaccaacgaacccgaagaagaggaattggccacgttaagcgaggaggaaatagctatggccgttaccgcctgggagaagggtctagaaagtctacctccacttaggcctcagcagaatcccgtgttgcccgtggctggagagcgaaatgtcttgattaccagtgccctgccctatgtcaataacgtgccacacctggggaacatcattggctgtgtgctctcagctgatgtgttcgccagatactcacgcctgagacagtggaatacactttatctgtgcgggaccgacgagtacggcaccgccaccgaaaccaaggcactggaagaaggcttaacaccgcaggaaatctgcgataagtatcacatcatccacgcagacatttatagatggttcaacatcagcttcgacatctttgggagaacaacaacgccccagcagaccaaaataacccaagatatttttcagcagttgctcaaacggggcttcgtgctgcaggacacagtcgaacagctcagatgcgaacactgcgcccgcttccttgccgataggtttgttgaaggggtttgtcctttctgcggctatgaagaagccagaggtgaccagtgcgacaaatgtggaaagttgatcaatgccgtcgagctgaagaagcctcagtgcaaggtgtgccggagctgccctgtcgtccaaagttctcaacatctgttcctcgaccttcctaagctggaaaaacgcctggaggagtggctgggccgaaccttgccaggcagtgattggaccccaaacgcacagtttattacccgcagttggctaagagacggtttaaaaccccgatgtattaccagagacctgaagtggggtaccccagtgcctctcgaagggtttgaggataaggttttctatgtgtggttcgatgcgaccataggctacctgagcatcaccgccaattacacggatcaatgggagcgatggtggaaaaaccccgagcaagtggatttatatcaattcatggccaaagacaacgtgccatttcacagtctggtctttccatgttcagccctgggggccgaggacaactacaccttggtctcccacctcattgctacagagtatctaaactatgaggacggtaaatttagcaagagtcgtggggttggggtgtttggagatatggcgcaggacaccggtatacccgccgacatctggcgcttctatcttctgtacatccggcccgaagggcaggatagcgcattcagctggactgaccttttgctgaagaacaactctgagctgctgaataacttgggcaacttcatcaatcgcgccgggatgtttgtttctaaattctttgggggctacgtgccggaaatggttctcactccagacgatcagaggcttctggctcatgtgactctggagctgcagcattaccatcagcttctggagaaggtgagaatcagggacgcccttaggtccattctgactatatctcgccatggaaaccaatatattcaagtcaatgaaccctggaagcgcatcaagggcagcgaagccgacaggcaacgagcgggaacagtgactggactggcagtgaatattgccgcccttctctctgtgatgttacaaccatacatgcccacagtttctgccaccatacaagcacaactccagctccccccccctgcatgcagcattctgttgactaattttctgtgtactttacctgcagggcaccagattggtacggtatctcccctatttcagaagctggagaacgatcagatcgagagtctgagacagcgcttcggcggcgggcaagcaaaaactagcccaaagccagctgtggtggagactgttactactgcaaagcctcaacagatccaggccctgatggatgaggttactaagcaaggcaacattgtgcgagagctcaaggcacaaaaagccgacaagaacgaggtcgcagcagaagtcgcaaaactactcgacctgaagaaacagctggctgtcgcggaaggaaagcctcctgaagcacccaagggcaagaagaagaagtag

SEQ ID NO: 194941 - DNA, 1908 bp, Artificial Sequence
  Description of Artificial Sequence: Synthetic coding sequence
atggccgtgaccgcctgggagaagggcctggagagcctgccccccctgcggccgcagcaaaatccagtccttcccgtggccggcgagcgaaacgtgcttatcacgtctgccttgccctacgtgaataatgtgccacatctgggcaacatcatagggtgtgtactgagcgctgatgttttcgcacgctactctcgccttagacagtggaacacactttacctttgcgggactgatgagtacggcacggccactgagaccaaagctttggaagaaggtttgaccccccaggagatctgtgataaatatcatattatccacgctgatatctaccgatggttcaatatctcgtttgacatctttggccggacaaccacacctcagcaaactaaaattacgcaggacatcttccagcagttgctgaagcggggctttgtgctgcaagatactgttgagcagttgagatgtgagcattgcgcccgtttccttgccgatcgattcgtggagggcgtgtgcccattttgcggctacgaggaggctaggggggaccagtgcgataaatgtggcaagttgataaatgctgtcgaactgaagaaaccgcagtgtaaagtttgtcggagttgccccgtagtgcagagttcccaacacctgtttctggacttgcctaaactggaaaaacggctagaggagtggttgggccgaacgttacctgggagtgactggactcccaatgcccagttcattaccagatcttggttgcgcgacggccttaagccgcggtgcattactagggacctgaaatgggggactcccgttcccttggagggcttcgaagataaggtgttctacgtatggtttgatgccaccatcggttacttatccattacagcaaactacaccgaccagtgggaacgatggtggaagaatcccgaacaggtggatctgtaccagtttatggcaaaggacaacgtgcctttccactcattggtcttcccctgttctgccctgggcgccgaggataactacaccctggtgtcacatctcattgcaactgagtatctgaactatgaagatgggaagttctccaaatctaggggggtgggcgtgtttggtgacatggcccaggacacgggcattcccgcagacatctggcggttctacctcttgtacattcgtccagaggggcaagatagcgcattttcctggacggatctgttactgaaaaacaattcggaactgctgaataacctcggtaatttcattaaccgcgcaggaatgtttgtctccaagtttttcggaggatacgtgcccgagatggtgctcacaccagacgaccagagattgctggctcatgttactctggagttacagcactaccaccagctgttagaaaaggtgcggatacgcgatgccctgcggtctattctgactatctctcgtcacggaaaccagtatattcaggtcaacgagccttggaaaaggattaaagggagcgaggcagaccggcaacgggcagggaccgtgaccggactggcagtcaatatagctgcccttctgagtgtgatgctgcagccatacatgcctacggtgtccgccacaattcaggctcagcttcagctgccacctccggcttgcagcatcttactgacgaattttctgtgtacccttcccgcaggtcaccagattggaacagtatctcccctgtttcagaagctagagaatgatcagatcgaatctttgagacaacgttttgggggcggccaggtgaggaagctgaaggccgtcccttcccttcataattcccactccatcaccagcttgatcagcctgtcctcgcctcaccctagcctcttcccgtcctttgggcctgcagcttcatctctaacagtgttcttgtcctgcttaaactag

SEQ ID NO: 194942 - DNA, 1641 bp, Artificial Sequence
  Description of Artificial Sequence: Synthetic coding sequence
atgcggctgttcgtgagcgacggcgtgcccggctgcctgcccgtgctggcggccgcgggacgcgcacggggcagggccgaggtgctcatcagcaccgttggccccgaggattgcgtcgtgccattcttgacgagaccaaaagtgccagtgctccagctggacagcggtaattacttattttccacaagtgctatctgcagatatttttttctgcttagcgggtgggagcaggacgacctcacaaatcagtggctagaatgggaggctacggagctgcaaccagctctgagtgctgctctatactatttagtggtgcaaggcaaaaagggcgaggatgtcttggggtctgttcgccgtgccctcacccacattgatcacagcctctccagacagaactgccctttcttggctggcgagactgaaagtctagctgatatcgtcttgtggggtgcactgtatccactgctgcaggaccccgcctacctgccagaggagttgtcagctctgcattcctggtttcaaaccctcagtacccaggaaccatgccagagggcagctgaaacagtcctaaagcagcaaggagtcttggcacttaggccctatctccagaagcagccccagccaagccccgccgaggggagggcggtcaccaatgaaccagaggaagaggagctagcaacgttatcggaggaagagatcgcgatggccgtgaccgcttgggagaagggcctggagagtctgcctcccctgcggcctcagcagaatccggtcttgcccgtcgctggcgagagaaacgtgcttatcaccagtgcactcccttacgtgaataacgtgccgcatctaggtaacatcattggttgcgtcctgagcgctgacgtattcgctcggtactcccgcctgagacagtggaacacattgtacctttgtggcacagatgagtatggaactgccactgagacaaaggccctcgaggaggggctcactccccaggaaatctgcgataaataccacataattcatgctgacatttataggtggttcaatatctcgttcgacatatttgggaggaccacgactccccagcagaccaagatcactcaggacatctttcaacaactgttgaagcgaggctttgtgctgcaggatactgtagagcagctccgctgcgaacactgcgcgaggttccttgccgatcgattcgtggagggagtttgtccattctgcgggtacgaggaggctaggggtgatcagtgcgataaatgtggcaagttgattaatgcagttgagttgaagaaaccacagtgcaaagtgtgccgatcatgccctgtggtccagtcatcccagcatttgttcctcgatttgcctaaactggagaaacggctcgaggagtggctagggcgcactcttcctggttcagactggacacctaatgcccagttcatcacacgctcctggcttagagatgggctgaagcctcgttgtatcaccagagaccttaaatggggaacaccagtaccacttgaaggcttcgaagataaagtcttctatgtgtggtttgacgcgacgattggatacctcagtatcaccgcgaactatacggatcagtgggagcgctggtggaagaaccccgagcagccctag

SEQ ID NO: 194943 - DNA, 1782 bp, Artificial Sequence
  Description of Artificial Sequence: Synthetic coding sequence
atgctgcggaccagcgtgctgcggctgctgggccggaccggcgcctctcgtctgagcctgctcgaggacttcggccccagatattactcctctggttccctgtccgccggcgatgacgcttgcgacgtgagggcttacttcactacaccaattttttatgtgaatgcggcacctcacatcggccacttgtacagcgccctgctggccgacgcactttgccgacataggaggctgcgggggccaagcacagccgcgacacggttttctacaggtaccgacgagcacggcctgaagatccagcaggccgcggcgacagcgggactcgccccaaccgaactgtgtgatcgagtcagcgaacagttccagcaactgttccaagaggctggaatttcctgcacagacttcatcagaactaccgaggcacgtcacagggtagccgttcagcatttctggggagtgctgaaaagtagaggcctgctgtacaaaggcgtttatgagggatggtactgcgcctctgacgagtgcttcctccccgaagctaaggttacccaacagcccggaccctccggcgacagctttccagtgagcctggagagtgggcatccggtgtcttggactaaagaggaaaactacatattcaggctttctcagttccgaaaaccactgcaacggtggctccgcggcaacccacaggccattacgcccgaaccattccaccatgtagttctccaatggctggatgaggaacttcccgacctcagtgtgtctcggcggagcagccatctgcattggggtattccagtcccaggagacgactctcaaactatatacgtctggctcgacgcacttgtgaactatctgactgtgattggatatcccaatgctgagttcaagtcatggtggcccgccacctctcatatcatcggcaaagacatcctcaaatttcacgccatctactggccagcctttctgctgggagcagggatgtctcctccacagcgaatctgtgttcacagccattggaccgtgtgtggtcaaaagatgtccaaatctctgggaaacgtggtggaccccaggacttgcttgaatcggtacactgtcgatggattcagatacttcctgctgcgacagggtgtcccaaactgggattgtgactattacgacgaaaaagtagttaagctgctgaactccgaactcgctgacgccctcggggggctgcttaacaggtgtactgcaaagcgcataaacccatccgaaacatacccagccttctgcaccacctgtttcccatctgagccaggactagtaggcccttccgtgcgggcacaggcagaggactacgcactggtctccgccgtcgccactttgcctaagcaagtggccgatcactatgataactttcggatttacaaggcccttgaagcagttagtagctgtgttaggcagacgaacggattcgtccaaagacacgctccttggaagttaaactgggagtctcccgtagatgcaccatggctgggaacagtcctacatgtggcattggagtgcctccgcgtgtttggcacgttactccaacctgtgactccctccctagcggacaagctgctgtcccgtcttggcgtctccgccagcgagaggagcctgggggaactgtattttctcccgagattctacgggcatccttgtccattcgaaggaaggcgcctcggtccagagaccggactgttatttccccgtctggaccagtctcgcacatggctcgttaaggctcaccggacctag

SEQ ID NO: 194944 - DNA, 1563 bp, Artificial Sequence
  Description of Artificial Sequence: Synthetic coding sequence
atgctgcggaccagcgtgctgcggctgctgggccggaccggcgcctctagactgagtttgctggaagactttggcccgcggtactattcctccggatccctcagcgccggcgatgatgcttgtgatgtgcgcgcctacttcaccactcctattttctatgtgaatgcggcaccacatataggccatctctatagtgccctactggccgatgcactttgtcggcacagacgcctccgggggccgagcacagcggcaacccgattctccacaggtactgacgaacatggcctgaaaatccagcaggcagccgctactgctggcctggccccaacagaactgtgtgacagagtgtccgaacagttccagcagttgtttcaagaggctggaatctcatggactaaagaggagaattacatcttcagactgtcccagttcagaaagcctttgcaacgctggctccgagggaacccacaggcaatcacccccgaacccttccatcacgtagtgttgcagtggctcgatgaggaactaccagatcttagcgtgtctaggcgcagtagccacctacactggggcattccagtgccaggggatgacagtcagactatctacgtatggctggatgcacttgtgaattatctgactgtgatcggctaccctaatgcggaatttaaatcttggtggccagccaccagccacatcattggcaaggatatcctgaaattccacgccatctactggccggcattcctcctgggcgccggcatgagtcctccacagcggatttgtgtgcactcccattggacagtctgcggccaaaagatgtccaaatcactcgggaacgtcgtagatccccgaacctgcttgaaccggtatactgtggacggctttagatactttctgctgcggcaaggagttccaaactgggactgcgactattatgatgagaaggtggtgaagttgttgaatagcgagctggcagatgccttggggggactattgaaccgatgcaccgcaaagagaattaaccccagtgagacatatccggccttttgcactacctgttttccgagcgagccaggactggtcggcccgtctgtgagagcccaggccgaagactacgcgttggtatctgcggtcgctaccctccctaaacaggtcgcagatcattatgacaatttccggatctacaaggctctggaagcagtgagctcttgtgttcgccagaccaatggcttcgtacaaaggcacgccccttggaagctcaactgggagtcccctgtggacgctccatggctggggacagtgcttcatgtcgccctcgagtgtctgcgtgtgttcggtaccctgctgcagccagtgaccccatcacttgcggacaaactgctctctagacttggcgtaagcgccagcgagcgctccttgggggaattgtactttctcccccgcttctacgggcacccgtgcccatttgaaggaaggaggctgggcccagagacaggtcttctctttcctagactagaccagtccaggacatggttggtgaaagcacatcgcacttag

SEQ ID NO: 194945 - DNA, 1461 bp, Artificial Sequence
  Description of Artificial Sequence: Synthetic coding sequence
atggtggccggcatgctgggcctgcgggaggagaagagcgaggaccaggacctgcagggcctgaaagacaagccacttaaatttaaaaaagtgaaaaaggataaaaaggaggaaaaggaaggtaagcacgagccagtacagcccagtgcgcaccactcagccgaaccagccgaagctggcaaagccgaaacctccgagggatcaggcagtgcacccgcggtaccggaggcatctgcgtctcctaaacaacggcgatccattattcgagatcggggtccaatgtatgacgacccaactctcccagaaggttggacccgcaagctgaagcagagaaagtcaggccgttccgctggtaaatacgatgtgtacctcatcaatccccaggggaaagccttccgtagcaaagtggaattgatcgcctacttcgaaaaggtaggtgatactagcctggatcctaacgatttcgatttcactgttacaggtaggggctctccttcccgccgcgagcagaaaccccccaaaaaaccaaaatctcctaaagcccctggcacgggacgtggccgaggccggcccaaggggagcgggacaactcgaccaaaggccgccactagcgaaggtgtacaagtgaaaagggtcctggagaaaagccccgggaagctgctggttaaaatgccgtttcaaacatccccaggaggcaaggccgaagggggaggcgccacaactagcacacaggtgatggtgataaaacggccaggccggaaaaggaaggcagaggcagatccacaggccattcccaagaaacgaggccgaaagcctgggagtgtagtggctgccgcggccgctgaggccaaaaaaaaggctgtgaaagagagcagtattaggtctgttcaggagaccgtgcttccaatcaaaaaaagaaaaaccagggagacggtgtcaatcgaggtgaaggaggtagtgaagccacttctggtgagcactctgggcgagaagtctggcaaaggactgaagacttgcaagagcccgggcagaaaaagcaaagaatcctcccccaagggacgcagctcttcagcaagttccccccctaagaaggaacatcaccaccatcaccaccatagcgagagccctaaggcccctgtgccactcttgccaccactaccaccaccaccgccagagccagagtcttcagaggatcctacctcaccacccgagccacaggaccttagctcctctgtctgtaaggaagaaaagatgccaaggggtggtagcctagaatctgacggttgtcctaaagagcctgcaaagacccagccagctgtggcaacggctgccaccgcagcggagaagtataagcacagaggtgaaggtgagcggaaagatattgtttctagctcgatgcccagacccaacagggaggagccagtagacagtaggacccccgtaaccgaacgcgtgagctag

SEQ ID NO: 194946 - DNA, 816 bp, Artificial Sequence
  Description of Artificial Sequence: Synthetic coding sequence
atggtggccggcatgctgggcctgcgggaggagaagagcgaggaccaagaccttcagggcttaaaagacaagccactgaaattcaagaaggtgaagaaggataagaaggaagagaaggagggcaagcatgaacctgtacagccatcagctcaccacagcgccgagcccgctgaagccgggaaggcggagacctctgagggttctggttccgcccccgccgtccccgaggcttctgccagccctaagcagagacgatccatcatccgggacaggggtcccatgtacgacgaccctacactgcctgagggctggactaggaagctgaagcaacgtaagtcaggtaggtctgctgggaaatacgatgtttaccttattaatccgcagggaaaggcttttagatctaaggtcgaacttattgcctacttcgaaaaggtaggcgacaccagcctagacccaaacgacttcgacttcactgtgactggaagaggaagtcctagccgaagggaacagaagcccccgaagaaacctaagtcccctaaggctcctggtacagggcgcgggaggggtcggcccaagggctcgggaaccacacgtccgaaggctgcaacatcagagggggtccaggttaagcgcgtgctggagaagagtccagggaagctccttgtcaagatgccgttccagacatccccggggggaaaggcggaagggggcggagccacaacttcaacacaggtgatggtcattaagaggcccggccgtaagcggagtccgcgagccccccggactccccccgcccctcttagccctcggacatag

SEQ ID NO: 194947 - DNA, 153 bp, Artificial Sequence
  Description of Artificial Sequence: Synthetic coding sequence
atggtggccggcatgctgggcctgcgggaggagaagagcgaggaccaagacctgcagggcctgaaagataagccactgaagtttaaaaaggtgaaaaaggacaaaaaggaggaaaaagagggcaaacatgaaccagtgcagccctccgcttag

SEQ ID NO: 194948 - DNA, 1497 bp, Artificial Sequence
  Description of Artificial Sequence: Synthetic coding sequence
atggccgccgccgccgccgccgcccccagcggcggcggcggcggcggggaagaggagcgcttagaggagaaaagcgaggatcaggacttacagggtctgaaggacaaacccctgaaatttaaaaaggtcaaaaaagacaagaaggaggagaaagagggcaagcatgagcctgtgcagccatctgcacaccattcggcggaacctgcagaagcaggaaaggccgagacaagcgaaggatccggatccgcccctgcagtcccagaggcttctgcaagcccaaaacagcgtcgaagcatcattagggacaggggccccatgtatgatgatcctaccctacccgagggctggaccagaaagctgaaacaacggaaatctggacgatcggctgggaaatacgatgtatacctcatcaatcctcaaggcaaagcctttcggtccaaggttgaattgatcgcctacttcgagaaagttggggacacaagccttgaccccaatgacttcgattttaccgtgactggacggggcagcccaagtcgcagggagcagaagcccccgaaaaaacccaaatcccccaaggccccgggtactggcaggggtagagggcgccctaaagggtccggtactaccagacctaaggcagcaacctctgaaggcgtgcaggtgaaaagagtgctggagaagtcccccggtaaacttctcgtgaagatgccctttcaaacaagtccaggcgggaaggccgaggggggtggagccacgacctcaactcaggttatggtgattaaacgacccggtagaaagagaaaggctgaggccgaccctcaggccatccccaagaaaagaggccgaaagcccggcagtgttgtggcagcggccgcggctgaagccaaaaagaaagccgtgaaagagtccagtatccgttccgtccaggagactgttcttccaattaaaaaacgaaaaactcgggaaactgtaagtatagaagtgaaagaggtggtaaagcccttattagtgagtaccctgggtgaaaagagcggcaagggactcaaaacttgcaaatcacccggccggaaaagcaaggagagtagcccaaaaggacgatcaagcagcgcttccagccctccaaagaaagagcaccaccatcatcaccatcatagtgagtcaccgaaggccccagtacccttactgccccccctacctccgcccccgccagaacctgaaagctcagaggatcccacatcccctccggagcctcaggacttgagctccagcgtgtgtaaggaagagaaaatgccacgcggaggatcccttgaatctgatggatgccctaaagaacccgccaagactcagcccgctgtcgccacagcggcaaccgctgccgagaagtacaaacacagaggagaaggggagcgcaaggacatcgtgtcttcatccatgccccgtccaaatcgcgaggagccggtagacagtagaacccccgtgaccgagagggtttcgtag

SEQ ID NO: 194949 - DNA, 1185 bp, Artificial Sequence
  Description of Artificial Sequence: Synthetic coding sequence
atggtggccggcatgctgggcctgcgggaggagaagagcgaggaccaggacctgcagggcttgaaagacaaacccctgaagttcaagaaggtgaagaaagataaaaaggaggagaaggaaggcaagcacgaacctgtgcagccaagcgctcaccacagcgccgaacctgcagaagctgggaaagcagagacctctgagggttcgggttctgcccccgcagtgccggaggcctctgcctcccctaaacagagacggagtattatcagagaccggggacctatgtatgacgaccctacgttacccgagggctggacacggaagctgaagcagaggaagtccgggcgatctgcagggaagtacgacgtgtacttgattaatccgcaaggtaaggcatttagatccaaagttgaactgatcgcctactttgagaaagtgggcgataccagcctggaccctaacgattttgatttcactgtcacaggacggggtagtccctcaagacgagaacaaaagcctccgaagaagcccaagtccccaaaggcgcctggcaccggtcggggcaggggcagaccgaagggatctggcaccaccaggcctaaggccgcaacatcagaaggagtccaagttaaacgagtcctcgagaagtctcccggcaagcttctggtgaagatgccctttcagaccagccccggcggcaaggccgagggagggggagcgacaaccagcacgcaggtgatggtaatcaaaagaccgggtcggaagcgaaaagcggaggcagatccgcaggccattcccaaaaagcgaggccgcaagccggggagcgtagtggccgctgcggccgcggaagcaaagaaaaaggctgtcaaagaatccagcattagatcagtccaggagaccgttcttcccatcaagaagagaaagacccgcgaaacagtcagtatagaagtcaaggaagtggtgaaacccttattggtctctacgcttggcgagaaatccgggaaaggactgaagacatgtaagtctcctggacgcaaatctaaggagtccagccctaaaggcaggtcttcatctgctagctcgcctcctaaaaaagagcatcaccatcatcaccaccacagcgagagcccaaaggctcctgtgccaactcgaataaaggctgccgttgtgtcgtccccatacggctag

SEQ ID NO: 194950 - DNA, 1818 bp, Artificial Sequence
  Description of Artificial Sequence: Synthetic coding sequence
atggccgaggactggctggactgccccgccctgggccccggctggaaacgccgcgaggttttcagaaagagcggcgctacctgtggccggagcgatacatactatcagtctccaaccggcgatagaatccgtagtaaagtcgagttaacccggtacttgggacctgcatgtgacctgaccctcttcgatttcaagcagggaatcctgtgctaccccgcaccaaaagctcaccccgtcgcagtggcctcaaaaaagaggaaaaagccatctcgcccggcaaagactcgtaagcgtcaggttggaccacaatccggggaggtgcgcaaggaagcgcctagagacgagacaaaggcggacacagacaccgctccagcctctttcccagcccccgggtgctgtgagaattgcggcattagcttcagtggtgatggtacccagaggcagcgactcaagaccctatgtaaggattgtagggctcagcgcatagccttcaacagggagcagaggatgtttaaaagggttggatgcggcgagtgcgcagcctgccaagtcaccgaagattgcggagcttgttctacttgcctcctgcagctaccccacgatgttgcatcggggctgttctgcaagtgcgagagacggcgatgtttgaggatcgtggagcgaagcagaggatgtggagtgtgcaggggctgtcagacacaagaagattgtggacattgtcccatctgtctgagaccccccaggccaggactccgccgccaatggaagtgcgtccagaggcgctgccttcggggaaagcatgcccggcgaaaagggggctgcgattccaagatggctgcgcggaggaggccaggcgcccaacctttgccccctcctcccccttcccagtctccagagcctaccgagccccacccgcgtgctttggcccctagtcctccagcagagtttatctattactgcgtggacgaggacgagcttcagccgtacactaaccggcgtcagaaccgaaaatgtggagcttgtgccgcttgcttacgtaggatggattgtgggaggtgtgatttttgctgtgacaagcccaagtttggtgggtctaatcagaaaaggcagaagtgcagatggcgccagtgtctacagttcgctatgaagagactgctcccgagtgtctggtccgagtccgaagatggagctggttcaccgcccccctacagacgaagaaagcgtccatcctcagcccgaagacaccacttgggacccacgcttaaacccacactggctacccggacagcacagccagatcatacacaggccccaactaagcaggaggcagggggtggcttcgtcctgcccccacccggcactgacctggtcttcctgcgcgagggcgcctctagccctgttcaggtgcccgggccagtggctgcctcaactgaggcgttgctccaggaggcccagtgctctggcctgtcatgggtcgtggcattaccccaggtaaagcaggaaaaggcggatacccaggacgagtggaccccagggaccgccgttctcacaagcccagtgctcgtccctggatgcccaagtaaagctgtcgatccagggctgccatccgtgaaacaggaaccacctgacccagaagaggacaaagaagagaacaaggacgatagcgcctccaaactcgctccggaggaagaagcgggcggtgccggcacgccagttattacggaaatatttagtctgggggggacccgttttcgtgacaccgctgtgtggttgcccaggtcaaaggatctgaagaagccgggcgccaggaagcaatag

SEQ ID NO: 194951 - DNA, 1761 bp, Artificial Sequence
  Description of Artificial Sequence: Synthetic coding sequence
atggccgaggactggctggactgccccgccctgggccccggctggaaacgacgggaggtgttcagaaagtcaggagctacatgcggacgctctgacacctactatcagagcccaaccggggatcggatccggagtaaggtcgaactaacaagataccttgggcccgcctgtgacctgacactgtttgactttaagcagggcatcctctgctacccagctcccaaggcacacccagtggcagtggcttccaagaaacgcaaaaaaccatcaagaccagctaaaaccaggaagaggcaggtgggcccacagtcaggggaagtgcgaaaagaggcccctcgggacgaaacaaaagccgacacagacactgctccagcaagtttccccgcacccggttgctgcgaaaattgcgggatatccttctcaggcgacgggactcaaagacagaggctgaagactctgtgcaaggattgccgggcacaaaggatcgcattcaacagagagcagagaatgtttaagagggttgggtgtggagaatgcgctgcctgtcaagtgaccgaagactgcggagcctgctctacctgcctcctacaactgccacacgatgtggcatccggcctgttttgtaagtgtgagagacgccgatgtctgcggatagtggagagatccaggggctgtggagtttgcagggggtgccagacacaggaagactgcggacactgccccatatgcttgcgaccgccccgtccaggcctgcgcaggcagtggaaatgtgtgcagcgaaggtgccttcgaggaaagcacgccagaaggaaggggggctgtgacagtaaaatggccgcacgccggcggcctggcgcccagcccctgccgccgccaccccccagccaatcccccgaacccaccgaacctcaaccttatacaaaccgcagacagaatcgtaagtgcggggcgtgtgcggcctgtcttagacgtatggactgcggcagatgtgatttctgttgcgataagcctaagttcggcggatccaatcagaagcggcaaaagtgcagatggcgtcagtgtctccagtttgcgatgaagagacttctgccctcggtctggagcgaaagcgaagacggcgcaggctcaccccccccgtaccgaaggcgcaaacggccaagcagtgctcgcagacatcaccttgggcccacattgaaacctaccctggctactcggacggcccagcctgatcacactcaggccccaacgaaacaggaagccggaggcgggttcgttctccctccacctggaacagacctcgtatttctgagagaaggcgcttcctcgccagtgcaggtcccgggcccagtggccgcaagtactgaagccctactgcaagctgttgaccctggcctcccaagcgtaaagcaggagcctcccgatccagaggaggacaaggaagagaacaaagatgattctgcctcaaaactcgctccagaggaggaagccggcggagccgggacacccgtgatcactgagatcttcagcttaggaggaactagattcagagacacagcagtttggctaccttcccttcaaggcaggcacagtggtcgggaggacggatgcaaggtgtgggaaaccgaggataccgtggaacccactagcacctcttggaaccccagagggtggccgggtacccacgtgagcctttctccccccccagcaagcatgatgtgggtaagttgccgtcgctcttggtgtccctccagtcagagctag

SEQ ID NO: 194952 - DNA, 1653 bp, Artificial Sequence
  Description of Artificial Sequence: Synthetic coding sequence
atggccgaggactggctggactgccccgccctgggccccggctggaaaagacgggaagtctttagaaaatcgggcgctacctgtggacgaagcgatacatactaccagtcccccaccggtgaccggatcagatcgaaggtcgaactgaccagatacctcggccccgcttgcgacctgacactatttgatttcaaacagggaatactctgttaccccgcccctaaggcgcaccctgtggcggtggctagtaaaaaacgcaaaaaaccaagtagaccagctaaaacgcgaaaacggcaggtgggtccacagtccggtgaggtgcggaaggaagccccacgcgatgagactaaagcagacacggatactgctcctgctagttttcctgcgcctggttgttgtgaaaattgcggcatatctttcagtggagacggcactcagaggcagcgcctgaaaacactttgcaaggattgtagagcacaaagaattgcatttaatagagagcagagaatgttcaagcgcgttgggtgtggcgagtgcgcagcatgtcaggtgactgaggattgcggggcttgttccacatgccttctccaactcccacacgacgttgcttccggcttattttgcaagtgcgagcgccgacgttgtctgcgaattgttgaaagaagtagaggttgcggtgtgtgtagagggtgtcagacccaggaggactgcggccactgtcctatatgtttgagacctcccagacccggtttacgccgccagtggaagtgcgtgcagaggcgatgtcttcgcggcaaacacgccaggagaaagggggggtgtgactcaaaaatggctgcccgccgcagacctggcgcccagccgttgccacccccaccaccaagccagtcccccgagcccacggaaccacacccacgcgcccttgccccatcccccccagccgagtttatatactactgtgttgatgaagatgagctccagccgtacactaatagaaggcagaaccgcaaatgcggagcttgcgctgcatgtctgagaaggatggactgcggaagatgtgacttctgctgtgacaagcctaagtttggaggcagtaatcagaagcggcaaaagtgcagatggcggcagtgcttgcagtttgcgatgaagagattgctgcccagcgtttggtcggaaagcgaagatggagctggctcaccgccaccatatcgacgtcgcaagcgcccttctagcgcaaggaggcaccatttgggaccaaccctcaagccgaccctggccacaagaaccgcccaacctgatcacacacaggcccccacaaagcaagaagcgggagggggatttgttcttcctcccccgggtaccgatctagttttcttgcgagaaggtgcttcaagtcccgtacaagtccctgggccagtggccgccagcactgaagctcttctgcaggctgtcgatcccggcctgccctccgtaaaacaggaaccccctgaccctgaagaggataaagaagagaataaggatgatagcgccagtaagctggcgccggaggaggaggccggcggcgcaggcacaccagtagaacctacaactcagccacagtattcaggcaacttcgacaatgacctgtacgagatctatctcatcgatatttag

SEQ ID NO: 194953 - DNA, 1650 bp, Artificial Sequence
  Description of Artificial Sequence: Synthetic coding sequence
atggccgaggactggctggactgccccgccctgggccccggctggaaaagacgtgaagtgttcagaaagagcggcgctacatgtggacgctctgatacttattatcagtcgccaacaggcgacaggattagatccaaagtggagctaacaaggtatctcgggccagcctgcgatttaactcttttcgatttcaagcaaggcatcttgtgctatcctgcgcctaaagcacatccagtggccgtggccagtaagaagcgcaagaagccaagtcgacctgctaaaacacgcaagaggcaggtgggcccccagagcggagaggtaaggaaagaagccccccgtgacgaaaccaaagcagataccgacaccgcccccgctagcttccctgccccaggttgttgtgagaactgcggaattagctttagcggtgatggaacccagcgtcagaggttgaagacgctttgcaaggattgcagagcacagcggatcgcctttaaccgcgagcagagaatgttcaaaagagtcgggtgtggagaatgtgccgcttgtcaggtgacagaagattgtggcgcatgcagcacctgcctgctgcagctaccccacgatgttgcaagcgggctcttttgcaaatgtgagagaagaagatgtctgcgcattgtggaaagaagtcgcggctgcggcgtatgtagggggtgccagacccaggaagactgtggccattgccctatttgccttcgtccccctagacctggattacgccggcagtggaagtgcgttcagagacggtgccttcgtggaaaacatgcacgacgcaagggcggctgcgactctaagatggctgcccggaggcgaccaggcgcccagccactgcccccgccgccccctagccagtcgcccgagccgactgagccacaccctagagcactagctccctcaccaccagctgagtttatttactactgtgtggatgaagacgaactgaagcgcctcctgccgtctgtgtggagcgagagcgaagatggcgcgggaagcccaccaccctacagaagacgtaagcgccctagtagcgcccgccggcaccatcttgggcctaccctgaagccaactctggcaacaaggaccgcccagcccgaccacacgcaggcccctacaaaacaggaagccggtggcggcttcgtgctgccaccccccgggaccgatcttgtcttcttacgcgagggggcctcctcacctgtgcaggtgcccggccccgtggccgcttcaacagaagcgttactgcaagaagcacagtgcagcggcctctcctgggtagtggctctaccacaagtgaaacaggaaaaagctgacacacaggacgaatggactccagggaccgcagtcctcacctcccctgttcttgtgcccggctgtccatcgaaggccgtggaccccggcctccccagtgtgaagcaggagccacccgatcccgaagaggataaggaggagaacaaagatgattctgcgagcaaattagctcctgaggaggaggcgggaggcgcaggtactcccgtcataacagaaatcttttcactgggcggaaccagattccgagataccgcagtctggcttccccggtcaaaggatctcaagaagcccggggcccgaaagcaatag

SEQ ID NO: 194954 - DNA, 1512 bp, Artificial Sequence
  Description of Artificial Sequence: Synthetic coding sequence
atggccgaggactggctggactgccccgccctgggccccggctggaagcgccgcgaagtctttagaaaaagcggagctacttgtggtagatccgacacgtactaccagagccccacgggcgatcgcatacgatccaaggttgaacttactaggtatctcggcccagcttgtgatctgactctgttcgacttcaaacagggaatcctgtgttatccagcgccaaaggctcacccggttgcagttgcatcaaagaaaagaaagaaaccatcacggccggctaaaacccgtaaacgacaagtgggcccccagtctggggaagtgagaaaggaggcccctcgggacgagactaaggctgatacagataccgcgccggcaagcttcccagcaccaggatgctgcgagaactgcggcatttctttcagcggagatggaacgcagagacagcggctcaagacgttgtgtaaagactgtcgagcacagcggatagcctttaatcgggagcagcggatgtttaaacgcgtgggctgcggggagtgcgcagcatgtcaggtgacagaagattgcggcgcatgtagtacctgtctcctacaattgccacacgacgtggcgagcggtctgttttgcaaatgtgagagacgcaggtgcctcaggattgtagagcggtctaggggctgtggggtatgtcgaggatgccagacccaggaagactgtggccactgtcctatctgcctcagaccacctaggcctggcctccgcagacagtggaaatgcgtgcagagacggtgccttcgtggcaagcacgcgcgcaggaaagggggctgtgatagcaaaatggccgctcgacggaggcctggagcacagccgctaccacctcctccaccttcacaatccccagagccaaccgaacctcacccaagggcccttgcaccgtcacctcctgccgagtttatctattattgtgtcgacgaggatgagctgaaaaggttgctgccgagcgtatggagcgaatcagaagatggggcaggaagccccccgccctacagacggcggaagcgaccatcctctgcaaggcgccaccacttggggcctacactcaaacccaccctggcaacccggacagcccagccggatcatactcaggccccgacaaagcaggaggccgggggaggctttgtgttaccacctcctgggactgatcttgtctttctgagagagggcgcttcatccccggtgcaggtgccaggccctgtggccgcctccaccgaggcactgttacaggccgtggaccccggtctcccctctgttaagcaggagccgcctgatcctgaagaggataaggaagagaataaggacgattctgctagcaagttggctcccgaggaggaagcgggcggggctggcactccagtcatcacagagatattcagtctcggcggtactcgtttcagagataccgccgtctggctcccacggtcgaaggacctgaaaaaacccggtgcaagaaaacaatag

SEQ ID NO: 194955 - DNA, 1671 bp, Artificial Sequence
  Description of Artificial Sequence: Synthetic coding sequence
atggccgaggactggctggactgccccgccctgggccccggctggaagcgcagggaggtattcagaaaaagtggcgcaacctgcggacggtctgatacatactaccagtcacctaccggcgatcgcattagatcaaaggttgaactcacccggtacctgggcccagcatgtgacctgactctcttcgatttcaagcaaggaatcctatgctatcctgccccaaaggcccacccagtcgccgtggcgtccaagaagcgcaagaagccatcccgacctgctaaaacaaggaagcgccaggtggggccccagtccggagaggtacgaaaggaggcccccagagatgaaaccaaggccgatacagacaccgcgcctgcctccttcccggcccccggttgttgcgaaaattgcggcatctcgttttcaggtgatggaacccagaggcagaggcttaaaacactgtgcaaagattgtcgcgcccaacgcattgcattcaaccgtgaacagcgcatgtttaagtcaagaggctgcggtgtgtgcagaggttgccaaactcaggaggattgcggccattgtcccatctgcctgaggcctcctcgtcccgggctacgtagacagtggaagtgtgttcagagacggtgtctccgcggaaagcatgcacgccgaaagggaggatgtgattcaaaaatggctgctcgaaggagaccaggcgcacaacctctgcctccaccgcctccatcacagtcgccagaacccacggagccccaccctagggcattggcaccctcaccccctgctgagttcatctactactgcgtggacgaagatgagctacaaccctatacaaacagacggcaaaatcgcaagtgtggggcttgtgccgcttgccttcgacgtatggactgtggcaggtgcgacttctgctgtgacaagccaaagttcggggggagcaaccagaagcggcagaagtgccgttggcggcagtgtctgcaatttgccatgaagcgactgctacccagcgtgtggtccgagagcgaggacggggcagggtcccctcccccttaccgtcgtcgaaagagacctagcagcgctcgtcgccatcatctgggcccgaccctgaagccaacactcgccactcgaacagctcaaccagaccatactcaggctcccactaagcaggaagctggggggggttttgtcctgcccccacctggcaccgatctagtgttcttgcgggagggcgcgtcaagtcccgtacaagtgcctggacccgtggctgcatcaaccgaagccttgctccaggaagcccagtgttctgggctatcatgggtggtggcactgccccaggtaaagcaggaaaaggccgacacacaggacgagtggactccaggaacagcagtgttaactagccctgtgcttgtcccagggtgtccaagcaaggcggttgacccaggcctgccgagcgtaaagcaggaacccccagacccagaagaggacaaagaagagaataaggacgattcagcctccaagctcgcgcccgaagaggaggcaggaggcgctggtacacctgtgataacggagatcttctctctggggggtacaagatttcgggatacggctgtgtggctacctaggagtaaagacctcaagaaaccaggagcccggaaacaatag

SEQ ID NO: 194956 - DNA, 1818 bp, Artificial Sequence
  Description of Artificial Sequence: Synthetic coding sequence
atggccgaggactggctggactgccccgccctgggccccggctggaagcgccgggaagtctttaggaagtcaggcgcaacctgtgggaggtctgatacatactaccagtctcctaccggcgacagaatccggagcaaagtggaactaacgcgctatctgggccccgcttgtgatctaaccttgtttgacttcaagcaagggattctgtgttatcccgcccctaaggcacacccggtggcggtcgccagcaaaaagcggaagaaacccagcaggcccgcaaagacccggaagcggcaggtcggcccacaatcaggggaggtgcgcaaggaagcccctcgcgacgaaactaaagctgacaccgatacggcacccgcctcttttcctgcaccaggatgctgtgagaactgtgggatttccttttccggtgatggcacccagcgacagcgactgaaaaccctgtgcaaggactgtagggcccaaagaattgccttcaatcgggaacagcggatgttcaaacgcgtgggatgcggggagtgtgccgcctgtcaggttacggaagattgcggggcgtgctcaacatgtctgctccaattgccgcacgacgtagcctccggcctcttctgcaagtgtgaaaggcgccgctgtttgagaatagtagagcggtcgagagggtgcggcgtttgtcgcggctgtcaaacgcaggaagactgcgggcactgtcccatttgcctgagaccacctcgaccaggattacgaaggcagtggaaatgcgtgcagaggcggtgcttgcgcgggaagcacgctcgtcgaaaaggcgggtgcgacagcaagatggccgctcggagacggcccggcgcacagccccttcctccccctcctccaagtcagagccccgaaccaaccgaacctcacccacgcgcactggccccgagcccaccggcagaatttatctattactgtgtggatgaggacgaactgcagccatacactaacagacgtcagaacagaaaatgtggcgcttgcgctgcctgtttacgtagaatggactgtgggaggtgcgacttttgttgtgacaaacctaaattcggtggaagtaatcagaaacggcaaaagtgccgctggaggcaatgcttgcagtttgccatgaaacgattgctcccaagcgtgtggagcgaatccgaggatggggccggctctcctcctccgtatcgtcgcagaaagcgcccctcatccgcacgcagacatcacctgggcccaactctgaaaccgactctggcgacaaggactgcacagcccgaccacactcaggcgccaactaaacaggaagccggcggtggattcgtcctgcccccgcccggaacagacttggtttttctccgggagggagcatcaagccctgtgcaagtgcccggtccggtggctgcctcaaccgaggccctgctccaagaggcacaatgctctggcttatcctgggttgttgcactgccgcaagtgaaacaggagaaagctgatacgcaggatgaatggaccccaggcactgcggttctaacctcgcccgtgttggtgcccggttgcccttcaaaagctgtggacccagggctgccttcggtgaaacaggaacctcccgaccctgaggaggataaggaggaaaacaaggacgattctgcttcaaagctagcccctgaagaggaagccggtggcgccgggacacccgtgataactgagatcttttccctgggaggaactcgatttagagatactgctgtctggctgccaagaagtaaagacctcaaaaagcctggagctcgaaaacagtag

SEQ ID NO: 194957 - DNA, 1512 bp, Artificial Sequence
  Description of Artificial Sequence: Synthetic coding sequence
atggccgaggactggctggactgccccgccctgggccccggctggaagcgcagagaggtctttcggaaatcaggagccacatgcggtcgttccgacacatattaccagtcacccacaggtgataggattcggagcaaagtcgagctgacaagatacttgggcccggcgtgtgacctcactctctttgactttaagcagggcatcttgtgttacccagctccaaaggctcatcccgtggccgtcgcatccaaaaaacgcaaaaagccatctaggcccgccaaaacccgaaagcgccaggtagggccccaatcaggcgaagtcaggaaagaggcaccccgcgacgagaccaaagccgacaccgataccgcccctgctagctttcctgctccaggatgctgtgagaattgtggaatcagtttttccggcgatggcacacaacgccaaagactgaagacactatgcaaggactgtcgggctcagaggatcgcttttaaccgggagcaaaggatgttcaaacgtgttggatgtggagaatgtgcggcatgccaggttacagaagactgtggggcatgctcaacttgccttctccaactcccccatgacgtggcgtcgggcctcttttgtaagtgtgaaaggcgccgctgtctacggattgtggagaggagcaggggctgcggcgtgtgcagaggctgccaaacacaggaggattgcgggcattgtcctatctgtctccgcccaccccgcccgggcctgaggcggcagtggaagtgcgtacaacggcgctgtctccgagggaaacacgctaggagaaaaggaggttgtgactcaaagatggccgctcgccggcggcctggcgcacagcccctgccccctcctcctccttcacaatctcctgaaccaaccgaaccacacccacgtgccttagcaccatcaccgcctgctgagttcatatactactgcgtggacgaagatgagctaaaaagactgcttcccagcgtgtggtctgagtccgaggacggtgcgggctcaccacccccttacagacgaaggaagcgaccaagcagtgcacgaagacatcacctggggcccacgttgaagcccacattagccacaaggaccgctcagccagaccacacccaggcaccaaccaagcaagaagccgggggcggatttgtactgccgccgcccgggaccgacttagtgtttttgcgtgaaggcgccagtagccccgtacaggtccctggaccagtcgccgcctcgacggaagccttgctgcaagcggtcgaccctgggctgcccagcgtgaagcaggagccgccggatccagaggaagataaagaggagaacaaggatgacagcgcctccaagcttgccccggaggaagaagctgggggcgcgggaacgcctgttatcacagaaatcttctcattaggaggtactcgcttccgagatacagccgtgtggctccctagatccaaagatctgaaaaagcccggggcaagaaagcagtag

SEQ ID NO: 194958 - DNA, 1650 bp, Artificial Sequence
  Description of Artificial Sequence: Synthetic coding sequence
atggccgaggactggctggactgccccgccctgggccccggctggaaacggagggaggtgtttagaaaaagtggggcaacttgtggtcgatcagacacatattatcaatcacccaccggggatagaatcagatccaaagtggagttgacaagatacctgggccccgcgtgcgacttgaccctgttcgacttcaaacagggcatcctctgctaccctgcaccaaaagctcacccagtggccgtggcctctaagaagcgcaagaaaccttccaggcctgctaaaacaaggaaacggcaggtgggaccacaaagtggcgaggtacgcaaagaggccccccgggacgagactaaagctgacactgatacagcccccgccagcttccccgccccagggtgttgtgagaactgcggtatctcctttagcggagacggaacccaacgacagcgcctcaaaactctctgtaaagattgcagggcacagcggatagccttcaaccgggaacagcgtatgttcaaacgcgtgggctgtggcgagtgcgccgcttgtcaggttacagaggactgcggggcttgctccacctgccttttgcaactgccacacgacgtggcttcaggactcttttgcaagtgcgaaaggcgcagatgtctgcggattgtcgaacggtctcggggttgcggcgtttgccggggctgtcagactcaggaagattgtggccattgtccaatttgcttgcgccccccgcgacccggtctgcggcggcaatggaagtgcgtccagcgaagatgcctgcggggcaagcatgccaggaggaagggcggctgtgattctaaaatggcagctaggcgtcggccaggggcccagccactcccccccccaccaccctcccagagtccagaaccgaccgagccacatcctcgggcgctggccccttccccccccgcggagtttatctattactgcgtggatgaggatgaactgaaaaggctattgcctagcgtctggtccgagagcgaagatggggcaggatccccgcccccatataggcgaaggaagagaccaagctctgcccgaagacaccacctagggccgacactgaagcccaccttggctactagaactgcacagcctgaccatacccaggctccgacaaagcaggaggccggaggtggatttgtgttgcccccccccggtaccgacctggtgtttctaagagagggggcttccagccctgtgcaagtccccggtcccgttgccgccagcaccgaggctctgctccaggaagcccagtgttcaggtctgagttgggtcgtcgcattacctcaagtcaaacaggagaaggccgacacgcaggatgaatggacaccaggaacggcagtattgacctcacccgttttagtgcccggctgtccatcaaaagcagtcgatcccggcctcccttcagttaaacaagaacccccagaccccgaagaggacaaagaagagaacaaagacgatagcgccagtaagctcgccccagaggaggaggccggcggcgccggtaccccagttattactgagatctttagtctgggaggcacaaggtttagggataccgccgtgtggttgccaagatcaaaggatcttaaaaagcccggggcccgcaagcaatag

SEQ ID NO: 194959 - DNA, 1818 bp, Artificial Sequence
  Description of Artificial Sequence: Synthetic coding sequence
atggccgaggactggctggactgccccgccctgggccccggctggaagcggagagaagttttcaggaagtcaggagccacttgtggaaggagcgatacatactatcagagcccaaccggagacaggatcagaagtaaagtagaactaacaaggtacctgggacctgcttgcgacctgacgctgttcgattttaagcagggcattttatgctatcccgcccctaaagctcacccagttgctgtggcttccaagaagcgaaaaaagccatctcgaccagcaaagacaaggaagcgtcaggtgggcccacagtccggcgaagttcgcaaggaagctccaagggatgaaaccaaagctgatacagatactgcccccgcctcctttccagcccccgggtgctgcgaaaattgtggaataagtttttcaggcgacggcactcaacgtcaaaggctcaagacactttgcaaagattgcagggcgcaaagaattgccttcaatcgagagcagcgcatgttcaagcgcgtcggttgtggggagtgcgcagcttgccaagtgaccgaggattgtggtgcctgtagcacctgtctgctccaactgccccacgacgtggcctcagggctgttctgcaagtgcgagcgccggcgctgcctccgcatagtggagcgttccagaggctgtggcgtgtgtcggggctgccagacacaagaagactgtggacactgccctatctgtcttcgcccccctcgccctgggttgcggaggcagtggaaatgtgtccagcggcgctgcctgagagggaaacacgcaagaagaaaaggtggatgcgactctaaaatggctgccaggcgacgtcctggggcccagccattgccgcccccgccaccctcccagtcaccagagcccactgaaccccaccctagggccctggccccatcgccacccgcggaatttatttactattgtgttgatgaggacgaacttcagccctacaccaacagaaggcagaaccggaaatgtggcgcttgtgccgcatgtcttcggcggatggactgcggaaggtgcgacttctgttgtgacaaacccaaatttgggggatcaaatcagaagaggcagaaatgtcgctggagacagtgtttgcagttcgccatgaagcggttacttccttctgtttggagcgaatcggaggacggcgcgggcagtcctccaccgtatcgtcgaaggaagaggccaagtagcgcgcgccgacaccacctggggcccacactgaaaccaactctggctaccaggacagctcagcccgatcatacccaagcacccaccaagcaggaagcaggcggcggcttcgtgctcccacctccaggaacagatctggtctttctgcgcgagggggcttctagccctgttcaggtgcccggtccagtggcggccagcactgaggccttgctgcaggaggctcagtgctcgggcctgtcctgggtggttgctctaccccaggtaaaacaggagaaagcggacacacaggatgaatggacccccgggaccgccgtgctgacgtcccccgtgcttgtgccgggttgcccatcaaaagctgtcgatcctggcttgcctagcgtgaagcaggagccacctgaccccgaggaggacaaagaggaaaacaaggatgattctgcctccaagctcgcccctgaggaagaggccggcggcgccggcactcctgtgataaccgaaatctttagcctgggaggaactcggttcagagatacggctgtgtggctgcccaggtcaaaggatcttaaaaaacctggagcccggaaacagtag

SEQ ID NO: 194960 - DNA, 1971 bp, Artificial Sequence
  Description of Artificial Sequence: Synthetic coding sequence
atgggcggcttccggctgcggaccggccggaacgccgccctgaactccgatcgcctgttactgcttcctgtggcatccatggcagaagattggctcgactgtcctgcactaggtcctgggtggaagcggagagaggtgtttcgcaaatccggggccacttgcgggcgcagcgatacgtattaccaatcccctactggcgaccggattagatcgaaagtagagctgaccagatatctcggaccagcctgtgacctcaccctcttcgattttaaacagggaattctgtgctatccggctcccaaggcacaccccgtggcggtggcctccaaaaaacgtaagaagccatcgcgcccagcaaagaccagaaaaagacaagtgggcccccaatccggcgaggttagaaaggaggctcctagggacgaaacaaaggccgacacggatactgcaccagcctcttttcccgctcctggctgttgtgagaattgcggaatttctttctccggggatgggacccagagacagagactgaaaaccctctgcaaagactgccgggcacagagaattgcttttaacagggagcagcgtatgtttaagagggtgggttgcggtgagtgcgcagcatgtcaggtcaccgaggactgcggtgcttgttccacttgcctcctgcagctcccgcacgacgtcgccagcggcttgttctgtaagtgtgaacgcaggagatgcctgcggattgtggagcgatcccgggggtgtggagtgtgccgcggatgtcagacacaggaagattgcgggcattgcccgatctgtctgaggcctccccggccaggcctgcgccggcagtggaaatgtgtgcaaagaaggtgcctaaggcacctcgctcaccggcttaggcgcaggcatcagaggtgccaacgacggacgcctcttgctgtagctcccccgaccggaaaacatgctcggagaaagggaggctgtgactctaagatggctgcccgccggagacccggtgctcaaccacttccaccgccccctcccagccagagtccagaaccgactgaaccgcatcctagagcactagctcccagcccaccagccgagttcatatactattgcgtcgatgaggacgagttgcagccttatacaaacaggagacagaaccgtaaatgcggggcctgcgcagcatgcctcagacggatggattgcgggcggtgtgacttttgttgtgacaagccaaagttcgggggcagtaaccaaaagcggcaaaaatgcaggtggaggcaatgtcttcaattcgctatgaagcgactgctaccctctgtttggtccgagagtgaggacggcgcggggtccccccctccatatcggaggcggaaaagaccctcgtctgctcgccgtcaccacctgggcccaactttaaagcccactctcgccacgaggaccgcccagccggaccacacccaggctcccactaagcaggaggctgggggaggcttcgtcctaccgcctcctgggaccgatctggtctttttgagggaaggcgcttcttctcccgtgcaagtacccggacccgtagccgcgagcacagaggccctgctgcaggaagcccaatgtagcggcctgtcctgggtagttgccttgccccaggtgaagcaggaaaaggcagacacccaggatgaatggacccccggcactgccgttctgacttctccggtgctagtgccagggtgtccaagtaaggcagtggatcccgggctacccagcgtaaagcaggaacctccagacccggaggaagacaaggaggaaaacaaggatgactctgcttccaaattggcgcctgaagaagaagcggggggcgccggaacccctgtcatcaccgagatattctcactaggcggcactcgcttcagggataccgccgtgtggctgccaagaagtaaggatcttaaaaagcccggggcacggaaacagtag

SEQ ID NO: 194961 - DNA, 1611 bp, Artificial Sequence
  Description of Artificial Sequence: Synthetic coding sequence
atggccgaggactggctggactgccccgccctgggccccggctggaaaagacgggaagtatttagaaaatccggagctacatgtggtagaagtgacacctattaccagagccccaccggggatcgcatcaggtctaaggtcgagctcacaagatatctcggcccggcttgcgacctcaccctgttcgacttcaagcaggggatcttatgctatcctgcacctaaagctcatccggtggcagtcgccagtaaaaagcgcaaaaagccgtcccgcccggccaaaactcggaagcggcaagtcggccctcagagtggagaagtgcgcaaagaggctcctagggatgaaactaaagccgacacagacaccgcccccgcctctttccctgcaccagggtgctgtgagaactgcggcatttcctttagtggcgatgggacacagcgccaaaggctcaagacattatgcaaagactgccgtgcacagcgaatcgcgttcaacagggagcaaagaatgtttaagcgagttggatgcggcgaatgtgctgcatgccaggtgactgaagactgcggagcttgttcgacatgtctgctccaactgcctcacgacgtagcctctggactgttttgcaaatgcgaacgacgacggtgtcttcgcattgtagagcgtagtagagggtgtggcgtttgccggggttgtcagacacaggaagattgtgggcattgtcctatttgcctacggccaccgcgccccggtttgcgaaggcaatggaagtgcgtacagcgaaggtgcctgcgcggcaaacatgcacgaagaaaaggtggatgcgactccaaaatggctgcccggaggagaccaggagcacagccactcccacccccaccgccatcacaaagcccagagccaaccgaaccacagccctataccaacaggagacagaaccggaagtgcggtgcttgcgcagcttgtctgagacggatggattgcggacgctgcgatttctgttgcgacaagcctaaattcggggggtccaaccagaagcgacagaagtgtaggtggagacagtgcctacagttcgccatgaaacggctcttgcctagcgtttggtccgagtccgaagatggcgctgggtcccctcctccttaccgaaggcggaaaagacccagtagtgcccgaaggcatcacttggggcccacactgaaaccaacactggctactcgcactgctcagccagatcacactcaagcccctaccaagcaagaagctgggggcggattcgtgctgcctcctcctgggaccgacctggtgttcctgcgcgagggggcgagttcacctgtgcaagttcctggacctgttgcagcctccactgaagctctgctacaggctgtagacccaggcttgccatctgtcaaacaagaacctccagacccagaggaagataaggaagagaataaagacgactctgcctctaagctcgcacccgaagaagaagctggcggcgcgggcacccctgtcatcacagagatcttctcacttgggggaacccgctttcgggacacagcagtgtggctgccgcgatcaaaagaccttaaaaaaccaggtgcaagaaagcagtag

SEQ ID NO: 194962 - DNA, 1893 bp, Artificial Sequence
  Description of Artificial Sequence: Synthetic coding sequence
atggccgaggactggctggactgccccgccctgggccccggctggaaacgacgcgaagtgtttcggaaatccggagctacttgcgggagatctgatacatattatcagagcccaactggcgatcgaatccgctcgaaggttgagctgactcgatatttggggcctgcctgtgacctgacactctttgatttcaaacagggaatcctgtgctatcccgccccgaaggctcacccagtagctgttgcttcaaagaagcgtaaaaagccctcccggcccgctaagactaggaaacgacaagtggggccccagtctggggaagtgcgaaaagaagccccccgggacgaaacaaaggctgacacagacaccgctcccgcaagctttccagccccagggtgctgcgagaattgcggaatttctttttcgggggatggcacccagagacagagactgaagaccctttgtaaagattgtcgagctcagagaattgcatttaaccgggaacagagaatgtttaaacgagtcgggtgtggtgagtgcgctgcctgccaagttactgaagattgtggcgcttgctctacctgtttactgcagctgccgcacgacgtagcatcaggccttttttgcaaatgcgaaagacgtcggtgccttagaattgttgagagaagtaggggctgtggggtctgtagaggatgtcaaactcaggaggattgtggccattgccctatctgcctccgaccaccacggcccggcttgaggcggcagtggaagtgtgtccaaaggcggtgtcttcgccatctcgcacaccggctgaggcgcaggcaccagcggtgccagagacgtacccctctggctgttgctccccctacaggtaagcacgcaaggcggaagggagggtgcgactcaaagatggccgccaggcgcagacccggcgcccaacccctacctcctccccccccctctcagtctccggagccaactgaaccccacccccgtgcactagctcccagccctccagctgaattcatttactattgtgtggatgaggacgagctgcagccttacacaaatagacgccaaaatagaaagtgcggcgcgtgcgcagcctgcttacggcggatggactgtggcagatgtgacttttgctgcgataagccgaagtttggtgggagcaaccaaaaacgtcagaagtgtagatggcgccagtgtctgcaatttgctatgaagaggttacttccatctgtatggagtgaatctgaggacggagccgggagcccacccccttatcgtcgcaggaaaagaccctccagcgctaggcgccatcacctggggcccactctaaagcccacgcttgcaacccggaccgcgcagccggaccacactcaggctcccactaaacaggaagcagggggcggctttgtactgccgccccctggtactgatttggtttttctgcgcgagggcgcgagctcacccgttcaggtcccaggaccagtggccgcctcgaccgaggcccttttgcaggaggctcagtgtagcggtctttcttgggtagtagcactaccccaagtaaagcaagagaaggcagacacccaggatgaatggactcctggcactgccgtgctcactagccctgttctggtccctggttgtcctagcaaggcagtggatcccggtctgcctagtgtcaaacaagagccgcccgatccggaagaggataaggaagagaacaaagacgactcagcaagtaaactagccccggaagaggaggccggcggcgcagggacacccgttatcactgagatcttttcacttggaggaacgcgattccgggacacggctgtttggctgccgaggtcaaaggatcttaagaaacccggggcccgaaagcagtag

SEQ ID NO: 194963 - DNA, 1704 bp, Artificial Sequence
  Description of Artificial Sequence: Synthetic coding sequence
atggccgaggactggctggactgccccgccctgggccccggctggaagcgcagagaggtgtttagaaagtctggagccacttgcggtagaagtgacacgtactatcagtcccctactggagaccgcatccgcagcaaggttgaattgacacgctacctggggcctgcatgcgacctgactttgtttgattttaaacaagggatcctgtgttatcctgcaccaaaagcccaccccgtcgctgtggctagcaagaaacgaaaaaaaccttcacggcctgcaaagacgcgtaagagacaagtggggcctcagtccggggaagtgcggaaggaggcaccgagggacgagaccaaagccgacaccgacacagcccccgcttcatttcctgcacccgggtgctgcgaaaactgtggtatttcattctccggcgatgggacacagagacagcggctaaaaaccctctgtaaggactgccgtgctcaacgaatcgcctttaaccgggaacagaggatgtttaagtctcgaggatgcggcgtatgccgtggatgccagactcaggaggactgcggacattgtcccatatgcttgcgtcctccccgtcccggtcttcgccggcagtggaaatgtgttcaaaggagatgcttgcggggcaaacacgcacgccgcaagggagggtgtgattctaaaatggctgcacgcagacgccccggggctcagccactgccccctccgcctcccagtcagagccctgagcctacagagccacatcctcgggcccttgccccatctccacctgcagagttcatctattactgcgtcgacgaggatgagctgccctacaccaacaggcggcagaaccggaaatgcggcgcttgcgccgcgtgtctgagacggatggattgcggccgctgcgacttttgctgtgacaagccgaaattcggaggttccaaccagaaacgtcagaaatgcagatggcgccaatgtctgcagtttgccatgaagcgtctactccccagtgtctggtccgaaagtgaggatggtgccgggtcgccgcccccctaccgacggagaaagcggccgtcttccgcaagacgacatcacctcggccccacactgaagccgaccctggccactcgaaccgcccagccagatcatactcaggcgcccaccaagcaggaggctggcggcggcttcgtcctgccccctcctggtactgacttggtctttctgagagaaggtgcttcatctcccgttcaggttccaggaccagtagctgcctcaaccgaagcattactgcaggaggctcagtgctctggcctgtcgtgggttgtggcactgccacaggtcaagcaagagaaggccgacactcaggacgaatggacacccgggactgctgtcctcacctcgcctgtgttggtccctgggtgtccctcaaaggccgtcgacccaggattaccctcggtgaaacaggaaccgccagaccccgaagaggacaaggaggaaaataaggatgatagcgccagtaagctggctcctgaggaagaagcaggaggcgccggcactccagtgattaccgagatcttcagccttggcggcacacggtttagggacaccgcagtctggttgccgagatactatcacctggccctggactggaagtgcaattgtgggtaccacttatgttgtagatcagtgctggtgccatag

SEQ ID NO: 194964 - DNA, 1608 bp, Artificial Sequence
  Description of Artificial Sequence: Synthetic coding sequence
atggccgaggactggctggactgccccgccctgggccccggctggaaacggagagaggtctttcgtaaatcaggcgcgacctgtgggcgttcagatacttactatcagtccccaacaggcgacaggatacggtctaaggtggaactgactcgatacttgggtcctgcctgcgacctcactctgtttgacttcaagcagggaatcctttgctatcccgcgcccaaagcacatcctgttgccgtggctagtaagaaacgcaagaagcctagtcgacctgcaaagacccgcaagaggcaagtagggccccagagcggtgaggttaggaaagaggcaccgagggatgagacaaaagccgataccgacactgctccagcctcgtttccggcccccggttgctgtgagaactgtggaatcagcttttctggagatggcacacagaggcagcggcttaagaccctctgtaaggactgtcgggcccagcgtattgccttcaatagagagcagagaatgttcaagcgcgtggggtgcggtgagtgcgccgcctgccaggtcacagaagattgtggagcttgcagcacatgtcttttacagttaccacacgacgtggcctcaggcttgttctgcaaatgtgagaggagacgttgtttgagaattgtcgaaaggtctcgaggctgcggcgtatgccgcggctgtcagacacaagaagactgcggccattgccctatctgcctcagaccgcctagacctgggctccgacgccaatggaagtgcgtgcaaaggaggtgcttgcgcgggaagcacgcgagaaggaagggagggtgcgacagtaaaatggccgccagacggcggcccggagcacaacccctaccacccccccccccatcccaaagcccagagcctaccgagccccaccccagagccctggctccaagccctcccgctgagtttatttattattgcgtggacgaggacgagttgaagcgactgctccctagcgtgtggtcggagtcagaggatggcgctggctcgccccctccataccggaggcgaaagcgccccagtagcgcaagacgacaccatctcggtcctactctcaaacctacgctggcgacaaggacagctcagccagatcacacgcaggccccaacaaagcaggaagctggcggcggttttgttctgccgccaccgggcacagacttggtctttctgagggaaggtgctagcagccccgtccaggtacctggccccgttgcagccagtacagaggccctcctgcaggcggtagatccaggcctgcctagcgtcaaacaggagccacccgaccccgaagaggataaagaagagaataaggacgatagcgcatcgaaattggccccggaggaggaggcaggaggcgcaggcacccccgtgatcacagagattttttcactcggggggacacggttccgggacactgcagtatggctcccgagggcagggactagggaaggtaaaatggatgtcaagtgcggcagaccccgcactcagtggagtcctcgcgcacgggccggtacccatgaagatggcctcgagccaatgagcgtcagtcatcacctgcagctgcggtag

SEQ ID NO: 194965 - DNA, 1968 bp, Artificial Sequence
  Description of Artificial Sequence: Synthetic coding sequence
atggccgaggactggctggactgccccgccctgggccccggctggaaacgtcgagaggtatttagaaagagtggggcaacctgtggacggtccgacacctactatcaatccccgacgggcgaccggatcaggtcaaaggtagagctgacccggtacctgggacctgcctgcgacctgacattgtttgacttcaaacaagggatcttgtgctaccctgcccctaaagctcaccctgtagcggtcgcctccaagaaacgcaaaaaaccctctcgaccggctaaaacacgtaagcggcaggtgggcccccagtcaggggaggtacgcaaggaggcaccacgcgacgaaactaaagcggacactgacactgcaccagcctcgttccccgcccccgggtgttgcgagaattgtggaatttcattttcaggcgacgggacccaacgacagaggctgaaaaccctgtgcaaggattgccgcgcccagcggattgcattcaatagggagcagcgaatgttcaaaagggtcggctgtggggagtgtgccgcgtgccaagttaccgaagactgcggcgcgtgttccacttgtctgttacaacttccacatgatgttgcgtccgggctgttttgcaagtgtgagcggagacgctgcctcaggattgtggaacggtctaggggttgcggcgtgtgcagggggtgtcagactcaggaagactgtgggcattgtcctatttgcctcagaccaccccgacccggcctacggaggcagtggaagtgtgttcagcgcaggtgcctccgcggaaaacatgcccggcggaaagggggttgtgatagtaaaatggccgcccgccggcggccaggcgcacagccgctgccaccacctcccccatcccaaagtcccgagccaactgaacctcatcctagggctctcgctcccagcccaccggcagaatttatttactactgcgtcgatgaggacgaactgcaaccctacactaacagacgccagaaccgcaagtgcggcgcttgtgcagcctgtcttcgccgcatggattgcggtcgctgtgatttttgttgtgataaacctaagtttggggggagcaatcaaaaacgccaaaaatgtcgctggaggcagtgtctccagtttgcaatgaaaagattattgccatccgtctggtcagaatctgaggatggagccggttcaccccctccctatcggcggcggaaacgtccctcctccgccagacgtcaccacctaggccctaccctgaagcccactctcgcaaccaggaccgcacaacctgaccacacacaggcacccaccaaacaagaagctggcggcggctttgtactcccaccacccggaaccgatctggtctttcttcgggaaggagcttcctcccctgttcaggtgccagggcccgtagcagcgtctaccgaggctttgctgcaggaggcacaatgttctggactgtcttgggtggtcgctttaccacaagtcaagcaggagaaagcagatactcaggatgagtggacgcctggcaccgcggttctgacttcccctgtactggtgcccggatgcccttccaaagcagtggaccctggactcccaagcgtgaaacaggaacctcccgaccctgaggaggacaaggaggaaaacaaagacgacagtgcctcaaagctggcacctgaggaagaggctggtggagcaggcacccctgtcatcaccgagatattttctctgggtggtactcgctttagagacaccgccgtctggcttccgagcttgcagggacgacattcaggcagagaagatgggtgtaaggtctgggagaccgaagacaccgtggagcctaccagtaccagctggaatccccgaggttggccgggtacccacgtgtcactgtcccctcccccagcatccatgatgtgggtgagctgccgtcgctcatggtgccctagcagccagtcatag

SEQ ID NO: 194966 - DNA, 1236 bp, Artificial Sequence
  Description of Artificial Sequence: Synthetic coding sequence
atgcgggcccaccccggcggcggccggtgctgccccgagcaggaggaaggcgagagcgctgcaggcggctccggcgccgggggcgactctgcaatagagcagggagggcagggtagcgcgcttgcaccatcccctgtcagtggcgtcagacgggagggcgcccgtggcggtgggcggggcagaggccgttggaaacaggccgggcggggcggcggtgtttgtgggagaggcagaggacgcggcagggggcgcggacgcggtcgaggtcgtggtcggggcaggggccgtcctccgagcggcggtagcggcctcggaggcgacggcgggggctgtggcggagggggttctggtggaggtggtgccccccgccgcgaacctgttccctttccttctggcagtgcagggccgggcccccgcggcccaagagctactgaatccggtaagaggatggactgcccagctctgccaccaggctggaagaaggaggaagtgatcaggaagagcggcttgagtgccggaaagagcgatgtgtactacttcagtcctagtggtaagaagtttagatccaaacctcagctcgcccgctacctcggcaacactgtggacctgtcctcctttgactttaggacaggcaaaatgatgccgagcaaacttcagaaaaacaagcagcgtcttcgaaacgatcctctcaaccaaaacaagggaaagcccgacttgaacacaaccctgccgatcagacagactgcgtcaattttcaagcaaccggtcacaaaagtgacaaaccatccttccaataaagtcaagagtgatccgcagcggatgaatgagcaaccccggcagctattctgggagaaacgtctccagggcttgagtgcatcagacgtcacagagcaaattatcaaaactatggaactccccaagggcctgcagggggttggcccgggatccaacgatgaaacgctgctgtccgctgttgcctccgcgttgcacacatccagtgctcctatcacgggccaagtgagtgccgcggtggaaaagaaccccgcagtgtggttgaacacctctcagcccctgtgcaaggccttcatcgtgacagatgaagatataagaaaacaggaggagcgagttcagcaggtaagaaaaaagttggaagaggctttgatggccgatatactgtcgcgggccgcagataccgaagagatggacatcgagatggactcaggggatgaagcatag

SEQ ID NO: 194967 - DNA, 909 bp, Artificial Sequence
  Description of Artificial Sequence: Synthetic coding sequence
atgcgggcccaccccggcggcggccggtgctgccccgagcaggaggagggggagtccgctgcaggcggatctggggcaggaggcgactctgccattgagcaggggggacagggatcggctctggcaccctcgcccgtgtccggggtgaggcgcgaaggcgcacgaggcggcgggaggggacggggccggtggaaacaggcgggccggggtggcggtgtttgtgggaggggtagaggaagggggaggggcaggggtcgcggacgcggtcggggccgcggtcggggtcgccccccgagcgggggctccggacttggaggggacggggggggatgtggggggggaggctccggggggggaggcgctccccggcgcgaacctgtcccgtttccctctggctctgccggtcccggtccccggggaccccgcgcgaccgagagcggaaagaggatggattgtcccgccctacctcctggttggaaaaaggaggaggttattcgcaagtcaggcttgtccgccggcaagagcgatgtttattacttctcccctagcgggaaaaaattccggtccaaaccacaattggctcgctacctcggcaatacggtcgacctctcttccttcgattttcgcactggaaagatgatgccaagcaagttacagaagaacaaacagaggttgaggaacgatccactcaaccagaacaagttacgctggaacactcaccggcctgctccgtggcacgccctgtctagattgtgcctgcttatacggtgtctcttgtgccttgaatgcgcatatcctctccccctccaccttgtgaatagctatagctcaaagacacagctgcactgccttcacctttgggaggcatgtcccgcctacagccgccagaatcagtctttccctccatag

SEQ ID NO: 194968 - DNA, 909 bp, Artificial Sequence
  Description of Artificial Sequence: Synthetic coding sequence
atgcgggcccaccccggcggcggccggtgctgccccgagcaggaggaaggtgaaagcgctgcgggtggctcaggagcagggggggatagtgccattgaacagggtggtcaaggctctgccctggcaccatcccccgtgagtggagttcggcgggaaggcgcgcggggcggagggagaggcagagggagatggaagcaagccggtcggggcgggggcgtgtgcggcaggggcagaggcagaggccgcgggaggggacggggacggggacggggcagggggaggggccgccctccaagtggtgggtccggtcttgggggagatggtggggggtgcgggggtggcggaagcggtggcggcggagctccacggagagagcctgtgcccttcccttccggttctgccggacctggacctcggggtccaagagcaaccgaatcgggaaagaggatggattgtccagcgcttccccccgggtggaagaaagaagaggtgatacggaagtcgggactgagtgcaggaaagagcgacgtgtactacttcagcccatcgggaaagaagtttagatccaaaccccagttggccaggtacctcgggaatacagtagacctttcgtcgtttgactttaggacaggaaagatgatgccaagcaaactgcagaaaaacaagcagcggctccggaacgaccccctaaatcagaataagttgcgctggaacacccataggcccgccccatggcacgccctgtctcgactgtgcctgctgatcaggtgtctgctttgcctggaatgcgcctaccccctgcctttacatctggtgaactcctacagctcaaaaactcagctacactgtctgcacctctgggaggcctgccccgcttactcccggcaaaatcagagtttcccgccatag

SEQ ID NO: 194969 - DNA, 876 bp, Artificial Sequence
  Description of Artificial Sequence: Synthetic coding sequence
atggagcggaagcggtgggagtgccccgccctgccccagggctgggaacgagaggaagtgccacgccgcagtggcctatccgctggacatagagacgtgttctactacagtccctctgggaaaaagttccgttcaaaaccccagcttgcccggtacctcgggggatcaatggacttaagtactttcgacttcaggactggaaagatgctgatgtccaaaatgaataagtctaggcagcgcgtaagatatgattcctctaaccaggttaaaggcaaaccagaccttaacactgccttgccggtcagacaaaccgcctctatctttaaacagccagtgacaaaaatcacaaatcatcctagcaacaaggtcaagtcagatcctcagaaggcagtggatcaacccagacagctattttgggagaaaaagctcagcgggctgaacgcatttgacattgcggaggagctcgttaagacaatggacctcccaaagggtctccaaggcgtgggacccggctgcaccgacgaaaccttgctctccgctatcgctagcgccctccacacaagcactatgcccattaccgggcaactctctgcagccgtggagaagaatcctggtgtgtggctgaatacgacgcagcccctgtgtaaggcctttatggtgaccgatgaggatatcagaaagcaggaagaacttgtgcagcaggtgaggaagcggctggaggaagccctcatggctgatatgctggcgcacgtggaagagctcgccagagatggggaagcccctctcgataaagcatgcgcggaagacgacgacgaggaagacgaagaggaagaggaagaggaacccgacccagatccggagatggagcatgtgtag

SEQ ID NO: 194970 - DNA, 780 bp, Artificial Sequence
  Description of Artificial Sequence: Synthetic coding sequence
atggagcggaagagccccagcggcaagaagttccggagcaagccccaattggcgcgatacttgggggggtctatggacctgagtacatttgactttcggactgggaagatgctgatgagcaaaatgaacaaaagtagacagcgggtgagatacgacagtagcaaccaagtgaagggcaagcctgacctgaacacggcactgccagtgcgacagactgctagcatttttaagcagcccgtaaccaaaatcacaaaccatcccagcaacaaggtgaagtctgatccacagaaggctgttgatcaaccacgccagctgttttgggagaaaaagctgtcgggcctgaacgcatttgacatcgcggaagagctcgtcaagaccatggacctgccgaagggcttgcagggggttggtcccggatgcactgacgaaacccttctctccgccatagcatcggccctgcatacctccacaatgcccatcacgggtcagctctcggcagccgtggagaaaaatcctggggtctggttgaatacaacgcaacctctgtgtaaagcatttatggtgacggatgaagatatccgcaagcaggaggaactggtacagcaggtcagaaagcggctggaggaggccctgatggcggacatgctggcccatgtcgaggagctcgcaagggacggcgaggctcctctggacaaagcttgtgccgaggatgacgacgaagaggacgaggaagaggaagaggaagaaccagaccccgaccccgagatggaacacgtttag

SEQ ID NO: 194971 - DNA, 4485 bp, Artificial Sequence
  Description of Artificial Sequence: Synthetic coding sequence
atgaacggcggcaaggagtgcgacggcggcgacaaggagggcggcctgcctgcaatccaggtgcctgtaggatggcagagacgggttgatcagaacggagtcttatatgtatccccttccggttccctgctgtcttgtcttgagcaagttaagacatacttgctcaccgatggcacgtgtaaatgcggccttgaatgtcccctcatcctccctaaggtatttaatttcgaccccggagctgccgtgaagcagcggacagccgaagatgtgaaggcggatgaggatgttacgaaactgtgcatacataaacgtaaaataattgcagtcgctaccctgcacaaaagcatggaggcacctcatcctagcctggtccttacctcaccaggcggcggaactaacgccacccctgtggtacccagccgggccgctacgccacggtcagttcgcaataaatctcatgagggaataaccaacagcgtgatgcccgagtgtaaaaatccattcaagttgatgatcgggtctagcaatgccatgggcaggctgtacgtgcaagaactcccaggctcccagcaacaagagcttcaccctgtgtatccgagacagcggttggggagtagcgagcacggacagaaatcaccatttcgggggtctcacggaggcttacctagtcccgcaagtagtgggtcacagatttacggagatgggtctatatcgcctaggacagatccactggggtcccctgacgtcttcacccgctccaacccaggattccacggagcaccaaactctagcccgatccatctgaatcgcacaccacttagccccccaagtgtgatgctgcacggaagtcctgtgcagtcatcttgcgccatggccgggcgaacaaacattcctctctctcccacattaaccactaagagccccgtcatgaaaaagcccatgtgcaatttctcgaccaatatggaaattccccgcgctatgtttcaccacaaacctcctcagggacctccccctcccccgccaccctcctgtgcactccagaagaagcccttgacctcagagaaagaccccctgggtatcctggaccccatcccctccaaaccagtgaaccaaaacccagtcatcattaaccccacctccttccacagtaacgtgcactcccaggtgcctatgatgaatgtgagtatgccaccagctgttgtgcctctgccatctaatctcccattgcccacggtcaagccgggccatatgaaccacggctcccatgttcagcgagtgcaacacagtgccagcacttccctgagtcccagcccagtgactagccccgtgcacatgatgggcactggaatcggtagaatagaagcatcgccacaaagatcccgctccagctcaacatcaagtgaccacgggaacttcatgatgccacccgtgggaccacaggctaccagtagtggcatcaaggtgccgccccggtcgccgcgttcaaccattggctccccacgaccatccatgccaagctcgccatcgacaaagagcgatggacatcatcagtacaaggatattcccaatccattaattgccggcatttctaacgtgttgaacactccttccagtgccgccttccccaccgcctcagccggcagctcgagtgtcaaatcgcagccggggttgttaggcatgcccctcaaccagatcttaaaccagcacaacgcggcttcattccccgcatcatctctgctgtctgccgcagccaaggcccagctggccaaccaaaataaattggctggcaataatagctccagcagctctaattcgggtgccgtagcggggagcggcaacaccgaagggcacagcactctcaacacgatgttccctcccaccgcgaacatgctgctgcctactggggagggccaatctgggcgtgccgctttaagggataaactaatgagccagcagaaagacgcactcaggaagagaaagcagcccccgacaacagtactttctttattgcgccaatcccaaatggactctagtgcagtgccaaaacccggtcctgacctgcttaggaaacagggacagggatcctttcctatctcatctatgagccagctgctccagtccatgtcctgtcaatcaagtcacctgtcaagtaacagcacacccggatgcggagcctccaacacagccctaccgtgttcggccaatcagctccattttactgatcctagcatgaattccagcgtgctccagaatattcccctcagaggagaagccgttcattgccataacgccaacacaaacttcgtccactccaattctcccgttccaaatcaccacctcgccggcctaatcaatcagatacaagctagcgggaattgtgggatgctctcccaaagcggcatggctctcggcaactccctacaccctaatcctccccagtcccggatatccactagttctacccctgtgatccctaactcaatagtttctagttacaatcagacgtcaagtgaggctggtggatcagggcctagtagcagcatagctatcgctgggaccaatcacccagccattacaaagaccactagcgtgcttcaggatggagttattgtcacaacagccgccgggaaccctctgcagtcacaactcccaattggtagcgatttcccatttgtcggtcaagaacatgcactgcatttcccgtccaacagtactagtaataatcatctgccacatcccttgaatccaagcttgctgtcatcgctcccaatatccctccccgtaaatcagcagcacctcctgaatcagaatttgctgaacatcctccaaccatcggctggcgaaggtgatatgagttcaatcaacaacactctgagcaatcaccagctgactcatctacaatcgctgctcaacaataaccaaatgtttcccccaaaccagcagcagcagcaactgctccaaggataccagaacttgcaagcctttcagggccagtccacgataccctgccccgccaataacaatccaatggcctgtttgttccagaacttccaggtccgtatgcaggaggacgccgccttgctcaataagcgcatttcaacacagcctggactgaccgctctgccagaaaaccccaacactactctcccccccttccaggatacgccttgcgaattacagccccgcatagatccctcactcggtcagcaggtaaaggacggcctggtcgtcggggggccaggcgatgcttctgtagatgctatttacaaggccgtggtcgacgccgcgtccaagggaatgcaggtggtgataaccaccgctgttaattccaccacacagatctctcctatccccgcactgagtgcaatgtccgccttcacagcatccatcggcgatcctctgaacctgagtagcgcagttagtgctgtcattcatggaagaaatatggggggcgttgatcatgatggacgtctcagaaactcgcgtggcgcaagacttcccaagaacctggatcatggcaaaaacgtgaacgagggtgacggcttcgagtactttaaatctgcgtcctgccatacgagcaaaaaacagtgggacggggaacagtccccacgcggagaacgcaatcggtggaaatacgaagagtttctagaccacccgggtcacatacacagttccccatgccatgaacgaccaaacaatgtcagtacattgcccttcctcccaggtgaacagcatcccatccttcttccaccccgtaactgcccgggggataagatcctagaggagaactttagatacaacaactacaagcggactatgatgtcttttaaagaaagactcgagaacacagtggaacgctgcgcacatatcaatggaaatagaccaagacagagtaggggattcggcgagcttctcagtaccgcgaagcaggatctggtgttagaggaacagtccccctcctcgtcgaattccctggaaaactctcttgtgaaagactacattcattataatggtgactttaacgcgaagagcgtaaacggatgtgtcccttctccctctgacgccaagtccatatcatccgaggatgacttgcgtaaccctgactcacctagcagtaacgaactcatacattacagaccacggacattcaacgttggcgatcttgtgtggggccagattaagggccttacaagttggccgggcaagcttgttcgggaagatgacgtccacaactcttgccagcagagtccagaagaggggaaagtggaaccagaaaagctaaagacgctgacggaggggcttgaggcatattctagagtccgcaagagaaaccgtaagagtgggaaacttaataaccaccttgaggcggccatacacgaggcgatgagcgaacttgacaagatgagtggcactgtccaccagatcccccaaggggaccggcaaatgcgcccccccaaacccaagagacggaagatttcccgctag

SEQ ID NO: 194972 - DNA, 2178 bp, Artificial Sequence
  Description of Artificial Sequence: Synthetic coding sequence
atggccgccgccagcgccgtgagcgtgctgctggtggccgccgagcgcaataggtggcacagattgccttccctcctgcttcctccaagaacgtgggtgtggagacagaggactatgaaatatacgactgctactggccggaacattactaaagtgctgatagcaaaccgtggcgagatcgcttgcagggtgatgcgcacggcaaagaaactaggggtccagaccgttgccgtctacagcgaggccgaccgtaactcgatgcacgtggacatggccgacgaagcctattccatcggtccagccccatctcaacagtcatacttgtccatggagaagattatccaggtcgctaaaactagcgccgctcaggcgatccacccaggatgcggctttctctctgaaaacatggaattcgctgagctctgtaagcaggaaggaattattttcataggtccccccccaagtgccattcgcgacatgggaattaaatcaaccagcaaaagtattatggccgcggctggagtgccagtcgtggaggggtaccatggtgaagatcagtcagatcaatgcctgaaagaacatgcgaggcgcatcgggtaccccgtaatgatcaaagccgtcagaggcggcgggggtaaaggaatgagaatcgtcagatccgaacaagaatttcaggaacagctcgagtccgcaagacgggaggcgaaaaagagttttaacgacgatgcaatgctgatcgagaagttcgttgatacccccagacatgtggaggtgcaggtatttggagatcatcacggcaatgccgtttatctatttgagagagattgcagtgtccagcgcagacaccagaaaattatagaagaggcccccgctccaggtatcaagtctgaagtgaggaagaagctgggagaggcagctgttcgggcggccaaggcagtcaattacgtgggcgctgggacagtggagttcatcatggattccaaacacaatttttgtttcatggaaatgaacactagactccaagtggaacatccagtgacggagatgatcacgggcaccgatctggttgagtggcagttgaggattgctgctggtgagaagatccccctcagtcaggaagagatcaccctacaaggccacgctttcgaggcacgcatatacgccgaggaccccagcaacaatttcatgcctgtagccggacctctcgttcacttaagcacacccagagccgacccaagcacgcgtatcgaaactggtgtgcggcaaggcgacgaagtgtccgtccactacgatcctatgatcgccaagctggtggtctgggctgccgaccgccaagccgctctgacaaaactgcgctattctctcagacagtataatatagtcgggctccacacaaatatcgactttcttcttaacctgtctggtcaccctgaattcgaggcgggtaacgtacacaccgattttatcccacagcaccacaaacagttactcctgagtaggaaagcggccgcgaaggagagcttgtgccaggcggcccttggcctcatattaaaagaaaaagccatgaccgataccttcacactgcaagcgcatgatcagtttagccccttctcctcatcatctgggagacggctgaacataagctacacccggaatatgaccctgaaagacggaaaaaacaacgtcgcgatcgccgttacctataatcatgatgggagctactccatgcagattgaggataagaccttccaggtgcttgggaacctctatagcgagggcgactgcacctatttaaagtgctcagttaacggcgtagcttctaaggcgaaactcataatactggaaaatactatttacctcttctcaaaagagggctctattgaaattgatatccccgttcctaagtatctgtcgagtgtcagctcccaggagacacagggaggacctctcgcccctatgactgggacaatcgaaaaggtcttcgttaaagccggagataaggtgaaggcgggagattcactcatggtgatgattgccatgaaaatggaacacaccattaagtcacccaaggatgggactgtgaaaaaagtattctatcgggagggcgcacaagccaatagacatactcccctagtcgagttcgaggaggaagagagcgacaagcgtgagtctgagtag

SEQ ID NO: 194973 - DNA, 1728 bp, Artificial Sequence
  Description of Artificial Sequence: Synthetic coding sequence
atggagaagatcatccaggtggccaagaccagcgccgcccagcacattcagtcaatcatggctgctgccggtgtgccagtagtagaaggatatcatggcgaggatcagtccgaccagtgcttaaaagaacatgcaagaaggatcggttatcccgtgatgattaaagccgttaggggcggaggagggaagggcatgaggatcgtgcggtccgagcaggaatttcaagaacaacttgagtccgcccgccgtgaggccaaaaaatcctttaatgacgacgcgatgctcatcgaaaagtttgtggacacacccagacacgtggaggttcaggtctttggcgatcatcatgggaacgctgtatacttattcgaacgggattgttccgtccagcgtcgtcaccagaaaataatcgaggaggcacctgccccaggaatcaaaagtgaggtgagaaagaagctcggagaggcagctgtgcgggcggctaaggctgtgaactacgttggggcaggcaccgtggagtttatcatggacagcaagcataacttctgtttcatggagatgaacacccgacttcaggtcgagcaccctgttactgagatgatcacgggaaccgacctggtggagtggcagttgcggattgccgccggcgagaagatacccctcagccaggaagaaattacattgcagggtcatgccttcgaggcgaggatctatgccgaagacccatcaaacaacttcatgcccgttgcgggccccttggttcatctgtccaccccacgcgcagaccccagtactaggatagagacaggagttcgccagggggacgaagtctctgtgcattacgaccccatgattgccaaactggttgtgtgggctgcagacaggcaggcggcgctgactaaactcagatatagcctgcgacagtataacatcgtgggtcttcacacgaacatcgattttttgttgaaccttagcggacaccccgaattcgaggctggcaatgtacacactgactttattccccagcaccacaaacagttgttgctgagccgaaaagctgctgcaaaggaatccctttgccaggccgcactaggcctcattctaaaagaaaaagcaatgactgatactttcaccctgcaggctcacgaccagtttagcccattttcctcatcctccggccgccgattaaatatcagctatacaagaaacatgacccttaaagacggtaagaacaatgtggcgattgctgtcacctacaatcatgacggctcctactccatgcagattgaagataagactttccaggtgcttggtaatttgtactcggaaggagattgcacctatctcaaatgtagcgtaaacggagttgcttcaaaagcgaagttgatcattctggaaaatactatttacctcttcagcaaagagggaagcatagaaattgatattccagttcctaaatacctctcctcggttagttcacaggagacacaggggggacccctcgcacctatgactggcacaattgagaaagtgttcgtcaaggccggcgacaaagttaaagccggcgattcgctgatggtcatgatcgccatgaagatggaacatactattaaatcaccgaaagacgggactgttaaaaaggtgttttaccgcgagggggcccaagcgaacagacacacgcccctggtggaattcgaagaagaagaaagcgacaagcgtgagtccgagtag

SEQ ID NO: 194974 - DNA, 1425 bp, Artificial Sequence
  Description of Artificial Sequence: Synthetic coding sequence
atggccgccgccagcgccgtgagcgtgctgctggtggccgccgagaggaacaggtggcaccggctccccagtcttctcctgccgcctagaacgtgggtttggcgtcaacgaactatgaagtacactaccgctacagacgaagcctactccatcgggccagcgccttcacagcaatcttacctgagtatggagaagatcatccaggtggcaaaaaccagcgccgcccaagcaatccaccccgggtgtgggtttcttagcgagaacatggagttcgccgagttgtgcaaacaagaaggcatcattttcatcggacccccgcccagcgccattcgggacatgggcattaagtcaactagcaaaagcatcatggctgccgccggcgtccccgtggtggaaggataccacggcgaggaccagagcgaccagtgcctgaaagaacatgctaggagaatcggctatcccgtcatgatcaaagccgtccgcgggggcggggggaaaggaatgagaatcgtgcggtcagagcaggaattccaggaacagctagaatctgcccgccgggaggctaaaaagagtttcaacgatgatgccatgctaattgagaaatttgtcgacactcccagacatgtcgaagtccaagtattcggggatcaccacgggaacgccgtgtacctgtttgaaagagattgttctgtgcagcgaaggcatcagaagatcattgaagaagcacccgcacccggcattaaatctgaggtccggaaaaagctgggggaggcagcggtgagagcagctaaggctgtaaactatgtgggggccggcactgttgaattcataatggactctaaacataatttttgcttcatggagatgaatacgcgactgcaggtggaacatcccgttaccgagatgatcacaggcaccgacctggtggaatggcagctgaggatcgcagccggcgaaaaaatcccactgtctcaagaagaaatcaccctgcaaggacacgcttttgaggcacggatttacgcagaagacccaagcaataacttcatgcccgttgccgggccactggtccacctctccacccctagggccgacccgtcaactcgcatcgaaacgggggtacggcagggcgacgaggtgtctgtgcattatgatcctatgatcgcaaagttggtggtatgggccgcagaccgacaagctgccctgacgaagctgagatactcgctgcggcaatataacatcgtggggctgcacactaacttaactagctattcaacctgcttagcaacccagtctttaaagctggggacctgtaccctcatttcctctctcaacacaactaactcctgttgttccgtgggacgcctgcagcccaaaagcttgtacgcacgacagccttgggttagttcctcgcggagaaagccatag

SEQ ID NO: 194975 - DNA, 1281 bp, Artificial Sequence
  Description of Artificial Sequence: Synthetic coding sequence
atggagttcgccgagctgtgcaagcaggagggcatcatcttcatcggccctccaccttctgccatcagagacatgggcattaagtctactagcaagagtatcatggctgcggccggcgtacccgtcgtcgagggttaccacggagaggaccagtccgatcagtgcttaaaggagcacgctagaaggattggttacccagtgatgattaaggcggttcgtgggggcggaggcaaagggatgagaattgtcagaagtgaacaggagttccaggagcagctggagtcggcacgccgcgaggctaagaaaagctttaatgacgacgccatgctgatagagaagttcgttgacaccccaaggcacgtggaggttcaagtattcggcgatcaccacggaaatgctgtctatctttttgaaagggactgttctgtgcagcggcgccatcaaaagatcatcgaggaagccccggcgcctggaattaagtcagaggttagaaagaaactgggggaggccgcggtgcgggccgctaaggcagtcaactacgttggtgctggcactgttgagttcataatggactccaaacataatttctgttttatggaaatgaatacaaggctgcaggttgagcaccctgtcacagagatgattacagggacggacctcgtcgagtggcaactgcggatagccgcaggcgagaaaattcccctcagccaggaagagatcacactccagggacacgcttttgaagcccgtatttacgctgaagacccgtccaataattttatgccagttgcgggccccttagtacatctctctaccccgagggccgaccccagcaccaggatcgaaaccggtgtccgccagggtgacgaagtgagcgtccattacgacccgatgattgcaaaactggtcgtgtgggctgccgaccgacaagccgcgctcacaaaacttagatatagtctccggcaatataacattgttggactgcacactaacattgatttcctgcttaacctgtccggccaccctgagttcgaagccggtaatgtccacaccgacttcattcctcaacatcataagcaactgctgctgagtcggaaagccgcggccaaggagagcttgtgccaggcggccctggggctcatcttgaaagagaaagcaatgacggatacttttactctgcaagcccacgaccagttctctcctttctccagcagttcgggcaggcgccttaacatttcctacacccgaaatatgacccttaaggacggaaagaataattag

SEQ ID NO: 194976 - DNA, 603 bp, Artificial Sequence
  Description of Artificial Sequence: Synthetic coding sequence
atggagaagatcatccaggtggccaagaccagcgccgcccaggccatccaccccggatgtgggttcctgtctgagaatatggaattcgcagaattatgcaagcaggaaggcatcatcttcataggccctccgccgtctgctataagagatatgggaatcaaatcaaccagtaaatcaatcatggctgctgccggagtaccagttgtggaaggttatcacggagaggaccagagtgaccagtgcctgaaagagcacgcccgtcggatcggctaccctgtgatgatcaaggcagtgcggggaggcggcgggaagggaatgaggattgtgcgtagcgagcaggaatttcaggaacagcttgagagcgcacggagagaggcgaagaagtcctttaacgacgatgcaatgctgatcgaaaagttcgtggataccccccgtcacgtggaagtgcaggtgttcggggaccaccacggcaacgcagtgtatctgttcgaaagagactgctctgttcagcgccgtcaccagaaaatcatcgaagaagccccggcccctggaataaagagtgaagtgaggaagaaggggcggagttgctctcagtcatgctag

SEQ ID NO: 194977 - DNA, 1578 bp, Artificial Sequence
  Description of Artificial Sequence: Synthetic coding sequence
atgtgggccgtgctgcggctggccctgcggccctgcgcccgggcctcaccagccggccctagagcttaccatggtgattccgtcgccagtcttggcacgcaaccagaccttggttctgcactgtatcaggagaactacaaacaaatgaaagctctcgtgaatcaactgcatgagcgggttgaacacatcaaattgggcggaggggagaaggctagagctctgcacatcagtaggggcaaattgctgcccagggaacgcattgacaacttaattgaccctgggagcccattcttggaattgtctcagtttgccgggtatcagctgtatgacaacgaagaagtccctggtggcggaatcattacggggatcgggcgtgtatcgggcgtcgaatgcatgattatcgcaaacgacgccaccgtgaaaggcggcgcatattaccctgttaccgtaaaaaaacaattgcgagcccaagaaatagccatgcaaaaccgtttgccctgtatttatctcgtcgactcaggtggtgcatacctgcctaggcaggctgatgtgttccctgatagggatcactttggtagaaccttctataaccaggcgatcatgagctccaagaacatagctcaggtaaaagccgcgacaggcgaggaagtaagtgcggaggatctgggcggcgctgacttgcactgtcgcaagtccggggtgagtgaccactgggccctggacgaccaccacgctctacacctcacaaggaaggtggtgaggaacctgaactaccagaaaaagctcgacgtgaccattgagccatctgaggaaccactcttcccagctgacgaactgtatggaattgtgggcgccaacctgaagaggtcatttgacgtcagggaagtgattgccaggattgtggacgggtcaaggttcacagagttcaaagcgttctatggcgataccctcgtgactgggttcgctcgcatctttggctacccagttggcattgtcggtaacaacggcgttctgtttagcgaatcagctaagaagggcacgcacttcgtacagctctgctgtcagcgtaacatcccactactgtttctgcaaaatattaccggcttcatggtcggtagggagtacgaggccgaaggcatagccaaggatggggccaagatggtagccgcggtggcttgtgctcaggtccccaaaataacgctcattatcggcggaagctacggcgcaggaaattacgggatgtgtggtcgggcttatagcccacgctttctctacatctggcctaacgcccggatcagcgttatggggggggaacaggctgccaacgtgctggcaactatcaccaaggaccaacgggcacgagaaggcaagcagtttagcagcgcggacgaggcagctctgaaagagccaatcatcaagaagttcgaggaggagggtaatccctattactccagtgcaagggtgtgggacgatgggatcatcgatcctgccgatacacggctggtgctgggcctgagtttctctgccgccttgaacgccccaattgagaagacagacttcggaatttttcgcatgtag

SEQ ID NO: 194978 - DNA, 1692 bp, Artificial Sequence
  Description of Artificial Sequence: Synthetic coding sequence
atgtgggccgtgctgcggctggccctgcggccctgcgcccgggcctcccccgcagggcctagagcctatcacggggattctgtggcgagcctgggcacgcagcctgacctgggctcagccctctatcaggagaactataagcagatgaaggcactcgtcaaccaattacatgaacgcgtcgagcatatcaaactggggggcggggaaaaggcccgggccttacatatctcccgagggaagttgctgcccagagaaagaattgataacctgattgacccaggctcacctttcctcgagttatcccagttcgcaggatatcagctttacgacaacgaagaagtccccggcggtggcataattactggcatcgggagggtttctggcgtggaatgtatgattattgcaaacgacgctaccgttaagggcggcgcctactacccggttaccgttaagaagcagctcagggcgcaagagatagccatgcaaaaccgcctgccttgtatctacctagtcgacagcggaggcgcctatctgccgaggcaagctgacgtgtttcctgacagagatcatttcgggcgcaccttctataaccaggccataatgagttcgaaaaacatcgcacagattgctgtggtcatgggctcctgtacagcaggcggggcctatgtcccagccatggccgatgaaaatattattgtccgaaagcagggcactattttccttgcggggccccccctggtgaaggctgctaccggggaggaggtgagtgccgaagacctggggggcgctgacttgcattgcagaaaatctggggtgtccgaccactgggcgttagacgaccaccacgctcttcatttgacccgtaaagtggtacgtaatctgaattaccagaagaaattggacgtgaccatcgagccttcagaggagcctctgttcccggccgacgagctatatggcattgtcggtgccaacctgaagcgaagcttcgatgttcgtgaagtaatcgcccgaattgtggacggtagccgtttcaccgagttcaaagcattctatggcgataccctggttacagggtttgcaagaatcttcggttaccctgtcgggattgttggcaataatggcgtgctgttttccgaatcagcaaagaaggggacccacttcgtacaactgtgttgtcagcggaatattcccctgctcttcctccagaacattacagggtttatggtaggccgtgagtatgaagccgaagggatcgccaaggacggagctaagatggttgcggccgtagcatgcgctcaggtccctaagattacgctgatcataggggggtcctatggagccggcaactacgggatgtgtggccgtgcttacagccctcgcttcctgtatatttggcccaacgctcgaatctctgttatgggaggtgaacaggcagccaacgtattggctaccataactaaagatcagagggcacgagagggcaaacagtttagttcagcagacgaggccgccttgaaggaaccaatcattaagaagtttgaggaagaggggaatccctactactctagcgctcgcgtgtgggatgatggaattattgatcctgcagatacacgcttggttctcgggcttagcttttctgctgcactgaacgcacctatcgagaagacagactttggcatcttccggatgtag

SEQ ID NO: 194979 - DNA, 870 bp, Artificial Sequence
  Description of Artificial Sequence: Synthetic coding sequence
atggccaagcacatccagaaggagatccagcggggcgtggagagctgggttagcttaggcaacagacgacctcacctttcgataatcctggtcggagataacccagcaagccacacttacgtgaggaataaaatcagggctgcgtccgctgtaggaatttgctccgaactaatactcaaacccaaagacgtctcacaggaagagctgctagatgtgacagaccaactgaatatggaccccagagtgagtgggatattggtccagttaccacttcccgatcatgtcgacgaaaggaccatctgcaacggcatcgcacccgagaaggatgtcgatggttttcatattattaatataggccgattgtgcttggatcaacacagccttatccctgccaccgcctcggctgtgtgggagataataaagagaacggggatccagacttttgggaaaaacgtagttgttgcagggcgttcaaaaaatgttggcatgcccatcgcaatgttactgcacacagacggcgagcacgagcggcccgggggtgacgctacagttaccatagctcatcgctacaccccaaaggagcagctgaaaattcatacccagttagctgatatcatcatcgtagctgcaggcattcccaaactcatcacgagcgacatggtgaaagagggagcagccgttattgacgtgggcatcaactatgtccacgatcccgtcactggtaaaaccaagctggtcggggacgtagactttgaagccgtgaagaaaaaggccggctttatcacacctgtgcccgggggggttggccccatgaccgtcgctatgctcctgaagaatactttgctggcagccaagaaaatcatctactag

SEQ ID NO: 194980 - DNA, 672 bp, Artificial Sequence
  Description of Artificial Sequence: Synthetic coding sequence
atggccaagcacatccagaaggagatccagcggggcgtggagagctgggtgagtctcggcaataggaggccacatttgagtataatccttgtgggggacaacccagcgagccatacttatgtgcgaaataagatacgggccgcctccgcagtcggcatttgttccgagctgattttaaagcccaaggatgtgtctcaagaagagttgctagacgtgacggatcagctcaatatggaccccagagtcagcggcattctggttcaattgcccctccccgaccatgtggatgagcgtactatctgcaatggaatcgctcccgaaaaagacgtggatggatttcatataatcaacatagggaggttgtgtctggaccaacatagcctgatccccgccacagcaagtgcagtttgggagatcattaagcgcacagggatccagacattcggaaagaatgtggtggtagctggccggtccaagaatgtggggatgccgatcgcaatgctgctgcacaccgatggggaacacgagcgcccgggaggagacgccactgtgactatagcgcaccgctacactcccaaagaacagctcaagattcacactcagcttgctgatatcataattgtggctgccgaaagatttcaccatttcgcccaagatctgagcaactcctag

SEQ ID NO: 194981 - DNA, 762 bp, Artificial Sequence
  Description of Artificial Sequence: Synthetic coding sequence
atggccaagcacatccagaaggagatccagcggggcgtggagagctgggtgtccttaggcaacagacgaccccatctatccatcattctcgtgggggacaatcccgcaagccacacctacgttcgcaataaaattcgagccgcctccgccgtggggatttgtagcgaactcatcctcaaacctaaggacgtgtctcaggaggagctcttagacgtgacagatcagctcaatatggacccccgggtgagcggcatcctggtccaactaccgctgccagatcacgtggacgagagaacaatatgcaatggcatagccccagaaaaggacgtggacggatttcacatcattaacattggccgattgtgcctggatcagcacagtctgataccagctactgctagtgctgtgtgggagatcattaagcgtacaggcattcagacgttcgggaagaatgtcgttgtagctgggcgtagcaagaacgtaggtatgcctatcgccatgcttcttcacacagatggagagcacgaacgccctggcggcgacgccacagtaaccattgcgcacaggtatacaccaaaagagcagcttaagattcatacccagttagctgacatcatcatagtggctgcaggaattccaaagctcattaccagtgacatggtgaaagaaggcgcggcggttatcgatgtgggaattaattatgttcacgacccggtcacaggaaagactaaattggtgggtgatgtggatttcgaggcatag

SEQ ID NO: 194982 - DNA, 1044 bp, Artificial Sequence
  Description of Artificial Sequence: Synthetic coding sequence
atgaccgtgcccgtgcggggcttcagcctgctgcggggccggctggggagggctcctgcgcttggcaggagcacggccccaagcgtgagggcgcccggcgaacccggaagcgccttcagaggttttaggtccagcggtgtgcgacatgaggccatcattatcagcggtaccgagatggcgaaacacattcaaaaggagatccagcgaggtgtggaatcatgggttagcctgggtaaccggagaccgcacctgtcgatcatactggtgggggacaaccctgcaagccatacatatgtgagaaataagatccgggccgcctctgcagtcggtatatgttctgaactaatcctgaaacccaaagacgtcagtcaggaagaactcctggacgtgacagatcagttgaacatggatccccgagtgtcagggatccttgtgcaactgccactccctgatcatgtcgacgaaagaactatctgcaacggcattgcaccagaaaaagacgttgatggctttcacattataaacattggccgcttgtgcttggaccagcatagcttaattcccgccaccgcatcggctgtgtgggagatcattaaacggactggaatccagaccttcggcaaaaacgtcgttgttgcagggcgtagcaaaaacgttgggatgcctatcgccatgctcctgcacaccgacggcgaacacgagagacctggcggcgacgccaccgtaactatcgcccaccgttacactcccaaagaacaactgaagatccatacccagctcgccgacattatcattgttgcggccggcattccaaagctgattacgagtgacatggttaaggagggcgccgcagttatagatgtcggaattaattacgtgcacgacccagtgacggggaaaactaaactcgtcggcgatgttgacttcgaggccgtgaagaagaaggcagggtttatcaccccagtgcccggcggggtagggccaatgaccgtggctatgctgctgaaaaatacactgcttgccgcaaaaaagatcatctactag

SEQ ID NO: 194983 - DNA, 441 bp, Artificial Sequence
  Description of Artificial Sequence: Synthetic coding sequence
atggacccccgggtgagcggcatcctggtgcagctgcccctgcccgatcacgtcgatgaacggaccatctgtaacggaatcgcaccggagaaggatgtggacgggttccacattataaatattggccgactctgtctggaccagcacagcctaatcccagcaaccgcttcagcagtttgggagattattaaaagaaccggaatccagacatttggaaagaacgtggtggtggctggccgcagcaaaaatgttggtatgccaatcgctatgttgctccatacggatggcgagcatgagcgccccgggggtgatgcaactgttacaatagcacatcgctacacccctaaggaacaactaaaaatccatactcaactcgctgacatcattattgtagccgcggagcgctttcaccattttgctcaggacttgtccaatagctag

SEQ ID NO: 194984 - DNA, 1257 bp, Artificial Sequence
  Description of Artificial Sequence: Synthetic coding sequence
atgcccatgctgctgccccacccccaccagcacttcctgaagggcttgctgcgggcaccattcaggtgttaccattttatcttccactctagcacgcacctcgggtcagggatcccttgtgcccagccctttaatagcctgggcctccattgtactaagtggatgctgctctccgacgggctgaaaaggaaactgtgcgtgcagaccaccctgaaagatcacaccgaggggttgagcgacaaggagcaaagattcgtggacaagctgtatactggtctgatccagggacagagggcttgtctcgcagaggcgatcaccctcgtagagtctactcacagtaggaagaaggaactcgcgcaagtccttttacagaaggtgctactttatcacagggaacaagagcaatcaaataaaggcaaacccctggcttttagagtaggactgagcgggccgcctggtgcgggaaagtctacatttattgaatacttcgggaaaatgctcacagagaggggtcataagctgtccgtactggcagttgaccccagctcgtgcacgtctggtgggtctcttctcggcgataaaacccggatgactgagctaagccgggatatgaatgcctacatcagaccctcacctactcggggcacactcggcggggtgacccggacaacaaacgaagccatcctactgtgtgaaggagctggatacgatataatccttatcgagacagtaggagttggacaatcagagtttgcggtggcagacatggtggatatgttcgtgctgctgctacctccggccggcggcgacgagcttcaggggataaagcgtggtattatagagatggctgacttagtcgccgtcacaaagtcagatggggatctgattgtcccagcccggaggattcaagccgaatacgtgtcagccttgaagctcttaagaaaaaggtcccaggtgtggaagccaaaggtgatcagaatcagcgcacggtccggggaggggatctccgagatgtgggataaaatgaaagacttccaggacctgatgttggcatccggagaactgaccgcaaagcgacgaaagcagcagaaggtctggatgtggaacctgatccaagagtcagtgctggagcatttcagaacacatcccactgtcagggaacagattcccctcctggagcagaaggtgctaatcggcgctctgagcccgggactggctgccgatttccttctgaaggcatttaaaagccgcgactag

SEQ ID NO: 194985 - DNA, 1275 bp, Artificial Sequence
  Description of Artificial Sequence: Synthetic coding sequence
atgcccatgctgctgccccacccccaccagcacttcctgaagggcctcctccgggctccctttcggtgttaccatttcattttccatagttccactcatctgggctcagggatcccctgcgcacagccctttaattctttgggactgcattgcacgaagtggatgctgctaagcgacggactgaagcgcaaattatgcgttcagacaactttgaaggaccataccgagggcctgagcgacaaggagcagcgctttgtcgataagctgtacaccgggcttatccaaggacagcgggcttgcttggccgaggcaataactcttgttgagagcacccattcccggaaaaaggaactggcccaagtgctgctccaaaaggtcctcctttatcaccgggaacaggagcaaagcaacaaagggaagccactggccttccgtgtgggtctcagcggcccaccgggggcagggaagagcacatttattgagtactttggcaagatgctcaccgagcgcggccacaaattgtcagtgttggctgtcgatccgtcttcgtgcacttctggcggctcgctgttgggcgacaagacaagaatgacagaactaagccgtgacatgaatgcctatataagaccctcccctactagaggaaccctcggtggcgttactagaaccacaaacgaagcgatactgctgtgtgaaggtgccgggtatgacatcatcctgatcgagacagtgggtgtgggacagtcggagttcgcagttgccgacatggtagacatgttcgtgctcttgctgcccccggccggcggcgatgagctgcagggaattaagcgggggataatagaaatggccgatctggtggccgtgactaaaagtgatggagatctgatcgtcccagctcggagaatccaagctgaatacgtgtctgccctcaagctcctgagaaagaggtcacaggtgtggaaaccgaaggttatcaggatttcagctcgcagtggagaggggatctcagagatgtgggataaaatgaaggatttccaggacttgatgttggctagcggagagttaaccgcaaaacgaaggaaacagcagaaagtttggatgtggaatctgattcaggaatctgtgctcgaacatttccgcacgcaccctactgttcgggaacagatccccctgctcgaacaaaaagtactaataggcgcattatctcctggtttggccgccgactttttgctgaaagccctgaaagccgagaccaataagattcaccccgtatag

SEQ ID NO: 194986 - DNA, 414 bp, Artificial Sequence
  Description of Artificial Sequence: Synthetic coding sequence
atggccgacctggtggccgtgaccaagagcgacggcgacctgatcgtgcccgcccgccgtattcaggccgaatacgtttccgcactcaagttgctgcgcaaacgaagccaggtgtggaaacccaaggtgattagaatcagcgcccgctccggagagggcatctctgagatgtgggataaaatgaaggactttcaggatctgatgctcgccagcggggagctcaccgcaaagcgacgaaaacagcaaaaggtctggatgtggaacctgatccaggaatctgtgctcgaacactttcggacccacccaacagtgcgagagcaaattcctctgttggaacagaaggtgttgatcggagccctctctcccgggctcgccgcagacttcctgctgaaggctttcaaatccagggattag

SEQ ID NO: 194987 - DNA, 480 bp, Artificial Sequence
  Description of Artificial Sequence: Synthetic coding sequence
atggccggcctgacccggttcgccctggagctggtgaccgagaagggtcatacctttgccgaggaacttcagaaaatccaatgcacactccaggatgttgggagcgctcttgcgacgccctgttcttccgcccgcgaagcccaccttaagtacaccactttcaaggccggcccaattcttgagttagaacagtggatcgacaagtatactagccagctccccccgctgactgcatttatccttccttcagggggaaaaatttctagtgcgcttcacttctgccgggcagtttgtaggcgcgcagagaggcgcgttgtaccactcgtacagatgggcgaaacagacgcaaacgtggccaaattcctgaacaggctttccgattacctgtttacgctcgccagatacgcagcaatgaaagagggtaatcaagagaaaatctatatgaagaatgaccccagcgctgaaagcgagggactttag

SEQ ID NO: 194988 - DNA, 753 bp, Artificial Sequence
  Description of Artificial Sequence: Synthetic coding sequence
atggccgtgtgcggcctgggcagccggctgggcctgggcagccggcttggcctgcggggttgtttcggcgccgcccggctcctgtaccctcgattccagagtagagggccacagggagtagaagacggcgacagaccacagccaagctctaaaaccccccgcatcccgaagatctacacaaaaactggcgacaaaggctttagtagtaccttcactggagagaggcgcccgaaggatgatcaggtctttgaagcagttgggacaacagacgagttgagctctgcgattggcttcgccttggaactggtgactgaaaaaggtcatacgtttgccgaggagttgcaaaagatccagtgtactttgcaggacgttggtagtgcacttgccactccttgctcttcggcccgggaggcgcacctgaagtatacaacattcaaggctggaccaattcttgagcttgagcagtggatcgataaatacacatcacagctcccacctttaaccgcttttatactcccctcaggcggtaagatcagctctgcattgcacttctgcagagccgtttgtaggagagcagaacggcgcgtggtgcccctggtgcaaatgggtgaaactgatgccaatgtggcaaaatttctgaaccggctgagtgattacctctttactctggcccggtatgctgcaatgaaagaagggaatcaggagaagatctatatgaagaacgatccttccgctgagagcgaaggtctgtag

SEQ ID NO: 194989 - DNA, 849 bp, Artificial Sequence
  Description of Artificial Sequence: Synthetic coding sequence
atggagcccaaggtggccgagctgaagcagaagatcgaggacaccttgtgccctttcgggttcgaggtgtaccctttccaggtcgcctggtacaatgagctgctgcccccagcgttccacctgccattgccagggcccacgctggccttcctcgtgctcagtacgccagccatgtttgatagggctctgaagcccttcttgcagtcttgtcacctccggatgctgacagaccctgtagaccagtgtgtggcctaccatcttgggagggtgcgcgagtctctccccgagctccagattgagattattgcggattacgaagtgcaccccaaccggcggcccaaaatactcgctcagaccgccgcccacgtagcgggcgccgcctattactaccagagacaggacgtggaggctgacccttggggaaatcaacggatatctggcgtgtgcatacaccccaggtttggtgggtggtttgccattcggggtgtggtgctgctgccgggtatcgaggtcccagatttgcctccgcgcaaaccacatgactgtgtcccaacgcgcgccgatcgaatcgccttgctggaagggtttaatttccattggcgagattggacctaccgtgatgctgtgacacctcaagagaggtactctgaggagcagaaggcatactttagcacaccaccagcccaacgattggcgctgctggggctcgcccaaccatccgagaaaccatcctccccttcgccggaccttccattcaccaccccagctcctaaaaaaccgggcaacccgagcagggcccggagctggctcagtccacgcgtctcccccccagcaagccctggcccttag

SEQ ID NO: 194990 - DNA, 891 bp, Artificial Sequence
  Description of Artificial Sequence: Synthetic coding sequence
atggccaacgtgctgtgcaaccgggcccggctggtgagctacctgcccggcttttgttccctcgtgaagcgggtggtgaacccgaaagccttttcgactgcgggaagttcaggctccgacgaatcacacgtggccgctgcaccaccagatatttgctccagaaccgtttggcccgacgaaacaatgggtccgtttgggccgcaggaccagcgcttccaactcccaggcaacatcggattcgactgccacctgaatggaacggctagtcagaaaaagagtctcgtccacaaaactctccctgatgtgttagccgagcctctgtcctcggagcggcacgaatttgtaatggcccaatacgtcaacgagtttcagggcaacgacgcccccgtggagcaagagatcaactcagccgagacctattttgagagtgctcgcgtagaatgcgccatccagacatgcccggagctcctgcgcaaggacttcgaatccttattccctgaggtggcaaacggtaaactcatgatcctgacagtcacccagaaaacgaaaaacgatatgaccgtatggtctgaggaggtggaaattgagcgtgaggtgctgctcgagaagtttattaacggcgccaaagagatttgctacgctctgcgagccgagggatactgggctgactttattgacccttcaagcggactcgcctttttcggcccctatactaacaataccctctttgagactgatgaaaggtatcgccacctgggctttagtgtggatgatctcggctgctgcaaagtgatcaggcactcgctatggggcacacacgtggtggtgggctccatcttcacaaatgccactcccgacagccacatcatgaagaagctgagcggaaattag

SEQ ID NO: 194991 - DNA, 891 bp, Artificial Sequence
  Description of Artificial Sequence: Synthetic coding sequence
atggccaacgtgctgtgcaaccgggcccggctggtgagctacctgccaggtttttgctccctagttaagcgggttgtgaatcccaaggcattcagtaccgcgggatcatccggctcagacgagtcccacgtcgctgctgcccctcctgacatctgctcacgcaccgtgtggccagatgagaccatgggaccattcggaccgcaggaccagaggttccaactgcctggcaatataggtttcgattgccacctaaacgggactgctagccagaagaagagtctggtgcacaagactctgccggacgttctagcagaacccctctcttctgagcggcacgaatttgtgatggcccagtatgtgaacgaattccagggcaacgacgctccagttgagcaggagataaatagcgcagagacatacttcgagtccgcacgggtcgagtgcgccattcagacctgtcctgaactgcttcgaaaggatttcgagtctctgttccctgaagtggcgaatggaaaactgatgatcttaacagtaactcagaagaccaagaatgacatgaccgtttggtccgaggaggttgaaatcgaacgggaggtgttgctggagaagtttatcaatggtgctaaagagatttgttatgccctgagggcagagggatattgggcggacttcattgacccatcctcaggcctcgcattcttcgggccgtacacaaataatacactgtttgaaacagatgagcgatataggcatctgggcttcagcgtggacgacctgggctgttgtaaggtgatccgccactcactgtggggtacacatgttgtggtgggttctattttcacaaacgcgacacccgacagccacattatgaagaagttatcaggcaactag

SEQ ID NO: 194992 - DNA, 531 bp, Artificial Sequence
  Description of Artificial Sequence: Synthetic coding sequence
atggcccgggtgctgaaggccgccgccgccaacgccgtgggcctgttctcaagattacaggcgccaatccctactgtgcgagcatcatctacctcccagcctctggaccaggtgactggctccgtttggaatctaggtcggctgaatcatgtcgcaatagctgttcccgatttagaaaaggccgccgcattttataaaaatatcctcggagcccaggttagcgaggccgtgcccctgcccgaacatggagtgtcagtagtgtttgttaacctggggaacaccaaaatggagttgctgcacccattaggccgcgactcccctattgccggtttcctccagaaaaataaagcgggtggcatgcatcacatctgcatcgaagtggacaacataaatgcagctgtgatggacttaaaaaagaaaaagattcgtagcctatcagaagaggttaaaataggagctcatggtaagcctgttattttcctgcatcctaaagactgtggaggagttttggtcgagctggagcaggcatag

SEQ ID NO: 194993 - DNA, 2070 bp, Artificial Sequence
  Description of Artificial Sequence: Synthetic coding sequence
atgatcgagatggccgccgagaaggagcccttcctggtgcccgccccccctcctccattgaaggatgagagtggcggaggcgggggcccaactgtcccccctcaccaagaagctgctagcggggaacttcgcgggggcaccgagcggggccctggccgctgcgctcccagtgcggggagccccgcagctgctgtcggtagagaatcccccggggcagccgcgacttcctcctcaggcccacaggcacaacagcaccgtggtggcggtccccaggcccaatctcacggagaggcccgcctttccgatcctcctggaagggccgccccccccgatgttggtgaggagcggcgtggcggcggcgggactgaattaggccctcctgctcctccccgcccacgcaacggttaccagcctcatagacctcctgggggcgggggcggcaaacggaggaacagctgcaatgtcggagggggtggaggcgggttcaagcatcccgcatttaagcgccgtagaagggtgaactcggactgcgacagcgtccttccctctaacttcttattaggcgggaatatcttcgaccctcttaatttaaatagcctgttagacgaggaggtgtccaggaccctgaacgctgagactcctaagtcatctcctctgcctgccaaagggcgcgatccagtcgagattctgataccaaaagatatcaccgatccactcagtctgaatacctgtacagacgaggggcacgtggttttagcctccccattgaagacaggacgaaagcgccataggcaccgggggcagcaccaccagcaacagcaggcagctggcggatctgagtcccatccagtaccccccaccgcgcccctgacccctttgctgcacggtgagggcgctagccagcagccgaggcacaggggacaaaacagggacgcaccgcagccatatgaactcaacactgctattaactgcagagacgaagttgtttcaccactgcctagcgccctgcaaggcccaagcggcagtttatccgcccctcctgcagcaagcgttatcagtgcgcccccttctagtagctcacgacatcgtaaaaggcgccggacttctagtaaaagcgaagcaggtgctcgcggaggcggtcagggcagtaaagaaaaaggccggggcagctggggcgggagacaccaccaccaccatccgttgccagcagccggcttcaaaaagcagcagcgcaaatttcagtacgggaactactgcaagtactacgggtaccggaatccttcttgcgaggatggacgccttagggtgttgaagccagagtggtttagaggtcgggatgtcctcgacctgggctgcaatgtgggacacctgacactaagcatcgcttgtaaatggggcccttcacggatggtggggcttgatatcgacagccggctcattcattctgctcggcagaacattaggcactatctaagtgaagaactgcggctccccccccagacactggaaggagacccaggcgctgagggggaggaaggcaccacaactgtgcggaaaagatcatgtttccccgcctcattgacggccagtcgcggccctatcgcagccccacaggtgcccttggacggggctgatacatcagttttccctaataacgttgtgtttgttactggcaactacgtgctggatcgggatgatctagtcgaagcgcagactcccgaatatgacgtcgtgctgtgtctctcattaaccaaatgggtacatctcaactggggtgatgaaggcctcaaaagaatgttcaggagaatctatcgccatttacggcccggggggattctcgttctggaaccccaaccctggtcttcttacggcaagcggaagacgcttacagagaccatctataaaaattattatcgaatacagctaaaacctgaacagtttagtagctatctgaccagtcccgacgtggggtttagctcgtatgagctcgtggccacaccacataatacctcaaagggtttccaacggccagtttatctgtttcacaaggctcgttctcccagtcactag

SEQ ID NO: 194994 - DNA, 663 bp, Artificial Sequence
  Description of Artificial Sequence: Synthetic coding sequence
atggtgggcctggacatcgacagccggctgatccacagcgcccggcagaacataaggcattatttaagcgaagaactaagactgccgcctcagactctggagggagaccctggagctgaaggagaggaaggcaccaccaccgtgaggaagcggtcttgtttccctgcatcgctgaccgctagcaggggcccaatagctgcgcctcaggtcccgctagatggcgctgatacctcagtgttccccaataatgtggtctttgtgacaggcaactacgttttggatcgcgatgacttagtggaagcccagacaccagaatacgatgtggttctgtgcctgtcactaactaaatgggtccacttaaattggggggacgagggcctgaaacgcatgttccgccggatctaccggcacctgaggccaggcggcatcttggtcttggaaccacaaccctggagctcctacggaaagcggaagactttgactgagacaatttataagaactactataggatccagttaaagccagagcaattctctagctacctgacctcccccgatgttggcttctccagctacgagctggtggcaactccccataatacatcgaaaggtttccagagacccgtttacctgtttcacaaggcgcggtctccgtctcactag

SEQ ID NO: 194995 - DNA, 852 bp, Artificial Sequence
  Description of Artificial Sequence: Synthetic coding sequence
atggccagcggcaccaccaccaccgccgtgaagatcggcatcatcggcggcacaggcctagatgatcctgagattttggaggggagaaccgagaaatatgtggatactccatttggaaagccttccgacgctctgatcctcggtaagattaaaaatgtggattgcgtgctacttgctcggcacggaaggcagcatacgatcatgcccagtaaggtgaattaccaagcaaatatctgggcattaaaggaggagggctgcactcatgtgattgtcaccactgcgtgtggcagcctgcgtgaggagatccaacctggtgacattgtcattatcgaccagtttatcgataggaccaccatgaggccccagagtttctatgacgggtcccactcgtgcgcacgcggcgtgtgtcatattccgatggccgaacccttttgcccgaaaacacgagaggtactgattgagacagcgaagaaactgggtctgcggtgccatagcaagggaactatggtgactatcgagggcccacggttcagttcaagggcggaaagctttatgttccgaacctggggcgctgatgtcattaatatgactaccgtgccagaggtcgtactagcaaaagaggcagggatttgttacgcatctatcgcaatggcgacggattacgattgctggaaagagcatgaagaggcagtgagcgttgaccgcgtactaaagaccctgaaggaaaacgcgaataaggccaagagtcttctgctgaccacaattccacagatagggagtacggagtggagtgagactctccacaacctcaaaaacatggctcaatttagcgtgctgttgccccgtcactag

SEQ ID NO: 194996 - DNA, 468 bp, Artificial Sequence
  Description of Artificial Sequence: Synthetic coding sequence
atggccgccgagacccggaacgtggccggcgccgaggccccccccccccagaagagatactaccggcagcgggcacactccaatcctatggcagatcatacactgagataccctgtcaagcccgaagagatggattggtccgagctgtatcccgagtttttcgcaccattaactcagaatcagagccacgatgatccaaaggacaaaaaggagaagcgagcacaggcccaggtggaattcgcagacatcggctgtggatatggcgggctgcttgccgacaaggatgttctgcctctcccacgccccacatttcaggcagacaaggcccaggtagcaaatcatcagtcacacccagcctcacggatttgtctacgtgctaaatcctggggggccggcgtttatcacaaccgttgtgcaggagccaccagactggatgtacatagtttccgtagggcccccacagtctag

SEQ ID NO: 194997 - DNA, 831 bp, Artificial Sequence
  Description of Artificial Sequence: Synthetic coding sequence
atggccgccgagacccggaacgtggccggcgccgaggccccccccccccagaagaggtactaccggcagagagcacattccaacccgatggctgaccacacactccgctaccctgtgaaaccggaagaaatggattggtccgagctgtaccctgagttttttgcccctctgacgcagaatcagagccatgatgaccctaaagacaagaaagagaaaagagcacaggcccaagtagaattcgctgatatcggttgcggatacggaggccttcttgtggagctttcacccttgttcccagatacattgatcctcggactagagataagagtgaaagtgagcgattatgtgcaggacagaatacgtgcactgcgtgcagctcccgcaggaggattccaaaacatcgcttgtctgaggtctaacgctatgaaacacctgcctaacttcttttacaagggacagctgacaaagatgttctttctatttcctgacccccacttcaagaggacaaagcataaatggcgcatcatctctccaacactgctggctgaatacgcttacgtcttaagggtgggcggccttgtttacacaatcaccgacgtgctggagcttcacgactggatgtgtactcatttcgaggaacaccctctgtttgagagggtccctctggaggatctgagtgaagatccggtcgttgggcacctggggacctctaccgaggagggaaagaaagtactgcggaatggcggcaaaaacttccctgcgattttccgccgtattcaggaccccgtgctccaagctgtaacgagccagaccagcctgcctgggcactag

SEQ ID NO: 194998 - DNA, 2274 bp, Artificial Sequence
  Description of Artificial Sequence: Synthetic coding sequence
atggccgaggtgggccggaccggcatcagctaccccggcgccctgctgccccaaggcttctgggctgcagtggaggtgtggcttgagagaccccaggttgccaataaacgtctgtgcggggctcggcttgaggcacggtggtccgctgccctcccctgcgcggaagccagggggccaggcacatccgcaggctctgagcaaaaagagcgcggacctggccctggacaggggtctcctggcggaggtcccggcccaagaagtttgtccggacccgagcagggcacagcgtgctgcgaacttgaagaagcgcagggccagtgccagcaggaggaggcccagagggaagccgccagcgtgcctctgcgcgactctgggcaccctggccacgctgaagggcgagagggggacttccctgcagccgaccttgacagtctctgggaggattttagtcagtccttagctagaggaaactctgagctgttggccttcctcacaagtagtggggccggatcacaacctgaggcgcagagagaactcgacgtggttctgcgtacagtgattccaaaaactagcccccattgccctctcacaactccgcgacgcgaaattgtcgttcaggacgtactgaatgggaccataacttttctgccgttggaggaagacgatgagggtaatctaaaagtgaagatgtcaaatgtatatcagatacagctgtcgcattccaaggaggaatggttcatttccgtgctcatcttttgcccggagcgttggcatagcgatgggattgtctaccccaagcctacttggctaggcgaggagctgctggctaaactggccaagtggtcagttgaaaataagaagagcgattttaaatccacgctctcgctgatctcaataatgaaatactcaaaagcataccaggaactcaaggaaaagtacaaagagatggtaaaggtttggccagaagtcacggatcctgagaagtttgtgtacgaggatgtcgcaatcgcagcctacctgcttatcctgtgggaagaagagcgcgccgaacggaggctaacagcccgccagagctttgtggacttggggtgtggaaacggactcctggttcatatattgtcttcagaaggccaccctggaagggggatcgacgtgagacgccgcaaaatttgggacatgtatggtcctcagacccaactcgaggaagacgccatcactccaaacgataaaacactgttcccagacgttgattggttgatcggcaaccacagcgacgaactcacgccatggatacctgttattgcagcgaggtcctcatataactgtaggttcttcgttctcccttgctgcttcttcgacttcataggtcgctacagcagacgccagagtaagaaaacacaatatagggaatacctagactttattaaagaagtgggctttacctgtgggtttcacgttgacgaggattgtttgagaattccttccaccaagcgggtttgcctggtaggaaaatcaaggacgtatccgtcttcaagggaagccagtgtcgacgagaaacgcacacagtacatcaaatcacgcagggggtgtccagtgagcccacctgggtgggaattatctcctagccctaggtgggttgccgccggtagtgctggccactgtgatggccagcaagctctggatgctcgcgtcgggtgcgtgacacgagcctgggcggcggaacatggcgccggacctcaagctgagggaccgtggctcccgggatttcacccccgggagaaagccgaaagagtccgcaactgtgctgccttgcctagggatttcatcgatcaggtcgttctgcaagtggccaacttgttgttggggggtaagcagcttaatacccgaagttcccgcaatggctcactcaagacctggaatggcggtgagagcctgagcctagccgaggtcgctaatgaactggacacggagaccttaaggcggcttaaacgggaatgtggtggccttcagaccctcctccggaactctcaccaggttttccaggtcgtgaatggtcgggtgcacattagagattggcgggaggaaacgttgtggaagactaaacaacccgaagccaaacaaaggctgttatccgaggcctgtaagactaggttgtgctggttcttcatgcatcatcccgatggttgcgccttaagcacagattgttgtccctttgcccacggcccagcagagctgaggccaccacgcacaacgccacgcaagaaaataagctag

SEQ ID NO: 194999 - DNA, 1236 bp, Artificial Sequence
  Description of Artificial Sequence: Synthetic coding sequence
atgtgcatcaagttcagcagcgtgatcgccaagaagaacgagcggtggcacagcgatgggattgtgtatccgaagcctacttggcttggtgaggagctgctagcaaagctggctaagtggtcagttgaaaataagaaatccgattttaagtctacattgagcctcatctccatcatgaagtatagtaaagcttaccaagaactgaaggagaaatataaggaaatggtcaaagtatggcctgaggtgaccgacccagaaaagtttgtttatgaggacgtggcaattgcagcatacctgttgatcctctgggaagaggagcgcgcggagcgcaggttgacagcccgccagagctttgtggatctgggctgtggtaatggcctgctcgtgcatatactcagttctgaaggacacccagggcgcggaattgatgtgaggcgacgcaagatctgggatatgtacggcccacagactcaactcgaagaagatgccataacaccaaacgacaaaacgctgtttcccgatgtggactggctgatcggtaaccactctgatgagctgaccccctggattcccgttattgctgccagaagctcctacaactgtagattttttgtgttaccttgctgcttctttgacttcatcggtaggtactcccgaaggcagagcaagaaaactcaatacagagagtacctcgatttcatcaaagaggtcggctttacctgcgggtttcacgtcgatgaagattgtctgcgcatccctagtaccaaacgggtgtgtctggttggcaagtcgcgaacttatccctcctccagggaagcaagcgtcgacgagaaaaggacacagtacataaagtctcggaggggttgtccagtgtcaccccctggctgggagctgagcccctctccacggtgggtcgctgccgggtccgcaggacattgtgacggacagcaggcacttgatgcccgcgtaggttgtgtgaccagggcatgggcagccgagcacggggccgggcctcaggctgagggcccatggctccctggcttccatcccagggagaaggccgagcgcgtcaggaactgcgcagctttacctcgagacttcatcgaccaggtggtattgcaggtggcgaacctgctgctaggcggaaaacagctgaatactagatcctcaagaaatggttcactgaaaacttggaatgggggagggaagctttctaccatcttaggcagaggctag

SEQ ID NO: 195000 - DNA, 1743 bp, Artificial Sequence
  Description of Artificial Sequence: Synthetic coding sequence
atgagcgacacctggagcagcatccaggcccacaagaagcagctggattcactacgcgagaggttgcagcggcgcaggaagcaggattctggacatctcgatctgcggaaccccgaggccgctctgtctccgacattcaggtctgacagccctgtgcctactgctccaacctctgggggacctaaaccaagcacagccagcgccgtgccagaactcgctactgacccagaactagagaagaagcttctgcatcatctttcggatctggcgctaacacttccaactgacgccgtgtccatctgtttggccatcagcactccagatgcacccgctacccaagacggcgtcgagtctctgttacaaaaattcgcagctcaggaactcatcgaagtgaaaaggggcctgcttcaagacgacgctcatcccactcttgtcacctatgccgatcattctaagctgtctgcaatgatgggagctgttgccgaaaaaaaaggacccggcgaagtggccggcactgtgacaggccaaaagaggcgagctgagcaggacagtaccacggtggctgcctttgcgtcgtctctcgtctccgggttaaattcatctgcctccgagcctgccaaggaacccgcgaaaaagtctcgcaaacacgcagccagcgacgtggacttagagatcgaatcactgctgaaccagcagagtactaaagagcaacagtccaagaaagtgagccaggagatcctggaactcctgaacaccacaaccgccaaggagcagtccatagttgaaaagtttagaagtagaggacgggcccaggttcaggaattttgtgactacggcactaaggaggaatgcatgaaagccagcgacgccgatagaccatgcagaaaactccattttcggcgaattattaacaaacacactgacgaaagccttggagattgctctttcttaaacacttgctttcatatggacacttgcaagtacgtccactacgaaattgatgcgtgcatggattcagaagcaccaggcagcaaagatcacactccaagccaagaactggcactgacccagagcgtcggaggggatagttcagccgacagattgtttcctccgcaatggatatgctgcgacatcagatatctggacgttagcatattgggcaagttcgccgtggtgatggcggacccaccgtgggatatccatatggaacttccttatggaaccctgacagacgacgagatgagacggctcaatatccccgtcctgcaggatgacggctttttgtttttgtgggtcactggtagagccatggagttaggaagagagtgcctgaatctgtggggatatgagagagtcgacgagataatttgggtcaagacgaaccaactgcagagaattatccgaactggtagaaccgggcattggctgaatcatggcaaggaacactgtctggtaggcgtcaagggtaatcctcagggattcaaccagggactggattgcgacgttattgtggccgaagttcgatctacctcccacaagccagacgaaatctatgggatgattgagcgcctctctccaggaacaaggaagatcgagctgttcgggcggcctcacaacgtacagcccaactggatcacccttggcaatcaattggacgggattcatttgctggatccggatgttgtcgcccgattcaaacaaaggtatccagacggcataatatccaaacctaagaacttgtag

SEQ ID NO: 195001 - DNA, 492 bp, Artificial Sequence
  Description of Artificial Sequence: Synthetic coding sequence
atgagcgacacctggagcagcatccaggcccacaagaagcagctggactccctccgggagaggttgcagcgcagaagaaagcaggactctgggcacctcgacctgcggaatcccgaggcagcgctgagcccgacatttcgatcagatagccccgtgccaaccgcacccaccagcgggggacctaaaccttccaccgcatccgccgtgcctgagcttgccacagaccccgaactggagaaaaagcttctacaccacctgtcagatctcgcccttaccctgccgacagatgctgtctctatctgtctggcaatctccacgccagatgcccccgccacccaagacggggtggaaagtctgctacaaaaattcgccgcccaagaactaatcgaagtcaagcgcgggctgctccaggatgacgctcatcccaccctggttacttatgccgaccactctaagctgtcggccatgatgggcgctgttgccgagaaatag

SEQ ID NO: 195002 - DNA, 462 bp, Artificial Sequence
  Description of Artificial Sequence: Synthetic coding sequence
atgagcgacacctggagcagcatccaggcccacaagaagcagctggacagcttaagggagcgccttcagaggcgacgcaagcaggactccgggcacttggatttgcgcaatccggaagctgcattatcacccacttttcgcagcgactcccctgttcccacagccccaaccagtggtgggccaaagcccagcacggcaagtgcagtgccagaactagccactgaccctgagctcgagaaaaaactgctccaccacttgagtgacctggctctcaccctccctactgacgctgtgtccatctgtcttgccataagcactcctgatgcaccagcgactcaggacggcgtggaaagtttgctgcagaagttcgccgctcaggagctgattgaacacagaaaccaacaaaggtctcagccacgcaaccagggcaacatgttaccccagatgcttatctggcgttag

SEQ ID NO: 195003 - DNA, 879 bp, Artificial Sequence
  Description of Artificial Sequence: Synthetic coding sequence
atgctgggcgcctgggccgtggagggcaccgccgtggccctgctgaggttgcttctcctgttgttgccccctgcaattcgcgggcccggcctgggcgtggccggcgtggctggagcagccggcgccgggctgcctgagtctgttatttgggccgttaacgcggggggagaagcccacgttgatgtgcacggcattcattttcggaaggatcctctcgaaggaagagtgggaagggcaagcgactacggtatgaaactgccgatcctgcgctctaatcctgaagatcagattctgtaccagacggaacggtacaacgaggagacattcggctacgaggtacccattaaggaggagggtgactacgttttagtacttaaatttgcggaggtctatttcgcccagagccaacaaaaagtcttcgacgttagattaaacgggcatgtagtggtgaaggatctggacatattcgatagagtggggcattctactgcacacgatgagattattcctatgagtataaggaaagggaaactgtcagttcagggagaggtctctactttcacaggtaagctctatattgagttcgtaaaagggtactacgataatcccaaggtgtgtgccctctatatcatggccggcactgtagacgacgttcccaagttgcagccgcacccaggactggagaagaaggaagaagaggaagaggaggaagaatacgacgagggcagtaatttgaaaaagcaaaccaacaagaatcgcgtgcagtccggacccaggacccccaacccctacgcatcggataactcttccttaatgttccccattctcgtggcatttggcgtcttcatacccacactgttctgcctatgtagactctag

SEQ ID NO: 195004 - DNA, 1035 bp, Artificial Sequence
  Description of Artificial Sequence: Synthetic coding sequence
atgctgagcgaggtgctgctggtgagcgcccccggcaaggtgatcctccatggggagcacgccgtagttcatgggaaagtagccctggctgtctccctgaacctccgtacctttttaaggctccagccacactccaacggaaaggtagacttgagccttccaaatattggtattaagcgggcctgggatgtggctcggttgcagtcactggacacttcttttctcgagcagggtgatgtgacgacccccacttcagagcaagtcgaaaagctgaaagaggtggccggtctgccggacgattgtgccgtgactgagaggctcgcagttctcgccttcctgtacctatacttgagtatctgccggaagcagcgctggacgaaagaggatctggagcttataaataaatgggctttccaaggggaacgtatgattcatggtaatcctagtggcgtggataatgccgtgagcacttggggtggggctctcagatatcaccaaggaaaaattagttcattgaagagaagccctgcactccagattttgctgactaacacaaaagtgcccagaaacacaagggcccttgtggctggtgtccggaaccgcttactgaaattcccagagattgtggcaccactgctgaccagcattgacgctatctcgctggagtgcgagcgggtgctaggagagatgggtgaagccccagcgcccgagcagtatttagttctggaggaactgatcgatatgaatcagcaccatctgaacgcactgggtgtgggacatgcttctctcgatcagttatgtcaagtaaccagagccagaggtctgcattccaagttgacgggtgccggtggcggcgggtgcggaatcactttacttaaacccggacttgagcagccagaagtggaagcaaccaagcaagcactgacctcatgtgggttcgactgcctggagacgagcatcggcgcgccaggagtctcaatccactcagccaccagcttggacagccgggtccagcaggccttggatggtctgtag

SEQ ID NO: 195005 - DNA, 516 bp, Artificial Sequence
  Description of Artificial Sequence: Synthetic coding sequence
atgctgagcgaggtgctgctggtgagcgcccccggcaaggtgatcttgcatggagagcacgctgtcgttcatggcaaagtggcgttggccgtgagcctgaacctgagaactttcttgcggttgcagccccatagcaacggaaaagtggatttgagcctcccaaatattgggataaagcgcgcttgggatgtcgcccggctccagtctctagacacttcattcctggaacagggtgatgtaacaacacctacgtctgagcaagtagaaaagttaaaggaggtagctggactgccagacgattgcgcagtaacagagcgactggctgtgcttgctttcctgtacctctatctatctatctgcagaaagcagagggccctacccagcctggacatcgttgtgtggtccgaactgcctcctggggctgggctgggatctagtgccgcttactctgtgtgcctagccgccgccctgctgacagtttgtgaggaaattcccaatcctttgaaggacggttag

SEQ ID NO: 195006 - DNA, 1035 bp, Artificial Sequence
  Description of Artificial Sequence: Synthetic coding sequence
atgctgagcgaggtgctgctggtgagcgcccccggcaaggtgatcctgcatggagagcacgctgtggtgcacggcaaggtagccctagccgtaagcctcaaccttcgcactttcctgcgtctgcagccccattccaatggaaaggtggacctgtctctgccgaacataggaataaaaagagcctgggatgttgctaggctacagagtctcgacacatcatttctcgagcaaggtgatgttaccacacccacatcggagcaggtggagaagcttaaagaagtagccgggcttccagacgactgtgctgtgacggagcgcttagctgttctggccttcctgtacctctatttatcaatctgcaggaagcagcgctggacaaaagaagatctggaactcatcaacaagtgggcctttcagggagagcgcatgattcacgggaacccatcaggtgttgataatgccgtgagcacctggggcggagctctgaggtaccatcagggtaaaatctccagtctgaaacgcagtcccgccctccagatcctcctgaccaacactaaagtgccacgaaacactcgggctctcgttgcgggcgtacggaatcgactgttgaagttcccggaaattgtggctcctctcttgacctcaattgacgcaatttcgctagagtgcgaacgggtgctcggagagatgggtgaggcccccgcgcctgaacagtaccttgttctggaggagctgatagatatgaatcaacaccatctcaatgccttaggcgtcgggcacgcctcactggaccagctctgccaggtgaccagggctaggggactccactccaaactcactggcgccggcggcggtggatgtgggattacactccttaagccaggtctggagcagcccgaagtcgaggccactaagcaggcactaacatcctgcggctttgattgcctcgagacttcaattggggctcctggcgttagtattcactccgctacatccctcgacagcagagtgcagcaggctcttgatggtttatag

SEQ ID NO: 195007 - DNA, 609 bp, Artificial Sequence
  Description of Artificial Sequence: Synthetic coding sequence
atgatccacggcaaccccagcggcgtggacaacgccgtgagcacctgggggggggctctcaggtaccatcaaggcaagataagctctcttaagcgaagccctgcgctgcagatcttgctgacaaacactaaagtgcccaggaacactcgtgccctggtggcgggtgtcagaaatagacttttgaagttccctgaaattgtggctcctcttctgacaagtatcgacgccatatccctggaatgcgagcgagtccttggggaaatgggagaggcacctgcccctgaacagtacctagtgctcgaggagttgatagacatgaaccagcatcacctgaatgcgctcggggtaggtcatgcatcgttggaccagctgtgccaggtcacaagagcccgaggcctacactccaagctgaccggagccggtggcggaggctgcggcataacccttcttaagcctggcctggagcagcccgaggtcgaagcgacgaaacaggccctgacctcttgcggcttcgattgtctggagacatccattggagctccaggggtgagcatccattccgccaccagcctggacagccgcgtgcagcaggcacttgatggactttag

SEQ ID NO: 195008 - DNA, 606 bp, Artificial Sequence
  Description of Artificial Sequence: Synthetic coding sequence
atgctgagcgaggtgctgctggtgagcgcccccggcaaggtgatcctgcacggggagcatgcagtggtgcatgggaaggttgcccttgctgtctccctgaacctccggaccttcctccgcctccaaccgcacagcaacggcaaggtcgacttgtccctcccaaatattggtatcaagagagcatgggatgtggccagactgcagagtctggacacttcctttctagagcagggggacgtaaccacccccacatcggagcaggtcgagaaattgaaagaggttgccgggctgccagacgactgtgccgtcacggaacgactggctgtgctggcctttttgtatctctatctgagcatttgcaggaagcagcgggcactccctagcctagatatcgtggtctggtccgagcttcctcctggagccgggctaggctcaagcgccgcatatagtgtgtgcctggcagctgccctcctcacagtgtgtgaggagattccgaatcctctcaaggacggcgactgcgtaaacaggtggacaaaagaggatttggaactgattaacaagtgggcttttcagggggagcgtatgatccatggaaatccttcttag

SEQ ID NO: 195009 - DNA, 1563 bp, Artificial Sequence
  Description of Artificial Sequence: Synthetic coding sequence
atgcccagcctggtggtgagcggcatcatggagcggaacggcggctttggtgagctgggttgtttcggcggctccgccaaggacagaggtctgctggaggacgaaagggctctacagctcgcacttgaccagttgtgtctcctaggcctgggcgaacctccagcacccacagccggtgaggacggtggaggaggaggagggggtgcacctgcccagccggccgcaccccctcagcccgcaccacccccaccaccagcggccccacccgcagcacctacagctgcgccagccgcccagacgcctcagcctcctaccgccccaaaaggggccagcgacgctaagctgtgtgccctgtataaggaagctgagctacgcctgaaaggctcctcgaataccaccgaatgcgtcccagtcccaactagcgagcacgtcgctgagatcgtgggccggcagggttgcaaaataaaggcactgcgtgctaaaaccaatacctacattaagacgcccgtccgcggagaagaacctgtgtttatggtgaccggcaggcgagaggatgtggctacggcgagacgggagattatctcagccgcagagcacttctctatgatccgggcttcccgcaacaagtcaggagctgctttcggcgtggctccggccttaccaggtcaagtgaccatccgggtaagagtcccttaccgcgtggtgggccttgtagttggccctaaaggtgctactatcaaacgtattcagcagcagacaaatacctatatcatcaccccaagccgggacagggatcccgtcttcgaaatcacaggggcccctggaaacgtcgaacgggcccgggaagagattgaaacccacatagccgtaagaaccgggaagattctcgaatacaacaacgaaaatgattttttggccggatctcctgacgctgccattgattccagatattcagacgcctggcgagtacaccagcctggatgtaaacctctcagcacctttcgccagaacagcctcgggtgcattggggagtgcggcgtggattctggatttgaggcccccagactgggggagcagggtggtgattttgggtacgggggctacctctttccaggctacggtgttggcaaacaggatgtgtattatggcgtggccgagactagccccccactctgggccgggcaggagaatgctacccccacctctgtgctgtttagttctgccagcagctcctcttcgagttccgccaaagcccgagctgggccgccgggggcccatagatcacctgctaccagtgcaggaccagaacttgctggcctcccacggcgaccacccggcgagccgttgcagggattcagtaaactcggtgggggaggcttgcgaagccctggcggcggtagagattgcatggtgtgctttgagtcagaggtgaccgcagccctggtaccctgcggacataatctgttctgtatggaatgtgccgtccggatttgcgagaggaccgaccccgagtgccccgtctgtcacattacagccacccaggccattaggattttctcctag

SEQ ID NO: 195010 - DNA, 1710 bp, Artificial Sequence
  Description of Artificial Sequence: Synthetic coding sequence
atgcccagcagcctgttcgccgacctggagcggaacggcagcggcgggggtggaggagggtcctctggagggggtgaaacactggacgatcaacgagctctgcagttggccctggaccagttgtcactcctggggcttgattcggacgagggcgcaagtctgtatgactcggaacccaggaaaaaatctgtgaatatgactgaatgcgttcccgtgccatcttccgagcatgtggctgaaattgtcgggaggcagggatgcaaaatcaaagctctgcgggcaaaaacaaacacttacataaaaaccccagttcggggagaagagccagtgttcgtggtgaccgggcggaaggaggacgtggcaatggctcgcagagagattatctctgctgccgaacacttctccatgatacgcgcctcccggaataaaaacaccgcactgaatggggctgtcccaggccccccaaacctacctggccaaactacgatccaggtcagagttccctacagagtcgtgggacttgttgtcggccctaagggagctaccataaaaaggatccagcagcagacccacacctacatcgtcactcctagcagagacaaggagcctgttttcgaagtgaccggaatgcctgaaaacgtggatagggcaagagaagagatcgaggcccatattgctttgagaacagggggaatcattgaactcacagacgaaaacgatttccacgccaatgggactgacgtaggctttgatctacatcatgggagcgggggctctggcccgggcagcctctggtctaaacctacgccatccatcacccccactcctggacgtaagcccttttctagttataggaacgacagttcaagttctctcgggtccgccagcactgactcctatttcggtggaggcacgtcatccagtgccgcagccacgcagagacttgcggattactcacctcccagtccggcactttctttcgcccacaacggaaacaacaataataacgggaacggatatacgtatactgctggaggggaggccagcgttcctagcccagacggctgtccagaacttcagcccaccttcgacccagctccggccccccccccgggcgcacctttaatctgggcccagttcgaacgcagccctggcggtggcccggcagcacccgtgtctagttcctgttcgtcaagcgcatcgtccagcgcctccagcagtagcgtcgtcttccccggcggaggggcaagcgccccttccaacgccaatctgggcttgctcgtgcaccgccggctacatcccggaacatcctgtccccggctctccccaccactgcacatggctcccggggccggagagcaccacctcgcgcgaagagttaggagcgatcccgggggcggagggttggcctacgccgcctacgctaatggcttaggagctcaattgcctggattgcagccatctgacacctccggcagttccagctctagttcatcgagcagcagctctagttcatcaagctccggtctccgccggaagggctccagagactgctctgtgtgctttgaatctgaggtaatcgctgcattggttccttgcggtcacaatttattttgcatggagtgtgcaaataggatttgtgaaaaaagcgagcccgagtgcccagtctgccacaccgccgtgacccaggccattcggatcttttcctag

SEQ ID NO: 195011 - DNA, 1980 bp, Artificial Sequence
  Description of Artificial Sequence: Synthetic coding sequence
atgcccagcggcagcagcgccgccctggccctggccgccgcccccgcccccttaccgcagcctccacccccccctcctcctccacctcctcccttacctccaccatctggcggaccagaattggagggcgatggcctcctgttacgcgagcgcctcgccgctctggggctggacgacccatcacccgctgagcccggcgcccctgccttacgggccccagccgctgctgcccagggccaagcaaggcgggccgcagaactgtcaccagaggagcgagctccgccagggcggccaggtgctcccgaagccgctgagctcgaactggaggaagacgaggaagaaggggaggaggccgagttggacggcgacctgctcgaagaagaagaacttgaagaggctgaggaggaagacaggagctctttgctcttgttgtctcccccggccgcgactgcttcacagacccagcaaatccctggaggcagtcttggctccgtgttacttcccgctgcccggttcgatgctagggaagccgctgccgctgccgccgccgccggggtgctgtacgggggagacgacgcccagggaatgatggccgccatgctgtcacatgcttacggcccgggaggctgcggcgcagcagccgctgctctgaacggtgagcaggccgccttgctgcggcggaagagtgtaaatacaacagaatgtgtcccagtaccctccagcgaacatgtggctgagatcgtcggcagacagggctgtaaaattaaagcactgcgtgcgaaaaccaatacttatatcaagaccccagtgcgcggggaggaacccatttttgtagtgaccgggagaaaagaggatgtcgcgatggctaaacgcgagatcttgagtgccgccgaacacttctcgatgatccgggcttctcggaataagaatggacccgccctgggcgggctgtcctgtagtccaaacctgcctggacaaacaacagtgcaggtccgggtgccttatagagtagtcggcctggtggtcggaccaaagggcgcgacaatcaagagaattcaacaacagacccatacttatattgtaacacccagtagggataaagaacccgtgttcgaagttaccggaatgcctgaaaatgtggatagggcacgagaggaaattgagatgcatatcgccatgcgcacaggtaattatatagagctcaatgaggagaatgactttcactacaacggcaccgacgtgagctttgaaggtgggactttgggatcggcctggctcagtagtaaccccgtgccaccttctagggctcggatgatttctaattataggaacgactcttcatcgtccctcgggagtggtagcacggattcatatttcggtagcaatagactcgcagacttctctccgaccagccctttctccacaggcaatttctggttcggagacacccttccttctgttggctcggaagatctggctgtcgacagcccagcattcgactcgctaccaaccagcgctcagactatatggacccctttcgagcccgtcaatcctttgtcaggtttcgggtcagacccgagcgggaatatgaagactcaacgccggggctcacaaccgtcaacacccaggctttctcctacctttccagaatccatcgagcatcccttggctcggagagtacgcagtgaccctccatccactggaaaccatgtcgggttgccgatctacattccggctttctctaacggcactaattcctacagcagctctaacggcggctcgacatcatcttctccacctgagtccagacggaaacacgattgcgtgatatgttttgaaaacgaggtgatagccgcacttgtgccctgtggccataacttattttgcatggaatgtgctaataagatttgcgaaaagaggaccccaagctgcccagtgtgtcagacggccgtcacccaggcgatccaaattcacagctag

SEQ ID NO: 195012 - DNA, 498 bp, Artificial Sequence
  Description of Artificial Sequence: Synthetic coding sequence
tggcggtggaccagctgccggcggagcggctggggcgccctggccaccaggacgaggaggggccggccaggcacaccccctcccccaagaccctctccgcccgacgtatttgcaggttttgccccacacccagctgctctgggacctcctactttactggcagatcagatgtcggtgatagggtccaggaaaaagagtgtgaacatgacagaatgcgtcccagtaccctccagcgagcatgtggcagaaattgttggcaggcaggggtgtaagattaaggctcttagggccaaaacaaatacatacattaaaacgccggtgcggggggaggaacctgtctttatagttactgggaggaaggaggatgtcgagatggcaaaacgtgaaatcttaagtgctgctgagcacttcagtatcattcgtgctaccagatctaaagctggtggccttccaggggcagctcagggacctcccaatctgccaggccagacaacatag

SEQ ID NO: 195013 - DNA, 2001 bp, Artificial Sequence
  Description of Artificial Sequence: Synthetic coding sequence
atgcccagcagcctgggccagcccgacggcggcggcggcggcggcggcgggggtggaggagtaggggccgctggggaagatccagggcctggccccgctcccccgcctgagggcgcccaagaagctgctccagcgcctcgccccccacctgaacccgacgacgccgctgctgcactgagattagctctagaccagttgtccgctctgggcctgggcggagcaggggacacagacgaggaaggtgccgccggggatggcgccgcagcagctggcggcgcagatggcggagctgcccccgaaccagttccccccgatgggcctgaagcgggtgcccctcctactctggcccccgctgttgccccagggtctctgcccctgctggacccaaatgcgagtcctccccctcccccccctcccagaccctctcctccagatgtgtttgccggattcgccccccaccctgcggccctgggacccccaactctactggccgaccaaatgagcgtaattggctcacgaaaaaagtccgtgaacatgaccgaatgcgtgccggttccctcatcagagcatgttgccgagatcgtaggacggcagggctgtaaaattaaagccctgagggcaaaaacgaacacctatatcaaaacaccggtcagaggtgaagagcctgtcttcatcgtgaccggtcggaaagaagacgtggaaatggctaagagggaaatcctgagtgccgcggagcatttcagcattattagggctacccggtcaaaggcaggtgggttaccaggagcagcccaggggcccccaaatttgccaggccagacaaccatccaggtgcgggttccatatcgggtagtgggtctagtggtggggcctaaaggggctacaataaaacgtattcagcaacgtacccacacatacatcgtaacacctggcagagacaaagagccggtgtttgctgttacaggcatgccggagaatgttgacagggctagggaagagattgaggcccacataactctacggacaggcgccttcacagatgccgggcctgatagcgacttccatgctaacggaactgacgtgtgccttgatctgttaggtgcagccgcatccctctgggcaaagacaccgaaccagggccgccgaccgcccacggcaacagcaggactgagaggcgacactgccctgggtgccccttccgcccccgaagcgttctatgcaggtagccggggcggccccagcgtgcccgatcccgggcccgcatctccctacagtggatctgggaatggcggattcgcttttggcgctgaaggtcccggggcacccgtaggaacagctgccccagatgattgcgattttggattcgactttgacttcttagccctggatctcactgtgcctgctgctgctacaatttgggcacctttcgaaagggcagcacccctgccagccttttccgggtgctcgaccgtgaatggagcaccaggtcccccggctgctggagcccggagaagcagcggcgcaggtactcctcgccattcaccgacactgcctgagcctgggggactgcgccttgagctcccactttcaaggcgcggagccccagaccccgtgggagccctctcatggcggcccccgcagggtccagtgtccttccctggcggagccgccttttcaaccgctacgagcctgccatcatccccagccgccgcagcttgcgctccgctggattccggggcttcagaaaactctcgaaagcctcccagcgccagtagtgcccccgccctcgccagagagtgtgtggtctgcgccgagggtgaagttatggccgcactggtcccttgtggtcacaatctgttttgtatggattgtgccgtgcgaatttgcggaaaaagcgaacctgagtgcccagcatgccggaccccagctacccaagcgatccgtgtcgagacagagaccccccagcctggaggcgccagtgcattgcaacgccagtactag

SEQ ID NO: 195014 - DNA, 1956 bp, Artificial Sequence
  Description of Artificial Sequence: Synthetic coding sequence
atgcccagcagcctgggccagcccgacggcggcggcggcggcggcggcggaggaggcggtgtgggtgctgcgggggaggaccctggccctgggccagcgccgccaccggaaggcgcacaggaagccgctccagcgccacgtcctccacccgaaccagacgatgccgccgctgcactgcggttggcgctagatcagttgtccgcactagggctgggcggcgccggcgatacggacgaggagggtgccgctggtgatggcgcggctgctgccgggggagcagacgggggagccgccccggagccagtgcctcccgacgggcctgaagccggggccccccccacccttgcacctgcagttgcaccaggaagtctccctctgctggatcccaacgccagcccacctccacctccccccccccgcccttcccctcccgacgtgttcgcaggatttgcccctcacccagccgctttgggtcccccgacccttctggccgaccaaatgagcgtgattggctcgcgaaaaaagtccgtgaatatgaccgagtgtgttcccgtgcctagttccgagcacgttgccgagattgtgggcaggcaaggttgcaagatcaaagcccttcgggccaagaccaacacctatatcaaaacccccgtgagaggtgaggagccggtgttcattgtgaccggacggaaagaggatgtagaaatggcaaaaagagaaatcttgtccgcggcagaacacttctccatcatacgggctacgcgtagtaaggccggtggccttccaggcgctgctcaggggcctccaaacctgcccggtcagacaactattcaagtgcgcgtgccctacagagttgttggattggtggtcggaccgaaaggagcaacgattaagcggatccagcagcggacacacacatacattgtgacaccagggcgtgacaaggagccggtcttcgccgttaccggtatgccagagaatgtggacagggccagagaagaaatcgaggcccacatcacattacgcaccggtgctttcacagacgctgggcccgattcggattttcatgccaatggtactgatgtgtgcctcgacttgctcggtgccgccgcgtctctctgggcaaaaactcctaatcagggcaggcgtccaccaactgcaaccgctggtctgcggggtgatacagcattgggcgccccttccgccccggaggcgttttacgcaggttccaggggaggcccgtctgtaccggatcccggcccagccagcccctactcaggatcaggaaacggtggctttgccttcggcgccgagggtcccggagctcctgtcggcaccgcagcccccgacgattgtgactttggcttcgattttgactttctggctctggacctgaccgtacccgctgctgctaccatttgggcaccttttgagagggccgctccgcttccagctttctcgggctgcagcacagttaatggtgcccctggaccccccgccgcgggggctcggcgttcaagcggcgccggcactcctcggcattcacccaccctgccggaacccggtgggttaaggctggaacttcctctgtcacgaagaggtgctccagatccagtgggagccctctcatggagacccccccagggacccgtttctttccctggcggcgccgcattctccaccgccacctcactgccgtcttctcccgcagcagcagcctgtgctcccctcgactccggagcatccgagaattctcgaaagcctccaagtgccagctcagccccagccttggcccgtgaatgcgtagtgtgcgcagaaggagaggtgatggccgcactggtgccctgtggccataacctgttttgcatggattgcgccgttcgaatttgtggcaaaagcgaaccagagtgcccagcttgcaggacccccgccacccaggcgattcacattttctcctag

SEQ ID NO: 195015 - DNA, 966 bp, Artificial Sequence
  Description of Artificial Sequence: Synthetic coding sequence
atgcagtgccggctgccccggggcctggccggcgccctgctgacccttctgtgcatgggtctcttatgtctgcggtatcacctcaatcttagcccgcaaagagtgcaaggcacaccggaactgtctcagcctaatccgggccctccgaagctccagctccacgatgtgttcatcgccgtgaaaaccacccgggccttccaccgactgcggttggaactgctcctggacacctgggtctctaggactagagagcagacattcgtcttcacagactcaccagataaaggacttcaggagaggctgggctctcatctggtggttactaactgtagtgctgagcacagtcaccccgccctgagctgcaaaatggcagcggaatttgataccttcctcgcttccggtctgcgctggttttgtcatgttgacgatgacaattacgtaaatcccagagccctgctgcaacttttgcgcgcctttccactagcgagggacgtttatgttggccgcccgtcattgaacagacccattcacgccagcgaacctcaacctcacaaccgcactcgacttgtgcaattttggttcgcgacgggaggagctggattctgtatcaatagaaagctggctctcaagatggcgccctgggccagtggttccagatttatggatacgagtgccctgatccgtctgccagacgattgtactatgggctatattatcgagtgcaaactgggggggaggttgcagcctagcccgctttttcatagccatctcgagaccttgcaattgttgcgcaccgctcagctgcccgaacaagttacactgagctacggtgtgttcgagggcaaactaaacgtgatcaagcttcaggggccgttttcccccgaggaggacccaagtcggtttcggagcctccactgtctgctgtatcccgataccccctggtgcccccagttgggtgctagatag

SEQ ID NO: 195016 - DNA, 924 bp, Artificial Sequence
  Description of Artificial Sequence: Synthetic coding sequence
atgcagtgccggctgccccggggcctggccggcgccctgctgaccctgctatgcatggggctcctttgtctacgctaccacctcaacctcagcccacagagggtccagggaaccccggagctgtcccagccaaatccaggccctccaaagctccagctccatgacgtgttcatagccgtgaagaccacgcgggcgtttcatagattgagacttgagctcttactggatacatgggtctcacgaacccgcgagcaggtcacccgctcccacctggttgtgactaactgctccgcggagcatagccaccctgcactgagctgtaaaatggccgccgagttcgatactttcctcgcctccggattacgctggttctgtcatgtggatgacgacaattatgttaatccccgagccctgttacagttgctcagggccttcccactggccagagatgtctatgtcggtcgccctagcctgaaccggcctatacatgcttcggagcctcaacctcacaatcggactagattggtacaattttggtttgccactggcggcgcaggattttgtatcaaccgcaagctcgccctcaaaatggctccttgggctagcggctctcgatttatggacacatccgccttgattcgcctgcccgatgactgcaccatgggctacatcattgaatgtaaactcggcggcaggttgcagccgagtcccctgtttcatagtcaccttgagaccttgcagttgctgcgcaccgcgcagctcccagaacaagtaaccctgagttatggtgttttcgagggaaagttgaatgttattaaactacagggtcctttcagtcctgaggaggatccctccaggtttcgaagcctccactgcctcttatacccagacacgccgtggtgcccacaactgggcgccaggtag

SEQ ID NO: 195017 - DNA, 357 bp, Artificial Sequence
  Description of Artificial Sequence: Synthetic coding sequence
atgcagtgccggctgccccggggcctggccggcgccctgctgaccctactgtgtatgggtctcctgtgcttgcggtatcatctaaatctttctccccagcgggtacaaggcactcccgagctttcccagcccaacccaggccctcccaaattacagcttcacgatgtctttattgccgtgaagactactagggcatttcatcgactgaggctggagttattactggacacatgggtgagccggactcgcgagcagacttttgtctttactgactctccggacaaggggctccaggaacggttaggaagccccgacagttcttctctcctgcagggccctaccttatggagtccttag

SEQ ID NO: 195018 - DNA, 399 bp, Artificial Sequence
  Description of Artificial Sequence: Synthetic coding sequence
atggccgccgagttcgacaccttcctggccagcggcctgcggtggttttgtcatgtggacgacgataattacgttaaccctcgcgccctgctgcagcttctccgggccttcccgttagctagggacgtctatgtgggtaggccgtccctcaatcgccctatccacgctagcgaaccccagccccacaataggacgaggctggtccagttctggttcgctacaggtggagccgggttctgtatcaaccgaaagctagcgctgaagatggccccttgggcctccggctcacggttcatggatacttctgcactaattcgcttacctgacgactgcactatgggctatattatagagtgcaagctcggtggacgcctgcaaccatctcccctcttccactag

SEQ ID NO: 195019 - DNA, 132 bp, Artificial Sequence
  Description of Artificial Sequence: Synthetic coding sequence
atggccgccgagttcgacaccttcctggccagcggcctgcggtggttttgtcacgtggacgatgataactatgtgaacccccgcgcactgctgcagctcctccgagcattccccctagctagagatgtctag

SEQ ID NO: 195020 - DNA, 264 bp, Artificial Sequence
  Description of Artificial Sequence: Synthetic coding sequence
tgaagccacctggagaccctgcagctgctgcggaccgcccagctgcctgagcagattagtctccctcctctctccgccctgtcgagatatactcttgtgtcaccggctggttgccccatgaacccagagctgctcggaaaggggtgggctgaaacgtccggttgcgctctggcaccgaaggtggccctgtgggttccagggaaatgcctcgttatcggctctccttggcagggactaagagtggttggcaaaccaagaatctag

SEQ ID NO: 195021 - DNA, 999 bp, Artificial Sequence
  Description of Artificial Sequence: Synthetic coding sequence
atgggcctgggccccgtgttcctgctgctggccggcatcttcccctttgcaccaccaggcgcagctgctgagccccacagtctacggtacaatctgacagtgctcagctgggatgggagcgtgcagtctggtttcctcgcagaggtccatttggatggacaaccattcctgcggtacgaccgtcagaagtgtcgagctaaaccacaaggccaatgggccgaagacgtgctggggaacaaaacctgggaccgggagacccgggatttaacggggaacggcaaggaccttagaatgacgctggcccatatcaaagaccagaaggaggggctgcactctcttcaagaaatccgcgtatgcgagatccacgaggacaactcaactcggtcatcacaacacttctactacgatggagagcttttcctgagccagaatctggagacggaagaatggaccgtgccccagtcaagcagagcccagactcttgccatgaatgtccgcaatttcttgaaagaagacgccatgaagaccaaaacccattaccacgcaatgcacgctgattgcctgcaagaacttcgacgatacctcgagagtggagtcgtgttgcggagaaccgtcccaccaatggtcaacgtgacacggagtgaggcatcagaggggaacattacagtgacttgccgggctagttctttctaccctcgcaacataattctgacctggagacaggacggcgtgagtctcagccacgatacacagcagtggggcgacgttctacccgacggaaatggcacctatcagacatgggtggcaacaaggatttgcagaggtgaagagcagagatttacttgctacatggaacactccgggaatcacagtacacaccctgtgccctcagggaaggtgctggtcctacagtctcattggcaaaccttccatgtgtccgcggttgcagcagggtgctgttacttctgttactactacttcctgtgccctctgttgtag

SEQ ID NO: 195022 - DNA, 585 bp, Artificial Sequence
  Description of Artificial Sequence: Synthetic coding sequence
atgggccagcgggaccagggcctggaccgggagcggaagggcccccaagacgaccccggctcttatcagggacccgagagaaggaattttctgaaggaggatgctatgaagaccaaaacacactatcatgccatgcacgctgactgtttacaggagctccgccgatatcttgaaagcggagtggtccttagaaggactgttccccccatggtgaacgtgacccgcagcgaggcaagcgaaggaaatatcaccgtgacatgcagagcatcgagcttctacccgcgaaacataatacttacgtggcggcaggatggagtgtcactgtcacacgatacccaacagtggggcgacgttctgcctgacgggaacggtacatatcagacatgggttgcaacaagaatttgcagaggggaggaacaaaggttcacctgttatatggaacatagcggaaaccacagtacccaccccgtgccctcaggcaaggtgctcgtcctgcagtcccactggcagacattccatgtttccgcggtcgcagcagggtgttgttatttctgttattactacttcctatgtccgttactttag

SEQ ID NO: 195023 - DNA, 870 bp, Artificial Sequence
  Description of Artificial Sequence: Synthetic coding sequence
atgggcctgggccccgtgttcctgctgctggccggcatcttccccttcgccccccccggcgccgccgcagagccccatagtcttagatataatttaactgtcttgagttgggacggaagcgtgcaatctggatttctcgctgaagtccacctggatggtcaaccatttctaaggtatgaccgacagaagtgtagagcaaagccacagggccagtgggcagaggacgtgctggggaacaagacttgggatagagaaactcgagatctcacaggcaatgggaaggatctgcgcatgaccttggctcatatcaaggaccagaaagaggtaccacagtcctcgagagcccagacgcttgcaatgaatgtaaggaattttttaaaggaagatgccatgaagactaaaacccactaccacgctatgcacgctgactgcctgcaggaactcagacggtacctggaaagtggcgtggtgctgagacgcaccgtcccacccatggtgaatgtgacacgctctgaagcttctgaaggaaatattacggtgacctgccgtgcctcgtccttctaccctcgcaacatcatcctcacttggcggcaggacggagtctccctctcgcatgatactcagcagtggggagatgttctgcctgacggaaacgggacatatcagacatgggtagccaccaggatctgtcgcggggaggagcagaggtttacatgttacatggagcatagtggaaaccactccactcatccggtcccgtctggtaaggttctggttctgcagtcccattggcagacattccatgttagtgcagtggctgcggggtgctgttatttctgctactattactttctttgtccactcctttag

SEQ ID NO: 195024 - DNA, 738 bp, Artificial Sequence
  Description of Artificial Sequence: Synthetic coding sequence
atgggccagcgggaccagcggctggaccgggagcggaagggcccccaagatgatcccggcagctaccagggaccagaaaggagaaacttcctgaaggaagatgctatgaagaccaaaacccattatcatgctatgcatgccgattgcctgcaggaattaagaagatacctcaaatccggcgtggtgttaaggagaaccgttcctccaatggtgaacgtgacacgctctgaggcctctgaaggcaacatcaccgtaacatgtcgggccagcggtttctatccatggaacatcactctttcctggcggcaagacggagtgagccttagccatgacactcagcaatggggcgatgtattgcctgacggtaacggaacgtatcagacctgggtggcgacgagaatttgccaaggagaggagcagagattcacttgctacatggaacactctggcaatcacagcacccaccccgtgccctcaggcaaggtgctcgtccttcaatctcactggcagacgtttcacgtatcagccgttgcggcagctgctatcttcgtgatcatcattttctatgtcagatgttgtaagaagaaaacaagcgccgccgaaggcccagaactggtgagtctccaagtgctggatcagcatccagtgggcacgagtgaccaccgtgatgccacgcagctcggctttcagcccctgatgagtgacttgggaagtacaggctccactgaaggggcctag

SEQ ID NO: 195025 - DNA, 1152 bp, Artificial Sequence
  Description of Artificial Sequence: Synthetic coding sequence
atgggcctgggccccgtgttcctgctgctggccggcatcttccccttcgctccacctggtgccgctgccgagccccattcccttcgttacaatctgaccgtgctgagttgggatggctccgtgcagtctgggttcctgacggaagttcacctggacggtcagccatttctgcgatgcgacaggcagaaatgtcgagcgaagccacagggccagtgggctgaggacgtcctgggcaacaaaacctgggaccgtgagacaagggatctgacagggaacggcaaggacctgagaatgacattggcacacatcaaagatcaaaaggagggcttgcacagtttgcaagagatacgtgtgtgcgaaatacatgaggataactccacccgcagctcccagcacttctactacgatggcgagctgtttttgagtcagaatcttgagaccaaggagtggaccatgcctcaatcatctagggcccagacactagctatgaatgtgagaaactttctgaaagaagacgctatgaaaactaaaacacattaccacgctatgcacgcggattgcttacaagagctccggcggtatctgaaatcgggcgtggtgctccggcggaccgtccccccaatggtcaatgttactaggagtgaggcctccgagggtaacataactgtgacttgtcgggcctccggcttctacccttggaatataaccctgtcctggcgccaggacggggttagcctcagccacgatacccagcaatggggggacgtgcttccagacgggaatggtacctatcagacatgggtggcaacccggatttgccaaggagaggagcaaagatttacttgctacatggagcactcaggcaatcactccacccaccccgtgcctagtgggaaggtgctggtgctgcagagccactggcagaccttccatgtgtcagcggtggcagcggcagcaatcttcgttatcattatcttttacgtgagatgttgtaagaaaaaaacttccgccgcagaaggaccagaacttgtgagtctgcaggtcttggatcagcaccctgtcggaacctccgaccatcgggatgccactcagctaggattccaacccctgatgtctgatctgggaagcacaggctccacagagggcgcatag

SEQ ID NO: 195026 - DNA, 870 bp, Artificial Sequence
  Description of Artificial Sequence: Synthetic coding sequence
atgggcctgggccccgtgttcctgctgctggccggcatcttcccctttgctcctcccggcgctgccgcggagccacacagtcttaggtacaatctgacagtcctgtcttgggatggctcagtacagtccggctttctggccgaagtgcatctagatggccaacccttcctgagatatgaccggcagaagtgtcgcgccaagcctcagggccagtgggcagaggatgtgctcggcaacaaaacctgggatagggaaacccgggacctgactggaaacggaaaagatctgagaatgaccttggcgcacatcaaagatcagaaggaagttccacaatcttcccgggcacagacactggccatgaatgtcagaaactttcttaaagaagatgccatgaagactaagacccattatcacgctatgcacgctgattgtctgcaagagctgcgccggtacctggagagcggtgtggtgctgagaaggactgtgccaccaatggtaaatgtgaccagatctgaggcctcggagggaaatattactgtcacatgcagagcctcgagcttttacccgcgcaatatcattctcacatggcggcaggacggcgtgagcctgtctcacgatacacagcagtggggcgatgtgctccccgatggaaatgggacctaccaaacgtgggttgcgactcggatttgcagaggagaggagcagaggtttacctgctacatggaacatagcggcaatcactccactcatccagtgccaagtggcaaggtcctcgtcctgcaaagtcactggcagacttttcacgtgtcggcggtggccgccggatgttgctatttttgctactattatttcctgtgtcctcttctgtag

SEQ ID NO: 195027 - DNA, 999 bp, Artificial Sequence
  Description of Artificial Sequence: Synthetic coding sequence
atgggcctgggccccgtgttcctgctgctggccggcatcttccccttcgcgccaccaggggctgccgccgaaccccactccttgaggtacaatctgaccgtgctcagctgggacggtagcgtacaaagcggcttcctggctgaggtgcatttggacggccagcctttcctcagatatgaccgccagaagtgccgggccaagccacagggccagtgggccgaggacgtgctggggaataagacatgggatcgagagactcgggacctgacaggtaatgggaaggacttgagaatgacactggcccacattaaagaccagaaggaaggcctacatagccttcaggaaatccgggtctgcgaaattcacgaggacaatagcacccgcagttcccagcatttctattatgacggcgagctctttttgtcacaaaacttggagactgaggagtggactgtgcctcaatcctccagagcacaaaccttggctatgaacgttcggaactttctcaaggaggatgcgatgaaaaccaaaacacattatcacgccatgcacgccgattgtctacaggaactcaggagatacctggagtctggcgtagtcctgagacggaccgtgccacctatggttaatgtcacccgatcagaagcatccgaggggaatattaccgtcacatgccgggcatcatcgttttatcccagaaatattatcctgacatggcgccaggatggtgtgagcctgtctcacgacacacaacagtggggcgatgtcttgcccgatggtaacggaacataccagacatgggtagctactcggatctgtaggggggaagaacaacggttcacatgttacatggagcattctggtaaccattctacacaccctgttccatctggcaaagttctggtgttgcagagccactggcagactttccacgtatccgccgtagcagcaggttgttgttacttctgttattattacttcttgtgccctctgttgtag

SEQ ID NO: 195028 - DNA, 585 bp, Artificial Sequence
  Description of Artificial Sequence: Synthetic coding sequence
atgggccagcgggaccagggcctggaccgggagcggaagggcccccaagacgaccctgggtcgtaccaggggcccgagagacgcaacttcttaaaggaagatgccatgaaaaccaaaacacattatcatgcaatgcacgctgactgtctgcaggagctcagaaggtacctagagtccggtgtggtgctgcggagaaccgtccccccgatggtcaacgtcacaagaagtgaagctagtgagggaaacattactgtgacatgcagggccagttcattttaccctcgaaatataatactaacctggaggcaggatggggtgtctcttagtcacgatactcagcaatggggggacgtcctgcctgacggtaacggaacataccagacttgggtcgccaccaggatttgcaggggagaggagcagcgattcacctgctatatggagcattccgggaatcatagcacccacccagtcccatctggaaaggtgttggtgttgcaatcgcactggcagaccttccatgtaagcgccgttgccgccggatgctgctatttctgttattattacttcctgtgcccactgctatag

SEQ ID NO: 195029 - DNA, 831 bp, Artificial Sequence
  Description of Artificial Sequence: Synthetic coding sequence
ttccccttcgccccccccggcgccgccgccgagccccacagcctgaggtacaacttgacagtgttatcatgggacggcagcgtgcagagcggcttcctagccgaggtgcacttggacggtcagccattcctccgatacgaccgccagaaatgccgggcgaagccacaggggcagtgggctgaagacgtcctgggtaacaagacttgggaccgggagacaagggacctaactggtaacgggaaggaccttcgcatgacactggcacacatcaaagatcagaaagaggtaccccctatggtgaacgtgaccagatccgaagcctccgaaggaaacatcacagtaacttgccgcgcgtcctccttctaccctcgtaacatcactttaacttggagacaagatggggtttcactcagtcacgatacccagcagtggggggacgtgttgccagacggtaatggtacataccagacatgggtagctaccaggatctgccagggagaggagcaaagatttacctgttacatggagcactcgggcaatcacagtactcacccggttccatcaggaaaggttctggtccttcagtctcattggcagacctttcacgtgtccgccgttgcggccgcagcagctgccatctttgtgattatcatattctatgtgagatgctgcaaaaagaagacaagtgccgctgaaggccccgaattagtcagtcttcaagtcctcgatcagcatcccgtcggcacctccgaccaccgggacgccacccaactaggatttcagcccctcatgagtgccctgggaagtaccggttcaactgaaggtgcttag

SEQ ID NO: 195030 - DNA, 1158 bp, Artificial Sequence
  Description of Artificial Sequence: Synthetic coding sequence
atgggcctgggccccgtgttcctgctgctggccggcatcttcccctttgctcctcccggtgcggcagccgagccgcatagtctgcgctataatctaaccgtgctgtcctgggacgggtctgtgcagagcggtttcctggcagaagttcaccttgacggtcaaccctttttacgatatgaccgacagaaatgtcgggccaaaccccagggccagtgggccgaggatgtcctaggtaacaaaacctgggaccgggagacccgggatctgactggaaatggaaaagatcttaggatgactttggcacatattaaggatcagaaagagggtctgcactctctgcaagaaattagagtttgtgaaatccatgaggacaactcaactagaagcagccagcacttctactacgacggggagttatttctatcacagaacgtggaaaccgaggaatggaccgtcccacagtccagcagggcacagacactggctatgaatgtgcgaaattttctgaaggaagacgctatgaaaacaaaaacccactaccatgcgatgcatgcggattgccttcaagaactgagacggtacttggagagctccgtggtgctgagacgccgcgtgcctcccatggtgaatgtcacacgatcagaagcctccgagggcaatatcactgtcacatgcagggcctcaagtttttatccacgcaatattacgctgacatggcggcaagacggcgtgagcctgtcccacgacactcagcagtggggagacgtgttacctgacggcaatggtacttatcagacttgggttgcgaccagaatttgccagggggaagagcagcgatttacctgttacatggagcatagtggcaatcattcaacccaccctgtgccttctggcaaggtgttggtgctccaatcgcattggcagacatttcacgtgagcgctgtagctgctgcggcagctgctattttcgtgattataatattttacgtcaggtgctgcaagaagaagacatctgcagccgaaggacccgagctggttagtctgcaggttttggaccagcatccggtgggaactagcgaccaccgagacgccactcagcttggctttcaacctttgatgtcagccctcggatccacagggtcgaccgagggcgcatag

SEQ ID NO: 195031 - DNA, 744 bp, Artificial Sequence
  Description of Artificial Sequence: Synthetic coding sequence
atgggccagcgggaccagggcctggaccgggagcggaagggcccccaggacgatcctggcagttatcagggacctgagcgcaggaatttcctcaaggaagatgccatgaaaaccaagacgcattaccacgcgatgcacgctgactgtctccaggagctgcgcagatatcttgagagctctgtcgttctacgccggagagtcccaccaatggtgaatgtcactcggagcgaagccagcgaaggcaatattacagtgacgtgccgcgcctcaagtttctacccacgcaatatcacgttgacttggagacaggacggtgttagcctgtctcatgatacacagcagtggggcgacgtccttccagacggcaatggaacatatcaaacctgggttgcaaccaggatatgtcagggcgaagagcagcggttcacctgttatatggagcactcaggcaaccactccacccatccggtccctagtggcaaagtcttggtgctgcagagccactggcaaacgttccatgtcagtgccgtggcggccgctgccgcagctattttcgttatcattatattctacgtgagatgttgcaagaaaaagacctccgccgctgagggccccgagctcgtaagcctccaggttctcgatcagcatcctgttggcacatctgatcaccgggacgcaacccaactgggattccagcctctgatgtcggcactgggctccacaggatcaacagagggtgcctag

SEQ ID NO: 195032 - DNA, 672 bp, Artificial Sequence
  Description of Artificial Sequence: Synthetic coding sequence
ttccccttcgccccccccggcgccgccgccgagccccacagcctgcggtataacttaacagtcctgagctgggatgggtctgtccagtccggcttcttagccgaagtgcatctggacgggcagccattcctccgttacgatcgccagaagtgccgggcaaaaccccagggtcagtgggccgaggatgtcctgggaaacaaaacctgggaccgagaaactagggacctgactggcaatggtaaagacctgaggatgactcttgcgcacatcaaggatcaaaaggaagtcccgcccatggtaaacgtcactagaagcgaggcaagtgaaggaaacatcacagtgacatgtagagcaagttcattttacccacgcaacatcatcctgacctggcgacaggacggtgtgtcactatctcacgatacccagcagtggggggacgtcttgcctgatggcaatggcacttatcagacttgggttgcaacccgaatttgcagaggcgaggagcaacgtttcacttgctacatggagcattcgggcaatcacagtacgcacccagtccctagcggcaaagtgttggtgctccagagccattggcagacattccacgttagtgccgttgccgccggatgttgttacttctgttactactactttctgtgccccttgctgtag

SEQ ID NO: 195033 - DNA, 672 bp, Artificial Sequence
  Description of Artificial Sequence: Synthetic coding sequence
ttccccttcgccccccccggcgccgccgccgagccccacagcctgcgttacaatctgaccgttttaagttgggatggatcagtgcaatcaggtttccttgccgaggtgcacttggatggacagccgtttttacgatacgatagacagaagtgtcgcgctaaaccccaggggcagtgggcggaggacgtgttgggtaataaaacctgggatcgcgagacgagggatttaacgggcaatggtaaagatctgaggatgacattggcgcacattaaagatcagaaggaggtgccaccaatggtgaacgttactcgcagtgaggcctccgagggcaatattactgtgacatgtcgcgcgagtagcttttaccctcgaaatatcatcctgacctggagacaggatggcgtgtctctatcccacgatactcagcagtggggggatgtcctccctgatgggaacggcacatatcagacttgggtagctacaaggatttgtcgaggagaggaacaacgcttcacttgctatatggaacacagtggtaaccactccacccatccagtaccctcaggtaaagtgctggtgttacaatctcactggcagaccttccatgtcagtgccgtcgccgcaggttgctgctacttctgctattactactttttatgccccctgctttag

SEQ ID NO: 195034 - DNA, 672 bp, Artificial Sequence
  Description of Artificial Sequence: Synthetic coding sequence
ttccccttcgccccccccggcgccgccgccgagccccacagcctgaggtacaatctgaccgttctatcttgggacggctccgtacagtctggcttcctcgcagaagtccacctggacgggcagcccttcctgagatacgacaggcaaaaatgccgcgccaagcctcagggccagtgggctgaggacgtgcttggtaacaagacatgggacagagagactagagatcttactggcaatggtaaagatctgcggatgacactggcacatattaaggaccagaaagaggtcccccccatggtaaacgtcacaagatccgaggctagtgagggaaacattacagtgacctgccgagcctcttcattctacccaagaaacatcattttaacatggcggcaagacggggtgagcctgtcgcatgatacgcaacaatggggggatgtgctcccagatggaaacggcacttaccaaacttgggtggctacgagaatttgtcgtggagaggaacagcgttttacttgttacatggaacacagcgggaaccactccacacatcctgtcccctcaggcaaggtactcgtgctgcagagtcattggcagactttccacgtcagcgccgtggccgcaggatgctgttatttttgctattattatttcttgtgccccctcttatag

SEQ ID NO: 195035 - DNA, 999 bp, Artificial Sequence
  Description of Artificial Sequence: Synthetic coding sequence
atgggcctgggccccgtgttcctgctgctggccggcatcttccccttcgcacctccgggggccgcggctgagccgcactcgttgcgctacaatttaacagtgctatcctgggacgggagtgtccagtcaggttttcttgctgaggtgcacctggacggccagccttttcttagatatgatagacaaaagtgcagagctaagcctcaaggccaatgggctgaggatgtgctgggaaacaagacttgggaccgggaaacacgagacctaacgggaaacggaaaggatctgcgcatgacactcgcacatataaaggatcagaaagaaggcctacactcactccaggaaatccgggtttgtgagatccacgaggataactccactcgcagctcacagcacttttactatgacggcgaactgtttctctcacagaatctggaaacagaggaatggaccgtgcctcaaagttcaagagcgcaaaccctggcgatgaatgtgagaaatttcctcaaagaagacgctatgaagacgaagacccactatcatgccatgcacgccgactgccttcaggagctgcgccgatacctggaatcaggcgttgtcctgcgcagaaccgttcccccgatggtcaatgtgactcggagcgaggccagcgagggcaatatcactgtgacttgccgcgcttccagcttctatccccgtaacataattctgacatggcgtcaggatggtgtctcgctctcccacgacacgcagcagtggggggatgttctgcctgatggcaatgggacgtaccagacctgggttgctactagaatctgccggggagaggaacagaggttcacctgttacatggagcattcgggaaaccactctactcaccccgtgccgagcgggaaggttttggtgttacagtctcattggcaaacctttcatgtgtcagccgttgccgccgggtgttgctacttttgttactattattttctgtgccccctgctttag

SEQ ID NO: 195036 - DNA, 1029 bp, Artificial Sequence
  Description of Artificial Sequence: Synthetic coding sequence
atgggcctgggccccgtgttcctgctgctggccggcatcttcccctttgcccccccgggggcagctgctgaacctcactctctgaggtataatttgaccgtgcttagctgggatgggagcgtgcagtcagggttcctggcggaagtgcaccttgacggccagccattcctccgctatgaccggcagaagtgtcgggctaagccacaggggcagtgggccgaagacgtgcttggcaataagacatgggatagagagacccgcgacctaacaggcaacgggaaagatcttagaatgaccctggcacacatcaaggatcagaaagaggtcccccaaagtagtcgagctcaaactctggccatgaacgtaaggaacttcctgaaggaagacgctatgaaaacaaaaacccattaccacgcgatgcacgctgattgcctgcaggagctccgacgctacctagaatcgtctgtggttctgcggcgcagggtccctcccatggtgaatgtcacccgctcagaagcatccgagggcaacatcacggtgacgtgcagagcctcttccttttaccctagaaatatcacactgacatggaggcaagatggggtgtcgttatcccacgatacacagcagtggggggatgtgctccccgatggcaacgggacttatcagacgtgggtggcaacaaggatatgtcagggcgaagaacagcgctttacctgttatatggaacattcgggaaaccatagcactcaccctgtcccgagtgggaaggtgctggtactgcagtctcactggcaaactttccatgtcagcgcggtggccgccgcggcagccgccatcttcgtaatcatcatcttttatgtgcgatgttgcaagaagaagactagtgcggcagaaggccctgaactggtgtccttacaggtcctggatcaacatccagtgggcactagcgatcatcgcgatgccactcaactgggtttccagccactgatgagtgccctgggctccacaggatcaacggagggcgcatag

SEQ ID NO: 195037 - DNA, 825 bp, Artificial Sequence
  Description of Artificial Sequence: Synthetic coding sequence
ttccccttcgccccccccggcgccgccgccgagccccacagcctgcgttataatttaaccgttctttcttgggatggctccgtgcagtcgggcttcctgacagaggtgcacttagatggtcagcccttcttgcggtgtgacaggcagaaatgcagggccaagccacagggacagtgggcagaggacgtgctaggaaacaagacttgggatcgggagacgcgggacctaaccggcaatggtaaggacctgcgaatgaccttagcccatattaaggatcagaaagaagtgccccccatggttaatgtcacaaggtccgaagcctctgaagggaacattacagtaacatgtcgtgcctcaggattctacccttggaacattactttaagctggagacaagacggagtgagtctgagtcacgatactcagcagtggggcgacgttttgccggatggcaatggaacctatcagacatgggtagctacccgaatttgtcagggagaggagcagcgcttcacatgctatatggaacactccggaaaccatagcactcatccagttccgagcggcaaggtgttagtactccagtctcattggcaaaccttccatgtttccgcggtggcggccgcagctatctttgtgatcattattttctatgtacgctgttgcaagaagaagacttctgcagcagagggacccgagctagtctccttacaggttctagaccagcaccctgtaggcaccagcgaccatcgggatgcaacccagcttggtttccagccgcttatgtctgatttaggatctacaggttccacggaaggggcctag

SEQ ID NO: 195038 - DNA, 585 bp, Artificial Sequence
  Description of Artificial Sequence: Synthetic coding sequence
atgggccagcgggaccagggcctggaccgggagcggaagggcccccaggacgatccgggtagttaccaagggccagaaaggaggaactttttgaaagaggatgccatgaagaccaagactcattatcacgcgatgcacgccgattgcctgcaggagttaagaaggtacctcgaaagcggagtggtgctcagacgaacggtgccgccgatggtgaatgtgaccaggagcgaagcatcagagggcaatattacagtgacgtgcagggccagctcgttctaccctagaaacatcatactaacatggcgtcaggacggtgttagtctgtcccacgacacacaacagtggggagacgtgttgccagacgggaacggcacatatcagacttgggtggcaaccaggatttgtaggggtgaggagcaacgctttacatgctatatggaacattccggaaaccactccacacaccctgttccatcaggtaaggtactcgtgttgcaatcccactggcaaacctttcatgtgtccgccgtggctgcaggatgttgctatttctgttattattactttctatgccccctgttatag

SEQ ID NO: 195039 - DNA, 870 bp, Artificial Sequence
  Description of Artificial Sequence: Synthetic coding sequence
atgggcctgggccccgtgttcctgctgctggccggcatcttccccttcgcccctcctggcgcagcagccgagcctcattcactgcgctataatttgactgtgttgtcctgggacggtagcgtccagagcggatttcttgctgaagtgcacctggacggacagccttttctgaggtatgatcgccagaagtgccgggcaaagccacagggtcagtgggctgaggatgtgctgggcaacaagacctgggaccgggaaacaagggacctgacaggcaatggaaaagacctgcgaatgacactggcccatattaaggatcagaaagaggttccacagtcaagtagagctcagacactggcaatgaacgttcgaaactttctaaaagaagatgccatgaagacaaagacacactatcacgccatgcacgccgactgtctgcaagaactgagaagatacctggagagcggggtggttttgagacgaacagtgcctccaatggttaatgtaaccaggtcagaggccagcgaagggaatataacagtgacttgtagggcctcctccttctatcctaggaacatcattttgacctggcgtcaagatggagtgtcattgtcccatgatactcaacagtggggggacgtgctaccagacggcaatggcacttatcagacctgggtggcgacgaggatttgtagaggggaggagcagcgctttacctgctacatggagcatagcggaaaccactctacccatcccgtcccctctggcaaggtcctggtactccagagccactggcagacattccacgtgtctgcggtggccgccggatgctgctatttctgttattactacttcctgtgtcccctgctttag

SEQ ID NO: 195040 - DNA, 999 bp, Artificial Sequence
  Description of Artificial Sequence: Synthetic coding sequence
atgggcctgggccccgtgttcctgctgctggccggcatcttcccctttgcccctcctggcgccgccgctgagccgcatagcctgaggtataacctgaccgtgctctcatgggacggctctgtacaatctggcttcctggctgaggtgcatctggacggacaaccattcctccgctatgataggcaaaaatgcagggccaagccacaagggcagtgggcggaggatgtgttgggaaacaagacctgggacagggagacaagagatttgacgggtaatgggaaggacctccgcatgaccctcgcccacattaaggaccagaaagaaggcctccactccttacaggagatcagagtctgcgagatccacgaggacaatagtacccggtcaagccagcatttttattacgatggcgagctgtttttaagccagaacctggagaccgaagaatggacggtgccccagtcaagccgcgctcaaacacttgccatgaatgtcagaaacttcctgaaagaagatgccatgaaaaccaagacccattatcatgcaatgcatgccgattgtctgcaggaactccggcggtacctcgagtccggcgtcgtattgagacgaaccgtgccaccaatggtaaacgtcacacggagtgaggcttctgaagggaacatcaccgtgacctgcagagcttcaagtttctatcctcggaatattattctcacttggcgccaagatggggtcagtctgtcacatgacacacagcagtggggggacgtgctgccagatgggaacgggacctatcagacttgggtcgccacgagaatttgtcggggagaagagcagcgctttacatgctatatggagcattcaggcaatcactcaacccatcctgtgccaagtgggaaggtgctggtccttcaatcccactggcaaacattccacgtgtctgcagtggctgcggggtgctgctacttctgttattactactttttgtgccctttgttgtag

SEQ ID NO: 195041 - DNA, 999 bp, Artificial Sequence
  Description of Artificial Sequence: Synthetic coding sequence
atgggcctgggccccgtgttcctgctgctggccggcatcttccccttcgctcctccaggggccgcggctgaaccgcattccctgagatacaatctgacagtgctatcttgggatggctcggtccaatccgggtttctggccgaagtgcacctggacggacaacccttcctgcggtatgatcgacaaaaatgcagagccaaacctcaggggcaatgggccgaagatgtgctgggaaacaagacgtgggacagggaaacaagggatctgaccgggaacggtaaggacttgagaatgaccctggcacacattaaggaccagaaagagggattacactctctgcaggagatcagagtgtgtgagattcatgaggataacagtacccggtccagtcagcatttttactacgacggggagctgttcctgagtcaaaatctcgagacggaggaatggacagtgcctcaatcgagccgagctcaaaccctcgcaatgaatgtgcgaaatttccttaaggaggatgccatgaagaccaagacccactatcacgccatgcatgctgactgtcttcaagaactccggaggtacctggagagtggcgttgttcttcgaagaactgtgcctccaatggtcaacgtgacgaggagtgaggcatctgagggtaacataactgtcacttgcagagcatccagcttctatccacgaaatatcatcctcacatggaggcaggatggcgtcagtctctcacatgacacccaacagtggggcgacgtgctccccgacggcaacggcacctaccagacatgggtggctactcggatctgtagaggagaagagcaaaggttcacttgttatatggaacattccggaaatcattcgacccaccccgtgccctccggaaaggttctcgtgctgcaatcacattggcagacctttcatgtttctgctgtcgcagccggatgttgctacttctgctactactattttctgtgcccactgctatag

SEQ ID NO: 195042 - DNA, 1152 bp, Artificial Sequence
  Description of Artificial Sequence: Synthetic coding sequence
atgggcctgggccccgtgttcctgctgctggccggcatcttccccttcgcacctcctggggccgccgcggagcctcattctctcaggtataacttaaccgtgctttcttgggacggaagcgtgcagtccggatttctgacagaggtgcacctggatggacagccattcctgagatgcgacagacagaaatgtcgtgctaaaccccagggacagtgggccgaagacgtactcgggaacaaaacttgggacagagagacgagagatctgacagggaatggaaaggacctcagaatgacgctggctcacattaaggaccaaaaagagggcctgcattctctccaggagattcgtgtgtgcgagatacatgaggataacagtaccaggtcatctcaacacttttattacgacggagagctgttcctttcgcagaacctcgagacaaaggagtggaccatgccacagtcgagtagagcccagaccctggcgatgaacgtgcgaaattttctaaaggaagacgccatgaagaccaagacgcattaccacgccatgcatgccgactgtctgcaagagctcaggaggtaccttaaatccggggtggtcctgagaagaacggtcccgcctatggtgaacgttaccaggagtgaggcaagcgaaggcaacatcactgtaacttgcagggctagtggcttctatccttggaacattacactgtcctggaggcaggacggggtgagcctaagtcacgatacccagcagtggggcgacgttttgcccgacggcaatggaacatatcagacctgggtagccactagaatttgtcagggcgaagaacagaggtttacctgctatatggagcattctggcaaccactctacccatccagtaccatccgggaaagtcctggttctccagtctcattggcaaacctttcatgtctcagcggttgccgccgcagccatctttgtgataatcattttttatgtgcgatgttgtaaaaaaaagacctcagcagccgagggaccggaactcgtgagtcttcaggtcctggaccaacaccccgtggggaccagcgaccaccgcgacgcaactcaactgggattccagcctttgatgtctgacctgggtagcacaggctcaaccgagggagcctag

SEQ ID NO: 195043 - DNA, 999 bp, Artificial Sequence
  Description of Artificial Sequence: Synthetic coding sequence
atgggcctgggccccgtgttcctgctgctggccggcatcttcccctttgcgccgccaggggccgctgccgagcctcatagtttgcgctacaatctgactgttctgagttgggacggctccgtacagagcgggttcctggccgaagtccacctcgacgggcagccctttctaaggtacgacaggcaaaaatgccgggccaaacctcagggacaatgggctgaagatgtactcggcaataaaacttgggatcgcgaaacacgcgacctgaccggaaatggaaaagatctacgcatgaccctagctcacatcaaggaccaaaaagagggattgcacagcctccaggaaatcagggtgtgtgaaatacatgaagataactccactagaagttctcagcatttctactatgatggcgaattgttcttatcacagaacctcgagaccgaagagtggacagtgccgcagtctagcagggcacagacgctggccatgaacgtgcggaacttcttgaaagaagatgcgatgaaaacaaaaacccattaccacgcgatgcacgctgattgcctgcaggaattgcgccgctaccttgagtcaggggtggtactgagaagaacagtgcccccgatggtgaatgtcacaaggtccgaagccagtgagggaaacatcaccgtgacttgtcgggcctccagtttttacccacgcaatatcatcctgacgtggcgccaggacggtgtctctctgagccacgatacacagcaatggggtgacgttctgcccgacggcaacgggacgtatcagacatgggttgcaactcgcatctgcaggggtgaggaacagagattcacctgctatatggagcacagcggcaaccatagcactcaccccgtgccgagcggaaaggttcttgttcttcaatctcattggcagacctttcacgtatcagctgtcgccgctggctgttgttacttttgttattattacttcctgtgccctctgctctag

SEQ ID NO: 195044 - DNA, 999 bp, Artificial Sequence
  Description of Artificial Sequence: Synthetic coding sequence
atgggcctgggccccgtgttcctgctgctggccggcatcttccccttcgccccgccaggagccgccgccgagcctcactctctgaggtacaatctcactgtgttgtcctgggacggctccgtgcagtcaggctttctggcagaggtgcacctggatggccagcctttccttcgatacgatcgacagaaatgtagagccaaacctcagggacagtgggcagaggatgtccttggcaataagacctgggatagggaaacaagggatctgacgggcaacggtaaggatcttcggatgacgctcgcccatattaaggaccagaaggagggcctgcactccctgcaggaaattcgggtctgcgaaattcacgaagacaacagcacccgtagcagtcagcacttctattacgacggcgaactgtttctgagccagaacgtcgagacagaggaatggaccgttccacagtcaagccgggcgcagaccctggcaatgaacgtacgcaacttcctgaaggaggatgctatgaagacgaaaacacattatcacgctatgcatgccgactgccttcaggaattgaggcgctatctggaaagcagcgtcgttcttcggagacgggtgcccccgatggttaatgttacaagaagtgaggcctcagaggggaacattactgtgacatgccgggcatcatctttctaccccaggaacatcacccttacctggaggcaggacggggtctcactcagccacgatacccagcagtggggtgacgtgctccctgacgggaacgggacctaccagacctgggtcgccactcggatctgtcagggggaggaacaaaggtttacatgttacatggagcactccggcaatcacagcacacatccggtacctagtggaaaagtgctggtactgcaatcccattggcagacatttcacgtcagtgctgtcgcagcatgctgttgctacttttgctactactatttcctgtgccctcttctgtag

SEQ ID NO: 195045 - DNA, 1152 bp, Artificial Sequence
  Description of Artificial Sequence: Synthetic coding sequence
atgggcctgggccgggtgctgctgttcctggccgtggccttccccttcgctccgcctgccgccgccgccgagcctcactctcttagatacaacctgatggtcctatctcaagatggcagcgtacagagcggattcctcgcagaaggacatctcgacggccagcccttcctgaggtacgatcgccagaaacgtagagccaaaccacaaggacagtgggccgaaaacgtgttgggagcgaaaacctgggacactgaaactgaagacctgactgagaatgggcaggatctcaggagaaccctcacacacatcaaggaccaaaagggaggtctacactcactccaggagattcgggtctgtgaaattcacgaagattcaagcaccagaggctcaaggcacttttattacgatggtgagctctttcttagccagaacttggaaacgcaggagtctactgtgccacaatcttccagagcccaaacgctggctatgaatgtcacaaacttctggaaggaggatgctatgaagactaagactcattacagagctatgcaggcggactgccttcagaagctgcaacgatacctgaagagtggcgtggcaattaggaggacagtacctccaatggtgaacgtcacctgcagcgaggtgagcgaagggaacattactgtcacttgtcgtgcctcctccttctacccaaggaacattaccttaacctggcgacaggatggagtgtccctgtcacataacactcaacagtggggtgacgtcctgcccgacgggaatggtacttatcagacctgggtggctactcgcatcaggcaaggagaggagcagcggttcacatgttatatggaacattccggtaaccatgggacccaccctgtgcccagcggcaaggccttggtactccaatcacagcgtacagattttccatacgtctccgccgccatgccctgcttcgtgattattataatcttgtgtgtcccatgctgtaaaaaaaagacctctgcagccgaaggtccagaactcgtgtctctgcaagtccttgaccaacaccctgtagggactggagatcaccgggatgctgcgcagcttggcttccagccgctaatgtccgccaccggaagcacagggtccacagaaggaacatag

SEQ ID NO: 195046 - DNA, 1152 bp, Artificial Sequence
  Description of Artificial Sequence: Synthetic coding sequence
atgggcctgggccgggtgctgctgttcctggccgtggccttcccctttgcaccacctgctgctgctgccgagccccacagcctaaggtataacctgatggtgctgtcacaggatggttcagtgcagagcggtttcctcgctgaggggcatttggatggtcaaccgttcctccgttacgatcgccagaagcggcgggcgaaaccacaaggtcagtgggcggaggacgtgctcggcgcaaagacctgggacacagagactgaggatctaactgaaaacggacaggacctgcggaggaccttgactcacattaaagatcagaaaggcgggctccactccctccaggagatcagggtgtgtgaaatccacgaagattctagcacacgcggatcacggcacttctattacgatggggaactctttctgagtcagaatcttgagacacaggaatctactgttccgcaatcgtcacgggcccagacactcgcaatgaatgtgaccaatttctggaaggaggacgctatgaagactaagactcactatcgcgccatgcaggcagactgcctgcagaagctgcagcgctatctgaaaagcggcgttgccatacgaagaaccgtccctccaatggttaacgtaatttgtagcgaggtgtccgagggcaatatcaccgtaacttgcagagcttcctcattctatccacgcaatatcactctcacctggcgccaggacggggtgtccctgtcccacaacacacagcagtggggcgacgtgctgcccgatggcaatgggacttatcaaacatgggttgctacacgaattcgccaaggtgaagaacagcggttcacctgttatatggagcacagcggcaaccacggaacccaccctgtccccagcgggaaggcactggtgttacaaagccagcgaactgactttccttacgtgtcagccgcaatgccgtgttttgtgattattatcatactatgcgtgccttgctgcaagaagaagacatctgccgccgaaggtcctgagctggtttcccttcaggtccttgaccagcaccctgttggaaccggtgatcatagagacgccgcccaactcggctttcagcctctaatgtcggctaccggttcgacaggatccaccgaaggaacgtag

SEQ ID NO: 195047 - DNA, 1023 bp, Artificial Sequence
  Description of Artificial Sequence: Synthetic coding sequence
atgggcctgggccgggtgctgctgttcctggccgtggccttcccctttgcccctccagccgcggcagccgaacctcattcgttaagatataatttaatggtgctgtcgcaggatggcagtgtgcagtccggctttctagcggaaggccacctggacgggcagccatttttgcggtatgaccggcagaaacgacgcgccaagccacagggacaatgggctgagaatgtgctcggcgctaagacttgggacaccgagaccgaggatttgacagaaaacggtcaagacctccggcgaactctcacacacatcaaagaccagaagggagtccctcaatcttccagagcccagacactggctatgaacgtgacaaacttctggaaggaggatgcgatgaagactaaaactcactatagagctatgcaggccgactgtctgcagaaattgcagcggtacctgaaaagtggggtcgctattagacgcaccgttcctcctatggtgaacgtcacctgctccgaggtgtccgagggaaacataaccgttacgtgccgcgcctcctctttttacccgaggaacattacgctgacgtggcgccaggatggggtgtcacttagccataacacccagcagtggggagatgttctgccggatgggaacggaacgtaccaaacctgggtcgccaccaggatccggcaaggggaggaacagaggttcacttgctacatggaacactctggtaaccacggtacccacccagtgccaagtggtaaagcactcgttctacaatcacagcgcacggacttcccttatgtgtccgctgcaatgccctgtttcgtgataatcattatcctctgtgtgccctgctgcaaaaagaaaactagtgccgctgaggggcccgagttggttagcttacaggtgctggatcaacaccccgtcgggacaggggaccatcgggacgcagctcagctcggctttcagcctttgatgagtgctaccgggtcaacaggttctacagaaggcacctag

SEQ ID NO: 195048 - DNA, 1023 bp, Artificial Sequence
  Description of Artificial Sequence: Synthetic coding sequence
atgggcctgggccgggtgctgctgttcctggccgtggccttcccctttgcgcccccagcagctgccgccgaaccccacagcctgcggtacaaccttatggtcctgagtcaggacggatccgtgcagagtggatttttagcagaggggcatctggatggacagccgttcctgcgctacgatcgccagaaaagacgagctaagccacaggggcaatgggcggaggatgtgttgggggctaagacttgggacaccgagacagaggacctgacagagaacggccaggacctgagaagaaccctaactcacattaaggaccagaaaggggtccctcagtcatcgcgggcccagactctggcaatgaatgtgactaacttttggaaagaagatgctatgaagactaagacccattacagagcgatgcaagccgactgcctgcagaaacttcagcgctatctgaagagcggggtggccatccgccgtaccgtgcctcccatggttaacgttacctgtagcgaggtatccgagggcaatatcacagtgacctgccgcgcgtcaagcttctacccgagaaatatcaccctgacatggcgacaggacggagtttctctgagtcacaacactcagcagtggggcgacgtcctgcctgacggcaatggaacctaccagacttgggttgctacacgaattcgtcagggcgaagaacagcgcttcacttgctacatggagcacagtggaaatcacggaacacaccccgttccctcaggcaaagctctggtgctccagagtcagcgaactgatttcccatacgtttcagctgcgatgccctgttttgtgatcattatcattctgtgcgtaccctgctgtaaaaagaagaccagtgcagctgaggggcctgaacttgtctcgctgcaggtgttggaccagcacccagtgggcacaggcgatcatcgcgacgccgctcagctcggatttcagcccctgatgtcagccacgggctctactggaagcacagagggggcttag

SEQ ID NO: 195049 - DNA, 126 bp, Artificial Sequence
  Description of Artificial Sequence: Synthetic coding sequence
atgggcctgggccgggtgctgctgttcctggccgtggccttcccctttgcacccccggccgcagccgcggtggagatgggatttcaccgggtgtcccaggatggtttggacctgctcaccagctag

SEQ ID NO: 195050 - DNA, 1083 bp, Artificial Sequence
  Description of Artificial Sequence: Synthetic coding sequence
tgaccccacagcctgcggtacaacctgatggtgctgagccaggacggctcagtacagagcgggtttctcgccgaggggcacctggacggtcagccttttctcaggtatgaccgtcagaagcgaagggccaaaccccagggccagtgggccgaagacgtgctcggcgccaaaacttgggatacggaaacagaggacctgaccgaaaacggccaggacttgaggcgtactcttacgcatattaaggaccagaagggggggctgcactccctccaagagatccgggtctgcgagatccatgaagattcatcgacacgtggaagcaggcatttctattatgacggagagttgttcttgagccagaacctggaaacacaggaatctactgtgccccagagcagtcgagcccagacactcgctatgaatgtgacaaatttttggaaggaagatgctatgaaaaccaaaactcattaccgcgctatgcaggcagactgcctacagaaactccagagatacttaaaatctggcgtcgccatcaggaggacggtccctccaatggtgaacgttacctgttctgaggtgtccgaaggtaacatcactgttacgtgtagggccagctctttctatcctagaaacatcacactgacgtggcgacaggacggcgtttcactgtcccataatacacagcaatggggggacgtgttgccagatggcaacggcacgtaccaaacttgggtggcaacacgcataaggcagggcgaagagcaaagattcacatgttacatggagcactccggcaaccacggaactcatcccgttcccagcggcaaggctctcgtactgcaatcacaacggactgacttcccctatgtcagcgcagccatgccttgcttcgtcattattattatactgtgtgtgccttgctgcaagaaaaaaacttccgccgcagaggggccagagctcgtatctttgcaagtgttggaccagcaccctgtcgggacaggggaccatcgggacgcagcacagttaggcttccagcctcttatgtctgctacaggatccacgggcagcaccgagggcgcctag

SEQ ID NO: 195051 - DNA, 1152 bp, Artificial Sequence
  Description of Artificial Sequence: Synthetic coding sequence
atgggcctgggccgggtgctgctgttcctggccgtggccttcccctttgccccaccggcggctgccgcggagcctcacagcctccgatataatttgatggtgctgtcccaggacggtagcgtgcagagtggtttcctggcggagggccacctggacggacaaccctttttgcgatatgatcgacagaagaggcgcgccaagcctcagggtcaatgggcggaagatgtactgggcgcgaaaacctgggacacagagactgaggacctgacagaaaacgggcaggaccttaggagaactctgacccacattaaagaccagaagggagggcttcattccttacaggaaatcagggtatgtgagatccacgaggactcttccacccgcggctcccgccatttctattatgacggcgaactttttctctcgcaaaatctggagactcaagagagcaccgtccctcagtcatctagggcccaaacacttgcaatgaatgttacaaatttttggaaggaggacgccatgaagacaaagacgcattaccgagcgatgcaggctgactgcctgcagaagctccagagatatctgaagtccggcgtggccattagacgcacagtgcccccaatggtcaatgtcacatgttccgaagtctccgaaggaaacatcactgtgacttgtcgcgcctcttcattctatcctcgaaacattacacttacctggaggcaggacggagtgtctctgtctcacaatactcagcagtggggcgatgtcttaccagatggaaacggaacttaccagacctgggtagccacccgcatccgacaaggcgaggaacaacggttcacctgctatatggagcactccgggaaccatggcacacatcccgtcccgtctggtaaagccctggtgctgcagtctcaacgcacagactttccttacgtttcagccgcaatgccttgtttcgttattattattatcttgtgtgtcccttgctgcaagaagaagacgtctgcagctgagggccctgagctcgtgtccctccaggtcctggatcagcaccccgtgggcactggggaccacagggacgcagctcagctgggttttcagccacttatgtcggccacagggtcgacaggctctacggaaggagcctag

SEQ ID NO: 195052 - DNA, 1023 bp, Artificial Sequence
  Description of Artificial Sequence: Synthetic coding sequence
atgggcctgggccgggtgctgctgttcctggccgtggccttcccctttgctcctccagctgctgccgcagagccgcatagcctgcggtacaacctcatggtgctgagccaggacggctccgtgcagagcggcttcctggctgagggccacctggacggtcaaccctttttgagatatgaccgccagaaacggcgagctaagccgcagggccagtgggccgaggacgtcctgggcgcagaaacctgggatactgaaactgaggatctgacggagaatgggcaggacctgaggaggacacttacccacatcaaggaccaaaagggagtgccgcaatcttcccgtgcacagacgctggcaatgaacgtcacaaatttttggaaagaggatgcaatgaagaccaagacacattaccgcgcaatgcaagccgactgtctgcagaaactccaacgatacctcaaatcaggagtggctatacgacgtacggtgccacccatggtcaacgtgacttgctctgaggtgtcggagggaaatatcaccgtgacttgtagagcttcctccttttatccgcggaacatcacattgacttggagacaggacggcgtctccctgtctcacaacactcaacagtggggcgatgtgcttcccgacggcaacggaacgtatcaaacttgggttgccactcgcatcaggcagggtgaggaacagcggtttacgtgttacatggaacactccggaaaccatgggacccaccctgtgccatctggaaaggccctggtgctccagtctcagcgcacagatttcccttatgtctctgctgccatgccatgctttgtcattatcataatcctttgtgtaccgtgttgtaagaagaaaactagcgctgctgagggccctgagctggtgtcattacaggtgctggatcagcacccagtgggtactggcgaccatagagatgctgcgcagctcggctttcaaccactcatgtcagcgaccggaagcaccgggagtacggaaggtgcatag

SEQ ID NO: 195053 - DNA, 1152 bp, Artificial Sequence
  Description of Artificial Sequence: Synthetic coding sequence
atgggcctgggccgggtgctgctgttcctggccgtggccttccccttcgccccccctgcagcggccgccgaaccccactcactgcggtacaacctcatggttctgagtcaggacggctccgttcagtcaggtttcctggcagaagggcatctggatggacagcctttcctccgttatgaccggcagaagcggcgcgctaagccgcaaggacaatgggcagaggacgtcctgggagccgaaacttgggacactgaaactgaagatctcacagagaatgggcaggacttgagaaggacactgacgcacatcaaggatcagaaaggaggtctccactctctccaggagattcgagtgtgtgagatacatgaagatagctcgacccggggcagccggcacttctattataatggcgagctgtttctctcccaaaacctggaaacccaggagagcaccgtgccgcagtctagtcgcgctcagacactggccatgaatgtcactaacttctggaaggaagacgctatgaagacaaagacgcactaccgcgccatgcaagccgattgcctccaaaagctgcagagatacctcaaaagtggcgttgctatcaggcgtacagtccctccaatggtcaacgtgacctgttccgaggtctcagaagggaacatcacagtgacttgtagggcctcttccttctaccctaggaacatcaccctgacctggcgacaagacggcgtttctctctcgcacaacacacagcagtggggtgacgtgctccccgacggaaatggcacatatcagacctgggtggctacacggatacgccagggagaagaacagaggttcacctgttatatggagcattccgggaaccatggcactcatccagtccctagtggtaaagccctggtattacaaagccaaaggacagacttcccttacgtctcagcagccatgccgtgcttcgtgattatcattatcttgtgcgttccatgctgcaagaagaaaacttccgccgccgaagggccagagctggttagcctacaggtgctggatcagcacccggtcggaaccggggatcaccgggatgctgcccagctcggatttcaaccactcatgagcgctacagggagtactggaagcacagagggcgcttag

SEQ ID NO: 195054 - DNA, 1023 bp, Artificial Sequence
  Description of Artificial Sequence: Synthetic coding sequence
atgggcctgggccgggtgctgctgttcctggccgtggccttcccctttgcaccccccgcagctgccgccgaaccacatagtttaaggtacaatctcatggttctgagccaggacggcagtgtgcagagcggctttctggcggagggccatttggatgggcaaccatttttgagatacgatcggcaaaaacgaagggcaaaaccccagggccagtgggcagaggacgtacttggagcgaagacgtgggacacagaaactgaagacctaaccgaaaatggtcaggacttgcgacgaacccttacgcatataaaagatcaaaaaggcgtgccccagagcagcagagctcaaaccctcgccatgaatgttaccaatttttggaaggaggacgccatgaaaaccaaaacacactacagagctatgcaggccgactgccttcaaaagctccagaggtacctcaaaagtggtgttgcgatccgccgcacggtaccgccaatggttaacgtaatttgcagcgaggtgtcagagggaaatattacggtcacatgccgcgcctcaagcttttacccgagaaatatcactttgacctggagacaagacggggtctccctgtcacataatacccagcagtggggcgacgttctccctgatgggaacggcacctaccagacttgggtggcaacaaggatacgtcagggcgaagagcagcgtttcacctgttatatggaacacagtggcaatcacggcacgcatccagttccttccggcaaagccttggtgttacaatcacagcgcacagactttccgtatgtgagcgctgcaatgccctgtttcgttattatcatcatcctctgcgttccctgttgcaagaagaaaacttcagccgccgagggtccagaacttgtgtctcttcaagtcctcgatcagcaccccgtggggacaggcgatcatcgagacgccgcgcagctggggtttcagccacttatgtctgctactggctcaactggaagcactgaggggacctag

SEQ ID NO: 195055 - DNA, 1023 bp, Artificial Sequence
  Description of Artificial Sequence: Synthetic coding sequence
atgggcctgggccgggtgctgctgttcctggccgtggccttcccctttgccccaccggcagccgcagctgagccgcacagcctgcgttacaatctgatggtgctaagtcaggacggttcggtgcagagcggattcttggcagaaggtcatctcgacggccagccattcctcaggtacgacaggcagaagaggcgggccaagccccaaggccagtgggctgaggatgtcttaggcgccgagacatgggataccgagacggaagacctcaccgaaaacgggcaggaccttaggcggacactgacgcatatcaaggaccagaaaggcgtaccccagtcctcgcgagcccagaccctggcgatgaacgtgacaaacttttggaaggaggacgcaatgaagacaaaaacacactacagggcaatgcaggctgactgtcttcagaaactgcagcgttatctgaagagtggcgttgcaattcgtcgcaccgtacctcccatggtgaacgtaacatgcagcgaagtgagcgaggggaacattactgtcacatgcagagctagcagcttttacccaagaaacatcacccttacctggagacaggacggagtttccctaagccacaatacacaacagtggggggatgtgcttcccgatggcaatggtacttaccagacttgggtggccactcgaatccggcagggtgaagaacagaggtttacctgctacatggagcatagcggaaaccatgggacgcacccagttccatccggcaaggctttagtcctccaaagtcagaggaccgactttccatacgttagtgccgcaatgccctgttttgttatcatcatcatactgtgtgtcccgtgctgcaagaaaaaaacttctgccgcagagggtcctgagctcgtaagcctgcaagtgttagatcagcaccccgtggggactggtgatcatcgtgacgctgcacagcttgggttccagcccctgatgtccgctacaggttcaacagggagtacagaaggtgcctag

SEQ ID NO: 195056 - DNA, 1023 bp, Artificial Sequence
  Description of Artificial Sequence: Synthetic coding sequence
atgggcctgggccgggtgctgctgttcctggccgtggccttccccttcgccccccccgcagcagccgcagaaccccactctctccgttacaatttaatggtcctgtcccaggatgggtctgttcagagcgggtttcttgcagaaggacatctggacggacaaccatttcttagatacgaccgacaaaagagaagagccaaaccacagggacagtgggcagagaatgtcctcggcgccaagacatgggatactgagacagaggacttgaccgagaacggacaagatctgcgtaggactttgacgcacattaaggatcagaaaggggtcccccagagttcaagggcccagacgctagccatgaatgtcacgaatttctggaaagaggatgcaatgaagaccaagacccattatcgcgcaatgcaggccgactgcctgcagaagttacagcggtatctcaagtctggcgtcgccataagacgcaccgtgccccccatggtgaacgtaacctgctcagaggtgtcggagggaaatataacggtgacctgcagggcctcgtctttttatcctagaaacataactctcacatggcgtcaggatggcgtaagcctgtcacacaatacacaacagtggggcgatgtactgcctgatggcaatgggacatatcaaacctgggtggcaacaagaatcagacaaggtgaggagcaacggttcacttgctacatggagcattctggaaatcacgggacgcacccggtcccctccgggaaggctctcgttttgcagtcccagagaacggacttcccgtacgtcagcgctgccatgccttgttttgtgataatcataatcctgtgcgtgccatgttgcaaaaagaaaacctccgcagcagaaggcccagagctggtgtcactccaagtcctagaccagcatcccgttggcaccggtgatcacagagatgccgcccagcttggttttcaaccacttatgtctgcaaccggatccactggtagtaccgaaggtacttag

SEQ ID NO: 195057 - DNA, 1152 bp, Artificial Sequence
  Description of Artificial Sequence: Synthetic coding sequence
atgggcctgggccgggtgctgctgttcctggccgtggccttcccctttgcgcccccagccgcggcggccgaaccccattccctccgttataatctcatggtgctgagccaggacggaagcgtacagagtggttttcttgctgagggccacctggatggtcagcctttcctacgctatgatcggcagaaacgtcgagcaaagccacagggacagtgggccgaggacgtactgggagccaagacatgggacaccgagaccgaggacttgaccgagaacggtcaggacctgcgtcgcacactcacccatatcaaggaccagaagggaggccttcactcactacaggaaatccgggtttgcgaaatccatgaggacagcagcactaggggatcccgccacttttactacgatggcgaattgtttttgagccagaacctggaaactcaggaaagtaccgttccacagtctagcagagcacagacattggcaatgaacgtgacaaacttctggaaggaggatgctatgaaaaccaagacccattatcgggccatgcaggctgactgcttgcagaaactgcagcggtacctgaagagcggtgtcgccatacgtcgcacggtgcctcccatggtcaatgtcacatgcagcgaagtctccgagggcaacataaccgtaacctgtcgagcaagttcattctacccacggaacattaccctgacctggcggcaggacggtgtgtctcttagtcacaatacacagcagtggggcgacgtacttcctgacggtaatggaacataccagacttgggtggccactcgaattcgtcaaggcgaagaacagagattcacttgctacatggaacactcaggcaaccatggaacgcaccctgttccgtccgggaaagccctcgtgctacaatcgcagcgcaccgactttccctacgtatctgccgccatgccctgttttgtgattatcataatcctgtgcgtgccatgttgtaagaagaagacctcagcggccgaggggcctgagctagtttcattacaggtgttagaccagcacccggtaggaactggagatcacagggacgctgcgcagctgggcttccaacctttaatgtctgctacaggatcaactggatccaccgaaggggcctag

SEQ ID NO: 195058 - DNA, 1152 bp, Artificial Sequence
  Description of Artificial Sequence: Synthetic coding sequence
atgggcctgggccgggtgctgctgttcctggccgtggccttcccctttgcccccccagctgcagccgcagaaccccattcacttagatacaatctcatggtgctgtcacaggacggctcagttcagagcggctttttggcagaggggcacctggacgggcaacccttcctccggtatgatcgccaaaagagaagagccaagcctcagggtcagtgggctgagaatgtgttgggggccaagacatgggatacggaaacggaagacctgacagagaacgggcaggacctccgcaggactctgactcacatcaaagatcaaaagggggggctccactctctgcaggagattcgggtctgcgagattcacgaagacagcagtacacgcgggagccggcatttttattatgacggtgagctttttctcagccagaatctagaaacacaggagtccaccgtgcctcagagctccagggctcagactctagctatgaacgtgactaatttctggaaggaggacgcaatgaaaaccaaaacccactatcgggcaatgcaggcagactgtctgcagaagctacagaggtatcttaaatccggcgtcgctatccggagaaccgtaccacctatggtcaacgtcacgtgcagcgaagttagtgagggcaacattactgtgacctgcagggcttcgagcttctatccgagaaatataaccctgacctggaggcaggacggggtttcactgtctcacaacacacagcagtggggcgatgtgctacctgacggaaacgggacctaccaaacatgggtggctaccaggattcgccagggcgaagaacagcggtttacatgctatatggagcattccggtaatcacggtacacaccccgtgccatccggcaaagcgctagtgctacaaagccagaggacggattttccctacgtgtccgcagccatgccctgcttcgtgatcataatcattttgtgtgtaccctgctgcaagaaaaagacatcagccgccgaaggtcctgagcttgtgtctttacaggtgttggatcaacatccggttggaaccggagatcaccgcgatgccgcccagctgggcttccagccattaatgtccgccaccggatcgaccggcagtactgagggcacttag

SEQ ID NO: 195059 - DNA, 1023 bp, Artificial Sequence
  Description of Artificial Sequence: Synthetic coding sequence
atgggcctgggccgggtgctgctgttcctggccgtggccttcccctttgcgccacccgctgccgccgctgaacctcattctctgcgctacaacctgatggtgctgtctcaagatggttcagtacagagcggtttcctcgctgaaggccatctggacggacaacccttcctcagatatgatcgccagaagcgaagagccaagccgcagggtcagtgggctgaggacgtgctcggagccaaaacctgggatactgaaacggaagatctaacagaaaatgggcaagatctgcggaggaccttgacgcatatcaaggatcagaagggggtgccgcagtcctcccgggcccaaacgctggccatgaatgtcaccaacttttggaaggaagacgctatgaagactaaaacccactacagggcaatgcaagcagattgcctccagaaactgcagcgatatctcaagtctggagtggcaataaggagaaccgtgccacccatggtaaacgtcacctgttctgaagtgagcgaggggaacatcaccgttacttgccgagcctcttcattctatccccgaaacattacactgacgtggcggcaggatggggttagcctgtcgcacaatactcaacagtggggagacgtcttgccagatgggaatggcacttatcagacctgggtcgctacaaggatcagacaaggcgaggaacagcgctttacatgctacatggaacacagcgggaatcacgggacacatccagtgccctccggtaaagcactggtgctccagagccagaggaccgacttcccatacgtgtcagcagccatgccttgctttgtgattatcatcatcctctgcgtgccatgctgcaaaaaaaagacttccgcagcagaaggtcccgaactcgtatctctgcaggtgctcgaccaacaccccgtgggaacaggggaccaccgtgatgccgcacagttaggttttcagccactgatgtccgctaccggtagcaccggatcgacggagggcgcgtag

SEQ ID NO: 195060 - DNA, 954 bp, Artificial Sequence
  Description of Artificial Sequence: Synthetic coding sequence
tgaccccacagcctgcggtacaacctgatggtgctgagccaggacgggtccgtgcagagcgggttcctcgctgaagggcacctagacggccagccgttcttgcggtacgatagacaaaaaagacgagcaaagccacagggccagtgggcggaagatgttctgggcgctaagacttgggacaccgagacggaagacctgactgaaaatggacaagatctgagacggactttgacccacattaaggaccaaaagggagtgccccagagtagcagagcacaaaccctagccatgaacgttacaaatttctggaaggaggatgcgatgaagacgaagacccactatagggccatgcaggcagattgtttgcaaaagcttcagagatacctgaaaagtggggtggcgatccgccggaccgtcccaccaatggtcaacgtgacttgttctgaggtgtcagagggaaatatcacggtgacttgtcgggcaagctccttctatcctcggaatataacactgacatggcggcaggacggagtgtccttatcccataatacacagcagtggggagacgttttgcccgatggcaacggcacgtaccagacatgggtcgcgacacgtatacgccagggcgaagagcaacgcttcacttgctacatggagcattccgggaatcacggaactcatcccgtgccatccggtaaagctttagtgttgcagtctcagcggacagattttccctatgtctctgccgcaatgccatgcttcgtgataattatcatcctctgcgtgccttgctgcaaaaaaaagacctctgctgcggagggccccgagctggtctctttacaagttctagaccaacatcctgtgggaactggggaccacagggatgctgctcagttaggctttcagccactgatgagtgccaccggttcgacaggatccactgagggcgcctag

SEQ ID NO: 195061 - DNA, 1152 bp, Artificial Sequence
  Description of Artificial Sequence: Synthetic coding sequence
atgggcctgggccgggtgctgctgttcctggccgtggccttccccttcgctcccccagccgccgctgcggagcctcattctttgcgctacaatctgatggtgttgagccaggacggtagcgtccaatctgggttcctggcggaaggccacttagacggccaacccttcttaagatatgacaggcagaaaagacgagctaaaccacagggccaatgggccgaggacgtcctgggcgccgagacctgggacaccgagaccgaagacctcaccgaaaatggccaggaccttcggcgcactctaactcatatcaaagatcaaaagggggggttgcattctttacaggaaattcgggtgtgcgaaatgcacgaagatagctctacacgaggtagtaggcacttctattataacggcgagctcttcctgagccagaacctggaaactcaggaatccacagtgcctcagagttcaagggcccagacactggctatgaacgtcacaaacttctggaaggaagatgctatgaaaaccaagacccactatagggcaatgcaagctgattgtttgcagaagctgcagcgttacttgaaaagcggcgtggctattaggcgaactgtgccccccatggtaaatgtgacttgtagcgaggtgtccgagggaaacataactgtgacatgtcgcgcgagcagtttttatccccggaacataaccctaacgtggcgacaggacggggtatctctctcacacaatacccaacagtggggtgacgtgctgcctgatggaaatggaacatatcagacctgggtggcaaccaggatccgccagggagaggaacagcgctttacatgctatatggaacactccgggaaccatggaacccatcctgttcccagtggaaaagctctcgtgttgcagtctcagagaactgacttcccttatgtctctgcggcaatgccgtgctttgtgatcattatcatcctttgtgtgccttgctgcaagaaaaaaaccagtgctgccgagggtcctgagttagtcagcctgcaggtcctggaccagcacccggtgggaactggtgaccatagggacgctgcacaactcgggttccaaccactgatgtccgccaccggttctacaggatcaacagagggcgcttag

SEQ ID NO: 195062 - DNA, 1056 bp, Artificial Sequence
  Description of Artificial Sequence: Synthetic coding sequence
atggtgctgagccaggacggcagcgtgcagagcggcttcctggccgagggccacttagatgggcaacctttccttcgatatgatcggcagaagagacgtgcaaagccacagggacaatgggccgagaacgtcctaggtgctaaaacgtgggacacagagaccgaagacctcacagaaaacggacaggatttaagaagaacattaacacatattaaagaccagaagggcgggttgcacagcctgcaggagattagagtatgcgaaattcatgaggacagttctactcgcggatcaaggcatttttattatgacggcgaattgttcctcagtcagaacctagaaactcaggaaagtacagtgccccaatcctctagggcacagactctggcgatgaatgtcactaatttttggaaggaggacgctatgaaaacaaagacccactacagggccatgcaggccgactgtcttcagaaactgcagcgctacctcaagagtggagttgctatcaggcgaactgtgcctcccatggtgaatgtcacatgttcagaagtgtctgagggtaatattaccgtcacctgcagggcatcttcattttaccctaggaacattactttgacctggcgacaggatggggtgagtctgtcacataacactcagcaatggggcgacgtcctgcccgacggcaacggaacgtatcaaacctgggtggccacgcggatcaggcagggagaagaacaaagatttacctgttatatggagcattctgggaaccacggcacccaccccgtgccttccggcaaagccctggtgttgcagtcgcaacgaaccgatttcccatatgtctctgccgccatgccatgcttcgttatcatcatcattctctgcgtcccatgttgcaagaaaaagacctctgcagccgaaggcccagaactcgtgagcctccaggtgctggaccaacatccggttgggaccggggaccatcgagatgcagcacaactcggatttcagcccctcatgagcgccacgggttcgactggcagcaccgagggtacctag

SEQ ID NO: 195063 - DNA, 126 bp, Artificial Sequence
  Description of Artificial Sequence: Synthetic coding sequence
atgggcctgggccgggtgctgctgttcctggccgtggccttcccctttgccccacccgccgccgccgccgtggaaatgggctttcatcgcgtatctcaggatgggctagatctgcttacaagctag

SEQ ID NO: 195064 - DNA, 126 bp, Artificial Sequence
  Description of Artificial Sequence: Synthetic coding sequence
atgggcctgggccgggtgctgctgttcctggccgtggccttccccttcgcgcctccagccgccgcagctgtcgagatgggctttcatcgtgtatctcaggacggtttggatctgttgacctcctag

SEQ ID NO: 195065 - DNA, 1056 bp, Artificial Sequence
  Description of Artificial Sequence: Synthetic coding sequence
atggtgctgagccaggacggcagcgtgcagagcggcttcctggccgagggccacctagacggtcagccattcctacggtacgatcgacagaagcggagagccaaacctcaaggccagtgggcagaagatgtgctcggggctgagacctgggacaccgagacagaagaccttactgagaatggacaagacctaagacggacactgactcacatcaaggatcaaaagggcgggctacactcattgcaggagattagggtgtgcgagatgcatgaagatagttccaccagaggctctcgacatttctactataatggagagctgtttctctctcagaatctggagacccaggaaagcacagtaccgcaatcttccagggcacaaactctggctatgaacgtcaccaatttctggaaagaggatgcgatgaagaccaaaacacactatcgcgccatgcaggccgactgcctgcagaagctccagcgctatctgaagtcaggggtggccatccgccgtactgtcccccctatggtgaacgtcacttgtagcgaggtgtccgagggcaatattaccgtgacgtgccgggcatccagcttttacccaagaaatattacgctgacatggcgccaagatggcgtcagtctgagccacaacacccagcagtggggcgacgtgctccccgacggaaatggtacttatcagacgtgggtggcaacacggataaggcaaggcgaggagcaacgatttacctgctatatggagcacagcggaaatcacggaacccacccagtgccaagcggcaaagctctcgttctgcagtcccagagaacagactttccctatgtgtctgcagcgatgccttgtttcgtcattatcatcatattgtgtgtgccctgttgtaaaaagaaaacatcagccgcagagggacctgagctcgtgtctctccaggtgctggatcagcacccagtgggaaccggagaccaccgcgatgccgcacaactgggcttccagcctttgatgagtgccacgggcagtacaggcagcactgaaggagcatag

SEQ ID NO: 195066 - DNA, 1056 bp, Artificial Sequence
  Description of Artificial Sequence: Synthetic coding sequence
atggtgctgagccaggacggcagcgtgcagagcggcttcctggccgaggggcatctggatggccagcctttcctgcgctatgaccgacagaagcggcgagccaaacctcagggtcagtgggcggaggatgtgctcggagccaaaacctgggacaccgaaacggaagatctcaccgagaacggccaggatctgcgccgaacgctaacccacattaaggaccagaaagggggattacatagtctgcaggagatccgcgtgtgcgaaatacatgaggactcctccacaagaggaagtagacacttctactatgacggcgagttatttctgagccagaatctcgaaacccaggagagtaccgtcccacagtcttctagagcccagactctcgctatgaatgtgacaaacttttggaaagaggatgctatgaaaaccaagacacattacagggccatgcaggccgactgtctacaaaagctgcagagatacctgaagagcggagtggctataagacgaacagtcccacccatggtcaatgtgatatgcagcgaggtgagcgaaggtaatatcacagtgacctgccgcgcatccagcttttacccaaggaacatcactctaacttggcgacaagatggggtttcccttagccataacactcagcaatggggcgacgtgctgcccgacggcaatggcacctatcaaacatgggtagctacacggattagacagggcgaggaacaacggtttacatgctatatggaacattctggaaaccacggcacccacccagtcccaagcggcaaagccctggtgcttcaatcccagcggaccgatttcccttatgtgtctgcggccatgccttgcttcgtgatcattattattctgtgtgtgccctgctgcaaaaagaagacttccgcagcagagggtcccgagctggtctcactgcaggttttggaccaacatcccgtcggtactggagatcatcgggatgcggctcaattgggcttccagccccttatgagtgccacaggctccaccgggtcaaccgagggtacctag

SEQ ID NO: 195067 - DNA, 126 bp, Artificial Sequence
  Description of Artificial Sequence: Synthetic coding sequence
atgggcctgggccgggtgctgctgttcctggccgtggccttcccctttgcccccccagcagccgctgccgtagagatgggtttccaccgggtcagccaggatggtttggatctacttacatcttag

SEQ ID NO: 195068 - DNA, 126 bp, Artificial Sequence
  Description of Artificial Sequence: Synthetic coding sequence
atgggcctgggccgggtgctgctgttcctggccgtggccttcccctttgcaccccctgctgccgctgccgtcgagatggggttccaccgcgtttcccaggatggactcgacctcctcactagctag

SEQ ID NO: 195069 - DNA, 1056 bp, Artificial Sequence
  Description of Artificial Sequence: Synthetic coding sequence
atggtgctgagccaggacggcagcgtgcagagcggcttcctggccgaggggcacctcgacgggcagccctttctgcggtatgatcgccagaaaagacgagccaaaccacagggacagtgggcggaaaatgtcctgggcgcgaaaacgtgggatacagaaaccgaagatctgacggagaacggccaggacttgcgacgtactttgacccacattaaggaccagaagggaggactgcatagcctacaggaaatccgcgtgtgcgagatccacgaagactccagcaccaggggtagtcgtcatttttattacgatggcgagctgtttctatcacagaatctggaaacccaagagagtactgtgccacagtccagccgagcacagaccctggccatgaatgttactaacttttggaaggaagacgcgatgaagacaaagacccactaccgtgcaatgcaggctgattgccttcagaagttacagaggtacttgaaaagtggagtggcgattaggagaactgtgccccctatggtgaacgtgacatgttctgaagtttccgaagggaacatcacagtcacctgccgggcctcgagcttctaccccaggaatattacacttacatggcggcaggacggagtttcattaagtcataatactcagcagtggggtgacgtgttgccggatggcaacggaacctaccagacttgggtggcaacccggatccgccaaggagaagagcaaagatttacctgctatatggagcattctgggaaccacggaacacacccggtcccaagtggcaaagctttagtcctccagagccagcgtactgattttccatatgtaagcgccgcgatgccatgttttgtaatcatcatcatcttgtgcgtgccttgctgcaaaaagaagacatccgcagctgaagggcctgagctggtttcacttcaagtcctggaccaacatcctgttggcactggcgatcaccgggatgctgcacagttgggcttccagcccctgatgtccgctactggttcgactggttcgaccgaggggacttag

SEQ ID NO: 195070 - DNA, 126 bp, Artificial Sequence
  Description of Artificial Sequence: Synthetic coding sequence
atgggcctgggccgggtgctgctgttcctggccgtggccttccccttcgcacctcctgcagctgctgctgtcgagatgggattccatcgcgtttcacaagatgggctagatctgctcacatcctag

SEQ ID NO: 195071 - DNA, 126 bp, Artificial Sequence
  Description of Artificial Sequence: Synthetic coding sequence
atgggcctgggccgggtgctgctgttcctggccgtggccttcccctttgccccccccgcagctgccgccgtggaaatgggtttccatcgcgtatcccaggacgggttggacctgctcacgtcctag

SEQ ID NO: 195072 - DNA, 1056 bp, Artificial Sequence
  Description of Artificial Sequence: Synthetic coding sequence
atggtgctgagccaggacggcagcgtgcagagcggcttcctggccgaaggacacttagatgggcagccttttctgcggtacgatagacaaaagagacgcgccaaacctcagggccagtgggcagaggatgtgctcggagccgagacatgggataccgagactgaggacctgaccgagaacgggcaggacttgcgaagaactctgacccacataaaagaccaaaagggggggctgcatagccttcaggaaattcgtgtgtgtgagattcatgaagacagtagcactcgcggttcccgccacttctactataacggcgagctgttcctgagccagaacctcgagacccaggaaagcacagtgccccagtcttcccgggcacagactttagctatgaatgtgactaatttctggaaggaggatgccatgaaaaccaagactcactatcgggccatgcaggccgactgcctccagaaactgcagaggtacctaaaatccggggtcgctatccggaggactgtgcctccaatggtgaatgtgacctgcagcgaggtgtccgagggcaacatcacagtcacctgcagagcctcctctttttatcctcgtaatattaccctcacctggagacaggatggagtgagcctgagccataacactcagcagtggggtgacgtactgcctgatggaaacggcacatatcaaacgtgggtggctacacgcattcggcaaggtgaagaacagcggttcacgtgttacatggaacatagcggaaaccacggcactcacccagtgcccagtggcaaggccctggtacttcagtcacagcgtactgattttccctatgtgagtgcagctatgccctgttttgtcatcatcataatattatgcgtgccttgttgcaaaaagaagacctcagctgcagaggggcctgagcttgtgtccctccaggtcctggatcagcatccagttggcacgggagaccacagagatgctgctcagctcgggttccagccgctaatgtccgctaccggcagcaccggttccaccgaaggtgcctag

SEQ ID NO: 195073 - DNA, 2088 bp, Artificial Sequence
  Description of Artificial Sequence: Synthetic coding sequence
atgagcccccccaaggaccccagccccagcctgcccctgcccagcagttcgtcacacagtagcagccctccttctagcagctccacctcagtgagtggcaacgcgccggatggcagctctccaccccagatgacagcatccgaaccattgtctcaggtctcaaggggtcatccaagtcccccgacacctaatttcaggcgtcgcgccgttgcacagggggccccacgggaaatacccctatacctcccccaccacccgaagccagaatgggccgagtattgtctggtcagcccaggggaggatggcctttccgatccagctgagatgacaagcgacgaatgtcagcctgccgaagcccccctgggggacattgggagtaatcaccgcgatccccatccgatttggggcaaggaccgctcgtggaccggccaggaactgtcgccactagctggtgaggatcgggagaagggaagtaccggtgctcggaaagaagaagaaggcggaccagtgctggtgaaagagaagctcggtctgaaaaagctggttctgactcaagagcagaagaccatgttattagactggaatgacagcattccagaatcagtgcatctgaaagccggagagcggatctcacaaaaatccgctgaaaatgggcggggtgggcgcgtacttaagccagtgaggccgctattgcttccacgcgctgcaggggagcctctgcccactcagcgtggcgcacaggaaaagatgggcacaccggcagaacaggcacagggtgagcggaacgtaccccccccaaagtcaccacttcgtcttatcgccaacgcaatcaggaggagcctggagccgttgctgtctaacagtgagggaggcaaaaaggcttgggctaaacaggaaagtaaaacacttcccgcccaggcatgcactcggtccttttccctgcgcaaaaccaactccaataaggacggcgaccagcacagtccaggccgcaaccagagctcggccttctcccctccagacccggcgctgaggacacactccttacccaatcgcccgagcaaggtgtttcccgcgcttaggagtcctccatgctccaagattgaggatgtgccaacattgctggaaaaagtttctttacaagaaaatttccccgacgcctccaagccaccaaaaaaaaggatatctctgttttcaagtctgagactgaaggacaaaagctttgagtcatttctgcaggaatccaggcagcggaaagatattagggacctgttcggcagccccaagagaaaggttttgccagaggactctgcacaggcgctagagaagctgctgcagccattcaagagcacatcactgagacaggccgccccgccgccgccacccccgcctccacctcctccgcctccccccacggcggggggtgcagattccaaaaattttcctctgagagcccaggtaaccgaagccagctcatctgcctcttctactagctctagctctgccgatgaggagttcgatccccagctttctctccagctcaaagaaaagaagacattgcgccgtagaaagaaactcgaaaaagcgatgaagcagctcgtgaaacaggaggagctgaagaggttatacaaggcgcaagcgatccaaagacaactcgaagaagtggaggagcgacagcgagcctctgagattcagggggttcggctggaaaaggccctgcgaggtgaggctgacagtggcacccaggacgaagcccagttgctgcaggaatggttcaagctggtcctggagaagaataaactaatgaggtatgagagcgaattgctgattatggcacaggagctggaactggaggatcaccaatctaggctggaacagaagttgcgcgaaaagatgctcaaagaagaaagtcagaaggatgagaaggatcttaacgaggagcaggaggtgttcaccgagctaatgcaggtgatagagcagcgcgacaagttggtcgactccctggaggagcagagaatcagagagaaagccgaggaccaacactttgaatctttcgttttttctaggggttgccagctctcgaggacttag

SEQ ID NO: 195074 - DNA, 90 bp, Artificial Sequence
  Description of Artificial Sequence: Synthetic coding sequence
atgagcccccccaaggaccccagccccagcctgcccctgcccagcagctcttctcactcttcttctcctccctcctcgagtagcacatag

SEQ ID NO: 195075 - DNA, 522 bp, Artificial Sequence
  Description of Artificial Sequence: Synthetic coding sequence
atgagcctgctgggccccaaggtgctgctgttcctggccgccttcatcattacttcagattggattcctctgggcgtgaacagccaaaggggagatgatgtaacccaggctactcctgaaaccttcaccgaggatccaaaccttgtgaatgaccctgctaccgacgagaccgttctggctgtgctcgctgatattgccccatcaactgacgatctggccagtctgagtgaaaaaaacaccacagctgaatgctgggacgagaaattcacttgtacgcgactgtactctgtccatcgccccgtgaaacaatgcattcatcaactctgttttactagcctccggcggatgtacatcgtgaacaaagaaatatgtagcagacttgtctgtaaggaacatgaggcaatgaaggacgaattatgtagacagatggccggactcccaccgcggcgccttcgacgcagcaattacttccgtctgcccccgtgtgaaaatgtggacctgcagagacccaacggcctctag

SEQ ID NO: 195076 - DNA, 492 bp, Artificial Sequence
  Description of Artificial Sequence: Synthetic coding sequence
atgagcctgctgggccccaaggtgctgctgttcctggccgccttcataataacctccgattggatccctctgggtgtcaactcccagcgcggcgacgacgtcacacaagccaccccagaaacttttacagaagatcctaacctggtaaatgacccggcaaccgatgaaactgtcctagctgtattagctgacatcgctccatctacagatgacctggagtgctgggacgaaaaatttacatgtactcggctctactcagtccatcgaccagttaagcagtgtattcatcagctctgtttcacatccctgcgccggatgtatatcgtcaacaaggagatttgttcccggttggtctgtaaggaacacgaggctatgaaagacgaactgtgtcgccagatggcagggctgccgcctagacgtttgaggcggtctaactactttaggctgcccccctgcgaaaacgtggacttacagaggcctaatggtctctag

SEQ ID NO: 195077 - DNA, 447 bp, Artificial Sequence
  Description of Artificial Sequence: Synthetic coding sequence
atgagcctgctgggccccaaggtgctgctgttcctggccgccttcatcatcaccagcgattggattcctctgggagtgaactctcagcgcggcgacgacgtgacacaagcaacacccgagacctttacagaggatcctaacctcgttaacgaccctgccactgacgaaacagaatgctgggacgaaaagtttacctgcactcgattatacagcgtacacaggcccgtaaagcagtgcatccaccagttgtgtttcaccagccttagaaggatgtacatcgtgaacaaagagatttgcagccgcctggtctgtaaggaacatgaggccatgaaagatgagttgtgcagacagatggctggtttgccaccaaggcgcttgcgacgttcaaactactttcgcctgccaccgtgtgagaatgttgatctccagaggcccaacgggttgtag

SEQ ID NO: 195078 - DNA, 492 bp, Artificial Sequence
  Description of Artificial Sequence: Synthetic coding sequence
atgagcctgctgggccccaaggtgctgctgttcctggccgccttcattattaccagcgattggattccactgggtgtgaacagtcagcggggtgacgacgtgacccaggccaccccagagactttcacagaagaccccaatctcgttaacgaccccgctaccgatgagaccgttctagcggtcctggccgacattgcacccagcacggatgacttagaatgttgggacgagaaatttacatgtactcggctgtacagcgttcaccggcccgtcaagcagtgcattcaccaactctgctttacctccttgcggcgcatgtacatcgtgaacaaggagatctgcagccggttagtctgcaaagagcacgaggcaatgaaagacgaattgtgtcgtcagatggctggactgcctccacggcggctgaggcggtctaattattttcgactgccaccttgtgagaacgtggacctgcaaaggcctaacggactgtag

SEQ ID NO: 195079 - DNA, 276 bp, Artificial Sequence
  Description of Artificial Sequence: Synthetic coding sequence
atgagcctgctgggccccaaggtgctgctgttcctggccgccttcataattactagtgattggatccctctcggcgtaaatagtcagaggggggacgacgtgacacaggccacccccgagacttttacagaagatcctaatctagtcaacgatcccgcgacagacgagaccgtcctggccgtgttggctgacatcgccccaagcactgatgatctagcctccctctccgaaaaaaacaccacggccgaatgttgggacgaaaagttcacatgctag

SEQ ID NO: 195080 - DNA, 1320 bp, Artificial Sequence
  Description of Artificial Sequence: Synthetic coding sequence
atgagcgtgcccagcgccctgatgaagcagccccccatccagagcaccgctggtgctgttcctgtcagaaacgagaaaggggagataagcatggaaaaggtaaaggtgaagagatatgtgtctggcaagcggcctgactacgcccccatggagtcctccgatgaagaggacgaggaattccagtttatcaagaaggccaaggaacaggaagccgaacctgaagaacaggaagaagactccagctccgaccccagactgaggaggcttcagaacaggatctctgaagatgtcgaagagagacttgccagacaccgaaaaatcgtagagccagaggtcgtaggtgaatcggattcagaggtggagggagatgcctggcgcatggagagagaggattccagcgaagaggaagaggaggagatagatgatgaagaaatcgagcgtagacgcgggatgatgcgccagagggcccaggagaggaagaatgaagagatggaagtgatggaagtcgaagacgaaggacgctcaggcgaagagtccgagtctgagagcgagtatgaggagtacactgattccgaggacgaaatggagccacgtcttaagcccgtcttcattcgaaagaaagatcgggttactgtacaggaaagggaggccgaggccctgaagcagaaggagctcgagcaggaagccaaaagaatggcagaggaaagaagaaagtataccctgaagatcgtagaggaggaaaccaagaaggagttagaagaaaacaaacgctctttggccgcattagacgcactgaatacagatgacgaaaatgatgaggaagagtatgaagcctggaaggttagagaactgaaaagaatcaaacgtgatcgggaagaccgagaggccctggagaaagaaaaagcagagatcgagcggatgcgcaacctgaccgaggaagagagaagggccgaactgcgcgcaaatgggaaggtcattacgaataaagccgtgaaaggaaagtacaagtttctacagaagtactaccatcgcggtgccttttttatggacgaagacgaagaagtgtacaaacgcgacttcagtgcccctactctcgaggatcacttcaataagactatcttgccaaaagtgatgcaagtgaagaattttggcaggtctggcaggaccaagtatacgcatctggtggaccaggacactacttctttcgactcggcctgggggcaagagtcagcgcagaacaccaagttcttcaaacaaaaagctgctggggtccgggatgtttttgaacggccttccgccaaaaagagaaagaccacctag

SEQ ID NO: 195081 - DNA, 549 bp, Artificial Sequence
  Description of Artificial Sequence: Synthetic coding sequence
atgcgggccgcctacctgttcctgctgttcctgcccggcctgctggcacaaggtcagtatgatctcgaccccctgcccccgttccctgatcacgtccaatacacccattacagcgaccagatcgataatccagactattacgattaccaagaggtgaccccacggccatctgaggaacagtttcaattccagagccaacagcaagtacagcaggaagtgatccccgcccccacacctgaaccggggaacgcagagctcgagcccaccgaaccaggacccctcgattgccgggaagaacagtatccgtgcactaggctgtactctatccacagaccctgtaaacaatgcctgaacgaggtttgcttctactctttaagacgagtatatgtcatcaacaaggaaatttgcgtgaggactgtgtgtgctcatgaggaactcttgagggccgacctctgcagagataaattcagcaagtgcggcgtgatggcatctagcgggctgtgccaaagtgtggcggcatcctgtgccaggtcatgcggttcatgttag

SEQ ID NO: 195082 - DNA, 552 bp, Artificial Sequence
  Description of Artificial Sequence: Synthetic coding sequence
atgcgggccgcctacctgttcctgctgttcctgcccgccggcctgctcgctcagggccagtatgacttagacccgctccctccttttcccgaccacgtgcagtatacgcattatagcgaccaaattgataacccagattattatgattaccaggaggtgacccccagaccgagcgaggagcagtttcagtttcagtcccaacagcaggtgcagcaggaggtgatccccgcccctacccctgagccaggcaacgctgagctcgagcccaccgagccaggaccccttgattgtagagaggaacagtatccatgtacgaggttgtattctattcacagaccatgcaagcagtgcctgaatgaggtttgcttctattccctccgccgggtctatgtgataaacaaagaaatatgcgtcagaacagtttgtgcacacgaagagttgctccgagcggatctatgtcgggacaaatttagcaagtgcggggtgatggcatcctcagggctctgtcagagtgtggctgcaagctgtgcccggtcctgcggctcttgctag

SEQ ID NO: 195083 - DNA, 549 bp, Artificial Sequence
  Description of Artificial Sequence: Synthetic coding sequence
atgcgggccgcctacctgttcctgctgttcctgcccggcctgctggcacaggggcaatatgatctggaccctctgccaccgttccccgatcatgtgcagtatacacattatagcgatcaaatcgataatcctgattactatgattaccaagaggtgactccgaggccgagtgaagagcagtttcagttccagagccagcaacaggttcaacaggaggttatccccgccccaacgcccgaaccaggcaacgcggaactcgaacccaccgagcctggccctttagattgtcgagaagagcagtacccttgtacacgactttatagcattcataggccttgtaaacaatgcctgaatgaagtgtgcttttatagcctcaggcgcgtgtatgtgattaacaaggagatctgcgttcggaccgtttgcgcacatgaagaattattgcgcgccgacctttgcagagacaagttctctaaatgtggcgtgatggcttcctccggtctctgccagtccgtggccgcctcatgcgctcggtcatgtggaagttgttag

SEQ ID NO: 195084 - DNA, 1089 bp, Artificial Sequence
  Description of Artificial Sequence: Synthetic coding sequence
atgaagctgcactgctgcctgttcaccctggtggccagcatcatcgtgcccgcggctttcgtgctggaggatgtggattttgaccagatggtgtctctcgaagctaaccgcagttcctataacgcctcttttccttccagcttcgaactctccgcgtcatcacattcagatgacgatgtcattattgccaaggagggaactagtgtgagcatcgagtgcttgctaaccgcctcccactacgaggacgtacactggcataacagtaaaggtcaacagctcgatggccgctctcggggaggaaagtggctggtttctgataactttcttaatatcacaaacgtggcctttgacgatcggggcctttatacttgcttcgtgaccagcccaatcagagcttcttactccgtgacactgcgcgttatatttacatccggcgacatgagcgtgtactatatgatcgtctgtctgattgcctttacaattactttgattctgaacgttactcgtctgtgcatgatgtctagccatctgagaaaaacagagaaggctatcaatgaattctttcggacggaaggtgccgaaaaactgcagaaggcatttgagatagccaagaggatccccatcataacatcagcgaagactcttgaactggctaaggtcacacagtttaaaaccatggaatttgcccgttacatagaggagctggctcgttccgttcctctgccgccactcatcttgaactgtcgtgctttcgttgaagaaatgtttgaggcggtaagagttgatgaccctgacgacttaggagaacggattaaggagaggccagcccttaatgctcaaggcgggatttacgtgataaatcctgagatgggaagatccaattctcccggtggtgatagcgatgatggctccttgaatgagcaaggacaggaaatcgcagtccaggtctcagtccacctccagtctgagaccaagagcatcgacacagagtcccagggttcatctcatttttcccctcccgatgatattggcagcgcagagtctaactgtaactacaaagacggggcatacgagaattgccagttatag

SEQ ID NO: 195085 - DNA, 1089 bp, Artificial Sequence
  Description of Artificial Sequence: Synthetic coding sequence
atgaagctgcactgctgcctgttcaccctggtggccagcatcatcgttcccgcagctttcgttcttgaggacgttgatttcgaccagatggtctccttagaagcaaaccgaagctcttacaatgcatctttccccagtagttttgagctcagcgcatcctcgcactccgatgacgatgttatcatcgcaaaagagggtacttccgttagtattgaatgtcttttaacagccagccattatgaggatgtgcattggcacaacagcaaaggacagcaactggatggcaggtctagaggtggcaagtggctggtgagcgataactttctgaatatcactaatgtcgcttttgacgataggggattgtatacatgcttcgttacatccccaattcgcgccagctacagcgtcacattacgcgtcatttttaccagcggagacatgtcggtctattacatgatcgtctgtctgatcgccttcacaattacgctgattttaaacgtgaccaggctctgcatgatgagcagtcatctcaggaaaactgagaaggcgataaacgaatttttccgtacagagggggcagagaagctccagaaggcctttgaaatcgccaagcgcattcctataatcacctctgctaaaacgctcgagcttgctaaggtgactcaattcaaaacaatggagtttgcgagatacatcgaggagctggcacgttcagtgcctctcccccccctgatactgaattgtcgggctttcgtagaagagatgtttgaagctgtgcgggtggacgatcctgatgacctcggggagcggatcaaggaacggcccgccctcaatgcacagggaggcatatatgtgattaatccagaaatgggccgatccaactcccccggaggcgattccgacgatggtagcttgaatgaacaagggcaggaaattgcagtgcaagtctctgtacatttgcaatctgagacaaagagtatcgataccgaaagccagggctcttcacacttctcccctcctgatgatattgggagtgccgagtcaaactgcaactataaagacggagcctacgaaaactgccagctctag

SEQ ID NO: 195086 - DNA, 651 bp, Artificial Sequence
  Description of Artificial Sequence: Synthetic coding sequence
atgagcgtgtactacatgatcgtgtgcctgatcgccttcaccatcactcttattcttaacgttaccaggctgtgcatgatgagtagccacctgcgaaagacagaaaaagctatcaatgaattttttagaacagagggagccgaaaagctgcagaaagcgttcgaaattgccaagcggatacccattatcacctcagctaagaccctggagctcgcgaaggtcacccagtttaaaaccatggaatttgcaagatacatcgaagaacttgcccgatcagtgcccctacccccgctgattttgaactgtagagcctttgttgaggagatgttcgaagctgtgcgggtggacgacccagacgaccttggtgagcgaattaaggagcggcctgccctgaatgctcagggcggtatctacgttattaacccagagatgggacggagcaattcacccggcggggactctgatgacggctccctcaacgagcagggacaggagattgcagtgcaagtctcggtgcacctgcagagcgagaccaaatctatagatacagagagccaaggctcttcccattttagtccacccgacgatatcgggagtgccgagtctaattgcaactacaaggatggcgcctacgagaactgccagctgtag

SEQ ID NO: 195087 - DNA, 54 bp, Artificial Sequence
  Description of Artificial Sequence: Synthetic coding sequence
atgaagctgcactgctgcctgttcaccctggtggccagcatcatcgtcccctag

SEQ ID NO: 195088 - DNA, 330 bp, Artificial Sequence
  Description of Artificial Sequence: Synthetic coding sequence
atgaagctgcactgctgcctgttcaccctggtggccagcatcatcgtgccagcagctttcgttcttgaggacgtcgactttgaccaaatggtaagcttggaggccaatagatcatcctataacgcgtcctttcccagcagttttgagctctcagcttcatctcactcagacgacgatgttattatagctaaggagggaaccagtgtaagcatcgaatgtctgctcacagcctctcactacgaggatgtgcattggcataacagcaagggccagcagctggatggcaggagccgtggaggaaaatggcttgtatcggacaattttctctag

SEQ ID NO: 195089 - DNA, 372 bp, Artificial Sequence
  Description of Artificial Sequence: Synthetic coding sequence
atgaagctgcactgctgcctgttcaccctggtggccagcatcatcgtcccagccgccttcgtgctggaggacgtggacttcgatcagatggtgtctttagaagccaacagatcgtcatacaatgcctcttttccgagctctttcgaactctccgcctctagccatagcgacgacgatgtgataatcgccaaagaaggtacatctgtgtctattgagtgcctcctgactgctagccactacgaagacgtacattggcataattccaaaggccaacagctggatgggaggtctcgcggcggcaaatggctggtgtctgataacttcctcaatataactaacgtggcatttgatgaccggggtctctacacttag

SEQ ID NO: 195090 - DNA, 768 bp, Artificial Sequence
  Description of Artificial Sequence: Synthetic coding sequence
atgaaggccctgctggccctgcccctgctgctgctgctgagcacccctccatgtgcgcctcaggtgtctggaattcgaggggacgctcttgagaggttctgcctgcagcagcctctggattgcgacgacatctatgcccagggttatcagtcggatggcgtgtatctcatatacccctccggaccctcagtcccagtaccagtattttgtgacatgacaactgaaggcggtaaatggacagtttttcagaagagatttaacgggagtgttagtttctttcgtggatggaacgattacaaattggggtttggaagggctgatggcgagtattggctgggcttgcagaacatgcacctacttactctcaaacagaagtatgaactgcgggtcgatcttgaggattttgaaaacaacacagcctatgccaagtacgccgatttttcaatctctcccaacgctgtcagcgccgaagaggacgggtacactctcttcgttgccggatttgaggacggaggcgctggggattcgttgtcctatcatagtggtcagaagttctcaacgttcgatcgcgaccaggatctgtttgtccagaattgtgccgccctatcttctggagcattctggttcagatcctgccacttcgctaatctcaacggtttttacctgggcggctctcacttgtcttacgcgaatggaattaattgggcccagtggaaaggcttttattacagtctgaagcggaccgagatgaagattcggagggcgtag

SEQ ID NO: 195091 - DNA, 840 bp, Artificial Sequence
  Description of Artificial Sequence: Synthetic coding sequence
atgggcgagctgagccccctgcagcggcccctggccaccgagggcactatgaaagcccagggtgttttgctaaaattggcgctgttagctctgcctctgctccttttgttgtccacccccccttgcgcaccccaggtgagcggaatccgcggagacgcgctggaacgcttttgtctccagcagcctctggactgcgacgatatctacgcacagggctaccagtctgatggagtctacctgatctacccaagcggcccctccgtcccagtaccagtcttctgcgatatgaccacggagggggggaagtggaccgtgttccagaaacgctttaacggctccgtctctttctttcgcggctggaatgactataagttgggatttggaagagcagacggtgagtattggttggggctgcagaacatgcacttactgacattaaagcagaaatatgagctccgtgtggatctcgaggatttcgagaacaacaccgcctatgcgaagtacgcagactttagtatcagccctaatgccgtgtcagccgaagaggacggctacacactcttcgtggcgggtttcgaggacggcggggctggagatagcttgagttaccacagcggacagaagttctccacatttgatcgcgatcaggatctgtttgtgcagaactgcgctgccctgagctctggcgctttttggtttcgcagctgtcacttcgccaatcttaatggattctatctggggggcagtcacctctcatacgccaacggtattaattgggcccagtggaaaggattctattactcactcaagcgcactgagatgaagatacggcgtgcctag

SEQ ID NO: 195092 - DNA, 468 bp, Artificial Sequence
  Description of Artificial Sequence: Synthetic coding sequence
atggtggacctgacccaggtgatggacgacgaggtgttcatggccttcgcctcctacgctacgatcattttgtctaagatgatgttaatgagcacagcaactgcgttttatcgcctcacccgcaaggttttcgccaatccggaagattgcgtagcctttggcaaaggcgagaatgcaaaaaaatacttacgcactgacgaccgagttgaaagagttaggcgggcccacttgaatgacctggagaatataattcctttcctgggcatcggactgctctattctctcagcggaccagatcctagcacagctatacttcatttcagactctttgtgggagctagaatttaccacacaatagcttatttgacacctttgccacagcccaatcgggctttatctttctttgttggctatggcgtgaccctgtcaatggcctacaggctgctcaaatcaaagctgtacctttag

SEQ ID NO: 195093 - DNA, 468 bp, Artificial Sequence
  Description of Artificial Sequence: Synthetic coding sequence
atggtggacctgacccaggtgatggacgacgaggtgttcatggccttcgccagttacgctacgattatcctgagcaaaatgatgctgatgagcactgcaaccgcattctacaggcttacccgcaaggtgttcgctaaccctgaggattgcgtcgcttttggcaaaggggagaacgccaagaagtatctgcgcactgacgaccgggtagaacgtgttagaagagctcacctgaatgaccttgagaacataatccccttcctgggcatagggctgctctattctctaagtggtccagatccgtcaaccgccatattacattttaggcttttcgtaggcgcacgaatttaccacaccatagcttacctcacacccttgccccagccaaatcgagctttgtcctttttcgtggggtacggagtcacccttagcatggcctaccgtctgctaaaaagcaaactgtacctgtag

SEQ ID NO: 195094 - DNA, 468 bp, Artificial Sequence
  Description of Artificial Sequence: Synthetic coding sequence
atggtggacctgacccaggtgatggacgacgaggtgttcatggccttcgcgagttatgcgactattatccttagcaaaatgatgctgatgagtaccgctactgccttctaccggctcaccaggaaagtgttcgcaaaccccgaggattgcgtggcttttggaaagggtgagaatgccaagaaatacctgcgcacggatgatcgcgtggagcgggtaagacgggctcacttgaacgatctggagaatatcatcccttttctgggaatcggactcctgtacagtttgagcgggcctgacccctccaccgccatattgcatttccgtctgtttgtcggcgcccggatctatcacacaatcgcttacctgacccctctgccgcagccaaatcgggcattgagcttttttgttgggtatggagttaccctgtctatggcctatcgcctgttaaagagtaagttgtatctgtag

SEQ ID NO: 195095 - DNA, 468 bp, Artificial Sequence
  Description of Artificial Sequence: Synthetic coding sequence
atggtggacctgacccaggtgatggacgacgaggtgttcatggccttcgctagctacgcaaccatcattttatcaaaaatgatgctgatgagtacagcgacagccttctaccgtctcacacggaaggtgtttgcaaatccggaagactgtgtggcatttgggaaaggcgagaatgccaagaagtatcttcggactgacgatcgggtggaacgcgttcgaagagctcacctgaacgacctggagaacataattcctttcctgggcatcggtttgctgtactctctctccggcccagacccaagcaccgccatcttacattttaggctgttcgtgggggccaggatttatcacactatcgcttacctgactcccctgcctcagcctaacagagcgctctcctttttcgtggggtacggcgtgactctgtccatggcttaccgactcctcaagagcaaactatacctgtag

SEQ ID NO: 195096 - DNA, 234 bp, Artificial Sequence
  Description of Artificial Sequence: Synthetic coding sequence
atggtggacctgacccaggtgatggacgacgaggtgttcatggccttcgcaagttatgccacgattatcctgtcaaaaatgatgctgatgagtacggccacggccttctaccgtctaacccgaaaggtgttcgccaatccggaagactgtgttgccttcggcaaaggagaaaatgccaagaagtacttgaggaccgatgatcgcgtggagcgcgtccgaagagcacacctgtag

SEQ ID NO: 195097 - DNA, 129 bp, Artificial Sequence
  Description of Artificial Sequence: Synthetic coding sequence
atggtggacctgacccaggtgatggacgacgaggtgttcatggcctttgctagttatgcgacgattatcctgtcgaagatgatgcttatgtcgacggccactgccttctatcggctgactaggaagtag

SEQ ID NO: 195098 - DNA, 243 bp, Artificial Sequence
  Description of Artificial Sequence: Synthetic coding sequence
atggtggacctgacccaggtgatggacgacgaggtgttcatggcctttgccagctacgcgaccataatcttgtccaagatgatgctcatgtccactgctacggcattctatcgcttgaccagaaaggtgttcgccaatcccgaagattgcgtcgcattcgggaaaggggagaacgcaaaaaaatacctccgtaccgatgaccgagttgaacgagtgcggagggcccatctcaacgacctttag

SEQ ID NO: 195099 - DNA, 264 bp, Artificial Sequence
  Description of Artificial Sequence: Synthetic coding sequence
atggtggacctgacccaggtgatggacgacgaggtgttcatggccttcgccagctacgccaccatcatcctgagtaagatgatgttgatgtccaccgccacggccttctatcgattgacccggaaagtctttgctaaccctgaagactgtgtggccttcggaaagggcgaaaatgctaaaaagtacttgaggaccgacgaccgagtggagcgagtgcgccgcattaagcaaacactgtctatttatctcgccagcagcatatag

SEQ ID NO: 195100 - DNA, 444 bp, Artificial Sequence
  Description of Artificial Sequence: Synthetic coding sequence
atggccggcaacagcatcctgctggccgccgtgagcatcctgagcgcttgtcagcagagttactttgccctacaggtgggcaaggcacgcctgaaatacaaggtgacaccgcctgcggtaactggtagccctgaattcgagagggtcttccgcgcacagcaaaattgtgtggagttttaccctatcttcatcataacgctgtggatggccggttggtacttcaatcaggtatttgcaacctgcctggggctagtgtatatttacggtagacatctgtacttctggggttattctgaagcagcgaaaaaaagaatcacggggtttcggctatccttgggaatccttgctttgctgactctactaggcgccctggggattgcgaactcattcctcgacgagtacctcgacctcaatatcgccaagaagttgagaaggcagttttag

SEQ ID NO: 195101 - DNA, 444 bp, Artificial Sequence
  Description of Artificial Sequence: Synthetic coding sequence
atggccggcaacagcatcctgctggccgccgtgagcatcctgagcgcgtgtcagcagtcctatttcgcccttcaggtcggaaaagccagattaaaatacaaggtgactccccccgccgtgaccggcagcccagaatttgagagagtgttccgcgcccagcagaactgtgtcgagttctaccccatcttcataatcacgctctggatggccggatggtacttcaatcaggtgttcgccacttgcctgggactggtttacatctacgggcggcatttatacttctgggggtacagtgaggcagccaagaagagaatcactgggttccgactgagcctggggatcctggcactgctcacactgctcggcgccctgggtattgccaattctttcttggacgagtatctcgatctaaatatcgcaaagaagctgcgacgacaattctag

SEQ ID NO: 195102 - DNA, 234 bp, Artificial Sequence
  Description of Artificial Sequence: Synthetic coding sequence
atggccggcaacagcatcctgctggccgccgtgagcatcctgagcgcctgccagcagtcttattttgctctacaagttggcaaagcacgcttgaaatacaaagtcacccctcccgccgttacagggagtcccgaattcgagagagttttccgggcccatttttgttacctgtccggaagcggcgtccatatttggcctagtcccattcttctgggaatatttagatcttgctag

SEQ ID NO: 195103 - DNA, 501 bp, Artificial Sequence
  Description of Artificial Sequence: Synthetic coding sequence
atgccctggcggggccggcggttccggctgtgccggcggaagatggccgtcctctctaaggagtatggattcgttctcttgaccggtgccgcaagcttcattatggtagcgcatctcgcaattaacgtgtctaaggcccgtaaaaagtacaaagtggagtatcccatcatgtacagcacggaccctgaaaatggtcacatcttcaactgcattcagcgtgctcatcagaacacgctggaggtgtatcctcccttcctgtttttcctggcggtgggaggcgtgtaccatccccgaattgcctcaggcctgggcttggcgtggattgtgggcagggtcctgtacgcctacggttactataccggggagcctagcaagaggtccagaggagctctaggatcaatcgccttgcttggcctagttggtacaaccgtttgctccgctttccaacacctgggctgggtgaagtctggactgggatccggccctaaatgctgccactag

SEQ ID NO: 195104 - DNA, 459 bp, Artificial Sequence
  Description of Artificial Sequence: Synthetic coding sequence
atggccgtgctgagcaaggagtacggcttcgtgctgctgaccggcgccgcctcgttcatcatggtggctcacctcgccataaacgtctcaaaggcaaggaagaagtacaaggtggagtatcctatcatgtactcgaccgacccagaaaacggtcacattttcaattgtatccagcgagcgcaccagaatacactggaagtttatcctcccttcctgttctttcttgctgttggaggtgtctatcatccccgcatagcctcagggctgggactggcctggattgtaggaagggtactgtatgcatacggatattacaccggcgaaccctccaaaagatctcgaggagctcttggtagcatagctctgttgggactcgtcggaacgaccgtgtgttctgcttttcagcatttgggttgggtgaaatcaggtctcggctcgggacccaaatgttgccattag

SEQ ID NO: 195105 - DNA, 501 bp, Artificial Sequence
  Description of Artificial Sequence: Synthetic coding sequence
atgccctggcggggccggcggttccggctgtgccggcggaagatggctgtactttcgaaggaatacggatttgtgttattgacgggagcagccagttttattatggtggcccatctagctattaacgttagcaaggctcgcaaaaaatataaagtcgaataccctattatgtattcaacagaccccgagaacggtcacatcttcaattgcatccagagggctcaccagaatacccttgaggtttacccaccgttcctgtttttcctcgcagtcggaggagtgtaccacccacgcatcgcatccgggttgggtctggcctggatagttggaagagtattgtatgcttatggctattatactggcgagcccagtaagcggagccgcggcgccttagggagcatcgcactcctgggcctggtgggtacaacagtgtgttcagcattccaacatctcggatgggtgaaatcaggccttgggagtggaccaaagtgctgtcattag

SEQ ID NO: 195106 - DNA, 501 bp, Artificial Sequence
  Description of Artificial Sequence: Synthetic coding sequence
atgccctggcggggccggcggttccggctgtgccggcggaagatggccgtgctttcaaaagaatatgggttcgtcttactgaccggagcagctagttttattatggtggctcaccttgctatcaacgtgagcaaggcaaggaaaaaatacaaggtggaatatcccattatgtactctacggaccctgagaacgggcacatttttaattgtatccagcgggcacaccagaacacactcgaggtctatcctccgtttcttttcttcttggcagtgggcggcgtctatcacccccggatcgcctccgggctcggtctggcttggatagtaggcagagtgctgtatgcttatggatactacacaggagagccgtccaagaggagtaggggggcactgggctccatcgcactactcggcctggtcggaaccacggtttgctctgctttccagcacctcggctgggtgaagtcggggctcggatcaggaccgaaatgttgtcactag

SEQ ID NO: 195107 - DNA, 459 bp, Artificial Sequence
  Description of Artificial Sequence: Synthetic coding sequence
atggccgtgctgagcaaggagtacggcttcgtgctgctgaccggcgcagcaagtttcataatggtggcccatctggctatcaatgtgtccaaagcaagaaagaagtacaaagtcgaataccccatcatgtactccacggaccccgagaacggtcacatttttaactgtattcagcgcgcacatcaaaataccctcgaggtgtacccacctttcctattcttcctagctgttgggggggtctatcacccgagaatcgctagtggactcggactggcttggattgtgggacgggtcctgtacgcctacggatattacactggtgagccctcgaaaagaagcaggggggctcttggttccattgccttgttaggccttgtaggtaccacagtgtgctccgccttccagcaccttggctgggtgaaatcaggcctaggttcaggtcctaaatgttgccactag

SEQ ID NO: 195108 - DNA, 501 bp, Artificial Sequence
  Description of Artificial Sequence: Synthetic coding sequence
atgccctggcggggccggcggttccggctgtgccggcggaagatggccgtcctgagcaaagagtacgggtttgtgctgctaacgggggcagcctcatttataatggtagcccacttggccataaacgtcagcaaagcacgcaagaagtacaaagttgagtacccgatcatgtattctactgatcctgagaatggccatatcttcaattgtattcagcgcgcccaccagaacaccctggaggtatatcctccttttctattcttcttagctgtcggtggtgtttaccacccacggattgcctccggcctgggcttggcttggatcgtgggacgggttctctatgcttatggatattatacaggtgaaccatcaaagaggtctcgcggtgccctcggtagtattgctctcttaggcctggttggcaccactgtttgttccgcttttcaacacctggggtgggttaaatcagggctgggctcaggccccaagtgctgtcactag

SEQ ID NO: 195109 - DNA, 972 bp, Artificial Sequence
  Description of Artificial Sequence: Synthetic coding sequence
atgccccggctgaccttcgcccccaagggctggccccacccccccacttcacttcattggtggttatttcaagaacttccgactccttcagagaatagcatgcctcccgggctgagcacaccaactgcttcacaggagggcgcaggacccgtcccagatcctagtcagccgacacgcagacaaattagactctctagcccggaacgacagcgactgagttcgctgaatctgacccctgaccccgagatggaaccacccccaaagccccctaggagctgtagtgcactggcccggcacgcattagagtcctccttcgttggttggggactgcctgtacaatctcctcaggccctggtggccatggagaaagaagaaaaagagtcacctttttcctcggaggaagaagaggaagatgtcccactggacagcgatgtagaacaggccctccagacgttcgcgaagacctccggtaccatgaataactatcctacatggcgccgcactttgttaaggcgggctaaggaagaagaaatgaaaaggttctgtaaggcccagacaattcagcgacgactgaatgagattgaggccgcgctcagggaattagaggccgagggcgtgaagctggagctggcacttcgccgacaatcctccagcccagagcaacagaagaagctgtgggttggtcagctgttacaacttgtagataagaagaattctctcgttgcagaagaggcagaactcatgatcacggtccaagaactgaatcttgaggaaaagcagtggcaattggatcaagagctcaggggctatatgaatagagaggaaaatcttaagacggccgccgataggcaggccgaagaccaagtgctgcggaagctagtcgatctggttaaccagcgggacgccctcattagattccaagaagagcggagattaagtgaactcgcactgggaactggcgcccaaggctag

SEQ ID NO: 195110 - DNA, 2946 bp, Artificial Sequence
  Description of Artificial Sequence: Synthetic coding sequence
atggccagccccaccagcaccaaccccgcccacgcccacttcgagtctttcctccaggcccagctctgccaagatgtgctttcttccttccaggaactatgcggtgccctagggttggagccgggcgggggactgccacagtaccacaagattaaagaccagctgaattattggagcgctaaatcattatggacaaagctggataaacgggccggacagccagtgtaccagcagggacgagcctgcaccagcacaaaatgcctagttgtcggagccggaccttgtgggttgcgtgtcgccgtggagctggccctgctgggggcccgggttgtccttgtagaaaaacggacaaagttttctcgacacaacgtgttgcacctctggccgttcaccatccatgaccttagagcactcggagcaaaaaagttttatggccgattttgcacaggtactctggaccatatctcaatcaggcaactgcagctccttcttctgaaggtagctctgcttcttggggtggagattcattggggcgtgacatttactggtttgcagccacctcctcgaaaaggttcaggctggagggctcaattgcagcctaatcctcccgctcagctggccaactatgagtttgatgtgctcattagcgccgcagggggaaagtttgtgccggagggtttcaaagttcgggaaatgcggggcaaacttgctattggtatcaccgcgaactttgtcaacggcagaaccgtcgaagaaacccaggtgcctgagatctctggcgtggcgaggatctataaccagagctttttccagtccctgctgaaggccacgggcattgacctagagaatattgtctactataaggatgatactcactatttcgtcatgacagccaaaaaacagtgtctgctgaggctgggtgttctgcggcaacccttttggccgttaggaaccggggtggcgcggggctttctcgctgccttcgacgctgcatggatggttaagcggtgggctgaaggggcagaatccctggaggtcctggccgaacgtgagagtctatatcagcttctcagtcaaacatccccggaaaacatgcatcgaaacgtggctcagtacggcttggacccggccactcggtaccctaacctgaatctgagggccgtcaccccgaatcaagtgcgggacctgtatgatgtactcgccaaagaaccagtgcagcggaataacgataaaaccgatacgggaatgccagccactggcagtgcaggcacccaggaggaacttctgcgctggtgccaggagcagactgccggctaccctggcgttcacgtgagtgatttatcctcctcctgggccgatggcctggcactatgcgccctggtttatcgactgcagccaggcctgctcgagccaagcgagttacaaggcctcggcgctctggaagcaaccgcctgggcactgaaagtcgcggaaaacgaactggggatcactccagttgtgagcgcacaagcagtggtggccgggtctgaccccctcggtctgatcgcatatttgtcccatttccattctgcattcaaaagtatggcccatagccccggcccggtctcacaggccagccccgggacctcatctgcagttctgttcttgagcaaactgcagcgaactctccaacgctctagagcaaaggagaacgccgaagacgccgggggtaagaagctgagattggagatggaggcagagacgccttctactgaagttcctcccgacccagagcccggcgtgccactcacaccccccagccagcaccaggaggccggtgcaggtgatctgtgtgccctgtgtggggagcacctctacgttctggaaaggctttgcgtgaatgggcatttttttcataggtcctgctttaggtgccatacctgtgaagcaacactctggcctggtggctatgagcagcaccctggggatggtcacttttactgtcttcaacacttgccccagaccgatcataaggcggaaggctccgaccgcggacctgaaagtcccgaattgcccacccccagcgaaaattccatgcccccagggcttagcacacccaccgcatcccaggagggcgcagggcctgtccccgacccaagccagccaaccagaaggcagatcaggctgagctctcccgagagacaacggctcagcagcctcaacctgactcctgacccagagatggagcccccccctaaacctcctcggagctgttccgctctcgcccgacatgcgttggaatctagttttgtgggctgggggctgcccgtccaatccccccaggctctcgtagctatggagaaagaagaaaaggaaagccccttttccagcgaggaggaagaagaagacgtcccactggacagcgacgtggaacaggccctccagaccttcgccaagacgtctggaacaatgaacaactatcccacctggcgcaggactcttctgcgtagggctaaggaggaggagatgaagcgattctgtaaggctcagacaatccagcggcggctgaatgagatagaggccgcgcttagggaattggaagctgaaggcgtcaagctggagctggccctgcgtcgtcagtccagctctcctgagcaacaaaagaaactttgggtcgggcagctgctacagctggtagacaaaaagaacagcctggtggccgaagaagccgagctcatgattacagtgcaggagctcaaccttgaagaaaaacagtggcagctcgaccaggagctcagggggtatatgaaccgcgaagaaaacctgaagacagcagccgacaggcaagcggaggatcaggttctgaggaagctcgtggatctggtgaaccagagggatgctctgattcggtttcaggaagaacgtcggttgagtgaactggccttgggtacgggagcccagggctag

SEQ ID NO: 195111 - DNA, 3204 bp, Artificial Sequence
  Description of Artificial Sequence: Synthetic coding sequence
atggccagccccaccagcaccaaccccgcccacgcccacttcgagagtttcttacaggcccagctgtgtcaggatgttctctcctctttccaggaattatgcggcgctctaggcttggagccaggtggggggctaccgcaatatcacaaaattaaagaccagcttaactattggagcgccaagtccctctggacaaaacttgacaaaagggcaggacagccagtttatcagcaggggagggcttgtaccagtaccaaatgcctcgtggtcggcgctgggccgtgtggcctgcgtgtcgctgtggagctggcattgctgggggcaagggtcgtgttggtggagaagcgaacaaaattcagccggcacaatgtgctgcatttatggcccttcacaatccatgatctccgcgcattaggagccaagaagttctacggccgcttctgtacaggtactttagaccacatatcaatccgccagctgcagctgctgttgctgaaagtggctcttctcctgggcgtggagatccactggggagtgacattcaccgggctgcagccccccccccggaaagggtctggctggagggcccagttacagccaaacccccctgcccagctcgcaaactacgaatttgatgttctcatctcagccgctgggggcaaattcgtgcccgagggattcaaggtgagagagatgcggggcaagcttgcaatcggtattactgccaacttcgtgaatggtcggacagtggaggagacccaggtgcctgaaatttctggagttgccaggatttacaatcaatccttttttcagagccttctgaaggcaacaggcattgaccttgaaaatatagtttattataaggacgacactcactacttcgtgatgaccgcgaagaaacagtgcctgctccggctgggcgtgctgagacaggactggccagatactaatcggctcctgggatccgcaaacgtcgtccccgaagcgctccagcgcttcacacgtgcagcggccgatttcgcgacacacggaaagcttggaaaactggaattcgcacaagatgctcatgggcagcccgacgtcagcgcttttgacttcacttcaatgatgagagcggagtcaagtgcacgggttcaggagaaacatggagctagacttcttctcggtttagtcggagattgcctggtagagcccttctggcccctaggaacaggagtggccaggggctttctcgccgcctttgatgccgcgtggatggtgaagcggtgggccgagggtgctgaaagtcttgaggttctggctgagcgcgaaagcctgtatcagttgctttcccagacatctcccgagaacatgcatcggaatgtagctcagtacggacttgacccagcaactcgctaccccaacctgaacctgcgggccgtgactcccaaccaggtgagagacctgtacgacgtcttggcaaaggaacccgtgcagcggaacaatgataaaacagacaccggcatgccagctaccgggtccgccgggacccaggaggagttgcttagatggtgtcaggagcagaccgccggctaccccggcgttcacgtcagcgatttatcttctagttgggctgacggactcgccctgtgtgccctagtgtatcgccttcaacctggtctgttagagccctcagaactccagggactcggcgctcttgaagcgacagcctgggctctgaaggtggctgagaatgagctgggaattacccccgtcgttagtgcacaggcagtggtcgcggggagcgatccacttgggcttatcgcttacctgagccattttcactccgctttcaagtcaatggctcatagccccggccctgtgtcccaggcgtcacctgggacaagtagcgccgtgctcttcttgagcaaactgcagcgcacactgcagcgatcccgggcgaaggaaaatgccgaggatgccgggggcaagaaattaaggctcgaaatggaagcagagaccccttcaaccgaggtaccacccgacccagaaccgggtgtgccactgacacccccctctcagcatcaagaggctggtgcaggggacctctgcgccctgtgcggggagcatctgtatgtactggagcgcctttgcgttaacgggcattttttccatagaagttgtttcagatgtcatacgtgcgaggcaacgctgtggccaggcggttatgaacaacaccctggggatggtcacttttactgcttacaacacctgccccaaacagaccataaagcggagggcagtgatcgaggacctgagtcacccgaattgccgacacctagtgaaaacagtatgccacccggactgtccactcccacagcaagtcaagaaggagcggggcccgtaccagatcccagccagccaaccaggaggcagatacgcctgtcctcgcccgagagacagcggcttagctctctgaacctaacacctgaccctgagatggaaccgccccccaaacctccgaggtcttgttccgccctggcacgtcatgccctggagtctagtttcgtgggatgggggctccctgtgcagagcccccaggcactagtcgctatggagaaagaagagaaggaatcccctttttcgtcagaggaagaggaggaggacgttccactggactcagacgtcgagcaggcactgcagaccttcgctaagaccagcggaaccatgaataattatcccacatggcggcggaccctcctccggcgtgctaaggaggaagagatgaaaagattttgtaaggctcaaacaatccaacgacgtttaaatgagattgaggctgctctgagggaattggaggccgagggcgtcaaactggagctggcactgaggagacaaagtagtagtcccgaacagcagaagaagctgtgggttgggcagttactgcaactggtagataaaaagaactctctggtagctgaagaggctgagctgatgattacagtgcaggagctgaatctcgaagagaaacagtggcagctggaccaagagctgagaggctacatgaaccgagaggagaatcttaagactgcagcagataggcaagccgaggatcaggttcttcgtaaacttgtcgacctggtgaaccagagggatgcactcatcaggtttcaggaggagcggcgactctctgagctcgcactgggcacaggggctcaggggtag

SEQ ID NO: 195112 - DNA, 3261 bp, Artificial Sequence
  Description of Artificial Sequence: Synthetic coding sequence
atgagctgcctgagccacagcagcctgcccagctgctgccccccccaagaagcctctatggcatcccccacgtcaactaacccagcccacgcgcatttcgaaagctttttgcaggcgcagctgtgtcaggacgtgctgtctagtttccaagagttgtgcggagctttgggactggagcccggcggcgggctaccccaataccacaagatcaaagatcagctgaattactggagcgctaagagcctgtggacaaaactggataagcgtgcgggccagccagtataccaacagggacgcgcctgtacatctaccaagtgtcttgtggtgggtgccgggccctgcgggctccgagttgccgtcgaactggcattattaggcgcaagagtagtactggtcgagaaacggacgaagttcagccggcacaatgtcctgcacctgtggcccttcaccatccacgacctgcgcgctctcggagctaagaagttctatggcagattctgtaccggaactttagaccacatctcaatccgacagctgcagttattactgctaaaggtggcgctcctcctgggagtggagatccactggggcgtaacgttcaccggcttgcagccacctcctcgtaagggatctgggtggagagctcaactccagcccaatcccccagcccagctggccaactacgaatttgatgtccttattagtgcagctggcggcaagtttgtgcccgaagggttcaaagtaagggaaatgcggggtaagttggctataggaattactgcgaatttcgtgaatgggaggaccgtggaggagacgcaggtccccgaaatctccggggttgcgagaatttacaatcagagcttttttcagagcttgttaaaggccacgggcatagaccttgagaatatcgtgtattacaaggacgatactcattatttcgtaatgacggcaaaaaagcaatgtctgctaaggctcggagtccttcggcaggactggcccgatactaacagattactgggttccgctaacgtggttcccgaggcacttcagcgttttaccagggcagctgcagactttgcgacgcacgggaagttaggaaagctggagtttgcccaggatgcacatggacaacctgatgtgtctgcttttgactttactagtatgatgagggctgagagcagcgctagggtccaggagaagcacggggctcgcctccttttgggcttggttggcgactgcctggtcgaacccttctggccccttggaactggggtggccaggggtttcctcgctgctttcgatgccgcgtggatggttaagaggtgggctgaaggtgcggaatctcttgaagtactggcagaacgagaaagcctgtatcagctgttgtcacaaacctcgccagagaacatgcatcgtaacgttgcccagtacggcctggatcccgccacccgatatcctaatcttaatcttcgggcggtgacaccaaatcaagtccgggacctgtatgatgtgctggccaaggaaccggttcagaggaacaacgataaaacagacacagggatgcccgccactgggtccgcgggcactcaggaagagcttctccgatggtgccaggagcagacggctggctacccaggtgttcatgtatcagacctgtcctcatcctgggctgatggcctcgctctatgtgcactggtttaccgccttcaacctggactgctggagccttccgagcttcagggtttgggcgcactggaagccactgcctgggccctgaaggtggccgaaaacgagcttggaattaccccagtggtctccgcgcaggcggtagtggcagggagcgaccccttagggttgattgcttatctctctcattttcactcagcctttaagtcaatggcccactcccccggcccagttagtcaggcttcaccaggtacctcaagcgccgtcttattcctcagcaagctccagagaacgctgcaacggagccgggcaaaagaaaatgcagaggacgcaggcggaaagaaactgaggctggagatggaggctgagacaccatcaactgaggtgccccccgatccggagcccggcgtacccttaacccccccatcccagcatcaggaggcaggcgctggagatttatgtgctctttgcggcgaacatctgtacgtgctagagagattgtgcgttaacggccatttttttcataggagttgcttcaggtgtcacacatgcgaggccaccctgtggccgggcggctacgagcaacatccaggggacggccacttttattgcctgcaacacctgccacagacagatcataaagcggagggctcagaccgaggacctgagtcacccgagttaccaactccctcggagaactccatgcctccagggctgtcaactccgacagcaagccaggaaggggcgggtcctgtgcctgacccctctcagccaactagaagacagatccgcctcagttcccctgagagacagcgactttctagtctcaacctgacacccgatcccgagatggaaccccctccgaagcctccaaggtcatgttccgccctggcccggcacgctctcgaatcatccttcgtgggatggggcttacctgtgcagagccctcaagcactggtggccatggagaaggaggagaaagaatcgcctttctcaagcgaagaggaagaggaggatgtgcctttggactcagatgtagagcaggctcttcagacttttgccaaaactagcggaactatgaacaattatccaacatggagaagaaccctgctgagaagggcgaaagaagaggagatgaagcggttttgcaaagcccaaactatccagcgtaggttgaacgagatcgaggctgcccttcgggagctggaggctgagggggtgaaactggagctcgccttgcgtcgccagtcttcctctccagaacaacaaaagaagctctgggtcgggcaactgctgcagctagtggataagaagaatagcctggtcgcagaagaagctgaacttatgataacggtacaagagttgaacctggaagagaaacagtggcagctggatcaggaattgaggggctacatgaacagggaggagaacttgaaaaccgcagctgacagacaggccgaggaccaggtgctgcgtaaactggtggacttagttaatcaacgagacgccctgattcgattccaggaggagcgacgtttgtctgagttggctcttgggactggcgcccaagggtag

SEQ ID NO: 195113 - DNA, 1776 bp, Artificial Sequence
  Description of Artificial Sequence: Synthetic coding sequence
cccaagtacgtgctgcccagcgaggcccaggtggtgcccgccaagcagctccagccgcaggacagatcatctgtacccgagcactctctgctggcaggcactcaggaggaattgctcagatggtgccaagagcagacggccggttaccctggcgtccatgtgagcgacttaagttcgagttgggctgacggtctcgctctttgtgcactcgtctataggctccagcctggactgttggagccatctgagctgcaaggtttaggcgctcttgaggccacagcttgggcgctgaaggtggccgaaaatgagctgggaatcacccctgtggttagcgcccaagccgtggtggccgggtccgacccactgggcctgattgcctatctgtcccatttccatagtgcatttaagtcaatggcacactcgcccgggccggtgagccaggccagccccggaacatcgtccgcagtgctctttctgtccaagctgcagcgaactctccagcggtccagggcaaaagaaaatgcagaggacgccggaggaaagaagctcaggctggagatggaggccgagactccgtccactgaagtgcctccggatccagaaccaggcgtgcccttgacacctcccagccaacaccaggaggccggagccggggatctgtgtgccttatgtggcgagcacttgtacgtgcttgagcgcctgtgcgtgaatgggcatttctttcacagatcttgctttcgttgtcatacctgtgaagctactttgtggcccggaggctacgaacaacatccaggggatgggcatttctattgtctgcagcaccttccccagaccgaccacaaggctgagggttccgatcggggtcctgaaagcccagaactccccacacctagcgagaattccatgccaccagggctctctacccccaccgcctcccaggagggcgccggccctgtccccgatccttcccagcccacaaggcgacagatcagactcagcagtcctgaacggcagaggttgagctccctgaacctcacccctgaccctgagatggaacctcccccaaaacctccacggtcatgcagcgctctggcacgccacgctctcgagtcttcctttgttggatggggcttgcccgtacaatcaccccaggccctggttgcaatggaaaaggaggaaaaggagtcaccgttttcaagcgaagaagaggaggaagacgttccacttgacagcgatgtcgagcaggcacttcagacgtttgccaaaacctcaggtactatgaataactatccaacatggcggaggacattattaaggcgcgccaaagaggaagaaatgaagcggttctgtaaggcacaaacgattcagcggcgcctcaatgagatagaagccgccctccgggagctcgaagcggagggagtcaagcttgagcttgctctccgccgacagtctagcagccccgagcagcagaagaaactgtgggtgggccagctactacagcttgtggacaagaaaaattcacttgtcgctgaagaggcagagttgatgattacagtccaggaattaaatctcgaagaaaagcagtggcagctcgaccaagagttgcgtgggtatatgaatcgggaagagaacctgaagaccgccgctgacagacaggccgaagaccaggtcctcagaaaactggtggatttggtcaatcagagggacgctctgatcagattccaggaggagcgcaggctgtctgagctggccctcgggacaggagcacaaggctag

SEQ ID NO: 195114 - DNA, 735 bp, Artificial Sequence
  Description of Artificial Sequence: Synthetic coding sequence
atggccagccccaccagcaccaaccccgcccacgcccacttcgagagttttctgcaggcccagttgtgccaagatgttttgtcaagtttccaggagctgtgcggagcgttagggctcgaacccggggggggattaccgcaataccacaagattaaggaccagctaaattactggagtgccaaaagcctgtggactaagctagacaagagagctggccagcccgtctatcagcagggtagagcctgcacctccaccaagtgcctggtagtgggtgcgggcccttgtgggcttagagtggcggtcgagttagctctgttgggggccagggtagtcctggtggagaaaagaacaaaattctctcgtcacaatgtattgcacttgtggcccttcacaattcacgatctgagagcacttggagccaaaaagttttatgggagattctgcaccggaactttggatcacatctctattcgccaactccagctcctcctcctgaaggtcgcactgctcctcggagttgagattcactggggcgtgacgttcaccggactccagccccccccacgcaagggctctggatggagggcccagctccagccaaatcctcccgctcagctagctaattacgagtttgatgttttaatcagcgccgccggaggcaagttcgtgcctgagggcttcaaggtgagagagatgcgtggaaaattggctatcggcatcacagcgaacttctag

SEQ ID NO: 195115 - DNA, 3375 bp, Artificial Sequence
  Description of Artificial Sequence: Synthetic coding sequence
atgggcgagaacgaggacgagaagcaggcccaggccggccaggtgtttgaaaactttgtgcaggccagcacttgtaagggcacacttcaggccttcaatattctcaccagacacctggacctcgaccccttagatcacagaaatttctattccaaactgaagtcaaaagttacaacatggaaagccaaggccttatggtacaaactggacaaacgcgggagccataaagagtacaaaagaggcaagtcatgcactaacactaaatgtttaatcgtcgggggggggccttgtggactccggactgcaatcgaactggcctatctgggtgccaaggtcgtggtggtggagaagcgggattcgttctctcggaacaatgtcctccacctgtggccatttaccatccacgaccttcgcggactcggagccaagaaattttacggtaaattttgtgccggttctatcgaccatatatctatccgccagctgcagctaatattgtttaaggtcgctttgatgctgggtgttgaaatacacgtcaatgtcgagtttgttaaggtactcgagcctcccgaagaccaggagaatcaaaaaattggatggagggcagaatttttgcctacagatcactcgttgtcagagttcgagttcgatgtgattattggcgccgacggacgccgaaacaccctcgaggggtttaggaggaaggaatttcgtggcaaactggccatcgctatcacggctaacttcatcaatcgcaactctacagctgaagcaaaggtggaagagatcagcggtgttgcctttatattcaatcagaagttttttcaggatcttaaagaggaaacagggatcgaccttgaaaacatcgtctactacaaggattgtactcactacttcgtgatgactgccaagaaacagtctttgctggacaaaggggtaatcattaacgactatatagatacagaaatgttgctctgtgcagagaatgtaaatcaggataacctgctgtcctacgctcgcgaggccgccgacttcgctacaaattatcaactgccctccctggacttcgctatgaatcactacggacaacctgacgtcgccatgtttgacttcacttgcatgtatgcctccgagaacgctgcactggtccgcgagcgacaggcacaccaactactggtggccttagttggtgatagcttgctcgagcccttttggccaatggggaccggctgcgctcggggattcttggccgccttcgatacagcctggatggtgaagtcgtggaaccagggcaccccacctttggagctgttggcagagagagagagcctctatcgcctgcttccccagaccacccctgaaaacatcaacaaaaactttgagcagtataccctcgatcccgggacacgatacccgaacctgaacagccactgtgtgcgccctcaccaggttaaacacctgtacatcactaaggagctggagcactatcccctggaaaggctgggttctgtacggcgatccgtgaatttgagtaggaaggaatctgacatccggcccagcaagttgctaacttggtgccagcagcagacggaaggctaccagcacgtaaatgtgacggaccttaccacgtcttggaggagtggcctagccctctgcgctataattcacaggttccgacccgaactgatcaacttcgatagtttgaatgaagacgatgccgtcgaaaacaatcagctcgccttcgatgtggctgaacgcgagttcggtatcccacctgttaccaccggaaaggaaatggctagtgctcaggagcccgacaagctgtcaatggttatgtatctgtccaagttttatgaactgttccgggggactccacttcgcccagtggactcctggcgcaaaaactacggagaaaacgcagatctgagtctcgcgaagagctccatttccaataattatctgaacttgacatttccacgaaaaaggacccctagggtagatggccagaccggtgaaaacgacatgaacaagcgcagaagaaagggttttactaaccttgacgaaccctccaacttcagctccagatcgcttggctccaaccaggagtgtggttcatccaaggaaggcgggaaccaaaataaagtgaagtccatggccaatcagctcctggctaagtttgaagagtcaactcgcaacccctccctaatgaagcaggagcgccgagtgtctggcatcggtaaaccagtactttgttcctccagtggaccgccagtgcactcttgttgccctaaaccagaagaggctacaccttccccatccccccccctgaaacggcagttccctagcgttgtcgtgaccggacacgtcctgcgtgagctgaagcaggtgtcggccggctctgagtgtctctctagaccatggcgcgccagggccaaatccgacctgcagcttggcggcactgagaatttcgctactctgccaagcacccgtcccagggcccaggctctttccggtgtgctttggcggctgcagcaagtagaggaaaagattcttcagaagcgtgcacagaaccttgccaatcgagagttccataccaaaaacatcaaggagaaggccgcacatctcgcctcaatgtttggccatggcgattttccccagaataaattactctctaaggggctgtctcacacccatcctcctagtccccctagccgcctccctagccctgacccggccgcgtcctcttctccctccacggtcgactctgcctcgcccgctcgcaaagagaaaaagagtccttcgggcttccattttcaccctagccacctcagaacagtgcacccacagctgactgtgggtaaggtgtcctcaggaattggggctgccgcagaggtcctggtaaatctttacatgaatgatcatagaccaaaggcgcaggccacttctccagatctagagtctatgcgtaaaagctttcccctgaacttaggcggaagcgacacctgctatttttgtaagaaacgagtttacgttatggagcgcctgtctgcggaaggtcattttttccaccgtgaatgtttcaggtgtagcatttgtgcaaccaccctgagactcgccgcgtacacttttgattgtgacgagggaaaattttactgcaagccccacttcatccactgtaagaccaactccaaacagagaaaacgacgggcagaacttaaacagcagagggaagaggaggccacctggcaggagcaagaagcccctcgacgcgacacacctactgaatcaagctgcgctgtggcagctataggtacgcttgagggcagcccacctgtgcacttctccctcccggtactgcaccccctgctgggatag

SEQ ID NO: 195116 - DNA, 3312 bp, Artificial Sequence
  Description of Artificial Sequence: Synthetic coding sequence
atgggcgagaacgaggacgagaagcaggcccaggccggccaggtgttcgaaaattttgtgcaagcgtccacttgtaaggggaccctacaagcattcaacatcctgactcgtcacctcgatttggacccactggatcatagaaacttctatagcaagctgaagtcaaaggtaactacttggaaagctaaagctctctggtacaaactagataaaaggggaagccataaagaatataaaagagggaagtcctgcaccaacactaagtgcttgattgtcggcggcggaccctgtggcttacgcaccgccatagagctggcatatcttggagcgaaggtagtagtggtagaaaaaagggattccttctctcgcaataacgtgttgcatctgtggccatttacaatccacgatttgcgtggtctgggcgcaaaaaagttttacggaaagttttgcgctggctccatcgatcacatttccattcggcagctacagctaatactgttcaaggtggccttgatgctcggcgtcgagatccacgtgaacgtggaatttgtgaaggttctggaaccccctgaagaccaggagaatcaaaaaattggctggagggcggagtttctgcccacagaccattctctgtcagagtttgaatttgatgtgatcataggtgctgatggccgccggaacactctggagggtttcagacggaaggagttcaggggcaaactggctatcgccattactgccaactttattaatagaaactccacagccgaggccaaggttgaggagataagcggagtcgccttcatattcaatcagaagttttttcaagatctgaaggaagagacaggcatcgatctggaaaatattgtgtattacaaagattgcacacactatttcgtgatgaccgccaagaaacagtctttgttggataagggagtgattattaacgattatatagacaccgaaatgttactctgtgcagaaaatgttaaccaagataacctccttagctatgccagggaggcagctgacttcgccaccaactaccagcttccttcactcgacttcgcaatgaatcattacggtcaaccagatgttgccatgtttgactttacatgtatgtatgcctctgagaacgctgcgctggtccgggaaaggcaggcacatcaactccttgtggccctggtcggagatagcctgctcgaaccattttggcctatggggaccggctgcgcacggggctttctggccgccttcgacaccgcatggatggtgaaaagctggaatcagggcacgccgccactggaattacttgccgaacgcgaatctctctatcgacttctcccccagacaacacctgagaacattaataaaaacttcgaacagtacacccttgatcccggaactcggtatcccaatctaaacagtcactgtgttcggccacaccaggtgaagcacctttacatcacgaaggagctagaacactatcctttggaacggctcgggtccgtccgtcgctctgtcaacctttctcggaaggagtccgatatccgtcctagtaagctgcttacctggtgccagcaacagactgagggatatcaacatgtcaatgtgacggacctcacgacgtcttggcgcagtggcttggcactgtgtgccattattcaccgctttcgccccgaactgatcaactttgacagcttgaatgaagatgacgcagtggagaacaatcagctggctttcgatgtggcggagagggagtttggaattccaccagtcacaactggaaaagagatggcaagtgcgcaggaacccgacaaactgtccatggtgatgtacctgtctaagttctacgagctttttcggggaactccgctcaggcccgttgactcttggagaaaaaactatggcgaaaacgcagatttaagcctcgcgaaatcttccatctcgaacaactatctgaatctcacattcccaagaaaacgcacaccaagggtcgatgggcagactggcgaaaatgatatgaataaacggcgaagaaaaggattcactaatctggatgaaccttcgaacttctcatctcggtctttggggtccaaccaggagtgtggatcatctaaggagggcggtaaccagaacaaagtcaagagcatggccaaccagttgctggccaagttcgaggagagcaccagaaacccctccttgatgaaacaagaacgtagagtgagtggcatcggaaaacccgtcttgtgttcctctagtggacccccagtccatagctgttgtcccaagccagaggaagccaccccatcaccctccccacctctgaaaagacagtttccttccgtggtcgtgacagggcacgtgctgcgagaactaaagcaggtgagcgctggatcagagtgtcttagccgcccctggcgggcaagggccaaatctgacctgcagttgggcggaacagaaaattttgccaccctccctagcacacggccgcgcgcgcaggccctgagcggtgtcctttggcgtcttcagcaggtcgaagaaaaaattttacaaaaaagagctcagaacctagctaatagagaatttcatacgaaaaatatcaaagagaaggcagctcatctcgcaagcatgtttgggcatggggatttccctcagaacaagctcttatctaaaggcctctcccacacccaccccccatcccctcctagcagactcccctcaccggatcctgccgctagcagctcaccatcaactgtggactctgcgtctcccgctagaaaattgactgtgggcaaagtgtccagtgggatcggcgccgcagcagaagtgctagttaacctttatatgaacgaccaccggccaaaagcccaagccacatctccagatctcgaatcaatgcgaaagtcgtttcctttaaatctgggcggaagtgatacctgctacttttgcaagaagagggtgtacgtgatggaaaggttgtccgctgagggccacttttttcacagggagtgctttcggtgttccatttgtgcgactactctacgcctcgctgcatatacgtttgattgtgatgaggggaagttttactgcaagccccactttattcattgcaagaccaacagtaagcagcggaagcgtcgtgccgagcttaaacagcagagagaggaggaagcaacgtggcaggagcaagaggctcctcgccgggacacacccaccgaaagctcctgtgccgtcgccgcaatcggaacattggaaggatccccaccagttcatttcagcctaccagtgttgcatcccctgctgggatag

SEQ ID NO: 195117 - DNA, 2931 bp, Artificial Sequence
  Description of Artificial Sequence: Synthetic coding sequence
atgggcgagaacgaggacgagaagcaggcccaggccggccaggtgttcgagaacttcgtccaggccagcacctgcaagggtacccttcaggcgtttaacattcttacgcgtcacctggatttggaccccctggaccatagaaacttctatagcaagctcaagagtaaggtgacaacgtggaaggccaaggcattgtggtataaactcgataaacgagggtcccataaggagtacaaacggggtaaatcatgcactaacacaaagtgcttgatcgtggggggtggcccgtgcggcctccggaccgctattgagctggcgtacctcggcgcaaaggttgtcgtcgtcgaaaaaagagatagttttagccgcaacaacgtgctgcatctgtggccattcactatacacgacctccggggactcggagcgaaaaagttctacggaaagttctgcgccggttccattgatcatatcagtatccggcaattacagctcatcctgttcaaagtcgccctcatgttgggcgtggagatccatgtgaatgtggagttcgtgaaagtgctggagccccccgaagaccaggagaaccaaaagataggatggcgcgccgaattcctgccaactgaccattccttgtcagaattcgagtttgatgtgattattggcgcagacggaagaagaaataccctagagggctttcgtcggaaagaattccggggcaagctcgccatcgctataaccgccaacttcattaacagaaactccactgcagaggctaaagtggaggagatcagcggtgtggcgtttattttcaaccagaaattttttcaggacttgaaggaggaaaccgggatcgacttggagaacatcgtgtactacaaagattgtactcattatttcgtcatgaccgctaagaagcagtcgcttttggacaagggagtgatcattaacgattacatcgataccgagatgcttctctgcgccgagaacgtgaaccaagacaatttattaagttatgcacgggaagcagccgatttcgctactaattatcagttgccttccctcgatttcgcgatgaatcactatgggcagcctgatgtggctatgtttgattttacctgtatgtacgcctctgagaacgccgcactggtgcgcgagcggcaggcccatcagcttttggtcgctttagtgggggactctttactcgagcctttttggcctatgggcactggctgcgcccgggggttcctggctgcttttgatacagcctggatggtgaagagctggaatcaaggaacccccccccttgagcttctggcggagagggaatctctgtaccgcctgttgccgcaaacgaccccagagaacatcaacaaaaacttcgaacaatatacactcgatcctggaactcgttacccaaacctgaattcccattgtgttcgcccgcaccaggtaaagcacttatacatcaccaaagagctggagcattacccccttgaaaggttggggtccgtacgacggagcgttaacctgtctagaaaggaaagcgatatacggccatccaagttgcttacctggtgccagcagcagacagaagggtaccaacacgtgaacgtgaccgacctgaccacatcctggcgctcaggactcgctctgtgcgccattatccataggtttaggcctgaattgattaactttgactcattgaacgaagacgatgccgtggagaacaaccagctggctttcgatgtagccgaaagagagtttggcatccccccagtcaccacaggcaaagagatggccagcgcacaggaacccgacaaattaagtatggtgatgtatttgtccaaattctacgaactgtttagggggacacccctcagacccgtggacagctggaggaagaattacggcgaaaatgccgaccttagcctggccaagtcctctatttctaataactacctcaatttaacctttccacgaaaacggactccacgagtcgacggacagactggagaaaacgacatgaataaacggaggaggaagggcttcaccaacttggatgagccatctaatttcagttccagatcattaggatctaatcaggagtgtggcagcagtaaggagggaggtaaccaaaataaggtgaaatcaatggctaaccagcttctggctaagtttgaggagagtactcggaatccatccctaatgaagcaggaaaaaaaaagcccatcaggcttccattttcatccctcacacctgagaacagttcacccccaggaaagcatgcgcaaaagttttcccctcaacctgggcggatctgacacatgctatttttgcaagaaaagagtctacgtgatggagaggctgtctgccgagggtcactttttccaccgggaatgcttcaggtgcagcatctgtgccaccaccttgagactggcggcttacacattcgattgcgacgagggcaagttttattgtaaaccacattttatccactgtaaaacaaattccaagcagagaaagagaagagcggagctcaaacagcagcgcgaagaggaggccacttggcaggaacaggaagcccctcgacgggataccccgacggaatccagctgcgccgttgctgcgattggaaccctcgagggatcccctcctggaatctccacatcgttctttaggaaagtgctaggctggcccttgcgattgccccgcgatctttgcaattggatgcagggtctcctccaggcagccggattgcatattagggacaacgcgtataattactgctatatgtacgaattgctctctctcggacttcctcttctgtgggcattttccgaagtattggcagcgatgtacagagaatccgaagggtccctagaaagcatttgtaactgggtactgagatgttttcctgtaaaactgcgctag

SEQ ID NO: 195118 - DNA, 363 bp, Artificial Sequence
  Description of Artificial Sequence: Synthetic coding sequence
atgggcgagaacgaggacgagaagcaggcccaggccggccaggtgttcgaaaactttgtgcaggcaagtacatgcaaaggcaccctccaagcctttaacattctcaccagacacttggatctggatcctctagatcatcgcaacttctacagcaaactaaagagcaaagttacaacatggaaggctaaggctctgtggtataagctcgataaaaggggctcacacaaagagtacaagcgggggaaatcctgcactaacacaaaatgtctgatagtagggggaggaccctgtggccttcgcactgcaattgagctagcttacctcggagctaaagtagtcgttgttgaaaaaagggattcgtag

SEQ ID NO: 195119 - DNA, 405 bp, Artificial Sequence
  Description of Artificial Sequence: Synthetic coding sequence
atgggcgagaacgaggacgagaagcaggcccaggccggccaggtgttcgaaaacttcgttcaagcatccacttgcaaaggcacattgcaggcttttaacattcttacacggcacttagacctcgacccccttgatcatagaaacttttattccaagctcaaatccaaggtcactacatggaaagcaaaggcactgtggtataaactggataagagaggatcacataaagaatataaacgagggaagtcctgtaccaacaccaagtgcctcatagtcggcggcggtccttgcggtctccggactgcaattgaacttgcttacctaggcgcgaaggtcgttgtcgtcgagaagcgggattcttttagtcggaataacgtgttgcatctgtggccatttacaatatag

SEQ ID NO: 195120 - DNA, 267 bp, Artificial Sequence
  Description of Artificial Sequence: Synthetic coding sequence
atgggcgagaacgaggacgagaagcaggcccaggccggccaggtgtttgagaacttcgtgcaggctagcacctgtaagggtaccctgcaggcttttaatatcctgacccgacatctcgacttggatccactcgaccacagaaacttctactcaaagctgaagtctaaagtcacaacatggaaagctaaggcgctttggtacaaactggacaaacggggcagtcacaaggaatacaaaagaggaaaatcatgtaccaacacgaagtag

SEQ ID NO: 195121 - DNA, 12 bp, Artificial Sequence
  Description of Artificial Sequence: Synthetic coding sequence
atgggcgagtag

SEQ ID NO: 195122 - DNA, 297 bp, Artificial Sequence
  Description of Artificial Sequence: Synthetic coding sequence
atgggcgagaacgaggacgagaagcaggcccaggccggccaggtgtttgagaattttgtgcaggcaagtacctgtaaggggacgctccaagcattcaatattctcacacgccacttagatttagacccgctggaccatagaaacttctactcaaaattgaaaagcaaagtgacgacctggaaggcgaaggcgctctggtataagctggacaagcgtgggtcacataaagagtacaagaggggcaagagctgcactaataccaaatgtctaattgttggaggtggtccatgtggttag

SEQ ID NO: 195123 - DNA, 267 bp, Artificial Sequence
  Description of Artificial Sequence: Synthetic coding sequence
atgggcgagaacgaggacgagaagcaggcccaggccggccaggtgtttgagaatttcgttcaggcatccacttgtaaggggaccttacaggccttcaacatcctcacccgccacctggacctggatccgctggatcaccgcaatttttatagtaagctgaagtccaaggtcacaacctggaaggccaaggcactatggtataaactggacaagcggggctcacacaaggagtacaagaggggtaaatcctgcacaaatacaaaatag

SEQ ID NO: 195124 - DNA, 309 bp, Artificial Sequence
  Description of Artificial Sequence: Synthetic coding sequence
atgggcgagaacgaggacgagaagcaggcccaggccggccaggtgttcgaaaacttcgtgcaagctagcacatgcaaggggacgctgcaagccttcaacattctcacacgccatctggatctcgatcctctggatcatagaaatttttattctaaactgaagtcgaaagtgacaacctggaaggctaaagccctgtggtataagcttgacaaaaggggatctcacaaggaatacaaacgaggcaagtcctgtactaacactaaatgcctgatcgtgggcggaggtccatgcggccttcggaccgcatag

SEQ ID NO: 195125 - DNA, 2805 bp, Artificial Sequence
  Description of Artificial Sequence: Synthetic coding sequence
atgggcgagaacgaggacgagaagcaggcccaggccggccaggtgttcgaaaactttgtgcaagcctccacttgcaagggaactcttcaggccttcaatatattgacaagacacctcgatttggaccctttggatcatcggaacttttatagcaagttgaagtccaaggttaccacatggaaggccaaggctttatggtacaaactcgataagagaggctctcacaaggagtacaaaaggggaaaaagctgtactaacaccaagtgtctgattgtcggaggtggcccgtgcggcctgcggacggcgatcgagctagcgtatctcggagcaaaggttgtcgtggtggagaagcgcgattcgttctctcggaacaacgtgctgcatctgtggccgtttaccatccatgatctgcgagggttgggggcaaaaaagttttatggaaaattctgcgccgggagtatagatcatataagcatcaggcagctacaactcatcttgttcaaagtcgcactgatgctgggagtcgaaatccacgtgaatgtggaatttgtaaaggtgttagagccgcccgaggatcaagagaatcagaagattggatggagagcagaattccttccgacagatcatagcctctccgaattcgagttcgacgtgattatcggcgctgacggcagaagaaacaccctggaaggcttccgccggaaagagttcagagggaaactcgcaatcgcaataactgccaatttcatcaatcgaaactccacggcggaggctaaggtcgaggaaatctccggagtagcatttatcttcaatcagaagtttttccaggatctgaaggaagaaacaggtattgacctagagaacatcgtctactataaggactgtacacactattttgtgatgactgcaaaaaagcaatcactcttagataagggggtaattattaatgattacatcgatactgagatgctgctgtgtgccgagaacgtaaaccaggacaacttactttcttacgccagagaggccgctgacttcgcaaccaactaccagcttccatcattggacttcgcaatgaaccactacggccagcccgatgtagccatgtttgatttcacatgcatgtatgcgtccgagaatgcagcccttgtgcgggagcgccaggctcatcaattactggtcgccctggtgggcgacagcctgctagagcccttttggccaatgggaaccgggtgcgccagagggtttctggccgcattcgacacagcttggatggtcaaatcgtggaaccaaggaaccccgcctctcgaattgctcgctgagcgggaatctttgtaccggctgttaccacaaaccacacctgagaacattaacaagaactttgaacagtatacgctcgatccaggtactcgctacccgaacctcaacagccactgcgtgaggccacatcaggtgaagcacctgtatatcacaaaggagctggaacattaccccctggagcgcctcggatcagttcgaagatctgtaaatttatcacgcaaggagtccgatattaggccttcaaagctgctgacctggtgccaacagcaaaccgagggctaccagcatgtcaacgttactgacctgacgactagttggcggtcaggacttgcactatgcgccattatccaccgtttccgacccgagttgatcaatttcgattccctaaacgaggacgatgcagtggaaaacaaccaactggcctttgacgttgccgagcgtgagttcggaatcccccccgtcactactgggaaagagatggcatcagcgcaggagccagacaaattgagcatggtcatgtacctttctaaattctacgaactgttcagaggtacccctttgagaccagttgacagttggaggaaaaattatggcgagaacgcggacctctctctggctaagagttcaatcagtaacaattatctgaatctgacattcccaaggaagcggaccccccgggtagacggccagactggcgaaaacgacatgaacaagcgccgaagaaaaggctttaccaatttggacgagccatctaatttctcttctcggagcctgggctcaaaccaggaatgtgggtccagtaaggaggggggcaatcagaataaggtgaagtccatggccaatcaactcctggccaagttcgaggaatctacccgcaaccctagtctgatgaaacaagagaagaaatctccatccggctttcatttccatccctcccacttgagaaccgtccatcctcagctcaccgtcggcaaggtttcctccggtatcggcgccgcagcagaggtgctggtcaacctgtacatgaatgaccaccggccaaaagcccaagctacgtcaccggacctggagtcaatgcgcaaatccttccccttgaatcttggcgggtctgacacctgctacttctgtaagaaaagagtgtacgtcatggaacgtctgtcagcggaggggcatttcttccatcgggagtgctttcgttgctctatttgcgcgaccacgctgcgtctggccgcgtacacattcgactgcgacgagggaaagttctactgtaaaccacactttatacactgcaagaccaattccaagcagcgaaaacgccgtgcggaacttaagcagcaaagagaagaagaggcaacttggcaggagcaagaggcacctagaagggatacccccactgagtctagttgcgcagttgcagcaataggcactctggagggttctccacccgtccattttagcctgcccgttctgcaccctctcctggggtag

SEQ ID NO: 195126 - DNA, 1638 bp, Artificial Sequence
  Description of Artificial Sequence: Synthetic coding sequence
atgcggagcagccccgacctgaacagccactgcgtgcggccccaccaggtgaaacatctgtacattacgaaagagctggagcactatccactggaaaggctcggatcagtgaggcgctccgtaaatctttcccgaaaggagtctgatatccgtccaagtaagctgctgacttggtgtcagcagcaaactgagggttatcaacatgtgaacgtcaccgacctcacgacaagttggcggtcgggcctggctctctgcgccatcattcatcgctttcgacctgaactaataaatttcgactctctgaacgaagatgatgcggtagagaataaccagctggcattcgatgttgccgagcgagaattcgggattcccccagttaccaccgggaaggagatggcatccgcccaggagcccgacaagctctccatggtaatgtatctgagtaaattctatgaactgtttagaggtaccccacttagacctgtggattcctggagaaagaactatggagaaaacgccgatctgtcactagctaagtcctccataagcaataactacctgaacctgacatttcctcgcaaacgtactccaagagtcgatggccagaccggggagaatgacatgaacaagagacggcgtaagggctttacaaacttagatgaaccctctaactttagtagccgaagcttaggcagtaaccaagagtgcggcagcagtaaggaaggggggaaccagaataaagtgaagtccatggcgaaccaactgctagccaagttcgaagagtctacccgcaatccaagcttgatgaagcaagagaaaaaatctccctccggctttcactttcacccatcccatttgcgcaccgtgcatcctcaactgacagtaggcaaggtgagctcagggattggggcagctgccgaggttctggttaatctgtacatgaatgaccaccgtcccaaggcccaggcaacaagccccgacctggagtctatgaggaagagtttccctctgaatctagggggcagcgatacctgctacttctgcaagaaacgcgtctatgtgatggagcgcctctccgccgaagggcactttttccacagggagtgcttccgctgctctatatgcgccacgaccctgagactggcggcctatactttcgattgtgacgagggaaaattctactgtaagcctcactttattcactgtaaaaccaatagcaaacagagaaaacggcgcgcggagctgaaacagcagcgagaagaagaagccacttggcaggaacaggaggccccacgacgggatacaccaacagaatcctcttgcgctgttgccgcaataggaacactggagggatcccctccaggtatctctactagctttttccggaaagtactgggttggccactcagacttcctagggatttatgtaactggatgcagggactcttacaagcagcaggcctccacatcagggataatgcttacaactattgttatatgtacgagctcctgagcctcggactacctctgctgtgggcctttagcgaggtcctggccgctatgtaccgagaatcagaggggagcctggagagcatctgtaattgggtgctgaggtgcttccccgtcaagcttagatag

SEQ ID NO: 195127 - DNA, 3273 bp, Artificial Sequence
  Description of Artificial Sequence: Synthetic coding sequence
atggccaccctgctgagccacccccagcagcggccccccttcctgcgacaggccattaaaatcaggagaagacgggttcgcgacttacaggatcccccgccccaaatggcacccgagatccagccgccatcccaccacttcagtcccgagcaaagagctcttctctatgaagacgctctgtacacggtccttcaccgattagggcaccccgagcctaaccatgttacagaggcctccgagttgctccgatatctgcaagaggctttccacgtagaacccgaagaacatcagcagaccctgcaacgcgtccgtgaactggaaaagccaatcttttgcctgaaggccactgtcaagcaggctaagggaattctcgggaaggacgtgtcggggttctctgacccctactgcctgcttggcattgagcaaggggtaggagtcccgggcggctcccctggctcgcgacaccgccagaaggccgtcgttaggcacactattcctgaggaggagacccatcggacccaggtgattacacaaactctgaatcctgtgtgggacgagactttcatcttggagttcgaagatatcacaaatgcgagcttccatctcgatatgtgggatctggatacagtcgagagcgtgagacaaaaattgggcgagctgacagatctacacgggctgcgtcgcatttttaaggaagcaagaaaggacaagggacaagacgacttcttggggaacgtcgtactgcggctgcaggatttgcggtgtcgggaagatcagtggtaccctcttgaacctcggactgagacctatcccgataggggtcaatgtcatcttcaatttcagcttattcataaacgcagagccaccagcgcgtcaagatcccagccgagctacaccgttcacttgcacctactgcagcaactggtcagtcatgaagtgacacaacatgaagcgggaagtaccagctgggatgggagtcttagccctcaggctgccacggtgctgtttctgcacgccacgcagaaggacctcagtgactttcatcagtcgatggcgcagtggctggcttactcccggttatatcagagcctggagttcccatccagctgtttattacaccctattacatccattgagtaccaatggatccagggaagactgaaggccgagcagcaggaggaactggcagcctctttcagctccctgctgacttacggtctcagtcttatccgccggtttaggtctgtgttcccattgtccgtctccgattcacctgcgcggctgcagtcactgctgagagtcctggtccagatgtgcaagatgaaggcttttggtgagctttgtcccaacacagctccactccctcagcttgttaccgaagccttgcagacggggacaacggagtggttccacctgaagcagcagcaccatcagcctatggtacagggcatccccgaggccggcaaagcgctgttagggttggttcaggatgtgattggggatttgcatcaatgtcagcgcacctgggataagatcttccataacacgctgaagatacacttatttagcatggcctttcgagagctgcagtggctggtggctaaacgtgtccaggaccatacaaccgttgtcggcgatgtagtaagcccagaaatgggtgagtcactgtttcaattatatatctcacttaaagagctgtgccagctgcggatgtcgagcagcgagcgggatggcgtcttagccctggacaatttccacagatggtttcaacctgctatcccttcttggctgcagaagacctataatgaggcactggcgcgagtccaacgtgccgtccaaatggacgaactggtcccacttggagagctgacaaaacactccacatctgccgtggatttgagcacctgcttcgctcagatctcgcatactgccagacagctggattggcccgatccagaagaagcatttatgatcactgtaaaattcgtagaggatacctgccgattagcgctcgtgtattgctccctcattaaagccagagccagagagctctcttctgggcagaaggatcaggggcaagctgccaatatgctgtgcgttgtagttaacgatatggagcagttgcggctggttatcgggaagttgcccgctcagctcgcctgggaagctcttgaacagagagtcggcgctgtccttgagcaggggcagctgcagaatactttgcacgcccaactgcagagcgcactggctgggttaggccacgagatcagaaccggcgtgaggactctggcagagcagttggaggtgggcattgccaagcatattcaaaagctcgtgggtgttagggagtccgtgctccccgaggacgcaattctgccactgatgaagttcttggaggtagagctctgttatatgaacaccaatctagtccaggagaacttcagcagtctgctgactctgctatggactcacaccctaacagtactggtagaagctgccgcaagccagagaagttccagcctagccagtaacaggctaaaaattgccctccagaatcttgagatctgcttccacgctgagggctgcggcctcccccctaaagccctccataccgccactttccaagcactccagcgggatctggaactgcaggcagccagctctcgggagctgattaggaagtatttttgctctagaatccaacagcaggccgaaactacctctgaggagttgggtgctgttacagtcaaggcgtcatatcgggcatctgagcagaaactaagagtcgaactgctcagcgcaagcagtctgctgcctctggactcaaacggatccagtgatccttttgtccagcttactctggagccccgacacgagtttccggagttagctgctagggagacacagaagcataaaaaggacttgcatcccctgtttgatgagacattcgagttcttagtgccggcggagccgtgtcgcaaggctggagcatgtctgctgctcacagtgctcgactatgacacgctcggggccgacgatctggaaggcgaggctttcttgccactcagagaggtgcccggccttagcggcagtgaagagcccggagaggtgccccagactcgccttccattgacatacccggcacctaacggagaccccatcttacagctcttagagggacggaagggagacagagaagcacaggtgttcgtgagattaaggcgccaccgagcaaagcaggccagccaacacgctctccgaccagcaccgtag

SEQ ID NO: 195128 - DNA, 2847 bp, Artificial Sequence
  Description of Artificial Sequence: Synthetic coding sequence
atggaggagcggaagcacgagaccatgaaccccgcccacgtgctgttcgataggtttgtgcaggccacaacctgtaaaggtacattgaaagcattccaggaattatgcgatcatctggagctgaagcccaaggactatcgctctttttatcataaactgaaaagcaagttgaactattggaaagccaaagccctatgggcaaagctcgacaagagagggtcacataaggattacaagaaagggaaagcttgcaccaacactaagtgtttgattattggagcgggcccctgtgggctcaggaccgccatcgatctttccctgctgggagccaaggtcgtggttatcgaaaaaagagatgcgttttctcgcaataacgtactgcacctttggccgttcactatccacgacctccggggtcttggcgcaaaaaaattctatggaaagttctgtgcgggagcaattgaccacattagtattaggcagttgcagctaattctgctaaaagtggccctaatcctgggaattgagatccacgtcaatgtagaattccaaggactaatccaaccaccagaagatcaggagaacgagagaatcggctggagggctcttgttcacccgaagacacatcccgtgtcagagtacgaatttgaggttatcatcggaggagacgggagaagaaatactctagaaggcttcagacgtaaggaatttcggggtaaattagccattgcaatcaccgctaatttcatcaacaggaataccacagccgaggctaaagtcgaggagatcagtggcgtggcattcatttttaaccagaaattttttcaagagctccgggaggccaccggaatcgacttggagaatatcgtgtattacaaagacgatacccactattttgtcatgacagcaaagaagcagtctctgctcgataagggcgtgatacttcacgattacgcggatactgagctcctcctgtcccgagaaaatgtagaccaggaggccctgctctcctatgcaagagaggccgctgacttctcaacacagcagcagctgccaagcctggactttgctattaaccactatggacaaccagacgtcgccatgttcgattttacctgtatgtatgcatctgagaatgcagcccttgtaagggagcaaaatggtcatcagctgttagtggccttggtcggtgatagtctgttggaacctttttggcctatggggacagggattgcgagaggttttcttgcggctatggattcagcctggatggtccgatcttggagtcttggtacaagtcccttggaggttctggcagagagagaaagcatctaccggctccttccccagactacacccgaaaatgttagtaagaatttctcacagtactctatagacccagttaccaggtacccgaacattaatgtgaatttcctcaggcccagccaggtgcgccatctttatgacacaggtgaaaccaaggacatacatctcgagatggaatctcttgtgaactcccggaccactcccaaattaacccgcaacgagagcgtggcccggagcagcaagttgctgggctggtgccagcgacagacagacggatacgctggtgtaaacgtgactgacttaacaatgagttggaaatcagggctcgccttgtgtgccataatccatcggtacaggcctgatcttatcgacttcgactctcttgacgaacagaacgtggagaaaaacaaccagttggccttcgatatcgctgagaaggaactgggaattagcccaatcatgacaggaaaagagatggcgtcggtcggagaaccagataaactctctatggtgatgtacctcacccagttctatgagatgtttaaggacagcctcccaagttcagataccctcgacttgaacgctgaggagaaagctgttctgattgcttctacccgctctcccattagcttcttgtctaaattgggacagactatttctcggaagcgctcgcctaaggataagaaagaaaaagaccttgatggcgccggcaagcggagaaagaccagccaatccgaggaggaagaggcaccaagaggtcaccgaggcgagcgacccacgctcgtctcaactctgaccgaccggcgtatggatgtcgcggtaggcaatcagaataaggtaaagtatatggctacacaactcctcgccaagtttgaggagaatgccccggcacagtctatcggaatccgacgccagggtagtatgaaaaaagaattccctcagaatctgggcggtagtgacacctgctacttttgtcagaagagagtgtatgtcatggagcggctctccgccgagggcaagttttttcatagatcttgtttcaaatgcgagtactgtgcaacaacattgcgactgtctgcgtacgcatacgacattgaagatggaaagttttattgcaagccacactactgctatcgactcagcgggtatgcccagaggaaacgtcccgccgtcgcaccactaagcgggaaggaagccaagggacccctgcaggacggcgccactacagatgccaatgggagagccaatgccgtcgcatcttctactgagcggacaccaggttccggcgtgaacggccttgaggagccaagcatcgcaaagagacttcgcggcacacccgagcgaatcgagctggaaaactatagactgtctctgcgccaggcggaggcgttacaagaggttccggaggagacacaggctgaacataatctcagctcagtgctcgacacaggcgccgaagaggacgtcgcttctaggagtgctcgcagggctgcaggaaggccaccggctaccaggccctag

SEQ ID NO: 195129 - DNA, 2901 bp, Artificial Sequence
  Description of Artificial Sequence: Synthetic coding sequence
atggaggagcggaagcacgagaccatgaaccccgcccacgtgctgttcgacagattcgtccaagctactacttgcaaaggtactcttaaagcgtttcaggagttgtgtgatcatttagagttgaagcccaaagattatagatcattttaccataagctcaaatccaaactgaattactggaaagccaaagccctatgggctaagctggataaacgtggcagtcacaaagactataaaaagggcaaagcttgtacaaacacaaagtgtctgatcatcggagcggggccatgtgggctccggacagccatagatctatcactcttaggcgctaaagtggtggtaatcgaaaagagggacgcattctccaggaataatgtgctccatctgtggccttttactattcatgacctacggggcttgggcgccaaaaaattttacggaaaattttgcgcaggggctatcgatcatatctcaatcaggcagttgcaactcatactccttaaagtcgcgctgatcctgggaatagagatccatgtcaacgtcgaattccagggattaattcagccgcctgaggaccaggagaatgaaagaattggttggagagccctggtccatcccaagactcatccagtgtcagagtacgagttcgaagtgatcatcggaggagacggcagacggaacaccctcgaagggttcaggcggaaagagttccgaggcaaactggcaatagcaattaccgctaacttcatcaaccggaacacaaccgcagaagccaaagttgaggagatctccggtgtggcctttatattcaatcagaagttcttccaggagctcagagaggcaaccggcatcgatctggagaacattgtatattataaggatgatacccactactttgttatgacggctaaaaagcagtcgctgctggacaaaggagtcatcctccacgattacgcggatacagaactgctgctgtctcgagagaacgtggatcaggaagctctactgagttacgcacgcgaagcagcagatttcagcacgcaacagcagctcccaagtctagactttgccatcaatcactatggccaacctgatgtcgctatgtttgattttacttgcatgtacgcttccgagaacgcggcccttgtaagagaacagaacggacaccagttgctcgtagcccttgtcggggacagtttactggaacctttctggccaatgggcaccggaatcgccaggggttttctggcggccatggacagcgcatggatggttaggtcgtggtcgctgggaacatcccctttagaggtcttggccgagcgggaatccatttacagattacttccccagaccactccagagaacgtgtctaagaactttagtcagtattccattgaccccgtcaccaggtatccaaatatcaacgtgaactttctaagaccttcccaagtgcgccatctctacgacaccggggaaaccaaggatatacacctcgaaatggaatcactcgtcaactccaggacaactcccaagctcacgagaaacgaaagcgttgcgcgctcttccaagttgctggggtggtgtcagcggcagacagacggttatgcaggcgtgaacgtcactgatctgaccatgtcttggaagagtggcctagccctgtgtgcaatcatccacaggtacagaccagatctgattgactttgatagtctggacgaacagaatgtagaaaaaaataaccaactggcctttgatatcgctgagaaagagttgggaatctctcctatcatgacaggcaaggagatggcttccgtcggtgaaccagataaactttccatggtcatgtacctgacacaattttatgaaatgttcaaagactctctcccctcatctgataccttggacctcaatgcagaggagaaggctgtgcttatcgcatcaaccaggtctccaatttctttcctgtctaagctgggacagacaatttcccggaagcgctccccaaaggataaaaaagaaaaagacttagatggtgcagggaaacggcgcaaaaccagtcaatctgaggaagaagaggcgcccagaggacacaggggcgagcgtccaactctggtatccacactgacagatagaagaatggacgttgccgtgggaaatcaaaataaggttaagtatatggcaacacaactgttggccaagttcgaggaaaacgcccctgcacagtctattggtattagacggcagggaagtatgaaaaaggagtttccgcagaacctaggcggatctgatacttgctacttctgccagaagagggtgtacgtcatggagcgactaagcgcagaaggcaagttcttccatcgatcatgctttaaatgtgaatattgcgcgactaccctaaggctctcagcgtatgcctacgatattgaagatggtaaattttattgcaaaccccattactgttatcggctgtccggatacgcgcagaggaaacggcccgccgtggctccgctgtctggaaaagaggccaagggtccccttcaggatggggctaccacagacgccaatggccgggcgaatgccgtcgcatcgtccaccgaacggacccccgggagcggcgtaaatggactggaggagccaagcattgcaaagcggttgagaggtaccccagaaagaatcgagctagagaattatagactgagtctgcgacaggctgaggccctgcaggaagtgccggaggagactcaggccgagcacaatttgtcaagcgtgctcgacactggcgccgaagaagacgttgcatcccgggactgggtctccccctggctgccacgaatggtctctaactcgtgggcacagatgatccaccctcctcagcctcccaccgtgttaggtagtcaaatgtag

SEQ ID NO: 195130 - DNA, 4713 bp, Artificial Sequence
  Description of Artificial Sequence: Synthetic coding sequence
atgagcgacagcctgtggaccgccctgagcaacttcagcatgcccagcttccccggaggaagcatgttcagaaggacaaagtcatgccgaacctcaaatcgcaagtctctgatattgacctccactagccctacgttgccaaggcctcacagcccattgcccggccacctggggtcttctcccctggatagcccacgcaacttttcccctaatacaccagcacacttttcatttgccagctctcgaagggcagacggtcggagatggtcattagcatccctcccctcatctggctacgggaccaacaccccctccagcacagtctcctcttcttgctcctctcaggagcgcttgcaccaactgccctatcagcccacagtagacgaactgcactttctgtccaaacacttcggaagtaccgagagcattacagatgaggatggaggccgtcgttcacctgcagtgcgacctaggtctcgcagcctctccccgggcagaagcccgtcttcttatgataacgagatagtgatgatgaatcacgtgtataaagagcggtttcccaaggcaactgcacaaatggaggaaaagctcagagattttacaagagcatacgagcccgacagcgtattgcctttggccgacggcgtcctgagctttattcaccaccagattatcgagctggctcgtgattgtctcacaaagagcagagatgggcttatcaccacagtatacttttacgagctgcaagagaatttagaaaagttgctccaggatgcctatgagcgtagcgaaagcttggaagtagccttcgtgacacagttagttaagaagctgctgattattatatcccgccccgctagactgctcgaatgccttgaatttaatcccgaggaattctatcatctcctcgaagctgcagaggggcacgcgaaagagggccaccttgtcaagacagacatccccaggtacatcattcggcagctaggcctcacaagggacccttttcccgatgttgtccatctggaggagcaggacagcggtggttctaacacccccgagcaggacgatctgtctgaagggcggtctagcaaagcaaagaagcccccgggcgaaaatgattttgataccatcaaactgatatcgaacggggcttacggagctgtgtacttggtcagacaccgagatactcggcagagattcgccatgaagaagatcaacaagcagaaccttatcctgaggaaccaaatacagcaggcctttgtggaacgtgatatcctgacatttgccgagaaccccttcgtggtgggtatgttttgctctttcgagactcggcggcatctgtgcatggtaatggagtacgtggaaggaggcgactgtgcgaccctgctcaagaacatcggagcgcttccagtagaaatggcaaggatgtattttgctgagacagtgctagccctggagtacctgcataactacggtatagttcaccgagacctgaaacctgataatctcttaatcacgagcatggggcacatcaagcttaccgatttcggcctgtccaagatgggcctgatgtctttaactaccaatctgtatgaaggtcatatcgaaaaggacgcacgtgaatttctggacaaacaagtatgtggcacacctgaatatattgcacccgaagtgatactcaggcaggggtatggaaagccagtagactggtgggccatgggtataatactgtatgagtttctggtggggtgtgtccctttcttcggagatacgccagaagaactgtttggtcaggtcatatccgatgatattctctggcccgaaggcgacgaggccctgccaaccgaagcccaactgctgattagtagtcttctgcagaccaaccccttggtaaggttgggcgctggcggggcatttgaagtgaagcagcatagtttttttagggatttggattggacagggctcctgagacagaaagctgagtttataccacacctcgaaagtgaagatgacaccagttactttgataccaggtctgatcgctatcaccacgtgaactcatacgacgaggatgacacaacagaggaagagcccgttgagataagacagttctcttcctgcagcccccgcttctccaaggtttactcatccatggaacagttgagtcagcatgagcctaagaccccagtggcggcggctggcagtagcaaacgggagccctcaaccaaaggcccggaggagaaggtggctggcaagcgggaaggactggggggcctgacactccgcgagaaaacttggagaggaggaagccctgaaatcaagagatttagtgcgagcgaggcctcgtttctagagggagaggcgtccccaccccttggcgcccgcagacgctttagcgctcttctcgagccctcaagattctcagctccacaggaggacgaagatgaggcacggctgaggagaccacctcggccctcgagcgatccggccgggagcttggatgcaagagctccaaaggaggagacacagggagaaggcaccagttccgctggcgattctgaggccaccgatagacctcgacctggggatctgtgccccccttcaaaagatggggacgcctctggacctcgcgcaaccaatgacttggttctgaggcgggcccgccaccaacagatgagcggcgatgtagctgttgagaaaaggcccagtcgaactggcggcaaagttataaagtccgcgtcggccactgccctctccgtgatgattccggccgtggatccccacggaagcagtccactggcatctcctatgtccccacggagcctgagcagcaatccaagctcccgagacagcagcccctcccgcgattactcccccgctgtgtctggcttacgttctcccataaccattcagcgctcgggtaagaagtacggtttcaccctccgggctatacgcgtgtacatgggcgataccgacgtatatagcgtccatcatatcgtttggcacgtcgaagagggggggccagctcaggaagccggtttatgcgcgggagatttgatcacccacgtaaatggagaaccggttcacggtatggtgcatccagaggtcgtggaactgattctgaaatcagggaacaaggtggctgtgacaacgactcccttcgagaacacgtctatccggattggcccagccagaagaagttcatacaaagctaagatggctcgcagaaacaaacggccctctgccaaggagggacaggaatcaaagaaacgcagctctctgtttagaaagattacaaaacagtcaaatctgctccacacatcccggtcgctcagttccctgaatcgctcacttagctcctctgacagtttgcctggttctcccacacatggcctccccgctaggagcccaacacattcttataggtccacgcctgactctgcatatttaggagctagctctcaatcctcttcgccggcatctagtacaccaaattccccggcctcctccgcttcccatcatatccggccgtcgaccttgcatgggctgtcccctaagcttcacaggcagtaccgatctgcacgttgcaagtccgccggcaacattcccttaagtcctcttgcacatactcccagtccaactcaggcctcccctcctcccctgcccggacacactgtgggttcatcgcatactacgcagtccttccctgctaaactccactcaagcccccccgtggtgcggcccagacctaagtccgcagagcccccacggtctcccctcctgaaaagagtacagtctgctgagaaattgggagccagtctcagcgcagataagaagggcgccttgcggaagcattctctggaggtcggccatcccgattttcgtaaagattttcacggtgagcttgccttgcatagtctggccgaaagtgacggcgaaactccgccagttgaagggttaggagctcccaggcaggtagccgtgaggcggctaggtcgccaggagagcccgctatccctgggcgctgaccctttgctccccgaaggggcatcacgccccccagtgtcatcaaaagaaaaggaatcccccggcggcgctgaggcctgcaccccacccagagcaacaactcccggcggtcgaactctagagagagatgttgggtgcacccggcatcagagcgtgcaaactgaggatggaactggcggaatggcgcgagctgtggcaaaggctgctctgtcccctgtgcaggagcacgagaccggccgccgctcttcgtcaggcgaggccggcacaccactggtgcctattgtcgtcgaaccagcccgccctggcgcaaaggctgtcgtgcctcagccgctcggcgccgatagcaagggtctccaggagccggctcctctggctccgagtgttcccgaggccccgagaggtagggaacggtgggtccttgaggtcgtggaggaaagaactacgttgtctggccctcgcagcaagcccgccagtccgaaactgtcaccagaacctcagacaccctcattggcccctgcaaaatgcagtgccccaagcagcgccgtcaccccagtgcccccagcgtctcttctcggaagtggaacaaaaccacaggtaggtctaactagccggtgtcccgcagaagccgttccccctgctggcctcaccaaaaagggcgtatcatccccggcaccacctggtccttag

SEQ ID NO: 195131 - DNA, 2178 bp, Artificial Sequence
  Description of Artificial Sequence: Synthetic coding sequence
atgagcgacagcctgtggaccgccctgagcaacttcagcatgccctcttttccggggggttcgatgttccgccgtaccaagtcctgtcggacaagcaaccgcaaatcgttgatccttacgtcgacaagtccaacattaccaaggccgcatagccccctgcctggacatctcggcagttccccgttggactcaccacggaactttagtccaaatacccccgcacacttctcgttcgcttccagccgaagagcagatgggcggcggtggtcccttgcatcacttccaagctccggctacgggacaaatacccccagttccactgtaagttcaagctgtagcagccaggagcgcctgcatcagttaccctaccaacccacagtcgatgagctccacttcctctcgaagcacttcggtagcactgagtctatcaccgatgaggacggagggcgccgcagcccggctgttcgacctcgttcccggagtctgagcccaggtcgatctccaagttcatatgacaacgaaattgtgatgatgaatcacgtgtacaaagagcgtttccctaaggctacagctcagatggaagagaagctgagggattttactagggcctacgagccagacagcgtcttgccactggccgatggcgttctgagctttattcaccatcagattatagaactagccagggattgccttacaaagagcagggatgggctcattacaaccgtctatttctatgaattgcaggaaaatttggagaaattgcttcaggatgcctacgaacggtccgagagtttggaagttgctttcgtcacacagctggtgaaaaagttgttaataatcatctcccgccctgcccgcctcctcgagtgcttagagtttaacccagaggaattttaccatctgctggaagctgcggagggacatgccaaagaaggccacctcgtaaagaccgacatcccaaggtacatcatccgccagctcggtctcactcgggacccctttccagacgtggttcaccttgaggagcaggatagtggcgggtccaacacgccagaacaagacgatctgtcagagggcaggagcagcaaagcaaaaaagcctccaggcgagaacgactttgatactatcaagctgatttcgaacggtgcctacggagctgtctatctcgtacgccaccgcgatactcgccagcgctttgccatgaagaaaatcaataagcaaaacctgatcctgagaaatcagatacagcaggcctttgttgaacgcgatatactgacctttgctgagaacccattcgtggtgggaatgttctgttctttcgaaacgaggcgccacctgtgtatggtcatggaatatgtggaaggtggcgactgtgccacactgctgaagaatatcggggctctccctgtggaaatggccaggatgtactttgccgagacagtgctggctctggagtatcttcataattatgggattgtccacagagaccttaagcccgataatctgctcattaccagtatgggccatatcaagctgactgattttggactcagcaaaatgggactgatgagcctgacaaccaatctgtacgaagggcacatagaaaaggacgcccgtgaattcctggataagcaagtgtgcggcaccccagagtatatcgcccctgaggttattttgcggcaggggtacggcaaacccgtggactggtgggccatggggatcattctgtacgagtttctggtcgggtgcgttcccttctttggagacacacctgaggagctgtttgggcaggttatctccgatgacatcctgtggcctgaaggagacgaagctttgcccaccgaggcgcaactgctgatcagttcccttctgcaaactaatccactggttcggctgggcgccgggggggccttcgaggtaaagcaacattcattttttagggatttagattggacaggacttctgagacagaaagctgagttcattccccacctggagtctgaggatgacacctcctactttgacacacgttccgatcggtatcatcatgtaaatagttacgatgaggatgacactaccgaggaggagccagtggagatccgtcaattttctagctgttcccccaggttcagtaaggtttacagcctgaggatacatatgtatacctataaatag

SEQ ID NO: 195132 - DNA, 5397 bp, Artificial Sequence
  Description of Artificial Sequence: Synthetic coding sequence
atgaagcggagccggtgccgggaccggccccagccccccccccccgaccggcgggaggatggcgtgcagagagcagccgaactcagccagtctctgccaccccgtcgtagggcacctcctggacgccagcggctggaggagagaacgggtccggccgggcccgaaggcaaagaacaggacgtcgtgacaggcgtctcacccctgctctttaggaaactcagcaatcctgacatctttagttccacaggcaaagtcaaattacaaaggcagttgtcacaggatgactgtaaactgtggcgggggaatctcgctagctctctgagtgggaagcagctccttcctctgagctcttctgtacactcttctgtcggccaagttacttggcaatcctcaggcgaggcaagcaacctggtgcggatgcgcaaccaatctctgggacagagcgctccttcattaaccgcaggcttgaaagaactcagcctgcctagacgcgggtccttctgccgtacaagcaatcgaaagagccttatcgtcacttcttctacttcacctacattgccaagacctcacagccccctgcacggccacactgggaactcccctctcgacagcccgcgcaactttagccctaacgcacctgcgcactttagctttgtgcctgccagaaggacagacggtcggcgctggtcgctggctagtttaccatcctcagggtacggaactaatactccaagtagcaccgtaagctctagttgctcttctcaggagaaactgcaccagcttccttttcagcccactgctgatgagctgcactttttgacaaaacatttctcaacagaaagcgtaccagacgaggaggggcggcagtcccctgcaatgcgtccgagaagcagatctctgagccccgggcggtcaccggtatctttcgactcagagattattatgatgaatcacgtgtacaaagaacgtttcccgaaggcgaccgcccagatggaggagcggctggccgagtttatttcaagtaacaccccagactcggtcctgcctcttgctgatggggcccttagctttatccaccaccaagtgatagaaatggcaagggactgccttgataaaagccgaagcggcctcataacaagccagtacttctacgaactccaagataacctggaaaagctgctgcaggacgcacatgagaggtctgagtcatctgaggtggcttttgtgatgcaactggttaagaagctgatgataatcatcgcaagacccgctaggctcctagagtgcctagagtttgaccccgaagagttttaccacctgttggaggcagcagagggccatgcaaaagaaggccaggggatcaagtgcgacataccccggtatatcgtttctcagttaggtttgacaagggacccgctcgaggagatggcacagctgagcagctgcgatagtccggatacacccgaaaccgatgactcaatcgaaggccacggcgcctccctgccaagtaagaagactccctctgaagaggatttcgagacgataaaattgatcagcaacggagcatatggcgccgtctttctcgtgcgccataagagcacccggcaacggttcgctatgaagaaaattaacaaacagaatctgatcctccgtaatcaaatccagcaagcattcgtagagagagatatcctgacgttcgcagaaaacccttttgtagtgagtatgttttgctcattcgataccaaacgccacctctgtatggtgatggagtatgtggagggcggtgattgcgcgaccttattgaaaaatatcggagctctgcccgtggacatggtccgtctgtacttcgccgaaaccgtcttggccctggagtatctgcataactacggaatcgtgcatagagacctgaaacccgataacctattgataaccagtatgggacacatcaaattgaccgattttggactctcgaaaattggtcttatgtcgttgactacaaacctgtatgagggccacattgagaaagatgctcgcgagtttttggacaaacaagtatgtgggactcctgagtacatagcgcctgaggtaatcctgagacagggctacggaaaacccgtcgattggtgggcgatgggcatcatcctatatgagtttctggtagggtgtgtgccctttttcggagacacaccagaagagctcttcggccaggttatatctgacgagatcgtatggcctgagggggatgaagcgctcccaccagatgcccaagatcttactagcaagctgcttcaccaaaatccattggaacgtcttggaactggctcagcctacgaagtcaaacagcaccccttcttcaccggcttagactggactgggctgctgcggcagaaagccgaattcataccccagctcgaatctgaagatgacaccagttatttcgatacccggtcagaacgctaccaccacatggattctgaagatgaagaggaagtcagcgaagacggttgtttggagatccgacagtttagttcctgctcacctagattcaacaaagtgtatagctctatggagcggctgtctctcctcgaggagcgccggactccccctcctacaaagcggtctctttctgaggagaaagaagaccacagcgatggcttagctggcttaaagggtagagaccgttcctgggtaatcggctctcctgaaattctgcggaagcgtctctctgtaagtgagtcctcccatactgaaagtgactcgagtccacccatgaccgtgcgccgtcggtgcagcgggttacttgatgctccaagatttccagaagggccagaggaagctagctccaccttgaggcggcaaccccaagaaggcatctgggtgcttacccccccctctggagaaggggtaagtggccctgtgaccgagcactccggggagcagaggcctaagctcgacgaggaggccgttggtcgttcgtccggttccagccccgccatggagacgcggggaagggggacatcacagctcgctgagggcgccaccgctaaggctatatcggatctggcggtccggcgggcccggcaccggctgttatctggcgacagtaccgagaaacggacagccagacccgtaaataaagtgattaagagtgccagtgctaccgctctctctctgctgataccgagcgagcaccatacgtgtagcccccttgcgtctccgatgtccccgcattcccagagctcaaacccatcctctcgcgacagcagccccagtagggacttcctgccggcccttggatctatgcggccccccatcataatccaccgggccggaaagaaatatggctttaccctaagggcgattcgcgtttacatgggggacagcgacgtgtataccgtgcaccacatggtttggcatgtagaagacggcggcccggcttccgaggccggcctccgccagggggatctgattacacacgtgaatggggagcctgtacatggactggtgcacactgaggtcgtggagctgatcctgaaatctggaaataaggttgccataagcactacccccttggaaaatacttcaatcaaagtgggacccgcgagaaagggcagttacaaagctaaaatggccagaagatccaaacgctctagaggcaaagatggccaggagagtcgcaaacgcagttcactcttcagaaaaatcacgaagcaggcttcccttctccatacttcacgcagtctcagcagtcttaacaggtctctgtccagtggagaatctggtcccggctcccctacccacagccattcacttagcccccgaagcccgacccagggatatcgggtgacccccgacgccgtccactcggtaggcggtaacagtagtcagtcctcatctccttctagctctgtgccatcgtcacccgccggctctggacacacaaggccttctagcctgcatggacttgcgccaaagctgcagcggcaatacaggtctccacggaggaagtcggcaggcagtattcccctttctcccctcgcccataccccctcccctcctccccctactgcttcgccccagcgaagtcccagcccacttagcggacacgtggcacaagcattcccaacaaaacttcacctgtcaccaccgctggggcggcagctgtctaggcccaagtcagcagaaccacctcgcagtcctttgcttaagcgggtccagtccgccgagaagctagccgccgccctggctgcctcagagaaaaagctcgccacttctcggaaacattctctggatctgccccattctgagctaaaaaaggagttaccccctcgggaggttagcccacttgaggtcgtgggagccagatcggtgctgagtggcaagggtgccctacccggcaaaggcgttttacagcctgcaccgtctcgggcgcttggcaccttacgccaagaccgggctgagagaagggagtccttgcagaaacaagaagcaatcagagaagttgacagctcagaagatgacacagaagagggccctgagaatagtcagggggcacaggagctgagcctggcaccccatcccgaagtctcccagtctgtcgccccaaagggtgcaggggagtcaggcgaggaagatccttttccttcacgggacccaagaagtctgggacctatggtgccatccttacttaccggtattactctgggacccccgcgtatggaatcaccttctggtccacacagacgcctgggaagcccgcaagctatcgaggaggcagcaagcagctcttcggcagggccaaaccttggccaaagtggagccacggaccctatcccacccgaggggtgctggaaagcccagcatcttcacactcaggcgctgaccgccctttcccccagcaccagtggtctgacccccacctccagttgcagccctcccagttcaactagcggaaagcttagtatgtggtcatggaagtctctgatcgaaggacctgaccgggcatcgccctccaggaaggccaccatggccggcggcctggctaatctgcaggatctcgagaacacaactcctgcgcagccaaaaaatttgtctccaagggagcagggaaaaacacagccaccaagtgcccctcgcctggctcatccgtcctacgaagatccatcacaaggctggctctgggagagcgagtgcgcacaggccgtaaaggaggaccctgctctgagtataacccaggtaccagacgcctctggggatcggcgacaggatgtgccttgtcggggctgtccattgacacagaaatccgagccaagtctgcggagaggacaagagcctggcggacatcagaaacatagagatctggcgcttgtccccgatgagttactgaagcaaacttag

SEQ ID NO: 195133 - DNA, 2379 bp, Artificial Sequence
  Description of Artificial Sequence: Synthetic coding sequence
atgttcagccccaccagcgcccccgccctgttcctgaccaaggtgcctttctcagccgattgcgccttggctaccagtcccctggcaattttcttaaatccccgtgcacactcttcacctggcaccccctgttcatcccgccccctcccctggtcctgccgaacaagtaatagaaaatccctcatagttaccagctccacctctccgacccttccacgtccccacagcccactacacggccatactgggaactcgccactggacagccctaggaacttctcccccaatgcgcctgcgcatttctcattcgtgcccgctcgaaggacggatggcaggcggtggtcactggctagcctgccttccagtggttacggtaccaacacgccgtccagcaccgtgtcgagttcctgcagttctcaggagaaactccaccagctcccttttcagccaacagctgacgagctacatttcctaaccaagcatttctcaactgagagcgtgccagacgaagagggtcgacagagccccgcaatgagacccaggtcacgctcactctctcccgggcgatctccggtatctttcgactccgaaattataatgatgaatcacgtgtataaagagaggtttccaaaggccacagcacagatggaggagcgactcgccgagttcattagtagcaatacacctgactcagtcctccccctggcagatggtgctctcagtttcattcatcaccaggtgatagaaatggctagagactgtctggataaatcgcgaagcggtctgatcactagccagtacttctatgaacttcaggataatcttgaaaagctgcttcaggacgcccacgaacgatctgaaagcagtgaggttgctttcgtgatgcaattagtgaaaaagcttatgatcatcattgcccggcctgcaagactgctggagtgcctggagtttgatcctgaagagttctaccatctcctggaggctgccgaggggcacgcaaaggaggggcaaggtatcaaatgtgacatccccaggtatatcgtcagtcaactcggactaaccagagacccccttgaagagatggctcagttatcaagttgtgattctccagacacacctgaaacagatgacagcattgagggtcatggggcttcactcccctccaagaagaccccgtccgaggaggatttcgagacgataaagttgatctccaatggtgcatacggagcagtttttcttgtgagacacaagtcaacccgccaacgcttcgccatgaaaaagataaataaacagaatttgatcctgaggaatcaaatacagcaagctttcgttgagcgtgatatcctgactttcgctgagaacccttttgtggtttctatgttctgctcctttgacaccaagagacacttatgtatggttatggagtatgtggaaggaggagactgcgcaaccctcctgaagaatatcggggccctgcctgtggatatggtaagattgtactttgcagagaccgtactagctctggaatacctccacaactatggcatagtacatcgggatttgaaaccagataacctcctgattactagcatgggacatatcaaattaactgactttggcttgagcaaaatcgggctgatgtctctaacaacaaacctctatgagggccacattgaaaaggacgctcgcgagtttttagataagcaggtctgtggcactccagagtatattgccccggaagtgatactgcgacagggttacggcaaacctgtagattggtgggcaatggggatcattctctacgaatttctcgtgggatgcgttccgttcttcggggatactcctgaggagctgttcggccaggtgatctcagacgagatcgtatggcctgaaggcgacgaggctctgcctcctgatgcacaggacctgacctccaagctgctgcaccagaaccccctcgaaaggcttggcacgggaagtgcctatgaagtcaagcaacatccctttttcaccggtctggattggaccggccttctccgccaaaaagccgaatttattccacagctcgagtccgaagatgacacctcttactttgacacccggagtgagcgctaccaccatatggattctgaagacgaagaggaggttagcgaggacggatgtctcgaaattaggcagttcagctcctgtagcccccggtttaacaaggtgtactcctctatggagcggctttctctccttgaggaaaggagaactccccctcctactaagcgtagtctaagcgaagaaaaagaagaccactcagacggactcgccgggctaaagggaagagatcggagctgggtgattggttcacctgagcaccaccccagcgcatag

SEQ ID NO: 195134 - DNA, 4827 bp, Artificial Sequence
  Description of Artificial Sequence: Synthetic coding sequence
atgaagcggagccggtgccgggaccggccccagccccccccccccgaccgacgggaggacggcgtgcagcgtgctgccgagctcagtcagagcctacccccacgccgacgagccccaccaggaagacagcgcctggaagagcgcaccggcccagcagggccggaggggaaagagcaagacgtggtgaccggcgtatctcctctcctctttagaaagctgtctaaccccgacatattctcctcaacaggcaaggtgaagctccagcggcaactgagccaggatgattgcaagttatggcgaggcaatctggcgagctcgcttagcgggaagcagttgctgcccctgtctagctccgtgcattctagcgtgggacaggtgacctggcagtcctccggcgaggcttcaaacttggttcgcatgcgaaaccaatccctaggacagtcagcaccaagcttaaccgccggacttaaggaactgtctttaccccgtagggggtctttctgcaggacttccaacaggaaatcattaatcgtgaccagttctacttcccctacactgccccgaccccactctcccctgcacggtcacacgggaaattcccccctcgactcaccccgcaatttttcacctaacgcgcccgcccacttttcctttgttcctgcccggcggaccgatggccggcgttggtcactggcgagtctgccaagctccggctatggtacaaataccccgagctcaactgtatcaagcagctgctcttctcaggaaaagcttcaccagctgccattccagccaacagccgacgaattgcattttctgacaaagcactttagtacagagagtgtgccagacgaagagggaaggcagtcacctgctatgagaccccgctcccgatccttatctccaggcaggtctccagtctccttcgacagcgagattattatgatgaaccacgtttacaaggagcgcttcccaaaagcacatgagcgatcagagtcatcagaggtggcattcgtgatgcaacttgtgaagaagctgatgatcatcatagctcgccctgcccggttgttggaatgcttggaatttgatcctgaagagttttaccatctgttggaggcagcagaaggacacgcaaaagaaggccagggcatcaagtgcgacattccgaggtacatagtcagccagttgggcctgacaagggaccctttagaagagatggcccagctttcatcctgtgattcgccagataccccagaaactgacgactctatcgagggtcacggggcctcactgccatccaagaaaactccatccgaagaggatttcgagactattaaactgatctctaatggggcctacggagcagtgttcctggtccggcataagtccacccgccagcggttcgctatgaaaaaaatcaataagcagaacctcattctgcgcaatcagatccagcaggcttttgtggaacgggacatcctaacatttgccgaaaacccatttgtggtgtctatgttttgtagttttgacaccaaaagacacttgtgtatggttatggaatacgtcgagggaggcgattgcgccacacttttgaaaaacataggcgcacttcccgtcgacatggtgaggctgtacttcgcggaaaccgtactcgctttggagtacctccacaattacgggatagtacatcgcgatttgaaaccagacaacttgctgataactagcatgggacacatcaagttaactgattttgggctgtccaaaatcggcctgatgagcctgaccaccaatctctatgagggtcacatcgagaaagacgcccgagaatttctggacaaacaggtgtgcggaaccccggagtacatcgcacccgaagtcattcttcgacaggggtatggtaagcctgttgattggtgggcaatggggataattctgtacgaattcttggtgggctgtgtgccatttttcggagacacacccgaggaactgttcggccaggtgattagcgacgaaattgtttggcctgaaggcgacgaagctcttcccccagacgcacaggacctgacgagcaagctcctacaccagaacccgcttgagagactggggaccggcagtgcttacgaggtgaaacagcatccctttttcacaggtcttgactggacaggtctgttacggcagaaagccgaatttattccgcagctcgaaagtgaggacgacacatcttactttgacaccaggtctgaacggtatcaccatatggatagcgaggatgaggaggaggtgagcgaagacggatgcctggaaatccggcagtttagtagctgctctcctaggttcaataaagtctacagttccatggaacggctgagcttactcgaggagcggcgcaccccaccaccgaccaagaggagtctctctgaagaaaaggaggaccactcagacggactagcaggcttgaaggggcgagaccggagttgggtgatcggctcaccagaaatcctgcgcaagcgactctccgtttccgaaagtagccataccgagtctgactcaagcccaccgatgacagtccgccgtaggtgttccggcctactcgacgcgccacgatttccggaaggacccgaagaagcaagcagcactcttcgccggcaaccacaagaggggatatgggtattgactccgccttcaggagagggggtatctgggcctgtgacagaacacagcggagagcagcgtccgaagctggacgaggaagctgtgggcagatccagcggctcatctcctgctatggaaaccaggggacgaggcacttcgcagcttgccgaaggcgcaactgcaaaggccatcagtgacttggcggtccgccgggctcggcacagattactcagcggggattctactgaaaagcggaccgccaggcctgtgaacaaagtaataaagtcagcctccgccacagcactcagcctcctgattccgagtgagcaccacacctgctcgcccctggcaagtccaatgtcacctcactctcagtcaagcaatcctagttctcgggattccagtccctacggatttacactgagggctattcgcgtctatatgggcgactccgacgtatatactgtgcaccatatggtctggcatgtggaagacggaggaccagccagtgaggcaggcctccgccagggagacctgataactcacgtcaatggagaacccgtgcatggcctcgtgcacaccgaagtggttgaactgattttgaaatcaggaaacaaggtggctatctcaacaaccccacttgaaaacacaagcataaaggttggccctgcacgaaagggatcctataaagccaagatggcgaggcggtccaaacgctcacgcgggaaggacggtcaagagtcaaggaaaagatctagtctttttaggaagattacgaaacaggccagcctcctccacacctccaggagtttgtcctcccttaacaggagcctgagctcaggggagtcagggcccggttcgccgacgcacagtcactctttatcccctcgctctcctacacaaggatatagagtcacaccagatgccgtacactccgagttgtctcggcccaagtctgccgaacctccccggagcccactactgaagcgggtccagagcgcagaaaagctcgctgccgccctggccgcaagtgagaagaagctggctacgagtcgtaagcatagtctggatctgccgcacagcgagttgaagaaggaactgcctcctagagaagtatcacccctagaggtggtgggtgccaggtccgtgttgagtggaaaaggggccttaccaggcaaaggggtcctgcagcctgctccatcccgcgcactgggaaccctgagacaggaccgggctgagcgaagagagagcctccagaaacaggaggctatcagagaggttgactcgagcgaagatgacacagaggagggaccagaaaactctcagggggcacaggagttgtctttggccccacaccccgaagtttcgcagagtgtcgcccccaagggcgcaggagagtctggtgaggaggatcccttccctagccgagatccccgctccctgggccctatggtgcccagcttgttgactggtatcactctgggaccaccaagaatggagtcaccgagcgggcctcataggcggctggggtcacctcaggcgatcgaggaggctgcttcttcctccagtgctgggcccaacctgggccagagcggtgcaacagaccctattcctcccgaggggtgttggaaggcacagcacttgcacacacaagcccttacagccctgtcaccttctacctccggcctgactccgacgagctcctgctctccacctagctctacaagcggaaaactctccatgtggtcatggaaatctcttatcgagggtcccgacagggctagcccatcacgcaaggcgacaatggccgggggactggccaatctgcaggatctggagaacaccacgccagcacagcccaagaacctgtcacctcgagaacaggggaagacacagcctcctagtgctccccgcctggcccatcctagctatgaagatccgagccaaggatggctctgggagtccgagtgtgctcaggccgtgaaagaggacccagcattgtctattacacaggttccagatgcgtcgggagatcggcggcaagatgtgccctgcaggggatgccccctcacacaaaaatccgaaccaagcctgcggagaggccaggagcccggggggcaccagaaacatagggacctcgcactggtgcctgatgaattactgaagcagacttag

SEQ ID NO: 195135 - DNA, 1893 bp, Artificial Sequence
  Description of Artificial Sequence: Synthetic coding sequence
atgcggccccggagccggagcctgagccccggccggagccccgtgagttttgacagcgaaataattatgatgaatcacgtctacaaggaacggttccccaaagccactgctcagatggaagaacgccttgctgaatttatcagctctaacacccctgactccgttcttccgctcgccgatggtgctctgagttttattcatcaccaggtcattgagatggcaagggattgtcttgacaagagccgaagtgggctgatcacttcccagtacttctatgagctgcaggataatttagagaagctgcttcaggatgaattcgatcctgaggagttctaccatctgctggaagccgctgaagggcacgcaaaagagggccagggcatcaaatgcgatatcccccggtacatcgtgagccagcttggcttgaccagagacccactggaggaaatggctcagctgtctagttgtgattctcccgacacgcctgaaaccgatgacagcattgaagggcacggggcatccctgcccagcaagaaaactccttcagaggaggacttcgagaccatcaaacttatctcaaatggagcctacggagcagtgttcctagtgcgtcataagtcaacgagacagaggtttgcaatgaagaaaattaacaagcagaacttgatcttgaggaatcagattcagcaagcttttgtggagcgagatatactgacatttgctgagaacccatttgtggtgtcaatgttctgtagctttgacactaagaggcacttgtgcatggtcatggaatacgtggagggaggagactgtgccaccctacttaagaacatcggggcactacccgtcgatatggttcgcctctacttcgcagaaacagtgctcgctctggagtacctgcataattacggcatcgttcatagggatctaaagcctgacaacctcctgattactagcatgggccacattaagcttacagatttcggcctgtcaaagatcggactcatgagcctgactaccaatctgtacgagggtcacattgaaaaggatgcccgagagttccttgataagcaagtctgtggaaccccggagtacatagcacccgaagttatactgcgtcagggctacggcaagcccgtggactggtgggcaatgggcatcattttatacgaattcctggtgggttgcgtgccattttttggtgatacacccgaagagctcttcggccaggtcattagtgatgaaatcgtctggcccgaaggagatgaggccctccccccggacgcacaggacctaacatcgaagctacttcaccagaacccactggagaggctgggcaccggcagcgcatacgaggtaaaacagcacccattcttcacaggcctcgactggactggcctcttgagacaaaaagccgaatttatccctcaactggaaagcgaggatgatacctcatatttcgacacccgtagtgagcgttaccaccatatggatagtgaagatgaagaagaggtgagtgaagatgggtgtctggaaatcaggcagttctcaagttgtagcccaaggtttaacaaagtgtactccagcatggaacgcctgtcgctgctggaggagcgccgaacgcccccccccaccaagcgctcgctcagtgaggagaaagaagaccacagcgatgggctggccgggttgaaggggcgcgatcgctcgtgggtcatcggctccccagaaatactgcggaaacgcctatcagtttctgaaagctccctgctgaaagtggctggacggccttctacattttcacagcactttggtacacaccctcatcagcagctattgagcagtcagttacatttatgggaggcagagcacgtggttctggagattccctattag

SEQ ID NO: 195136 - DNA, 1035 bp, Artificial Sequence
  Description of Artificial Sequence: Synthetic coding sequence
atggacgacagcagcatcctgcggcggcggggcctgcagaaggagctgagcctaccaaggcgcggctctttttgcaggacatctaatcggaagtctctcatagtgacatcctcaacttcacccaccctgcctcggccccattcaccgctacatggccacaccggaaattccccacttgacagtccaaggaacttctcccccaacgcccccgctcacttttcttttgtgccagctaggagccactctcatcgcgccgatcggacagacggcaggcgctggagtcttgcctctctgccctcgagcgggtacggaacaaatacaccgagttccaccgtgagttcaagctgctcctcacaggagaaactgcaccagctgccttttcagccaactgcagatgagctgcacttcttaacaaagcactttagtacagaaagtgttcctgatgaggagggccggcaaagtccagccatgagacccgcaccctctcgcgccctgggaactctgcgacaggaccgcgccgagcgaagagagagcttgcagaagcaggaagcaatccgagaagtcgatagctccgaggatgacaccgaggaaggacccgaaaactcccagggggctcaagaattatctctggctccccaccctgaggtttcacaatctgtcgcgccaaaaggtgcaggagagtccggcgaggaggatcctttcccaagccgtgaccctcgctccttgggacctatggtgccttctctgctgactgggatcacccttggcccacctcggatggaaagtccaagcggtccccatcgacggcttggatcacctcaagccatagaagaggctgcatcttcaagcagcgctgggccaaacctgggacagtccggtgcgacagaccctatcccccccgaggggtgctggaaggcccagcacctccatacacaagccctgaccgccttatcaccttctactagcggtctggcgcacctgatgcgaatcccagctagggccggctatggatccttgtccgtgcataagcaatag

SEQ ID NO: 195137 - DNA, 3930 bp, Artificial Sequence
  Description of Artificial Sequence: Synthetic coding sequence
atggacgagagcagcctgctgcggcggcggggcctgcagaaggagctgtctctcccccgacgaggacgcggatgcagaagcggcaatcgcaaaagcctggtagtaggaacgccttctcccaccctctctaggcccttgtccccgctttctgtccccacagctggttcatctcccctcgatagtcctaggaatttctcagctgcaagcgcgcttaacttcccttttgcgcggagggccgacggtcgcagatggagcttggcctctctcccctcttctgggtacggaacaaataccccttccagcactctgagtagttccagttcttcacgcgagaggctccaccaactgccatttcagcctacaccagatgaactccactttctgtccaagcattttcgatcatccgaaaatgtgctcgatgaggaaggcggtaggtcccctcgcctccgtcctcggtcccgcagcctcagtcctgggcgagcaaccggcacttttgacaatgaaatagtgatgatgaaccacgtttacagagagcgctttcccaaagccactgcacagatggaggggcggctgcaggagtttctgactgcatacgctccaggcgcacgccttgccctcgcggatggggtgctgggattcatccaccatcagattgtcgaactggccagagattgtctagcgaagtcaggtgaaaacctggtcacgagccgctattttctggaaatgcaggaaaaactagaacgtctcctgcaggacgcacatgagagatccgatagtgaggaggtgagttttatagttcagctggtaagaaaactcctcatcattatcagcagaccagccaggctgctggaatgcctcgagttcgatcctgaagaattctatcaccttctggaggctgctgagggccatgctcgtgaggggcaaggcatcaaaaccgaccttccgcagtacattattggtcagctggggctggcgaaggaccctctcgaggagatggtccccttatcacatttagaggaggagcagcctcctgccccggaatctcccgagtcacgcgctctggtgggtcagtcccgtcggaagccatgcgaatcagattttgagacaattaagttaatcagtaacggcgcttatggtgccgtgtaccttgtgagacacagggacacacgccaacgcttcgccatcaaaaaaattaacaaacagaatttaattctgagaaaccagatccagcaggtgttcgttgagcgggatatcctgacatttgcggaaaaccctttcgtagtttcaatgttttgttcgtttgagacgcggcgccacctgtgcatggtaatggaatatgtagaaggcggagattgtgccaccctgctcaagaatatgggacccctgcctgtagacatggcccgtctatacttcgccgagacagtacttgcactggagtatctgcacaattatggcatcgtacacagagacctaaagccggataatctcctgatcaccagcctgggacacattaaactaactgacttcggtctgtctaaaatcggactgatgagcatggcaacaaatctgtacgagggtcacattgaaaaggacgccagagagttcatagacaaacaagtgtgcggcactcctgagtatatcgctccggaagtcatctttcgccaggggtacggtaagccagtggactggtgggccatgggcgtggtgctgtacgaatttctggtaggctgcgtgccattcttcggcgatactcccgaggaactctttggtcaggtggtaagcgacgaaatcatgtggcccgagggcgacgaagcactgcctgctgacgctcaagacctaatcacccgccttctgcgacagtctccacttgaccggttgggcacaggaggcacccacgaggttaagcagcatccgttcttcctggcactcgactgggcgggcctgctccgccataaggccgagtttgtgcctcagttagaagccgaagacgatacctcttactttgatacacggtctgagcgctataggcacctaggaagcgaggacgatgagacgaatgatgaggaatcatcgaccgagatcccccaattttcaagttgctcccatcgtttttctaaggtgtatagcagctccgaatttctggcagtgcagccaacaccaacattcgctgagaggtcgttcagcgaagatcgtgaagaaggctgggagaggagtgaggtggactacgggaggagactcagtgcagacattaggctacggagctggacatccagcggttctagctgtcagtctagctcaagccagccagaaagaggccccagcccctcactgctcaacactatcagtctcgataccatgccaaagtttgcttttagttccgaagatgagggcgttggcccaggtcccgcagggccaaaacgacctgtgttcatcctgggtgaacctgaccctccccctgccgctacccccgtcatgcctaagccttcatcgttgagcgccgataccgctgccctgtctcacgctcgccttcgctccaattcaattggtgcacggcattccacccccaggccactggacgctggacgtgggaggcgcctcggcggtcctcgcgatcctgcacccgagaagtcaagagcctcctcatcaggcggaagcgggggcgggtcaggtgggagagttccaaagtcagcctctgtgtctgccctgtcgttgataatcacagcagatgacggatctggtgggccccttatgagcccgctgtcacctcgctccctctctagcaacccttcttctagagactccagccctagtcgggatccctctccggtgtgtgggtccctgaggccgcctatagtgattcacagctcaggcaagaaatacgggttttccttacgtgccattcgcgtctatatgggagatagcgatgtctacaccgtgcatcacgtcgtgtggtctgtggaagacggatcccctgctcaggaggcgggccttcgggctggagaccttatcacccatattaacggcgaatccgtgctgggtctcgtgcacatggatgtggttgaactcctgctcaaatctggcaataagatttctctgaggacaacagcacttgaaaatacctcgattaaggtggggccagctcgcaagaatgtggctaagggacgtatggcaaggagaagtaaacgttcccggaggcgggaaactcaagataggagaaagtcgctgttcaaaaagatttctaagcagacctctgtattgcacaccagccggtcatttagcagtgggctgcaccatagcctctcttcttctgagagtttgcctggatcacccacccatagtttaagccctagtcctacgactccttgtcgcagccctgccccagacgttcctgccgatacaactgcatcacccccgtcagcctccccctcgtctagctctcctgcctcccctgcagctgccggtcacacgcgaccaagctcactacacgggctggccgcaaagcttggacctccacggcccaagacagggcgaagaaagtcgacctcatctatcccaccatcccctctcgcctgtccacccatctccgcccctcctcccaggagccctagtcctctgcctggccaccctcccgccccagcgcgcagcccccgactccggagaggccagtctgccgataagcttggcacgggcgaacggctggatggtgaagctgggcgaagaacccgaggccccgaagctgaattggtggtgatgagacgtttgcacttgtcagagcgccgtgattctttcaaaaagcaggaagccgtgcaggaagtgtcttttgacgaaccccaggaagaggcgacaggacttcctacttctgtgccccaaattgcagtcgaaggggaagaagccgttcccgtcgcgttagggccaaccggtagagactag

SEQ ID NO: 195138 - DNA, 2523 bp, Artificial Sequence
  Description of Artificial Sequence: Synthetic coding sequence
atggaccccaccgccggcagcaagaaggagcccggcggcggcgccgctaccgaggaaggagtcaataggatcgccgttcccaagccacctagtattgaagaattctctatagttaagcccatctctcggggcgcctttggaaaggtctatctgggacaaaagggcggaaagctctacgctgtgaaggtggtgaagaaggcagatatgatcaacaaaaacatgacccaccaggtgcaggccgagcgagatgcacttgcactatccaagagtccattcattgtgcacctttactacagcttgcagtcggctaataacgtctaccttgtgatggaatacctgataggtggcgatgtgaaatctttgctccacatatacggatacttcgatgaagaaatggccgttaagtatatttccgaggttgccctcgccctggactatctgcaccgacacggtatcatccatcgagatttgaaaccagataacatgttaattagcaacgaggggcatatcaagttaacggacttcggcctgagcaaagtgacccttaatcgagatatcaatatgatggacatcctcacaacacccagtatggctaaacccagacaagactatagtcggactcctggccaggttctgagcctgatttccagcttgggtttcaatacccccatagccgagaagaaccaggatcccgctaatatcctatccgcctgcttgagcgagaccagccagctgtcccaggggctcgtctgtccaatgtcggtcgaccagaaggacaccacaccttacagctctaaattgctcaaaagctgtctggaaaccgttgccagcaatccaggcatgcctgtgaaatgcctcacctctaaccttctgcaaagccggaagcgattggcgacctcctccgctagtagccaatcccacacattcatatcatccgtggaatctgagtgtcattccagccctaagtgggagaaggactgccaggaaagcgatgaagcactcggccccactatgatgagctggaatgccgtagaaaagctttgtgctaaatctgcaaacgccattgagaccaagggctttaacaaaaaggatttagagcttgctctttccccaatacacaactctagtgcacttccaacaacaggccggagttgcgtaaatttggccaaaaagtgtttttctggcgaggtgtcatgggaggccgttgagctggatgtcaataatattaatatggacaccgacactagtcagctgggctttcaccaatccaatcaatgggccgtcgattccgggggcatctcagaggaacatctggggaagcggtcactgaagagaaacttcgagttggtggacagtagcccgtgcaagaagattatccagaataagaaaacctgtgtagagtacaagcataatgagatgactaattgctataccaatcagaatacaggattaactgtggaggtgcaggacctgaagctcagtgtgcacaagagccagcagaacgactgcgctaacaaggaaaatatcgtgaactcttttaccgataagcagcagacaccggagaagctgccaattcctatgatcgccaagaaccttatgtgtgaactggacgaagactgtgaaaagaacagtaaacgagactatctctcctcctccttcctgtgctccgatgacgaccgagcctctaagaacatctctatgaactctgactcctcgtttccaggcatctcaatcatggagagtcctctggagtcacagccactggactcggaccgctcaattaaggaaagttcattcgaagagtcaaatatcgaagatcccctgatcgttacaccggactgccaggaaaagacctccccaaagggggtggaaaaccccgcagtacaggagagcaatcaaaagatgcttggccccccattggaagtcctaaagaccctcgcgagcaagcgaaatgctgtggcttttcgcagcttcaatagccacatcaacgcctcaaacaattccgaaccaagccgcatgaatatgactagcctggacgccatggatatctcctgtgcctactccggcagctacccgatggccattactccaacgcagaaacgacggtcttgcatgccccaccagacccccaatcagattaaaagtggcaccccttacaggactccaaaatccgtgagacggggcgtggctccagtcgacgacgggaggattctcggtactcctgactacctcgcacccgaactgctgctgggtagggcccatgatatcccttggcccgaaggcgaagaaaaactatctgacaatgcacagagcgcagtggagattctgctgacgatcgacgatactaaaagagccggcatgaaggagttaaagaggcatccactctttagcgacgtggactgggagaatcttcaacaccagacaatgccatttatacctcaacctgatgatgaaaccgacaccagttattttgaggcgcggaatacggcccaacacttgaccgtcagtggattctctctgtag

SEQ ID NO: 195139 - DNA, 2640 bp, Artificial Sequence
  Description of Artificial Sequence: Synthetic coding sequence
atggaccccaccgccggcagcaagaaggagcccggcggcggcgccgcaaccgaggaaggcgtgaacagaatcgccgtccccaaacccccctccatagaagagtttagcattgttaaaccaatctcaaggggcgccttcggcaaggtgtatcttggtcaaaaaggggggaaattatatgcggtaaaagtggtcaagaaagccgacatgattaataaaaatatgactcaccaggtacaggctgagagggatgctctggcgctgtctaagtctccttttatcgtgcatttatattatagcctccagagtgcgaataatgtttaccttgtgatggaatatctgattgggggggacgtcaagtccctcttacacatctatggatactttgatgaggagatggccgtgaaatacattagtgaagtcgctttggctctcgattacctacaccgacacggaatcattcatagggatctcaaaccagacaacatgttgataagcaacgaggggcacataaagcttacagactttggactgtccaaggtgacactcaacagagatataaatatgatggacattttgacaacgccaagcatggccaagcccaggcaggactacagcagaacaccgggccaggtgttaagcctgatctcttcgctcgggtttaatacccccatagccgagaagaaccaggatcctgctaacatcctaagcgcttgtctgtcggagacctcacagttatcccaagggctcgtttgtcctatgtctgtggaccagaaggacaccacaccctatagcagcaaactgctgaagtcatgtctggaaacagtggcgtcgaaccccggcatgcccgtgaagtgtcttactagtaaccttttacagagcagaaagcgccttgctacgtcttcagcttcttctcagagccatacgtttataagcagtgtggagtcggaatgccattctagcccaaagtgggagaaggattgccaggaaagcgatgaagctctcggccctacgatgatgtcctggaatgcggtcgaaaaactgtgtgccaagtccgcgaacgctattgagacgaaggggtttaataagaaggacttggagttagctttgagtcctattcacaattcttcagctctgcccaccactgggcgctcctgtgtgaatttagcaaaaaagtgcttttccggagaggtgagctgggaggcggtggagttggacgtcaataatattaatatggacactgacacctcacagttaggctttcaccagtcgaatcagtgggccgtggactccggaggcataagcgaggagcatctcgggaagaggtccctcaagaggaattttgagttggtggacagctcaccatgtaagaagatcatccagaacaagaaaacctgcgtggaatacaaacataacgaaatgaccaactgctatacaaaccagaacacgggtctgactgttgaagtccaggatttaaagttatctgtgcacaaaagccagcagaatgattgcgctaacaaggagaacatcgtaaactctttcaccgataagcagcagacccccgagaagctgcccatccccatgatagcaaaaaatctcatgtgtgaacttgacgaggattgtgaaaagaactcaaagcgagactacctgagctcgagctttctgtgtagtgacgatgatagagctagtaagaacatcagcatgaacagcgacagctcttttcctggcatttctattatggaatctccactggagtctcagcccctggattcggatagaagcattaaagagagctcttttgaggaaagtaatatagaagatcccctaattgtgacaccggactgtcaagaaaagacttcccccaaaggcgtcgaaaatccagctgttcaggaatctaaccagaagatgctgggccctcccctggaagtcctgaagactctggcttccaagagaaatgccgttgctttccgatctttcaattcccacataaacgcatccaataattcagaaccctccaggatgaatatgacgtcattggacgccatggacatatcatgtgcttattcaggaagctacccaatggccattactcccacgcagaaacggcgctcgtgtatgccgcatcaacagacacccaaccaaatcaagagcggcacaccctaccgaactccaaaaagcgtcaggcgtggtgtggctcccgtggacgacggccgtatccttggaacgccagattatctggcgcctgagcttttgctgggccgcgcacacggaccagcagtggattggtgggctttgggtgtgtgcctgttcgagtttctgacaggcatcccccctttcaacgacgagaccccccagcaagtcttccaaaatattcttaaaagagatatcccgtggcccgagggagaagaaaagctttcagataatgcacaaagcgcggtggagatcctcctgaccatcgatgataccaagagggcaggcatgaaggagcttaagcgtcaccctctcttctctgatgttgactgggagaacttgcaacatcaaactatgcctttcattccacagcctgatgacgagaccgatacatcctatttcgaggcaaggaataccgcacagcacctgacagtctcaggatttagcctgtag

SEQ ID NO: 195140 - DNA, 2637 bp, Artificial Sequence
  Description of Artificial Sequence: Synthetic coding sequence
atggaccccaccgccggcagcaagaaggagcccggcggcggcgccgctacagaggagggtgtaaaccgaatcgccgtgcccaagccaccctccatcgaagagtttagcattgtgaagcctatcagccgaggcgctttcggaaaagtgtacctcggtcagaagggtgggaagctctacgccgtcaaagtggtcaaaaaagccgatatgataaacaagaatatgacccaccaggtgcaggctgagcgcgacgctttggcattaagtaagagtcctttcatagtccacctttattacagtctgcagtctgcaaacaacgtttatctggtcatggaatatctgatcgggggcgacgtgaagtccctcctgcatatctatggatactttgacgaagaaatggcggtgaaatacataagcgaggtcgcgcttgctctggattatctacatcgccacggcatcatccatcgggacttgaagccagacaacatgttgattagtaatgagggacacatcaagttgaccgacttcggcctgagtaaggtcacacttaacagagacattaacatgatggatatccttaccactccatcgatggcaaagccgaggcaggattatagccggaccccgggccaagtgcttagcttgatttcatccttgggctttaatacgcctattgctgaaaagaatcaggatcctgccaacattctgagcgcctgccttagcgaaactagccaattaagccagggactggtgtgtccaatgagcgttgatcagaaggacaccacaccatatagtagtaaacttctaaaatcttgtcttgaaacggttgcgtctaaccccgggatgcccgtgaagtgcttgacctcaaatctcctccagtctagaaagaggcttgctacgtcttccgcctcttcacaatctcacacatttatctcaagcgttgaaagcgaatgccacagctcccctaagtgggaaaaagattgccaggagagcgatgaggccctgggaccaacaatgatgtcatggaacgctgtggagaaactttgcgcgaaaagcgccaacgcaattgaaacaaagggctttaataagaaggatctcgagctggctctttcacctatccataattcgagcgccctccccactacagggagatcctgtgtgaacctggcaaagaagtgcttcagtggggaggtgtcgtgggaagcagttgagctcgacgttaataatatcaatatggataccgataccagccagctgggctttcatcagtcgaaccagtgggcagtggactctgggggtatcagtgaagagcacctgggcaaaagaagcctgaaaaggaatttcgagctggtggattccagtccctgcaagaaaattatccagaataagaagacatgtgtcgaatataaacataacgaaatgaccaattgctataccaatcaaaatacgggattgactgtcgaggtgcaggatttaaaactgtcagtgcacaagagtcagcaaaatgactgtgctaacaaggaaaacatcgtaaactcgtttactgataagcaacaaacgccggagaaactgcccatccccatgattgccaagaatctgatgtgcgaactcgacgaggactgcgaaaaaaattcaaagagagattacctatcaagttcttttctgtgctctgatgacgatcgcgcctccaaaaacattagcatgaatagcgattctagctttcccggaatatcaatcatggagtccccccttgagagtcagcccctcgactctgacaggagcatcaaagaatctagttttgaagaaagtaacatcgaagaccccttgatcgtaacccctgattgtcaggagaaaacgtctccaaagggtgtcgaaaatccagctgttcaagaatctaaccagaagatgctaggtccacccttggaagtcctcaagacattagctagcaaaagaaacgccgtcgctttcagatccttcaacagccacattaatgctagtaacaattccgaaccatcgcggatgaatatgacctcactcgatgccatggatatctcctgcgcatattccggaagttaccccatggctataaccccgactcagaagcggcgctcttgcatgccccaccaaacacctaatcagattaagtcgggaaccccatatagaactccgaaatcagtccgccgcggcgtggcccccgttgacgacggaagaatcttgggtacccccgattaccttgcaccagagctgctgctggggagggctcatggaccagccgtcgactggtgggcactcggggtatgtttgttcgaatttttaacgggcattccaccctttaatgatgaaacaccccagcaggtgtttcagaacatcttaaaacgggacattccgtggcctgaaggtgaagagaagctgagtgacaatgcccagtcagccgtcgaaatccttctgaccatcgatgacactaaaagggccggaatgaaggagttgaaacggcaccctctcttctctgatgttgattgggaaaacctccagcatcagaccatgcctttcattcctcagccagatgatgaaactgacactagttactttgaggcccgcaataccgcccagcacctgactgtgtctggcttctccctgtag

SEQ ID NO: 195141 - DNA, 17817 bp, Artificial Sequence
  Description of Artificial Sequence: Synthetic coding sequence
atgcagaagggcctgctggaccaggacaccggcctggtgctgctggagagccaagttataatgtcagggctaatagcacccgaaacaggcgagaatctgagcctcgaggaggggatagctaggaatctcataaatccgcaaatgtatcagcaacttagagagctgcaggatgccctcgccttgattagcaggttgacagagtctcgtgggccattgtcagtcgtcgaggctatcgagaagcggatcatttccgagaccgtggggctgaagattctggaggcccatctggctacaggaggattcagtctgtcaccctcagagaactgtatcaatttagaggaggcctttcaccagggtcttatctctgcctggctgcattccgttttggagtcctaccttcgcacgtccaagaatcttatcgatcccaacacagcagagaagataggacttctggaccttatgcagagatgcattgtccatcaggaaagcggcttcaagctgctgcccgtaaagcagttggctggtggcatggtgagtttaaagtctggcagaaaggtttcaatttttcgagccgtgcaggaagggctgatcgatcggcaagtcactgtccgtctgctggaggcccagctgtttgcaggcgggatcgtggatccacgaacaggacacagactcactgtggaagaggcagtccgccataatctaatagaccaggatatggcttgcgctatcctcatccgccaactgcagaccggcggcattatcgacaccgtaactggccagcgattgacaatcgatgaggccgtttccaatgacctcgtggcagcaaagattgccttagtaatcctggagtcactttggagcttcatgggactgctctggcccgagagtggagagattctgcccataaccgatgcactcgaacagggcatagtgagcactgagttggctcataagattctgagcaatcgtcagcacattaaagccctgttcttaccagcaaccacagaaattctctcctggaaaaaggcaatcgagagcggtatcctggatcgcgatctagcaaacaatctaaagtcgatctgcatccctgacgttatgccccatatgcagctggccgatagtgcggaacaaaatatcaaccctggggccgctgtgcttccatgctctaagagccaccccaaggcaacggcatcccagtccgaaaatttgctcttccagctgatgactcactcctatattaacgtccagaacggccagaggctgcttctcctagacaaggaactgatggagacactgacttcaagagacgagtatcagacctctcctccaaaggtagtcgagatcggacatcagcggcagaagaccccagagggtctgcaggagtccgcgaatgttaagatttccggtaccttctcgtcggggtggaccgtccggcttcctgagtttcaattttctagtcagaacaaggaatacccggaccgcgaagactgcaccaccgagaagggcaagaagacaaccgtcgagaccgaggattcttccgtggaaaaccctgaacaggacctcttcgttgaacagaaggagcgcaatcctaatatcgacgctctcaaggtgattaacaaagtgaaactggaggtgcagcggcagcttatcgggacgcagagggaggaccagaccgcggtaagcgtgagggagaatgccagtaggggtcacctgctgacaatcccgccagcagaggccgagggcgtgcccttggtagtcgataaagatgtcttctccgtggaaacaccaaagaaggagcatcagcctctgagaaataccagtttcacctgtcagaatgaacaggctcatacactggagactgaatatattcacgatgagactgggggctctcacataaaaccccaaagcaagaagctgcaggtgcaagtcaagaaaacccttggcatcaaactcgagcttaagtccgaaaccgacggcaatgttcatccactggataagaaggaaatgttgaagaagacgttcttggctaaagacgatcacaaggaatcacaggaggcacagaacatcgcgggcggaagtatgatgatgtccgaaaagacagacgaggaggactccgggagggaaatctttttgagctgctcgcatccactggaacttctcgaggaggcaactcttaatgtactgagtgcccagttgctcgacggtggcatttttcatgaacagaccgggcagaaactgttgctgaatgaagctatcagtcgggggatagttcctagccacacagccgtgaagctgatggaaaagttgaacatgttccaaggatttttcgactcacaaacatgtgaaagccttaccaccgaggaggtgatcaatgaaggcttgatggacgagaagctcctgcataacgtgttgatggccgataaggccatttctggcgtcctggatcccaggacgcagactctttgtagtgtcaaggacgcagtgactgtaggtctcctggacaaagaaaccgccacccgcatccttgaaaggcaagtcgttacaggcggaattattgatctgaagagagggaaaaaggtgtccgtcaccctcgctagcacgcttggactggtcgacgtggcagatcagcccgagctaataaaccttgagaaagctagtaaggggcgtgacgctgaaaagactgtgagggaacgactcatcagtcttcagatggagacaactggcctgatcgatccagacagcaaggctccactcaccgtcgttcagagcatcgatcgtggcttgcttgaaagggaagaagctgtaaggctcctcaccaaacaggtggtagatggtggtattatccaccacataagtggcatgagattgagcgtggacaacgcattccggcacggcttgataggagaagatctggccgaaaaactcaaacgcgtggagaatcttaatatccatcagatatttaatcctgaaactaaggaaaacatcagcctccctaaggcgatcaaactcgacctgataacctctgatctgaaaagggaaatacaggaagtgcaggcctttactggcaactttgtggacctcatctccggacagcgtctgaccttggcagaagcaaagaaagaaggcctgcttacaaatgaggccgtcttgagccctggcatgatgcacgggatcgtagatccggaaaactgccgaattgtcccatactccgaactcgtgaaaaagtgcaaaattgacatagagtcgggacagcggtacctggaagtaatccctttttcagacataaaggatggggtgtcggataaagtgctgactctcagccaagctattcagctgggcaaagttgacttcgcctctaccctgaaggtcctcgaggcacaagccaatactgggggaatcatcgatacggcgacaggtaaaaggctaaccctcgcctctgcattggaggaaaaactggtcgatgagaacatggtgaggataatcgcgagtcaccaagtgctgaatggggggatagtagatatcttctccgaccaaagggtgacactcgtcgaggcaatcgaaaagcgcctgatttcccccgagctcgccaatatgatccaaattgattccagcgagttctccgaccatagagcgcagattgagaaacaggagggtattgaggtgtgcgctctgcagaatgagtttttaggcaaggatatgctgatcgcgtgcaatcagacggctgagatgtcatgtaataaggtggaagagagcgagcggttgtttcaggtcgagaatcagagcgcccaggaaaaagtaaaagtgcgagtgtcagatggggagcaggctaagaaatcgcgggaaatcagtcttaaggagtttgggtgtaaggatcagcgaaaacctcgcatgtccagtgacgcaaaagaatttataagcataatcaatcctcataatctaaaaggcaagtctctgggacaggtctctctaacccatccctattccgagtgcgactttaaactgaaggaggtagctaggaataacatgggcaacgacaccaatgaagagcaggagaaggctgtcaccaagatagagatcatctctcacatgaagcaatccaccagctgtctggattccgaagagattcgggagaaccagggtgaagtgatcctagaggtgcaagagacatattgtgaaacaagcggcaaactgcctagcgagcaggtgcttcagcagcctatgaatgccagagtcaagtccaagagggaaaagcgcgaggttatagttgaagaatctattagaacctgcaagccggccttcttgtcagaggagaaactgtaccaagagactgccattcgagacgagcatgacagccacattaagtcgcagcccagggaaatgacgagctctgagaaaggcaaggaggctgatacagaaatggggttttccatcacatttaaaatcgaggaaagtagcagccaggtcgtgccacagggtatctccgtgaagcatctggacgccttgactctcttttcctccaagcaggctaacgagggcaaagttaacaatttgtctttgtgcctcaccctgaagcctgaggagaatcttagcagagagattgcctgtggcgcccaaagcgagcccttcccctgtatgactcccagacccgagggactccattatcaagaaagcgacggaaaggcgcaagttacgggaccttctcagatctcgaagaccgacaaatccttccaaggtacgacacgtcaagaaaccaattatcaggacagctgggtgacttccaaaacaaaagagacgaagcatcagatatcatcttccaatgagtgcaaagagaagagctaccaggaggtgagctttgatccagcgaggggtttgaagctcgaggagataaccgtaagtcgacctgactcaaaggaggtgaggtatctcgagttttctgacaggaaagatctgcaccaccaaggctcgaaatcagacgataaattatgcggcacactgaagtccgagatcgccactcaggagttgaccggagagaaattcttagaaatggccaatcccaatgtggctggtttggaagccggatctatcgaggatatcgtgacccaacgaggttcccgggttcttggctcctttctgccagagaagctgtttaagggagtgtcacaaaaggaaaatactgggcaacagaacgcgatcatctcgcctacagtcctagagacctcagaggaaaagacagttagtctgacggtctgtagcgccgtaaagacggaaaaaacaccacaagaaaagctcagagagagtcccgggtctgaacaaacaccctttatgacggctcccgaaggcaagggaaacgggggagtcaaccccgaaccgttccgagccactcagaacgtgttcacgagacagttgtgcctggagcacgatgaaaaattggtgagctacctgagcctcctgaggaatattgaaatgagaaccaaacagatccagccactggagctgaaccttgcagagcttcaggacttgctctgccaggcaaaggtgctggagcgagaactgaaggacttaaccacactggtgagccaggagctagaatgcgtcaaccagattatcatctcgcaacctcaagaagtgccagctcagctgctgaaggccttagagaaagacgccaaaaacctacagaaatccctaagttccgtgtccgatacatggaacagccgtttgctgcattttcagaatgcagtggagatagagaaaactaaagtgctcaaccaacatacacaattagaaggtcgactccaggatctcagggcatgggtcgggaacaagaacctcatacttaatagtaaagggtcaaatagcgagattgacgtggactcccttaacctttgcctccagcagtacgaggatttgaagcagcccatggcagaacggaaagcccagcttgatgctctagctttcgacatccagttctttatttccgaacacgcccaggacctgtcaccacaacagaataggcagatgttgcgtctcctcaatgaactgcaacggagttttcaggatatcctcgagcagaccgccgctcaggtggatgcgctccaaggacacctccagcagatggagcaagaagcactcgtaaagaccttgcagaagcagcagaatacctgtcaccagcagctggaggatctgtgtagctgggtgggccaggctgaaagggctttggcgggtcaccaaggtcgaaccacccaacaggatctctctgctttgcagaagaaccagtccgatctaaaggatctgcaggacgacatccaaaacagggctacctcatttgctaccgtggtaaaggacatcgagggatttatggaggagaatcagacaaagctgagccctcgggaacttacagctctgcgggagaagttgcatcaggctaaggaacaatacgaagctttgcaggaggaaacgagagtggcacaaaaggagctggaggaggccgtcacctcagctttgcagcaggagaccgaaaagtcaaaggccgcaaaagagctggccgaaaataagaagaagattgatgcacttttggattgggtgacctcggtggggagtagtggaggtcaactcctcactaatctccccgggatggagcagctgagcggagctagcctcgaaaaaggcgcccttgatactactgacggatacatgggagttaatcaggcgcccgagaagttagacaagcaatgcgagatgatgaaggcaagacaccaggaactgttgagtcagcagcaaaactttatactggccacacagtcggcccaagccttcctggaccagcacgggcacaatcttactcccgaggaacagcagatgctgcaacagaaactgggcgaactgaaggagcagtatagcacctcccttgcccaatccgaggctgaattgaagcaggtacagacactgcaggatgagcttcagaagttcctgcaggatcacaaagagttcgaaagttggctggagaggtcagaaaaggagttggagaatatgcataaggggggttcttcccccgagaccttacctagcctgctcaaacgtcagggtagctttagtgaggacgttatttcacacaaaggtgatttaaggttcgtgacaatcagtggccagaaggtccttgatatggagaattccttcaaggaaggcaaagaaccgtcagagattggaaatctggtaaaggacaagctgaaagatgctacagagaggtacacggcacttcacagcaagtgcacaaggctgggctcccacctgaatatgctcctcgggcagtatcaccagttccagaatagtgcggattccttgcaggcgtggatgcaggcctgcgaggccaatgttgagaaactgttatccgacacggtggctagcgatcccggagtcctgcaggagcagcttgccacaactaaacagctgcaggaagaactggcagaacaccaggtgcccgtggagaagcttcagaaggttgcccgagacattatggagatcgagggggaacccgcaccagaccaccgacatgtccaggagaccacggattcaatccttagccactttcagagtctgtcatattcattggcagagagaagtagtttgctccagaaggctattgcccaatcacagtcggttcaggagagcctggagagcctgttacagtctatcggggaagtggagcagaacctggaaggcaaacaggtgagcagcttgagcagtggcgtaattcaggaggcactggcaacaaatatgaagcttaagcaggacatcgctcgccagaagtcttccttagaggccacacgcgaaatggtgacccgttttatggaaactgccgatagcactacggccgctgttctccagggtaaactagcagaggtctcccagcgctttgagcagctgtgcttgcagcaacaggagaaagaatcctctcttaagaagttattaccacaggctgagatgttcgagcatttgagcggcaagttgcagcaattcatggaaaataaaagccggatgctagcgagcggcaaccagccagaccaggacattacccacttctttcaacaaattcaggagcttaatctcgagatggaggaccagcaggaaaacttagacaccctcgagcatctggtaacagaattgtcttcctgcggttttgcgcttgatctgtgccagcaccaggacagggtccagaacctccgcaaggattttactgaactccaaaagactgttaaggaaagagagaaggacgcatcaagctgtcaagagcagttagacgaatttagaaaactggtcagaactttccaaaaatggctgaaggagactgaggggtcaatccctccaaccgaaactagcatgtctgccaaggaactcgaaaaacaaattgagcatttgaagagcctcttggatgattgggccagcaaagggactctggtggaggaaatcaattgtaaggggacctctctcgagaatctcatcatggagataactgcacctgatagtcaggggaaaaccggaagcattcttccctctgtggggtcttccgtggggtcggtgaacgggtatcatacgtgtaaggacctcaccgaaatccagtgtgatatgtccgacgtcaatctgaaatatgagaaactagggggcgtgctgcacgaaagacaggagagcttacaggcaatcctcaaccgcatggaggaagtgcacaaagaggctaacagtgtgctgcagtggctggagtccaaggaagaagtccttaagagcatggatgccatgtccagtcctaccaaaaccgaaactgtcaaagcacaagcggagagcaacaaggcctttttggcagaactggagcagaattccccaaaaatccagaaagtgaaggaagccctagcgggacttctggtgacatacccaaatagccaggaagctgaaaattggaagaagattcaggaggagctgaatagccgctgggagcgggccacagaagtaacggtggcaaggcagagacagctcgaggaaagtgcctctcatctcgcatgctttcaggccgcggaatctcagctgcggccctggttgatggagaaggaactaatgatgggcgtgctggggcccttatccattgatcctaatatgctgaacgctcaaaaacagcaggtccagttcatgctgaaagaattcgaggcgcgccggcaacagcacgaacaactgaacgaggctgcccagggcatcttaaccggacctggagatgtgtcactaagcacatctcaggtgcagaaagagctccaatctatcaatcagaaatgggttgagttgaccgacaagctgaattcccgctcttcccagattgatcaagcaatcgtgaagagcacccagtaccaagagcttctccaagatctttcagagaaagtgcgtgcagtaggtcaacgactgtctgtccagtccgcgatttccacccaacccgaagctgtcaagcagcagctcgaggaaacctccgagatacgttccgatctcgaacagctggaccacgaagtcaaagaggcacagacattgtgcgacgagctcagcgtcctcatcggcgagcaatatctgaaggatgaactcaaaaagcgtctggagacggtggccttgccccttcaagggcttgaagacctggctgccgacagaattaatcgcctgcaggcagctttggcctccacgcaacagtttcagcagatgtttgacgagttaagaacctggttggatgacaaacagtcccagcaggcaaagaactgccccatcagcgccaagttagaacgcctgcagtcacaactccaggaaaatgaggagtttcagaagagtttgaatcagcactccggctcctatgaggtgatcgtggccgaaggggagagcttgctccttagtgtacctccgggcgaggagaagcggacgctccaaaaccagctggtggagctgaagaaccactgggaggagctctctaaaaagaccgctgatcgacaatcccggctgaaggattgcatgcagaaggcccagaaatatcagtggcatgtagaggacctagtgccctggatagaggattgcaaggctaagatgtctgaacttcgcgtcaccttggaccccgtgcagctggagtcatccctactgcggtcaaaggccatgcttaatgaagttgagaaacgacggtctctactcgaaatcctcaacagtgccgcggatattctgattaattcttcagaagccgacgaagatggcatcagagacgagaaggccgggatcaatcagaatatggacgccgtgactgaggagctgcaagcaaaaacaggctccctggaggaaatgacccagcggctgcgcgagtttcaggagtcttttaagaacatcgaaaaaaaagtggaaggggccaagcaccagttagaaatctttgatgccctgggctcccaggcatgttcaaataagaatttagaaaagcttcgcgcacaacaagaggttctccaggccctggagccacaagtcgactacctgagaaatttcacccagggtttagtcgaagacgcacctgatgggagcgatgcaagccaattgctgcaccaggcagaggtagcccaacaggagttcctggaggtcaagcaacgtgttaattccggctgtgttatgatggagaataagctcgaagggattggacaatttcattgcagggttcgggaaatgttttctcaacttgctgacctagacgacgaactcgacggcatgggagccattggaagagacacggattcattgcagtcacagattgaagacgtgcgactgttcttgaataagatccacgtacttaagctcgacattgaggcctccgaagctgagtgtcggcacatgttagaggaggagggtactcttgatctgctgggattgaaaagggagctggaggctcttaataaacagtgcgggaagctgaccgagagaggtaaagcaagacaggagcagctcgaactcaccctgggccgagtggaagatttttacaggaagttgaaagggttaaacgacgcgactaccgcggctgaggaggctgaggcactgcagtgggtggtgggcaccgaagtggagataattaaccagcagctggccgactttaaaatgttccaaaaggagcaagtcgaccctctccagatgaagctccagcaggtcaacggtctaggacaggggctcatccagagtgctggtaaggactgcgatgtgcagggactggaacacgatatggaggagataaacgcaagatggaataccctgaacaagaaagtggcccagagaatcgctcagctccaggaggcgctgctccactgtggtaaatttcaagatgctctggaaccactgctgtcttggttggccgacaccgaagagctgatagctaaccaaaagccacctagtgccgaatacaaggtcgtgaaagcacagattcaggaacaaaagctgttgcagaggttgctcgatgaccggaaagcaacagtggatatgctgcaggccgagggaggcaggatcgcccagagtgctgagctggcagaccgtgaaaagattaccggacagcttgagtccctggagtcccgatggaccgaactcctgtccaaagcagccgctaggcaaaaacagttggaggacatacttgtcctggcgaaacagttccacgagactgccgagcccatctcagatttcctgtccgtcaccgagaaaaagctggccaattcggagccggtagggacacagacggctaagatacagcagcaaattattcgccacaaggccctggaagaagacatcgagaaccacgcaacagatgtccatcaggccgttaaaatcggccagagcttgtcttccctcacttccccggcagagcagggagtgttgagcgagaaaattgactctctgcaggctaggtactcagaaatccaggaccgctgctgcagaaaagctgcactgctagaccaggctctgagcaacgctaggctgtttggagaggatgaggtggaagtcctgaactggctggccgaagtcgaggacaaactttcgtctgttttcgtcaaagacttcaagcaggacgttcttcacaggcaacatgccgaccatctggctttgaatgaagagatcgtaaataggaagaagaacgtagaccaagccattaagaatggacaggcgctgctcaagcaaaccaccggagaagaagtactgctcatacaagagaagctggacggcattaagacacgctacgctgacatcacagtaacaagttccaaagccctccgcacactggagcaggctcgtcagttggccacgaaattccaatcaacctacgaggagttaactggatggctgagggaggtggaggaggagttggcaacatcaggagggcagagccctacaggtgagcagataccgcagtttcagcagagacagaaggagctcaaaaaagaggtgatggagcataggctggttcttgacacagttaatgaggtgagcagagccctgctcgagcttgtgccatggcgcgccagggaaggactggataaactggtgtccgacgccaacgaacaatacaaattagtgtctgacactatagggcagcgcgttgacgaaattgacgcagcaattcagaggagccagcagtacgagcaggctgccgacgcggagctagcgtgggtggctgagacgaagcgtaaactcatggcccttggccccattagattggagcaggaccagactaccgctcagttgcaagtgcaaaaggcctttagcatcgacatcatcaggcataaggattctatggatgagctattctcccacagatccgaaatttttggaacgtgtggggaggaacagaagactgttcttcaggagaaaacagagagcttgatccaacagtatgaagctatatccctgctgaatagcgagcgatacgctagactggaacgagcccaagtactggtgaaccaattttgggagacctacgaggagctgtctccctggatcgaagaaacacgagccctgatcgcccagctcccttccccagctatcgatcacgagcagctcagacagcagcaggaggaaatgcggcagttgagagagtctattgccgaacataagcctcatattgacaagctgctcaaaatcggccctcagctgaaggagctgaaccctgaagagggggagatggtggaagagaaataccagaaggcggagaatatgtacgcccagattaaggaagaggtgagacagagagccttggcattagacgaagccgtgagccaaagcactcagatcacagagttccacgataaaatagaacccatgttggagacccttgaaaatttgagttcccgcctaaggatgcctcccttaatcccagccgaggtcgacaaaatccgtgagtgcatctctgacaataagtcagccacagtcgagctggagaaactacagccatccttcgaagctctcaagcggcgcggggaagagctcatcgggcggtcacaaggcgcagacaaagaccttgctgccaaggagatacaagataagcttgaccagatggtgttcttttgggaggatatcaaagctcgggcagaggagcgagaaatcaaatttttggatgttctggagctggcagagaagttctggtatgacatggccgcccttctgaccacaatcaaagatacacaggatattgtgcatgatctagaaagcccaggcatcgatccttccattatcaaacagcaggttgaggctgctgagactatcaaggaagagaccgacggcctccacgaggagcttgagtttattaggattctgggtgccgatctgattttcgcctgcggagaaacagaaaagcccgaggtacgcaaaagtattgatgaaatgaataacgcctgggagaaccttaataaaacatggaaagagcggttggagaaattggaggatgcaatgcaggcagccgtccagtaccaagacacacttcaggctatgtttgattggctggacaacacagtcattaagttgtgtactatgccccctgtaggaaccgatctgaacactgtgaaggaccagttgaatgagatgaaagagtttaaagtcgaggtttaccaacaacaaattgagatggagaagcttaatcatcaaggagaacttatgcttaaaaaggctacagacgagacagaccgagacatcatacgggagccattgactgaattgaaacacctgtgggaaaatctgggggagaagatcgctcaccgtcagcacaaactggaaggggctttgctcgccctgggccagtttcagcatgcgttagaagagttgatgtcttggctgacacacaccgaagaactcctggacgcacaacggccgatcagcggagaccctaaagtcatcgaggtagagttagcgaaacaccacgtgctaaaaaatgatgtgctggcgcatcaggccaccgtcgagacagtgaacaaagctggaaacgagcttctggagtcctctgcaggcgacgatgccagcagcctccggtccagactggaggccatgaaccaatgctgggagagcgttctccagaagaccgaagagagggaacagcaactccagagcacccttcagcaagctcaaggatttcattccgagattgaagatttcctgcttgagttgacgcgcatggaaagccagttgtcggcttccaagcccaccggtggcctccccgagaccgcccgggaacagctggatactcatatggaactgtatagtcagttgaaggccaaggaggaaacttacaatcagctcctggataaggggcggctgatgctgctgtccagagacgacagcgggagtggcagcaaaacggagcagagtgttgccctcttggaacagaagtggcatgtcgtgagctcaaagatggaggaacggaaatccaaattggaggaagccttaaatctagcaacggagttccaaaattccttgcaagagttcataaactggctgactctagctgagcaaagtctcaatatagcttcccctccgtcccttatactaaatactgtgttatctcaaatcgaagaacacaaggtgttcgcaaacgaggttaacgctcaccgcgaccaaatcatcgagctagaccagactgggaaccagctcaagtttctctcgcaaaaacaggatgttgtgctgataaagaaccttttagtgagcgtacaaagtagatgggaaaaagtggtgcagaggagtatagagcgaggaagatccctggacgacgccaggaagcgggctaaacagtttcatgaggcctggaagaagctgattgactggctcgaggatgctgaatctcacctggacagcgaactggagatttcaaatgatccagacaagataaaattgcagctgtccaagcacaaagagttccagaaaacattggggggcaagcaaccagtctatgataccaccattaggaccggccgcgccttgaaagagaaaacactgctgcctgaggatagtcagaagttggacaattttctgggagaggtgcgcgacaagtgggacactgtatgcggaaaaagcgtggaaagacagcataaactggaggaggcgctgctgttctcagggcagtttatggacgcactgcaagccctcgtcgactggctttacaaagtcgagccgcaactggccgaggaccagcccgtacacggcgacttggacctcgtgatgaatctgatggatgcccacaaagtctttcagaaagagttaggtaaacggaccgggaccgttcaggtcctgaagcggtcgggtagggagttgatagaaaatagccgcgatgatacaacctgggtcaaaggccaactgcaggaactttcaacacgctgggacacggtttgcaagctgtctgtgtccaagcaatccaggctggagcaagccctgaaacaggccgaggtcttccgagacaccgtgcatatgctattggagtggctttctgaggctgaacagacactgaggttcagaggagccttgcccgacgacactgaagctttacagtcactgatcgacactcataaagagttcatgaaaaaagtggaggaaaaaagggtggacgttaattctgctgtggcaatgggtgaagttatcctagcggtgtgccaccctgactgcattaccacaattaagcattggatcaccataatcagggcccggtttgaggaagtgctcacatgggcaaagcagcatcagcaaaggcttgagacagcattatccgaactcgtagccaacgccgagttactggaggaactgttggcctggatccagtgggcagagacaacattgatacaacgcgaccaggagccaatcccacagaacatcgaccgggtcaaggccctgattgccgaacatcagacctttatggaagaaatgactagaaagcaacctgatgtggacagggtgactaagacctataagcgcaaaaatatagagccaacccacgctccatttatcgaaaaaagtcgttccggaggccgcaagtctctgtcccagcctactcctcctccaatgcctattctgtcccagagcgaggctaaaaaccctcggattaatcagctgtccgcccgttggcagcaagtctggctactggccctagaacgacaaaggaaactcaacgacgccctcgacagactcgaggaactgaaagagtttgcaaactttgacttcgatgtctggcgtaaaaagtacatgcgctggatgaaccacaagaaatcccgtgtgatggatttcttcaggcggatcgataaggatcaggacgggaaaataactagacaggagtttattgacgggattttggccagcaaattccccacaacaaaattggagatgaccgcagtggccgacattttcgatcgggatggagatggctatattgactattacgagttcgtggctgcactacacccaaacaaagatgcctatcggcctacgactgacgcggataaaattgaggatgaggtgacgcggcaggtcgcacagtgcaaatgtgccaaacggtttcaggtggagcaaatcggggagaacaaatacagattcttcctgggcaaccagtttggcgactcacaacagctgagactggtccggatcctgcgatctactgtgatggtgcgcgtcggggggggttggatggctctggatgaatttcttgtgaagaacgacccatgtcgggctaggggaagaacgaacatcgagctacgcgagaagttcattttacctgagggagcctcccaaggtatgaccccttttagatctaggggtcgacggagcaagccaagtagccgagccgcttctccaacccgctccagctcatcagcgtcacagtctaatcactcttgtacttccatgccgtcaagccccgcaacccccgcttccggcaccaaagtgatccccagttctggatccaaacttaaaaggccaacacctacatttcattcgagccgaacttccctggccggcgacacaagtaatagcagctcacctgcctccactggcgctaagacgaaccgtgccgaccctaagaaaagcgctagcagacctggcagtcgcgcaggaagtcgagccggtagccgcgctagttcccggcggggctccgatgctagcgacttcgacttgctcgagacccaatccgcttgtagtgacaccagcgagtcttcagccgcaggcggccaggggaacagccgccgggggctgaataagcccagcaagatcccaactatgtcaaaaaaaactaccacagcttctccccggacacctggcccgaagagatag

SEQ ID NO: 195142 - DNA, 16293 bp, Artificial Sequence
  Description of Artificial Sequence: Synthetic coding sequence
atgagcagcagcgacgaggagaccctgagcgagcggagctgccggtctgaacggtcttgtcgttcagaacgatcttaccgatccgaaaggagtgggagcctttctccctgtccccccggagatacgctgccctggaatctgcccctgcacgagcagaagaaacgcaagtcccaggactcagtgcttgaccccgctgagcgcgcggtggtgcgggttgccgatgagagagatagggttcaaaaaaagacattcacaaagtgggtaaataaacacttgatgaaagtcagaaaacacattaacgatctgtatgaagacctgcgagatggtcataacctcatatccctcctcgaagttctgtccggtatcaagcttccgagggaaaagggtaggatgagattccataggctgcagaacgtgcagatcgctctggactttctaaagcagcgccaagtcaagctagtcaacataagaaatgatgacattaccgacggaaaccctaagctgacccttgggctgatttggacaatcatcctccacttccagatctctgatatctacataagtggagaaagcggggacatgtcggctaaagagaagttgctgttgtggacccagaaggtgactgcaggctacaccggcattaagtgtacgaacttctcttcatgctggtccgacggaaagatgtttaatgccctcatccaccgttataggcccgacttggtcgatatggagcgtgtgcaaattcagtcgaatagggagaatctcgaacaggccttcgaagttgcggaacgcctgggagtaacccgcctactggacgctgaagacgttgacgtgccttcacccgatgagaagtcagtaataacttatgtgagttccatctatgacgccttccctaaggttcctgagggcggagaagggatttctgctaccgaggtggattctcggtggcaggagtatcaaagtcgtgtagatagcttaatcccctggattaagcagcacacaattctcatgagtgataagacgttcccacagaatcctgttgaactgaaagcactgtataaccagtacatacattttaaagagaccgagattttggcaaaggaaagggaaaagggtcggatcgaggaactgtataagttactggaagtttggatcgagtttggcagaatcaagctgccccagggctaccatccaaatgacgttgaggaagaatggggcaagctgattatagaaatgctggaaagagagaagtccctccgaccagctgtggagagacttgagctgctgttgcaaatcgccaacaagatccagaatggagccctgaattgcgaagagaaattgacattggcgaagaacactctgcaggccgacgcagcccatctggaatcagggcaacctgtccagtgcgagtctgatgtgattatgtacattcaggagtgtgaggggctgattcggcagctccaggtagacctgcagatccttcgggatgaaaattactatcagttggaggaacttgccttcagagtaatgaggctgcaggacgaattggtgaccctacgcttagagtgtaccaatttgtacaggaaaggccacttcacatctttagagctggtgcctccttcaacccttacaactactcacctgaaagctgagcccttgaccaaggccacccactcttcttccacgtcctggtttcggaagcctatgacccgggccgagttagtggccatcagttcaagcgaagatgagggcaatctgcggttcgtgtacgagctcctatcctgggtcgaagagatgcagatgaagcttgagagggcagaatggggtaacgacctgccatcagtcgaacttcagctcgaaactcagcaacacatccacacctccgtcgaggagctgggatcatccgtgaaagaggctagactctatgaaggtaagatgtcacagaattttcatacatcctatgcagaaacgcttggaaagcttgaaacacagtattgcaagctgaaggagacctcgtctttccgcatgcgacacctgcagagtctccacaagtttgtctcccgcgctacggctgagctcatatggttgaacgaaaaagaggaggaagagctcgcgtacgactggtcagataacaactctaacatttccgcaaagcgcaattacttttcagagctgactatggagctggaggagaagcaggacgtattcagaagtctgcaggacaccgcagagctgctgagtttggagaatcaccctgcaaagcagacagtggaggcttacagcgctgcagtgcagagccagctccagtggatgaaacagctttgtttgtgcgtggagcagcacgttaaagagaacacggcctacttccaatttttcagcgatgctagagaattggaaagttttttgcgcaatctgcaggactcaataaaaaggaaatatagttgcgaccataatacctccctgtcacgccttgaggacttattgcaggacagcatggatgagaaagagcagctcattcagagcaagagctccgtcgcctcattggtcgggcgatctaaaacaattgtgcagctcaagccccgatcccctgaccatgtcctgaagaataccatttctgtaaaagccgtgtgtgactacagacagatagaaataacaatctgtaaaaacgacgagtgcgtgctggaagataactctcaacgaactaaatggaaagtcattagtcccaccggtaatgaggccatggtcccttctgtgtgtttccttattccaccccccaataaggacgctatagaaatggcatctagagttgaacagtcttaccaaaaggtgatggcactgtggcatcagcttcacgtgaacactaagagtctaatctcgtggaactatctccgtaaagacctcgacctggttcagacttggaaccttgagaagctacgctccagcgcaccaggtgaatgtcaccagattatgaaaaacctgcaggctcattatgaagatttccttcaagattctcgagattccgttctcttctccgtcgctgacaggctgagactcgaagaggaggtagaagcctgtaaagcccggtttcagcacctgatgaagtccatggagaatgaagacaaagaggagactgtcgccaaaatgtatatcagcgaactgaaaaacattaggctcaggctggaggagtatgagcagcgagtcgttaaacgtattcagagcctcgctagttcccgcacagatagagacgcctggcaggataacgcactcagaatcgccgagcaggaacatacgcaggaggatctgcagcagctccgcagtgacttggacgcagtcagtatgaagtgcgactcattcctacatcagtctccttcctcgagctccgtccctactctgagatccgagcttaacctgcttgtggagaagatggatcacgtctacggattgtccactgtctatctcaataagcttaagacggtcgatgtgatcgtgcgaagcattcaggacgcagagttactggtcaaagggtacgaaataaaactgtcccaggaggaggtagtgcttgccgaccttagtgctctcgaggcccattggagcactctgcgtcattggttgtccgatgtaaaggacaagaactccgttttttccgtgcttgacgaggagattgcgaaggccaaagtggtggctgagcaaatgagccgattaacgcctgaacgcaatttggatctggagaggtaccaggagaaggggtcccagctgcaagagaggtggcacagagttatagctcagcttgaaatccgccagagcgagcttgagagtattcaggaggtacttggcgactaccgcgcatgccatggcacactaattaagtggattgaggagactacagcacaacaggaaatgatgaagccggggcaggctgaagattcccgggtattatccgagcagctgagccagcagacggcgctctttgccgagatcgaaagaaatcagaccaagctggaccaatgccagaaattctcgcaacagtactccactattgtgaaagattatgaacttcagctgatgacctacaaagcatttgtggaatcccagcagaagtcccctggaaagaggaggcggatgttgtcatcgtctgatgcgattactcaggagttcatggacttgcgtacccgctacactgcgcttgtgactcttactacacagcacgtgaagtatatcagcgacgccttgaggcgtttggaagaggaggagaaggttgtagaggaagaaaagcaggagcatgtggaaaaagtgaaggagctgcttggctgggtttcaaccctcgcacggaacacccagggaaaggccactagcagtgagacaaaagagtccaccgacatagaaaaggccatcttagaacaacaagtactgtctgaggaacttaccacgaagaaggagcaggttagcgaggccattaaaacatcacagatctttctagcaaagcacggtcacaagctgtctgagaaggagaaaaaacagatcagcgaacaacttaatgccctgaacaaggcttaccatgatctctgcgacggaagcgccaatcagttacagcagctgcaaagccaattggcccatcagacggaacagaaaacgctgcagaaacaacaaaatacctgtcatcagcagcttgaagacctgtgttcctgggtcggccaggctgagagagcgctcgccgggcatcagggccggacaacccagcaggacctgagtgccctgcaaaagaaccagtcagatcttaaagatttacaggatgatattcaaaatagagccacctccttcgcaactgtggtcaaggacatcgagggatttatggaggaaaatcagaccaaactcagtccccgcgagttgacggctctgagggaaaagttacatcaggcaaaggaacagtacgaagccttgcaggaagaaaccagggtagctcagaaggagttagaagaggccgtcacgagcgcactccagcaggagacagagaaaagtaaggcggctaaggaattggccgagaataaaaaaaaaatcgacgccctgttggactgggtgacttccgttgggagctccggtggccagttacttactaacctgcctgggatggaacagctctccggagcaagcctcgaaaagggggccttggataccactgatgggtacatgggggtgaaccaggctccggagaagttggataagcaatgtgagatgatgaaagctcgccatcaggagctgctctcccagcaacaaaactttattctggccacacagtcagcgcaggctttcctggaccagcacggccacaacctgactccagaggagcagcagatgctgcaacagaagctcggcgagctgaaagagcaatactcaacaagcctggcccagagcgaagccgagctcaagcaggtgcaaaccttacaagatgagcttcaaaagtttttgcaagaccataaagaattcgaaagctggctggagaggagtgaaaaagagttggaaaacatgcacaaaggtggctccagtcctgagacgctgcccagcttgctaaaacgccagggatccttcagcgaggatgtgatttcccataaaggcgatctgaggtttgtgacgatttcaggccagaaagtgctggacatggagaattctttcaaggaaggcaaggaaccttccgagattgggaatctcgtgaaagataaactgaaggacgctaccgagcgatatactgctttacactcgaaatgtacccgactgggctcacatctcaacatgctgctcgggcagtatcaccagttccagaactcagcagattccctgcaggcatggatgcaggcctgtgaagctaacgtggagaagctgctgagcgacaccgtcgccagtgacccaggggtgctacaagagcaactggctactactaagcaactacaggaagaactggctgagcaccaggtcccagtagaaaaactccaaaaagtggcaagagatatcatggagatagagggcgaacccgcaccagaccaccggcacgtgcaggaaactactgacagcattctctcacactttcaaagcttgtcctatagtcttgcagaacgatcgagtttgctgcagaaggctatcgctcagtcacagagcgtacaagagtccctcgaaagtcttctccaaagcataggcgaagtggaacagaatctggaaggcaagcaagtctcctccctctctagtggggtgatccaagaggccttggctaccaacatgaagttaaaacaggatattgccagacagaagtctagtctcgaagccactagggaaatggtaactaggtttatggaaaccgcagattccacaaccgccgccgtgctgcagggcaaactcgccgaggtgtcccaaagatttgagcagctgtgtttgcagcagcaggagaaagagtcatctctgaagaagctcctgccccaggctgaaatgtttgagcacctgtctggcaagctccagcagtttatggagaataagtctcggatgctggcttcaggaaaccaacctgaccaggacattacccatttcttccaacagattcaggagctcaacctggaaatggaggatcagcaggagaatctcgataccttagagcatctcgtgaccgagctgtccagttgtggattcgcgctggacctgtgtcagcaccaggacagagttcagaatctacgtaaagactttaccgagttgcagaaaactgtaaaagaaagggagaaggacgcatcttcctgtcaggagcagttggatgagttccggaaactggtcaggacttttcagaagtggctcaaagaaacagaaggcagcattccaccaaccgaaacatccatgtctgctaaagagctagagaagcaaatcgagcacctaaagagcctactggacgactgggctagtaaggggacccttgtggaagagattaactgtaaaggcacaagcctcgagaacttgattatggaaattaccgcccctgattcgcagggcaaaacagggtccattttgcctagcgtaggttcgtcggtgggatctgttaacggataccatacctgtaaggatctgaccgagattcaatgcgacatgtccgacgtcaatttaaagtatgaaaagttgggaggtgtgctgcacgaacgccaggaatcgctccaggcaattctgaacaggatggaggaggttcacaaggaggccaactccgtcctccagtggctcgagtccaaagaggaagtattgaagtccatggacgcaatgtcctcccccacaaagaccgagacagtgaaagcccaggccgaatccaacaaggctttcctcgcagaactcgaacagaattccccaaaaatccaaaaggttaaggaggcgctggctgggctcctagtaacatacccaaacagtcaggaagcggagaactggaagaagatccaagaagagctgaattcccggtgggagagagcgaccgaggttaccgtggctcgacagcgacaattggaagagtccgccagccacttggcgtgctttcaggctgctgagtcacaacttcggccgtggttgatggaaaaggagctgatgatgggggtcctcgggcccctgtctatcgacccaaatatgttaaatgcgcagaagcaacaagtgcagttcatgctcaaggagttcgaagccaggaggcagcagcacgagcagttgaacgaagcagcccaagggatattgactggaccaggtgatgttagtctgagtacttcacaggttcagaaggaactacagtcgattaatcagaaatgggtagagcttacagacaagctgaattcaagatcttcacagatcgatcaagctattgtgaagtcaacccagtaccaggaattactgcaagacctgagtgaaaaagtcagggccgtggggcaaaggttatcagtgcagtcagcaatttctactcaacctgaggcagtgaagcaacagctcgaagaaactagtgagatcaggtcagatctcgaacagctggatcacgaggtgaaagaggctcaaacgctgtgcgacgagttgtctgtgctcattggggagcagtacctgaaggacgaactgaaaaagcgcctggaaactgttgcgctgccactccagggactggaggatcttgcagccgatagaatcaacaggctgcaagccgctcttgcatccacccaacagtttcagcagatgttcgacgagttgcgtacatggctggacgacaaacagagccagcaggctaaaaattgccccatctctgcgaagctggagcgtcttcaatcacagcttcaggaaaatgaggagttccaaaaatcccttaatcagcactctgggtcctatgaggtgatcgtcgctgagggagagagcttgttgctgagtgtgcctcctggggaagaaaagagaactctgcagaatcagctcgtcgaactgaagaatcactgggaggaattaagtaagaaaacagccgacagacagtctaggctgaaagactgcatgcagaaagcccagaagtaccaatggcatgtagaggacctggtcccttggatcgaggactgtaaggcgaaaatgtcagagctacgagtgaccctggaccctgttcagttagaatcttccttattgcggtccaaggccatgctgaacgaggtggagaaacgacggagtctcttggagatcctgaacagtgccgctgacatactcatcaacagttccgaagcagacgaggatggtattcgggatgaaaaggcaggcatcaatcagaacatggatgccgtgactgaggagctgcaagcaaagaccggtagtctggaggagatgacgcagagacttagggaatttcaggagtccttcaaaaacattgaaaaaaaagtagaaggtgctaagcaccagctcgagatctttgatgcattggggtcacaggcttgttccaataagaatctggagaagctgcgcgctcaacaggaggtgcttcaggcattagagcctcaggtggactacctgcggaattttacacaggggttagtggaggacgctcctgatggatctgacgcgtcccagctcttgcaccaagctgaggtggcccaacaggagttcctggaggttaagcaacgagtgaattcagggtgtgtgatgatggagaacaagctcgagggaatcggccagtttcattgtagagtgcgcgaaatgtttagccagctggcagatctcgacgacgagctggacggcatgggggccatcgggcgggacacagacagcctccaatctcaaattgaggacgtgcgactcttcctgaacaagatccacgtcctcaaactggacatcgaagcatctgaagctgaatgccgtcatatgctggaggaggagggtacactggacttgctgggactgaaaagggaactcgaggctctgaacaagcaatgtggaaagctgacagagagggggaaagcccggcaggaacaacttgagctgaccctgggccgcgtggaagatttttatagaaagctgaagggtctgaacgatgctaccaccgctgcggaggaagcggaggcacttcagtgggtcgtcgggacagaggtggagattatcaaccaacagctcgccgattttaagatgttccaaaaggaacaggtggatcccctgcaaatgaagcttcagcaagtcaacggactgggccaaggactaatccagtccgctgggaaagactgcgacgtccaaggactggagcacgacatggaagaaatcaatgcgcgttggaataccctcaataagaaggtcgcacagcggatcgctcagcttcaggaagctctcctacactgcggtaagtttcaggatgcactggagccccttttgagctggctggctgacactgaagagctgattgcaaaccagaagcccccctccgccgaatacaaagtggtgaaggcccagatacaggagcagaagctgctccagcgactgctggatgatagaaaggccaccgtggatatgctccaggccgaagggggcagaatagctcagtcagcggagctcgccgaccgtgaaaagatcaccggccagctcgaaagtctcgagagtagatggactgagctgctgagcaaagcggcagctcggcaaaagcagctcgaggacattctggtgcttgcaaaacagttccatgagactgccgagcccatctccgattttctctcagtgactgagaagaagctcgccaactccgagcctgtgggcacgcagacggcgaaaatccagcagcagattatacggcataaggcgcttgaagaggatatcgagaatcacgccacggatgtgcatcaggcagtgaagatcggacagtctctctccagcctgacctctccagccgagcagggagtcctctctgagaagattgacagtttacaggccaggtactctgaaattcaggatcggtgttgtcgcaaggcagctctgttggatcaggccctgtctaacgctcggctgtttggggaagacgaggtggaagtgctgaattggctggctgaggtggaagataaactgtcctcagtgttcgtgaaggatttcaagcaagatgtcctccacaggcagcacgctgaccacctggctttaaacgaggagattgtgaatcgaaaaaagaacgtggaccaggcaattaagaatggtcaggccctcttaaaacagactaccggtgaagaagtattgcttatccaggagaaattagacgggatcaaaactagatacgctgacatcaccgtcaccagctccaaggcacttaggaccttggagcaagctcgacaactcgccaccaagttccaatctacctatgaggaactaactggttggttgcgagaagttgaggaagagcttgcaacctcaggtggacagtcaccaactggtgagcaaatcccacagtttcaacagcggcagaaagaactgaaaaaagaagtgatggagcaccgccttgtcttggacaccgtgaacgaggtgtcacgtgcactactcgaacttgttccatggcgcgcgagagagggtctggataagctggtctctgacgccaacgaacagtacaagctcgtgagcgatacaatcggacagagagtggatgaaattgatgccgccatccaaaggagccaacagtacgagcaagccgccgatgctgaactcgcatgggtggccgagacaaaaagaaaacttatggctcttggtcctattcgattagaacaggaccagaccacagctcagctgcaagtgcagaaagccttctctatagacatcatccgccacaaggattcgatggatgagctcttctcccaccgaagcgagatatttggcacatgcggagaagagcagaagactgtcctgcaggaaaagaccgagtcactgattcagcagtacgaggcaatatcgttgctgaattcagaaaggtatgcccgcctggaacgtgctcaggtcctggttaaccagttttgggaaacatacgaggagctgagtccctggatcgaggagacccgagctctcatagcccagctgccaagtcccgcaattgaccatgagcagctgcgacaacagcaggaagaaatgcgccagctccgagaatccatagccgagcacaagccgcatatagacaagctgttgaagattggtccccaactcaaggaactaaatcctgaggagggcgaaatggtagaggagaagtaccagaaggccgaaaacatgtacgcgcagataaaagaagaagtgcggcagcgggccctcgctctagacgaggccgtttcacagagtacccaggtctctcagttccacgacaagatcgagcccatgctggaaacactcgagaacctaagttctcgcttgcgaatgccccccctgattcccgcagaagttgataagatcagagagtgcatctccgacaacaaaagtgctacagtggagctggagaaacttcagccatcgttcgaggcgctaaagagacgcggcgaagaactgattggaaggtcccaaggcgccgacaaggacctggcagcaaaggaaatccaggataagcttgatcagatggttttcttctgggaagacataaaagccagggcggaggagcgcgagattaaattcctggatgtcctggagttggctgagaaattctggtacgacatggccgctctccttacaactatcaaggatacacaagacatcgtgcacgatctggaatccccaggaatcgacccatcaataattaaacaacaggtggaggccgcagaaacaattaaagaggaaaccgacgggttgcatgaggaactggaattcatccgaatcctcggggcggacttaattttcgcctgtggtgaaactgagaaacccgaggtcaggaagtccatagatgagatgaataatgcttgggagaacttaaacaagacctggaaagaacgtcttgagaagctcgaagatgcaatgcaggccgccgtccaataccaggatactttacaagctatgttcgattggctcgataatacggtgatcaaactttgcactatgccgcccgtcggcaccgacctcaacactgtgaaggatcaacttaacgagatgaaggagtttaaggtggaagtttatcaacaacagatcgaaatggagaaactcaaccaccagggagaactgatgctaaaaaaggccactgatgaaaccgatagagacattattcgtgagcccctcaccgagctcaagcatctatgggagaacctaggtgagaagattgctcaccggcaacacaaacttgaaggtgccctgctcgcacttgggcagtttcagcatgcacttgaagagctaatgtcctggttgacacacactgaggaactactcgatgcacaacggcctatttcaggagatcctaaagttatcgaggttgaactggccaaacatcacgtgcttaagaatgacgttctggcccatcaggctaccgtggaaactgttaataaggccggaaacgagctgctggaatcgtccgccggcgacgatgcaagcagtttacgctcgagattggaggctatgaaccagtgttgggagtctgtattgcaaaagacagaagaaagggaacaacagctacagtccacgctgcagcaggcccaaggctttcattctgaaattgaggacttcctcctagagcttactcggatggagtcccagctgagcgcctccaaacctacgggcggcctgcctgagacagcccgagagcagttggatactcatatggagctctactctcagctcaaggctaaggaggagacctataaccagttgctagacaagggccgcctgatgctgctaagtcgcgatgacagcggttccggctccaaaacagaacagagcgttgccctacttgaacagaaatggcacgtggtatcatccaagatggaggagcgcaagtccaagctggaggaagcactgaatctagctaccgagttccaaaattccttgcaagagttcattaattggctgaccctggctgaacagagtctgaatatcgcatcccccccctctctgatcctgaatactgtcctaagtcagatagaggaacacaaggtatttgccaatgaagtgaatgcacaccgggatcagattatcgagctagaccagaccggaaaccaattgaaattccttagtcagaagcaggacgttgttttgataaaaaatctgctggtctctgtacagtctagatgggaaaaggtggtgcaacgcagcatagagcgaggtagatctctggatgacgcgcgaaaaagggctaagcagtttcatgaagcttggaagaaactaattgactggttggaagacgcagagtcacacctcgatagcgaacttgaaatctcaaatgaccccgacaagatcaagctccagctctcaaagcataaagagtttcagaaaactctcggaggcaagcagcccgtctacgatactactattagaacaggccgagcgctgaaggagaagacacttctgcccgaggatagtcagaaactggataactttttaggagaggttcgggataaatgggacactgtatgcgggaaatcagtcgaaaggcagcataaattagaagaggccctattgttttctgggcagttcatggacgctctccaagcactggtggactggttatacaaagtcgaaccacagcttgccgaagaccagcccgtgcacggtgacttggacctggtgatgaacctgatggatgcgcataaagtgtttcagaaggagctgggcaagaggacaggcacagtgcaggttctgaaacgcagcggacgggagctgatagagaactcccgtgatgataccacctgggttaaaggacagctacaggaactgagcaccaggtgggatactgtgtgcaaactgagcgtatccaagcagagcaggttagagcaagcactcaaacaggcggaggtgttccgcgacaccgtgcacatgctcctggaatggctatcagaggccgagcagactctgaggtttcgtggtgcactgcctgatgacaccgaagcccttcagagtctgatagacacacataaggagttcatgaaaaaggtggaagaaaagcgtgtcgacgtcaattcagctgtcgctatgggagaagtgatccttgccgtttgccacccagactgtattactaccatcaagcattggataaccatcatccgggctcgctttgaggaagtgttgacctgggctaaacagcaccaacagcggctggagaccgctttgtcagaacttgtggccaatgctgaacttctcgaggagctgctcgcgtggattcagtgggctgagactacactgatccaacgagatcaagaaccaattccgcaaaacattgacagagttaaagccctgatagcagaacatcaaactttcatggaggaaatgacaagaaagcagcccgacgtcgaccgggtaaccaagacgtataagcggaagaatatcgagcctactcacgcgccttttattgaaaagtcccgttccggtggacgcaaatctctgtcccagccaacaccgccacctatgccaattctgagccagtccgaggctaagaaccccagaattaatcaactgtccgcccgctggcaacaagtctggctccttgccctggaaagacaaagaaagctaaatgacgcactggatcgactggaggagctgaaagaatttgcaaactttgacttcgacgtgtggcgcaagaaatatatgcgatggatgaaccacaaaaagtcccgcgtgatggacttcttccggagaatcgataaggatcaagacgggaaaattactaggcaggagttcatcgatggtatccttgcgagcaagtttcctaccacaaaacttgagatgacagctgtggcggacatcttcgatagggatggagatggctacattgactactacgaatttgtggcagccttacaccctaataaagatgcgtaccgtcccacgaccgatgccgataagatcgaggatgaggtaacacgccaggttgcgcagtgcaagtgtgcgaaacgttttcaggtggagcagataggcgagaacaaatatcgttttggggacagccagcagctgcggctcgttcggattctgcgatcaacagtcatggtgcgggtcggcggaggatggatggctttggacgaattcctcgttaaaaacgatccctgcagagcacggggccgtactaatatcgaactgagagagaaattcattttgccagaaggggccagtcagggcatgacgccattccggagtcgcggccgtcgctccaaaccctccagcagagcggcaagtcctactaggagcagcagcagcgcatcccaatcaaaccattcctgtacctccatgcctagctcaccggctactccggccagtggtaccaaagtcatcccctcctccggctccaagttaaaacgccctactccaacctttcatagctcgcgcacctctctggccggggacacaagcaatagttcatccccggccagcacgggagccaaaactaacagggccgatcccaagaagagcgcttctcgccctggaagccgagctgggtcccgcgccggtagccgagcaagctctcgacggggctctgacgcctcagatttcgacctgctcgaaacgcagtccgcatgcagtgacaccagcgagtcatccgccgcgggtggacaagggaactctaggcgggggctgaataaaccgtccaagatccctacaatgtctaagaagaccaccaccgccagcccccggacacctggaccaaaacgttag

SEQ ID NO: 195143 - DNA, 16293 bp, Artificial Sequence
  Description of Artificial Sequence: Synthetic coding sequence
atgagcagcagcgacgaggagaccctgagcgagcggagctgccggtctgagcggtcttgcaggtcagaacgatcatatcgctcagagagaagcggcagtctgagtccatgtccacccggcgacaccctgccctggaacctaccactccacgaacagaaaaagcggaagagccaggattccgtactcgaccccgccgagcgagcggtggttcgcgtggccgatgaacgagatcgtgtccagaagaagaccttcaccaagtgggtgaacaagcacctgatgaaggtgcgaaaacatatcaatgatttgtatgaagacctcagagatggacataacctgatatcccttttggaggtgctaagtgggatcaagctgccccgggagaagggacgcatgcggttccacagactgcaaaatgttcaaatcgctctggactttctgaagcagagacaggtcaagttggtgaacattcggaatgatgacatcactgatgggaaccctaagttgaccctgggcctgatctggacaatcatcctccattttcagataagtgatatatacatctccggcgaaagtggagatatgtcggctaaagagaagctgttgttgtggacgcagaaggtaacagctggatacaccgggatcaaatgtacgaattttagttcatgttggagcgatgggaaaatgttcaatgcccttatccaccgctacaggccagatctcgtggacatggagcgtgtccagatacaatccaacagagagaatctcgaacaggcctttgaagtcgcggagcggctcggcgtgacaaggttattggatgccgaggacgtagatgtgccctctcccgatgaaaagagtgtgataacatacgtcagctccatttatgacgcttttcctaaagtgcccgaggggggggagggtatttccgctacagaggtcgactcccgatggcaggagtaccagtctagggtggactcactgatcccctggatcaagcagcataccattctcatgagcgacaagacgttcccccagaatcccgtcgaattgaaagcgctgtataaccagtatattcactttaaggagactgaaattttggctaaggaacgagagaagggtcggattgaggagctgtataaattgctcgaggtgtggatcgagttcggacggatcaaactgccccaggggtaccaccctaatgatgtggaagaggaatggggtaaattgattatagagatgttagagcgtgagaaatctctgagaccggctgtcgagcgattagaacttctgctgcaaattgctaacaagattcagaatggtgcactgaattgcgaagagaagctgactcttgccaaaaacacccttcaggcagatgccgcccacctcgagagtgggcaacccgtccagtgcgagtctgatgttatcatgtacatacaggagtgtgaagggctgatccgccaactgcaggttgacctccagatcctgcgcgatgagaattactatcagctggaggaactggcatttagagtcatgcggttgcaggatgagttggtgaccctgaggctagagtgcaccaatctgtaccggaaaggacattttacatccctggagttggtcccgccaagcaccctcaccaccacacatctcaaggctgaacccctcaccaaggccactcacagcagttccacctcttggtttcggaagccaatgacacgggcggagctggttgctatttcttcttccgaagacgaaggcaacctgcgattcgtttacgaactgctgtcttgggtggaggagatgcagatgaagttggagcgcgcggaatggggcaacgacttgcctagcgtcgagcttcaattggagacacagcagcacatccacacgtccgttgaagaacttgggagttctgttaaggaagcccgactgtacgaaggaaaaatgtcccagaattttcataccagctatgcggagactctggggaaactggagactcagtactgcaagctcaaagaaacttcaagcttccggatgaggcatctgcagtcactacacaagttcgtttcccgcgccaccgccgagctgatttggctgaatgaaaaggaagaggaagagctagcctacgattggagcgacaataactctaatattagcgcgaagaggaactactttagcgaactcactatggaactcgaagagaagcaagacgtctttaggtccttacaggatacggctgagttgctgtcacttgaaaaccaccccgccaaacagaccgtggaagcatacagtgcggcagttcagagccagctgcagtggatgaaacagctgtgtctctgtgtcgagcaacacgtgaaggagaacacagcatatttccaatttttcagtgacgcccgggaactggagtctttcctgcgaaacctgcaggatagcatcaaaaggaaatattcctgcgatcataatacctcattgtctcggttggaggatttactccaggattccatggatgaaaaggagcagctgatccagtctaagagctcagtcgctagcctggtgggccgctcaaagacaattgtgcagctgaaaccccggagccctgaccacgtgcttaagaacactatctctgtcaaggcggtgtgcgattacaggcagatagagattaccatctgcaagaacgatgagtgcgtgttagaggataacagccagcggaccaaatggaaggtgatatctcctactgggaatgaggccatggtgccctccgtgtgtttcctcataccccctccaaacaaagatgccattgaaatggcaagccgagttgaacagtcttaccagaaagttatggctctgtggcaccagcttcatgtcaacacgaagtctctcatttcttggaactacctcaggaaagacctcgacctggtccaaacatggaatctggaaaagttgcgttcgagcgcgccaggagaatgccaccagatcatgaaaaatctgcaggcccattacgaagactttctgcaggactctcgcgactctgttctgttcagtgttgctgacagactgagactggaggaagaggttgaagcatgtaaagctcgttttcagcacctgatgaagagcatggaaaacgaggataaagaagagacagtggccaagatgtacattagcgaactcaagaatattaggctgaggctcgaagaatacgaacagcgtgtagtaaagcggatacagagccttgcatctagtagaaccgatcgagatgcctggcaggataacgcactgaggatcgcggagcaggagcacacccaagaggatcttcagcagctcaggtccgacttggacgccgtgtcaatgaagtgtgattcctttctccaccaatcgcccagtagctcttctgtgcctaccctgaggagcgagttaaatctcctggtcgaaaagatggatcacgtgtatggtttatccaccgtgtatctcaacaaactgaaaacagttgacgtgattgtgagatccatacaagacgccgaactcctcgtcaaaggatatgagattaagctgtcacaggaggaggtggtgctggctgacctgagcgcccttgaagcacactggtctacattaaggcattggctgtccgatgtgaaagacaagaattcagttttttctgttctcgatgaagagattgccaaagctaaagtcgttgctgaacagatgtcccggttaacaccggaaagaaacctggacctggaacgatatcaagagaaaggctctcagctacaagagagatggcatcgggtgattgcacagctggagattagacaaagtgaattggaaagcattcaggaagtcctcggcgattaccgagcttgtcacggcaccttaataaagtggatcgaagagacaaccgcccagcaggaaatgatgaagcccggccaggccgaagactctagagtactctctgaacagctctcccagcagaccgctctgtttgccgagatcgagcggaaccagaccaagcttgaccaatgtcagaagttctcccagcagtattccaccatagtgaaggactatgaacttcaactgatgacttataaggcattcgtggaaagccagcagaagagtcctggcaaaagacgtaggatgctgtcttcttccgatgccattacccaggagtttatggacctgcgcacacgatatacagccttggtaactctgactacccaacacgtgaaatacatctccgatgccctgcgcaggctcgaagaggaagagaaggtggtggaggaggaaaaacaggagcatgtcgagaaagtgaaagaacttctggggtgggtgtcaactctggcacggaacacgcagggcaaagctacctcttcagagacaaaagagtctacagatatcgagaaggcaatactggagcaacaggttctgtccgaagagctgacaaccaagaaggaacaggtgtccgaggccattaagacatcacagatattcttagccaagcacggacataagctttcagaaaaagaaaaaaagcagatctcagagcaactcaacgccctaaataaggcgtatcatgacctgtgcgacggatccgccaaccagctccaacagctacaatctcaactggcccatcaaactgagcaaaaaaccctgcagaagcaacaaaacacctgccatcagcagctcgaagacctatgctcctgggtgggtcaggcagagagagccttggcggggcatcaagggcgtacaactcaacaggatctatccgccctgcaaaaaaatcagtccgatctgaaagaccttcaggatgacatccagaacagagccacaagctttgcaactgtcgtgaaggacatagagggcttcatggaagaaaatcagaccaagctgtctccaagggagctgacagctcttcgagagaagctgcatcaagccaaagaacagtatgaagccctgcaagaagagacacgagtggcacaaaaagagcttgaagaggccgtcacctccgcacttcaacaggaaacagagaaaagtaaagccgccaaggagctggcagagaataagaagaagatcgacgctcttctggactgggtgacctcagtgggctcatcgggcggccaattgcttacaaacctgcccggaatggaacaactgagcggcgccagccttgagaaaggcgccttggataccaccgatggatacatgggcgttaatcaggccccagaaaaactggacaaacagtgcgagatgatgaaagcaaggcaccaagaattgctgagccaacaacagaacttcatactcgccacccagagtgcgcaggccttccttgatcagcacggccacaacttgacccctgaagaacagcagatgcttcagcagaagctcggtgagctaaaggaacaatatagtacatctctcgcccagtccgaggccgagctgaaacaggtccaaaccctgcaggatgagctccagaaattcctgcaagaccataaagaattcgaatcttggcttgaacgttccgagaaagagctggaaaacatgcacaaggggggaagttctcctgaaacacttccttctctactgaaacgccaagggagcttttcggaggatgtgatatcacataaaggcgatctgcgcttcgtgaccatctcaggacagaaggtgttggacatggagaatagcttcaaagaaggcaaagaaccatcagagattggaaacctcgtgaaagacaagctcaaagacgccacagaaagatataccgccttacactccaagtgtacaagattaggctctcacctgaatatgctgctgggtcagtaccatcagtttcagaactcggccgacagcttgcaggcctggatgcaggcctgcgaagcaaatgtggagaagttgctgagcgacactgtggccagtgaccctggagtgctgcaggagcagctggcaactaccaaacagctgcaggaagaacttgccgaacatcaggtacctgtcgaaaagctccaaaaggttgccagagacattatggagattgaaggtgagccagcaccagatcacaggcatgtgcaggagaccaccgatagtattctgtcccactttcagagtctgtcatatagcctggctgagcgaagtagcctgctccagaaagctattgcccaaagccagtccgttcaggaaagtctagaaagcctgctccagtctataggggaggttgagcagaacctggagggcaagcaggtatcctccctctcctctggcgtcatccaggaggcccttgccacaaacatgaagctgaagcaagatattgcaagacagaaatcctcgctcgaggccaccagggagatggtgacacgtttcatggaaacagcggacagcacaacggctgccgtcctgcagggaaagttggccgaggtcagtcagagattcgagcagctctgcctccaacagcaggagaaggagtcttctctaaagaaactgctccctcaggctgagatgtttgagcatctgtctgggaagctgcaacagtttatggagaacaagagtaggatgctggccagcggtaaccagccagatcaggatattactcatttctttcagcagattcaggaactgaacctggagatggaagaccaacaggagaacctggacaccctggaacacttagtgactgagctgtccagttgcggcttcgctctcgatctgtgccagcaccaggatagggtgcagaaccttcggaaggattttacagagctccagaaaacggtgaaggagagagagaaagatgctagcagctgtcaagaacagctggatgagttcagaaagctagtccgcaccttccagaagtggctcaaggagacagagggtagcatccctcccactgagacaagcatgtcagctaaagagctggagaagcagatcgagcatctgaagtcactcctggacgattgggcctctaaggggactctcgtcgaggaaatcaattgtaaggggacctccctcgaaaatttgattatggaaataaccgctccagattcccaaggtaagactggcagcattttgccctccgtgggctcaagtgtgggcagtgtaaacggatatcatacatgtaaggatctaaccgaaattcagtgcgatatgagcgacgtaaacctgaaatacgagaagcttgggggggttcttcatgagaggcaagagtctctgcaggccatcctcaatcggatggaggaggtccataaggaagccaactccgtcttacagtggctggaatcaaaagaagaagtcttaaagtccatggatgcaatgtcatctcccacaaagacagaaactgtgaaagcccaagcagagtcaaataaggcgtttctcgctgaactggaacagaattctccgaaaattcagaaggtcaaagaggcgctggcaggactgctcgtgacttatcctaattcacaggaggcagagaattggaaaaaaattcaggaagagctcaactccaggtgggagcgagccactgaagtcaccgtggcacggcagcggcaactggaagagtccgctagccacctggcttgcttccaggccgccgagagccagctgcgtccatggcttatggaaaaggaattaatgatgggagtcctgggcccactcagcatagacccaaatatgctcaacgcccagaaacaacaggtccagttcatgctgaaggagttcgaggcgcgcagacaacagcatgaacagctgaatgaagcagcacaaggaatcttaacaggccccggcgacgtgagtctgtcgacctcccaggtccagaaggagttgcagagcattaaccagaaatgggtggagttaacagataaactgaacagccggagcagccagatcgaccaggccattgtgaagagcacccagtatcaagagctgctgcaggatctatctgaaaaggtgcgggccgtgggacagagactatcggtgcagagcgctatctccacccagcccgaggcagtcaagcagcagttggaggaaacgtcagaaataagatcagatcttgaacagctggaccatgaagtcaaggaggctcagacactgtgcgacgaattgtctgttctaataggagagcagtatctgaaggacgagctcaaaaagcgtttggaaaccgtggcactgcctctgcagggtcttgaggatttggccgcagataggatcaatagactgcaggccgcactcgcttcgacacagcaatttcagcagatgttcgacgaactaaggacatggctggatgataaacaaagtcagcaggctaagaattgccccatcagcgcgaagctcgaaagactccagtctcagctgcaggagaatgaagagtttcaaaagtccctgaaccagcattctggtagctacgaagtaattgttgcggaaggcgagtcccttctcctaagcgtgcctcccggagaggagaaacgcactctccagaaccagctggtggagctgaagaatcattgggaagagctgagtaagaaaaccgcagataggcagtcccgcttgaaagattgcatgcagaaagcccagaagtaccagtggcacgttgaagacttggttccttggatcgaggattgcaaggcgaaaatgagcgagttaagggttaccctggaccctgtacaactcgaaagtagtctgctgcgtagcaaagccatgttaaatgaagtggagaaacgcaggagtctcctcgagatccttaacagcgcggcagacattctcataaattcttctgaagcagacgaggacggcatccgcgatgagaaagctggcatcaatcagaatatggatgccgtgaccgaagaactgcaggcgaaaaccggctctttggaggaaatgacccagagattgcgcgaattccaggaatctttcaaaaacatagaaaagaaagtggaaggggcgaaacaccagttagagatcttcgacgctttaggatctcaggcgtgctccaataagaacctggaaaaacttcgcgcacagcaggaggtgctacaggccctggaaccccaggtggactacctgcggaatttcactcaggggctcgtggaagatgcacccgatggctcagacgcctcacagctcctccaccaagctgaggtcgcccagcaagaatttttggaggtgaaacagcgggtcaattcaggctgtgtaatgatggagaacaagctggagggaattgggcagtttcactgccgtgtgcgggaaatgtttagtcagttggctgacctggacgatgaactcgatggaatgggcgctatcggcagagataccgactctttgcagtcccagatcgaagacgtgcgtttatttctgaacaaaattcatgttctcaaactggacatcgaggctagtgaagccgagtgtcgccacatgctcgaagaggagggtacactcgatctattgggccttaaaagagaactggaggccctcaacaaacaatgcggcaagctgaccgagcggggcaaggcccgacaagaacaacttgagctaacccttggcagggtggaagacttttaccggaaacttaaaggactcaatgacgcgactactgcagccgaggaggccgaagcactgcagtgggtggtgggcactgaggtggaaattataaaccagcagcttgctgattttaagatgtttcaaaaagaacaggttgacccactccagatgaaactgcaacaagtaaacggtctaggacagggtctgatccagtccgctgggaaggactgcgacgttcagggtctggagcacgatatggaggagatcaacgccagatggaacactctgaataaaaaggtcgcgcagaggattgctcagttacaggaggccctactgcattgcggcaaattccaggacgctctcgaacctttgctctcttggctggctgacaccgaagaactcattgccaaccagaagccaccatcagccgagtacaaggtcgtcaaagctcagatccaggagcagaaactgttgcaaagattactggatgacaggaaagcaacagtggacatgttacaggccgagggcggtcgcatagctcagagcgctgagttggctgaccgcgaaaagattacaggtcagctggagagcctagaatctcggtggaccgagctgctatctaaggccgctgcgagacagaaacagctcgaggacattctggtcttggccaaacagttccacgagacagcagagcccatctctgattttttaagcgtaaccgaaaagaagctggcgaatagcgagcccgttggaacacagacggcaaagattcagcaacagatcatcaggcataaggccctggaggaagacatagaaaatcacgctacggacgtgcaccaggctgtgaagataggccaaagcctttcgtctctcaccagccctgcagaacagggcgtgctgtcagagaagattgacagtcttcaagcacgctattctgaaatccaggatagatgctgtcggaaggcagctctgctagatcaggcactctcaaacgcccgtttattcggagaagacgaagtggaagtgctgaattggttggcagaagtcgaggacaaactgtcttccgtcttcgtcaaagacttcaagcaggacgtgctccacagacagcacgcagatcatctggcactgaacgaggagattgtaaacaggaaaaagaatgtggatcaggctataaagaacggccaagcactacttaaacagactacaggcgaagaagtcctgctcatacaggaaaagctggatggcatcaagacccgttacgccgacatcacggtcacatctagcaaagccctgcgaaccctagaacaagcgcggcagctggccacaaaattccaaagcacatacgaggagctgactggctggctcagagaagtcgaggaagaactagctacgtcaggcgggcaatcacctactggcgagcagataccccagttccagcagagacaaaaagagctcaaaaaggaggtgatggaacataggctggtcctggacaccgtcaacgaggtttcccgtgcgctattggaattggtgccttggagggccagggaggggctggataagctggtgtcggacgcgaatgagcagtataaactagtgagtgatacgatcggacaacgtgtcgacgaaatcgacgccgctatccagcgttcccagcagtatgaacaggctgcggatgctgaactggcctgggtcgcagaaacaaagcgcaagctgatggccctggggcccattcgtctggagcaggatcagacaacagcccaactgcaggtgcaaaaggccttcagcatcgatatcatcagacataaggattcgatggatgaactgttctcacaccgatccgaaatcttcggcacatgcggggaggagcagaagacggttcttcaagagaaaaccgaatcactgattcagcaatatgaggctatatccctactcaactcagagagatatgcccgactggagcgcgcccaggtcctcgttaaccagttttgggaaacatatgaggaattgtcaccctggattgaagagacccgagccctgatcgcccaacttcccagccctgccatcgatcatgagcagctgcgtcagcagcaggaggagatgcgccaactccgcgagtccatcgctgaacataagccgcacatcgataagctcctgaaaattggtcctcagctgaaagagctgaaccccgaagaaggagagatggtggaggaaaagtaccagaaggcggagaacatgtatgctcagattaaggaggaggtccggcaaagggcattggcgctcgacgaggctgtgagtcagtctactcagatcaccgagttccacgacaagatagaaccaatgctcgaaacccttgaaaatttgagcagccggctgaggatgcctccactgataccagcagaagtcgacaagatacgagaatgtatcagcgataataagtccgctactgtggaactcgaaaaactacagccctcatttgaagcacttaagcggagaggcgaggaattaatcggtagatcacaaggagcagacaaagacctggcagctaaagagattcaagataaactcgaccagatggtcttcttttgggaagatatcaaggcccgcgctgaagagcgagaaatcaagtttttagacgtgcttgaactggcagagaaattttggtacgatatggccgccctactcaccactattaaagacacccaggatattgtgcacgacttggagtctccaggcatagatccttctattataaaacagcaagtcgaagcagctgaaactattaaggaagagaccgacgggctgcatgaggaactcgaattcatcaggattctcggcgcagatctgatcttcgcctgtggcgaaacagagaaaccagaggttagaaaaagtatcgatgaaatgaacaatgcctgggaaaaccttaacaaaacatggaaggagcggctcgagaagctcgaagatgccatgcaggccgctgtacagtatcaggacactctgcaggcgatgtttgactggttagacaacaccgtgattaagctttgcacaatgccacccgtgggaactgatctgaacaccgtcaaagaccaactaaatgagatgaaggaattcaaggttgaggtttatcagcaacaaatcgagatggagaaattaaaccatcagggcgaactcatgcttaagaaggccactgatgagactgacagggacattatccgcgagccgttaacagagcttaaacatctgtgggagaaccttggagagaagatagctcaccgacagcacaagctcgagggcgccttactggccctggggcaatttcaacacgccctggaggagttaatgtcctggctcacacataccgaggagctgctggatgcccagcggcctatcagcggcgacccaaaggtgattgaagtggagttggccaagcatcacgtgttaaaaaacgatgtgctcgcgcatcaggcaacagttgaaactgttaataaggccggtaacgaattgctggagtcctctgcaggtgatgacgctagctccctcaggtctcgtctggaagctatgaaccagtgttgggaaagtgtattgcagaaaactgaagagcgggaacagcagctccagtctaccttgcagcaagctcaggggttccactccgagatcgaggattttctactggagttgacccgcatggagagccagttgtcagcttctaagcctaccggcgggctccctgaaacagcccgggaacagctggacacacatatggaactctacagtcagctcaaggccaaggaggaaacgtacaatcagctgctggacaaaggtcgattaatgctactctcccgggatgattccggcagcgggagtaagacggagcagtccgtagccctgctagaacagaagtggcatgttgtgtcaagcaaaatggaggaacgcaagagtaagctggaagaagctctgaatttggccacagaatttcagaacagcctccaggaatttatcaactggctcaccctcgcagaacagtcacttaacattgctagccctcctagtctaatactgaataccgtcctctcacagatcgaggagcacaaagtgttcgccaacgaggtcaatgctcatagggaccagattatcgagttggaccaaacaggaaatcagctcaagtttttgtcacaaaagcaggatgtagtgttgatcaagaatctgcttgtgtctgttcagagtagatgggagaaagtggtgcagcgctccattgagaggggaagaagtctcgacgatgcccgcaagcgagctaagcagttccatgaagcatggaagaaactgatcgactggctcgaggacgctgaatcacacctggatagtgaactggagattagtaacgaccccgacaaaattaagttgcagctgtctaagcacaaggagtttcagaagaccctgggcggcaagcagccagtgtacgacacaaccatcagaaccgggagagccctgaaggagaaaactctgctgcctgaggatagccagaagctcgacaattttttaggggaggtcagggataagtgggacactgtttgcggcaaatcggtggaacgacaacataaactggaggaggcactgctgtttagcggccagtttatggacgccctgcaagccctagtggactggctttataaggtggagccacaattggccgaggaccagcctgtgcacggagacctggacctggtgatgaatctgatggacgcccataaggtcttccagaaggaactgggaaagaggaccggtacagttcaggtgctgaagagatcaggtagggaactgatcgagaactccagagacgacacaacatgggtgaagggacagctgcaggaactatccactcgctgggacactgtgtgcaaactgtcagtgagcaagcagtccagattagagcaggccttgaagcaggctgaagtgttccgcgatactgttcacatgctgctggagtggctgagtgaagctgaacagacccttcggttccgtggggcgctgccagatgacacagaggcacttcagagtcttattgatactcacaaagaatttatgaagaaggtagaagagaagcgggtcgacgtaaactcagctgtcgctatgggggaagtgattctggctgtgtgtcacccagactgtattaccaccatcaaacattggattacaatcataagagcgaggttcgaggaggtgctcacctgggcgaaacaacaccagcagaggctagaaaccgctttatctgaactagtagctaatgcagagctgctcgaagagctgttagcatggattcagtgggccgagacaacattaattcaacgggaccaggaaccgatcccacaaaacattgatagagttaaggcgctgattgccgagcaccaaaccttcatggaagaaatgactcgtaagcagcctgatgtcgaccgggtgacaaaaacctacaagagaaaaaacattgaaccaacccatgccccatttattgagaaaagcaggtctggcggacggaaaagcttaagtcaaccaacgccaccccctatgcccattttatcccaatctgaagcaaagaacccacgaatcaatcagctgagcgcaagatggcaacaggtttggctcctggccctggagcgtcagcgcaagctaaatgatgcactcgaccgccttgaggagttgaaagagttcgcaaactttgacttcgatgtctggcggaagaagtatatgagatggatgaaccacaaaaaatctcgggttatggattttttcaggcgtatcgataaagaccaagatggaaagataacaaggcaggaatttatcgatgggattctcgcctctaagtttcccaccaccaagctggagatgactgcggtggcggatatatttgatcgcgatggagatggatacatcgattactacgagtttgtggccgccctacatccaaacaaggacgcctacagacccaccactgatgctgataagattgaagatgaggtcacgagacaagtggcccagtgtaaatgtgcgaaacgcttccaggtcgagcaaatcggggagaacaaatataggttcggcgattcccaacagttgagactggtccgcattctgaggagtaccgttatggtgagggtggggggcggttggatggcactcgacgagtttcttgtcaaaaatgacccatgtagagccaggggtaggacaaacatagaactccgagagaaattcatactcccggagggggccagtcaaggtatgacccccttccgcagtcgcgggagacgatctaaaccttcaagtcgggcagcctctcctacccgcagtagctcgagcgcctcacagtctaaccatagttgcacttctatgccttcctctcccgcgacacccgcctcaggaactaaagtgatcccctcatcaggctctaaacttaagaggcccaccccgaccttccactcgagcaggactagcctcgccggcgatacaagcaatagttcgtctcccgcgagcaccggtgcaaagaccaatagagccgaccctaaaaagagcgccagcaggccgggtagcagagccggatctagagccggctctcgcgcaagctcacggcgaggaagcgatgcaagtgattttgacctgctggaaacacaaagtgcctgctccgacacatcagagtcctccgccgccgggggccagggaaacagcaggcggggtctgaacaagccttccaaaatcccgacgatgagtaagaagacaaccaccgcttctccccgaacgccaggtccaaagaggtag

SEQ ID NO: 195144 - DNA, 3189 bp, Artificial Sequence
  Description of Artificial Sequence: Synthetic coding sequence
atgggcaacagcctgggctgcttcaaggagcccaaggagagcatcgctattccggagaaagcccctatcagccctaaaaaacgcgtgaggtttaagcgcagatggcgcgggaaaaagatccccactcctgaagcctcccaccaggaagaaacttccgaagggactggcgtgattgaagaaactgaaactttaaccaagctaactgaatccctgcaaaaagaagacggcgtcggcggagtcgaacatactccacccgacattctcctcccaggcgattctgctcctaattctcgggtcgtggatagagggatgattgtgcaggtgaaggagcggtttcaaggtgaagtccaaaccgcccatctgctgctggagaacgaaagctcagtggcgggtggagtttgggactcattagaggagggcatgacggtgattgcccacctgctcgacaacccagcagaacgtaattgcgagaagtcagtgtcccagcttgtggaattccctaggaccgcctcctgctcctcccgcgctgtgctgcttcccctacagggggaaactgccgtagagaaagggaacatacaacgcggatttaggtcatgtgctttgccacggactgattaccctactgataagggcaaccaagagcagttcagtgagggatggtcagtcgaggaaggaactaaatcggtgtccggtgctccccagactgccagctggatcatcgagtgcagtgtaagctcactcttactggatcagcctggcggacagagacgtaccgagccctcacacgtcggccaggttcccccacaggattcccgcctgcccacatcccagagcgatctaagtatttccggcgtgaccgttagcattcttccttcgtctagtggctatgggagtgatgggcctcatatccatggcattcaacccaaggacaccgaaccagaaaagtcttcaacctcttttagcgaagaagacggaacactcagcctggaagcctctcacacgcccagctggggcctcgaggaaatcagcgatatttacatttctggcgaatctggcgacatgtccgctaaggagaagctgctcctgtggactcagaaagtaacagcgggctacaccggaatcaagtgcacaaacttttccagttgttggagcgatgggaagatgttcaatgcccttattcatcgctaccgacccgacttggtggacatggagagagtgcagatacagagtaaccgagagaacctggagcaggctttcgaagtcgctgaaagattgggtgtgacaaggctcctcgacgctgaggatgtcgatgtcccctctccagacgagaaatcagtgattacctatgtgagttccatttacgacgcgttccctaaggtgcccgagggaggagaggggattagcgcaacagaagtggatagtcgttggcaggagtaccagtccagagtcgatagcttgatcccatggattaagcaacacaccatcctgatgagcgataagacatttccccagaacccagtagagttgaaagccctgtacaaccagtacattcatttcaaagaaacagagattctagccaaagagagagagaaggggcggattgaggaactgtataagctgttagaagtatggattgagtttggccgcattaagctacctcagggctatcacccaaacgacgtggaggaggaatgggggaaacttataatcgagatgttggagcgcgaaaagtccctgcggcccgctgtagagcgcctcgaactgcttctgcaaatagccaacaaaatccagaacggagccctcaactgtgaggagaaacttactctagcaaaaaatacactgcaggcagacgccgctcacctggagtcgggccaacctgttcagtgcgaatcagacgtaattatgtatatacaggagtgcgaaggcctcatacgccaactccaggtggacttgcagatcttgagggatgagaactattatcagctggaagaactcgcattcagagtgatgaggctgcaggacgagctggtgaccttacgcctggagtgcacaaacctttataggaaagggcactttaccagtctcgagctagtgcccccctccactttgactacaacccacttgaaggcggagccccttaccaaagctactcattctagtagcacctcgtggtttaggaagccgatgaccagagctgagttggtggctattagctcaagcgaagacgaagggaacctccgtttcgtctacgagcttctgagctgggtcgaggaaatgcagatgaaactggagagggctgagtggggaaatgatttgccctccgtcgagctgcaactcgaaacccaacaacacatccacacaagtgtggaagaactgggctcaagtgtgaaggaagcgcgactttatgagggcaagatgtcccagaacttccacacatcctatgccgagactttgggcaaactggagactcaatactgtaagctaaaggaaacctcctcttttcgcatgcgccacctccagtcattgcacaagttcgtcagcagagcaaccgccgagctgatttggcttaacgaaaaagaggaagaggagctcgcttatgactggtccgacaataactctaacatcagcgctaaacgcaattatttttccgaacttactatggagctagaagagaaacaagatgtttttaggtccctgcaggacactgccgagttgctgagcctggagaaccatcctgccaaacagaccgtcgaggcatatagcgccgccgttcagagccaactgcagtggatgaagcaactctgcctctgcgtcgagcaacacgtgaaggagaacaccgcctactttcagttttttagtgatgcccgagagctggagagctttctcagaaatctccaggatagtattaaacggaaatactcctgcgaccataatacctctctgtctaggctggaagacctgctgcaggactccatgttccaggatgagaaagagcagttgatccagagcaagtcttccgtggcctctctggtaggtcggtcaaagacaatagtgcagctcaaaccccgctcccccgaccacgtcttgaaaaatactatatccgtgaaggccgtctgtgattacaggcaaatcgaaggtagaaccatcttaagtgagggatacggaccattggctagcgcagcctgctag

SEQ ID NO: 195145 - DNA, 22167 bp, Artificial Sequence
  Description of Artificial Sequence: Synthetic coding sequence
atgagcagcagcgacgaggagaccctgagcgagcggagctgccggtctgagcgaagctgcagaagtgagaggtcgtatcgctcagaacggagtggttctctctcaccatgccctcctggtgacactctgccctggaacctgcccttacatgagcagaaaaagcgcaagagccaggactccgtgctggatccagcagagcgtgcggttgtcagagtcgctgatgagcgcgatcgtgtgcagaaaaaaacattcacaaaatgggtaaataagcatctcatgaaagttcgcaaacatatcaacgacctctacgaagatctgagagacggccacaacctcatctcactccttgaggtcctgtctggaataaaattaccgcgtgagaaaggcaggatgcgcttccacaggctccagaacgtccagattgcgctggattttcttaagcagagacaggttaagctcgtcaatatccgcaatgacgacatcacagatgggaacccaaaacttacactcggtctcatctggacaataattctccactttcagatcagtgatatttatatttcaggtgaatcaggagatatgagcgctaaggagaagctgctcctttggacacagaaggtgaccgccggctatacaggtatcaagtgcacgaacttttcttcctgctggagtgacggcaaaatgtttaatgcactcatccatagataccgtcccgatctggttgacatggagagggtgcagatccagtccaatagggagaatctcgaacaggctttcgaggtggcagagagactgggcgtcacacgactactggatgccgaggacgtggacgtccctagtccggatgagaaatccgttatcacatacgtgagctcaatctatgatgcattccctaaagtgcccgagggtggcgaaggtatcagcgccacagaggtcgattcccgatggcaggaataccagagtagagtggactcgctcattccatggataaaacagcataccatcctgatgtccgacaagacgttcccacaaaaccctgtcgaattaaaggcactgtataatcaatatatccactttaaagaaactgaaattctggctaaggaacgagagaaaggcagaattgaggaactttacaagttgctggaggtatggatcgagttcggcaggatcaaattacctcaaggttaccatcctaatgacgtggaggaggagtggggcaagctcattattgagatgcttgagcgagaaaaaagcctgcgccctgccgtcgagcgccttgaactgcttttgcagatagctaacaagattcagaacggcgcgttgaattgcgaagaaaagctgactctggctaagaacacgttgcaggctgacgccgcgcacttggaaagcgggcaacctgtgcagtgtgagtcagatgttatcatgtacatccaagagtgtgagggactgataaggcaacttcaggtggacctgcagattctgcgggatgaaaattattaccagctcgaagaactcgcatttagagtcatgagattgcaggacgagcttgtgacactgagactcgagtgcaccaatctgtacagaaagggacacttcactagcttggagttagtgcctccatctactctcacgacaacccacctaaaggccgagccattgaccaaggccacacacagttcttctactagctggttccgtaagccaatgactcgcgctgagctcgttgccatttcatccagcgaggatgaaggtaacctccgcttcgtttatgaactgctgtcttgggttgaagaaatgcaaatgaagttagagcgtgctgaatggggaaatgaccttccctctgtggagctacagctcgaaacacaacagcacattcacactagcgttgaagagctgggctcatctgtcaaagaggcccgactgtacgagggaaagatgtcacaaaattttcacactagctatgcggaaaccttgggaaaacttgagacgcagtactgtaagttgaaggaaactagctccttccgaatgcggcacctacagagtctccataagtttgtctccagggcgactgcagaactgatttggctgaacgagaaagaggaagaagaactcgcctacgactggtcagataacaattcgaacatttccgccaagcgcaactactttagtgagctgactatggagctggaggagaagcaggacgtgttcaggtctttgcaggatactgctgagctcctgtcactggagaatcatcctgcgaagcaaactgtcgaagcctacagtgccgcagtgcaaagtcagctgcagtggatgaaacagttgtgcctgtgtgtggaacagcacgtcaaggaaaacactgcttatttccagtttttttccgatgcgagagagttagaatcattccttcggaacctgcaggactcgattaagcggaagtacagttgcgaccataacacaagcctctcgcgtctggaggatctgctgcaggattccatggacgagaaagagcagctcatacagtctaagtctagcgtagcaagcctggtgggccggagcaagactatcgtacaacttaagcctcgtagccccgatcacgtgttgaagaacacaatttcggtgaaggcagtgtgcgattaccgccagatagagataactatttgcaaaaatgacgagtgcgtcctggaagacaactcacaaagaactaaatggaaggtcatctctcccaccggaaacgaggcgatggtaccttcagtgtgttttttgatacctccacccaacaaggatgccatcgagatggctagtagggtcgaacagagctatcagaaggttatggccttatggcatcagttgcatgtgaacaccaagagtctgatctcttggaactacttgaggaaagatctcgatctcgttcagacctggaatctggagaagctgaggagcagtgctccaggagaatgccaccaaattatgaagaacctgcaagctcactacgaagacttccttcaagatagccgggatagcgtcttattcagcgtagctgataggttaaggcttgaagaggaggtcgaggcatgcaaagcccgattccagcacctcatgaaatcaatggaaaatgaagataaagaggagacagtcgctaagatgtatattagtgagctaaagaacattaggctgcgtctagaagaatatgagcaacgggtcgtgaagcggatccagtcactggcatctagccggaccgaccgagacgcgtggcaggataatgctttgagaatagctgaacaggagcatacacaggaagatctgcagcaactaagatctgatctggacgcagtctccatgaaatgcgattcctttctccaccagtctccaagctcatcaagtgtgccgacactgcggagtgagcttaacttgctcgtcgagaagatggatcacgtttacgggctgtcaacggtgtatctcaacaaactcaaaaccgttgacgtcattgtgaggagtatacaggatgcagagttactggtaaaaggttacgaaatcaagctttcccaagaggaagtggtcctcgcggacctcagcgccctggaggctcattggagcacactgcgccattggctgtctgatgttaaggacaaaaacagcgtcttttcagtgctcgatgaggagatcgccaaggccaaggtagtggctgaacagatgtcccgcttgacacctgaacgcaatcttgatctcgagcggtatcaggaaaaagggagccagttgcaggaacggtggcaccgggtcatagctcagttggaaatcaggcagtccgagctggagtcgattcaggaagtgcttggagactacagagcttgtcatggcacgctcatcaagtggatagaggagaccacagcccagcaggaaatgatgaagccaggacaggctgaagatagcagggtattgtccgaacagctgtctcagcagacagctttgtttgctgagatcgagaggaatcagactaaattggatcagtgccagaagttctctcagcagtacagtaccatagtgaaggactacgaactgcagctgatgacatacaaggctttcgtagaaagtcagcagaagagccccggcaagagacgcagaatgttgtcaagcagcgatgcaattacacaggaattcatggaccttaggactcgatacactgccctagtgacactgacaacccagcacgtgaaatatatcagcgacgcactgcggcgtctggaggaagaggagaaggtagtagaggaggagaaacaggagcatgtagagaaggtgaaggaactgctgggctgggtgtccactcttgcccgaaacacacagggtaaagccacaagctccgaaaccaaagagtctacagatattgagaaggcaattctggagcagcaggtactctctgaagagctgactactaaaaaggaacaggtgtcagaagcaatcaaaaccagccagatctttcttgccaaacatggccacaagctttctgaaaaagaaaaaaagcagatctctgaacagttaaatgcccttaacaaagcttaccacgacctgtgcgatgggagtgcgaatcagctgcagcagctgcagtcccagctcgcccaccagactgaacagaaagagtgccgcgcagttgcgggtgtcattgacttaggtacagtagaaatttttcctatattcaaggctatgcagaaggggctgctggaccaggataccggcctggtcctgctcgagtcccaagtcattatgtctggtctcatagcccccgagactggagagaacctgagcctggaggaggggatcgcaaggaacctgatcaatccccaaatgtaccagcaactgagagagttgcaggacgccctggctttgataagcaggctgacggaaagcagagggcccctcagcgtcgtggaagccattgagaagagaattatctccgagacagtgggattaaagatcctcgaggcccatttggctaccggaggcttctccctgtcccctagcgaaaactgtattaatctcgaggaggccttccatcaggggctgatttccgcatggctccactctgtgttagaatcttacttgagaacctcaaagaaccttattgaccccaacactgcggagaagatcggtttactcgacttgatgcagaggtgcattgtccatcaggagtccggctttaaactgctgcctgtgaagcaactggcaggagggatggtaagtttgaagtccgggaggaaggtgagtatttttcgggcggttcaagaagggctgatagaccgtcaagtaacagtccgtctcctggaggcgcagctgttcgccggaggaatcgtggatccacgcactgggcaccgtctgaccgttgaagaggcggtaagacacaatttgatcgatcaggacatggcatgtgctatcctgataaggcagctgcagaccggaggcatcatagatactgtgaccggccagagactcactatagacgaggccgtaagtaacgacctggtcgcagcaaagattgctctcgtgattcttgagagcctgtggagtttcatgggtctgctgtggcctgagtcaggggaaattctgcctataacagatgcgctcgagcagggtatcgtcagtactgaactggctcataaaatcctgtcaaataggcagcacattaaagctcttttcctgcccgccacaaccgaaattctcagctggaagaaggctatcgaaagcggtatcctggacagggacctggcaaacaacttaaaatccatttgtatcccggacgtcatgccccacatgcaactcgccgactccgcagagcagaatattaatcctggagcagccgtcctaccctgctccaagtcccacccaaaagccaccgcctctcagtctgagaacttgttgtttcagttgatgactcactcatacatcaacgtgcagaatgggcagcgactgctgcttctggataaggagttaatggagactcttacctcgcgagatgagtatcagacaagcccacctaaagtggttgaaatcggacatcaaaggcagaaaacaccagaaggcctccaagagtcagccaacgtaaaaatctccggtacattttctagcggttggacagtgagactgcccgagttccagttctccagccagaataaagaatatcccgatcgagaggattgcacaacagaaaagggaaaaaagacgaccgtcgagaccgaagactctagtgtcgagaacccagaacaggacttgtttgttgagcaaaaagagcgcaacccaaacatcgacgctctgaaagtgatcaataaagtgaagctcgaggtgcagcggcagctgattggtactcagcgagaggatcagacagccgtgtcagtcagggagaacgcttcccgcgggcacttgctgacgattccacccgctgaagcggaaggcgtacctttagttgtggacaaggacgtcttcagtgtcgagaccccaaagaaagaacatcagcctctacgtaacacctccttcacctgccagaacgaacaggctcacacactagagactgaatacattcacgacgagactggcggctctcacattaagccccaatctaaaaagctgcaggtgcaggttaaaaaaacattggggatcaaactcgagctgaagagcgagactgatggtaatgtacaccccctggacaagaaggaaatgcttaaaaagactttccttgcgaaagacgaccacaaggagtcacaggaggctcagaatattgccggcggttcaatgatgatgtctgagaagacagatgaggaagactcaggtcgagaaatctttttgtcgtgtagccacccccttgaactgctggaggaggccacgctcaatgttcttagcgctcagctcctcgacggcggtattttccatgagcagacaggacagaaactgctcttgaacgaagcaattagtaggggtatagtgcccagccatacagcagtgaagttgatggagaagttgaatatgttccaggggtttttcgactctcagacctgtgagagtcttacaaccgaagaagtgatcaacgagggtctgatggacgagaaattattgcacaatgtgctcatggcagacaaggcgatctccggggtgctggacccacgcacgcaaaccctttgtagcgtgaaagatgctgtgaccgttggtctgctcgacaaagaaacagcaacccgaatcctggaaagacaagtagtcacaggtggcatcattgatctcaagcgcggtaagaaggtgtccgtgacgttagcatccacactggggctggtcgacgtagcagatcagccagagctaattaatctggagaaggcatctaagggacgcgacgctgagaagactgtacgcgaacgtctcattagcctccagatggaaaccactggtttgatagaccctgatagcaaggcccccctgaccgtcgtacagtctatagatcgaggccttctggaacgcgaagaagctgtccgactcctgacaaagcaagtggtggacggcgggattattcatcatatatccggcatgaggctgagcgtggataacgcttttcgccacggcctgatcggtgaggatctcgccgaaaagctcaagagggtagagaatctgaacatccaccagatttttaaccccgagacgaaagaaaatatttccctgccgaaagcaattaagctcgacctcattacctccgatctcaaacgggaaattcaagaggtgcaggcttttacagggaacttcgtggacctgattagcggccagagactgacactggcggaggccaaaaaagaaggtttactcaccaatgaggccgtgctgagtcctggcatgatgcacggtatagttgaccctgagaattgcagaatcgttccatatagcgaactggtcaagaagtgtaagatcgacattgaaagtggccagcggtacctggaggtaatccctttttcagacattaaagacggtgttagcgacaaagttctcaccttgagccaggccatacaactgggcaaggtcgatttcgcctccactctgaaagtcttggaggcccaagccaatacaggggggattattgacactgctacaggaaagaggctgactctagccagcgccctcgaggagaagctagtagacgaaaacatggtccgtattatagcctcacaccaggttctcaatggcggaatcgttgacatcttttcagatcagcgcgtgaccctggtggaggctatcgaaaaaagactgatttcccccgaacttgccaacatgatccaaatcgacagctctgaattttcagaccaccgggcccaaattgagaagcaggaaggaatcgaagtctgtgcactgcaaaatgaattcctgggcaaggatatgttaatcgcatgtaatcaaacagccgaaatgagctgtaacaaggtggaggaaagtgagcgtctatttcaggtagagaaccagagcgctcaggaaaaggtcaaagtgagagtgtccgacggcgaacaagccaagaaaagtcgcgagattagcctgaaggagtttgggtgtaaagatcagcggaaacctcgcatgtcttccgacgccaaggaatttatctctatcatcaatcctcataacctaaaggggaaaagcctaggacaagtcagcctaacccacccgtattctgagtgtgattttaagctgaaggaggtcgcacgtaataacatgggcaatgataccaacgaggaacaagaaaaggcagtcactaaaatagagatcatctcccacatgaagcagtctacttcctgcctcgattctgaggagatacgggagaaccagggtgaggttattttagaggtgcaggagacgtactgcgagacttctggcaaactgccctcggagcaggtgctccaacagccaatgaatgccagggttaaatcaaagcgggaaaagcgggaggtgattgtggaagagtctatccggacttgtaagccagcattcctgtctgaggagaaactttatcaggaaaccgccatacgcgacgagcacgattcccatattaaatctcaaccccgcgaaatgacctcatctgaaaagggtaaggaggcagacactgaaatggggtttagcattacatttaagattgaggagagtagttcgcaagtggtaccccagggcatcagcgtaaagcatctggacgccctgacactcttttcgtcaaaacaagctaatgaagggaaggtgaataatctgtctctgtgcctgactctgaaacctgaagaaaatctgagtagagaaatcgcctgtggagcccagagcgagccattcccttgcatgaccccacggcccgaggggctacactaccaggaaagtgacggcaaggcccaggtaacagggccctctcaaatcagcaaaaccgataaatctttccaaggtacgacccgccaggagacaaattatcaggatagctgggtgactagtaagacgaaagagactaaacaccaaatttcctcatccaatgaatgtaaggagaaaagttaccaggaggtttcattcgatcctgcgcgcggactcaagctagaagaaatcactgtgagcagaccggatagcaaagaggtgcggtatcttgaattttcagacagaaaggatcttcaccaccagggctctaagtcagacgacaagctttgcgggacacttaagtcagaaatagcaacacaggaattgacaggcgaaaagtttcttgaaatggctaacccaaatgtggcgggtttagaggctggatctattgaggacattgtcactcaaagaggtagccgcgtgttaggatcctttttacctgagaaattgttcaaaggggtgagtcagaaggagaataccgggcagcaaaatgccattatcagtcccacagtcctggagacgtccgaggaaaagaccgtaagtctgacagtgtgtagtgccgtgaaaacggaaaaaactccgcaagagaagctgcgggagtcaccagggagtgaacagacgccctttatgaccgccccggaggggaagggcaacgggggggtgaatccggagccatttagagccacccagaatgtctttactaggcagctttgtctagagcacgatgagaaactggtgtcctacttaagcctcctgcgcaatatcgagatgaggactaaacagattcaacctctagagttgaaccttgccgaattgcaggacctgctgtgccaagcaaaggtgttggagagagagctgaaggatcttactacacttgtgtcacaagagctcgaatgtgttaaccagattatcatctctcagccccaagaggtacctgcccagttgctgaaagccctggagaaggatgccaaaaaccttcaaaagagcctgtcatcagtgagcgacacatggaatagtcggctcctccatttccagaacgcggtagaaatcgagaagaccaaggtcctcaaccagcatacccagctggaagggagattgcaggacctgagagcatgggtgggcaacaagaatctaattttgaacagcaagggctctaattcggagatcgacgttgacagcttgaacctctgtcttcagcagtatgaggacctgaagcagcctatggcggagcgcaaagcccagttggacgcgcttgctttcgatatccaattcttcatcagcgaacatgcccaagacttaagtccacaacaaaacagacagatgcttagactgttaaacgagctgcaacggtcttttcaagacatacttgagcagaccgctgcacaggtggacgcccttcagggccaccttcagcaaatggagcaggaggcccttgtgaagaccctgcagaaacagcaaaatacatgtcaccagcagcttgaggatctatgcagctgggtcgggcaggctgaacgcgccctcgcgggccaccagggtagaacaacacagcaagacctatctgctttgcagaaaaaccagtctgaccttaaggatctgcaagatgacattcaaaaccgtgccactagctttgctactgttgtaaaagacatcgaaggttttatggaagaaaaccagacaaaattgagccctagagagctgactgccctgagggagaaactgcatcaggccaaagaacagtacgaagcactccaggaggagaccagggtggcccagaaggagcttgaagaggctgtgactagcgccctgcagcaggagaccgagaagagtaaggccgcaaaagaactggctgagaataaaaaaaagatcgatgctctgcttgattgggtgacttccgtcggatcctcaggcggccagcttcttaccaatcttcccggtatggagcaattatcaggagcgtctctggagaagggcgctctcgacactactgacgggtacatgggtgtcaatcaagcaccagaaaagctcgacaagcaatgcgaaatgatgaaggcgcgccatcaagaactgctcagccagcaacagaactttatcctcgccacacaaagcgcccaggcttttctggaccagcacgggcataatctcacacccgaggagcaacagatgcttcagcagaaacttggggaattgaaagaacagtattccacaagcctcgcccagtccgaggccgaactgaagcaagtgcagactttgcaggacgagctgcagaagttcctccaggaccacaaggagtttgagtcatggctcgaaaggtccgagaaggagctggaaaacatgcataagggtggaagtagccctgaaaccctgccttctctgttgaaacggcagggctctttcagcgaagatgtgataagtcataaaggcgacttgaggttcgtaactataagtgggcaaaaggtactcgatatggaaaacagtttcaaggagggcaaggaacccagcgagatcggcaatctggtaaaggacaagctgaaagacgccaccgaaagatatactgcactgcattccaaatgcacccgcctgggctcccacctgaacatgttgctagggcagtaccatcagtttcagaactctgccgattctcttcaagcctggatgcaggcttgcgaggctaatgtcgagaagttgctcagtgataccgtcgcctccgacccaggagtgcttcaggaacaactcgccacaaccaagcagctccaggaagagctcgctgagcaccaggtgccggttgagaagctccagaaggtggctcgcgacataatggaaattgagggtgagcccgctcctgaccaccgccatgtccaggagacaaccgactcaatcttgagccatttccagtcactgtcatatagcctggccgagaggagcagcttgctgcagaaagcaattgctcaaagtcagtcagtccaggaatctctcgagtctctgttacaatccatcggagaagtcgaacagaatctcgaagggaaacaggttagctccctgagctcaggagtgattcaggaagcgctggctactaacatgaagctgaaacaggatattgccaggcagaagtcttcacttgaagcgactcgcgagatggtcaccaggtttatggaaacagcagattctacgaccgcagcagtccttcaagggaaactggcagaggtttcacaaaggtttgagcagctgtgcctccagcagcaggaaaaggagagtagcctgaagaagttgctgcctcaggcggagatgtttgagcacctgtcgggcaagcttcagcaattcatggaaaataaatctaggatgctcgctagcggaaaccagcccgatcaggatattactcactttttccagcagatccaggaacttaacctggagatggaagatcagcaggagaacctggatacccttgagcatctggtgacagaactctctagttgtggatttgcactggatctgtgccagcaccaggatagggttcaaaacctgcggaaagatttcacagagctgcagaagacggtcaaagaacgagaaaaagatgcctcatcttgccaggagcaactcgacgagtttcggaagctagtcagaacattccagaagtggctcaaggagacagaaggctccattcctccaaccgaaacgtcgatgtccgctaaagaacttgagaagcaaatcgagcacctgaagtcactgttggatgactgggccagcaagggtaccctggtcgaggaaataaactgcaaagggaccagtctggaaaaccttatcatggaaattacagcacccgactctcaggggaagacagggtctatccttccgtcggtggggagttctgtgggcagcgtgaacgggtaccacacctgcaaggatctgactgagatacagtgcgatatgagtgacgtgaatctcaaatacgaaaagttggggggcgtgctccacgagcggcaggagagcctccaagcaatcctgaatcggatggaggaggtacataaagaggccaactcggtgctgcagtggcttgagagtaaagaggaggtcctgaaatctatggatgccatgtcttcgcctacaaagactgagactgttaaggcacaggccgagagtaacaaggccttcctggccgaactcgaacagaacagccccaaaattcagaaagtgaaagaagctctggccgggctgctggtcacttacccgaactcacaggaagccgagaattggaaaaagatccaggaggagctaaattctcggtgggagagggcaactgaggtcaccgtggccaggcagcggcagctcgaggagagtgcctcgcatctcgcctgttttcaggccgctgagtcacagctgcgaccgtggttgatggagaaggaactcatgatgggcgttctcggccccctgtccatagatccaaacatgctcaacgcacagaaacagcaggtgcaatttatgctaaaggaattcgaggcacgacgccagcagcacgagcagctgaatgaggcagctcagggaattctgaccggccctggcgatgttagtctgagcacctctcaagtacagaaggaactgcagtccatcaatcagaaatgggtagagttgactgacaagttaaatagccgatctagccagatcgatcaggcaattgtgaaatctactcagtaccaggagctcctgcaggacctctccgagaaagtaagagccgtggggcaacgcctaagcgttcagtctgctattagtacccagcccgaggcagttaagcagcagcttgaggagacgtccgagattcgttctgacctggaacaactggaccatgaggttaaagaggcgcagaccctatgtgacgagctgtctgtgcttattggggagcagtatctgaaggacgagctaaaaaagagactggaaaccgtggcactccccctgcaggggctggaagaccttgcagcagacaggataaacaggctacaggctgcgctggctagtacccagcagttccagcagatgtttgacgagctccgcacgtggttggacgataagcagagtcagcaggcaaaaaactgccccatatcagctaagctggaacgcctacaatctcagctgcaagagaacgaggagtttcagaagagcctgaaccagcactctggctcctatgaagtgatagttgcagagggcgaatcattgctcctttccgtccctcccggagaggaaaaacggacattgcagaatcagcttgtcgaacttaagaaccactgggaggagctttcaaaaaagacagcagatagacaatctagactgaaagattgtatgcagaaggctcagaagtatcagtggcatgtagaagacctggtaccatggatcgaggattgtaaagccaagatgtctgagttgagagtgaccctcgatcctgtgcagttggagagttctcttttacggagcaaagccatgcttaatgaggtcgaaaagcgcaggtccctgttggagattctgaactctgccgcagatattctgatcaacagttcagaggccgacgaggatggcattagagacgagaaggccggaatcaatcagaacatggatgcagttaccgaagagctgcaagcgaaaacgggctctctcgaggaaatgacccagaggctcagagagttccaggaatcattcaaaaatattgagaaaaaggtggagggcgccaaacatcagctggagatcttcgacgccctggggtcccaggcatgctcaaacaaaaacctggaaaagctgcgcgcacagcaggaggtgctgcaggcgctggagcctcaggttgactacttgcggaactttactcagggtctggtagaggatgcccccgatggctcagatgcttcccagctccttcaccaggccgaggtcgcacaacaagagtttctcgaggtcaaacaaagggttaacagtggctgtgttatgatggaaaataagctcgaaggaatcggtcagttccattgccgcgtgcgggagatgttctctcagctggctgaccttgatgatgaattggatgggatgggcgccataggaagggacacagatagtttgcagtcccagatcgaagacgtcagattgttcctgaataagattcacgtgctaaagttagacattgaggcatcggaagccgagtgtcggcatatgttagaggaagaggggaccctcgaccttctggggctcaaacgcgagctggaagctctaaataaacaatgtggtaaactcacagagcgtggaaaggcaagacaggagcaactcgagctgaccctgggccgagtggaggacttttaccgtaaattgaagggactaaatgacgccactacagctgctgaggaagccgaggctctgcagtgggtcgtgggaactgaggtggaaattatcaaccagcagctggccgacttcaaaatgtttcagaaagagcaggttgaccctttgcaaatgaaactccagcaagtgaatggactggggcagggtctgatccagtccgccggcaaagattgtgatgttcagggccttgagcatgatatggaggagatcaacgcacggtggaatacactgaacaaaaaggtcgcacagcggatagctcagctgcaggaggctctgctgcactgtggaaaatttcaggacgcactggagcccctcctttcctggttggctgataccgaagaactcatagcaaatcagaaaccccccagtgccgagtataaagtggtgaaggcgcagatacaggaacagaagttgctgcaacggctcctggatgatcggaaagctacggtcgatatgttgcaagctgagggggggcgaatcgcccagtccgccgaactggccgaccgtgagaaaatcaccgggcagctcgaaagtctcgagagtcggtggaccgaattgctgtccaaggcagccgctcgccaaaagcagctcgaagacatccttgtcctcgcaaagcagtttcatgagacggctgagcccattagcgacttcttgtctgtgaccgaaaaaaagcttgccaacagtgagcccgtcgggactcagacagctaagatacagcagcaaatcataagacacaaggcactaaacgaagaaatcgtaaatcggaaaaaaaacgtggaccaggccattaagaacggccaggctctgttgaaacagacaacaggcgaagaagttcttctgatccaggaaaagctggatggtattaagacaaggtacgcggatatcacagtaacttcctctaaggccctgaggaccctggaacaggccagacaattagcgaccaagttccaatcaacttacgaggagctgactggctggctaagggaggttgaggaggagttagctacatccggaggtcagagtccaacaggggagcagattccccagtttcaacaacggcagaaggaactgaaaaaggaggtgatggagcacagactcgttctggacacagtgaacgaggtgtccagagcgcttctcgagctcgtgccctggcgggcgcgggagggcctagataagctcgtgtctgatgcaaacgaacagtataagctggtgagcgataccattggccagagggtggacgagattgatgcggctattcagcgcagtcaacagtacgagcaggccgcagatgcagagctggcatgggtggctgagacaaaaaggaaattaatggcattggggcccatcagattggagcaggatcagacaacggctcaacttcaggtacaaaaggctttcagtatcgacatcatcagacataaagatagcatggatgagttattcagtcaccggtcagaaattttcggcacatgcggggaagaacaaaagaccgtcctgcaagaaaagaccgaatctctcattcagcaatacgaggccatttctctcctgaacagcgaacgttacgcacgtcttgaacgagcccaggttctggtcaatcaattttgggaaacctatgaagagctttctccttggatagaggagactagggcgctgatcgcccaactaccttcacctgctatcgaccacgagcagttacgccagcagcaggaagagatgagacaactccgtgaaagcatcgcggagcataagccacacatcgacaagctactgaagatcggtcctcagttaaaagaactaaaccccgaagagggggagatggtcgaggaaaagtaccagaaggctgaaaatatgtatgctcaaataaaggaagaggtgcgtcagcgcgcccttgcgcttgacgaggcggtaagtcagagcacacagataactgagtttcacgacaagattgagcccatgctggagacgttggagaacctctcctccaggctacgtatgccaccccttataccagcagaggttgacaaaattagggagtgcatctcagacaataagtctgccacagttgagctggagaagcttcaacccagcttcgaggccctgaagcgcagaggtgaagaactgattggcaggagtcaaggtgccgacaaggacctggcggccaaggaaatccaggacaagttggaccagatggtcttcttttgggaggacatcaaggcccgagccgaagaaagggagattaagttcctcgacgtgctggagctagcagagaaattttggtatgatatggcagccctccttacaacaatcaaggatacacaagacatcgtgcatgatctcgaaagccctggaatcgatccgagcatcatcaagcagcaggtggaagccgccgagacaatcaaagaggaaaccgatgggctccacgaagaactggaattcatccggattttgggcgccgatctcatcttcgcatgtggagaaactgagaaacccgaggtcagaaagagcatcgacgagatgaataatgcctgggaaaatctcaacaagacctggaaagaaaggctcgaaaaactggaagacgcaatgcaggccgcagtacagtaccaagatacgttacaagcgatgtttgactggctcgataacacggtcatcaagctatgcaccatgcctcccgttggcacagacttgaacacagttaaagaccagttaaacgagatgaaggagttcaaggtggaggtctaccagcagcagatagagatggagaagcttaaccaccagggggagctgatgcttaagaaggctactgatgagacagaccgcgacattatcagagagccactcacggaactgaagcatctgtgggagaatttaggcgagaaaatagctcaccggcaacataagttggagggagccctcctagctctgggacaattccagcacgcccttgaggagctcatgagctggctcacacacacagaagagttattagacgcacaaaggccaatcagcggcgatccaaaagtgatcgaagtagaattagccaagcatcatgtgcttaagaacgacgtcctggcccaccaagcaacagttgagaccgtcaataaggccggcaacgagctgctggagtcctctgcaggtgatgatgcttcctcattaaggtctaggcttgaagctatgaatcagtgttgggagtctgttcttcagaagactgaggaaagagaacagcagctgcagagtactctccagcaggcgcagggctttcacagcgagatcgaggactttcttctcgagctgacccggatggaatcccagctgtctgcgtcaaaacccactggcgggctccctgaaactgctagggaacagctcgacacccacatggagttgtacagtcaactgaaagcaaaggaggaaacctacaatcaattactggacaaagggcggctcatgctgttatctagagacgattcgggctccggctcgaaaaccgagcagtctgtggccctgctggaacagaagtggcatgtcgtctctagcaagatggaagagaggaagtctaaacttgaagaggcactgaacctggccaccgagttccagaactccctacaggagttcatcaattggctcaccctcgcagagcaaagcctaaacatcgcctctcctccttctctaattctcaacaccgttctgagtcagatagaggaacacaaggttttcgccaacgaggttaacgcccatagagaccaaattattgaactcgaccagacgggaaaccagttgaaatttctgtctcagaagcaggatgtcgtcctaattaagaatctattggtgagcgttcagtcccgttgggagaaggtggtccagcgcagtattgagaggggacggtctctggatgacgcccgtaagcgggcgaagcagttccatgaggcctggaaaaaactgatcgattggctggaggatgctgagagtcacctggatagcgaactggaaatatctaacgacccagacaagataaaactacagctttcaaagcacaaggagtttcagaagactttgggcgggaaacagcctgtctatgacacgactattcgcaccggacgcgctctgaaggaaaagacactcctcccagaggatagtcagaagcttgacaattttttaggcgaagtccgcgacaagtgggacaccgtgtgcggtaaaagcgtagagcgacagcacaagctcgaagaagcgctgttgttctcgggccagttcatggacgctctgcaggctttagtggattggttatacaaggtggagccccagctcgccgaggatcagccggttcacggcgatctagatctcgttatgaatctgatggatgcccataaagttttccagaaagagcttggaaagagaaccggcaccgttcaagtgctgaaaagatccggcagggaattgattgaaaattccagagacgataccacctgggtaaagggccaactgcaggaactgagtacaagatgggacacagtgtgtaagctgtccgtcagcaaacagtcccgcttagaacaggccctcaaacaagccgaagttttccgggatacagtgcacatgctgctcgagtggctttccgaggctgaacagactttacgattcaggggcgccttgcccgatgatacagaggcgttacagtcgctgattgacacacataaagaattcatgaaaaaggttgaggagaagcgtgtggacgtcaattcggccgtggccatgggcgaggtgatcctcgcggtttgtcatcccgactgcattacaactataaagcattggatcaccattatcagagcaagattcgaagaggttttaacatgggctaagcagcaccagcaacggcttgagaccgcgctgtccgagctggtggcgaacgcagaactcttagaagagttactcgcatggatccaatgggctgagactacgctcatccagcgggatcaggagcctatccctcagaatatcgacagggttaaagcacttattgcggagcaccagacgtttatggaagagatgacacgtaagcagccagacgtggacagggtgactaaaacctacaaacggaaaaatatagaacctacccacgctccatttatcgaaaaatcccggtccggcggcaggaaatctctcagtcagcctaccccaccccccatgcctattctcagccaatccgaggccaagaaccctagaataaaccagctaagcgcccggtggcaacaggtttggctccttgcactggagagacaacggaagctgaatgacgcccttgataggctggaggagctaaaagaattcgccaactttgactttgatgtatggcgcaagaagtacatgcggtggatgaatcacaaaaaaagtagagttatggactttttccgacggatcgacaaggatcaggacggcaagatcacaagacaagaattcattgacggaatactggccagcaagtttcctacaaccaagctcgaaatgaccgccgtggcggacatctttgatcgcgatggcgacggctatatagactactatgagttcgtagcagccttacacccaaacaaagacgcctacaggccaacaactgacgccgataaaatagaagatgaggtgacacgccaggttgctcagtgtaagtgtgccaaaagattccaggtcgaacagataggtgaaaataaatatagattcggggactcacagcaactgaggctggtaagaattctaagaagcacagtgatggtgagggttggaggtggatggatggccctggacgagttcctcgtgaagaatgatccctgcagagctaggggccgtacaaacatagaactccgagagaaatttatactgccagagggggcctctcagggtatgaccccgtttcggagtcgcgggagacggtccaaaccctcttctcgggctgcttcacccacgcggtcaagttcctccgcctctcaatctaaccactcgtgcacaagcatgccatcctccccagctactcctgctagtggcaccaaggttattccctcctctgggtctaagctcaaaaggcctacacctactttccattcatcaaggacctcgctcgctggagatacatcaaacagctcatctcccgcaagtacaggcgccaaaaccaatagagcagatcccaagaaatccgcatctagaccagggtcccgagctgggtcccgggctggcagccgcgcctcctctcgcagaggaagtgacgcctccgactttgatcttttagaaacacaaagcgcctgcagcgatacaagtgagagtagcgcagctggcggccagggaaatagccggagggggctgaataagccaagtaagattcctacaatgtctaagaagaccaccactgccagccccagaacaccaggccctaagcggtag

SEQ ID NO: 195146 - DNA, 1155 bp, Artificial Sequence
  Description of Artificial Sequence: Synthetic coding sequence
atcaccagcccctgggccccccggcccagctgcagcagcccctgggccatgagttcaagtgacgaagaaaccctctcggagcggagctgcagatctgagcgcagctgccggagcgagcgctcctatcgctcagagagatcaggcagtctgtcaccgtgtcctcctggagacactctgccttggaatctcccactgcatgagcagaaaaagaggaagtcccaggacagtgtgcttgaccccgcagaacgggcagttgttagagtggcagatgagcgggaccgggttcagaagaagactttcacaaagtgggtaaacaagcacctgatgaaagtccgcaaacacatcaacgacctgtatgaagatctccgggatggccataacttgattagcttgctggaggttttgagcggaataaaactgcccagggaaaagggaaggatgcgattccataggctgcagaacgtgcagattgccttggatttcttgaaacagcgtcaggtgaagcttgtcaatatacgaaacgacgatatcacagatggcaaccccaaactaactctggggttgatctggaccattattctgcacttccagatatccgatatttacatcagtggggagtcaggggatatgtctgcgaaggaaaaactcctgctctggacccagaaagtgactgctggatacaccgggatcaagtgtaccaacttctcctcttgttggagtgatgggaaaatgttcaacgcgctaatccacaggtatcggccagacctggtcgacatggaaagagtgcagatacagagtaaccgcgaaaacttggagcaagccttcgaggttgcagaaaggctgggggtcactcgattacttgacgcagaagatgtcgatgtgcccagcccagatgaaaagagtgtcataacttacgtcagcagcatctatgatgcattccctaaggttcccgaggggggcgaaggaattagtgcaacggaggtggattctcggtggcaggaatatcagagtagagtcgactcgctcatcccgtggataaaacagcataccatcctgatgtcggacaaaaccttcccacagaatccagtcgagctgaaggccctttacaaccaatacatccattttaaagaaaccgaaatcctggcaaaagaatag

SEQ ID NO: 195147 - DNA, 603 bp, Artificial Sequence
  Description of Artificial Sequence: Synthetic coding sequence
atgcccctgctggacagcagctacctgccccccaccatcttcatcctcacccatgtgttgggagttgccggagtgctctattggaagcgtcatgcgcggggacgcgccgacgaacgagatagggtgcagaagaagacattcaccaagtgggttaacaagcatctgatgaaagtgcggaagcacatcaacgatctgtacgaagacttgcgggacggccataacctcattagtctactcgaggttctgtccggtatcaaattgccccgtgagaagggtcgtatgcgttttcatcggctgcagaacgtgcagattgccctagattttctgaagcaaaggcaggtcaagctggtgaacattaggaatgatgatattaccgatgggaaccccaagctgacactggggttgatatggaccatcatcttacattttcagatttcagacatctacatctctggagagtccggggacatgtccgctaaggaaaaactgctgctgtggacgcaaaaagtgacagccggttatacggggatcaaatgtactaattttagtagttgctggagcgatggaaaaatgttcaatgcgttgatccaccgatacagatag

SEQ ID NO: 195148 - DNA, 15903 bp, Artificial Sequence
  Description of Artificial Sequence: Synthetic coding sequence
atgagcagcagcgacgaggagaccctgagcgagcggagctgccggtcagagcggagttgtcgatctgagcgctcttataggtcagagcgcagcgggtcactgtcaccctgtccacctggggatactctaccctggaatctgcccctccacgagcagaaaaagagaaagtcgcaggactcagtcctggatcccgccgagagggccgttgtccgagtggccgacgagcgcgatagagtgcaaaaaaagactttcacaaaatgggtcaataagcatctcatgaaggtgcggaagcacattaatgatctctatgaggacctgagggacggtcacaacttgataagtcttttagaagtgctgagtggaattaaacttccacgcgaaaagggtaggatgcgattccacaggctccagaacgtccagattgccctcgactttctcaagcagaggcaagtcaagctcgtcaacattcgaaacgatgacattacggatggcaatcccaaattgacactggggcttatttggacgattattctccacttccagatctctgacatatacatctccggcgagtcgggggacatgtctgcaaaagaaaaacttctgctgtggactcagaaggtaaccgctgggtatactggtattaagtgcactaacttctctagctgctggagtgatggaaagatgttcaacgccctgattcatcgctacagacctgacctggtggatatggaacgcgttcagatccagagtaatagggaaaacctggaacaagcctttgaagtggccgagaggttaggcgtcacacgactgctcgacgccgaggatgtggatgtgcccagccctgacgagaagagcgtgattacttacgtgtctagcatttatgacgcatttcccaaggttcccgaaggtggtgagggaatttctgcgacggaggttgattcaagatggcaagaataccaaagcagggtggatagcctgatcccatggatcaaacagcacacaattcttatgagtgataagacattcccccagaatcccgtggagttgaaagccctgtacaaccagtacattcatttcaaagagaccgaaatcctggcaaaggaaagagaaaaggggcgcatcgaggagctgtataagttgctggaagtgtggattgagtttgggagaattaaacttcctcagggttatcaccccaatgacgtagaggaggaatggggaaaactaattattgagatgctcgagagggaaaagagcctgaggcccgcagtcgagcgactggaattactgctgcaaatcgccaataagatccagaatggagcacttaactgtgaagagaaacttacattggccaagaacactctacaagctgacgctgctcacctcgagtctggccagccagttcagtgcgagtccgatgtgataatgtacatccaagagtgcgaaggtcttatcagacagttgcaggtggatctacaaatcctacgtgacgaaaactattaccaactagaagagcttgcttttagggtcatgcgcctgcaggacgaactagtgacactgagactcgaatgtactaacctgtatcggaaagggcacttcactagcctggaacttgtacctccaagcactttgaccaccacacacttgaaagctgaacccttgaccaaggccacccatagcagttctacgtcctggttccgtaagcctatgactcgcgcagagctcgtggcaattagtagctccgaagacgaaggcaaccttagattcgtgtacgagctgcttagctgggtcgaagagatgcagatgaagctggaacgagcagagtggggcaatgatctccccagtgtggaactgcagttggaaacgcaacagcacatccatacctctgtcgaagagttaggatcatccgtcaaggaagctagactgtatgaggggaaaatgtcccagaacttccatacctcttacgctgaaacactgggtaagcttgagacgcagtattgtaaattgaaagaaacctcctcttttcggatgcgacatctacagagtctgcataaattcgtatctagggccacggcggagctgatctggctgaacgagaaagaggaggaagagttggcttatgactggagcgacaataatagcaatatctccgctaagcgcaattatttttctgagctcacaatggagctcgaagaaaagcaggacgtatttaggtctctccaggatacagctgaattactatctttggagaaccacccagccaagcaaaccgtggaagcctactctgctgcggttcagtcacagctccagtggatgaaacaactatgcctgtgcgttgagcagcacgtaaaggagaataccgcttacttccaatttttttcagacgccagagaactcgagtcgtttttgagaaatcttcaagatagtattaagagaaaatattcctgtgatcacaacacgtcactctcgaggttggaagacctgcttcaggactctatggatgaaaaagaacagctgattcagtctaaaagttccgtcgcgtccctggtcgggagatcgaagactatcgtccaactgaagccccgctctcctgatcatgtgctcaaaaacaccatcagtgtcaaggcagtgtgcgattatagacagatagagatcactatctgtaaaaacgatgaatgtgtgctggaggacaactctcagcgcactaaatggaaagtcataagtccaaccggaaatgaggccatggtgccgtcagtgtgttttctgatcccccctccaaataaagatgccattgagatggcctcacgggtggaacagtcttatcagaaagttatggcgctgtggcaccagttgcatgtaaacacgaagtcactgatatcctggaattacttacggaaagatctggatctggtgcagacctggaatctcgaaaagctgcggtcctccgctcctggtgaatgtcatcagattatgaagaatttgcaagctcactatgaggattttctgcaagattcaagagacagtgtcctgttttctgttgctgacaggctccggcttgaagaagaggtcgaggcttgtaaagcaaggtttcaacatttgatgaaatcaatggagaatgaagacaaggaggaaactgtcgcaaagatgtatatcagtgagctgaaaaacatacggctgaggcttgaggagtacgaacagcgcgtggttaagaggatccaaagcctcgcctcttctcggaccgaccgggacgcctggcaggacaacgcactcagaattgccgagcaggaacatacgcaggaggacctgcagcaacttagatcagatctagacgcggtgtccatgaaatgcgattcttttttgcaccagagcccctctagctcctctgtccccacgctgcgcagcgagttgaacttgctcgtagagaaaatggatcacgtgtacgggctgtctaccgtgtacctcaacaaactcaagacagtggatgttattgttaggtctatccaggacgccgaactcctggtgaaaggatatgaaatcaaattgtctcaggaggaggttgtgctggcggatctatctgctcttgaggcacactggagtactttacgccattggctgagcgatgtaaaggacaagaattccgtcttttcagttcttgacgaagagatcgccaaagccaaagtggtggctgaacaaatgagcagattgactcccgagaggaatctggacttggagagataccaggaaaaaggcagccagcttcaggaacgatggcaccgggtgatcgcgcagcttgagatccggcagagcgagctggagagtatccaagaggtactcggggactaccgagcgtgtcacggcactttaataaaatggatcgaggaaactacagcacaacaggaaatgatgaagccaggacaggctgaggactcaagggttctctccgaacagctgtctcagcagactgcattatttgctgagattgagcggaatcagacaaagctggaccagtgtcagaagttttcccaacagtactccactattgttaaagactacgaacttcagctcatgacatataaagcctttgttgaatctcagcagaagtcgccaggtaaaaggagacgcatgctatctagctccgacgctattacccaggagtttatggatctccggacgagatacaccgcattggtgaccttgaccacacaacatgttaagtacatatctgacgccttgaggagacttgaggaagaggagaaagttgtagaggaggagaagcaagaacacgtggaaaaggtaaaggaactgttaggctgggtcagcacacttgcgaggaatacacagggtaaggcaacatctagtgaaacaaaagaatccactgatatcgaaaaggccatcctcgaacagcaggtcctcagtgaggaactcaccactaagaaggaacaggtgtcggaggcaatcaagaccagccagatctttcttgccaagcatgggcacaagctcagcgagaaagaaaaaaagcagatctctgaacagctgaatgccctgaacaaagcctatcacgatctctgcgacggctctgccaaccagctgcagcagctacaatcacagctggcccatcagaccgagcagaagacactacagaaacaacaaaacacttgtcaccagcaactggaagacctgtgctcgtgggttgggcaagcagaacgagccctggctggacaccaagggcgcaccactcaacaggatctgagcgcattgcaaaaaaatcagtccgatctgaaggacctgcaggacgacatacaaaatcgggcaacgagcttcgccactgttgtgaaggacatcgaggggtttatggaagaaaatcagaccaaactcagcccacgcgagctgacggctctcagagaaaaacttcaccaggcaaaggaacaatacgaggccctgcaggaagaaacgagagtcgcacaaaaggagctggaggaggccgtgacgtcagctttacagcaggaaacagaaaagagcaaagccgctaaggagctcgcagaaaacaagaagaaaattgatgccctgttggattgggtgacatcagttggcagttccggaggccagcttctgacaaacctcccgggcatggagcaactgtctggcgccagtctggaaaagggcgcattggacactaccgacgggtacatgggagtgaatcaggcgcctgaaaaactcgataaacagtgtgaaatgatgaaggccagacaccaggagttgctgtcccaacaacagaattttattcttgccactcagtccgcccaggcatttttggatcaacatggccacaatctcactcctgaggaacaacagatgttgcaacagaagcttggcgaactgaaagaacagtactcaacctccttggcacagagcgaagcagaattgaagcaggtgcaaaccttacaggacgaattgcagaaatttttgcaggaccacaaggagtttgaatcatggctggagcgatcagagaaggagctagagaatatgcataagggcggctcctctcccgaaaccctgccatcccttctgaagcgtcagggaagttttagcgaagatgtcattagccacaagggagacctgagatttgtaactatttctggccaaaaagtattagacatggagaacagttttaaggagggtaaggaaccgagcgagataggcaacctcgtgaaggacaagctcaaagatgccacagagagatacaccgccttacattccaagtgtacacgcctgggcagccatctgaatatgcttctgggtcagtatcatcagttccagaactctgccgatagtttacaagcatggatgcaagcctgcgaagccaatgtggagaagcttctttccgatacagtggcatcggatcccggagtgctgcaagagcagctagccacaacaaaacaacttcaggaggaactcgccgaacaccaggtacccgtcgagaaactgcagaaagtcgcccgggacatcatggagatcgaaggggagcccgctccagaccacaggcatgtccaggagacaactgactctatcctgtcgcacttccagtcccttagctacagccttgccgagcgttcttctctgcttcaaaaggcaatcgcgcaaagtcaaagtgtccaggagagccttgaatccctgctgcaaagcatcggagaagttgaacagaatctggaggggaaacaggtgtcctccctttcatccggtgtgatccaagaggcccttgcaacgaatatgaaattgaaacaggacattgcaagacagaaaagctctcttgaggccacaagggagatggttaccagattcatggagacagccgacagcactacagcagccgtgcttcagggcaagcttgctgaggtatcgcagcggtttgagcagctttgccttcagcaacaggaaaaggaatccagcctgaagaaactgctgccccaggctgagatgttcgagcatttgtccgggaagctgcagcagttcatggaaaataaatctcggatgctggcaagcgggaaccagccggaccaagacataacacatttcttccagcagatccaggagctcaatctcgaaatggaggatcagcaggaaaacctggacacattggagcatctggttactgagctcagtagctgtggttttgcactcgatctctgccagcatcaggatagagtgcagaacctgaggaaggattttacggagctgcaaaagaccgtgaaggaaagagagaaagacgcatctagctgccaggaacaacttgacgagttccgtaaactagtccgcacatttcagaagtggctcaaagaaaccgagggctccattccgcccacagaaacttccatgagcgcaaaagagctagagaagcagattgagcacctaaagtcacttttggatgattgggccagtaaaggcacccttgtagaggagatcaactgcaaggggacctcgctggagaacttaattatggagatcacggcacccgattcacaaggaaagaccgacttgacggaaatccagtgcgatatgtctgacgtcaatctgaaatacgagaaactgggtggagtactccacgaacgacaagaatctctgcaggcaatcttgaaccgcatggaggaggtccataaggaagctaatagcgtactgcagtggctcgaaagtaaagaggaagtgttaaagagcatggacgccatgtcaagccccacgaaaacagagaccgtgaaggcacaggctgaatctaacaaagcttttctggccgagctcgaacagaatagcccaaagattcaaaaagttaaggaggccctggccgggctcttggtcacatacccgaactcacaggaggccgaaaattggaagaagattcaggaggagctgaattctcgatgggagcgcgcaactgaggtcaccgtagcccgtcagcggcaactagaagaaagcgcaagtcacctggcctgcttccaggcggcagagagccaactgcggccctggcttatggaaaaggaattaatgatgggggtgttagggccactttcgattgatcccaacatgctgaatgcccaaaaacagcaagtgcagtttatgctcaaagagtttgaggcccggcgtcagcaacatgagcaactgaacgaagccgcccaaggtatcctgacggggccgggcgacgtgagcttatcaactagtcaggtgcaaaaagagctgcagtccattaatcaaaaatgggtcgagttgactgataagctcaattcccgcagctcccagatcgatcaagcaatcgtaaaaagtactcaatatcaggagctgctgcaggaccttagtgagaaggtgcgcgcagtgggacagcgtctcagcgtacaatctgctatttccacacagcctgaggcggtaaagcaacagctggaagaaaccagtgaaatcagaagcgacctggagcagctggatcacgaggtaaaggaggcacagacattgtgcgacgagctctcggtgctgataggagaacagtacttaaaagatgagctgaagaagcggctggaaactgtggccctccctctccagggactggaagatctggcggcagaccgtatcaatcggctgcaggccgcgctcgcatccacgcagcaattccagcagatgttcgatgagcttagaacttggctggacgataaacagagccagcaggctaagaactgccctatatcagccaaactcgagcggttacagagtcagttgcaggaaaatgaggagttccagaagtctctgaatcagcactctggctcctacgaggtgattgtagctgagggggagagtttgttgctgtctgttccccctggtgaagagaagaggacactgcagaaccagttggtcgaactaaaaaatcactgggaggaactgtctaagaagacggctgatagacagtctcgactcaaggattgcatgcaaaaagcccagaagtaccagtggcacgtcgaggacctggtgccctggattgaggattgcaaagccaaaatgagcgagctgcgcgtgaccttggaccctgtgcagctggaaagtagccttctgagaagcaaggccatgctgaatgaggtcgagaaacgtcgatcactgcttgaaattctcaactccgccgctgacatcctgattaactcttccgaggccgacgaagacgggatccgagatgagaaagcagggatcaatcagaatatggacgccgtgaccgaagagctgcaggctaaaacagggtctctggaagaaatgacacagcgcctgagggagttccaggagtcgttcaagaatattgagaagaaggtcgaaggcgccaaacaccagttagagatctttgacgcactcggttcgcaggcatgtagcaacaaaaacctcgaaaagctgagggctcagcaggaagtcttacaagctctggagccacaggtggattatttgaggaacttcacacagggactagtggaagacgcacccgatggctcggatgcctcacagctgcttcatcaggcagaggtcgcccagcaggaatttcttgaggttaagcagcgagtcaacagcggctgtgtgatgatggaaaacaagctcgagggcatcggccaatttcactgccgggtgagagagatgttctcacaacttgctgatttggacgacgagctggacggaatgggggcaattgggcgagataccgactcactccagagccaaattgaggatgtgcgtctgtttttaaacaaaatccacgttctgaagttggacatcgaggcctcagaggctgagtgtcggcacatgttggaggaagaagggacgctggacctgttgggcttaaagcgcgagctcgaagccctcaacaagcagtgcggcaagctaactgaacgaggtaaagcgcgccaggaacagttagagttaactctgggaagggtagaggacttttaccggaagctcaaagggctcaacgacgcaaccaccgccgccgaggaggccgaggcccttcagtgggtcgtggggacagaggtcgagataatcaatcagcagctggccgattttaaaatgtttcagaaagaacaagtcgaccccctgcagatgaagctgcagcaggttaatggactgggtcagggtctcattcagagtgctggcaaagattgcgacgtgcagggcctggaacatgatatggaggaaatcaacgcgagatggaatactctgaataaaaaggtggcccagcgcatcgcacagctgcaggaggccctcctccactgcggcaagttccaggacgcactggaacccttgctgtcttggctggcggacacagaggagctgatcgcaaatcagaaacccccatccgctgaatataaagtcgttaaggcacagattcaggagcagaagctgctgcaaagacttctggatgacaggaaggctaccgtcgatatgctccaggccgaagggggtcggatcgctcagagcgcagaactggccgaccgcgagaaaatcacaggccagctcgaatctttggagagtcggtggaccgaactcctgtctaaggccgctgccaggcaaaaacagctcgaggacattttagtgctcgccaaacagttccatgagacagccgaacctataagcgacttcctgtcagtgaccgagaagaaattggctaatagcgagcccgttggaacccagaccgccaagatacagcagcagatcatcagacacaaggccctgaacgaggagatcgtgaaccggaagaagaatgtggaccaggcaattaaaaacgggcaagcccttcttaagcagactaccggggaagaggtgttgctgatacaggagaaacttgacggaattaaaactcggtatgccgacattactgtcacctcctctaaggccctccggaccttggaacaggcccgccagttagccacaaagtttcagagcacctacgaagaactgactggctggctcagggaagtggaagaggagctggctaccagtggcggtcagagtccgaccggtgaacagattccacaattccagcaaagacaaaaagagttaaagaaggaagtcatggagcataggttggtactggacacggtgaacgaggtgtcacgtgcattactggagctagtgccgtggcgggcgagggaggggttagacaaactggtgtcggacgcaaatgaacagtataagctggtcagcgatacgatcggtcagcgggtcgacgagatcgacgcagccatccagaggtcacagcaatacgaacaggcagcagacgctgagctggcgtgggtcgccgaaacaaagcggaagctgatggccctgggacccatacgcttggagcaggaccaaacgactgcacaattgcaggtgcaaaaggccttctcaattgacatcatacgccataaagactcaatggatgagctcttttctcatcgcagcgaaattttcgggacctgcggggaagagcagaagacggtactgcaagagaagacagagtctcttatccagcagtatgaggcgatttctctgctcaacagtgaacggtatgcgaggctggagcgcgcccaggtgcttgtgaatcagttttgggagacctacgaggagctatcgccttggatagaggagacacgagctcttattgctcagctgccgtcccccgctattgaccatgagcagttaaggcaacagcaggaggaaatgagacaactgagagaaagtatcgctgagcataaaccccacatcgacaaattacttaagatcggtcctcagctcaaagagcttaacccggaagaaggagagatggttgaagagaagtatcagaaagcagagaacatgtacgctcagatcaaggaagaggtccgccagcgcgcgctggcactggatgaagcagtctctcaatcaactcaggtgagtcagttccacgataaaattgaaccaatgttggaaactctggaaaacctgagctctcggctgcggatgcccccactgattcccgccgaggtcgataaaattagggaatgcatcagcgataataaatccgctacagttgaacttgaaaagttgcagcctagcttcgaagcgcttaaaagaagaggcgaagagctgatcgggagatcacagggcgccgataaagacttagccgctaaggagatacaggacaagctagatcaaatggtgtttttctgggaagatatcaaagcaagggccgaggagagagagattaagttcctcgatgtgctggagcttgctgaaaagttttggtatgacatggcggctcttctaacaactataaaagatacccaagatattgtccatgatctggaatcacctggcattgatccatccatcataaaacagcaggtggaggcggccgagacaataaaggaagaaactgacggactgcacgaggagctcgaattcatacgcattttaggggccgacctgatctttgcctgcggggagaccgagaaacccgaggtcagaaagtccatcgacgagatgaataatgcttgggaaaatctgaacaaaacatggaaggagagactcgagaagctcgaggatgcgatgcaggcagccgtgcaataccaggacaccttacaggcaatgtttgattggctggataatactgtgatcaaactgtgcactatgcctcccgtcggcacagacctgaacactgtgaaggatcaactgaatgagatgaaagagttcaaggtggaggtttatcagcagcaaatcgagatggaaaaactcaaccatcagggtgaactgatgttgaagaaggcgacagacgaaactgacagagacattataagagaacccctgacagagctgaagcacctgtgggagaacctgggtgagaagatcgcacaccgacaacacaaactggagggtgcccttctggctctcggacagttccagcatgccttagaagaactgatgtcatggcttacccataccgaagaactgctcgatgcccagagacctatttctggagaccccaaagtcatcgaagtggaactggcaaaacatcacgtgctcaaaaatgacgtcttggcacaccaggccacggtggagacagtgaataaagccggcaacgagctgctggagtcttccgctggggatgacgcctctagcctgcgttcacgtttggaggctatgaatcaatgctgggagtcagtgctgcagaagacggaggagcgagagcaacagctacagtccacactgcagcaagcccaaggcttccacagcgaaatcgaggattttctgctggaattaacaaggatggaaagccagcttagtgcgtcgaagccaacgggagggttgccagaaaccgcccgcgaacagctagatacacatatggagctatacagccagctgaaagctaaagaggagacatacaatcagttactcgataaggggagactgatgctcctgtcgcgcgacgattctggcagcggaagtaaaacggaacagtccgtggcactgttagagcagaagtggcacgtcgtgagctcaaagatggaagaaagaaaatccaagctggaggaggcccttaacctagcaaccgagttccagaacagtctgcaggaatttatcaattggctgactctggctgaacagagcctgaacattgctagcccacctagcttgattctcaatacagtgctctcccagattgaggaacacaaggtgtttgccaacgaagtcaatgcccacagggatcagataatagagctggatcagacgggtaatcagctaaagttccttagccaaaaacaggatgttgttctgatcaaaaatctgctggtctccgtacagtccaggtgggagaaagtggttcagcgatccattgagaggggccgctctctcgatgacgccaggaaaagggctaaacagttccacgaggcctggaaaaagctaattgactggctggaagacgcagaatcacatctggattccgagttggagatttccaatgatccagataaaatcaagctccagctcagcaaacacaaggaattccagaaaacccttggtggcaagcagcctgtttatgacacgaccattcggacaggtcgggcattgaaggaaaaaacactcctcccagaggatagccagaagctggacaattttctgggggaggtccgcgacaagtgggatacagtgtgcggaaaatctgtcgagaggcaacacaagttagaagaggccctgctgttcagtggccaatttatggacgccctgcaagctcttgtggattggctttacaaggttgagccccaactcgccgaagaccagcccgtccacggggacctcgatctagtgatgaacctcatggatgcgcacaaagtgttccaaaaagaactcggaaaacggaccggaacggtacaggtcctgaagaggtccggccgggagctcattgagaactcccgcgacgacactacctgggtgaaagggcaactccaggagctttcaacacggtgggacaccgtctgtaaactaagcgtctcgaagcagagcagactggagcaggctctaaaacaagccgaggtgttccgggatacagtccatatgctcttagaatggctttcagaggccgagcagactctcagattccggggggcactacccgacgacacagaagccctgcagagcctaatcgatacccataaggaattcatgaaaaaagtggaggagaaacgtgtcgacgtgaattcagccgtcgcaatgggcgaggtcatacttgccgtctgtcatcccgactgtatcacaaccattaaacactggattacgatcatacgcgctcggtttgaggaagtgctaacttgggctaagcagcaccaacagaggctggaaactgccctaagcgagttagtggccaacgccgagctgctagaagaacttctggcttggattcagtgggcagagactacccttattcaaagagatcaggagccaattccacagaatattgacagggtaaaggctctcattgcagagcaccagacctttatggaggagatgaccaggaagcagcctgatgtggaccgcgttaccaagacatacaagcggaagaatatcgagccaactcacgctccattcatcgagaagtcacgctccggggggcggaaatccctcagccagcctacaccaccacccatgcctattctgtctcaatcagaagccaagaatccgagaatcaatcaactgagtgcccgctggcagcaggtctggcttctggcactggaacgtcaacgtaaactgaatgatgctctggataggctagaggaactgaaggaattcgcaaacttcgacttcgacgtgtggcgcaagaaatacatgaggtggatgaatcataaaaaatcacgggtgatggatttttttcggcgcatagacaaagaccaggatgggaagataacccggcaggaatttatagatgggatcctagcgtcaaagtttccgaccactaagctggaaatgacggcagtggcagacatatttgatagggacggcgatgggtatattgattattacgagtttgttgccgcgctccaccctaataaggatgcctatagacctaccacagacgccgacaaaatcgaagacgaggtcactcgccaggtagctcagtgcaaatgtgccaaaagatttcaagtcgagcagataggggaaaacaagtaccgttttggcgactcacagcaacttcgtctcgtacggattctacggtccactgtcatggtgcgggttgggggcggatggatggctctcgatgaatttctcgtaaagaatgacccatgccgggccagaggaaggactaatatcgaactacgcgaaaagttcatcctgcccgaaggagcttcccagggaatgaccccattccgatctcggggcaggcgcagtaagccatcttcaagggcagcttcaccaacccgcagcagctcttcagcttcccagagtaatcactcttgcacctcgatgccttcaagtcctgccacacccgcctcaggaacgaaagttatcccatcctcagggtccaagctcaaaagaccaacgccaacattccacagctcccgcacttccctggcaggagatacgtctaattctagcagccccgcatccactggggcaaaaacaaatcgtgccgatccgaaaaaatcagccagtagaccgggctcacgagctgggtcccgagcagggtcacgcgctagctcacgccgcggaagcgacgcctccgattttgaccttctggaaactcaatctgcatgttccgatacttccgagtcttcggcagctggtggccaagggaattcaaggaggggcctaaacaaaccctcaaagattcccacaatgtccaagaagaccactactgcttcaccccgaacacccgggcccaaaagatag

SEQ ID NO: 195149 - DNA, 1035 bp, Artificial Sequence
  Description of Artificial Sequence: Synthetic coding sequence
atgaccgccgtggccgacatcttcgaccgggacggcgacggctacattgactactatgagttcgttgccgcactccacccaaataaagatgcctatcgacctacaacagacgcagacaagatcgaggacgaggtgaccagacaagtcgcccaatgcaaatgtgccaagagattccaggtcgaacagatcggagaaaataagtacagatttggagactcccagcagctgagattggtgcgcatcctacgctcaacagtgatggttcgtgttgggggggggtggatggctctggacgaattcctggtgaaaaacgatccgtgtcgcgctcgcggtcgaaccaacatcgagctgcgggagaagtttatactcccggaaggcgcaagccaaggcatgacgccctttcggtccaggggccgtcggagtaagccatcatctagagccgcaagtccaactcggagttccagctcagctagccaaagcaatcatagttgtacatcaatgccctccagtcccgcaacccccgcaagcggtaccaagacaagccttcagttcagccgttgctatgacaagccttggctggtgaacagcaaggccgggacccctatccgcgatagtcactctccggacctgcagctgccgacgcccgaggtaattccatcttcagggtcaaaactcaaacgtcccacacctacattccacagcagtcgcacctccctggccggtgacacaagtaattcttcgtcacctgcatcaacaggggccaagaccaatcgggctgatccaaagaagagtgcctctaggcccggttcgagagccggcagtcgcgccggcagtagagcttccagccggagagggagcgacgcctcagattttgatctactggaaacccaatcggcttgctctgacacctcagaatctagcgctgcgggcggccagggaaacagccgtaggggcctgaataaaccgtccaaaattcccaccatgtcaaaaaagacgactaccgcctcaccacgtactcccggtcctaagcgctag

SEQ ID NO: 195150 - DNA, 16293 bp, Artificial Sequence
  Description of Artificial Sequence: Synthetic coding sequence
atgagcagcagcgacgaggagaccctgagcgagcggagctgccggtcagagagatcctgtagatccgaaagaagttatcggtcagagcgctcgggctctctctccccctgtccccctggcgacactctaccatggaaccttcccctccacgaacagaaaaaaagaaagtcccaggactccgttctcgatcctgctgaaagggcagtggtccgagtggcagatgagagggatcgagtccagaaaaaaacatttaccaaatgggtgaacaagcacctaatgaaggtaagaaaacatataaacgatctatacgaggacctacgggatgggcataatctgataagcctgctcgaagtgctgtctgggataaagctgcctcgcgagaaaggacggatgcgattccatcggcttcaaaacgtgcagatcgcgctcgatttccttaagcaaaggcaagtgaaactggtgaacattagaaacgacgacattaccgatgggaacccaaaacttactctcggcttgatctggactattatcttgcactttcagatctccgatatttatatttccggcgagagtggagacatgtcagctaaggaaaaactgctgctctggactcaaaaggtgactgcggggtatactggtattaagtgcactaacttttcttcttgctggtccgacggtaaaatgttcaacgccttgatccaccggtaccgaccggatttggttgatatggaaagggttcaaattcaatcaaacagagaaaatctggaacaagcgttcgaggtggcggagaggttgggggtgacacgcttgctggacgcagaggacgtcgacgtgcctagtcccgatgagaagtccgtcataacatatgtatcgtcaatctacgacgcttttcctaaggtacctgaaggtggcgaggggatttcagctacagaggttgattcccggtggcaggaataccaaagccgagtggactcccttattccgtggatcaagcagcatacaatactgatgtccgacaagacttttccccagaaccccgtggagttaaaagctctatacaaccagtacatacactttaaggaaactgagattctcgcaaaggagcgagaaaagggccggattgaggagctgtacaagcttctggaggtctggatagagttcggccgcatcaagctaccgcagggatatcatcccaatgatgtagaggaggagtggggtaagttgatcatagaaatgttggagcgcgagaagtcactccggcctgcagtggaaaggctggagctgcttctccaaatcgcaaataagattcagaacggggccctaaactgcgaggaaaagcttacccttgccaaaaacacccttcaggcagacgcagcacacctcgaatcagggcagcccgtccagtgtgaaagtgacgtaattatgtacatccaggagtgtgaaggactgatacgccagctgcaagttgacctgcaaatactccgagatgagaattattaccagctcgaggagctggcttttagagtcatgcgtttgcaggatgaactggtcactctcagacttgagtgcacgaatctctatcgcaaggggcactttacgtctctggaactggtaccacccagcaccctcactaccacacatcttaaggcggaacctctgacaaaagctacacactcctcttctacttcttggtttcgtaagcccatgactcgcgcagagctggtggctatttcttcatctgaggatgaaggcaacttaagatttgtctacgagcttctgtcctgggttgaagagatgcagatgaagctcgagcgggccgagtgggggaacgacctcccatccgttgagcttcagctggaaacccagcagcacatccacacctctgtcgaagagttgggaagctccgttaaagaagcccggctatacgagggtaagatgagtcaaaattttcatacttcctacgctgaaacattaggcaaactggagacacaatactgcaagctgaaggaaacttcctcatttcgcatgaggcatctgcaatcactgcacaaattcgtcagcagggccaccgccgagttgatatggctgaatgagaaggaggaggaggaactggcttacgattggtctgataacaattcaaacatttccgcaaagcgcaattacttcagcgagctgaccatggagctggaagagaagcaggatgtgtttagatctctgcaggataccgcagagttactcagcttggagaatcaccccgccaaacaaacagtagaggcatattccgccgccgtgcaaagtcagctgcagtggatgaagcagctttgtttgtgcgttgaacaacacgtaaaagaaaatactgcctacttccagttcttctccgatgctagagagttagagagctttctccgcaacttgcaggatagcatcaagcgcaagtattcatgcgatcacaatacaagtctatctagactggaggacttattgcaggactctatggacgagaaggagcagctgatccaaagcaagagttcagtcgccagtctggtcggccggagcaagaccatcgtacaactgaagcccaggtcacctgaccatgtgctcaaaaatacaatctctgtgaaggctgtgtgtgactatagacaaatagagataacgatctgcaagaatgacgaatgtgtgctcgaggataattcccagaggacaaagtggaaggtcatcagccctactggcaatgaagcgatggtgccatccgtctgtttcctgatacctcctcccaacaaagacgccatcgaaatggcttcacgggtggaacaatcataccaaaaagtcatggccctctggcatcagctccatgtgaacactaaatctttaatttcatggaactacctgcggaaggatctggacctggtgcagacctggaatcttgaaaagctccggagctccgcgccgggcgaatgtcaccagataatgaaaaatttgcaggcccactatgaagacttcctgcaagacagcagggactcagtcttgttctctgttgcagatcggctgaggctggaagaggaggtggaggcatgcaaagctagatttcagcatttaatgaaatccatggagaatgaggataaggaggagacggtggctaaaatgtacatatcagaattaaaaaacatccggttacgcctagaggaatatgaacagagggtggtcaaacgcatccagtcactcgccagtagtcggacagaccgcgacgcctggcaggacaatgccctgagaatagcagagcaagagcatacgcaggaagatctacaacagcttcgttccgacctggacgccgtgtcgatgaagtgcgattctttcctgcatcaaagtccttccagtagtagcgtgcccactttaaggagcgaactcaacctgctggtggaaaagatggatcacgtgtatggactttctacagtatacctgaataaactgaagaccgttgacgttatcgttagatctatccaggacgccgaattgctggtcaaagggtacgaaatcaaacttagccaggaagaagttgtcctggctgacctctctgcattagaagcacactggagcaccctccggcactggttgtctgacgtcaaagataagaacagcgtgttttccgtgttggatgaggaaatcgctaaagccaaagtagtggccgagcaaatgtcccgtctgacacctgagaggaatttggacctcgagcggtaccaggaaaaaggatctcaattgcaagaaagatggcacagagttatcgctcagctcgaaatccggcagtctgaactggagagcatacaagaagtcctaggggattatcgggcctgtcatggcactcttattaagtggatcgaggagactaccgctcaacaagagatgatgaagcctggtcaggcggaggacagtcgcgtgctctccgagcagctgtctcagcagactgcgttattcgctgagatagaaagaaatcagaccaagttggaccaatgtcaaaagttttcccaacagtacagcacaatcgttaaagattacgagctgcagttaatgacctacaaggctttcgtggagagtcagcaaaaaagtccaggcaagcgtagacgaatgctctcctcctcggatgcgatcacacaggagttcatggacctgcgtacacgatataccgccttggtgacactcactacccagcacgtgaagtatatctccgatgccctcagacggctggaggaggaagagaaggtggtggaagaggagaagcaagagcatgtcgagaaagtcaaggaacttctcggatgggtgtctaccctggcaaggaacacacagggcaaagcaacatcctccgagactaaagaatctaccgacatcgaaaaagcgattctcgagcaacaggtgctgtccgaagagctcaccacgaagaaggagcaggtctcggaggcaataaagacaagtcagatatttctcgccaaacatggacacaagcttagtgaaaaggaaaagaaacagatttctgagcaactgaacgccctgaacaaggcatatcacgatctgtgtgatggctcagccaatcagctgcagcagctgcaatcacaactcgcgcatcagaccgagcagaaaacattacagaagcaacagaatacgtgccatcagcagcttgaagacttatgttcatgggttggacaggctgaacgggcattggctgggcatcagggacgcacaactcagcaggacctctctgccctccagaagaatcagtccgacttaaaggaccttcaggatgacattcaaaatcgagctacctccttcgcaactgtggtgaaggacattgaggggttcatggaggaaaaccaaacaaaactctccccacgcgaactgaccgctctgagggagaagctgcaccaggctaaggagcagtatgaggccctgcaagaggagacacgagtggcgcagaaggagttggaagaagctgttacaagcgccttgcagcaagagaccgagaagtccaaagcagccaaagaactggcagagaataagaagaaaatcgacgccttgctcgattgggtcacttcagtggggtccagcggtggccagttactgaccaatctccctggcatggagcagctgtcgggtgcttctctggaaaaaggagccctggatactacagacgggtatatgggagtgaatcaggcgccagagaagctagacaagcagtgtgagatgatgaaagccaggcaccaggaactcttaagccaacagcagaatttcattctagccacacagtccgcccaggccttcctggatcagcatgggcataacctcactcccgaggagcaacagatgctgcagcaaaaactgggcgagctgaaggagcagtatagcacctccctggctcagagtgaagcagagctgaaacaagtgcagacactccaggacgagctacagaaatttctacaggaccacaaggagtttgagtcttggttggaacgcagcgagaaggaacttgagaacatgcacaaaggtggatcttcccccgagaccctccccagtctgctgaagcgccagggctccttcagcgaggatgtaatatcgcataaaggagacctcaggtttgtgactatctcagggcaaaaggttctggatatggagaattctttcaaggagggaaaagagccctccgagattggaaatttggttaaggacaagcttaaggacgcgaccgaaagatatacggctctgcattcaaagtgtacaaggttggggagtcatctaaatatgttgctgggacaataccaccaattccagaattcagccgattcattgcaggcgtggatgcaggcctgcgaagcgaacgttgagaaactgctctcagatacggtcgcgagcgatcctggggtcttgcaggagcaacttgccacaaccaaacagctccaggaggagctggctgaacaccaggtgcccgtcgaaaaactccagaaggtggcaagggatatcatggagattgagggtgaacctgcacccgaccacagacacgttcaagaaacgactgacagtatcctgtcacacttccagtcactgagctatagcctcgccgaacggagttccctgctgcagaaagcaatcgcacagtcccaaagtgtacaggaatccttggagtctttactgcagagcatcggggaggtagagcagaacctggagggcaaacaggtctcttccctttcttcaggcgtgatacaggaggcgctggctaccaatatgaagcttaagcaggacatcgctcgacagaagagcagtttggaagcaacacgtgaaatggttactcgcttcatggagacggccgattcaacgaccgccgccgtgctgcaaggcaagctggccgaagtgtcccagagatttgaacagctgtgtctgcaacagcaggagaaggagtcttcactgaagaagcttttgccccaggctgaaatgttcgaacacctgtccggaaaactccagcagtttatggagaataagtcaagaatgctcgcctctgggaaccagcccgatcaggacatcactcacttctttcagcagatacaagagctgaatctggaaatggaggatcagcaggaaaacctggataccttggagcatctcgtcaccgaactgtcctcctgcgggttcgctctcgatctgtgtcagcaccaggatagagtccagaatctgagaaaggatttcaccgagctccaaaagacagtgaaggaacgggagaaggatgcttcaagctgccaggaacagctggacgagtttcggaagctagtgcgcaccttccagaagtggcttaaggagaccgagggtagcatccccccaactgagaccagcatgagtgccaaggagctggagaagcagattgaacacctgaaaagtctgttagatgactgggcgtccaaaggcaccttggtggaggaaatcaattgcaagggcacaagcctggaaaatctaatcatggaaatcacagctccggatagccagggcaagacgggaagcatcctgcccagcgttggatccagcgtggggtctgtgaatggctaccacacatgtaaggacttgactgagatccagtgcgacatgagcgacgtgaacctgaagtacgaaaagcttgggggcgttctccatgaaaggcaggaaagcttacaggccattttaaacaggatggaggaagtgcacaaggaagcaaatagtgtgctgcagtggctggagagtaaggaagaggttctgaagtctatggatgctatgtcttctccaactaaaactgaaaccgtgaaggcacaagcggagagcaataaagcatttctggctgagctggagcagaacagcccaaagatccagaaggtcaaagaggctttggcgggcctgctcgtaacataccccaactcacaggaagccgagaactggaaaaagatccaggaggaacttaacagcagatgggagagagcaactgaggtgaccgtggcacgccaacgccagctcgaggagtcagccagccacctggcctgctttcaagccgcagagtcgcaactgcggccctggctgatggaaaaggaacttatgatgggagtcctgggcccactgagcatagacccaaatatgttaaatgcacagaagcagcaggtgcagtttatgttgaaggagtttgaggctcgtaggcagcaacacgagcagctcaatgaggccgcccaaggcattctcacaggtcccggagatgtcagcctgagtacatctcaggttcagaaagagctgcagtctatcaatcagaaatgggtggaactgacagataagttgaactctaggtcatctcagatcgatcaggccattgtgaagtcaacacagtatcaggaactactacaggacctaagcgaaaaggtacgcgccgtgggccagcggttgtccgtgcagtccgccatctccacgcaacccgaagcggttaaacagcagctggaggaaacctcagagattaggtctgatctcgaacaactcgaccacgaagtgaaagaagctcagacactttgcgatgagctgagcgtactgatcggcgagcagtatcttaaggacgagctcaagaagagactggagactgtcgccctgcccctgcagggcctcgaggacctagctgctgaccggataaaccgactgcaggccgccctggcatccacccagcagttccagcagatgtttgatgaacttagaacgtggctggatgacaagcagagtcaacaggcgaagaattgcccaataagtgcaaagctcgagagacttcagagtcagctccaggagaacgaagaatttcagaaaagtctgaaccagcacagcgggagctacgaagttatcgtggctgagggcgaatctctgcttttgtccgtcccgccaggtgaagaaaaacggacactgcagaaccagctggtggagttaaagaatcattgggaagaactgtcaaaaaaaacggctgaccggcagtccaggctgaaggactgcatgcagaaagcgcaaaaataccagtggcacgtcgaagacctggtcccatggattgaggactgcaaggcaaagatgtccgaactacgagtcactctcgaccccgttcaactagaaagctcactgctgcgctccaaggctatgttaaacgaggtcgagaaacgtcgcagcctcctggaaatactgaacagcgccgccgacattttaataaattcttcggaggccgatgaagatggtattagagacgagaaggccgggattaaccagaatatggatgctgtgactgaggagttgcaggccaagacaggctctctcgaagagatgacccagaggcttcgtgaatttcaggagagcttcaagaacatcgaaaaaaaagtagagggagcaaaacaccaattggagatcttcgatgctctgggctcacaggcatgctccaacaagaatctcgagaaactgcgtgctcagcaagaggtcttgcaagcacttgaaccccaggtggattatctgcgaaacttcacgcaaggtctggtcgaagacgcccctgatggcagcgatgccagtcagctcctgcaccaggctgaggtggcacagcaggagtttttagaggtcaagcagagggttaattccggctgcgtcatgatggagaataagctcgagggcatcggacaatttcattgccgagtgagggagatgttcagtcagttagctgatctggacgacgaactggacggaatgggcgcaatcggaagagacactgacagcttgcagagtcagattgaggatgtgcgcttgttcctgaataaaattcatgtcctgaagctggacatcgaggcctccgaggccgagtgtcgtcacatgctggaggaagaaggcacattagacctcctcggcctgaaaagggagctggaagccctcaacaagcaatgcggaaagctgactgagcgcgggaaggctcggcaggagcagttggaactgactttaggcagggtggaagacttttatcgaaaactgaaggggctgaatgacgcaacgactgccgcagaggaagctgaggcccttcagtgggtcgtgggaacggaggtggaaattataaatcagcagttagccgatttcaaaatgttccagaaagagcaggttgacccccttcaaatgaaactgcaacaggtgaacgggctggggcagggcctgatccaatcagccggcaaggattgcgacgtccagggactcgaacacgacatggaggagatcaatgccaggtggaacacactgaacaagaaagtggcacagcgtatcgcccagctgcaggaggctctgctgcactgcgggaagtttcaggatgctctagagcccctactctcctggctcgctgatacagaggagcttatagccaaccaaaagcccccatcagccgagtacaaagtggtcaaggcacagatacaggagcagaaacttctgcagaggctgttggatgacaggaaagctacagtcgacatgcttcaggcagagggcggcagaattgcacagtcggctgagctcgccgacagggagaagatcaccggacagctggaatctcttgaatctagatggacagagctgctgtcaaaggccgccgcccgacagaagcagctggaggacatcttagttctcgctaaacagtttcacgagaccgctgaaccaatctcagatttcttgagcgtcacagaaaagaagcttgcaaactcggaacctgtgggcactcagaccgccaaaatccaacaacagatcatcaggcacaaagctttggaggaagatatcgagaaccacgctacagatgtgcaccaagctgtgaagatcgggcagtctctgagcagtttaacctcaccagctgagcaaggtgttctttccgagaagattgactctctgcaagctcgttacagcgaaattcaggaccgttgctgcaggaaggcggccctgctggatcaggcgcttagtaatgcaaggttattcggcgaagacgaagtcgaggtcctcaactggttagccgaggtggaagacaaactgtccagcgttttcgttaaagactttaaacaggatgtgttacaccggcagcacgcggatcatctggccctcaatgaggagatcgttaaccgcaagaaaaacgtggatcaggcgattaaaaatggtcaggcccttcttaagcagaccactggggaagaagtgctgctcattcaggagaaacttgacgggataaaaacaagatacgctgacatcaccgtgaccagtagcaaggccctccggacgctcgagcaggcccggcagctagcgaccaagttccagtctacctatgaggagctaactggctggctcagggaggtggaagaggaactggctacctccggtggccaatctccaactggggaacaaattccacagttccagcagcgccaaaaagaacttaagaaggaagtcatggagcatcgtctggtcctggacactgttaatgaggtctcccgcgcactcctggaactggttccgtggagagctagagagggcttagataaattggtgtcagacgccaacgaacagtacaaactagtttccgacacaatcggccaacgggtcgacgagatagatgctgccatccagaggagccaacagtacgagcaggctgccgacgctgagctagcttgggttgcagaaaccaaacggaaattaatggccttgggacctattaggctagaacaggaccagactacagcacagctgcaggtgcagaaagctttttctattgacatcattcgccacaaagatagtatggacgagctgttctcccatcggtcagagatcttcggtacgtgcggcgaggagcagaaaactgtgctccaggaaaaaactgagagcctgatccagcagtacgaggccatatcgttattaaacagtgaacgatatgctaggctcgaacgtgcacaagtgctggtcaaccaattttgggaaacctatgaagagctgtctccctggatcgaagagaccagggctctgatcgcacaacttccctctcctgccatcgaccacgagcagctgagacagcagcaggaggagatgcggcaactacgcgaaagcatcgccgagcacaagccccatatagacaaactgctaaaaattggccctcagttgaaggagttaaaccctgaggagggagagatggtcgaggagaagtaccagaaggctgagaatatgtatgctcaaatcaaagaggaggtgcgtcaaagagcgctggccctggacgaggctgtgtctcaatcaacacaaattaccgaatttcacgacaaaatcgagccgatgctggagactctagagaatctgtcttcccgtctgagaatgccacctctcattcccgccgaagtggataagataagggagtgtatcagcgacaacaagagcgccactgtggaactcgagaaactccagccatcttttgaggcccttaagagacggggtgaggagttgatcgggcgctcacaaggtgctgataaagacctggcagcgaaagaaatccaggacaaactggatcagatggtgtttttctgggaagacattaaggcaagggctgaagagcgggaaattaaatttcttgatgttctggaactagccgaaaagttttggtacgacatggctgcactactcacaactattaaggatactcaagacatcgtccacgacctcgagtctccaggtattgatccctctattataaagcagcaagtcgaggccgccgagactattaaggaggaaacggatgggttgcatgaggagttggagtttatccgcatcttgggggctgatctgatatttgcgtgtggagagacggaaaaacccgaggtccgcaagagcattgatgagatgaacaatgcgtgggagaacctgaacaagacctggaaagagcgactggagaaactggaagatgctatgcaggctgccgtccagtaccaggatacattgcaggccatgttcgattggctcgacaacacagtcataaaattgtgtacaatgcctcccgtggggaccgacctgaacacggtgaaagatcagctgaacgaaatgaaagaattcaaagtcgaggtataccagcaacaaatagagatggaaaaactcaatcatcagggggagcttatgctgaagaaggccaccgatgagacggatcgagacataatccgcgagccgctcactgaattgaaacatctctgggaaaacctcggcgagaagatcgctcatcggcagcataagctggagggtgcattgttagccctgggccagtttcagcatgcgctggaggaacttatgtcctggctcacccataccgaggaactgctcgacgcacaaaggccgatcagcggggacccgaaggtcattgaggtggagctcgccaagcaccacgtgcttaaaaacgatgtcctagcacaccaagctaccgttgaaacagtgaacaaggccggaaacgagctcctggagagttcagccggtgatgacgcctcctcattaaggtcacgcctcgaagctatgaatcagtgctgggagagcgtcctgcagaaaaccgaggagcgggagcagcagctgcagtctaccctgcaacaggcacagggatttcacagcgaaatcgaggactttttgttggaactgacgagaatggaatctcagctctcagctagtaagcctaccggcggcctccccgaaaccgcaagagagcagctcgacacccacatggaattgtacagccagctaaaagccaaggaagaaacatacaaccagttactggacaaaggacggttgatgcttctttctcgggacgatagcggatcaggctctaaaactgaacagtccgttgccttattggaacagaagtggcacgttgtgtcttccaagatggaagaaagaaagagtaagctggaagaggctctaaatctcgcaacagagttccagaattccctccaagaattcattaattggttaaccctggccgagcagtccctaaatattgcctccccgccttctctgattctgaatacagttttgtcacaaatcgaggagcataaagttttcgccaacgaagtaaacgctcatcgggatcaaatcatcgagcttgatcagaccgggaatcagctcaagttcctgtctcagaaacaagatgtcgttctgattaaaaacctactcgtctccgtccaatctcggtgggagaaagtcgtacagaggtcgatcgaaagagggcgcagcttggatgacgcgcgtaaacgcgctaaacaatttcatgaggcttggaaaaaactgatcgattggctggaggacgccgaaagccatcttgacagtgaactggagatctccaacgacccagataaaataaagttgcagctctccaagcataaagagtttcaaaagaccttaggcggaaaacagcctgtgtacgatactactattcggactgggcgtgctctgaaggagaagactctcctgcccgaagacagccaaaaactggataactttttgggagaggtgcgggataagtgggatacagtgtgtggtaagagcgtcgagaggcaacacaagttggaagaggccctactgttcagcggccagtttatggacgcgttgcaggcgctggtagactggctctataaggtcgagccgcaacttgccgaagaccagcccgtacatggcgacctggacctggttatgaacctgatggacgcacataaggtgttccagaaagaacttggaaaaaggaccgggactgtgcaggtgctaaagaggtccggacgcgaattaatagaaaatagcagggatgatacaacgtgggtgaagggccaactccaagaactctctacccgttgggacacagtgtgtaagttatcagtaagcaagcagagtaggctggaacaagctctcaaacaagccgaagtgttccgagataccgtgcatatgctgctggaatggctgtcagaagctgagcagacactcagattccgtggtgcattaccggacgatactgaagccctccagagccttatcgacacacacaaggagtttatgaagaaggttgaagaaaagcgggtggatgtgaactcagctgtggctatgggagaggttatactcgccgtgtgccaccccgactgcatcacgacaataaaacactggataacgatcattcgggcacgatttgaggaagtgttaacctgggctaagcagcaccagcaaaggctggaaactgcactgagtgagctcgtagcaaacgcggaactgttggaggaactactcgcgtggatccaatgggcagagaccacgctgattcaacgggaccaggagccgatccctcagaacatcgatagggtgaaggccctgattgccgaacaccagaccttcatggaggaaatgacacggaaacagccagacgtggacagggtcactaagacctacaaaaggaaaaatatcgaacctacccacgctcccttcatagagaagtccaggtctggcgggcgaaaatcattgtcccagccaacacccccaccgatgccaatcctatcacagagcgaggctaagaaccctcggatcaatcagctcagtgcccgttggcagcaagtttggctacttgcgctcgaacggcagcgaaagctgaacgacgctctggaccggctggaagagttgaaggagttcgctaattttgattttgatgtgtggaggaaaaagtacatgaggtggatgaatcacaaaaagtctagagtgatggactttttccggaggatagataaggaccaggacggcaagattacccgccaagagttcatagatgggatcctcgcctctaaatttccgacaaccaaattggagatgactgccgtggccgacatttttgatagggacggcgacgggtacatcgattattacgagttcgttgcggccctgcatcccaataaggatgcttatagaccaaccaccgatgctgacaagatagaagatgaagttacccggcaggtcgcccaatgcaaatgcgcaaaaaggtttcaagtggagcagatcggtgaaaataagtacagatttggagatagtcagcagttgaggctcgtgcgcatcctacggtctacagtgatggtccgagttggaggtggctggatggcgctggacgaatttctagtgaagaacgacccatgtagggcccggggtcgcactaacatcgaactacgggaaaagtttatactgcctgagggtgcgtcccagggcatgactccattcaggtcccgtggtcgaagatccaaaccaagttctcgggcagcatcgcccacaagatcctcgtcaagtgcctcccagagcaatcattcttgtacgagcatgccttcttctccagcaactcctgcctccgggacaaaggtgataccttccagtgggtcaaaactcaagaggcccacaccaacctttcactcctcccgcacatccctcgcgggagatacctctaacagctccagcccagcttccaccggagccaaaactaatcgcgccgaccctaaaaaatccgcctctcggcccggatcacgcgcgggatccagagccggctctcgcgccagcagcaggcgtgggagcgatgcgtccgatttcgatctccttgagacccagagtgcctgttcggacacctccgaaagtagcgccgctgggggccagggaaactcacgtaggggcctgaacaaaccctccaaaatacccaccatgtctaaaaaaacaaccactgctagtccgcgcacaccgggccctaaaagatag

SEQ ID NO: 195151 - DNA, 8412 bp, Artificial Sequence
  Description of Artificial Sequence: Synthetic coding sequence
atggacggcgtggccgagttcagcgagtacgtgagcgagaccgtggatgtgcctagtccatttgaccttctggagcctcccacatcgggtgggtttctgaagctgagcaaaccatgttgttatatctttccggggggcaggggagattcagcactattcgccgtgaacggattcaacatacttgttgatggcggcagcgataggaagtcctgtttctggaaactcgttcgtcatcttgataggattgactctgttttgttaacacacatcggggcagacaacctgcctgggatcaacgggctcctccagcggaaagtcgcggagcttgaagaggagcaaagccagggctcctcatcctattccgattgggtgaagaatctgatctctccagagctcggagtggtcttctttaacgtcccagaaaagcttcggctgcccgacgcttcacggaaggcaaagaggagtattgaagaggcatgtctgactctgcagcacctcaacaggctgggcatccaggctgagcctctctacagggtggtgagcaacaccatcgagcctcttacactgttccataagatgggcgttggacgtctcgacatgtacgtactcaacccagttaaagacagtaaggagatgcaatttctgatgcagaagtgggccggcaattcaaaggccaaaacaggaatagtgctgccaaatggcaaggaggcggagatctccgtgccctacctgacctcaatcacagccctggtcgtgtggctgccggcaaatcctaccgaaaagatagtaagggtcctgttccccggcaatgccccccagaataagatccttgagggtctagaaaagctcagacatctggacttcctgcgataccctgttgccacgcagaaagacttagcctccggtgcggtcccgaccaaccttaaacctagtaagataaaacagcgcgcggactcaaaggagagcctgaaagcaacaactaagaccgccgtttctaaactggccaagagggaagaggtggttgaagagggggcaaaagaagcacggagtgagcttgctaaggaactcgcaaaaacagagaaaaaagctaaagaatccagtgaaaaaccacccgagaagcccgccaaaccggagcgggtgaagacggaatcctcagaggctcttaaggccgagaaacgcaagctgattaaagacaaggtgggcaaaaagcacctgaaagagaaaatttccaaattggaggagaagaaggacaaggaaaagaaggagatcaagaaagaaaggaaggaactaaagaaagacgagggaaggaaggaggagaagaaggacgctaagaaagaggaaaagagaaaggacaccaagcccgagttgaaaaagatctcaaagcccgaccttaagcctttcactcccgaggttcgaaagaccttatacaaggccaaagtgcccggcagagtcaaaatcgaccgcagtcgcgccatcagaggcgagaaagagctctcttccgagcctcagacgcctcccgcccagaaagggactgttccgctgccaaccatttcggggcatagggagctggtattatcttcccccgaagacctgactcaggacttcgaggaaatgaaacgagaagaacgcgcccttttagcagagcagcgggatacaggcttaggggacaagccctttcccctggacaccgccgaggaagggcccccctccactgccattcagggaactcccccctcagtcccgggccttggccaggaagaacacgtcatgaaggaaaaggaactcgtccctgaagtacctgaagagcagggttcaaaggaccgcgggctggatagcggggcagaaactgaggaggaaaaggatacctgggaggaaaaaaaacagcgagaggccgagcgtctgcctgacaggacagaggcaagagaggagagtgagccggaggtcaaggaagacgttatagagaaggctgagttggaagagatggaggaggttcatcccagtgacgaagaagaagaggacgcgacgaaagccgaagggttctaccagaaacatatgcaggagccactgaaagtgacacctagaagccgagaggccttcggtggtcgtgagttgggccttcagggcaaggccccagagaaggagacttcgctgttccttagctctctcaccaccccggccggggctaccgagcatgtgtcctatatacaggacgaaactatcccaggttattctgagacagagcagaccatctcggacgaggagatccatgatgagcctgaggaaagaccagctcccccacgattccatacaagcacttatgacctccctgggcctgagggggctgggccgtttgaagcgtctcaacccgcggacagtgccgtgcctgccacgagtggaaaggtgtacggaacccccgaaactgaattgacttatcccaccaatattgtcgcggcccctctcgctgaagaagaacatgtcagctccgcgacatctatcacagagtgtgacaagctctccagctttgctacatcagtagctgaagatcagtccgtggcctccctgactgccccccagacggaggaaaccgggaagtcctccctccttctggacaccgtgaccagcattccctcaagtcgcacagaagctacgcaggggctcgattatgtgccaagtgccggaactatctcgcctacatcctcactggaagaagacaaagggttcaaatctccaccatgcgaggatttcagtgtcaccggtgagagtgagaaacggggcgagattatcggaaagggtctgtcaggcgagagggctgtcgaagaggaagaagaagaaacagccaatgtcgagatgtcagagaaactgtgtagccagtatggaactcccgttttttccgcccccgggcatgctcttcaccctggcgagcccgccctgggtgaagccgaggagcgctgtctaagtcctgatgacagtacggtgaagatggccagccctccaccctccgggcctccgagtgccactcatacgccattccaccagtctccagtagaggaaaagtcagaacctcaggacttccaggaggcagactcgtggggagacactaagaggaccccaggagtgggcaaggaggacgcagccgaagagacagttaaacctggtcccgaggagggaacgctggaaaaggaggagaaggtaccacctccccgcagcccccaggcccaggaagcccctgttaatattgacgaaggcctgacaggctgcactatccaactgctgcccgcacaagacaaggctatcgtgttcgagattatggaagcaggcgaaccaaccggaccgatcctgggcgctgaggcactgcccggggggttgagaacgttacctcaggagcctgggaaaccacagaaggatgaggttctgcgctatcctgacagaagcctgtcaccggaggacgcagaatccctctcagtcctcagtgtcccctcaccggacactgccaaccaggaaccgacccctaagagtccatgtggactcacagaacagtaccttcataaggataggtggcctgaggtgtctccagaagatacgcagagtctcagtttgtccgaggagtccccctctaaggagacatcgttagacgtctcttccaagcagctctcccctgagagcctgggcaccctgcaattcggggagctgaacctgggtaaggaggagatgggccacttaatgcaggctgaagacacatcccaccataccgcccctatgtccgtgccggaacctcatgccgcaaccgcaagcccacctaccgacgggacaaccagatactctgcgcagaccgacatcactgacgattccctggaccgcaagtcaccagcctccagcttttcccactccactccttccggaaatggtaaatacctgccgggcgcaatcacttcacccgacgaacacatcctcactcccgattcctcttttagtaagtcacctgagtccctgcccgggccagcacttgaggatatcgctatcaagtgggaggataaggtccctggactgaaggataggacttcagagcaaaagaaagaaccagaaccaaaggacgaagttctgcaacagaaggataaaactctggagcataaggaggtggtggagcctaaagataccgctatataccagaaggatgaggccctgcacgtgaaaaatgaggctgttaaacagcaggataaggctttagaacagaaaggcagagatttggagcagaaggacaccgcactggagcagaaagacaaagccctcgagcctaaagataaagacttggaggaaaaggacaaggccctggaacagaaggataagattccagaagagaaggataaagccttagaacaaaaggatactgcactggaacaaaaagacaaggccctggagccaaaggacaaagacctagagcagaaggaccgcgtcttggagcaaaaggaaaaaattcccgaagagaaggacaaagccctcgatcagaaagtgcgttctgtggagcacaaggctcccgaagacactgttgccgagatgaaagaccgtgatttggagcaaacggataaagctcctgagcagaaacaccaagcacaggaacagaaggacaaagttagcgaaaaaaaagaccaggccttggagcagaagtactgggcactgggccagaaggatgaagcactggaacaaaacattcaggctctcgaggaaaatcatcagactcaggagcaagagagcttagtgcaggaagataagacaaggaaacctaagatgctggaggagaagagccctgagaaagttaaggccatggaagagaaactggaggccctactggagaaaactaaagccctgggactggaagaatcactggtgcaggaggggcgcgctcgagagcaggaggagaagtactggagggggcaagacgtggtgcaggagtggcaggaaacatctcccactagagaggaacccgccggtgaacaaaaggaactcgctcctgcatgggaggatactagcccagaacaggacaatcggtattggcggggacgagaagatgtcgcattggagcaggacacctattggagagagctgtcgtgtgaacggaaagtctggttcccccacgaactggacggccaaggtgccagacctcattacactgaagaacgggagtcaacattcctggacgaaggcccggacgatgaacaggaagtgcctctgcgggaacatgcaacccgctccccatgggcatccgacttcaaggatttccaggaaagttcacctcagaagggactcgaagtggaacggtggctggcagagtcccccgtggggcttccccccgaagaagaggataagctgacgaggtcacctttcgaaataatttcaccccccgcctcgcctccagaaatggtcggacaaagagtcccttccgcgcccggacaggaatcccccataccagatcccaaactcatgcctcacatgaaaaacgagcctactactcccagctggttagccgacattccaccgtgggtcccaaaagatcgtcctttgccgccagcaccgttgtcacctgcccctggaccgcccaccccggcccccgaaagtcacacacccgccccgttctcttggggcaccgccgagtatgacagtgtggttgccgccgtgcaggagggcgccgcagagttggagggtgggccttactcgcctttaggaaaggactacagaaaagcagagggcgaacgagaagaggaaggtcgcgcggaagctcctgataaatcttcacatagctcaaaggtacccgaagcttctaagagccacgccaccacagagcctgaacaaaccgaacctgaacagcgggaaccaacgccataccctgatgaaagaagcttccagtatgccgatatctatgaacaaatgatgctgactggcttgggccctgcctgtccaacacgggagcccccgctgggggcagccggtgactggcccccgtgtctgtccaccaaagaggccgccgcaggaagaaatacttctgcggagaaggaactttcgagtcccatttcacccaagtccctgcagtctgacacgcccaccttctcgtatgcggccctggccgggccaaccgtgcctccccgaccagagcctggccccagcatggagccgtctttaacaccccctgccgttccaccacgagcccccatcctaagtaagggtccttcccctcctctgaatggaaatatcctgtcttgttcacctgatcgaaggtctccatccccaaaggagtctgggagatcccattgggacgactcaacaagtgatagcgagctggagaaaggcgcccgggaacagcccgagaaagaagcacagtcccctagcccaccacatccaattccaatgggcagtccaacactgtggccagaaactgaggcacacgtctcaccccctcttgactctcacctcggtcccgcccgcccctctctggacttccctgcgtccgcatttggttttagttcattgcagcctgctcccccacagctgccaagtccggctgaacctcgtagtgccccatgcggctctctggccttctctggcgatagagctctcgctctggccccagggcctccaaccaggacgaggcatgacgagtaccttgaggtcacgaaggcaccttcgctggattctagtctcccgcaactccccagcccatctagccctggggccccattgctatctaatctgcccaggccagcctctcctgcactcagtgaaggttcaagctctgaggctaccacccctgtgatcagcagtgtagctgagcgcttttccccatcactcgaagccgcagagcaagaatccggagaactggaccccggaatggaaccggcggcccattcactgtgggatcttacccctttaagcccggcgccgcctgctagcctggacctcgccttggcccccgccccatcactcccaggagatatgggggacggaattttgccatgtcacctggagtgttccgaagctgcaacagaaaaaccctcaccatttcaggtacccagcgaggattgcgctgccaatggtcccaccgaaacgagtcccaatcccccaggccctgccccagccaaagcagaaaacgaagaggccgctgcttgtcccgcttgggagaggggggcatggccagagggtgcagaacgcagtagtaggcccgacaccctcctgtcgccggaacagcctgtctgtcccgctgggggttcaggagggcctccctcctctgcttctcctgaggtcgaagccggcccccagggctgtgcgacagaaccccgcccacaccgcggggagctgtccccatcgtttctgaacccgcccctgcccccgagcatcgacgacagagatttatcaaccgaggaagtgcgcttggtcggtcgcgggggccggcgcagagtcgggggccctggcaccacgggaggtccttgcccggtgaccgacgaaacccctccaacttctgcctcggatagcgggtcgtctcagagcgattccgacgttcctccagaaacagaggaatgcccaagtataactgccgaagccgccctggacagcgatgaagatggcgatttcctccccgtcgataaagcaggcggagtgagcggcacccaccaccctcggcctggccacgacccgcctcccctcccacagcctgaccctagaccctccccaccccgtccagacgtgtgtatggcagacccggaaggcctgagcagcgagtccggaagggtggagagattgagagagaaagagaaagtccagggtagggtgggccgtcgggctcccggcaaggcaaaacccgcaagcccagctcgccggctcgatctcaggggtaaaaggtccccaacgcccggaaaaggtcccgccgaccgggcatcgagggcacccccacgccctcgctctacgacgtcacaagttacccccgctgaagagaaggatggtcacagtcccatgagtaagggcttggtaaacggcctgaaagctggaccaatggcattgtcctctaagggcagctccggcgcccccgtctatgtcgacctggcctacattccaaaccactgctccggaaagactgcagatctggatttctttagacgagtacgggcatcctactacgtagtttccggtaatgacccagctaatggagagccctcccgggcagttctcgacgctcttttggaaggaaaagcccagtggggtgagaatcttcaggtgacgctcatcccgacacacgatactgaggttacccgggagtggtaccaacagactcatgagcagcagcagcagttgaacgtgctggtccttgctagttccagcactgtggtcatgcaagatgaaagttttcccgcttgcaagatcgaattctag

SEQ ID NO: 195152 - DNA, 9126 bp, Artificial Sequence
  Description of Artificial Sequence: Synthetic coding sequence
atggagaccgaggccgagcccgcccggccccacggcgtggccatggagacaactccaggccttggtctgaggtcacccggggctcccctggcacagaaccccgccgagttactctgcgaagctggcgcggcagtggcagccgcaagatgggacctgcagaagcatagccttcttatagttataggcgacatcggcaccgaatcacagttaagggccgtgcgagcccaccttgaacagggcattttgagctggaacatcgatctgtcatcgttcgacctcaaccaacagttaaggctgtttatcactcgccatctagcacattttagctcggaagtgaaaggtcaacggacactttgtcatcagtccgagattctagagacaatcattcttgtgaacccatcagcagacagcatctcgtcagaggtgcatcatctgctaagcagcagctctgcctacaagcttctcattctgagcgggcagagcttagaacccggaggtgacttaatactgcagagcggaacgtactcatacgagaattttgctcaggttttgcacaaccccgagatttctcagctcctgtcaaatcgcgacccaggaattcaggcctttttaaccgtgtcctgcctgggggagggagattggagtcatctgggcctttcctccagccaggagacgctgcaccttagactgaaccctgagccaaccctgccaaccatggatggcgtggcggaattttccgagtacgtttccgagacagtggacgtaccatcaccatttgatcttttggagccgcccactagtgggggattcctgaagttaagtaagccctgctgctacatctttccaggaggacgcggtgactccgctctctttgcggtgaacggcttcaatatccttgtggatggtgggagcgatcgtaagagctgcttctggaaactggtcaggcatctggacagaattgattctgtcctcctgacccacataggcgctgataatcttcccgggatcaacggtcttctccagaggaaggtggctgagttagaggaagaacagagccagggctccagcagctattccgattgggtcaaaaatcttatttctcccgagctcggggtagtgttcttcaacgtgcccgagaaactacggctgcctgatgcttcccgcaaagccaagcgctccattgaagaagcctgtctcacactgcagcacttgaaccgtctaggaatccaagcagagccgttgtaccgcgtggtctccaacactattgagcccctaacattattccacaagatgggagtcgggcggttggacatgtacgttctcaatcccgtgaaggatagcaaggaaatgcagtttctaatgcaaaagtgggctggaaatagcaaagcaaagaccggcatcgtcctccctaatggcaaggaggctgaaataagcgtgccatacctgacctctatcactgcgctggttgtatggctgcccgccaacccaaccgagaaaatcgtccgggtgctcttccctgggaatgctcctcagaataagattctagaggggctggaaaagctccgccacctcgacttcctgagataccccgtggcaacgcaaaaggatctcgcctccggggctgtacccaccaacctgaaaccatctaagattaaacagagggctgacagcaaggagagtctgaaggccacaacaaaaaccgcggtttccaaactggccaagcgagaagaagttgtggaggagggcgccaaagaagcccgttccgagctggccaaggaactcgccaaaaccgaaaaaaaggctaaggagtcctccgagaagcctccagagaagccagccaaacctgaacgggttaagactgaaagttccgaggcccttaaggccgaaaagcgaaagctgattaaggacaaggtcgggaaaaaacacctgaaagaaaaaatttcaaagctcgaagaaaaaaaggacaaggaaaaaaaggaaatcaaaaaggagaggaaggagctgaaaaaggacgaggggcgtaaagaggaaaagaaggacgccaagaaggaggagaaacgaaaagacacgaaaccagagcttaagaagatcagcaagcctgacctgaagcccttcacgcctgaagtccggaagaccctctataaggcgaaggtcccaggaagggtaaaaattgataggtctcgagcaatccgaggagagaaagaattgtccagcgagccacagacaccccccgcccagaaaggcacggtgccgctgcccaccatcagcggacaccgggaacttgtgttatctagtcctgaagatttgacccaagattttgaagagatgaagcgggaggaacgagccctgctggccgagcaaagagacaccgggttaggcgataagccgttccccttggacacagctgaggaaggcccaccttccacagcaattcagggcacccctccctccgtgccaggcctgggccaagaagagcacgtgatgaaagagaaggagttagtgcctgaagttcccgaagagcagggtagcaaagacaggggcctggactcgggagccgagacagaggaggagaaagacacgtgggaagaaaagaaacagagagaagccgaaaggctcccagatcggaccgaggcgcgtgaagaaagcgagccagaggtcaaggaggacgtgatagagaaagctgagttagaggagatggaagaggttcaccccagcgacgaagaggaggaggatgctaccaaggctgaggggttttaccaaaaacacatgcaggaaccattgaaagtgacaccacgcagccgggaggcgttcggagggcgggaactggggctgcagggtaaggcccctgagaaggagacatccctgttcctgagcagcctgacaactccggcaggtgcgactgagcacgtgagctatatacaagacgagactattcccggatatagcgagacggagcaaacgatttctgacgaagagatacacgacgaaccggaggagaggcctgctccacctagattccatacctcaacctacgatctacctggccccgagggggctgggccattcgaagcatcacaacccgcagactctgcagtcccagcaacgtcagggaaggtgtatggcaccccggaaacagaactcacgtacccgacaaacatcgtagcagccccactagctgaggaggagcatgtgtcctcagctacttccatcactgagtgtgataagctgtctagctttgccactagtgtcgccgaggaccagtccgtggcttcactcacagctccccaaacagaagagaccgggaagtcttctttattactggacacagttacaagcatcccgagcagccgcacagaggccactcagggcctggactatgtgccatcagcaggtaccataagccccacctcctcactggaagaggacaagggattcaagagccctccctgcgaagatttcagcgtgaccggggagagcgagaaaaggggagagattatcgggaagggtctaagcggggagcgagcagttgaggaagaggaggaagagacagccaacgtggaaatgtcagaaaagctctgttcacagtacgggacacctgtgttctctgccccagggcacgccttgcatcccggagaacccgctcttggagaggccgaagaaaggtgcctgtcccctgacgacagtacagtgaaaatggcaagcccacccccgagcgggccgccttcagctacccataccccattccaccagagtcctgtggaagaaaagtccgagcctcaagatttccaggaggctgatagttggggcgacacaaaaagaaccccaggggtcgggaaggaagacgccgctgaagagactgttaagcccggccccgaagaaggcacactggaaaaggaggagaaggtcccacccccacgatctccccaggcacaagaggctccagtgaatatcgacgagggtttaaccggatgcacaattcaactgctgcccgcccaagataaggcgatcgtgttcgagatcatggaggcgggagagcctaccggccccatactgggggctgaggcacttcctggcggcctgagaactcttccccaggagccagggaaacctcagaaggacgaggtgctaaggtacccagatagaagcctctctccagaagatgctgaatccctgtccgttctgagcgtcccctcaccagacactgcaaaccaggagcccactccgaaatctccatgcggcctaaccgagcaatacctacataaggataggtggcctgaggtgagtccagaagatacccagagtctcagtctgagcgaagagagccctagtaaggagacctctttggacgtctcttctaaacagctgagccccgaatctttggggactctccagttcggcgagcttaacctggggaaagaggaaatgggccacctgatgcaggccgaggatactagccatcatacggcacctatgagcgttcccgagccccacgctgctactgcaagtcccccaaccgatggcaccacccgctacagtgcccagactgatattactgatgattctcttgatagaaagagccccgcttcctcattcagtcatagcactccttcaggaaacggcaaatacctgccaggagctatcacatccccggacgaacatatcctcacccccgattccagcttctccaagagcccagaatcactcccaggacctgcgctcgaagacattgcaatcaagtgggaggataaagtacctggcctaaaggacagaacctccgaacagaagaaagaaccagaaccaaaggacgaagttctccagcagaaggataaaaccttagaacacaaggaggtggtagagcctaaggataccgccatctaccagaaggatgaagccctgcacgttaaaaatgaagccgttaagcagcaggacaaggcactcgaacagaagggccgcgatctagagcaaaaggacaccgcgctcgagcagaaggataaggcgctcgagccaaaggacaaagacctggaggagaaggacaaggccctagagcagaaggacaagataccagaggaaaaggacaaggctctcgagcagaaagacactgccctcgaacagaaagataaagccttagaacccaaagataaagatctggaacagaaggaccgcgtgttggaacagaaagaaaagatacctgaggaaaaggataaggcgcttgaccagaaagttaggagtgttgagcacaaggcccctgaagacacagtggcagagatgaaggaccgggatctggaacagactgacaaggcccccgaacaaaagcatcaggcacaggagcagaaggataaggtgtcagagaagaaagaccaagccctagagcagaagtactgggccctcggtcagaaagatgaagccttagagcagaacatccaggctctcgaagaaaatcatcaaacgcaggagcaggagagtcttgtgcaggaagacaagaccaggaagcctaaaatgctagaggagaagagcccagagaaggtcaaggcgatggaagagaagctggaggctttgctcgaaaaaacaaaggccttgggactcgaagaatcattggtccaggagggtagggctcgagagcaggaagagaagtattggaggggccaggacgtggtacaggaatggcaggagacaagtcccacgcgcgaggagcccgcaggtgagcagaaggagctggccccagcctgggaagacaccagccccgaacaagacaaccgttactggcgggggagagaggacgtcgcgttagaacaggacacatattggcgtgaactcagctgcgaacgtaaagtgtggttcccccatgagttggacggtcagggggcgcggccccattacacagaagaacgggagtcaacctttttagatgagggtccagatgatgagcaagaggtgcctctcagggagcacgcaacgcgaagcccatgggcctctgattttaaagatttccaagagtctagtcctcagaagggtctggaggttgaaagatggttggccgagtcaccagtggggttgccaccagaggaggaagacaagttgactaggagcccctttgagattatcagtcctcccgccagtcccccggagatggtagggcagagggtgccttccgcccccgggcaagagtctccgatccccgacccaaagttaatgccacatatgaagaatgagccaactactccctcttggctcgccgatatccccccatgggtaccgaaagaccgccctctgccccctgcgcctctgtcgcctgcccctggacctcccacgcctgcacctgaaagccacacgcccgctcccttcagttggggtacagcagagtacgatagtgttgtggccgccgtgcaggagggggccgcagaattggagggtggcccctattccccattgggtaaggactatagaaaggccgagggcgagcgcgaggaggaagggagggcagaggccccagataaatcaagccattcatcaaaagttcctgaggcatcaaagagccatgctacaacagagcccgaacagacagagcctgaacagagagaaccaaccccgtatcccgatgaacgcagttttcaatatgccgacatttacgagcagatgatgctgactggtctgggacccgcctgtccaactcgcgaacctcccctcggtgcagccggtgattggcctccttgtttatctaccaaggaagccgccgccggccgtaatacttctgccgaaaaggaactctcctctcccatatcccccaaaagtttgcagagcgacaccccgactttctcatacgccgcccttgctggacccacagtgcctccccgtcctgagcccggtccctccatggagccctctctgacgccaccagctgtcccgccacgtgcccctatcctgagcaaagggcctagcccaccgctgaatggaaacattctctcctgcagccctgacaggcgatccccaagcccaaaggagagcggccgcagccattgggacgatagcaccagtgatagtgagttagaaaagggcgccagggagcaacccgaaaaggaggctcagtctccctcaccgccacacccaattcctatgggatccccgaccttgtggccagagacagaagcccatgtgtctcccccactggattcgcatcttggacctgcaagaccgtccttggactttccagcttcagcttttggctttagcagcttacaacctgctccaccacagcttcccagtcccgccgagccaaggtctgctccttgcgggagtctcgcattttccggcgacagagcactggccctggctcccggcccacctactcgaacccgccatgacgagtatctggaagtcaccaaggccccttcactggattctagcctgcctcagctgccatctcccagctctcccggggcccctctactgtctaaccttcccaggccagcatccccggcactctctgaaggtagtagtagcgaagctacaactcctgtgatttcatcagttgccgaaagattctctcccagtctggaagctgcagagcaggagagtggggaactcgatccggggatggaaccagcagcccattccctatgggacctgacgccactgtcgccagcaccaccagccagtctcgatttagcactggctcctgccccctccttgccaggggacatgggagatggcatactgccatgtcacctggaatgttcagaagccgccaccgagaaaccatctccctttcaagtgcctagcgaggattgtgctgccaacggccctacagaaacaagccctaaccctcctgggcctgctccggccaaggctgaaaacgaggaagcagccgcatgccctgcatgggaaagaggtgcttggccggagggtgctgaacgcagttcccggccagacaccctgctctcccccgaacagcccgtgtgccccgccgggggaagcggcggccctccctcaagtgcctcccccgaggtggaggccggcccccagggctgtgctactgaacccagaccacaccggggagaactgtctccatccttcctgaacccccccttgccaccctccatagatgacagagatctgtctactgaggaagtgcgcctggtgggccggggcggtcgacggagagtcggcggaccagggaccactggaggtccctgccctgttacagacgaaacacccccgactagcgcctctgatagtggttctagccagtcagacagcgacgtgccgcctgaaacagaagaatgcccctcaattaccgcagaagctgcattggatagtgatgaggacggagattttctgcctgtagataaagcggggggcgtgagtggtacccaccacccacgcccaggacacgaccccccccccctgcctcagccagatcctcgaccttccccccctaggccggatgtgtgtatggcagacccagaggggctgtcttctgagtcaggtcgggtggaacgtctgcgcgaaaaggaaaaggtacagggaagggtcggaaggcgcgcccccggcaaagcaaaacctgcgagccccgcgcggcgtctagaccttaggggcaaacgctctccgacgccaggcaaagggccagcggacagggccagcagggctccccctaggccccgatccaccaccagccaagtgactccagccgaagagaaagacggccattcacccatgtccaagggtctagtgaatggcctgaaggctggcccaatggctctgtccagtaagggatcatcaggcgcccctgtgtacgtggacctggcctatatcccaaaccactgctccggcaaaacagccgacctagacttctttcggcgtgtgagagcttcctattatgttgtgtccgggaacgatcctgcaaatggcgaacctagccgcgccgtgttggatgccctgctggaaggaaaagcgcagtggggggaaaatctacaggtgaccctcatccctacacacgacacggaggtgaccagagagtggtaccagcagactcatgaacaacagcagcagctaaatgttctcgtactggcctcatcttccacagtcgtgatgcaggacgaatcatttccagcgtgcaagatcgagttttag

SEQ ID NO: 195153 - DNA, 8418 bp, Artificial Sequence
  Description of Artificial Sequence: Synthetic coding sequence
atggacggcgtggccgagttcagcgagtacgtgagcgagaccgtggacgtgcccagcccttttgacctgcttgaacctcccacaagcggtggcttcctgaagctctctaagccttgttgctacatctttcccgggggtagaggagacagcgctctgttcgccgtcaacggcttcaacattctggtggatggcggctccgatcggaaaagttgcttttggaagctcgttcgtcaccttgaccgaatcgatagcgtactgttaacacacatcggggcagacaatctaccgggaattaatggcctgcttcagaggaaagtcgcagagttagaagaggagcagagccagggcagtagttcatacagcgattgggtcaaaaacttgatttcacccgagctcggggtcgtgttcttcaacgtccccgagaaattgcggctgcctgatgcctcacgaaaagccaagcgttcaatagaagaggcctgtctgaccctacaacatctgaatcggctgggcatacaggccgaacctctctacagggtggtgtccaataccattgaaccactgactttgttccataaaatgggcgtgggacgactggacatgtatgtactcaatcctgtgaaggattctaaagagatgcagtttcttatgcagaagtgggccggaaattccaaagctaagacgggtatagtcttacccaatggaaaagaggccgagatcagcgtcccatacttgaccagcattaccgcactagtggtctggcttcctgccaatccaacagaaaagattgtgcgcgtcctcttccccggcaacgccccccagaacaaaatcctggagggactcgagaaactcagacatctcgacttccttcgataccccgtggccactcagaaggacctggcatccggagctgtgcccacgaacctgaagccatcaaaaatcaaacagcgggcggactccaaggagtctcttaaggccactaccaaaactgccgtgtctaagctggccaaaagggaagaagtggtagaggagggagctaaggaggcaagatccgagctggcaaaggaactagccaaaactgaaaagaaagccaaggagtcctctgagaagccccctgaaaaacccgccaaaccagaacgcgttaagacagagagctcagaagcattaaaggctgagaaacgaaagctgattaaagacaaggtgggcaagaagcatttgaaggagaagatttccaagctggaagagaaaaaggacaaggagaaaaaggaaattaaaaaagaaaggaaggagctgaagaaagacgagggccggaaagaggaaaagaaagacgcgaagaaggaggaaaaacgaaaggacactaagccggaattgaagaaaatctccaagccggacctaaaaccattcactcccgaagtgagaaagacactgtataaggctaaggtgcctggaagggtaaagatcgacagatcccgcgcgattaggggcgagaaggaactctcttctgaaccccaaactccacccgcccagaaaggcacggtccctctgcccacgatctctggccaccgagagctagttctcagcagccctgaggaccttacccaagacttcgaggagatgaagcgagaagagcgggctctcctggccgaacagcgggacacaggcctgggggataaaccttttcccttggacacggccgaggaagggcccccttcaacagcaattcagggaacgcccccttccgtaccaggactgggccaggaggagcatgtgatgaaagagaaagagctggtgcccgaggtcccagaagaacagggatctaaggacagaggcctggacagcggcgcagagacggaggaggaaaaggacacgtgggaggagaagaagcagcgcgaggccgagagactgccagaccgcacagaggcccgggaggagtccgaaccagaggtcaaggaggatgttatagagaaggccgaactggaggaaatggaggaggtccaccccagtgatgaagaggaggaagatgccactaaagccgaaggcttctaccaaaaacatatgcaggagcctctgaaggtgacacccagaagtagggaggcatttggtggtagagaattgggcctgcaaggcaaagctcctgagaaggagacgagtctcttcctatcctctctgacaacacccgctggcgctaccgagcacgtttcttacatccaagatgaaactataccaggatactctgaaacagaacagactatctctgacgaggaaattcacgacgaaccagaggaaagaccagcccctcccaggttccataccagtacctacgatctgccgggacctgaaggcgctggaccatttgaggcttcacagccagcggattccgcagtcccagctacatccggtaaagtgtacggcacacccgaaactgagctaacgtacccaactaatatcgtagcagctcctcttgccgaggaggaacacgtctcctccgcaacatcaatcacagaatgcgataaactgtcttccttcgcaacatccgttgctgaggaccaaagcgttgcaagcctcactgcaccccagacagaagagacaggaaagagttccctgctgctggacacggtgacctccatcccaagcagccgaaccgaagccacccaggggctggactacgtgccctccgctggaaccatctctcccacttcctcactcgaggaagataaaggcttcaagagtccaccctgcgaggactttagtgtcaccggcgagtctgagaaacgcggtgaaattattggcaagggactgagcggagagagagcagttgaagaagaggaagaggagacagccaacgttgagatgtccgagaaactgtgctctcagtatggcacccctgtgtttagcgctcccggacacgccctgcacccgggcgaacctgctctgggtgaggccgaggaacgctgtctgtctcctgacgacagcactgtaaaaatggcttctccaccgccttccggacccccaagtgccacccacacccccttccaccaaagtccagtcgaggagaaaagcgagccccaggattttcaggaagcagattcttggggggacactaagcggaccccgggggttggcaaggaagacgcagcagaagagactgtcaagccaggacccgaagaggggacactggaaaaagaggagaaagttcctccaccccgttcaccgcaggctcaggaggcaccagtgaatattgacgagggactgacaggatgcacaatccaacttcttcccgcccaggacaaggccatcgtgttcgaaatcatggaagccggtgaacccacaggtcctatcctgggcgcggaggcactgcccggtggcctgcggacgttgcctcaggagcccggaaagccacagaaggacgaagtgttgcgataccccgacagaagtctatcacctgaagatgccgaatctctgagtgtactgagcgtgccgagtcctgataccgccaaccaagagccaacccccaaatcgccctgcggtctgacggagcaatacctacataaagatcgctggcctgaggtcagccctgaagatacacagagtctgtctttgtccgaggagagtccgagtaaagagacgtccctcgacgtctctagcaagcagctgagccccgaatccttgggcaccctgcagtttggagagctgaatctagggaaagaagagatgggtcacctgatgcaggcagaggacacttcacatcacaccgcccccatgtctgtgcctgagccccacgcagccacagccagcccccccaccgatggcactaccaggtactctgcccagacagacattaccgatgacagtcttgatcggaaatctccggcatctagcttctcgcacagcacaccatccggcaatggcaaatatctgcccggtgcaatcacatcacccgacgaacatattttaaccccagacagcagctttagtaagagcccagagtccctgccgggaccagccttggaggacatcgcgataaagtgggaagacaaggtccccggtttgaaggacagaaccagcgagcaaaagaaagagcccgaaccaaaagatgaggtgctccagcagaaggacaagacactcgagcacaaagaagtcgtggaacccaaagatacagccatttaccagaaggatgaggcattgcacgtgaagaatgaggcagtgaaacagcaggataaagcactagaacagaaagggcgcgacctggaacaaaaggacaccgcattggagcaaaaggacaaggcacttgaacccaaggataaagatcttgaagaaaaagacaaagccctcgaacagaaagacaagattccggaggagaaggacaaggccttagaacagaaagacaccgcactggagcaaaaagataaagccctggaacccaaggacaaggaccttgagcagaaggatagagtgctggagcaaaaagagaaaattcctgaagagaaggataaagccttggaccagaaagtgcgatccgtggaacataaagctcctgaagacaccgtggccgagatgaaagatcgggatcttgagcagactgataaagcacccgaacagaaacatcaggctcaagagcaaaaggataaggtgtcagaaaaaaaggatcaagcgcttgagcagaagtattgggctctcgggcagaaggacgaggcacttgagcagaatatacaggccctggaggagaatcaccaaacccaagagcaggagtcacttgtgcaggaggataagaccagaaaaccaaaaatgctggaggaaaagagccccgagaaggtcaaagctatggaagagaaacttgaagctctgctggagaagactaaggccctgggactggaagagtccctggtgcaagaaggtcgtgccagggaacaggaagaaaaatactggaggggccaagacgtcgtccaggagtggcaagagacatcccccactagggaagagcccgctggcgagcagaaggaactcgcccccgcctgggaggacacctcacctgaacaggacaaccggtattggcgaggcagggaggacgtagccctggaacaggacacatactggagggaactgtcttgtgagaggaaggtttggttcccccacgagcttgacggccaaggagcacggcctcactacaccgaagagcgggagagtaccttcctggatgagggccctgatgacgagcaagaagtaccgcttagggaacacgcaacgcgtagtccatgggcatctgattttaaagattttcaagagagttctccacagaaaggcttggaagttgagaggtggttagctgagagtccagtaggtttgcctcccgaggaagaggataagctgaccagatccccttttgaaatcatctcgcctcctgcaagcccacccgagatggtgggacagagggtgccatccgctccaggccaggagtctcctatacctgaccctaaactgatgccccatatgaaaaacgagcccactactccatcttggctggctgatattccaccctgggtccctaaagaccgaccactgcctcctgcacctctgtctcctgcccccggccctcctacaccagctccagagagccacaccccagcccctttctcttggggtaccgccgagtatgattccgtggttgcagcagtgcaggagggggccgctgagctcgagggggggccttactcaccgctcggaaaagactacagaaaggcagagggagaacgagaagaggaggggagagccgaagcccccgacaagtcctctcatagcagtaaggtcccggaggcctcaaagagccatgcgaccactgaaccggagcaaactgaacctgaacagagggagcccactccctatcccgatgaaagatcttttcagtatgccgatatatatgagcagatgatgctgactggcctcggacccgcctgccccaccagggagccacccttgggcgctgctggagattggcccccatgtctttccacaaaggaggcagctgcgggacgcaatacaagcgctgaaaaagagctaagctctcccatctcacctaaaagcctccaatcagatactcctacgttttcgtacgccgccctcgcagggccgactgtgccacccagaccagaacccggccctagcatggaaccatctttaactccccctgcagtgccacctcgggcaccgattctcagcaaagggccatccccgcctttaaatggaaatatcctgtcctgttccccggatagaaggtcaccttcacccaaggagagtgggagatcccactgggatgacagtacatctgacagcgagctggagaagggggctcgcgagcagccagagaaagaggctcagagcccatccccaccccatcccattccaatggggagtcccacactatggcccgagacagaggcacatgtgtctcccccactagacagccatctgggacccgcccgccctagcctggactttcccgccagcgcttttggattttcgtcgcttcagcctgcccccccacagctcccaagcccggccgagccgaggagcgccccatgcggaagcttagctttttctggggacagagccctggccctcgcgccaggcccaccaacgaggaccagacacgatgagtacctggaggtcacgaaagctccttctctcgactccagcctgccccaactgccatctcctagtagccccggggccccactgctgagcaatctacctcggccggcgtctcctgccctgtcggagggctcatcatcagaggccaccacgcccgtgatctcatctgtggcggagaggttctcccccagccttgaggcggccgagcaggaatctggtgagctcgaccctggcatggaacctgcggctcactcgttgtgggatctgactcccctgtctcccgcaccacccgcgtctctcgatctggccttggcccccgcccccagcctcccgggcgatatgggcgatgggatccttccctgccatttagagtgtagcgaagcagctaccgaaaagcctagccctttccaagtgcctagcgaggattgcgctgctaacggtcctacagagacgtcaccaaaccctccaggaccagccccagcaaaggccgaaaatgaggaggcagccgcctgccccgcttgggaacggggtgcttggccagaaggagccgagcgctcgagccggcccgacacacttctgtcacctgaacagccagtgtgtcctgccggcggcagcggaggaccaccctcttccgcatctcccgaggtggaggccgggccccaaggctgtgccaccgaacctcggccccaccggggagagctaagtccaagctttctgaatcccccattgcccccgtcgatcgacgatagagacctgtcgaccgaggaggtgcgccttgtgggacgcggaggccgccggagggtgggtggccccgggactacagggggaccttgccccgtaactgatgaaacacctccaaccagtgctagtgattccggttcttcgcagagcgattctgatgtccctcccgaaacagaagagtgtcccagcattacagccgaggctgctctggatagcgacgaggatggagacttcttgcctgtggacaaagccgggggagtgagcgggacgcatcacccaaggccggggcacgacccccctccactcccccagcccgaccctcggccttcacccccccgccctgacgtttgtatggctgatccagagggcctctcttctgagagtggccgggtcgagaggctgagagagaaggagaaagtgcaaggacgggtgggtagacgcgcccctgggaaggctaaacctgcttctccagctaggagactggacctgcggggcaagcggagtccaactccgggcaaggggccagctgatcgagccagcagagctcctcctagaccgaggagtactacgtcgcaggtgacacccgccgaagaaaaagacggacactcccctatgtctaaagggctcgtgaacggtttgaaagcgggccctatggcactgtcgtcgaaggggagttctggggccccagtttatgtggatttggcctacattcctaatcattgctcagggaaaacggccgatctggatttcttccggcgggtgagagccagctactatgttgtctccggaaacgaccccgccaatggggaaccgagcagagctgtgcttgacgctctgctggaaggcaaggcccagtggggcgaaaacttacaggtctccgtgacacttatacctacacacgatacagaagtgacacgggaatggtaccagcagacccacgagcagcagcaacagcttaatgtgctggtcttggcatctagctccactgtcgtaatgcaggacgaaagctttccggcctgtaagatagagttctag

SEQ ID NO: 195154 - DNA, 1884 bp, Artificial Sequence
  Description of Artificial Sequence: Synthetic coding sequence
atggacggcgtggccgagttcagcgagtacgtgagcgagaccgtggatgtgcctagtcccttcgaccttttagaacctccgacttctgggggattcctgaagctgtcgaagccgtgctgttatatcttccccggagggcggggtgatagcgcgctctttgccgtgaatggctttaacatcctggtagatggcgggtctgatcggaagtcttgtttctggaaactcgttcgacatctagataggatcgactccgtgctgctgacccacatcggagcagataatctgcctggtatcaatggtctgttacagcggaaagtggcagagttggaggaggagcagtcccaaggcagcagctcctacagcgattgggtaaaaaatctgatctctcccgagcttggtgtggttttcttcaatgttcccgagaagttgagactgccggatgcatcccgcaaggcaaaacgatccattgaggaggcctgcctgaccctacagcatctgaaccggttagggatccaagccgaacccctgtatcgtgtcgtgagtaacaccatcgagcccctgaccttattccataagatgggcgtgggtagactcgatatgtatgtcctgaatcctgtcaaggactccaaagagatgcaattcctgatgcaaaaatgggctggaaatagtaaggcaaaaactggaatagtgctcccaaacggaaaggaagccgagatctcggtaccttatctcaccagcattactgccctcgttgtgtggctgccagcaaatcctacagaaaagatcgtgcgtgtcctgttccccggaaacgctccccagaacaagatcttggaaggcctggaaaagctccgtcacctcgacttccttcgctaccctgttgccacccaaaaggacctggcatccggcgctgtgccaacaaacctcaagccctccaaaatcaaacagagggccgacagcaaagagagtctgaaggcgacaacgaagacagccgtgtctaaactcgctaagagagaggaagtcgtcgaagagggggcaaaagaagcccgctccgagctggcaaaggagttagccaaaactgagaagaaagctaaggagtctagtgaaaagccaccggaaaaacccgccaagcctgagagggtaaaaacagaaagcagcgaggcgctgaaggcagaaaagcgaaaactgattaaggataaagtggggaaaaagcacctcaaagaaaaaattagcaaattagaggagaaaaaagacaaggaaaaaaaggaaatcaaaaaggaaagaaaagagctgaagaaggacgagggtcgtaaggaggagaagaaagatgcgaaaaaggaggagaagcgtaaggacactaagccagaactgaaaaaaattagtaagcccgacctgaagccttttaccccggaagtcaggaagacactttataaggctaaagtaccaggaagagtgaaaatcgatcggtcccgtgccatcagaggtgaaaaggaattgtcttccgagccccagacccctccggcccaaaagggtaccgtgccactcccgaccatttctggccatcgggagttggtactttcatcacctgaagacttgacacaggattttgaggaaatgaagagggaggaacgcgccttgctggccgagcagagggataccggcctcggtgataaacccttcccattggataccgccgaagagggtcccccttccaccgcgatccaggggacaccaccctccgtgcccggactaggccaggaggagcatgttatgaaagagaaggaactcgtgccagaagtgcctgaggaacagggatcaaaggacaggggtctggacagcggagccgagacagaggagaaaaaaaagaagaaaaagaagaagaagtag

SEQ ID NO: 195155 - DNA, 1680 bp, Artificial Sequence
  Description of Artificial Sequence: Synthetic coding sequence
atggccgacgagcggaaggacgaggccaaggccccccactggaccagcgcacctttaactgaggcatccgcacatagccatccaccagagatcaaagatcaaggcggcgctggcgagggtctcgtgcgtagcgcgaatggatttccctaccgggaggacgaggagggagcttttggagaacacggcagccagggtacttattctaacaccaaggagaatgggatcaacggggagttgacgtcagctgacagggagactgcagaggaggtgagcgcccgaatcgttcaggtggtcacagccgaggccgtggccgtgttaaagggggagcaggagaaagaggcccaacataaggatcagaccgcggccctgcctctcgctgcagaagagaccgcgaatctgcctccttctccgcccccttcccctgcatctgaacagactgtcaccgtggaggaggccgcaggaggagaatcagctttagctccctcagtatttaagcaggccaaagataaggtatccaattcaacactctcaaagattcccgccctacaggggagtactaaatcgcctcgatactcttccgcgtgcccaagtactacgaagagggccaccttcagcgatagcttattgatccagccgacgagtgcaggcagcactgaccggctcccatacagtaagtcaggaaataaggacggtgtgaccaaaagcccagagaagcgttcctcgctcccccgcccaagtagcattctgcccccccggcggggagtgtctggcgaccgcgatgagaattcctttagcctcaattcctccatttctagttctgctcgtcgcactactaggtccgagccaatccgaagggcagggaaatctggcacatcgaccccaacaactccaggatctaccgcgattactcccgggacgccaccctcatattccagccgaacaccggggactcccggaaccccctcttaccctcgcaccccacacacacccgggaccccgaaaagtgccatactcgtgcccagcgaaaagaaggtggccattatccggactccccctaagtctcccgctactcctaagcagctgaggctgatcaaccaaccattgcctgacctgaagaacgtgaaatctaagatcggatctaccgacaacatcaaataccaacctaagggcgggcaggtgcgaatcctgaacaagaaaattgatttcagcaaagtccagtctagatgcggatcaaaagacaacatcaagcacagtgcaggggggggtaatgttcagatcgtgacgaaaaagatagatctgtctcacgtcactagtaaatgcggtagcctgaagaacatacggcaccggccaggcggcggcagggtcaaaatcgagagtgtgaagctcgacttcaaagaaaaggctcaagcaaaggttggatccctcgataatgctcaccatgtgcccggcgggggtaatgttaagatagacagccagaagcttaactttagggagcatgccaaggctcgagttgaccacggcgcggaaattatcactcagagtccgggacgttcttccgtcgcaagtccgcggcggctcagcaacgtctccagtagtgggtcgataaatctcttagaaagcccccagctcgcgaccctcgctgaggacgtgactgcggctctggctaaacaaggtctgtag

SEQ ID NO: 195156 - DNA, 5484 bp, Artificial Sequence
  Description of Artificial Sequence: Synthetic coding sequence
atggccgacgagcggaaggacgaggccaaggccccccactggacctccgctcctttaaccgaggcttctgctcatagccatcctcccgaaattaaggaccagggaggtgctggtgaggggctggtcagaagtgcaaacggcttcccctatagggaagacgaggagggtgcatttggggaacatggctcccagggcacctattccaacactaaagagaatgggatcaatggtgagctgacaagcgcagatcgagaaaccgcagaagaggtctccgctcgcattgttcaggttgtgacagcggaagcagtggctgtactcaagggggaacaggaaaaagaagcacagcataaggaccaaaccgctgccttaccgctggcagcagaggagactgcgaacctgcccccaagcccacccccctcccccgctagcgaacagacggtgaccgttgaggaagatctgctcacggccagcaagatggaattccatgaccagcaagaacttaccccaagcacagcagaacccagcgatcaaaaggaaaaagagtcggagaaacagtccaagcccggagaagacctgaaacatgctgctttggtctcgcaaccagagacaaccaagacatatccggataaaaaggacatgcaggggactgaggaggaaaaggcccctctggccttattcgggcacaccctggtggcctccttggaggatatgaagcagaaaactgaaccgtccttggtggtgccaggaatcgatctccccaaggaaccccctactcctaaagaacagaaagactggttcatagaaatgcctacagaggctaaaaaggacgagtggggcctcgtggcccccatctctcctgggccgttaacccccatgcgggagaaagacgtgtttgatgatatccctaagtgggagggtaagcaatttgactccccgatgccatctccttttcaaggggggagctttaccctacccctggatgtcatgaagaatgaaatcgttacagaaacttctccctttgctccggcgtttctacaaccagacgataaaaaatctctacagcagacttcaggcccagcaacggctaaggactcctttaagatagaagagccccatgaggccaagccggacaaaatggcggaggcgccaccatctgaggctatgaccctccctaaagacgcacacattcccgtcgtggaggagcacgtgatgggtaaggtgctcgaagaagagaaagaggcgatcaaccaggagaccgtgcagcagagagatacctttactccaagcggacaagaacccattctcaccgagaaagaaaccgaattgaaacttgaagaaaaaaccaccatcagcgataaggaggcagtacccaaagaaagcaagcctcctaagcctgcggatgaggagattggcattattcagacttcaactgagcacacgttctccgagcagaaagatcaagagccaactaccgacatgcttaaacaagatagctttcccgtctctttggaacaggcggtgacagattcagccatgacaagcaagacgctcgagaaggctatgaccgagccatcagctctcattgagaagagttcgatacaagagctgttcgagatgagggtggacgacaaggataagattgaaggggtgggggcagctaccagcgcggagctggatatgcccttctatgaggataaatccggaatgtcaaaatatttcgagacctccgctttgaaagaggaagcgaccaagtcaatcgaaccagggtccgattattacgagctttctgatactcgcgagagtgtccatgaatcaatagacacaatgtcacccatgcacaaaaatggggacaaggagtttcagaccggcaaggaatcgcagccatcaccccctgcacaggaggccgggtattctaccctcgcccagtcatatccttccgatctaccagaggagccgtcttccccccaggagcgcatgttcaccattgaccccaaagtgtacggcgaaaaacgtgatcttcattccaagaacaaagatgacctgactctctcacggtcccttgggctcggagggagatctgccattgagcagagatccatgagcatcaacctgcccatgtcatgtttggactccatcgcgctgggcttcaactttggacgtggacacgatttgtctccgttagcctcggacatcctcactaacaccagcggtagcatggacgagggcgatgactacctgcctgccacaaccccagccctcgagaaagcgccatgctttcctgtggagtccaaagaggaagagcagatcgagaaagtcaaagctacgggagaggagtccactcaagcagaaataagctgcgagtccccttttctggccaaggatttctacaagaacggcacagtcatggcccccgacctgccagagatgctagatttggctggcacacggagtaggcttgcttcagtttccgccgacgcagaggtggcaagacggaagtctgtcccatctgagacagttgtggaagattctagaacaggtctgcccccagtgaccgatgagaatcacgtcattgtgaaaaccgatagccagttagaggacttaggctattgtgtatttaacaaatatacggtccctctgcctagtcccgtccaggattccgaaaacctgagcggcgagtccggaacattctatgaaggcaccgacgataaggtgcggcgcgatctggccacagatctgagtcttattgaagtaaaactagccgctgccggccgggtaaaggatgaattcagcgtggataaagaggcatccgcacacatcagtggcgacaaaagcggactctctaaggagttcgatcaagaaaagaaggccaacgatcgactggataccgttttagaaaagagcgaggagcatgctgacagtaaggaacatgcaaagaaaacggaagaagccggtgatgaaattgaaacttttggcctgggtgtgacctatgaacaggccctcgctaaggatctgtccatccctactgacgccagcagcgagaaggcagagaaggggctgagcagcgtacccgaaattgccgaggttgagccttcaaagaaggtagagcagggtctggattttgccgtgcagggacagctggatgtcaaaatttcagacttcggccagatggccagcggcctgaatatcgacgaccggcgggcgactgagttgaagctggaggctacacaggatatgaccccatcgagtaaggcacctcaagaagctgacgctttcatgggcgtcgagtcaggacacatgaaagagggtacgaaggtgagcgagaccgaagtaaaagagaaagtcgcgaaacccgacttggtacaccaggaagctgtggataaagaagagagctatgagtcttctggtgaacatgagagtcttacaatggagtcactgaaggccgacgaaggtaagaaggagacatctcctgaatctagcttaattcaggatgaaatcgccgtgaagctatcagtcgaaatcccttgtccccctgccgtgagcgaagccgacctggctacggacgagcgagccgacgttcagatggagttcatacaggggccgaaagaggagtcaaaagaaaccccagacatcagtattactccaagcgacgtggccgagcccctgcacgaaacaatagtgagcgagcctgccgagatccagtccgaagaagaggaaatcgaggctcagggggagtacgataagttgctgttccggagcgacactctgcaaataacggatctaggggtatctggtgcaagggaagagtttgtcgaaacgtgcccaagcgagcataaaggcgtaatagaatccgtggtcacaatcgaggacgactttatcacagtggtccaaacgaccaccgacgaaggggagtctgggtcccacagtgtacggtttgccgccctggagcagccggaagtggaaaggcggccaagcccacacgatgaagaggagtttgaggtcgaagaggctgcagaagctcaggctgagccaaaggatggatccccagaggcaccagcatctccagagagggaggaagtcgcgctttccgagtacaaaaccgaaacgtacgacgattataaagacgaaacaacgatcgatgactccatcatggacgccgactcactttgggtcgacacccaggatgacgatcgctcaatcatgacggagcagctagagactatccccaaagaagaaaaagccgagaaagaggccagacgatcaagtctcgagaaacacaggaaggagaaaccattcaagactggtaggggcaggattagcacaccagagagaaaggtcgctaagaaggaaccaagtaccgtttctcgcgacgaagtcaggcggaaaaaagcggtgtacaagaaagcagagctagccaaaaagaccgaagtgcaagcccactcccctagtaggaagtttatattgaaaccagccatcaagtacacccgacctacccatctgtcatgcgtgaaacggaagacaacagccgctggaggagaatctgccttggctccttccgtgtttaagcaggcaaaggacaaggtaagcgatggagtgaccaagagccccgagaagagatccagtctcccccggccttcaagtatcctgcctccgcgccgtggtgtgtctggagatcgggacgaaaattcttttagtctgaactcttcaatcagctcctcagcccggcgtacaacaagatccgaacccattagacgtgcaggtaagtctggaaccagcacacccactacacctggctcaacggcgatcactcccggcacgccaccatcctatagctcgcgaacaccgggcaccccgggaacaccaagttatccacgcaccccacacacacccggcacacctaagtctgctatccttgttccgtctgaaaagaaagtcgccatcattagaactccacccaagtcacccgctacgccaaagcagctacggctcatcaatcaacctctgcctgatctgaagaacgtgaagagcaaaatcgggtctactgacaatatcaaatatcagcccaaaggcggacaagtgcaaattgtgacaaagaaaatcgacctgagccatgtgacttccaaatgcgggagcctcaagaatatacgccacagacctgggggcggtcgcgtgaagatcgagtccgtgaagttagactttaaagagaaagcccaggcgaaggtgggcagcctcgataacgcccaccatgttccgggaggtgggaacgtgaaaattgactcccagaaactgaactttagggagcacgcaaaggcacgcgtggatcacggcgccgagatcataacccaaagccctgggcgctccagcgtggcgagtccccgccggctttccaacgtttcatcctcggggagtatcaacctgctggagagcccacagctcgctacactggccgaggacgtgacagcagccctcgccaaacagggactgtag

SEQ ID NO: 195157 - DNA, 1416 bp, Artificial Sequence
  Description of Artificial Sequence: Synthetic coding sequence
atggccgacgagcggaaggacgaggccaaggccccccactggaccagcgcgccattgaccgaggcatcagcccactcacatcctcctgaaattaaagaccagggcggggccggcgagggtttggtccggtcggcgaacggattcccttatcgggaggacgaagaaggtgcttttggagaacacggaagtcaggggacatatagcaacaccaaggagaatggaataaacggtgagttgacatcagccgatcgtgaaacggcagaggaggtgtccgcccgcattgtccaagtggtgacggccgaagccgtcgccgtgttaaaaggcgaacaagaaaaggaagcacaacataaagaccaaacagccgcactgccactggcagcggaagagacggcaaacctccccccatctcccccaccctctccagccagtgaacagactgtgaccgtcgaagaggcagctgggggggaaagcgccctggccccttcggtgttcaagcaagcaaaagacaaggtatccgatggagtaacaaagtcccctgagaagcggagctccctgccaaggccgtcttccattctccccccacgacgcggtgtgtccggggacagggatgaaaactcattcagcctaaatagctctatatcttcaagcgctcggagaaccacccggtccgagcccatcagaagagccggcaagtctggcacaagtacaccaactacccctgggagtacggccattacaccagggactcctcccagctacagctccaggaccccgggtacgccaggtacaccctcttatccacgcacgccacacacccccggaacgccgaaatccgctattttagtaccctctgaaaagaaagtggccattatcaggacaccacccaagtcgcctgccacacctaagcagctacggctgataaatcagccattacccgacttgaaaaacgtcaagagcaaaattgggagtaccgacaacataaagtaccaacctaaagggggacaagtacagatagtgacaaaaaaaatcgacctgagccacgtgacatcaaagtgcggttccctaaagaacatccggcatcgtccaggaggaggcagggtgaaaattgaatcagtgaaactcgattttaaggagaaggcgcaggctaaagtaggatccctggacaatgcgcatcacgtgcccggaggaggaaacgtgaagatagattctcagaaattgaacttccgcgaacacgctaaggcgagagtggatcacggggcggagatcattacacagagtccagggaggtcttcagtcgcgtcaccaagacgcctttctaacgtgagctcatccggtagtattaacctgctcgagtctcctcagctagcgactctagctgaggacgtgacagcagcactggccaagcagggactttag

SEQ ID NO: 195158 - DNA, 321 bp, Artificial Sequence
  Description of Artificial Sequence: Synthetic coding sequence
atggccgacgagcggaaggacgaggccaaggccccccactggacctccgctcccctgacagaggcctcagcacactcccacccccctgaaatcaaggaccaaggtggagcgggagaggggctggttagatccgccaatgggttcccctacagggaggatgaagaaggcgcttttggtgaacacggctctcaaggtacctatagcaacaccaaggagaatggcatcaatggcgagctgacatccgctgaccgcgagactgccgaggaagtgtcagccagaatagtccaagtcgtcacggctgaggccgttgcagtgctgtag

SEQ ID NO: 195159 - DNA, 1416 bp, Artificial Sequence
  Description of Artificial Sequence: Synthetic coding sequence
atggccgacgagcggaaggacgaggccaaggccccccactggacctcagcgcccctgactgaagccagcgcgcactcccacccacccgagataaaggaccagggaggcgcaggtgagggcctcgtccgctccgccaatggttttccctatagagaagacgaagaaggcgcgtttggagagcatggcagccagggcacttactctaataccaaagaaaacggcatcaatggtgagctgacctccgccgatagggaaactgcggaagaagtctctgcccgaatagtgcaggtggttaccgccgaggctgtcgcagtcctgaagggagaacaagaaaaggaagcccaacacaaggatcagactgctgccctgccactggcagctgaagaaaccgctaatctgcccccttccccaccaccgtctcccgcttctgagcaaacagtaaccgtggaggaagccgcaggtggggagtccgcattggcccccagcgttttcaagcaggcgaaagacaaagtatctgatggggtgaccaaaagtccagagaagcgtagtagcctgccgaggccaagcagtatattacctcctagacgcggggtgtccggagatcgagacgaaaacagcttttctttaaactccagtattagcagctccgcaaggcgcaccaccagatcagaaccgattagacgggctggtaaatctggcacgagcactccaacgacacccggatctaccgcgataacccctggcactccaccctcctactcatcgcggacccctggaactcctggaactcccagttacccacgtacgccccataccccgggtactcctaaaagcgctattttggtgcccagcgagaaaaaggtggccattattaggaccccacctaaatctcctgccacacctaagcagcttcggctcattaatcagccgttgcccgatctgaagaacgtgaagtctaagatcggcagtacggacaacattaagtaccagcctaaaggcgggcaggttcagattgtcactaagaagatagacttgtcacacgtgacttcgaaatgtggctccttgaaaaacatcagacaccgacccggcgggggccgggtgaaaattgaatctgttaaacttgattttaaggaaaaggctcaggccaaggtggggtccctcgataatgcccaccatgtgccaggcggcggaaatgtaaagattgatagccagaaactcaatttccgggagcacgcaaaagcgcgcgtggaccatggggctgaaatcatcacgcagtcgccaggtaggtccagtgtggcctcccctcgccgactctcaaacgtgtcatcttctggttccatcaaccttctagagtctccgcaactcgccactctggcggaggacgttaccgcagccttggccaagcagggcttgtag

SEQ ID NO: 195160 - DNA, 5472 bp, Artificial Sequence
  Description of Artificial Sequence: Synthetic coding sequence
atggccgacgagcggaaggacgaggccaaggccccccactggacctcagcccccctaaccgaggcttcagcccactcccatccacctgaaatcaaggaccaaggcggagccggcgagggcctcgtgcgtagtgccaacggattcccttacagggaggacgaagagggcgcttttggcgaacatggaagtcagggcacctactccaacaccaaagaaaacgggatcaatggcgagctcacgtcggcggatcgggaaactgcagaggaggtctcagcacgaattgttcaggtggtcactgctgaggccgtggcagttttgaagggtgagcaggagaaggaggcacaacataaggaccagacagccgcccttcccctcgcggccgaggagacagctaatctgcccccaagcccaccacctagccctgccagcgaacaaacagtgaccgtagaggaagccagtaagatggaattccatgatcaacaggagctgacccccagcaccgccgagccatcagaccagaaggagaaggagtctgagaaacagtccaagcctggagaggatttgaagcatgccgcactggtcagccagcccgaaactacaaaaacctaccccgacaaaaaggatatgcaaggaacagaagaagaaaaggcgcctttagcactcttcggtcatacgctcgtcgcctctcttgaggatatgaagcagaaaactgaaccttcactcgtggtcccgggcattgacctcccaaaagaaccaccaacccctaaggagcaaaaagattggttcatcgaaatgccaacagaggctaagaaagatgagtgggggttagtcgcccctataagtcctggccccctgacaccaatgagggagaaggatgtatttgatgatattcctaagtgggaggggaaacagtttgactcgcctatgccctccccgttccagggcggctccttcaccctgcccctagacgtgatgaagaacgagatcgtcactgaaacgagcccatttgctccggcattcctgcagcccgatgataagaaatccttgcagcaaacctcagggcctgccaccgccaaggactctttcaagatcgaagaaccgcatgaagctaagcctgacaagatggccgaagccccaccatctgaggccatgactctccccaaagacgcgcacatccccgtggtggaggaacatgtgatgggtaaagtgttggaagaggagaaagaagccattaaccaggaaacagttcagcagcgagatacatttactcctagtgggcaggagcccatactcacagagaaggagacggaacttaagcttgaggagaaaacgaccataagcgacaaggaggctgtccccaaagagagcaaaccgcccaagccagctgacgaagagatagggatcattcaaacttctaccgaacacactttcagcgaacagaaagaccaggagcctactactgacatgctcaagcaggactcctttcctgtcagtctcgaacaggccgtgacggattccgccatgacttcaaaaactctggagaaggccatgaccgagccctcggctctgatcgaaaaatcatcaattcaagagctgtttgagatgagagttgatgacaaggacaagattgaaggcgtcggtgccgccacttctgctgaattagacatgcctttttacgaagataagtctggcatgtccaaatacttcgagacttcagctcttaaagaagaggccactaagtccattgaaccggggtctgactattatgagctgtctgacaccagggaaagcgttcacgaatctatcgacacgatgtcacctatgcacaaaaacggggataaggaattccagaccggcaaagagagccaacctagtcctcccgcacaggaagcaggatattctactctcgcacagagttatccaagtgatctgcctgaagagcccagcagtccccaggaacgcatgttcacaatcgacccgaaggtgtacggcgaaaagcgcgatctccactcgaaaaataaggacgacctgactctaagcaggtctctggggttaggaggcaggagcgctatcgagcaacgatcaatgtctatcaacctgcccatgtcctgcctggattcgattgcacttggctttaactttggacgaggacatgacctcagtcctctggcgagcgacattctgactaacacctctgggtcgatggatgagggagacgattacctgccagctactacccctgccctggaaaaggcaccgtgcttcccagtggagtccaaagaagaagagcagatcgagaaggtgaaggctaccggtgaggaatccacgcaggcagaaattagctgtgaatcaccttttctggcgaaagacttttataagaacggcaccgttatggcgcctgacctgccagaaatgctggacctcgcgggcactcgttcgaggctggcgtcggtttctgccgatgccgaggtcgcacgccggaaatccgttccaagtgaaactgttgttgaggatagtcgcacagggctgccccccgtgaccgatgagaatcatgtaatcgttaaaaccgatagccagctggaagacctcgggtattgcgtgtttaacaaatacacagtaccactgcccagccctgtgcaagatagtgaaaacctttctggcgagtcaggcacattttacgaggggaccgacgacaaagtaagacgggatctggccactgacctgagtctgatcgaggttaagctggccgcagcagggcgagtgaaggacgaattcagcgtggacaaggaagcgagcgcccacatctctggagataagtccggattgagcaaagagtttgaccaagaaaagaaagcgaacgacaggctggatacagttttagaaaagagcgaggaacacgccgattccaaagagcatgccaagaagacagaggaagctggggatgagatcgagaccttcgggctcggcgtgacatatgaacaggcgttagcaaaggatcttagcattccaactgatgcgtcttcggagaaagccgagaaaggactgtctagtgttcccgaaattgccgaagtggaacctagtaagaaggtggagcaaggcttggacttcgccgtgcagggccagctggatgtgaaaatttccgatttcgggcaaatggcctcaggattaaatatcgacgataggagagcgaccgaactcaagttggaagccactcaggacatgacgcccagctccaaggccccacaggaggcagacgcgtttatgggagtggaatcgggtcacatgaaggagggcaccaaggtttcggaaactgaggtgaaggagaaagtagccaaacccgacctggtgcatcaagaagccgttgataaagaggagtcctacgaaagctctggcgagcacgaatccttgactatggaaagtctgaaggccgacgaagggaaaaaagagacctcccccgagagctctctgatccaggatgaaatcgctgtgaaactatcagtcgaaatcccttgtcccccggcagtctccgaagcagatttggcaacagacgaaagagccgacgttcagatggagtttattcagggtcccaaggaagaatctaaagaaacacccgatatcagcatcactccctcagacgtggctgagcctctccatgagacaattgtgtcagaacctgccgagatacagtccgaggaggaggaaattgaagctcagggggaatacgacaagctgctgtttcggtccgacacactgcagatcacagatttgggtgtgagcggagccagggaagaattcgtggaaacctgtccatccgaacataagggtgttattgaatcagtggtgaccattgaggacgactttatcaccgtagtccagacaacaaccgatgaaggagagtccggatcccattctgttcgtttcgcagccctggagcagcccgaggtagaacgcagaccttccccccacgacgaggaagagttcgaggtggaagaagcggcggaggcccaggcggagccgaaggatggttcacccgaggcaccagctagtcccgagcgtgaagaggtagcccttagcgagtacaagaccgaaacatacgatgactataaagacgaaaccacaattgatgatagcattatggacgcagactccctgtgggtcgacacacaggatgatgaccggtcaattatgacagaacagctagaaaccataccaaaggaagagaaagccgagaaggaggctaggcggtccagtctggagaagcaccgcaaagaaaagcctttcaaaacaggtagaggacgtatcagcaccccagagcgaaaagtggctaagaaagagccctctactgtgagccgggatgaggtccgacgaaaaaaggccgtgtataagaaggctgagctggctaagaagaccgaagttcaggcccactctccatcccgtaaatttattcttaagcctgcaattaagtacacacggcccacccatctgagttgcgtgaagcgcaagaccaccgccgccggcggtgagtcagcactggcaccttccgtgttcaagcaggcaaaagataaagtttccgacggcgtgaccaagagcccagaaaagcgaagtagcctgccacgcccctcctctatcctcccacctagaaggggcgttagcggggatagagacgaaaactccttcagcttgaatagtagtatttctagctccgctcgccgcacaacgcgctctgaaccaatacgacgagctggcaaatctggcactagcactccgaccactccgggaagcactgcaattaccccaggcacgcccccgtcttattcaagccgaacccctggcacccctggcacacccagttatcctcggacgccgcacacccctggcacaccaaaaagcgccatcctcgttccatcagaaaagaaagtcgcaatcatccgtacccctcctaagagccctgccacaccaaagcagctgagactcataaatcaacctctgcctgacctgaagaatgtgaagtctaagatcggctctactgacaacatcaaataccagccaaagggcggccaggttcagattgttacgaagaagatagacctgtcccatgtcacttcaaaatgcggaagtctgaagaatattcgccacaggcccggaggcggacgggtcaagattgagtctgtaaaactcgacttcaaggagaaagcacaagcaaaggttggcagcctggataacgctcatcacgtgccgggaggcggaaatgtgaaaattgattctcagaaattgaatttcagagaacacgcgaaggctcgcgtggatcacggagcggagatcatcacccagtcgcctggaagaagcagcgtggctagcccacgacgcctgagcaatgtttccagctccggatctattaacttgcttgagagtcctcagttagccacgctggcagaggatgtgaccgccgcactggctaagcagggactgtag

SEQ ID NO: 195161 - DNA, 2664 bp, Artificial Sequence
  Description of Artificial Sequence: Synthetic coding sequence
atggagaccaccggcgaccagggcatcgagggcatggcctacatggatgagaaccgtaacatcacattcacctgtccccgcaccccatctgagcttattaataaaagttcaccccttgaagttttagaatctgctgcttgtgaaaaactgccaacaccgacaccacaggtggtgaaagagggcgattcattcccagacaccctggcgaaaaacgggcaggaaattgcacccgctcaaatttccaaaagtctcatggtcgataactatacgaaagacggggtaccagggcaagagcgtccaaaaggccccagtgcagtggtgcctagcacttcaactggtggagtggccctcccaattacaaccgccattgagactgtcaacattcatggggaccattcactgaaaaataaggctgagcttgcagatagcatgaaaaacgaagccggaatagacgagggccatgtgatcggcgagtctgagagtgtacactccggagccagcaagcacagtgtggagaaggtgacagagttagctaagggacaccttttgcccggtgtgcctgtggaagatcaatccttgcccggcgaagcccgcgcactcgaggggtacgccgacagggggaactttcccgctcaccccgttaacgaagagaaggagaccaaggaaggatctgtggcagtgcaaatacctgatttgttagaggacaaagcccagaaactctcgttttgcgaagatcagaatgcacaagatcgcaacagtaaagggtcagacagtttgaacaaaaaggttgatctcaccttgttgtcaccaaagagtgagaatgataagctgaaagagatctccctggcttgcaaaatcacagaattggagagcgtcagcttgccgacccctgagatacaaagcgatttcctccactctaaggtggaagccccgccgtcagaggttgcagacacccttgtgatcatgacagccagcaagggcgtacgattgcccgaaccaaaggacaaaattcttgagaccccacaaaaaatgacagaaaaatcggaaagcaaaacccccggcgaggggaaaaaagaggacaagtcacgaatggctgaacctatgaagggctacatgcggcctaccaagagcagggggctgaccccgctgctcccaaagagcactatccaggaacaagagcgccataagcaactgaagtctgctggcattgcacgccccgaggagggccgccctgttgtgtctggaacagggaatgacataacaacgcctcctaacaaggaactgccccccagtcctgagaaaaaaactaagcccctggctacaacccagccggctaaaacatccacaagtaaggctaaaactcagcctacatctcttccgaaacagcccgctccaactactataggcggactcaataaaaagccaatgtcactggcctcaggtcttgtacccgcggcccctcccaagcgccctgcggttgccagcgcacgaccatcaattctgccttctaaagacgtcaagcctaagcctattgcagatgccaaagcacccgagaaacgcgccagcccatcaaaacctgcaagtgcacccgccagcaggagcggctcaaagagcacccaaaccgtggcaaaaactactactgcagccgctgtggcaagcacggggccctcatcgcggtccccctctactctgctgcctaagaaaccgaccgctatcaaaaccgaaggcaaaccagccgaggtgaagaagatgactgcaaaaagcgtgcctgctgatctgagtcgacctaaaagtactagtacatcttccatgaagaagaccaccaccctctccggaacagcacccgctgccggtgttgtgccaagccgagtcaaggcgactcccatgccctcacgcccgtcgaccaccccttttatcgataagaagccaacctctgcaaagcccagctccaccactccacgcctctcccgattggcaaccaacaccagtgcaccagaccttaagaacgtgaggagtaaggttgggagcactgagaatatcaagcaccaacccggcggcggaagagctaaggtcgagaaaaagaccgaggccgctgctacgacccgcaaacccgaaagcaacgccgtgaccaagaccgccggacctatcgccagcgctcaaaagcagcccgccggcaaagttcagatagtatccaaaaaagtgagttattcacacatacaatcaaagtgtggaagcaaagataatataaaacacgtgccaggcggtggtaacgtgcagatccagaataaaaaagtagacatctccaaggtcagctcaaagtgcggttctaaagccaacattaagcacaagcctggcggcggggacgtgaaaattgagagccagaaacttaattttaaagagaaggcccaggccaaagtgggatccctggataatgtaggccatttgcctgctggaggcgccgtgaagaccgaaggcggaggatccgaggctccgttgtgcccaggtcccccagccggcgaggagcccgcaatcagcgaagccgctcccgaagcaggggcccccacaagcgccagcggtttgaatggtcacccgaccctaagcggaggcggggaccaacgagaagcccagacattggacagccaaatacaagaaaccagcatttag

SEQ ID NO: 195162 - DNA, 1392 bp, Artificial Sequence
  Description of Artificial Sequence: Synthetic coding sequence
atctgcgaggagcccgtggccaagaagcgggaggagctggcccacttctctaattccagttctaattcaggaaaaaaagagctgggaactgcaggattatacctccacagcaagctcgagcagatcccggaggggtcctccaaggagaagggccaggaagactttagtgagaccaggattgattcttgtagccaagtatgccagcgcggagaaaaacagcccggtcagaccgctctggctggtaagaaagagatagaggtcaccgcaactcagagcactccctccttcctgttcgagaagccacctagggatggcatcgcgcggcctgaggaaggccggcccgtggtgagcgggacagggaatgatattaccacccctccaaataaagagctgccaccaagcccagagaagaaaaccaagcctattgccgacgccaaggcccctgagaaaagggctagccctagcaaaccagcctccgcaccagcctcgagaagcggatccaagtccacccagactgtcgcgaagactactactgccgcggcagtagctagcacgggacctagttcccgatccccttctaccctgcttccaaaaaagcccacggcaataaagacagagggcaagcctgccgaagtgaaaaaaatgacggcaaaatccgttccagccgatctttccagacctaaatcaacgagcacatctagtatgaagaagactacaacactctctggcacagctcccgcagccggggttgtccccagcagggtcaaggcaacgccgatgccaagccggccatctactacacctttcattgataaaaagccgactagcgccaaaccgtcctcaactaccccaagactgtcacggttagccactaacacttccgcgccggacctcaagaatgtcaggtccaaggtggggagtaccgaaaatataaagcatcagcccggaggtggtcgtgttcagatcgtctcaaaaaaggtgtcatactcacacatccagtcaaaatgtgggtccaaggacaacataaaacatgttccgggaggcggcaacgtacagatccagaacaaaaaagtggacatcagcaaggtgtcttcgaagtgcggcagtaaggcaaacatcaaacacaaacctggggggggtgacgttaagatcgagagccagaagctcaacttcaaggagaaagcccaggctaaagtcggatcccttgacaacgttggccacctgccggcgggtggtgctgtgaaaatagagacatatcgattgacgttccgcgcgaacgcgagagccaggacggaccacggagcggatatcgtaagcaggcctcctcacttcccaggaggcccaaactcaggctctagagtactcggccctttgtcaagggctgttcactag

SEQ ID NO: 195163 - DNA, 3459 bp, Artificial Sequence
  Description of Artificial Sequence: Synthetic coding sequence
atggccgacctgagcctggccgacgccctgaccgagcccagccccgacatagagggtgagatcaagagagacttcatcgccacccttgaagctgaagctttcgacgatgttgtgggcgaaaccgtgggcaagaccgactatatcccactcctggacgtggatgagaagaccgggaacagcgagtccaagaagaagccatgttctgaaacatcccaaatcgaagatacgccatcatcaaagcctaccttactcgcaaacgggggacatggcgtggagggatcggacacaaccgggtcacccacagaatttttagaggagaagatggcttatcaagaataccccaactcacagaactggcccgaggatacaaacttctgctttcagccggagcaggtcgtggacccaatacagacggatcccttcaaaatgtaccacgacgatgatcttgccgatctcgtgttccctagcagcgcaacagctgatacatccatttttgctggccagaacgatcccctgaaagattcatatggtatgagtccctgtaacaccgcagtggtcccacagggttggtcagtggaagccctcaattcaccccatagcgagtcatttgtgagccctgaggctgtggccgagcccccccagcccaccgctgtcccactagagctcgccaaggaaatagagatggcgtccgaggagaggcctcccgcccaggcgttagagatcatgatggggctgaagactaccgacatggccccttccaaagagacagagatggccctagccaaagatatggcactcgcaactaagaccgaggtggctctggccaaagatatggagtcgcccaccaaattggatgtgacactcgctaaagacatgcagccttctatggagagtgacatggctttggtcaaggatatggagcttcctaccgagaaggaggtggctctcgtgaaggacgttcgctggcccaccgagacagatgtctccagcgccaaaaacgtggtcctcccgactgagaccgaggttgcgccagccaaggatgttacgcttctaaaggaaaccgaaagggcctcccccataaagatggacctggccccgtctaaggacatggggccccccaaggaaaacaaaaaagagaccgagagagcatcacctataaagatggatttggcaccgtccaaggacatgggcccaccgaaggagaacaagattgtgcctgctaaggacctggtgcttcttagcgagattgaggtggcccaagccaacgatataatttcttcgacagaaatctctagcgctgaaaaggtggctttaagttccgaaaccgaggtggccttagcccgcgatatgacgctccccccagagacaaatgtcattcttaccaaggataaagcactgccattggaagctgaagtggctcccgtgaaggacatggcccagctgccggaaaccgaaatagcccctgcgaaggacgtggcccctagtacagtaaaagaagtcggcctgctgaaggatatgtcgcccctctctgaaaccgagatggcgttggggaaggatgtcactcctccccctgagacagaggtggtgctcattaaaaacgtgtgccttccacctgaaatggaagtcgcccttaccgaagaccaggtgcctgccctaaagactgaagcacccttggctaaggacggggtgctgaccttagccaataacgtgaccccggccaaggatgttcctcctctgagcgagacggaggctactcccgtgcctatcaaagacatggagattgctcagactcagaaggggattagcgaggatagccacctcgagtccctgcaggacgtcgggcagtccgccgctcccacgttcatgatctcacctgagactgtgacaggcacaggcaagaaatgtagtctgcccgccgaagaggattcagtgcttgaaaaactgggagagaggaaaccctgtaactcccagccaagcgagctgagttcagaaacatctggcatagcccgtccggaggaaggacgccctgtcgtgtctggcaccggcaatgacatcaccacccccccaaataaagaactaccacccagccctgaaaagaaaacgaagcctctggcaaccacacagccggctaaaacctctacatccaaagctaaaactcagcccacctcccttccaaagcaacctgctcctaccaccatcggaggcctgaataagaagccgatgtcattagcctcaggcctggtccctgccgcccctcccaagcgcccagcggtggcgtcggctcgaccttcaattctgcccagtaaagacgtgaaacccaaaccgatcgcagacgcgaaagcccccgagaagagggcatcccccagcaagccagcatctgctcctgcctcacgctccggtagcaagtccactcagaccgtcgcgaagacaaccaccgctgctgcagtagcttccacggggccaagctcccggagtccatccaccctcctgcccaagaagccgacagctataaagacagaagggaaacctgctgaggttaaaaaaatgacagcaaaaagcgttccggctgatctgagcagaccaaagtccactagcacgtcctccatgaagaaaacaacaaccttaagcggtactgccccagcggccggggttgttccgagcagagtgaaagctacccctatgccttctcggcccagcactaccccattcattgataaaaagccaacgtctgcaaaaccaagcagcacaacacctaggctgtctcgattggcgactaatacaagcgccccagatctcaaaaatgtgaggtctaaagtcggttccacagaaaacattaagcaccagcctggcgggggaagggcaaaggtggagaagaaaactgaggcagccgccaccaccagaaagcccgaatctaacgctgtgaccaagacggctggtcctatcgccagtgctcagaagcagcctgcgggcaaagtacagattgtgtcaaagaaggtgtcttattctcatattcagagtaaatgcggctccaaggataacatcaagcatgttcccgggggcgggaatgtgcagatacaaaacaagaaggtggatatcagcaaggtgagctccaaatgcggaagtaaagctaacattaagcataaacctggagggggagatgtgaaaattgagagtcagaagttaaatttcaaggagaaggctcaggcaaaagttgggtcactcgataacgtcggtcatctacctgccggaggtgcagtcaagaccgagggaggggggtccgaagccccgctgtgtccagggcctccggctggggaggagcccgctattagtgaggccgcccccgaagccggagcccccacctccgcaagtggactaaacggccatccaacattgagtggaggcggcgatcaaagagaggcacagacgctagatagtcagatccaggaaacatccatttag

SEQ ID NO: 195164 - DNA, 2139 bp, Artificial Sequence
  Description of Artificial Sequence: Synthetic coding sequence
atggagaccaccggcgaccagggcatcgagggcatggcctacatggatgaaaaccggaacatcacgtttacatgtcctagaacccccagcgaacttattaataagtcatcccctctggaggtcctagagagcgcagcctgcgagaagctgcctactcccactccccaggtcgtcaaagaaggagattcctttcctgacacccttgccaaaaatggccaggaaatagctcccgcacagatcagcaaatcccttatggttgataattacacaaaagatggtgtcccaggccaggagagacccaaaggtccttctgcagtggttccatctacctccactggaggggtggccctgcccatcactactgcaatagagacagttaacattcacggcgaccactccctgaaaaataaggcggaacttgcagattcaatgaagaacgaagccggcattgatgaaggccacgtcatcggcgaatcggaaagcgttcattcaggcgccagtaagcactctgtggaaaaggtgaccgaattagcgaaaggtcacctgctcccgggcgttccagtggaggaccaatcacttcctggggaggcccgcgccctggaaggttacgctgacagagggaacttcccagctcaccccgtcaatgaggagaaggaaactaaggagggaagtgtagcggtgcagattcccgatctgctggaggacaaggcgcagaaactctccttctgcgaggatcagaacgcacaagatagaaacagcaagggatcagattccctgaacaaaaaggtggatctgacattactctccccgaaatctgaaaatgacaagctgaaagagatcagtttggcctgtaagatcactgaactggagtccgtctcactgccgaccccagaaattcaatcagatttcttacactccaaagtggaagcccctccttccgaggtcgcagatacccttgtgattatgactgcgagcaagggtgtgaggctgcctgaacccaaagataaaatattggagacgccacagaaaatgaccgaaaagtctgagtcaaaaacgccaggcgaaggaaagaaagaggacaaaagccggatggccgaacccatgaaaggatatatgcggcctaccaagagcagaggcctcacccccctgctgcccaaatcaacaattcaggaacaggagaggcacaaacaactgaaatcggcaggtattgctcggccagaagaaggcaggcctgtggtgagcggtactggcaacgatattaccactccacctaacaaagagcttccgccctctcccgaaaagaaaactaaacctctcgccaccacccagcccgctaagacctctacctccaaagctaaaacacagcccacctctcttcccaagcagcctgccccaacaacgattggcgggcttaataagaagccaatgtctctcgcctctgggctcgtgcctgcagctccccctaaacggccagctgtggcttcagctcgcccatctatattaccttcgaaggacgtcaaacctaagcccattgctgacgcaaaggcgccggaaaaaagggcaagcccttcaaaacctgcttcggcccctgcatcgagatctgggagcaaatcaacccagaccgtggcgaaaacgacaaccgctgccgccgtggcatcgaccggcccctcttcaagatccccttctacactgctcccaaagaagccaaccgccataaaaaccgaaggaaagccagcagaggtgaaaaaaatgaccgcaaagagtgttcctgctgacctcagtcgaccaaaatcaacaagtacaagctccatgaagaagactactaccctgtctgggaccgcccctgctgcaggagtcgtgccctcccgtgtgaaagcaaccccgatgccatctagaccttctactacaccattcattgataagaaaccgaccagcgctaagccgagcagtactacacccaggctctccaggctggctacaaacacctcagcgcctgatcttaaaaacgtgcggtctaaggccaaggtagaaaaaaagaccgaggccgccgctacgactcgcaaaccagagagtaatgctgtgaccaagaccgcaggccccatagcgtccgctcagaaacagccagctgggaaggtatag

SEQ ID NO: 195165 - DNA, 2436 bp, Artificial Sequence
  Description of Artificial Sequence: Synthetic coding sequence
atggccgacctgagcctggccgacgccctgaccgagcccagccccgatatcgagggtgagattaagcgtgattttatcgccactctggaagccgaggccttcgacgatgtggtcggggaaaccgtggggaaaaccgattacataccccttttggacgtcgacgagaagaccgggaattcagagtcaaagaaaaaaccctgcagcgagacctctcaaattgaggataccccctcgtctaaaccaacactcctcgccaatggcggccatggtgtcgagggctcagataccacagggagccctactgagttcttagaagagaaaatggcttaccaagaatatcccaattctcaaaattggcccgaagatactaacttttgctttcaaccagaacaggtagttgatcccatacagacagatccattcaaaatgtatcacgacgatgacttggcggacctggtgttcccttcgtccgctacagccgacacctccatctttgccggtcagaacgatcctctgaaagatagctacggtatgtcaccatgcaacaccgccgtagtcccacagggctggagcgttgaagcactcaactcgcctcatagtgaatcatttgttagtcctgaagctgtggccgagcccccgcagcccaccgctgtgcctctggagctggccaaggagattgaaatggcctctgaggagcggccacctgctcaggcactggaaattatgatgggcttaaagaccaccgacatggcccctagcaaggagacggagatggctctcgccaaggatatggcattggccaccaagaccgaagtggccttggcgaaggacatggaatctcccacaaagctcgacgtaaccctcgcaaaggatatgcagccttcaatggaaagtgacatggcacttgtgaaggacatggaactgccaactgagaaggaagtggctctggtgaaagatggcgtgcgccttccagagccaaaggacaagattctggagactcctcagaagatgaccgagaagtctgaaagcaagacacctggcgaaggcaaaaaagaggacaagtcccggatggctgagccaatgaaggggtacatgaggcccactaaatccagggggctcacccccttgctgcccaagagcactatccaggagcaggagagacacaagcagctgaagagtgccggaatcgctaggcccgaggagggcaggcctgttgtatctgggacaggcaatgatatcaccacaccccccaataaggagctgcctccaagtccagaaaagaaaacaaaaccactggctacaacccagccggcgaagacgtctacttcaaaggctaaaactcagcctaccagcctgccaaagcagcccgcgcctacaacaataggcgggttgaacaaaaagccgatgagtctagctagcggcttggtgccagcagcaccaccgaagaggcccgccgtggcgtcagccagacctagcatactccctagtaaggacgtaaaacccaagcccatcgctgatgccaaagctcctgagaaacgcgcctctccctctaagccggccagtgcgcccgccagcagatcggggagcaagagcacccagacagtggctaagactactacagccgccgccgtggcttccacaggaccctcatcaagatctccctccacgctgctgccaaaaaagcccaccgccataaagaccgagggaaagcccgcagaggttaaaaaaatgacagccaaatccgtccccgcggacctaagtcgccctaagtctaccagcacaagttccatgaaaaagacaaccacactttccggaacagctcccgccgcaggtgttgtcccgagccgggttaaagcgacgccgatgccatcacggccaagcacgacacccttcattgacaaaaagcccacaagcgccaaaccatcatccaccaccccaaggttgagtagactcgctaccaatacctccgcccccgatcttaagaacgtgcggtcaaaagtaggttcaactgaaaatattaagcaccaaccaggcggcggacgggtgcagatccaaaataaaaaggtcgatatttccaaggtgtcttcaaagtgcggaagtaaggctaacatcaaacacaagcccggaggcggggatgtcaagattgaatcccaaaagctgaattttaaggagaaggcacaggccaaggttggctcactcgacaacgtagggcaccttcccgccggcggggccgtcaagactgaaggcggtggctctgaggcgccgttgtgcccaggtcctccagcaggagaagaacccgccatatctgaggctgcacctgaggcaggcgccccgacctctgctagtggtcttaatggtcatcctaccttgtctggcggcggcgatcaacgggaagcccaaacattggactcacagattcaggagacgtccatttag

SEQ ID NO: 195166 - DNA, 3408 bp, Artificial Sequence
  Description of Artificial Sequence: Synthetic coding sequence
atggccgacctgagcctggccgacgccctgaccgagcccagccccgacattgagggcgagattaagcgcgactttatcgccaccctggaggccgaagcctttgacgacgtggtgggcgagacggttgggaagaccgattacatcccgttgctggatgtggacgagaagacgggaaattcggagtcgaaaaagaagccatgctcagaaacgtcacagattgaagacacgccgagtagcaaacccacgttattggccaacggcgggcacggtgtggagggcagcgacaccactgggagcccaactgaatttcttgaggagaagatggcttaccaggagtatcctaactcacagaattggccggaagataccaacttttgctttcagccggagcaagtggtggaccccattcagactgatcccttcaaaatgtaccatgatgacgatctcgcggacttggtcttcccttcctcagccactgctgacacgtccatcttcgctggacaaaatgacccactcaaagattcttacgggatgagcccatgtaacactgccgtcgtccctcagggttggtctgttgaggcgctaaattcaccccactccgagtcttttgtgtcccctgaagccgtcgccgagcctcctcaacccacagccgtgccccttgaactcgcgaaagagattgagatggcttctgaggagcgccccccagcacaggcactcgaaataatgatggggctgaagaccaccgacatggccccatccaaggaaaccgagatggctcttgccaaggacatggccctcgccacgaagaccgaggtggctctggcgaaagacatggaatcacccactaaactggatgtaacccttgctaaggacatgcagccctcaatggaatccgacatggccctggtcaaggatatggagctcccaaccgagaaggaagttgcactagtaaaggacgtacgatggcctaccgaaaccgacgtcagtagtgccaagaatgttgtgcttcccaccgaaacagaagtagcccctgccaaagacgtgactctgctgaaggagacagagcgggccagcccgattaagatggacctggccccatctaaagacatgggaccacctaaagagaataagaaagagacagaaagagcttctcccataaagatggatctggccccctccaaggacatgggtcctcccaaggagaacaaaatagtgcctgccaaggacctggtgctgctgtctgaaatcgaagttgcccaagctaatgatattatatcaagcactgagatctctagcgccgagaaggtggccctgagcagcgagaccgaagtggctctcgctagagatatgacactgccacccgagaccaacgttatcttaacgaaagacaaggctctgcccctggaagcggaggtcgcgcccgtgaaggacatggcccagttacccgagaccgaaatagcgccggctaaggatgtggctccatccaccgtgaaggaggtgggcctcctcaaagatatgtctcctctgtcagagaccgaaatggccctcgggaaggacgtgaccccacctcccgaaacggaagtcgtgcttatcaagaatgtgtgtctgccaccggaaatggaagtggcattgacagaagaccaggttccagccctgaagactgaagcccccctcgctaaggacggtgtcttgactctcgctaacaatgtcacacccgccaaggatgttccccctttatcggagactgaggctacccctgtcccaataaaggatatggaaattgctcagacacagaaagggatttctgaagacagtcacctggagagcctgcaggatgtcggccagtcggcagctccaacatttatgataagcccggaaacggtcaccggcactggcaaaaagtgttcgctacccgccgaggaggacagcgtgcttgagaaactgggcgaaaggaagccgtgtaacagccaaccgtccgagctgtcttcagaaacatccggcatcgctcgccccgaagaggggcgacccgtcgtcagtgggactgggaacgatatcactacacctcccaacaaagaattaccaccgagccctgagaaaaagactaaacctctcgccactacacagcccgctaagacttcgacaagcaaggcaaaaactcagcccacctctttgcctaagcagcctgcccccactacaatcggtgggctgaataagaaacctatgtctctggcttccgggttagtgcctgccgcccctccaaaaagacctgccgtggcatccgctcgtccatctatactcccatccaaggatgtgaaacctaagcccattgcagacgccaaggctcccgaaaaaagagccagccccagcaagcccgccagcgccccagcgtctaggagcggctcaaaaagcacacagaccgtggctaaaaccaccacagccgccgcggtggcctccaccgggccctcaagccgatccccttccaccctgttgcccaaaaaacccaccgccatcaaaacagagggtaagccagccgaggtgaaaaagatgacagccaagagcgtgccagccgaccttagccgcccaaaatccacttccacatcttccatgaagaagactaccaccctgagtgggacagcccccgcggccggagttgttcccagccgagttaaagccacccccatgccatcccgcccttctaccacaccctttattgataagaagcccacatctgccaaaccatcaagtaccaccccgcgactgagcaggcttgcaactaacacttctgccccagatcttaagaatgtaagatcaaaggtgggcagtaccgagaacattaagcatcagcccggaggcgggcgcgcaaaagttgagaagaagaccgaggccgctgccaccacaaggaaacctgaatctaacgctgtgactaagaccgccggacccatcgcctctgcccagaagcagccagccggtaaggttcagatcgtgtctaagaaagtaagttacagccacattcaaagtaagtgcgggtctaaggataatatcaagcacgtacccggcgggggtaatgtccagatccagaataaaaaggtggacattagtaaggtgtcctctaaatgcggttccaaagccaacatcaagcataagcccggtggcggtgacgtcaagatcgagtcgcagaaactgaatttcaaggagaaagcccaagccaaggtaggaagcctcgacaatgtgggtcatttacccgctggcggagctgtgaagattgagacgtaccggctcacctttagagctaatgcccgcgcgcggacagatcacggagcagacattgtgagtcgcccccctcactttcccggcggaccaaattccggttcccgggtgctgggacctctctctcgggctgttcactag

SEQ ID NO: 195167 - DNA, 2487 bp, Artificial Sequence
  Description of Artificial Sequence: Synthetic coding sequence
atgagcctgagcgacaagcagaccgccagcctgaccgccgcctacggacagctgtccaagggaaaacccgccgagtgtagaatggatagtccaaaggaaattagccaggccgggttcgagtggcagaggacagaaggaaagctcaatgagatcggcctgaatgtgtcgatggatggccaaccaaaggatggattggttaagaacgcctcctttctggagcagaataaactgtgtttctttgaaggcaaactggacaaagagctaagcatcgagatgcaagacaaggattgccaggaagcctcgggacatctggagtcccgctacgtgatctctgagacttgccatccgcttgagggcaattccgtgcaccagaaaacctcagagttccatctgggcctgatagagggccctgacaaaaacaagaccatacctgtgcaagggaaggtggctgggaagaacggtctggagacaaagtctcaatcagacctggattttcctggggctgctgatatccccactaggtacgtgaaagaacaggaaacaagcgtttggaatccttcttttcatcctgtcgcacagggatcactcggttcaagagaagcaacgcccggggaaatggagaactctataaccccaggctgccccgtcataggcgttgtgaacgataactcagaacagctcaagtgcgaatccccactgttagtcagcctggcacatcccgctcctattatagagcattcacctacaactattcctccaataaccatggtgtttacccaagagcacttaaatgcctcatgccatatacgcgaccacgacaaagaactcgaaaagctgagtagcacagaggaagccgtcctgaatcaggctccccagcaaaagaaggccgtgcggagggctctctctgagtgctcacatctctcagtgcccccagcagtcaatctggccgataagtatccggaactcccagcgagggaagaaccgtctagcggcctcttaccccctccgagcagcccgatgccttcacctacgcccggtaaactgggcgcacccgcgatgaaacggagcatgacagtgggtgaagagcagactgccagctacaaactgtctcctgggaaacttcctatactatctaccaaggagatcccgcccttcatttgcgaggagccagttgctaagaagagggaggaacttgctcatttctctaattcctcatccaattctggaaaaaaagaactgggcaccgccggattatacctacattctaaactggagcagatccccgaaggtagctccaaagaaaaaggtcaggaggactttagcgagactcgtatcgacagttgctcccaggtgtgccaacgcggagagaaacagccaggacagacagctctagccggtaagaaagaaatcgaagttactgctacacaatcgactccatcttttctttttgaaaagcctcccagagacggcatcgcccggccagaggagggccgtccagtcgtgtcaggcacgggaaatgatattaccacccctccaaacaaggagctgcccccctcaccagaaaagaagaccaaaccaattgcagatgctaaggcacccgaaaagcgcgccagcccatcaaaaccagccagcgctcctgcctcgagatccggcagtaagagcacgcagactgttgcaaaaaccactacagccgccgctgtggcgtctaccggacctagcagccggtccccctccactctgcttcctaagaaacctacagctgatctgagcagaccaaaatccacatctacatcaagtatgaaaaagactacgaccctgtcaggcaccgccccggccgctggtgtggttccgagcagagttaaggctactccaatgccctctcgcccttctaccactccttttatcgataaaaaacctacttcggccaagcccagcagcaccacaccccgactgagcaggttggccactaatacctcggcacccgacctgaaaaatgttaggtctaaggtgggatcgacagagaacatcaagcaccagcctggtgggggcagggtgcagatagtaagcaagaaggttagttactctcatatacagtctaaatgcggatccaaggacaacatcaaacatgttcccggaggcggaaatgtgcagatccagaataagaaagtggacatttccaaggtcagctccaagtgcgggtcaaaagcaaatattaagcacaagccagggggcggggatgttaagattgagagccagaagttgaatttcaaggaaaaggcccaagctaaggtaggctccctcgacaacgtgggccaccttccagctggtggggccgtgaagattgaaacctatcggctcacgtttagagccaacgcccgcgcacgcacggaccatggtgccgatatcgtgtcgagacccccacattttcccggcggacctaattcaggcagtcgtgtgctggggcccctttcccgtgcagtccattag

SEQ ID NO: 195168 - DNA, 6894 bp, Artificial Sequence
  Description of Artificial Sequence: Synthetic coding sequence
atggccgacctgagcctggccgacgccctgaccgagcccagccccgatattgagggcgagattaagcgagattttatcgccaccttggaggcagaggcctttgacgacgtggtgggggagacagtcgggaagacagattacatccccctgctggatgtggacgagaagacagggaatagcgagtctaagaaaaaaccctgcagcgagacgtcccagattgaggacctcccccttcccccgcatcccgcaagcctttccttccatctgccacttgataccccttcctccaagccaacattgctagctaatggaggccatggggtagagggtagcgatactaccgggtctcctactgaattcctggaagaaaaaatggcgtatcaggaatatcctaacagccagaattggcctgaggacacgaacttctgttttcagcccgagcaagtggtggacccaatccagaccgacccttttaagatgtatcacgacgacgacctcgctgatcttgtcttcccctcctcagcaactgccgacacaagcatcttcgctgggcagaatgaccctcttaaagatagctacggtatgtcaccctgtaacaccgctgtggtaccccagggctggagcgtcgaggcgctaaatagtccacactccgagtcctttgtgtcccctgaagctgtagccgaacctccacagcctacagcagtgccgctggagctggccaaagaaatcgagatggcttctgaggaacgccctcccgctcaggccctggagatcatgatgggcctgaaaaccacagacatggccccttcaaaagagaccgagatggccctcgccaaggatatggcccttgccaccaagacggaagtggccctcgcgaaggacatggaatccccgacgaaactggatgtgacgttagctaaggacatgcaaccctctatggaaagcgatatggcactggtgaaggacatggagctccctaccgaaaaggaggttgccttagtcaaagacgtccgttggcccacagagaccgacgtgtcctctgccaaaaacgtggtcctgccaaccgaaacagaagtcgctccagcgaaagacgtcacacttctcaaagaaacagaacgagcgtcgcctataaaaatggacctggcgccttccaaggatatggggccgcctaaggagaataagaaagagacagaaagggcctcgcctatcaaaatggacttggccccctccaaagacatgggccctcctaaagagaacaaaattgttccagccaaagacctagtcttactgagtgaaattgaggtagcccaagccaacgacatcatatcaagcacagagatttccagcgctgaaaaggtagccctttccagtgagacggaagtcgctctggcacgggacatgacgctcccccctgagacgaatgtcatccttactaaggataaggcattgcctctggaagccgaggtggcaccggttaaggacatggcccagctccctgaaacagaaatcgccccagcgaaggatgtcgcaccaagcactgtcaaggaggtaggtctcttgaaagacatgtccccactctccgagacagaaatggctctgggaaaagatgtcacccctcctcctgagacagaggtcgtgctgatcaagaacgtgtgcctgccgcctgagatggaggtggcactcacagaagaccaggtacccgcgctcaaaactgaagcccccctggccaaggatggcgtccttacccttgccaataatgtgacaccggccaaagacgtaccacccctctccgagacagaagccactccagtgccaatcaaggatatggagattgcccaaacgcagaaaggaatatcagaggacagtcatctcgaatcactgcaagacgttggtcagtcagcagctcctacgttcatgattagccctgaaaccgttaccggcacgggaaagaaatgctcactgcctgccgaggaggactcagtactagagaaactgggtgagagaaagccttgtaatagccaaccgtctgaactttcgagcgagaccagcgctaacttcatgtactgcggcacaccgccaacccaagcaaaacaagtgtgccggccctccgacaggcggagcacccgaccaaaacctgcccgggtgccccccgagctgctcggcggttcccccccgtggaagactttagaccacaggctcgggcattgttctctttccgagtctggctgggtttccggttcatcatcttgtggtggacctggcaaccagcggaagagtattcatgtggactctctcgagccccagagagatctcggtcgggaggcctgggacattgagagcacaccgatcatgatgaagaagaagaagaagaaaccaaagcagaagcgatacagccagccccgcgctggtgggccctcggatgacgacaacgctgataagcccaaggggcacccatttgccgcggatacccagaagtcaggggtcctccctagtcagcctaccacgatggggactgaatacggcctggtatccggcgaaaacctgaagcgcgaatgcctggtgaattcctccgctgcgcgcctggtggccgagaactttgtcagcgagtccctgagaatacccttgtatccaagtgaagaagcccccaagaccgccatttcctcacagtccaagctgagggtggaagaagaatccaaatccaataagagcgtcctacagaaccaggacaaaaaactgctcaaacagcatgagtacaaaccacagcccgctccccatctgaagactcccgtcgataaatctcagtcagtggggcctcttaacctgaagggtccactagcagaggtgtcagcatataacgtggagacacctctggacattcggttaaaggagggctgtagtccttttttggaccaggaggtgatgggagtggtcagcaaaccgaccgctgcaaaagagatccccaatttggtgccaacacttattgcttcaaatcctctggaatgcaacctgaaggaggggaataatgaatcgaagatgacaaagctccagaatgttaaactgaaagaattcccggaaggcgccgaagaggataaagagctcaagaaggaggccttccctaacgaaagacaggagattagtattttcacctcagaacagctgcagggacaggtgctggtgcaggtccctggcgtcgaaaatgaaccatttaaacggatggctggcgacggcaagtctagaaagggtagaggatcctcaggtaagatgaggacagattcaggtaaagtaaaagctaaatcggagctcccctttttattggactcacagaaagatggcagggcagtcctgattcccagcgaacctgtctctaaaaccgagggaatgaccacacaagataaatcagaagagctagggctaaactcaagcaagcaaccagggaccaaggccgacctgactgaggctgtggttatgggggaacctaaggagatgacgcaaccaaaagtggcgggcaccatgcaagctctcattcccctagagagcggttcaggtatgacacagacatcaggcgtcagcaccgagactggcgacgtcgtaaaggatatgggggtcaataatcaaagcaaagagggccgttgcccatggaaagaccatgaagcagccccttggatttcagaaaagccaaagaagcgcggaaacgaaggcaaatccaagaaattcaagaataattacagcacgcagcctgctagaatggagcggaaggaggaaatcctgaatccacctttcgagggtaaggacggagatactggctccatcccacacaaatctaaagagatcggcttcacttttcctaaaatgcatgattcctcattctcacacactcctgataccccgacggtcgaggccgtcgaccgcaaggggggcaacttccaggtgaactttgttgagttaggaacattgggagagaataaaattagtactgtgaaagcatctaccgtcactgagccacccgccaaagtgactgacgtgtcctgccaagagcagatacagggggcgggcttcgtgccatctgtggtgagcgaagaaaacaagacggatgcagctaataggtatacggctgtggcagacaaaccctccaagcgcagcaatgatggcaagtctaagaaagtcaagaattcttctcctgagaagcacatactggagaacaaaattgacgcgactaagatccatgtgcctatggaaacaactggtgatcagggaatcgaaggtatggcttacatggacgaaaatcggaatatcactttcacatgcccaagaactccatctgagctgattaataaatcctcaccgttagaagtgctggagagcgccgcatgcgaaaagctaccgaccccaacaccccaggtggtgaaagagggagattccttcccggacacccttgcgaagaacgggcaggaaatcgccccagctcagatctctaaatctctgatggtggataactatacgaaagacggggtgcccggccaagagcgacccaaagggcccagtgcagtagtgcccagtacgagcaccgggggggttgccctcccaattactacagcaatcgagacagtaaacatccacggagaccactctcttaaaaacaaagctgagcttgccgactccatgaaaaatgaggccgggattgacgagggacatgtgatcggggaaagcgagagcgtccactctggcgcctctaaacattctgtggagaaagtcacagaactggctaaaggtcacctgctcccgggagtgcctgtggaggaccagagtctgccaggcgaggcgcgagcactggagggatacgccgaccgtgggaactttcccgcccaccctgtcaatgaggaaaaggaaactaaggaaggctcagtggccgtgcaaatcccagacctgctggaggacaaagcccagaagttgtccttttgtgaggaccagaacgcccaggacagaaattcgaagggttccgactcactaaacaaaaaggtagatcttaccctgctgagccccaaatccgaaaacgacaagctaaaggaaatcagcctcgcctgcaaaatcactgagctcgagtctgtttcactccccacacctgagattcagagcgacttcctgcattcaaaggttgaagccccccccagtgaggtggcggataccctggtgatcatgacagcttccaagggggtccgccttcccgagcccaaggacaaaattcttgaaactcctcagaagatgaccgaaaaaagcgaatcgaagacccccggtgagggaaaaaaggaagacaagagtcgcatggctgagcccatgaagggttatatgagacctactaaatcaagaggactgacccccctgctgccaaaatcgaccatccaggagcaggaaagacacaaacagctgaaatcagccgggattgcgcgccccgaggaaggtcgccctgtcgtgtctggaaccggtaacgacataaccacacccccaaacaaggagctgccaccctctcccgagaagaaaacgaagccgctagctacgactcagcctgccaagacttccactagcaaggccaagacacagcccaccagtctgcccaaacagcctgctccgactacaatcggtggcctgaacaagaagcctatgagcctggcctcgggccttgtccccgcagcaccccccaaacggcctgcagtggcctcagccagaccatctatcctaccaagcaaagatgtgaaaccaaagccaatagccgacgctaaggcccccgaaaaacgcgcctccccttccaaacccgcttctgcacctgcatctcggtcgggctctaaatctacacaaaccgtcgccaagaccaccaccgcagcggcggtcgcgtcaaccgggccgagctctaggagtccatctacccttcttcctaaaaaacccaccgccatcaagactgaagggaagcccgctgaggtgaagaaaatgaccgctaagtctgtccctgctgacctcagtcggcctaaatctacgagcacgagcagcatgaagaaaacaacaacactgagtggaactgccccagcggccggggtcgttccttcgcgtgtgaaggcaacccctatgccgagtcgcccctctactacgcctttcatcgacaagaagcctacatccgcaaaaccctcaagcactaccccgagactgtcccgcctcgcgacaaacacttccgcccctgacctgaaaaacgttaggtcaaaagtcggctcaacagaaaatatcaaacaccagcctgggggcggccgcgctaaagtcgagaaaaagacagaggccgccgccaccacaaggaagcctgagtccaacgctgtaactaagactgccggaccaatcgccagcgcccagaagcaaccggccggcaaagtgcagattgtgagcaagaaggtgagctactcacatatccagtctaaatgtgggagcaaagacaacatcaaacacgtccctggaggtggtaacgtgcaaattcagaacaagaaggtcgacatctcaaaggtgtcttctaaatgcggaagcaaggcgaacattaaacacaagccgggcggaggtgacgtaaagatcgagagtcagaaactcaacttcaaggagaaggcacaagccaaagtggggagcttagacaacgtcgggcatctgccggctgggggggcagtcaaaaccgagggggggggctccgaggcccctctgtgcccgggccctccggctggagaggaacctgcaatctccgaggcagcaccggaggccggagcccccacctccgctagcgggctcaacggccatccaacgctctccggaggaggcgaccagagagaggctcagaccctggacagccagattcaagagacttctatttag

SEQ ID NO: 195169 - DNA, 750 bp, Artificial Sequence
  Description of Artificial Sequence: Synthetic coding sequence
atgaccgccaagagcgtgcccgccgacctgagccggcccaagagcacgagcacaagtagtatgaaaaagactacaaccctcagtgggaccgccccggctgcaggggtcgttcctagtagagtgaaggcaactcctatgccctccagaccttccactacgcccttcatcgataagaagcctacatccgcaaagccctcgtccacaaccccccgcttgtccagactcgccacaaacacctctgcgcctgaccttaagaacgtgaggtctaaagtcggctccaccgaaaatattaagcatcaacctggcggtggcagagtacaaatcgtgtctaaaaaggtgtcctattcccacattcagagcaagtgcgggtcaaaagacaacatcaaacacgtgccaggcgggggcaatgtgcagatacaaaataagaaggttgacatttctaaggtctcctccaaatgcggctccaaggctaacattaaacacaaacccggaggaggggacgtaaaaatcgaatcacaaaagctcaactttaaggaaaaagcacaggcaaaagttggctctttggataatgtgggtcaccttcccgcgggaggtgcagtgaagattgaaacgtacaggctgacatttagggccaatgcacgggcacggactgaccacggcgcagatattgtgagccgccctcctcacttccccggcggacccaacagcggttctcgagtgctcggacctctatcccgggccgtgcactag

SEQ ID NO: 195170 - DNA, 300 bp, Artificial Sequence
  Description of Artificial Sequence: Synthetic coding sequence
atggccgacctgagcctggccgacgccctgaccgagcccagccccgacattgaaggagagataaagcgggactttattgctactctcgaggccgaggctttcgacgacgtagtcggagagaccgtcgggaagaccgattacattcctcttctggacgttgatgaaaaaacgggcaattccgagtcgaagaagaaaccctgctctgaaaccagccaaattgaggacacacctagttctaagccaactctgctggctaatggcgggcacggagtcgaagggagcgacaccactgaggcctag

SEQ ID NO: 195171 - DNA, 2277 bp, Artificial Sequence
  Description of Artificial Sequence: Synthetic coding sequence
atggccgagccccggcaggagttcgaggtgatggaggaccacgccggtacatatggattgggagacagaaaggaccagggcggttacaccatgcaccaagatcaagagggcgatacagatgcaggactgaaagagtctccactgcagacccccacggaagacggcagtgaggagccagggtcagagacctccgacgcaaaatctactcccaccgccgaagacgtgactgcaccattggtcgacgaaggggcaccaggtaagcaggcagccgcccagcctcatactgaaattcctgaggggaccactgccgaagaggccggcataggggatactcccagtttggaggacgaagctgctggtcacgtcactcaggagccagaaagcggtaaggtcgtgcaggagggttttctacgggaacctggaccaccaggcctgtctcatcaactcatgagcggaatgccaggagctcctttattgcccgagggaccccgcgaggccacgcggcagcccagcggcactggacctgaagataccgagggcgggcgccacgctcccgagctgctcaagcaccaactgttgggagacttgcaccaggagggaccccccctgaagggcgcagggggaaaagagaggccggggagcaaggaagaggtggatgaggacagagatgtggatgaatcctctcctcaggactcacctcccagtaaggcgagcccagcacaggatggccgaccccctcagacggctgccagggaagccacctcaattccaggtttccccgcagagggagcaatccctctgcccgtcgactttctcagcaaagttagcactgaaatccctgcatcagagccagacggccctagcgtgggtagagccaagggacaggatgcacctctggagttcaccttccacgtagagattacacctaatgtgcagaaggagcaggcccattcagaagagcatttggggagagccgccttccccggggcgccgggtgaagggccagaggctagaggacccagcctgggagaggataccaaagaggccgatctgcccgagccatccgaaaagcagcctgccgcggcgccgaggggaaagcccgtaagccgggtgcctcagctaaaggcccgcatggtttcgaagtctaaggacggaaccggaagcgacgataagaaagcaaagaccagcacacgatctagtgcaaaaacattgaaaaatagaccatgccttagcccgaagcaccccacaccaggctccagtgaccctctcatccaaccaagctcacctgccgtgtgcccagagccgccatctagccccaagtacgtctcgtcagtcaccagcaggacagggagcagtggggctaaggagatgaagctgaaaggcgcagatggaaagaccaaaattgcaaccccacgcggcgccgcgcctcctggacagaagggccaggctaatgccacgcggatccccgcaaaaacgccacccgcccccaaaacaccacctagtagtggagaaccccctaagtccggtgatcgctctggctactcctcgcccggtagccccggtacacccgggagtcgctctcgcacaccttcactgccgaccccccccacgcgcgagcccaagaaggttgccgtcgttcggacgcctcctaaaagtcccagctctgccaagagtcggctgcagacagccccagtccctatgccagacctgaaaaacgttaaaagcaaaatagggagtactgagaatctaaaacatcagcccggaggcgggaaggttcaaattatcaataaaaagcttgacctttcgaacgtgcaaagcaagtgtgggagtaaagataatataaagcatgtgcccggggggggctcggtacaaattgtgtataaaccagtggacctcagcaaagtcacttcaaaatgtggttcactgggcaatatacatcacaagccgggtggcggacaggtggaagtgaaatcagagaaattagactttaaggaccgagtccagtccaaaatcggctccttagacaatataacccatgtgcctggagggggaaacaaaaaaattgaaacccataaacttacctttcgtgagaacgccaaggcaaagacggaccacggggctgaaatagtttacaaatccccggtcgtgagcggcgatacaagtcctagacacttgtctaacgtgtcttccactggatctatcgacatggttgacagcccccagctggccactctcgctgacgaggtgagcgcgtcccttgcaaagcaaggtctgtag

SEQ ID NO: 195172 - DNA, 1152 bp, Artificial Sequence
  Description of Artificial Sequence: Synthetic coding sequence
atggccgagccccggcaggagttcgaggtgatggaggaccacgccggaacctatgggcttggagaccgcaaagaccagggcggttatacaatgcatcaagatcaagagggcgataccgatgccggattgaaggccgaggaggcagggatcggtgacactccgtccctggaagatgaagccgccggacacgtgacccaggcacgcatggtgtccaagtcaaaggatggtactgggtccgacgataaaaaggccaaaggcgcagatggcaaaactaagatcgctactccacgcggggccgcccctcctggccagaagggccaggccaacgccacaaggatcccagcgaagacccctcctgctcctaagacaccaccatcttccggcgaacctccaaagagcggggatcgaagtggatattcctctcccgggtcacccggcacccccggcagccgctccagaactccaagcctgcctactccacccacccgcgaaccaaagaaagtcgcagttgtacgtaccccacccaagtccccttcgagtgcaaaaagtcgacttcagacagctccggttccaatgcctgatctgaagaacgttaaatccaagatcggcagcactgaaaatctgaaacaccagcccggggggggaaaagtacaaataataaataaaaaactggacctgtccaacgtccaatccaagtgcggaagcaaagacaacattaaacacgttcccggcggaggctcagtacagatcgtttacaagcctgtggatctgtccaaagttactagtaaatgcggcagcctaggtaacatacatcataagccaggcggcggccaagtggaagtgaagtctgagaagttggattttaaagaccgagtgcagtcgaaaatcggaagtctcgacaacatcactcatgtgccagggggcgggaacaaaaaaatcgaaacacacaaacttacctttcgtgagaatgccaaggcaaaaaccgaccatggagccgagatagtgtataagtcgcccgtggtatccggcgacacatcacctcggcacttatccaacgtctcatcaacaggatctatcgatatggtcgatagcccccagctggctactctggctgatgaagttagtgcttcgcttgctaagcagggcctgtag

SEQ ID NO: 195173 - DNA, 1239 bp, Artificial Sequence
  Description of Artificial Sequence: Synthetic coding sequence
atggccgagccccggcaggagttcgaggtgatggaggaccacgccggcacctacggactcggcgatagaaaagaccaggggggctacactatgcaccaggatcaggagggcgacaccgatgctggattgaaggagtcgccactacaaacccctactgaagatggtagcgaggagcctggcagtgaaacctcagatgctaagtccactccaacggctgaagcggaagaggctggaatcggggacacaccctccctagaggacgaggcagccggacacgttacacaggccagaatggttagcaaatcaaaagatgggaccggcagcgacgacaagaaagcaaagggcgctgacggcaagactaaaattgccacccccaggggagcagccccgcctgggcaaaaagggcaggcaaacgcaacacggattccagccaaaactcccccagccccgaaaaccccccctagctccggagagccaccgaagtctggagatcgatcagggtacagtagtccgggctccccagggactcccgggtctcgatcgaggaccccctctctgcccacgccacctacaagagagccaaagaaggtcgctgtagtgcgcactccgccaaaaagcccttcctccgccaagagtcggctgcagacggcgcccgtccctatgcctgatctcaagaacgtaaaaagcaagatcggatctaccgagaatctaaagcaccaaccaggaggcggtaaggtgcaaatcatcaataaaaagttggacctaagcaacgtacaatcaaaatgtggcagcaaagacaacattaagcatgtaccagggggaggaagcgtccagattgtgtataagcctgtggacctgtcaaaagtgacctcaaagtgtgggtcccttgggaacattcaccacaagccaggcggaggtcaagtggaggtgaaatcagagaaactcgatttcaaggaccgcgtccagtccaaaatcggcagcctcgacaatataacacacgtgcccggaggaggtaataagaagatcgagacgcacaagttgacatttcgagaaaacgccaaggccaagaccgatcatggtgccgaaattgtgtacaagtctcctgtggtcagtggagatacgtcccccagacacttgagcaacgtgtctagcacgggaagcatcgacatggttgattcaccacagctggccaccctggctgacgaggtgtctgcttctctcgctaaacaaggtctgtag

SEQ ID NO: 195174 - DNA, 2331 bp, Artificial Sequence
  Description of Artificial Sequence: Synthetic coding sequence
atggccgagccccggcaggagttcgaggtgatggaggaccacgccggtacatatgggcttggcgaccgtaaggaccagggcggctatacaatgcaccaggatcaggagggcgatacggacgcaggcttgaaggaatctccattgcaaacaccaacggaggatgggagcgaggagcccggctcggagacatctgatgccaaaagcacaccaacagctgaggacgtcaccgccccgctggtggacgagggtgctccaggtaagcaagccgccgctcagccacatactgagatccctgaaggaacgacagctgaggaggccggcattggtgacacgccgtccttggaggacgaagctgccggccacgtgacccaggaaccagaatcaggtaaggtcgtgcaggagggtttcctccgcgaacctggcccgcctgggctgtctcaccaactcatgagcggcatgccaggcgcgcctctgctgcccgagggccctcgcgaagctactagacagccgtctggaacaggaccagaggatactgaggggggtcgacatgcaccagaactgctgaaacatcagttactcggcgaccttcaccaggaagggccaccactgaaaggagctggaggcaaagagcgacccggaagtaaggaggaagttgatgaggatcgagatgtcgacgagtcatctccccaggactcacctccatcaaaagcctcccccgcgcaagatggccgaccaccgcagacagcagcaagagaggccacgagcatcccaggtttcccagctgaaggcgcgatcccccttcccgtggattttctgtcaaaggtgtctacggagatcccggcaagcgagccagatggcccaagcgttggccgggcaaagggacaggacgcgcctctcgagtttacatttcacgtggagattacaccaaatgttcagaaggagcaggcgcattctgaggaacacctggggcgggctgctttcccaggtgcgccaggcgaaggccctgaagctaggggcccatctctgggggaagatactaaagaggcagatctgccggagccttctgaaaaacagcccgccgcggccccaaggggaaagcctgtctccagagttcctcagctgaaggctaggatggtatctaagtccaaggatggaaccggcagcgacgataagaaggctaaaaccagcactagaagtagcgctaaaacactgaaaaaccgtccctgccttagtccaaaacatcctacaccaggatcgtccgatcccctcatccaaccatcctcaccagcagtgtgccctgaaccaccatcctcaccgaaatacgtctcgtcggtgacatccagaaccggctcttctggcgccaaagagatgaagttgaagggggctgacggaaaaacaaaaatagccacccctcggggggcggccccaccgggacagaagggacaagcgaatgctactcggattccggccaaaactccgcccgccccaaagacaccaccaagctccgccaccaaacaggtccagcggagaccaccccctgcaggacctagatctgagcgtggtgagccccccaaatctggagatcgcagtggctattcctccccaggctcccccggcaccccgggcagccgttccaggactccttctttgcctaccccgcccacccgcgagccaaagaaggtcgccgttgtcagaacccctcctaagagcccctcctccgctaaatcgcggctccagacagcccccgtgcctatgccagacctgaagaatgtgaaatccaagatcgggtccaccgagaatctgaagcaccagcccggcggagggaaagtgcagattataaacaaaaagctggacctgtcaaacgtacagagcaagtgtggaagcaaagacaacattaaacatgtcccaggaggaggctcagtgcagatcgtctacaaaccagtggatttatctaaggtcacctccaaatgcggcagtctcggaaatattcaccataaacccggggggggccaggtggaggttaagtccgaaaagctggattttaaggatagggtgcagtccaagatcggttcattggataacattacccacgttcccgggggcggtaataaaaagatcgagactcataagctaaccttcagggaaaacgctaaagccaaaactgaccacggcgcagaaatcgtttacaaatccccagtggtaagtggagatacatcccctcgccatttgtcaaatgtctcttcaaccggatctatagatatggtggactctcctcagctagcgaccctggccgacgaagtaagcgcatcactcgccaagcaaggactatag

SEQ ID NO: 195175 - DNA, 951 bp, Artificial Sequence
  Description of Artificial Sequence: Synthetic coding sequence
atgctgcgggccctgcagcagcggaagcgggaggccggcatcggcgacacaccttctctcgaggatgaagctgcggggcacgttacacaagcacgcatggtgagcaagtctaaagacggaaccggcagtgacgacaagaaagcgaaaggagcggatggaaaaacgaagatcgccacgccccgaggggcggctcctcccgggcagaagggacaggcaaacgcgacgcgaataccagcaaagactcctcccgccccaaaaacccctcccagttcaggtgagccccccaaaagtggtgatcgctccggctattctagccctggcagcccgggaactcccgggagccgaagccgaaccccatctctccccacgcctcctacacgcgagcccaagaaagtggcagtggtacgcacacctccaaagtccccaagttctgctaagtcaagactgcaaacggcccctgtgcctatgcctgatctcaagaatgtaaaatccaaaatcgggagtaccgaaaatctaaagcatcagccaggaggcggcaaagttcagatagtgtacaagcctgttgatctgtctaaggtgacatccaagtgcggtagcctcgggaacatacatcacaagcccggaggcggccaggtggaggttaagagtgagaagctcgatttcaaagaccgtgtccaaagtaaaattggaagtttggacaacattacacacgtgccaggtggtggaaacaagaaaattgaaactcataagcttactttcagagaaaacgccaaagctaagacagatcatggcgccgagattgtttataagtctcctgtggtctccggtgacacaagccccaggcatcttagcaatgtgagctcaaccggtagcatcgatatggtggacagcccacagctggctactctcgcagacgaagtgtccgcatcactcgccaaacagggcctgtag

SEQ ID NO: 195176 - DNA, 1326 bp, Artificial Sequence
  Description of Artificial Sequence: Synthetic coding sequence
atggccgagccccggcaggagttcgaggtgatggaggaccacgccggcacgtacggtctgggcgataggaaggaccagggcggatatacaatgcatcaggatcaggaaggagacaccgatgctgggctgaaagaaagcccgcttcagacccctacagaggatggctctgaggaaccaggatcagagacttctgacgcaaagtctacacccacagccgaggacgtgactgccccccttgtggacgagggcgctcctggaaagcaagcggctgcccaacctcatacggaaatcccggagggcaccacagccgaagaagcgggcattggagatacccccagtctcgaagacgaagccgcgggtcacgtcacacaggctcgcatggtgtctaagagtaaggatggcacgggctcagatgacaaaaaggccaaaggtgcggacggcaagactaaaatcgccacccctagaggcgcggccccgcctggtcagaagggtcaggcgaacgctacccgaatccctgccaaaacacctcctgcaccaaagacacctccttctagtggagagccgcccaagtcgggcgatcgaagcgggtactcgtcccccggatcgcctgggacgcctggcagtcgctccaggacaccatccctgccaacacctcctacaagagaacccaaaaaggttgccgtggtgcgtactccgcctaagtccccaagcagcgccaagagtcgacttcagacagcgcctgtccctatgcctgatcttaaaaatgtgaagtctaagatcggatctaccgagaacctgaagcatcaaccaggcggagggaaagtgcagattattaacaaaaagctggacctttcaaacgtgcagtcaaagtgcgggagtaaggataacatcaaacatgtgccaggtggggggagcgtccagatagtttataaaccagtcgacctgtctaaggtcacctccaagtgtgggtccctcgggaatatccaccataagcctggagggggacaggtggaggtgaagagcgaaaagctggattttaaagaccgagtccagtcaaagatcgggagtctggataacatcacccatgtccccgggggaggaaataaaaagattgagacacataagctgacttttagggagaatgccaaggccaagacggatcacggcgccgagatagtctacaagagtccagtagtgagcggggatacctccccacggcatctctctaacgtgagcagcactgggtctatcgacatggttgatagccctcagttggccaccttggcggatgaagtttccgcctctctggccaagcaaggcctctag

SEQ ID NO: 195177 - DNA, 1080 bp, Artificial Sequence
  Description of Artificial Sequence: Synthetic coding sequence
atggccgagccccggcaggagttcgaggtgatggaggaccacgccggaacctacggcctgggggatcgtaaagaccaaggaggatacaccatgcaccaagatcaggaaggtgacacagacgccggattgaaagaatcaccactccaaacgccaacagaagacggttccgaagaaccgggatctgaaacctccgacgccaagagtacaccaacggcggaagctcggatggtgtcaaagtcgaaagatgggactggatcagatgacaagaaggcaaaaggtgccgacggtaaaacaaagatcgcgacccctcgcggcgcggccccccccggtcaaaaggggcaggcgaatgctacacggattcccgccaagacaccgcctgcacctaagaccccaccatcctctggggaacccccaaagagtggcgatcgttctggatacagctcccccggtagcccaggaacccccggaagtcggagtcgaacgccctccctccccaccccccctacccgcgagcctaaaaaagtggccgtcgtgagaacgccacccaagagcccttctagtgccaagtcaaggctgcagactgcgcccgtccccatgccagatttaaaaaatgtaaaatctaagatcggctcaacagagaatctcaagcaccagccaggcggcggaaaggtgcagatcgtctacaagccagtcgatctgtccaaagtgacgtcaaagtgcggatccttgggtaacattcaccataagcctggcgggggacaggtggaggtgaagtccgaaaagttggacttcaaagacagagtgcagagtaagattggaagcctggacaatatcactcacgtcccaggggggggcaataaaaaaatagaaacccacaagctcacgttccgcgaaaatgccaaagctaaaaccgaccacggcgctgagattgtttacaagagtccagttgttagtggtgacacgtctccccgccacctgtccaacgtgtcctcgaccgggtctatcgacatggtcgactccccacagttggccacactggcagatgaggtgtcggcttcattagcaaagcagggcttatag

SEQ ID NO: 195178 - DNA, 2331 bp, Artificial Sequence
  Description of Artificial Sequence: Synthetic coding sequence
atggccgagccccggcaggagttcgaggtgatggaggaccacgccgggacctacgggctcggagatcgcaaggatcagggaggctacaccatgcatcaagatcaagagggggacactgacgccggactgaaagaatcaccactccagacacccaccgaggatggctcagaagagcccggttccgagacatctgatgctaagtccacaccgacagccgaggacgtcactgcaccactggtcgatgagggcgcgcctggcaaacaggccgccgctcaacctcacactgaaatccccgaagggactacggctgaagaagccggcattggcgatactccatccctggaggacgaggcggcagggcacgtgactcaagaaccggagagcggtaaggtcgtgcaagaaggtttcctgcgtgagccaggaccccccggcctgtcccatcaattaatgagcggaatgcccggcgcgccactccttcctgagggcccgcgcgaagcaacgcggcagcctagcggtaccggtccggaggataccgagggaggccgtcacgctcctgaactgctgaagcatcagctgctgggcgatctgcatcaggagggcccacctctgaagggcgccggaggcaaggagagacctggctctaaggaggaagtggatgaggatcgcgatgtggacgagtccagccctcaggatagccccccttccaaagcctccccagcacaggacggaaggcccccacagaccgcagcacgagaagctactagtattcctgggttccccgccgagggagctatcccactacccgtagacttcttgagcaaagttagcacagagattcctgccagcgagccggatggaccatctgtgggacgtgctaagggtcaggacgcacctctggaattcacattccatgtggaaatcacccctaacgtgcaaaaagagcaggctcactcagaggaacatctaggccgcgcggccttccctggagcccctggcgaaggaccagaagccaggggaccaagtcttggcgaggatacaaaagaggcagacttacctgagccgagtgaaaagcagccggccgctgctccgcggggcaagccagtctctcgggttccacagctgaaagcccgaatggtgagtaagagcaaggatggcacagggagcgacgacaaaaaagcaaagaccagtacacgaagttcagcaaagactctgaagaaccggccctgcctgagcccgaagcatccaacccctggctcatccgaccctctcatccagccctctagtcccgccgtatgtccggaacctcctagcagtccaaagtacgttagttcagttactagtaggactgggtcatctggcgccaaggagatgaaactgaaaggagccgatgggaaaactaaaatcgccactccaagaggcgccgccccgccaggtcaaaaaggccaggctaatgccacccgtatcccagctaaaaccccgccagcccccaagacacccccaagctccgcgaccaagcaggtgcagaggaggccgccaccagccgggcctcggtccgaaagaggcgaacctccaaaaagtggcgatcggtctggttattcctccccaggctctccgggcacaccaggatcccggtctaggacacccagcctgcctacaccacccaccagagaacctaagaaggtggcagtcgtgcgcactccccctaaaagcccaagttcggcgaagtcccggttgcaaacagcgccagtgccaatgcctgacctgaaaaatgttaagagcaagattggaagcaccgaaaacttgaaacaccaaccgggaggtggaaaggttcagatcattaataaaaaactggatctttctaacgttcagtctaagtgcggtagcaaagataacattaagcatgttccaggtggtggaagtgtccagatcgtgtacaaaccagtggacctgagcaaggtaacatcaaaatgcgggtccctgggcaacatacatcataaaccggggggcgggcaggtcgaggtgaaaagcgaaaagctggactttaaggatcgtgttcaaagcaagatcggttcgctggacaacatcacccatgtgcccggcggcgggaataagaaaatcgaaacccataagttgacctttagggagaacgctaaggccaaaaccgatcacggcgctgagatcgtctacaaaagtccagtcgtgagtggggacacgagcccccgacacctgagcaacgtgtctagtactggctctattgacatggttgactctccacagctggccaccctcgccgacgaagtgagcgcgtcccttgccaagcagggcctgtag

SEQ ID NO: 195179 - DNA, 1239 bp, Artificial Sequence
  Description of Artificial Sequence: Synthetic coding sequence
atggccgagccccggcaggagttcgaggtgatggaggaccacgccggcacttatggccttggcgatcgtaaggatcagggcggatataccatgcaccaagaccaggagggggataccgatgcaggcctcaaagagagcccactccagacccccacagaggatgggtctgaagagccaggatctgagacctccgatgccaagtccacccccacggccgaagcagaagaagcaggcattggcgacacccctagccttgaagacgaggcggccggccatgtaactcaggcccgcatggtgagcaaatcaaaggatggaacgggctcagacgacaaaaaggctaaaggcgccgacgggaaaactaaaatcgcaacccctaggggcgccgcgccacctggtcagaagggccaagccaacgctactagaattcccgcgaaaaccccacctgcccccaaaacacctccatcctcgggcgaacccccaaaatcaggagacaggagcggatattcctcacccggaagtccagggacaccaggctcacggtcaaggaccccatctctgcccacaccaccaaccagggagccaaagaaagtcgctgtcgtacggactccgcccaaatcgccgagtagcgccaaatctcgactgcagactgctcccgttccaatgcctgatttgaagaacgttaaatccaagataggctccaccgaaaaccttaagcatcagcctggcggaggcaaggtacaaattattaataaaaaactggacctgtctaatgtacagagtaaatgtggtagcaaagacaacatcaagcatgtccccgggggcggtagcgtccaaattgtgtacaagcctgtggacttgtccaaggtgaccagcaagtgcggctccctggggaacattcaccacaagccgggaggaggacaggtggaggtgaaaagcgagaagctggacttcaaagaccgcgtgcagagtaagattgggtcactcgacaacatcacccatgtgcccggcggtggtaacaagaaaattgagacacacaagttgaccttcagggaaaacgccaaggcgaagactgaccacggcgcagagatcgtgtataagtcacctgtagtatccggagatacttccccccgccacttgagtaacgttagctcgacagggagtatcgacatggtggacagtcctcagctcgccaccttggccgatgaggtgtccgcctccttggccaaacaaggcttgtag

SEQ ID NO: 195180 - DNA, 795 bp, Artificial Sequence
  Description of Artificial Sequence: Synthetic coding sequence
acccgggaggccgagggcgccgacggcaagaccaagatcgccaccccaaaagggcaggctaacgctacacgcatccctgccaaaacccctccagcaccaaaaactcccccgtcttctggagagccccctaagtccggcgataggtccggctactcgtcccctggcagccccggaacacctgggagccgctcccgcacacccagtttgcctacccctcctaccagagagccgaaaaaagttgcagtggttaggactccacctaagagcccatcttccgccaagtcgcgtttgcaaaccgccccagtacccatgccggacctcaagaacgtcaaaagcaaaatcggatctacagagaaccttaagcatcaaccaggggggggaaaggtgcagatagtatataagccagtggatctgtctaaggtgactagtaagtgcggatcacttgggaacattcaccataagccaggagggggccaagtggaagtaaagtccgagaagctcgatttcaaggaccgagttcagtcgaaaattggcagtctggacaatatcacgcacgtgcctggaggtggcaataagaagatcgaaacacataaactcacctttcgcgaaaacgccaaagccaagaccgatcacggggcggagatagtctacaaaagcccagttgtctctggagacacttcaccccgccatttgtctaacgtttcgagcactggaagtatagacatggtggactcaccacaacttgcaacacttgctgatgaagttagtgccagtttggccaagcaggggttatag

SEQ ID NO: 195181 - DNA, 1059 bp, Artificial Sequence
  Description of Artificial Sequence: Synthetic coding sequence
atggccgagccccggcaggagttcgaggtgatggaggaccacgccggaacgtacggcctgggggaccggaaggaccagggtggatacactatgcatcaagatcaggaaggtgatacagacgcaggcctgaaggccgaggaagccggaattggtgatacaccctctctcgaagatgaggctgccggtcatgtaactcaggcccgcatggtttccaaatctaaggacggtaccggatctgatgacaagaaagcgaaaggcgccgacggaaagaccaaaatcgccacaccgagaggagccgccccccccggacagaagggccaagctaacgccacgcggattccagccaagacacctcctgctcccaaaacgcccccgagttctggagaaccgcccaagtccggagatcgtagcggctattcatctccaggctcccctggcacacctggaagccgcagcagaactccatctctccctactcccccgactagggaacccaagaaggtggccgtcgttaggacaccacccaaatcaccttccagcgctaagagccggttgcaaaccgccccagtccccatgccagatcttaagaacgttaagagcaagatcgggtcaactgaaaatctgaagcaccagccgggaggaggcaaagtgcagatagtgtataagccggttgatctcagcaaggtgactagcaagtgtggatcactgggtaacatccaccataaacctgggggaggccaggtcgaagtgaagagcgaaaagttggattttaaagatcgtgttcagagtaagataggctcgctcgacaacatcactcacgttcccggcggcggcaacaagaagatcgagacccataagcttacgttcagagaaaatgccaaggccaaaacagaccacggcgccgagatagtgtataaatcacctgtggtcagtggcgacacttccccacgccacctctccaacgtgtcaagtacaggctctattgatatggttgactccccccagctcgccactctcgctgatgaggtgtcggctagtctggccaagcagggtctgtag

SEQ ID NO: 195182 - DNA, 1233 bp, Artificial Sequence
  Description of Artificial Sequence: Synthetic coding sequence
atggccgagccccggcaggagttcgaggtgatggaggaccacgccggaacttacggtcttggtgatagaaaggatcaaggcggctacaccatgcaccaggatcaggagggagataccgacgccgggttaaaggagtctccactccagacgcctacggaagatggcagtgaggagcccggctccgagacctctgatgcgaagtcaacccccactgcagaggacgtgactgccccactagtagatgagggagctccaggaaagcaggccgcagcgcagccacacaccgagattccagaaggcaccacagccgaagaggccgggatcggagatacaccatcactcgaggacgaggctgccgggcatgtgacacaggctcgcatggtgtccaaatcaaaagacggcacgggtagtgatgataaaaaggcaaagggcgctgatggcaagacaaagatcgccacccccaggggcgcagccccacctggacaaaagggacaagctaatgccaccaggatacccgccaagacaccccccgcacctaagacaccccccagtagcggcgaaccacctaaatccggcgaccgctcaggttactcctccccggggtcccctggtacccctggtagccgctcacggacaccttccctccctacacccccaacccgcgagcccaagaaagtggctgtggtaaggacccctcctaagagtccaagtagtgcaaagtctagactccaaactgcaccggtgcctatgcccgatttaaagaacgtcaagtctaaaataggttccacagagaacctcaaacatcagcccggagggggcaaagtgcagattgtgtataaacccgtggacctgagtaaggtgacctctaaatgtggcagcctcggtaacatacaccacaagcccggcggaggccaggtggaggtgaaatccgaaaaattagactttaaggatcgagtgcagtccaaaattggaagcctcgacaatatcacacacgttcccggtggaggaaataagaaaattgagactcataagttaacctttagggaaaatgccaaagctaagactgatcacggagcggagatcgtatataaaagtcctgtggtgtccggtgacaccagcccacgccatttaagcaatgtttctagcacgggatcaatcgacatggtggattcgccacagctcgctaccctggctgacgaagtctccgcctcactcgccaagcagggtttatag

SEQ ID NO: 195183 - DNA, 807 bp, Artificial Sequence
  Description of Artificial Sequence: Synthetic coding sequence
atggccgtgaacgtgtacagcaccagcgtgaccagcgacaacctgagccggcatgatatgctggcctggatcaacgagtcccttcagttgaacctgaccaagatcgagcagctctgttccggtgctgcgtactgtcagttcatggatatgctcttccccggtagtattgccctgaaaaaggttaagttccaagcaaaactcgagcacgaatatatacagaattttaaaattcttcaggcggggttcaagcggatgggggtggataaaattatacctgtagacaagctcgtcaagggcaagtttcaagataatttcgagttcgtgcagtggttcaaaaaatttttcgacgcgaattatgatggaaaggactatgaccctgtagcagcacgacaggggcaggaaacggcggtcgcgccgagtctggttgcgccagcccttaacaaacctaagaagcctctcacttccagcagtgccgctcctcaacgcccaatctctacacagagaactgctgccgcccccaaagcaggtcctggcgtggtgagaaagaaccccggcgtaggaaatggggacgatgaagctgcggaacttatgcaacaggtgaacgtcctgaaattgactgtggaagacctggagaaggagagggacttttattttggtaagctgcggaacatcgagttgatttgtcaggaaaatgaaggggagaacgatccagtcctgcagagaatcgtcgatatcttatatgcgaccgacgaggggttcgtgattcctgacgaaggcgggccccaagaagagcaggaggaatattag

SEQ ID NO: 195184 - DNA, 984 bp, Artificial Sequence
  Description of Artificial Sequence: Synthetic coding sequence
atgcccggccccacccagaccctgagccccaacggcgagaacaacaacgatatcatacaagacaataacggtactatcattccattcaggaaacataccgtgcggggcgagcgaagttattcgtggggcatggccgtgaatgtctacagtacatctattactcaggaaactatgtcccgccatgacatcatagcttgggtcaatgatatcgtttccctcaattacacaaaggtcgagcagttatgcagcggggccgcttattgccagtttatggacatgcttttcccaggctgcattagtttgaaaaaggtgaagtttcaggccaagcttgaacacgagtacattcataactttaaactgctgcaggccagcttcaaacggatgaacgtcgataaggtgatccctgtggagaaactggtcaaggggcgatttcaggacaatcttgacttcatccagtggttcaagaagttctacgacgctaactatgacggtaaagagtacgaccccgtggaagcgcggcagggccaggatgccattcctccccccgaccctggggagcagatctttaatcttcccaagaaatcacaccatgctaacagtccaaccgctggtgccgccaagtcatctcctgcggccaagcctggctcaacaccaagccggccgtcatctgccaaaagagcttctagctctggctctgcttcgaaaagcgataaggatctcgagacacaggtcatccagctcaatgagcaggtacacagcttgaagttggcccttgaaggtgtggaaaaagagcgggacttttattttggcaagctgagagagatcgagctattgtgtcaggaacacggacaggaaaacgacgatcttgtgcaacgccttatggacattctgtacgcctctgaggagcatgaagggcacaccgaagaacccgaggccgaagaacaagcgcacgaacagcagccgccccagcaggaggaatattag

SEQ ID NO: 195185 - DNA, 855 bp, Artificial Sequence
  Description of Artificial Sequence: Synthetic coding sequence
atggccgtgaacgtgtacagcaccagcatcacccaggagaccatgtcccggcatgatatcattgcctgggttaacgatattgtctctcttaattacacaaaagtagaacagctgtgctcaggagctgcgtattgtcagttcatggacatgctgtttcccggctgcatttccctgaagaaagtgaaatttcaggccaaactcgaacatgagtatatccacaactttaaactcttgcaggcgtcctttaagcgtatgaacgtggacaaggtcatcccggtagaaaagctggtcaagggcaggtttcaagacaacctcgacttcattcagtggttcaaaaaattttatgatgctaattatgacgggaaggagtacgatcccgtcgaggctaggcaggggcaagacgccatacccccacctgatcctggagaacagattttcaatctgccaaaaaagagccaccatgcaaactccccgaccgcaggggccgccaaaagttcacccgcagctaagcccgggagtaccccctccaggccctcgagcgccaaacgggcttccagttctggatccgcgtctaaatccgacaaggatctagaaacacaagtgatccagctaaacgaacaggtacacagtcttaagctggcccttgagggagtggagaaagagagggatttctattttggaaagctgagagagattgagcttctttgccaggaacatggtcaggagaacgacgacctggtacaaaggctcatggatatcctgtatgccagcgaggagcacgaaggacacaccgaggagccagaggccgaagagcaggcacacgaacagcagcctccacagcaggaggagtactag

SEQ ID NO: 195186 - DNA, 948 bp, Artificial Sequence
  Description of Artificial Sequence: Synthetic coding sequence
atgaagcagaaccgggaccagaagtgccccgtgagccagcggaactcatcattccaacagccaggccgtaaacccggctgctcttcctggggtatggccgttaacgtatactcaacctcaatcacccaggaaacgatgtcacggcacgacattatcgcgtgggtgaatgatatcgtgagtttaaactatacaaaagtggaacagctgtgtagcggagcagcctattgtcagtttatggacatgctgttccccggttgtatttcactgaagaaggtaaaatttcaggccaaattggaacacgagtacatccacaattttaagttactgcaggccagctttaaaaggatgaacgtggataaggtgatcccagtggaaaaactggtgaaggggagatttcaggataatctggacttcatccaatggttcaagaagttttacgacgctaattacgatggcaaggaatatgatccagtggaggccagacagggccaagatgctattccgccaccagatcccggagaacagatcttcaaccttcccaaaaagtcccatcatgccaattcccctacggccggcgctgctaagtcctcccctgccgccaaacctggatctacgccgtcccgaccctcaagcgccaagagagcctcgtcatcggggagtgcgagcaaaagtgataaggatctagaaacgcaggtgatccagttgaatgagcaggtccatagtctgaagttggctctagaaggcgtagagaaggagcgtgacttctatttcgggaagctgcgtgagatcgaactgctctgtcaggaacacggacaggaaaacgacgatctggtccagcgtctcatggatattctgtatgcatcagaagaacacgaaggccataccgaagaacctgaggctgaggaacaggcccatgagcagcaaccaccacagcaggaggagtactag

SEQ ID NO: 195187 - DNA, 825 bp, Artificial Sequence
  Description of Artificial Sequence: Synthetic coding sequence
atggcccggaccaccaccaccagcagccggatcatcaccggcccctctttcctaagtgggagtacgcagtgcgctggtagcgttcctaccggcgccgcctattgtcagtttatggatatgttattcccagggtgtatctccctgaagaaggtgaaattccaagccaagcttgagcacgaatacatccataattttaagctgctacaggcgtcattcaaacgcatgaatgtggacaaagtgattccagttgagaaactggtcaaaggacgctttcaggacaacctggactttatccagtggttcaagaaattttatgatgctaattatgatggtaaagagtatgacccagtagaagccagacagggccaggatgccatccccccaccagatcccggcgagcagatttttaacctccctaaaaaaagccaccacgctaatagtccaaccgccggggccgccaaatcttctcctgccgcaaagcctgggtcaactccatcaagaccttcgtccgcaaaacgagcctcatcttctggtagtgccagcaagtctgacaaggatctggagacccaggtcatccagctgaacgaacaggtccattcactcaagttggctctcgaaggcgtagaaaaggagcgtgacttttacttcgggaagctgagagaaatcgaactgttgtgtcaggagcacgggcaagaaaacgatgatctcgtacagaggctcatggacatcctgtacgcctccgaagagcatgaaggccacacggaggagccggaggccgaggaacaggcccacgagcagcagcccccgcagcaggaggagtattag

SEQ ID NO: 195188 - DNA, 1005 bp, Artificial Sequence
  Description of Artificial Sequence: Synthetic coding sequence
atgagcgagcccatccgggtgctggtgaccggcgccgccggccagatcgcttattcgctgttgtacagtattggtaacgggtctgtgttcggcaaggatcagcctatcattctcgtgctcctggacatcactcctatgatgggtgtgctcgatggagtgctgatggagttacaggattgtgcattgcccttgctgaaggacgtgatcgccactgacaaggaagacgtggcatttaaggacctggacgtggccatcctagtagggagtatgccgaggcgtgaaggcatggagcgtaaggacctgttaaaggcgaacgttaaaattttcaagtctcagggggccgcgttagataaatacgctaaaaagagcgtgaaagtcatcgtggtcggcaaccctgctaacaccaattgtcttactgccagtaagtcggcacccagcatcccgaaagaaaatttctcctgcctgactaggctggaccacaatcgtgccaaagcccagatcgccttaaaattgggcgtgactgccaatgacgtcaagaacgtaataatctggggtaatcactcctccactcagtatcccgatgtaaatcacgctaaggtcaagctgcaggggaaggaagtcggagtatatgaagcactgaaggatgattcttggttgaaaggcgagtttgtcacaacagtccagcagagaggggctgcagtgatcaaggcccgaaaactgtcctccgctatgtccgccgcgaaggccatttgcgaccacgtaagagatatatggtttggcacgcccgagggagagttcgtgagcatgggcgtgatatccgacgggaactcatacggggtccccgacgatctgttatatagttttccggtggtgattaagaacaagacctggaaatttgttgagggtttacccattaatgattttagtagagagaagatggacctaactgctaaggagctaacagaagagaaggagtccgcattcgagtttctgtcatctgcctag

SEQ ID NO: 195189 - DNA, 801 bp, Artificial Sequence
  Description of Artificial Sequence: Synthetic coding sequence
atggccgtgaacgtgtacagcaccagcgtgaccagcgagaacctgtcaaggcatgatatgttggcctgggtgaatgattctttacacctgaattacaccaaaatcgaacagttgtgttccggtgcagcttattgccagtttatggacatgctgtttccgggctgcgtacacctgcgcaaagtcaagtttcaagctaagctcgaacacgaatacatacacaactttaaagtactccaggccgcttttaagaagatgggggtcgacaagattattcctgttgagaaattggtgaagggaaagtttcaggacaattttgaatttattcagtggtttaaaaaatttttcgacgccaactacgatgggaaagactacaaccctttactcgcaagacaaggccaggatgtcgcccccccaccaaatccagttcctcaaaggacctctcctaccggccctaagaatatgcaaacttctggccgattatccaacgtggctcctccatgcatcctcaggaagaatcccccttccgcccgcaacggtggtcacgagaccgacgcacagatcctggaactgaaccaacagctggttgacctgaagcttacggtagatggcctcgaaaaggaacgtgacttctacttttctaaattacgggatattgagctgatctgtcaggagcatgagtcagaaaactcgcccgtaatctcaggtatcatcggcatactctatgccactgaagaaggattcgccccaccagaagatgatgaaattgaggaacaccaacaagaggatcaggacgaatactag

SEQ ID NO: 195190 - DNA, 801 bp, Artificial Sequence
  Description of Artificial Sequence: Synthetic coding sequence
atggccgtgaacgtgtacagcaccagcgtgaccagcgagaacctgtctaggcatgatatgctggcctgggtgaacgacagcctgcacttaaactacactaaaattgagcaactttgctcaggtgcagcctactgtcaattcatggacatgttgttccctggctgcgtgcatttaagaaaagtgaaatttcaggccaaattagagcacgaatacatccacaacttcaaagttctgcaggcagcctttaagaagatgggggtagataagattatccctgtcgaaaaacttgtgaaaggtaagtttcaggataacttcgagttcatccagtggttcaaaaaattcttcgatgcaaactatgatggaaaagactacaacccacttctcgcaagacagggccaggatgtcgcgcctccacccaatcctgttccccagcgaacctcccccaccggccccaagaacatgcagacgagtgggcggctcagcaacgtggcaccaccttgtatactgcgcaagaatcctccttctgcgaggaacgggggccacgagacagacgcccagattttggaactcaaccagcagctggtggatctgaaactcaccgtggacggacttgaaaaggaacgcgacttttacttcagcaaattgagagacatcgagctaatctgccaggaacatgagagcgaaaactcaccagtgatttccggtatcataggcatcctctacgcgactgaagagggatttgctccaccagaggatgatgagatcgaagagcaccagcaagaagaccaagacgagtattag

SEQ ID NO: 195191 - DNA, 657 bp, Artificial Sequence
  Description of Artificial Sequence: Synthetic coding sequence
atggccgtgaacgtgtacagcaccagcgtgaccagcgagaacctgagcaggcacgatatgctggcatgggttaatgatagtctccatcttaactatactaagattgaacagctttgctctggagccgcgtactgtcagtttatggatatgctgttcccagggtgcgttcaccttcggaaggtaaagtttcaggccaaacttgagcacgagtatattcataactttaaggtattacaggcagcatttaagaagatgggcgtcgataaaattatacccgtggaaaagctggtgaagggtaaattccaggacaacttcgaattcattcagtggtttaaaaagttctttgatgccaattacgatgggaaggactataacccacttctcgcccgccaaggccaggatgttgcacccccccccaaccctggcgatcagatttttaataaatcaaagaaactgatcggcacagccgtgccacagcggaccagccctaccggccccaagaatatgcaaacatccggccgcctgagcaatgtggcgcccccctgtatactccggaagaacccccctagcgctagaaatggcggtcatgaaaccgacgctcaaatattggagcttaaccagcagctggtcgatctcaagttgaccgtggacggctag

SEQ ID NO: 195192 - DNA, 2004 bp, Artificial Sequence
  Description of Artificial Sequence: Synthetic coding sequence
atggagaccctggagagcgagctgacctgccccatctgcctggagctgtttgaagatccgctgctgctgccctgtgcgcactccctgtgtttcaattgtgctcacagaattctcgtttcacactgtgctactaacgagtctgtagaaagtatcacagcattccaatgccccacctgcaggcacgtaataacgctgagccaaagaggacttgatggtctgaagagaaacgtgaccttgcagaacattatcgatcggtttcaaaaagcttctgtgtctggccctaactctcctagtgagacgcggagggaacgggccttcgatgccaacaccatgacaagtgccgagaaggtcctctgccagttttgtgatcaggacccagcccaggatgcagtaaaaacatgcgttacctgcgaggttagctactgtgacgagtgtctgaaggctactcatccaaataaaaagccgtttactggccatcgtcttattgagcccatccccgatagccatatcagaggtttgatgtgcctggagcacgaggacgagaaagttaatatgtactgtgtgacggatgatcagttaatctgcgcgctgtgcaaactcgtgggccgccatcgggaccaccaggtcgctgccctgtcagaaaggtacgacaagctaaaacagaacctcgagtcaaacctgaccaatctcattaagcggaatacagagctggagacgctcttggctaagctgattcaaacatgtcaacatgtcgaggtgaatgcctcccgtcaggaggctaagctcacagaagagtgtgatctattaatcgagatcattcagcagcgacggcagattatagggacgaagattaaggaggggaaagttatgagattacgcaagctggcccaacagatcgctaactgtaaacagtgcattgagcgctccgcctctctcattagtcaagcagaacattctctgaaggagaatgatcatgcccggtttttgcagacggctaagaatatcacagaaagggtctccatggccactgcgtcctcacaggtcctgatccccgaaatcaatctcaacgatacattcgacacttttgccctggacttctcaagggaaaaaaaactgcttgagtgtctggactacctgaccgctcctaatccccctaccattcgagaggagctgtgcacagcctcatacgacaccatcacggtgcattggacaagtgatgatgagttttccgtagtgtcatatgaactccagtacacaatcttcacgggacaggccaatgttgtctcattgtgcaatagcgctgattcgtggatgatcgtgcccaatattaagcagaaccactacactgtgcacgggttgcagtctgggacaaagtacatcttcatggtgaaggccataaaccaagccgggtcccgaagttccgagccaggtaagttgaaaacgaattctcagccattcaagttagaccctaagagcgctcataggaagctcaaagtgagccacgataatttaacagtggaacgcgacgaaagttcaagtaagaaatcacacactcccgaaaggtttaccagccagggaagctacggcgtagccggtaatgtgtttattgattcaggtcggcactattgggaagtggtgatctccgggagcacttggtatgccattggcttagcatataaatcagcacctaagcacgagtggattggtaagaattcagcgagttgggccctgtgtcgctgtaataataactgggtggtgaggcataattccaaagagatccccatcgagcctgcacctcatctgcggagggtcggaattttgctggattacgacaatggttccattgcgttctatgatgccctgaactccatccacctctacacatttgatgtggccttcgcccagcctgtgtgtcctacgttcacagtgtggaataaatgccttacaatcattacgggcctcccgatcccagaccaccttgactgtacagaacagctcccttag

SEQ ID NO: 195193 - DNA, 2004 bp, Artificial Sequence
  Description of Artificial Sequence: Synthetic coding sequence
atggagaccctggagagcgagctgacctgccccatctgcctggagctctttgaggatcctttactgctaccttgtgcccactcactatgcttcaactgtgcccatcgcatcctagtgagtcactgtgctacaaacgagtcagtggagagtattaccgccttccagtgcccgacgtgtcgccatgtgattacgctgagccagagaggtctcgacggcttgaagcgaaacgtgactctgcaaaatatcatagacagatttcagaaggcgagtgtaagcggacctaacagcccttcagaaaccaggagggaaagagcgttcgatgccaacacaatgaccagtgcagagaaagtgctttgccagttttgcgaccaggacccagcacaagatgcagtaaaaacctgcgtgacctgtgaggtgtcctactgcgacgaatgtttgaaggccacacatcctaacaaaaaaccctttaccggccatagactgatcgaaccgattcccgatagtcacatacgaggattaatgtgcctcgagcacgaggacgagaaagtaaacatgtattgcgtgacggacgatcaactgatttgcgccctgtgcaagctggtaggaaggcaccgcgaccatcaagtggcggccctgtcagaaagatacgataagctgaagcagaatttggaatcgaacctcaccaatctcattaagcgcaacacagaactcgagacgctgttagccaaactcatccagacatgtcagcacgtggaggtcaacgcaagtaggcaagaggcaaagcttacagaggaatgcgacctgttgatcgagattatacaacagcggcgtcagattataggaactaagatcaaggagggcaaagtgatgcggctccgcaaactggcacagcagattgccaactgcaaacaatgcattgaacggtccgctagcctgatctcccaagctgagcactctttgaaggaaaacgatcatgcccgcttcctccaaacagctaaaaacattacggagcgggtgtccatggctacggcctcatctcaggttttgatccctgaaattaacctaaatgacacctttgacacctttgcactggacttttcgcgggagaaaaaactgctcgagtgcctggattatctgacagcccccaatccacctactatccgtgaagaattatgtacagctagctacgacactatcacagtgcattggaccagcgacgacgagttctccgtcgtctcatatgagctccagtacacgatctttacaggccaggccaatgttgtgtcactgtgtaactccgcggatagctggatgatcgtgcccaatataaaacaaaaccactacacggtgcatggcctccaatccggcactaaatatatttttatggtgaaagcgataaaccaggctggatcaagatctagtgagcccggtaaacttaaaaccaactctcagccgtttaaactggacccaaagtcagctcatcggaaactgaaagtgagccacgacaatcttacagtcgagagggacgagagtagtagcaagaagagccatactccggagaggtttacttcacaagggtcttatggcgttgcgggaaatgtttttattgattccgggcgacactattgggaagtggtaattagcggaagcacgtggtacgcaatcggcttggcatacaaatccgcccccaagcatgagtggatcggaaagaacagcgcgtcatgggccctctgccgttgtaacaacaactgggttgtccggcataattctaaagaaattccaatagagcctgccccacacctgcggcgcgtcgggatcctcctagattatgacaacgggtcgatcgccttttatgacgcactgaattctatccacctgtacacatttgacgtcgctttcgcccagccggtgtgccccactttcaccgtgtggaataaatgtctgactatcattaccggcctacctataccggaccatctggactgcactgagcaactcccctag

SEQ ID NO: 195194 - DNA, 2004 bp, Artificial Sequence
  Description of Artificial Sequence: Synthetic coding sequence
atggagaccctggagagcgagctgacctgccccatctgcctggagctctttgaggaccccctgctgctgccctgcgcacactccctttgcttcaactgtgctcaccgcatccttgtgtcccactgtgctactaacgagtccgtagaatcaattacagcattccagtgcccaacatgccgccatgtgataaccttgtcccaaagagggctcgatggactaaagcgtaacgtgactttacagaatattatcgatcggttccaaaaggccagtgtgagtgggcctaactcaccctctgaaactcgaagggaaagagcgttcgatgccaataccatgacgtctgctgaaaaggtcctgtgtcagttctgcgatcaggaccctgcccaagacgctgttaagacatgtgtcacctgcgaagtctcctactgcgacgagtgtctcaaagcaacgcacccaaacaaaaaacccttcactggccacagactgatcgaaccaatccccgatagccacattcggggtctcatgtgcctggaacacgaggacgaaaaagtgaacatgtattgtgtgactgatgaccaactgatctgtgccctgtgtaaacttgtaggccgtcaccgggaccaccaggtcgccgccctttcagaaagatacgacaagctgaaacagaatctagagtcaaatcttactaatcttatcaaacgcaataccgagcttgagaccctgctcgccaagctcatccagacttgccaacatgtggaagtaaatgcaagcagacaggaggccaaactgacagaagaatgcgatttgttgatcgagataatccagcagagacgccagatcataggcacaaagataaaagagggtaaagtgatgcgtctgcgaaaactggcccaacagatcgcgaattgtaaacagtgtatcgaaagaagtgcgagcctgatttctcaggccgagcactctctcaaggagaatgaccacgctcggtttctgcagacagcaaaaaacataacagagcgagtgagcatggcaacagcaagctcacaggtgctgatacctgagattaatctaaatgacacattcgacacctttgcattggatttttcaagggaaaagaagctcctcgagtgtctggactatcttactgcaccgaacccccccaccattagagaggaactgtgcaccgcctcttatgacacaatcactgtgcattggacgagtgacgacgaatttagcgtggtctcttacgagctgcagtacacaatctttaccggtcaagcgaatgtcgtgtcattgtgtaactcggcagatagttggatgattgttcccaacattaagcagaaccactataccgtgcacggattgcagagcggcaccaaatatatctttatggtgaaggccattaaccaggctggttcacggagctctgaacctggtaagttaaagaccaacagtcagccatttaagttagatcccaagtccgcccaccggaaactcaaagtgtcccatgacaatcttacagtcgaacgggacgagtcttcttctaaaaaatcccacactcccgagcgctttacctcacagggaagctatggggtggcggggaacgttttcatagattcagggcgccactactgggaggtcgtcatcagcggctcaacctggtacgctatcggacttgcgtataagtccgcacccaaacatgagtggattggcaagaactcagcatcatgggccctctgccggtgtaacaataattgggtggtgaggcacaatagtaaggagataccaatcgaaccagccccccaccttcggagggtagggatcttattagactatgacaacgggagtattgccttctacgacgctcttaattccatccacctctatacattcgacgttgccttcgcccagccggtgtgtccaacattcaccgtgtggaataaatgtctgaccatcatcaccggtctgccgattcccgaccacctggactgcacggaacaactaccatag

SEQ ID NO: 195195 - DNA, 1659 bp, Artificial Sequence
  Description of Artificial Sequence: Synthetic coding sequence
atggagaccctggagagcgagctgacctgccccatctgcctggagttattcgaagatccactgctgctcccctgtgctcactctctgtgcttcaattgtgcgcataggatcctggtgagccactgcgccaccaacgagtctgtggagtccattaccgcctttcagtgtcctacttgtcggcacgttattactctctctcagcgcggtctcgacggactgaaacgaaacgtcacactccagaacatcattgacaggtttcagaaggcatccgtgagcggcccgaattcacccagtgagaccaggagggagagagccttcgatgctaataccatgacatcggctgagaaagtcttatgccagttctgcgatcaggatcccgcacaggacgccgtgaaaacttgcgtgacttgcgaggtgtcatattgtgatgagtgcttgaaggcaacgcacccaaacaaaaagccattcacgggccatcggcttatcgagcccatcccggacagccatatccgcggcctgatgtgcctggaacacgaggatgaaaaggtaaacatgtattgtgtgaccgatgatcagctcatttgtgcactgtgtaagctcgtagggaggcacagagatcaccaagtcgccgccctgtcagaacgctacgataaactcaaacagaatttggagtcaaatctcaccaatcttatcaagcgcaatacggaactggaaacgttgcttgctaagcttattcagacttgccagcacgtcgaggtaaatgcctctagacaggaggccaagttaactgaagagtgcgatctgctgatcgagatcatccagcaacgccggcagattattgggaccaagatcaaggaggggaaagtgatgcggcttcgaaaactggcacagcagatcgctaactgcaaacagtgtatcgagcggtcagcaagccttatctcccaagcagagcattccctcaaagagaatgaccacgctagattcctgcagactgccaaaaacattaccgaacgggttagtatggcgacggccagttctcaggtgttgatccccgaaatcaacttgaatgacacttttgacacattcgcccttgattttagcagagagaaaaagctgctagagtgtctcgattatctaactgcacccaatcctccaacaattagagaagagctttgtaccgcttcctacgataccattaccgttcactggaccagcgatgacgagttttcggtggtgagttacgaacttcagtacacaattttcacagggcaggccaacgtggtttccctgtgcaactctgccgacagttggatgatcgtaccaaatatcaagcaaaaccactacactgtgcacgggctgcagagcggaacgaaatacatcttcatggtcaaggccataaatcaggctgggagtagatcatccgagcccgggaagctgaagacaaactcccagccttttaagctggatccaaagtccgcccacagaaagctgaaggttagtcacgacaatctgacagtggaaagggatgagagctcctccaaaaagtctcacacccctgagaggttcacaagtcagggaagctatggggtagcgggcaacgtgtttatagactccgggcggcattactgggaagttgtcatctctgggtccacctggtag

SEQ ID NO: 195196 - DNA, 2004 bp, Artificial Sequence
  Description of Artificial Sequence: Synthetic coding sequence
atggagaccctggagagcgagctgacctgccccatctgcctggagctcttcgaggacccgctcctgctgccttgcgcccattctctgtgttttaactgcgcgcataggatcctggtaagtcactgtgctaccaatgagtcagtagagtccatcacagctttccagtgccccacctgccgacatgtgatcaccctgagtcagcgcggcctggacggcttgaagcggaacgtgactctgcagaatattatagacaggtttcagaaggcgagcgtcagtggccccaattcaccatccgagacacggagggagcgagcgtttgatgctaacactatgacgagcgcggagaaggttctgtgtcagttttgtgatcaagatccggctcaggacgcggttaaaacctgtgtaacctgcgaggtgagttattgcgatgaatgtctgaaggcaacacatccgaataaaaagcccttcacaggccaccggctcatcgaaccaattccggactcccatatcagagggctaatgtgcctggaacatgaggacgaaaaggttaatatgtactgcgttaccgacgatcagcttatttgcgcgctgtgtaagctggtgggaagacatcgggaccatcaggttgccgcactctcagagcggtatgacaaactaaaacagaatctggagtctaatctaacaaacctgataaagcgtaacaccgagcttgagaccctcctggcgaagctcattcaaacatgccaacacgtggaggtgaatgcatcacgccaggaagccaaactgaccgaggagtgcgatttgctgatagaaattatacagcagcgtcgccaaatcattgggacgaaaatcaaagagggcaaagttatgcggctcaggaagttggctcagcagattgcaaactgcaagcaatgcattgagcgctctgcaagcctgatctcacaagctgaacactcactgaaagaaaacgaccatgcccgttttttgcagaccgccaagaacattactgaaagagtttcaatggcaactgccagcagtcaggtcctgatccccgagattaatctgaatgatacctttgatacctttgctttggattttagccgtgaaaagaagctgcttgagtgcctagattacctgactgccccaaacccccctactattcgagaggagctgtgtaccgcctcttacgatacaatcactgtgcattggacaagtgatgatgagttctccgtggtgtcgtacgaactccaatatacgatattcactggacaggctaatgtcgtttcactgtgcaactctgccgatagctggatgattgtgccaaatattaaacaaaatcactatactgtgcacggcctgcagagtgggactaagtacatttttatggtgaaggctatcaatcaggcaggctcccggtcttcagaaccaggcaaactaaagactaattctcagcccttcaaacttgacccaaagtccgcacacaggaagttgaaagtcagccatgacaatctgactgtggaacgagatgagtcttcgagcaagaagtctcatactcctgagcggttcacatctcaggggagctatggagtggctggtaatgtttttatcgactccggccggcactattgggaggtggtcattagtgggtccacctggtatgccatcgggctggcctataaaagtgcaccgaagcacgagtggatcggcaagaactcggcgtcttgggccctctgtaggtgtaataacaattgggttgtaaggcacaattctaaggagatccccatcgaacccgcaccgcatttgagacgtgtggggattctgctagattatgacaacgggtccatcgccttttacgacgctctgaacagcatccatctatataccttcgacgtggcttttgcacaaccggtgtgtcccacttttacagtgtggaacaaatgccttacgattatcaccggcctaccaataccagaccacctggactgcacagaacagttaccgtag

SEQ ID NO: 195197 - DNA, 2004 bp, Artificial Sequence
  Description of Artificial Sequence: Synthetic coding sequence
atggagaccctggagagcgagctgacctgccccatctgcctggagctttttgaagacccattgcttctcccttgcgcacacagcctctgctttaattgcgcgcaccgaattcttgtgtcccactgcgctacgaacgagagcgttgagagcataactgcatttcagtgccctacttgcaggcacgtgattacccttagtcagcggggcctcgatggtcttaaaaggaacgttacccttcagaatatcatcgatcggttccagaaagcctctgtgtctggacctaacagtccgagcgaaaccagaagggagcgcgctttcgatgccaacacaatgacatccgctgaaaaggtgctgtgtcagttctgtgaccaagaccctgcccaggacgccgtcaagacttgtgtgacatgtgaggtgtcttactgtgacgagtgtctgaaagctactcaccctaataagaaaccatttaccggccacaggctgatcgagccaatcccagattcacatatccgggggttgatgtgtctcgaacacgaagacgagaaggtgaacatgtactgcgttactgacgaccagctgatctgtgccctgtgcaaactcgtgggaaggcatagagatcaccaggtcgcagctctgagcgagaggtacgacaagctgaagcaaaatcttgagtctaacctgaccaacctaatcaagaggaacacggaacttgagaccctgctggcaaagctgatccagacatgccagcacgtggaggttaatgcctcccgacaggaagccaagctcactgaagaatgcgaccttctgatcgagattattcaacagaggaggcagattattggcaccaagattaaagagggtaaggtgatgagactacgcaaattagcccagcagatagcaaattgtaagcaatgcattgaacgcagtgcttccctgatttcccaggctgagcactcacttaaagaaaatgaccacgccaggtttctacagaccgccaagaacataacagaaagagtgtctatggccaccgcctcgtcccaggtcctcatccccgaaattaacttgaacgataccttcgacacatttgcattagatttcagccgagaaaagaagctgctggaatgcctggattacctgaccgctcctaacccacctaccattagggaggagttgtgtacagccagttacgacaccattacagtgcactggacctccgacgacgagttttcggtggttagttatgagctgcaatacacaatcttcacagggcaggctaatgtggtctcgctgtgtaactccgccgattcttggatgatcgttcccaatattaaacagaatcattacacagtgcacggcttgcagagcggcactaaatatatttttatggtgaaagccatcaaccaggccgggtctaggtccagcgaaccaggcaaattgaagactaattcgcagccattcaaacttgaccctaaatccgcacaccggaaactgaaagttagccacgacaatttgaccgtcgagcgcgatgaatcttcctcaaagaaaagtcacacccccgagcgcttcacctcccaaggctcatacggagtggctggaaatgtattcatcgattctggaaggcactactgggaagttgtgatatctgggtctacttggtacgcgattgggttagcctataaatcagcccctaaacatgaatggatagggaaaaactctgcatcctgggccctttgccgctgcaacaacaattgggtagtaaggcataatagcaaggaaattcccatcgaaccagccccccatcttcgacgggtaggcattctcctggactacgataatggaagcattgcgttctatgatgcgctgaacagtatacacctgtatacgtttgacgtggctttcgcacaacctgtatgtcccacctttaccgtgtggaacaagtgcctcacaataatcaccgggctcccgatccccgaccacctggattgtaccgaacagttaccttag

SEQ ID NO: 195198 - DNA, 1452 bp, Artificial Sequence
  Description of Artificial Sequence: Synthetic coding sequence
atggagaccctggagagcgagctgacctgccccatctgcctggagcttttcgaggaccctctcttgctcccctgcgcccacagcctgtgtttcaactgtgcacatcgtattctcgtgtcacactgcgctactaatgagagtgtagagtccataactgcctttcagtgtcccacttgcagacatgtcatcaccctttctcagaggggcttggacggtctcaagcggaatgtaacactccaaaacatcatcgatcgattccaaaaagcatccgtgagcggaccaaattctccttctgagacccgaagagaaagagcattcgacgccaataccatgacttctgccgaaaaagtgctgtgccagttctgcgatcaggatccggcccaagacgctgtgaaaacttgcgttacctgcgaggtgagctattgtgacgagtgcttgaaagcgactcatcctaataagaaaccattcacaggccataggttgatcgagccgatccccgacagtcacattcgaggcctaatgtgtctcgagcacgaggacgagaaggttaacatgtattgtgtgacagatgatcagttgatctgtgccctttgtaaattggtgggccgtcatagggaccatcaagttgcagctctctcggagaggtatgacaagttgaagcagaaccttgagtcaaatctgactaacctgatcaaacggaacaccgagttggaaacactcctggctaagctcattcagacatgccagcacgtggaagtcaatgccagtcgtcaggaggccaaactgactgaagaatgtgatctgctgatcgagattatccagcaacgtagacagataattgggactaaaatcaaagaaggcaaggtgatgcgactgcgtaaattggcacaacagatcgccaactgcaagcagtgtatcgaacggagcgccagcctgataagtcaggccgagcactcactgaaagaaaacgaccacgcacgttttctgcagacagcaaaaaatatcactgagcgagttagcatggccactgctagctcccaggtgctcattccagaaataaatttgaatgacactttcgatacatttgccctagactttagcagggagaagaagctgcttgaatgcttagactatctaaccgcacccaatccacccacaatccgagaagagttatgtacagcgtcttatgacacaattaccgtgcactggacatctgatgatgaatttagcgtggttagctacgagctgcagtacaccatctttactggacaggctaacgtggtttctctttgcaacagcgccgattcctggatgattgtccccaacataaagcagaatcactataccgtccacgggctgcagagcgggactaaatacatcttcatggtcaaagccattaatcaagccggctctaggtcaagtgagcccggtaaactgaaaactaactcttag

SEQ ID NO: 195199 - DNA, 594 bp, Artificial Sequence
  Description of Artificial Sequence: Synthetic coding sequence
atggagaccctggagagcgagctgacctgccccatctgcctggagctgttcgaggaccctctactgctgccctgtgcgcactccttgtgttttaattgcgcacatagaatcctcgtgtcacattgtgccacaaacgagtctgtggaaagcattaccgcattccaatgcccaacatgtcgccacgtcataactctgtcccagaggggcctcgatggtctcaaaagaaacgtcaccctgcagaacatcatagaccgttttcagaaagcctcggtaagcggccctaattcccccagcgaaacacggcgagaacgagccttcgatgcgaacacaatgaccagcgctgagaaagtgctatgtcagttctgcgaccaggatccggctcaggatgccgtcaagacctgcgtaacgtgcgaggtctcttattgcgacgagtgtctgaaggcaacccatcctaataaaaaaccctttaccgggcacaggttgatcgagcccatccctgatagccatatccggggtctgatgtgcctggagcacgaagatgagaaggtcaatatgtattgcgtgactgatgaccagcttatttgcgcactgtag

SEQ ID NO: 195200 - DNA, 2004 bp, Artificial Sequence
  Description of Artificial Sequence: Synthetic coding sequence
atggagaccctggagagcgagctgacctgccccatctgcctggagctgttcgaggacccactgctcttgccttgcgcacacagtttgtgttttaactgtgcccatcggatactggtgtctcattgcgccaccaacgagtctgtggagtctataacagcctttcagtgtccaacgtgtagacacgtgatcaccctctcccaacgtggactggacggactgaagaggaatgtcacccttcagaacattatcgatcgcttccagaaggcgtcggtgagtggccccaatagtccttctgagacaagaagggagcgggccttcgacgctaataccatgacatctgccgagaaggtgctgtgtcagttttgcgatcaggaccctgcccaggatgcggttaagacttgtgttacgtgcgaggttagctattgtgacgagtgtctgaaggcgacccatccaaataagaagccctttactggacatcggctgatcgaacccatcccagatagtcatatcagaggactcatgtgcttagagcatgaggatgaaaaggtaaatatgtattgtgttacagacgaccaattaatatgcgcactatgtaagctcgtggggaggcatagagaccaccaagttgccgccctgagcgagcggtatgataaattaaagcaaaacctggaatctaatctgaccaatttaattaaacgtaatactgaactggagacactgctcgccaagctgatccagacctgccaacatgtggaggtgaatgcctcgaggcaggaagccaagctcaccgaggaatgtgacttgcttatcgaaatcatccagcagcgcagacagattatagggactaaaattaaagagggtaaggttatgcgattgaggaagctggcacagcagatcgctaactgtaagcagtgtatcgaacggtcagcatctctgatatcacaggctgagcattccttgaaggagaacgaccacgcccgattcctgcagactgccaagaatattaccgaacgagtctccatggcaacagcgtctagccaggtgctgatccctgagattaacctcaatgacacgtttgatacctttgctctcgacttttcccgtgaaaaaaaattgctggaatgtttggattatttgactgccccaaaccctcccactatccgggaggagttgtgcactgctagttacgatacaattactgtgcattggacatccgatgatgaattttcggtcgtgagttatgaactccaatatactatctttaccggccaggcgaatgtagtttccctatgtaactctgccgatagctggatgattgttcctaatatcaaacagaaccactatactgtccatgggctgcagtcgggaaccaaatacattttcatggtgaaagccatcaatcaggctggctctcgatctagtgaaccaggtaagctgaaaaccaattcacagcccttcaaacttgatcccaaaagtgcgcatcggaagttgaaggtctctcacgataaccttactgtagagcgcgacgagagttcttcaaaaaaaagccacacgcccgaacggtttactagccagggttcctacggcgttgcaggcaacgtgttcatcgacagcggacgccattattgggaggtcgtgatcagcgggtctacatggtatgcaattggtctggcgtataaatccgcgccgaagcatgaatggatcggtaagaactcagcaagttgggccctgtgtcgttgcaataataattgggtggtaagacacaatagcaaagagattccaatagagccagccccacacctgcggcgagtgggaatcctgctcgattacgataatgggtccattgctttctacgatgctctgaactcgatccacctctatacattcgacgtagcgttcgcccagcctgtctgcccgactttcacagtctggaacaaatgccttactatcatcaccgggctccccattcccgaccatctggactgcacagaacagctgccctag

SEQ ID NO: 195201 - DNA, 1854 bp, Artificial Sequence
  Description of Artificial Sequence: Synthetic coding sequence
atggagaccctggagagcgagctgacctgccccatctgcctggagctgttcgaggaccctctgctgctgccatgcgctcatagcctctgctttaactgtgctcatcgaattctagtatcacattgcgccacgaatgagtcagttgagagtattacggccttccagtgcccaacatgccgacacgttataacactctcgcagcggggcctggacggccttaagcgcaacgtgaccctacagaacataatagaccgattccagaaagccagcgtatccggccctaactcccccagtgagacttctgccgagaaggttctgtgccagttctgcgaccaagatcccgctcaggacgctgtcaagacctgtgtaacatgcgaagttagttactgtgacgaatgcttaaaggccactcatccgaacaaaaagccctttacggggcataggctgatcgaacccatcccagattcgcatattagaggtctcatgtgcctcgaacatgaagatgagaaacagaaccttgaatctaacctcacaaatctaataaagagaaatacagaactcgaaactctgctcgccaagttaatccagacatgccagcacgttgaggttaatgctagtcgccaggaggcaaagctaacagaagagtgcgatctgcttatagaaatcatccagcaacgcagacaaatcatcggaacaaagatcaaggaaggcaaagttatgcgcttgcgcaagctcgctcagcaaattgcgaattgtaagcagtgtatcgaaagaagtgcctctctgatatcccaggcagagcactctctcaaagagaacgatcatgccaggttcttacaaaccgcaaaaaatatcaccgaaagggttagtatggcaacagctagcagtcaagtcctgattcccgaaattaatcttaacgacaccttcgataccttcgctctggacttctctagagagaagaaactgttggagtgcctggattatttaactgctccgaatccacccacgattagggaagagctgtgtactgctagctatgatacaatcacggtccattggacaagtgacgacgaatttagcgtggtgagctatgaactacagtacactatctttactgggcaagcgaacgtggtgtcactttgtaactcagcggatagctggatgatagtgccaaacataaagcagaatcactatactgtgcacggcttacagtctggtactaaatacattttcatggtaaaggccataaaccaagcagggtctcgctcttccgagcccggcaagctgaagacaaattcacagccctttaaacttgatcccaagtccgcccacaggaagcttaaggtctcgcacgataacctgacagtggaacgagatgaaagtagttcgaagaagagtcacacccccgagcgcttcacatcacaagggagttacggggtggccggcaacgtgtttatcgattcgggccgccattattgggaagtcgttatttctggaagcacatggtatgccattggtttggcgtataaatccgcacctaaacacgagtggatcgggaagaattctgcatcttgggccttgtgccgctgcaacaataactgggtagtgcggcacaatagtaaagaaataccgattgaacctgctccccaccttagacgcgtgggcatcctgctcgactacgacaatggctcaatcgccttttatgatgcactcaactctatccatctctacaccttcgacgtcgcctttgcccagcctgtgtgccctaccttcactgtatggaataaatgtttgaccataatcacaggtcttcccatccctgaccaccttgattgcaccgaacagttaccatag

SEQ ID NO: 195202 - DNA, 2208 bp, Artificial Sequence
  Description of Artificial Sequence: Synthetic coding sequence
atgggcgagagccccgccagcgtggtgctgaacgccagcggcggcctgttctcgcttaagatggaaactctggaaagcgagctgacatgccctatctgtctggaattgtttgaggatccactgctcttaccctgtgctcacagcctatgtttttcgtgcgcgcacagaatcttagtctcttcatgttcttcaggggagtccatcgagcccattaccgcatttcagtgtcccacttgccggtacgtcatttcactcaaccataggggactggacggactcaagaggaacgtgactctgcagaatattatcgatcgcttccagaaggcctcagtcagcggccccaattctccatctgagtctcggcgggagcggacctaccggccaactaccgcgatgagtagcgagagaatagcctgccagttttgtgagcaggatcctccacgcgatgcagtcaagacatgtattacctgcgaggtaagctactgtgatcgttgtctgagagcaactcaccccaataaaaagcccttcacctcccacagattagttgagcctgtgccagacacacatctgcgcggcatcacatgtttggaccacgagaatgaaaaggtcaacatgtactgtgtttcagacgaccaactcatctgtgctttgtgcaaacttgtcggaaggcacagagaccaccaggtcgcctctctgaacgatagattcgaaaagctgaaacaaaccctggaaatgaacttaactaatttggtgaagagaaactcagagctcgagaatcagatggcaaaactcatccaaatttgtcagcaggtcgaggtcaacacggccatgcacgaagcaaagcttatggaagaatgcgacgaactggtggaaatcattcaacagcgaaagcagatgatcgcagttaaaattaaggagaccaaagtgatgaagcttcgcaaattggcccagcaggtggcgaattgtcgacaatgcctggagaggagcactgttctgatcaaccaggcagagcatatcctgaaggaaaacgatcaagctcgtttcctgcaatcagccaaaaatatcgccgagcgagtagccatggcaacagctagttcgcaggtgctgatacccgacatcaattttaacgacgctttcgaaaattttgccctagacttctccagagaaaaaaagcttctggaaggcctggattacctgacagcacctaaccccccctcaattagggaggagctgtgtacagccagccatgacaccattactgtgcattggatcagtgatgacgaattctcaatctcttcctacgagcttcagtacactatctttaccggccaagctaattttatctctaagtcttggtgttcgtggggcctgtggcctgaaatccggaagtgtaaagaggctgtctcatgtagcaggctggcaggcgctccgcgcggactgtataactcggttgactcatggatgattgtgccaaatattaagcaaaatcactatactgtgcacggcctccaaagcgggacacgctacattttcatcgttaaggccattaatcaggcgggttccagaaatagcgagcccacccggttgaagacaaatagccagccttttaagctggatccaaagatgacccacaagaaactgaagatcagcaatgatggtcttcaaatggagaaagacgagtccagtctgaaaaagagccataccccagagcgcttttcaggtactgggtgctacggtgccgccggtaacattttcatcgattccggctgtcactattgggaagtcgtgatgggcagttctacttggtacgctatcggcatcgcctataaaagcgctcctaagaatgagtggattggcaagaacgcctcttcctgggtgttttctcgctgcaatagcaactttgtcgttcgtcacaataacaaagagatgctggtggatgtgccacctcacctgaagcgcctcggcgttctgcttgattatgacaataacatgctatcgttctacgaccccgctaactccctccacctccacaccttcgacgttacattcatactccccgtgtgccctacttttacaatttggaacaagtccctaatgattctttctggtttaccagcccccgatttcattgattaccccgaacggcaagagtgtaattgccgcccgcaggagtcgccttatgttagcggcatgaagacctgccactag

SEQ ID NO: 195203 - DNA, 2118 bp, Artificial Sequence
  Description of Artificial Sequence: Synthetic coding sequence
atgggcgagagccccgccagcgtggtgctgaacgccagcggcggcttgtttagcctgaagatggagaccctcgagagcgaactgacctgcccaatatgtttagaactctttgaagatcctctcctgttgccctgcgcccacagcctgtgtttttcctgcgcccatcggatattagtgagttcttgctcctcaggggaatctattgaacccataactgcttttcaatgtcccacatgccgatatgtcatatccttgaatcacaggggactggatggactgaagagaaatgttactctccagaatataattgacagattccagaaagcttctgtatccggcccgaattctccttctgaatctaggcgtgaacgtacctataggcctacaactgccatgagttccgaacggattgcttgccagttttgtgaacaggacccgccccgagatgcagtgaagacgtgcatcacgtgcgaggtctcttactgcgaccgatgtctacgggcaacacatcccaacaagaagccgttcacatctcacaggttggttgagccagtacctgatacacacttgagaggaattacctgcctggatcatgaaaacgaaaaggtgaatatgtactgcgttagtgatgaccagcttatctgtgctctgtgcaagctcgtcgggcgtcacagagaccatcaggtagcttcactgaacgacagatttgaaaagctcaagcagactctcgagatgaacttgactaacctggtgaaacgaaacagcgaactggagaaccagatggccaagctgatacagatttgtcaacaggtggaggtgaacactgccatgcacgaggctaaactcatggaggaatgcgacgaattggtcgagataatccaacagcgcaaacaaatgattgccgtgaaaataaaagagaccaaggtgatgaagttaaggaagctcgcccagcaagtggctaattgtagacagtgcctggagcgctccaccgtgttgattaatcaggcagaacacattctcaaggaaaacgatcaagctaggttcctccagagtgccaagaacatcgcagaacgagtggccatggcaactgccagtagccaggtgctcattccggacattaatttcaatgatgcatttgaaaactttgcactcgacttcagccgtgagaaaaagctcttagaggggctggactacctcacagctccaaacccaccaagtattcgagaggagctctgcacagcctcgcatgatactattacagtgcactggatttcagacgacgaatttagcatttcttcatatgaacttcaatatacaatcttcaccgggcaggccaacttcatctcactctacaattccgtggactcctggatgatcgtgcctaacataaaacagaatcattacaccgttcacggcctgcagtctggcaccaggtatatctttattgtcaaggcgattaatcaggcaggctcacgaaattccgagccaacaaggttgaagacaaattcccagccctttaagctggatccgaaaatgactcacaagaagctcaagattagtaatgacggcttgcagatggagaaggatgagagtagtttgaaaaaaagtcacacccctgagcgcttctcaggaactggatgctatggggcggcaggaaatatctttatagacagcggatgccattactgggaggtggttatgggctcttctacttggtacgccataggtattgcttacaaatcagctccaaaaaacgaatggatcggtaaaaatgcctcatcctgggtgttctcaaggtgtaactccaattttgtggttaggcacaacaacaaggagatgcttgtggatgttcctccgcacctgaagcgcctcggggtgctgttagactacgataacaatatgctcagcttttatgacccggccaattctctgcacttacacaccttcgacgtgaccttcatcctgcctgtatgccctacattcactatttggaacaagtctctaatgatcctgagcggcctacctgcccccgacttcatagactaccctgagcgccaggagtgtaactgtagaccacaggaaagcccatatgtgtcagggatgaaaacgtgccactag

SEQ ID NO: 195204 - DNA, 660 bp, Artificial Sequence
  Description of Artificial Sequence: Synthetic coding sequence
atggagaccctggagagcgagctgacctgccccatctgcctggagctattcgaggacccattgctgctcccctgcgctcacagtctgtgtttctcatgtgcccacagaatactggtcagtagctgtagcagcggggagagtatcgagccaatcacagcctttcagtgtcccacctgccggtatgttattagtctgaaccacagaggcttggacgggttgaaaagaaatgtcacactacaaaatataattgatcgatttcaaaaggcgtccgtatctggacctaattcccccagcgagtctcgtcgcgagcggacctacagacctaccaccgcaatgtcttctgagagaattgcttgtcagttctgtgagcaggatccaccaagggatgcggtgaaaacctgtatcacctgtgaggtttcatattgtgacaggtgcctaagggctacacaccccaataagaaaccattcacatcccataggctcgtggagcctgttcccgacacccatctgagggggatcacttgtctggatcacgagaacgagaaagtcaatatgtactgcgtctccgacgaccaactgatctgtgccctctgtaagcttgttgggcggcatagagatcatcaagtggcttcactgaatgatcggttcgagaagctatag

SEQ ID NO: 195205 - DNA, 1407 bp, Artificial Sequence
  Description of Artificial Sequence: Synthetic coding sequence
atggagccccagcccggcggcgcccggagctgccggcggggcgcccccggcggagcctgcgagctcggacctgctgccgaagctgctccaatgtccctagcaatccatagcaccaccggaacgcgatatgacctggcagtgccaccggacgaaactgtagaagggctaagaaagcggttatctcagaggctgaaggtgccaaaggagcgcctagccctgctgcacaaggacactcgtttgagtagcggaaagctgcaggaattcggtgttggagatggttcaaagcttactctagtcccgacagtggaagccggccttatgtcccaggcaagtcgtcccgaacagtccgtgatgcaggccttggagtctttaactgaaacccaggtttctgattttctcagcggccgctctcccctcactcttgccctgagggtgggggaccatatgatgtttgtgcaacttcagttggccgcccagcatgccccgctgcagcaccggcatgtcctggcagccgccgccgccgccgccgcagcccgtggcgatcccagtatagcctcgccagtgagctcgccttgccggccagtcagcagtgcagcaagagtccctccggtgccaacctccccatccccagcaagccctagcccgatcacagcgggctctttcaggtctcatgccgcatcaaccacatgtcctgaacagatggactgcagcccaacagcttcctccagcgccagccccggggccagcactacaagtactccaggtgctagccctgctcctcggtctaggaagcccggggcagtcatagaatctttcgttaaccatgcccccggagtcttctccggaaccttcagcgggactctccatcctaactgccaggattcatctggcaggccacggcgagacataggaaccatacttcagatccttaatgacttactctccgctactcggcactatcaggggatgccccctagcctcgctcaattgagatgccacgctcagtgtagtcctgcatcccccgccccggatctggcacctaggaccacctcttgtgagaagctgacagccgccccaagcgcctcgctgctgcagggtcaatcacagattagaatgtgcaaacctcctggggatcgcctgcgccagacagagaatcgggcaactaggtgcaaggtggagagactgcagctgttgctgcagcagaagaggttaagacgtaaagcccgacgcgacgctagaggtccctatcactggtccccttcgcggaaggccggaagatccgacagctcatccagcggaggagggggtagcccaagcgaagcctctggcctggggctggattttgaggactcagtatggaagccagaggtgaatccggatatcaaaagcgagtttgtggtggcttag

SEQ ID NO: 195206 - DNA, 771 bp, Artificial Sequence
  Description of Artificial Sequence: Synthetic coding sequence
atgggcgagcccagccgggaggagtacaagatccagagcttcgacgctgagactcagcaactcctcaaaacagccctaaaagtggcgtgcttcgaaacagaggatggcgaatactccgtttgtcagcgcagctactcaaattgctccaggctgatgcctagcaggtgcaatacccaatacagggacccaggagctgtagacctagaaaaggtggcgaatgtgattgtggaccattccctccaggactgcgtcttctccaaagaggcaggacgtatgtgttatgccatcatccaagccgaatcaaagcaggcaggacaaagtgtgttccgaagaggtctgcttaataggttgcaacaggagtaccaggcccgggagcaactacgcgccagaagtctgcaagggtgggtctgctacgttacgttcatctgcaatattttcgactacctacgggttaacaacatgcctatgatggctttagtgaatcccgtgtacgactgcctgtttcggctcgcacagcctgattctctgagcaaggaagaagaggtggactgcctggtacttcagctgcatagggtgggcgagcagctggaaaaaatgaatggtcagcgcatggacgagctgttcgtgttaatacgcgatggtttcttgctgccaacgggactcagctcattggcccagctcctgttgctggaaattatagaattcagggccgccggttggaagacgacacccgcggcgcataagtattactattccgaggtgtccgattag

SEQ ID NO: 195207 - DNA, 669 bp, Artificial Sequence
  Description of Artificial Sequence: Synthetic coding sequence
atgggcgagcccagccgggaggagtacaagatccagagcttcgacgctgagacacagcagttgctgaaaactgcacttaaggaccccggtgcagtagacctggaaaaggtagctaacgttattgtcgatcactccctgcaggattgcgtgttttccaaggaggctggtcgcatgtgctatgccattatccaggccgagtccaagcaggctgggcagagtgtctttcggaggggcctactcaacagactccagcaagaataccaggcccgagaacagttacgggcccgttccctgcaggggtgggtctgctatgtgacctttatctgcaatatcttcgattatctgcgcgttaataacatgcctatgatggcgctggtgaatcccgtgtatgattgtcttttccggttagcccagcccgattcattgagcaaggaggaggaagtggattgcctggtgttgcagcttcaccgggtcggcgaacagctggaaaagatgaatggacagcgcatggacgaactcttcgtgctgatccgagatggttttctgctcccaaccggcctgtcatcactggcacaattattgttgttggaaatcattgaatttagggcggccggatggaagacgaccccagccgctcacaagtactattactctgaagtgtctgactag

SEQ ID NO: 195208 - DNA, 792 bp, Artificial Sequence
  Description of Artificial Sequence: Synthetic coding sequence
atgggcgagcccagccgggaggagtacaagatccagagcttcgacgccgaaacccaacagctgctgaaaacagccctgaaagccccatctttagagtgcacagtcgcctgttttgaaacagaggacggcgagtactctgtctgccagcggagctactctaattgttctcgccttatgcctagcagatgtaatacccagtaccgcgaccctggtgccgtagatttagaaaaggtagctaatgtgatcgtggaccattcactccaggattgcgtgtttagcaaggaggccgggcggatgtgttatgccattattcaggccgagagcaaacaggcaggccaatcagtttttagacgagggcttctgaacagactgcagcaggaataccaggccagagagcagctcagagcccggtctctacagggctgggtgtgctatgtaactttcatctgcaatatcttcgactatctaagggtcaacaatatgccaatgatggctttggtgaatcctgtgtacgattgcttgttcagactggcgcagcccgactcgctgtccaaggaggaagaggtggattgtcttgtactgcagctccatcgcgtcggagaacagcttgaaaaaatgaatggacagcggatggatgagctctttgtactgatccgggatggcttccttcttcctaccgggctctcttcgctcgcgcaattactcctactggagatcattgaattccgtgccgcagggtggaagacaacaccagcagctcacaagtactactactcggaagtctccgattag

SEQ ID NO: 195209 - DNA, 1164 bp, Artificial Sequence
  Description of Artificial Sequence: Synthetic coding sequence
atgccccggccccggctgctggccgccctgtgcggcgccctgctgtgtgcaccaagccttctggtagctctcgacatttgcagcaaaaacccatgtcataacggcggactgtgcgaagaaatcagccaggaagtgcgcggggacgtcttcccttcttacacatgcacgtgcttgaaaggctacgccggtaaccactgtgagacgaaatgcgtggagcctttgggcctggagaatgggaatattgctaattcccagatagcagcctcctcagtgagggtgacgtttctgggactgcagcactgggtccccgaattagcccgacttaatcgagcaggtatggtgaacgcctggacaccttcttctaacgacgataacccgtggattcaggtgaacttattgaggaggatgtgggtcaccggcgtcgttacccagggcgcctccaggctggctagccatgagtatttaaaagccttcaaagtagcgtactcacttaacggtcacgagttcgattttatccacgacgtgaataagaaacacaaagagttcgtaggcaactggaacaagaatgccgtgcatgttaaccttttcgaaacaccagtggaggctcagtacgtgagactttatccaacctcatgtcataccgcctgtaccttgcggtttgagctgctcggttgcgagctcaacggctgtgccaaccctctgggcctgaaaaataacagcatccccgataaacagattaccgctagctcatcctataagacttggggattgcatctatttagttggaatccctcctacgctagattagataagcagggaaactttaatgcatgggtggccgggtcttacgggaacgaccagtggctgcaggtcgatcttggttctagtaaggaggtgacaggcatcatcacacagggcgcccggaacttcggctctgtgcagttcgtggcctcctataaggtggcctactccaacgatagtgcaaattggactgagtaccaagatcctcggacagggtcctctaagatctttccaggaaactgggataaccattcacacaaaaagaacctgttcgaaacccctatactcgcgaggtatgtcaggattctgcccgttgcttggcacaataggattgcgttgcgcctggaattgctggggtgctag

SEQ ID NO: 195210 - DNA, 1140 bp, Artificial Sequence
  Description of Artificial Sequence: Synthetic coding sequence
atgtggcccttccccgagggcggcaacaccatccccatcctgcacactgatatctgcagtaaaaatccgtgtcacaacggggggttgtgtgaggaaatatcacaagaggtaaggggggacgtgttcccatcttatacttgtacatgtctcaagggctacgccggaaaccactgcgagactaaatgcgtcgagcctctcggattggaaaatggtaatattgcgaactctcagatcgctgctagcagcgtgagagtaacctttcttgggttgcaacactgggtccccgaactggcacgcctgaatcgggccggtatggtaaatgcctggacgccttcatctaatgacgataacccatggatccaagtcaatctcttgcgcagaatgtgggtgaccggggtggtgacgcagggtgcttcacgcctggcaagccatgagtaccttaaagctttcaaagtggcctatagcctaaacggtcacgagttcgactttatacacgatgttaacaagaaacataaggaattcgtgggaaactggaacaagaatgcggttcacgtcaatctgttcgagacccctgtggaagcacagtatgtgcggctgtacccaacttcatgccacacagcctgcaccttgcgtttcgaacttctgggctgtgagctgaacggatgtgcaaatcccctgggattaaaaaacaactcaattccagataagcagatcactgcctcaagcagctataaaacgtggggcctgcaccttttctcctggaatccatcatatgcgcgcctggataagcagggaaacttcaacgcttgggtggccggctcttatgggaacgaccaatggctgcaggtcgatcttgggtcatccaaggaggtgacgggcatcatcacgcaaggcgccagaaacttcggatccgtccagttcgtggcgtcctataaggtggcatattctaacgactcagccaattggaccgagtaccaggacccacgcactggtagttcaaagatctttccaggtaactgggataaccactctcacaaaaagaatctctttgaaactccaattctggctagatatgtgagaattcttcccgtcgcttggcacaatcggatcgctttgcgcctcgaactgttggggtgttag

SEQ ID NO: 195211 - DNA, 1008 bp, Artificial Sequence
  Description of Artificial Sequence: Synthetic coding sequence
atgccccggccccggctgctggccgccctgtgcggcgccctgctgtgcgccccatccttgctagtggctctggacatttgtagtaaaaatccatgtcacaacggaggcctctgcgaagagatttcccaggaggttcggggggacgtcttcccctcctacacgtgtacttgtttaaaaggatacgcaggaaatcactgtgaaacaaagtgcgtggagccgttgggattggaaaatggcaatatagccaactctcagatcgccgcctcgtccgttcgggtaacgtttctggggctgcaacactgggtccccgagctggcccgcctcaaccgcgccgggatggttaacgcctggaccccctcgagtaacgacgacaatccttggattcaagtgaatcttctgaggcgtatgtgggtgacgggagtggtgacccagggtgcaagtaggctggcttcccatgaatatttaaaggcctttaaggtggcatatagcctaaatggtcacgaattcgactttatccacgacgtcaataaaaagcacaaggagttcgttgggaattggaataagaatgcagttcacgtgaatttgttcgagacgcctgttgaggcgcagtatgtacgtttgtacccaacgtcttgccacactgcatgtacacttcgattcgaactgcttggttgcgaacttaatggctgcgcaaacccgctggggctcaagaacaactccatccctgacaagcagattaccgccagctctagctataagacctgggggttgcacttgttctcttggaacccttcctatgcccggctcgacaagcagggaaactttaatgcctgggttgcgggaagttacggaaatgaccagtggctgcagatttttcctggcaactgggacaaccattctcataagaagaacctgttcgagactccgatcttggccaggtatgtccgcattcttcctgttgcttggcacaatcgaattgcactgaggcttgaattattgggatgttag

SEQ ID NO: 195212 - DNA, 1929 bp, Artificial Sequence
  Description of Artificial Sequence: Synthetic coding sequence
atgccctgcggcgaggactggctgagccaccccctgggcatcgtgcagggattcttcgctcaaaatggcgttaatcctgactgggaaaaaaaggtgatcgaatattttaaagaaaaattaaaagaaaataacgcaccgaagtgggtcccatctctgaatgaagtgcccttacattatctcaagcccaatagcttcgtcaagtttcgatgtatgatccaggacatgttcgaccccgaattttacatgggtgtgtacgaaacagtcaaccagaacacaaaggcacacgtgctgcatttcggtaaataccgggacgtggctgagtgtggaccacagcaggagctagacctgaacagccccaggaatactaccctggagcgacagactttctattgtgttcccgtcccaggggagtcaacttgggtgaaggaggcatacgtgaatgctaatcaggcccgggtgagcccatcgacaagttatactcctagccgccacaagagatcatatgaagatgacgatgatatggatctgcagcctaacaagcagaaagatcagcacgcgggcgccaggcaggccgggagcgtgggcgggcttcagtggtgtggcgagccaaagcgattggagactgaggcaagtactggtcaacaactcaactccctgaatttgagtagcccttttgacctcaacttccctctgccaggagaaaaaggtcccgcttgcttagttaaggtatacgaggactgggattgttttaaagtcaatgatattttggagttgtatggtatcctgagcgtggatccagtcctgagtatactgaacaatgatgagagggacgcttccgctcttctcgatcccatggagtgcacagatacagcagaagaacagcgagtccactcaccccccgcgagcctggtcccacggattcatgttattctcgcccagaagttacagcacattaatccactcctcccagcctgcctcaataaggaagagagtaagacctgcaagttcgtttcatctttcatgagcgagttaagtccagtgcgcgcggagttgctcggctttctaacccacgccttgctgggagattccctggctgcagagtatctgatcctgcatctcattagtaccgtgtacactagacgcgacgtgctcccattgggaaagttcaccgtaaacctgtcaggctgtccacggaatagcacattcacggagcatctttacaggatcatccagcacctggttccggccagctttagactccaaatgaccatagagaacatgaatcatctgaaattcatccctcacaaagattataccgccaacaggctcgttagtggccttcttcaacttccttcaaacacgtctctggtgattgacgagacactgctggagcagggacagctagatacacccggggtgcacaatgtgacagctctgtcaaacctcatcacatggcagaaggttgattacgacttctcataccatcagatggagttcccctgcaatatcaatgtgttcatcacttctgagggaaggtctttgcttcccgcagattgccaaatacatttgcagcctcagctgattccgccgaacatggaggagtatatgaattcacttctttcggctgtcctaccctccgtgctgaacaaatttcggatatacctgacgctactgcggtttttagaatatagtatatccgacgagattaccaaggccgtcgaggacgattttgtggaaatgcgcaagaacgatccccagagtattactgccgatgatttgcaccagctgcttgtagtggctcgctgcttgagcctgtctgcgggtcaaactacattgtcgagagagagatggcttcgggccaagcagcttgaaagcctgcggcggacgaggctgcagcagcagaaatgtgtgaacggaaatgagctgtag

SEQ ID NO: 195213 - DNA, 1923 bp, Artificial Sequence
  Description of Artificial Sequence: Synthetic coding sequence
atgccctgcggcgaggactggctgagccaccccctgggcatcgtgcagggattctttgcccagaacggagtgaatccagactgggagaagaaagtgatagagtactttaaagaaaaactgaaggaaaataatgcccccaaatgggtgccttccctgaatgaagtcccgctccattatctgaaaccaaactcgtttgtgaagtttaggtgcatgattcaggatatgtttgaccccgagttctacatgggcgtgtacgagacggtaaaccagaataccaaagcccacgtgctgcattttggcaagtaccgagatgtggccgaatgcggcccgcaacaggaactggatctgaattccccgaggaataccactctggagcggcaaaccttctactgtgtccccgtgcccggggaatcaacctgggttaaagaagcttacgttaatgccaatcaagcgcgagtgtctccctctacctcctatactccctctcgtcacaaacggagttacgaagacgacgacgacatggatctgcagccgaacaaacaaaaggatcagcacgccggggccaggcaagctgggagcgtgggcgggcttcaatggtgtggcgaaccaaaacgtctagagacagaggccagtactgggcagcagctcaacagtttgaacctgtcatctccttttgacctgaattttcctctgcccggcgagaagggcccagcatgccttgtaaaggtctacgaggattgggattgcttcaaagttaacgatatcttagaactctacggcatcctctcagttgaccctgtgctcagtatactgaataatgacgaaagagatgcctcagccctgttagacccaatggaatgtacggacacagccgaagagcagcgggtgcatagtcccccagcatctcttgtgccaagaatccatgtgatcctcgcgcagaagcttcaacatatcaaccctctgctgcctgcatgtctgaataaggaggaatccaagacctttgtgtccagtttcatgagcgaactcagtcccgtgcgcgccgaacttctcggatttctaacacacgcacttctgggagacagcctggccgctgagtatctaatcctgcatctcatctctacggtctatacacgaagagacgtgcttcccctgggcaaatttaccgttaacctgagcggctgccccagaaactccaccttcaccgagcacctgtatcgaattattcagcatctggtgcccgccagtttcagactgcaaatgaccattgaaaatatgaaccatctgaagttcattcctcacaaagactatacggccaatcgattggtgagcgggttgttgcagctcccatccaatacttccttagtgatcgacgaaacactccttgaacaggggcaattagatacccccggggtccataatgtgacagccctgtctaatcttattacatggcagaaagttgattatgatttcagctatcaccaaatggaattcccatgcaacatcaatgttttcatcacctcagaagggcgaagccttctgcccgccgactgtcagatccatctgcagccacaactgatccctcccaacatggaagagtatatgaactcactcctgtcagctgttcttccctctgtcctaaataagttcagaatctacctgaccctgcttcgctttctcgagtactcgatctccgacgaaataacaaaagccgtcgaggatgattttgtggagatgcgcaaaaacgatccacaatccatcactgctgacgatctccatcagcttttggtagttgcccgctgtcttagcctgagcgctggacaaacaacactgagcagggagagatggttaagggccaagcagttagaatctctgcggagaactcgtctccagcagcagaaatgcgtaaacggaaacgaactgtag

SEQ ID NO: 195214 - DNA, 2628 bp, Artificial Sequence
  Description of Artificial Sequence: Synthetic coding sequence
atggacgaggaggaggacaacctgagcctgctgaccgccctgctggaagaaaacgaatccgccttggattgtaattccgaggaaaacaattttctgactagggagaacggtgagccagacgcctttgacgagctgttcgacgccgacggtgatggtgaatcttacaccgaagaggctgatgatggagagaccggggagaccagagacgaaaaagagaatcttgccacactgttcggtgacatggaagatctgactgacgaagaggaggttccggccagccagtctaccgagaaccgagttcttccagccccggcaccacgaagggagaagacgaacgaggagctgcaagaggagctgagaaacttacaagagcaaatgaaagcactgcaagagcagttaaaggtgactaccataaaacagacagcaagcccagctcggctgcaaaagagtcccgtggaaaaatcccccagaccccccctcaaggagagaagagtgcagaggatccaggaatcaacgtgttttagcgctgaactcgacgttccagctctccctagaactaagcgggtcgcgcggacgcccaaagcctcccctcctgatccgaagagttcctccagccgcatgacctcagcgccttctcagccattgcagacgataagcaggaataagccttctggaatcacacgaggccagatcgtggggaccccaggttcttcaggagaaacaacacagcctatctgtgtagaggcctttagcggactaaggttgcgcagacctagagtgtcatccaccgagatgaataaaaaaatgacagggcggaagttgatacggctgtctcagatcaaagaaaagatggcacgcgagaagctcgaagagattgactgggtcacattcggtgtgattcttaagaaggttacgccacagagtgttaatagcggaaagaccttcagtatctggaagcttaacgacttgagagatctcacccagtgcgtgtcgctgttcctgtttggtgaggtacacaaggctctgtggaaaacagaacagggcaccgtggtggggattctgaatgcaaaccctatgaaacccaaagatggctccgaggaagtttgtctctcaattgaccaccctcagaaggtgctaattatgggggaggcactggacctcggaacctgcaaggccaaaaagaagaatggagagccctgcacccaaacagtcaacctgagagattgtgaatattgccagtatcatgtacaggctcaatacaaaaaattgtccgctaaaagggccgaccttcagtccacattttccggcggccgcattcctaagaagtttgccaggagggggactagcttaaaagagcgcttgtgccaggatggcttctactacggtggggtatcatcggcttcctacgctgcttccatcgccgccgctgtggcccctaaaaagaaaatacagaccacactttctaacctcgtggttaaaggtactaatttgattatccaggagaccaggcagaagctgggaatccctcaaaaatctctgtcttgctctgaggaatttaaggaattgatggatctgcctacctgtggtgctagaaaccttaagcaacacttggctaaggcgactgcatccggaatcatgggcagccctaagccagccattaaatctatctccgcatccgctttgctaaagcagcagaaacagagaatgctggaaatgagaaggcgcaaatcggaagagattcaaaagcgtttcctgcagtcttcttccgaggtcgagagccccgctgtgcccagctccagtcgacagcctccagcccagcccccgcgtacaggatctgagttccccagactagagggtgcccctgcaacgatgacaccgaaacttggccggggagtgctggaaggcgatgacgtccttttttatgatgaaagtcccccgccacgtccaaagctgtctgcactagcagaggccaagaaattggctgcaattacaaagcttcgggccaaagggcaggttctgacaaagaccaacccaaatagcattaagaaaaagcagaaggacccccaggacatactcgaggtcaaggaaagggtggaaaagaacactatgttcagcagccaggcagaagatgaactggaacctgctcggaaaaagcgacgggaacaattggcctacctcgagagtgaagaattccaaaagattctgaaggctaaaagcaagcacacaggtattctgaaagaagcggaggctgaaatgcaggagcgctacttcgaacctctcgtgaaaaaggaacagatggaagagaagatgcgcaacatacgcgaagtcaagtgccgcgtcgtgacttgcaaaacctgcgcctacacacatttcaagcttctagagacgtgtgtgagcgaacagcatgaatatcattggcacgatggggtcaagcggttctttaagtgtccctgtgggaaccgtagcattagcctcgacaggctacctaataagcattgtagcaactgtggcctttataaatgggagcgcgacggcatgttaaaagagaagaccgggcccaaaattgggggggagaccctcctccccaggggagaagagcatgccaaattccttaactccctcaagtag

SEQ ID NO: 195215 - DNA, 2568 bp, Artificial Sequence
  Description of Artificial Sequence: Synthetic coding sequence
atggacgaggaggaggacaacctgagcctgctgaccgccctgctggaggagaacgaatctgccctggattgtaatagtgaggaaaacaacttcctaacacgggaaaacggcgagcctgacgcatttgacgagctattcgacgccgacggcgacggcgagagctatacagaagaagccgacgatggcgagacaggcgagacacgggatgaaaaagagaacctggcaacactattcggggatatggaggacctgacggatgaagaggaggtacccgccagccagtcaacggaaaacagagtgcttcccgcgcctgccccaagaagggaaaaaaccaacgaggagcttcaggaggagctgcgcaacctgcaggagcaaatgaaggcgctacaggagcagttaaaggtcacgactatcaagcagacggcaagccctgcccggctacagaaatctcccgagaaaagtccgagacccccattgaaagaacgccgggttcaaagaattcaagaatcgacttgcttttccgccgagctcgacgttcccgcacttccgcggactaagagagtggctaggactccgaaggcaagcccacctgaccctaagtcatccagctctcgtatgacaagtgcgccctctcagccactgcagacgatatctagaaacaaacctagcggcataacccgcggccagatcgtaggcacccctgggtccagtggtgagacaacccaaccgatctgcgtcgaggctttcagtggtctcaggctgaggcgaccacgcgtctctagcaccgagatgaacaagaaaatgacaggaagaaaactcataaggctgtcccagattaaggaaaagatggccagagagaaactggaagagattgattgggtgacctttggggtgattctcaagaaggtcaccccacagagcgtcaattctggtaaaacttttagcatttggaaactaaatgacctgcgggacttaacacagtgcgtttccctattcctgtttggagaggtgcacaaagccttatggaagacagaacaaggcacagtggttggaatcttgaacgccaaccctatgaaacccaaagacggcagtgaagaggtgtgcctctccatcgaccaccctcagaaagttctcattatgggcgaagcacttgacttgggaacctgcaaagccaaaaaaaaaaacggcgagccatgtactcaaaccgtgaaccttcgggactgcgagtactgtcagtatcacgtacaggcgcagtataaaaagctgagtgctaagcgggctgaccttcagtctaccttctcgggcggaagaattccaaagaagtttgcgaggagaggtaccagcctgaaagagcgactttgccaggatggattctactatggcggagtgagcagtgctagttacgccgcctccatcgcagctgctgtcgcccccaagaagaaaatccaaactacactgagtaacctggttgtcaagggaacaaaccttattatccaggaaacccgtcagaaactgggcattccacagaaatccctttcatgcagcgaagagtttaaggagctcatggatctccctacctgcggagccaggaatctgaagcagcatcttgcaaaagccactgctagtggcatcatgggctctcccaagcctgctatcaaatccatttccgcttccgcactcctcaaacaacagaaacagagaatgctggagatgcgtaggagaaaatccgaggaaattcagaagcggtttctgcaaagttcctctgaagtcgagagcccggcagttccgagctccagtcgtcagccccccgcccagccaccccgcaccggaagcgagtttccccgactggaaggcgctccagcaactatgacgcctaagctggggaggggggttctggagggagacgacgtcctgttctatgacgagagtcccccaccacggcctaaattgtccgccctcgcagaggccaaaaaattggccgcaatcacgaagctcagggcaaagggtcaagtgttgaccaagaccaatccaaactcaatcaagaagaagcagaaagacccacaggatatcttggaagtcaaggaacgcgtggagaaaaatactatgttcagctcccaggctgaagacgagttggagcccgctaggaagaaaaggcgcgaacagttggcctaccttgaatccgaggaattccaaaaaatcctgaaagccaagagtaaacacactggcattctgaaagaggccgaggctgagatgcaagaaaggtacttcgaacctctcgtgaagaaggaacagatggaggagaaaatgaggaatattcgggaggtaaagtgcagagtggtgacttgcaaaacatgcgcttacactcatttcaagctgctggagacatgtgtctccgaacaacacgagtatcactggcacgatggagttaagcgcttttttaaatgcccctgcggaaacagaagtatctccctggaccggttacctaataagcactgttccaactgtggcctctacaaatgggaacgcgacggcatgctcaaagtatgccacttacgtactaacttctag

SEQ ID NO: 195216 - DNA, 2625 bp, Artificial Sequence
  Description of Artificial Sequence: Synthetic coding sequence
atggacgaggaggaggacaacctgagcctgctgaccgccctgctggaggagaacgagtcagctttggactgcaatagtgaggaaaacaacttccttacacgagagaacggagaaccggacgcttttgacgagctattcgacgcagacggggatggagagtcttataccgaagaggcagacgatggggaaaccggggagacccgcgatgagaaggagaacctggctacgctgtttggagatatggaggacctgaccgacgaggaagaggtacccgcctcccagagtaccgagaacagggtattacctgccccagcacccaggagagaaaaaaccaatgaggaactgcaggaagagttaaggaatcttcaagaacagatgaaggcactgcaagagcagcttaaggtaactacgatcaagcaaaccgcaagtcccgcacggctgcaaaaatctcccgaaaaatctccccgccccccgctcaaagaacgccgggtacagcgcatccaggagtcaacgtgcttcagcgctgaacttgacgttccggctctgcctcggacaaaacgggtggcaaggacgcccaaagcgtctccacccgatccgaaaagttcatccagccgtatgaccagtgcccctagccagccactacagaccatctctaggaacaagccttccggcattacaagaggccagatcgtcggcactccagggagtagcggagagaccacccaacccatctgcgtagaagctttttcgggactccgcttaagacgcccgcgagtctcctcaaccgagatgaataagaaaatgactggccgaaagctgatcaggctttcccaaatcaaagagaagatggctcgcgaaaaactcgaggagatcgactgggttacttttggcgtgatcctgaaaaaagttacaccccagagcgtcaactccgggaaaactttttctatttggaaactcaatgacctgagagatctgacgcaatgcgtgtctttatttttatttggagaagttcacaaggccctgtggaaaacggagcagggaaccgtggtgggaatcctgaatgccaacccgatgaagcccaaagacggctctgaagaagtgtgcctatcaatcgaccacccccaaaaggtcctcatcatgggcgaagcacttgatttaggcacctgtaaggcaaaaaagaaaaatggtgagccatgcacgcaaacggttaatctccgcgactgtgagtattgtcagtaccacgttcaggcacaatacaagaagttaagtgccaaaagggctgacctccagtctaccttttctggaggtcgaatccctaagaagtttgcaaggcgcggtacgagcttgaaagagcgcttatgccaggatggattttattatggtggcgtgagtagcgccagttatgccgcttccattgccgcagcagtcgcccctaagaagaagatccagactacactcagcaacctggtggtcaaaggaaccaatctcatcattcaggagactcgacagaaactcgggatcccacagaaatccttatcttgttccgaggaattcaaggagcttatggacctgccgacatgcggcgcccgcaacctgaaacagcacctggccaaggccacagcctccgggattatggggtccccgaagcctgccattaagtccatatctgcaagtgccctgttgaaacagcaaaagcagcgcatgctcgaaatgcggcgcaggaagtccgaggaaatccagaagcgcttcctgcagtcttcaagtgaggtggaaagcccagcagttccatcgtcttcacgacagccgccagcccagcccccacgtactgggagtgagtttcctagattggagggggcgccggctacgatgactcccaaactaggaagaggggtgctcgagggcgacgatgtattgttctacgacgagtccccacccccacggcctaagctctcagctctcgccgaggctaagaagctggcggctattacaaagctgcgggccaagggtcaagtgctcacaaagaccaacccaaactcaattaagaaaaaacagaaggacccacaggacatcctggaagtgaaagaacgggtggagaaaaatacaatgttttctagccaggccgaagatgaactggagcctgcaagaaagaaaagaagagagcagctggcctatctcgaatctgaggaatttcagaagatccttaaagccaagtcaaagcacacaggtatcctcaaagaggctgaggcagagatgcaggagcggtacttcgaaccgttggtgaagaaggaacaaatggaggagaaaatgcgaaatatccgggaggtgaaatgtcgggtcgtgacgtgcaagacttgtgcgtatactcacttcaaactgctggagacatgtgtctcagagcagcacgagtaccactggcacgacggggtgaaacggttcttcaagtgtccatgtgggaacagatcgatcagtctggatcgtctccctaacaagcactgctcgaactgcggactgtataaatgggagcgcgatggcatgttaaaagagaagaccggacccaagattggaggtgagaccctgcttcctcggggcgaggaacacgcaaagtttctgaacagcttgaagtag

SEQ ID NO: 195217 - DNA, 2628 bp, Artificial Sequence
  Description of Artificial Sequence: Synthetic coding sequence
atggacgaggaggaggacaacctgagcctgctgaccgccctgctggaagagaatgagagtgcattagactgcaactccgaagaaaacaacttcctgaccagagaaaatggtgaacccgacgccttcgacgagctcttcgatgctgacggtgacggggaatcatacacggaggaagccgacgatggcgagaccggcgaaacgagagatgagaaggagaacctggctactcttttcggcgacatggaggatctgaccgatgaggaggaggtacctgcctcacaatccacagagaatagggtcctccccgctcctgcccccagaagggagaaaactaatgaggaacttcaggaagagcttcggaacctccaagagcagatgaaagctctgcaggaacaacttaaggtaacaacgattaagcagaccgcttcgcccgcgcggctgcagaagagtcccgtggagaagtcccccaggccacccctgaaagagaggcgcgtgcaaagaatacaggaaagcacttgcttctctgccgagcttgatgtgcccgctctacctcggaccaagcgcgtggccaggacccctaaggcatctcctcccgatcccaaatcttcttctagtcgcatgaccagcgccccatcgcagcctctgcagacgatctcacgcaataaacctagtggaattaccaggggccagattgttggaacacccgggtctagtggggagacgacccagcccatttgtgttgaagcatttagtggtttacgcttacgccgcccacgggtgtcatcaaccgaaatgaacaaaaagatgaccggaagaaagctcattaggctgtcccagattaaagagaagatggctagagaaaagctggaggaaatagactgggtcacctttggtgtaatacttaaaaaagttactccccagtctgtaaattccgggaagactttctctatatggaagctgaacgatctgcgtgacttgacacaatgtgtgtcactgtttctctttggggaggtgcataaggccctttggaaaaccgaacaggggacggtggttgggattctcaacgccaacccaatgaaacctaaagacggtagcgaggaggtatgtctgtctatcgaccacccccaaaaagtcctgattatgggagaggcactagacctcgggacttgtaaggccaaaaagaaaaatggtgaaccatgtactcagactgtaaatctccgtgactgcgaatattgtcaatatcacgtccaagcgcagtacaagaaattgagcgcaaagcgggctgacttgcagtctacttttagcggcggccggattccaaaaaagtttgccaggcgtggcacttcactgaaagagaggctgtgtcaggacgggttctattacggaggtgtgtcctccgcctcctatgcagcgtcgatcgcagccgccgtggcacccaagaaaaagatccagactacactgagtaaccttgttgttaagggcacaaatctgatcatacaggaaacaaggcagaaattaggtataccacagaagagtctgtcatgttcagaagagttcaaagaactgatggatctgcccacttgcggagctcggaacctcaagcagcacctggcaaaggctacagctagcgggattatgggatccccaaagcccgccatcaaatccattagcgcatctgccctgctcaaacagcagaaacaacggatgttggagatgcgaagacgcaaaagcgaggagatccaaaaaaggttcctgcaaagttcaagtgaggtagagagtcctgccgtgccctcttccagccggcagccccccgcacagccgccccgcaccggctctgagttccctcggctggaaggtgcgccagctacgatgacccctaagttagggcgaggggttctggagggagacgatgtgttattttacgatgagtcccctcctcctagacctaaactttctgcactcgccgaggccaagaagctcgccgcgataacaaagctgcgagctaagggtcaggtgctgactaagactaaccctaactctatcaagaaaaaacagaaagacccgcaggacattttggaggtaaaggaaagggtggagaagaatactatgttttcctcacaagccgaggatgaactggagcccgctcgtaagaaacggagggagcagctggcgtaccttgagtccgaggaattccagaaaatcctgaaagcgaaatcaaaacacacagggatcttgaaagaggctgaggccgaaatgcaggagcgatattttgaaccgctggtgaagaaagaacagatggaggagaaaatgcgaaatatcagagaagtgaaatgtcgggtggtcacctgcaaaacatgtgcttacacgcacttcaagctgctagagacatgcgtttccgagcagcatgagtaccattggcacgacggtgtaaagcgattcttcaagtgtccctgcggcaaccgatccataagcctcgatagactgccaaacaagcactgctccaactgtgggctatataagtgggagcgggacggaatgctgaaggaaaagacaggtccaaagatcggcggcgagacgctcctgccaaggggagaggaacatgccaaattcctaaatagcctgaaatag

SEQ ID NO: 195218 - DNA, 2466 bp, Artificial Sequence
  Description of Artificial Sequence: Synthetic coding sequence
atggacctggccgccgccgccgagcccggcgccggcagccagcacctggaagtgcgagatgaggtcgcggagaagtgccaaaagctgttcctggatttccttgaggaattccagagttccgacggcgagatcaagtaccttcagctggccgaggagctgatacgtcctgaacgcaacaccctggtggttagttttgtcgacctggagcagttcaatcagcagctgtcaaccaccatccaggaggagttctaccgtgtctacccatacctgtgcagagctctgaaaacctttgtgaaggaccgaaaggaaattccccttgccaaggacttttacgtggccttccaagatctgccaacacggcataagattagggagcttacaagcagtcgaataggtctgctcaccaggatatcagggcaagtggtcaggacgcatccagtgcacccggaactggtcagcggaacattcctttgcttggactgccagaccgttataagagatgtggagcaacagtttaagtatacccagcccaacatttgtaggaaccccgtttgtgcgaaccggcggcggttcctgttggataccaacaaatcccgcttcgtagatttccagaaagtcaggatccaggagacccaagctgaactgccaagggggtcaatcccacgatctcttgaggtcatcttacgtgcagaagccgtggaaagtgctcaggcaggcgataaatgcgacttcaccgggactttaatagtggtccctgatgtgtccaaactttccacacctggcgcccgagcggaaaccaacagccgtgtttccggtgtggatgggtatgaaaccgagggaatcagaggcctgcgggctctcggtgtaagagacctgtcctataggttggtcttccttgcgtgttgcgtggctcctaccaatcccaggtttggcggtaaggaactgcgggatgaagaacagactgcagagagcatcaagaatcagatgacagtgaaagaatgggaaaaagtatttgaaatgtcccaggacaaaaatctctatcacaacttgtgtaccagtctcttccctactatccacggaaacgatgaagtgaagcgaggcgtccttctgatgctctttggtggtgtccctaaaacaaccggggaggggactagtcttagaggcgatatcaacgtctgcattgtgggggatccctccactgctaaatcccagttcctgaagcacgttgaggaattttcaccacgggcagtctatacttcagggaaggcctcctcggctgccggccttaccgccgccgtggtccgcgatgaggagtcccacgagtttgtcatcgaggctggcgcactaatgttggctgataatggcgtgtgttgcattgacgagttcgataagatggacgtgagagaccaggttgccattcacgaagctatggagcagcagactatcagcattaccaaggctggtgtcaaggcgacactcaatgccaggacgtctattctcgcggccgcaaacccaatcagtggccactatgacaggtctaaatcactgaagcagaacataaatctatcggcgcctataatgtcgcgctttgatcttttctttattctggtcgacgagtgtaacgaggtgaccgactacgccatcgcccggcgcatcgtagacctccacagccgcattgaggagtctatcgaccgggtctattcattagatgacataagaagatatctgctattcgccaggcaatttaagccaaagatctcgaaggagtcagaggacttcattgtagagcaatacaaacacctgcgacagagagacggatctggggttactaaaagttcctggcgtattaccgtcaggcagcttgagagcatgatcagactctctgaggctatggcaaggatgcactgctgcgatgaggtccaaccaaagcatgtgaaggaagcctttagattacttaataagagtataataagagtagaaacacctgacgtgaatctggatcaggaggaagagattcagatggaggtggatgagggagcgggcggcatcaatggacacgcggactcccctgcacccgtcaacggaatcaacggatacaatgaagatattaaccaagaatccgcccccaaagcatcactgcggctggggttctccgaatactgtagaatttcaaacctgatcgtgctccatcttcggaaggtggaggaagaagaagatgagtcagcccttaagagaagcgaacttgtgaattggtatttaaaggagatcgaaagcgagatcgactcagaagaggagctgatcaacaaaaaaaggataatcgagaaagtcatccaccggctgacacactacgatcatgtgttgattgagctcacccaggccggccttaagggcagcactgaaggatctgaatcatatgaagaggacccatacctggtcgtaaaccctaactacttgctcgaggactag

SEQ ID NO: 195219 - DNA, 2160 bp, Artificial Sequence
  Description of Artificial Sequence: Synthetic coding sequence
atggccctgaaggactacgccctggagaaggagaaggtgaagaagtttttgcaagagttttaccaggatgacgagctcgggaaaaaacagtttaaatacggtaaccagctggtgcggctggctcaccgagagcaggtggctttgtacgtggatctggacgacgtggctgaggacgaccctgaactggtggacagtatctgtgagaacgctcggcggtatgccaagttattcgccgacgccgtccaagaactgctcccccaatacaaagaacgggaagttgttaacaaggatgtcctggacgtctacatcgaacaccggcttatgatggaacaaaggtctagggaccccgggatggtgaggtccccacaaaaccagtatcccgcagaactgatgcgaaggtttgaactctatttccaaggcccgtcttcgaataaacctcgtgtgattagagaggtaagagcagattcagttggaaagctcgtcacggtgcgggggattgtgactcgggtcagcgaagtcaaacctaagatggttgtagcaacttacacttgcgaccaatgcggagctgagacctatcagccgattcagagtcccactttcatgcctctgatcatgtgcccctctcaggagtgccaaaccaaccggagcggtggaagactatatctgcagacgcgggggagcaggttcatcaagttccaagaaatgaagatgcaggaacacagcgatcaggtgccggtgggcaatatcccaaggagtatcacggttttggtagagggggagaatactaggatagcccaaccaggcgaccacgtgagcgtcactggaatttttctccctatactgcgtactggcttccgccaggtggtccagggacttttatcagagacctaccttgaagcccacagaatcgtgaagatgaacaagtccgaggacgatgagtctggggcaggcgagctgacaagagaagaactgcgccaaatcgccgaggaggacttttacgaaaagctggctgcaagcatcgctcctgagatatatgggcatgaagacgtcaaaaaggcactcctcctgctcttagtgggcggtgtggaccaaagtcccaggggcatgaagatcaggggaaacattaacatatgcctcatgggggaccctggggtcgcaaaatcccagctactgtcctacattgataggctggctccgagaagccaatacactaccggccgcggatcatctggcgtggggctaacagccgccgtcttacgcgattctgtatctggcgagttgaccttggagggaggggccctggttctggctgatcaaggcgtttgttgcattgacgaattcgacaaaatggcagaggcagatagaactgcgattcacgaagtgatggaacaacagacaatctcgatcgccaaagccggaatcttgaccacacttaatgcccgatgttcaatattagcggctgctaatccagcttacggcaggtacaatccccgtagatcactcgaacaaaatatccagctcccagctgccctcttaagcagatttgaccttctctggctgatacaggacagaccggacagagacaatgatctgcggctggcgcagcacataacttacgtgcaccaacacagtaggcaaccacccagtcagttcgagccgttagatatgaaattgatgcgtcgctatatagcgatgtgtcgggagaagcagccaatggttccagagtctttagccgattacattacagccgcatacgtcgaaatgaggcgggaagcttgggcttccaaggatgctacttacacatctgcacgcaccctactcgccatcctcagactctccactgccctggcccggctgcgaatggtcgacgtagtcgagaaagaagatgtaaacgaagcaatcaggctgatggagatgagcaaggactccctgcttggcgataaaggccagactgcccggacacagaggcctgccgacgtgattttcgctaccgtgcgggagctggtgtctggcggccgttccgttagattctctgaagccgaacaacggtgtgtgtctcgtggcttcactccagcccagttccaggccgcgctggatgaatacgaggagcttaatgtctggcaggtaaacgccagtcgcacacggattacattcgtctag

SEQ ID NO: 195220 - DNA, 1170 bp, Artificial Sequence
  Description of Artificial Sequence: Synthetic coding sequence
atggccctgaaggactacgccctggagaaggagaaggtgaagaagttcttgcaggaattctaccaggacgatgagctggggaaaaaacaatttaagtacgggaaccagttagtccggctggcgcaccgcgagcaggttgccctgtacgtggatcttgatgacgtggctgaggacgatccagagctcgtagactctatatgcgaaaacgcaagaaggtatgcgaagctcttcgctgacgctgtacaggaactgctgccacaatataaagaaagggaggtggttaacaaagatgtgttggatgtttacattgaacaccgcctgatgatggagcagcgctccagggatcccgggatggttcggagccctcagaatcagtaccctgccgagttgatgaggaggtttgaattgtatttccagggaccaagctctaataagccaagagtgatacgagaagtgcgtgccgacagcgtaggtaaactggtcactgtgaggggcatagtcacccgggtgtccgaggtaaagcccaaaatggtggtcgccacttacacttgcgatcagtgtggagccgaaacgtaccagcctatccagtctcctactttcatgcctctcatcatgtgtccttctcaagagtgtcagacaaaccggagtggcggacgcctgtacctgcaaacaagaggctcacggttcatcaagttccaggagatgaagatgcaagagcattctgaccaagtccctgtcgggaatatccctaggtccatcacagttttggtggaaggagaaaatacacgaatagcccaacccggcgatcatgtgagtgtgacaggcattttccttccgattctccgtaccggatttcgccaagttgtacaggggctcctgtctgagacttacctggaagctcacaggattgtcaagatgaataagagcgaagacgacgagtctggtgccggcgaattgacccgcgaggaactacggcagatagccgacgtgatttttgctaccgtgagggagctcgtgtccggaggaaggagcgtgcgattttccgaagccgaacagaggtgcgtaagccgaggattcacgcccgctcagttccaggctgctctggacgagtacgaagagctgaacgtgtggcaagtgaacgcttcccgaacacgcatcacctttgtttag

SEQ ID NO: 195221 - DNA, 1632 bp, Artificial Sequence
  Description of Artificial Sequence: Synthetic coding sequence
atggtggtggccacctacacctgcgaccagtgcggcgccgagacctatcagccaatccaatcccctaccttcatgcctctcattatgtgtcctagccaagagtgtcagacaaacagaagcggtggccgtctttatctgcagacacgcggatcacgctttattaaattccaggagatgaagatgcaggagcatagcgatcaggtgcctgtggggaatatacctcggtccattacagtcttggtcgaaggcgagaatacccggatcgcgcaacccggcgatcacgtgagcgttactggaatattcttacccattcttcggacgggcttccggcaggtggtgcaaggcctcctgagcgagacttacttagaagcccataggatcgttaaaatgaacaaaagcgaagacgatgagtccggagccggcgagctaaccagggaggaactgcgccagatcgctgaggaggacttctacgaaaagctggccgcgtctatcgccccagagatatatggacacgaggatgtgaagaaagccttgctattattgctggttgggggagttgatcaaagcccccgcggcatgaagatcagagggaacattaacatctgcctcatgggagatcccggcgtggccaagtctcagcttctgagttatatcgacaggcttgccccccggtcccagtacactaccggcagagggtcaagcggagtaggacttaccgctgccgttctccgggatagtgtgtccggcgagctgaccttggaaggaggggcactggtgttagccgaccagggcgtgtgttgcatcgatgagtttgataagatggcggaggcggatcggactgccattcacgaggtgatggaacagcagacaattagtatcgcaaaggccggcatccttacaacgctcaacgcccgatgttctatccttgccgcggcaaatcctgcatatggaagatataatccacggcgtagcctagagcagaatatccagcttcccgctgcactgttgagcagatttgaccttctttggctgatccaggacagaccagatcgcgataacgacctcaggctcgcgcaacacattacttatgtgcaccagcacagccgtcagcccccatcacagtttgagcctctggacatgaaactgatgaggaggtatatcgccatgtgccgagaaaagcagcccatggtcccagaatcacttgccgactacataaccgcggcgtacgttgagatgagaagggaggcctgggccagtaaagatgccacatacacctcagcccgaactttactggctatccttcgactgtcaaccgccctggcgagactgagaatggtagacgttgtagaaaaagaagatgttaacgaagcaataagactgatggaaatgagcaaggactctctgctcggggataaaggtcaaacagcccgcacccaacgaccagcagacgtgatcttcgctaccgtgagggagctcgtctctggaggtagaagcgtacggttcagcgaagccgagcagcgctgtgtctccagaggcttcactcctgcacagtttcaggctgcccttgacgagtatgaagagctgaatgtatggcaagtgaatgcaagcagaacaagaattaccttcgtttag

SEQ ID NO: 195222 - DNA, 1839 bp, Artificial Sequence
  Description of Artificial Sequence: Synthetic coding sequence
atgatggagcagcggagccgggaccccggcatggtgcggagcccccagaaccaataccctgccgaacttatgagaagatttgaactctatttccaggggccatcttctaacaagccgagggtgattagggaagtgagggctgatagcgtgggcaaactggtcactgtccgagggatagtcacaagagtgagcgaggtcaaaccaaaaatggtcgtcgccacctatacatgtgatcaatgcggggcagagacctatcagcccatccagtcccccacctttatgcctctcataatgtgccctagtcaggagtgccaaactaacagaagcggggggagactgtatctgcagacacgcggcagtagattcatcaaattccaggagatgaaaatgcaggaacacagcgaccaggtacccgtgggcaatatccctcgcagcataacagtgctagtcgagggggagaacactagaatcgcgcagccgggagatcacgtatcggtcaccggcatattcctacccatcctccgaacaggatttcgtcaggttgttcagggattgttgtccgagacctacctggaagcacaccgcatcgtgaaaatgaataagtccgaggacgatgaatccggggcaggggagcttacgcgcgaggagctgcgccaaatcgcagaggaagacttttacgaaaagctggccgcgagcattgctcctgagatttacggccatgaagatgttaagaaggccctgttgctgctgctcgtggggggcgtggaccaatcacctagaggtatgaaaattcgaggtaatattaatatttgccttatgggcgatccgggcgtggccaaatcacagctactgtcctacatcgaccggctcgccccccgatcccagtataccacaggacgagggtcctccggggtggggctgacggcagccgtgctgagggactctgtgagcggcgaactgaccttggaagggggggccttagtgctagccgaccaaggagtgtgttgtatagacgagttcgacaaaatggccgaagcagataggacagcaattcacgaagtcatggagcagcagacaatctccattgctaaggccggtatactcaccaccctgaatgcaaggtgctctattttggcagctgccaaccctgcatatggccggtacaatccccggaggtccctggaacaaaacattcaactgccagcagccctcctcagccgattcgatctgctctggctgattcaagacaggccagatcgtgataatgatctgagattagctcagcatattacttacgtgcaccagcatagtaggcagccacccagtcagtttgaacccctggacatgaaactcatgcgcaggtatattgccatgtgtagagagaaacagccaatggtgcccgaatctctggcagactacatcactgcagcttacgtcgaaatgcgcagggaggcctgggccagcaaggatgccacatacacttcagccagaaccctgctggccatcctgaggctgtcgaccgctctagcaaggcttcggatggtcgatgtggtggagaaggaggacgtgaacgaggccatccgactgatggagatgtccaaggattcacttctgggagataagggacagactgccaggacccaaaggccagccgatgtgatctttgcaactgtcagggaactagtgtcaggaggtcgatccgtccgattctctgaagccgagcagcgctgcgtaagtaggggcttcacccccgctcagtttcaggctgccctagacgagtatgaagagctcaatgtttggcaggtaaacgcaagcaggactcgcattacgtttgtgtag

SEQ ID NO: 195223 - DNA, 1971 bp, Artificial Sequence
  Description of Artificial Sequence: Synthetic coding sequence
atgacccccagctggtggacccagttcgtgcggatgcccggcgccacccgctcgagtttgcttatgccctactacaaagaacgcgaggtagtgaataaggatgtgctggacgtgtatattgagcataggcttatgatggagcaacgttctcgcgaccctggaatggtgaggtctcctcagaaccagtaccctgccgagttgatgcggcgttttgaactgtacttccaggggccttctagcaacaagccacgtgtgatccgcgaggttcgcgctgactccgtagggaaactggtgaccgtgagaggaatcgtcactcgcgtgtctgaagtgaaaccaaagatggtggtggccacgtacacatgtgaccaatgcggagcagaaacgtatcaacctattcagtccccaaccttcatgcctttgatcatgtgtcccagccaggagtgccagacaaaccgtagcggcggccgtctttatctgcaaacgcggggaagccggtttatcaagtttcaggagatgaaaatgcaggagcactcagaccaggtacccgtgggcaacatacccaggtcgataaccgtgctagtcgaaggagaaaataccaggattgcacagcccggggatcacgtttctgtgaccggtatcttcttacccattctgcgaacaggctttagacaggtggtacagggattattgagcgagacatatttggaggctcacaggatcgtcaagatgaacaagtccgaagatgacgagagcggagctggagagcttacacgcgaggagctgcgtcagatcgctgaggaggacttctatgagaaactggcagccagcattgctcctgagatctatggccacgaggacgtgaaaaaagccctgctgctgctgttggtgggcggggttgaccagtccccccgggggatgaagattcgcggcaacataaacatctgtctcatgggggatcccggtgtcgctaagtcccagctactttcatatattgaccgcctggcaccccgctctcaatacaccaccggcagaggatcttccggagttggactgacggcggccgtgctgcgcgacagtgtatcgggagaactcaccctggagggcggtgccctagtccttgcggaccagggggtctgttgcatcgatgagtttgataagatggcagaagcagacaggactgcgatccatgaagtgatggagcagcaaaccatctctattgccaaagccgggatcctcacaactctgaacgccagatgcagtattctggccgccgccaatcctgcctacggtcggtacaatccgaggcgttctcttgagcagaacattcagctcccagctgcccttctctcgcgatttgacctcctgtggctcatacaggaccgacccgaccgcgataatgatctgagattagcccagcatattacatacgtgcaccaacacagtaggcagcctccttctcagtttgagccgttggatatgaaactgatgcgcaggtatatcgcaatgtgcagggaaaagcaaccaatggtgccagaaagtcttgcagactacatcaccgcagcttatgtcgagatgcgacgtgaggcttgggcatcgaaagatgcgacatatacttccgctcgcacactgctggccattctcagactatccaccgccctggctcggctccgaatggtggacgttgtcgagaaagaagacgtgaacgaggctatcagattgatggagatgtccaaggactctctgctcggcgacaaggggcaaacagcgcgaacacagcgccctgccgacgtgatcttcgctactgtgcgcgagctggtcagcggcggacggagtgtgcggttctccgaggcagagcagcgttgtgtcagccggggcttcacccctgcccagtttcaggccgctctggacgagtacgaggagcttaacgtttggcaggtgaacgcatctcggacaagaatcacgtttgtgtag

SEQ ID NO: 195224 - DNA, 2475 bp, Artificial Sequence
  Description of Artificial Sequence: Synthetic coding sequence
atgaacggcgagtaccggggccggggcttcggccggggccggttccaatcatggaaacgcggccggggtggcggtaactttagtgggaagtggagggaacgtgagcaccgaccagacctttctaagacgaccggaaagagaacaagcgagcagacgccccagttcctgctgtccacaaagacgcctcagtctatgcagagtactctggaccgattcattccttacaagggatggaagctctacttctcggaggtgtattctgatagttcgccacttatcgaaaagatacaggccttcgaaaagtttttcacaagacacattgatctgtatgataaagatgaaatcgagcggaagggatccatcctggtcgatttcaaagagctgactgaaggcggggaggtcacgaacctgattcctgatatcgcaaccgagctgcgtgacgcccccgagaagacgctcgcttgtatgggactggccatccaccaggtgttgacaaaagacctggaacgtcatgccgccgaactgcaggcgcaagagggactttcaaacgacggggagacgatggtgaacgtcccccacattcacgcgagagtgtacaactatgagcccctgactcagctgaaaaacgttcgcgcgaattactacggcaaatatatcgccctgcgagggactgtggtcagggtcagtaatataaagcctttgtgcacaaaaatggcttttctctgcgcagcctgcggggagatccagtcattccccctcccagatggaaaatattcacttccgacaaaatgcccagttcccgtatgtaggggaaggagtttcacggccttgcgcagctcacccctcacagttaccatggactggcaaagcattaaaattcaggagctgatgagcgatgaccaaagagaggccgggaggatccccagaacgatcgaatgtgagttggtacacgatctggtggattcatgtgtgcccggcgatactgtgacgatcaccgggattgtcaaagtctcaaacgctgaagaagcaaatagtatttccaatagcaagggacagaagactaagtcatccgaagatggatgtaagcacggcatgctaatggaattcagcctcaaggatctatatgccatccaagagatacaagccgaggagaatctttttaaattgatcgtcaactctctctgccccgttatcttcggccatgaacttgtgaaagccggtctcgctctggcactgtttggaggtagtcagaaatacgcagacgacaaaaatcggattcctatccgaggcgacccacatatacttgtcgtgggagaccccggcctagggaaatcacagatgctgcaggcggcgtgcaacgttgctcctagaggcgtctatgtctgtgggaatactacaactactagtggtctgacagttaccttatcaaaggactcttcttctggggacttcgccctcgaggctggggcattagtgctgggagatcagggcatatgtggaatcgatgagttcgacaagatggggaatcaacaccaggctctgttagaagctatggagcagcaaagcatctctcttgcgaaagccggggtggtgtgctcactccccgcgcgtacctcaatcattgctgccgccaacccagtgggcggtcactataacaaagcgaagacagtgtccgagaatttaaaaatgggcagcgccctgttatcccgcttcgacttggtctttattttactggatacgcccaacgagcaccacgaccatctgctgtctgaacatgtgattgccattagggctgggaaacagcgcaccatctcctcagctacagtcgcccggatgaattctcaagattctaacacatcagtcttggaagttgtatccgagaaaccattgtctgagaggttaaaggtcgtccctggcgagacaattgacccgatcccccaccaactcttgcgtaagtacatcgggtatgccagacaatacgtgtatcctagattgagtacagaagccgctcgggtattgcaggatttttacctggaactgcgtaagcagtcacagcgacttaatagtagtcctatcactactcgacagcttgaatctctgataagactcacagaggctcgcgccagattggagttaagagaagaagccactaaagaagatgctgaggacattgttgagatcatgaagtactcaatgctgggtacatattcagacgagttcggcaacctagattttgagcgctcacagcatggctcagggatgtctaacagaagcactgctaagagattcatatccgctctgaacaatgtagcagagaggacctataataacatttttcagtttcatcaactgcgccagatcgcaaaggagctgaatatccaagtggcagactttgaaaatttcatcgggagccttaacgatcagggatacctgctgaaaaaaggcccaaaggtttatcagctgcaaaccatgtag

SEQ ID NO: 195225 - DNA, 2382 bp, Artificial Sequence
  Description of Artificial Sequence: Synthetic coding sequence
atgaacggcgagtaccggggccggggcttcggccggggccggttccagagctggaagaggggacgggggggcggcaatttcagcggcaagtggcgcgagagagagcacagacccgatctcagcaaaaccacgggaaagcgtacctcagaacagactccgcaattccttctctccacaaagacacctcaatcaatgcaaagtaccctcgatcggttcatcccttacaaagggtggaaactttattttagtgaagtatattcagatagctcccccctcatagaaaaaatccaggccttcgagaaattttttactcgccacatcgacctgtacgataaggatgaaatcgagaggaagggtagtattcttgtcgactttaaagaactaaccgagggcggcgaagttaccaacctgatcccagatatcgcaaccgagttgagggacgcccccgagaaaaccctggcctgcatgggtctggctattcaccaggtgctgacgaaagatctcgagaggcatgccgccgaactacaggcccaggagggactatccaacgatggcgagaccatggttaacgtgccacacatacacgcaagagtttataattacgagcctctaacacagttgaaaaatgtgcgtgccaactattacggaaaatacatcgcactcagaggaactgttgttcgggtttctaatattaagcctctgtgtaccaagatggcgtttttatgtgctgcctgcggagaaatccagtccttccctctgccagacggcaaatattcactgcccaccaagtgccccgtgcctgtttgcaggggcaggtcatttaccgctctgcgctcatcgccactaactgttacgatggactggcagagcataaagatccaagagttgatgagcgatgatcagcgggaagcaggacgaatccccagaaccatagagtgcgagctggtgcatgaccttgtcgattcttgtgtgcctggggatacagtcaccattacaggaatagtgaaagtgtccaatgcagaggaggggagtagaaacaagaacgataaatgcatgttcctgctgtatattgaggcgaactcaatcagcaactctaagggacagaaaactaaatcgagcgaggacggctgtaaacacggaatgttgatggagtttagccttaaagatctgtacgccatccaggaaatccaagctgaggagaacctatttaagctcatcgtgaattccttgtgccctgtgatctttgggcacgaagctgcctgtaacgtggctccacgcggcgtgtatgtttgtgggaacacaactaccacttccggcttgaccgtcaccctcagcaaggatagcagcagcggcgacttcgcgctcgaggcaggagctttggtgttgggtgaccagggcatatgcggaatcgacgaatttgataagatggggaatcaacaccaggcactgcttgaggcaatggagcaacagtccatcagtttggcgaaggctggagtggtttgcagtttgccagcccgcacatcaataattgctgcagcaaaccctgtgggcggccactacaataaggccaagacggttagcgaaaatctcaaaatgggctctgccctgctgagtcggttcgaccttgtattcatccttcttgatacgcccaatgagcatcacgaccatcttctctctgagcatgtgattgccatccgcgccggcaagcagagaactatcagtagcgccacagtggccaggatgaactcccaggacagtaacacatccgtgctcgaggtagtatccgagaaaccactgagcgaaagactgaaggttgtgcccggggagacgatcgacccaatcccccatcaactgttaagaaagtatataggttatgcccggcaatacgtctaccccaggctgagcacggaagcagctcgcgtccttcaggatttctacttggagctgagaaagcaatcacagaggctgaactctagtcccatcactactcgccaacttgagtcactgattcgtttgaccgaagcccgcgcccggctagagctaagggaagaggcaactaaagaggacgcggaggacatcgttgagatcatgaagtacagcatgctggggacatacagcgacgaatttggcaacctcgattttgagcgttcgcaacacgggagcgggatgagtaatcgttcaaccgccaaacggtttatcagcgcactgaacaacgtggcggagcgcacttataataacatttttcagtttcaccagcttcgacagatagccaaggagcttaacatacaagtggccgacttcgagaatttcattggatccttgaatgaccagggatacttactcaagaaaggaccaaaggtgtatcagttgcagacaatgtag

SEQ ID NO: 195226 - DNA, 2643 bp, Artificial Sequence
  Description of Artificial Sequence: Synthetic coding sequence
atgaacggcgagtaccggggccggggcttcggccggggccggttccagagctggaaaagggggagggggggcggcaacttcagcggaaagtggcgcgagcgggagcaccggcccgatttgtcaaagacaactggcaagagaacgagtgaacagacaccacaatttctcctgtccactaagacaccgcagagcatgcagagcacattggatcggttcattccctataaggggtggaaactatatttttcagaggtttactctgacagctctccactgatcgaaaagatccaagcctttgaaaagtttttcacaaggcacatcgatctgtatgacaaggatgagattgaaaggaaaggctcaattctggtcgactttaaagaactcacagaagggggcgaggtgactaacctgattcctgatattgcaaccgaactgcgggacgcgcccgaaaagacactcgcttgtatgggtctggcaatccatcaggttctgactaaggatctggaacgccatgcagccgagctgcaggctcaagaagggctgagtaacgacggggaaacaatggtcaacgttcctcatatacatgctcgggtctacaattatgagcctttaactcagctgaagaacgtaagggccaattattatggtaaatatatcgcattgagagggactgtcgtcagagtgagcaacattaaacccctgtgcaccaagatggccttcttatgtgcagcttgtggcgaaatccagagttttcctttaccagacggaaaatactctctgcccacaaaatgcccggtcccagtgtgccggggtagatccttcactgccctccgctcgagtcccttgacggtgacaatggattggcagtctatcaaaattcaggaactgatgagcgacgatcagcgcgaggcgggacgcattccgagaacgatcgagtgcgaactggtacacgacctggtcgactcatgcgttcccggtgacacggtcacaattacaggaattgtgaaagtcagcaacgctgaagaagggtctcggaataaaaacgataaatgtatgttccttctgtacatcgaagctaatagtatttctaatagcaagggccaaaagacaaaatcttctgaagacggttgcaagcatggaatgttgatggagttctctctgaaggatctctatgcaattcaggagatccaggccgaagagaatttgttcaaactgatagttaaatggagtctcgcactgagccctcgcctggagtactccggggctatctccgcacattgtaatctccacctgcctagttccaattcctcaccaactagcgcttgccgcgttgctggaaccaccgggatgcggcatcaaactcagcttctgctgctggtgaaggcagggttggcactcgctctgttcggaggatcgcagaaatacgcagatgataagaaccgcatccccatccggggagacccccacatcctggttgtcggcgacccaggacttggaaagtctcaaatgctgcaggcggcatgtaatgttgccccaagaggcgtgtacgtctgcggcaacaccaccacaacaagcggcctgacagtcaccctttctaaagattcatcgagcggggactttgccctggaagccggcgccttggtgttgggcgatcaaggaatatgcggtatagacgagtttgataaaatgggcaaccagcatcaggcacttctggaggctatggaacagcaaagtatcagtctggccaaggcaggcgtcgtatgttctctcccagctaggaccagcatcatcgctgccgctaaccctgttggcggccactacaataaagccaagaccgtgtccgagaatctgaaaatgggttctgctctcttgagcaggtttgacttagtttttatcttgctcgatacacccaatgaacaccacgatcaccttctgagtgaacatgtaatagcaattcgagccggaaagcagcggaccataagctctgcaaccgtggcacgtatgaactcacaagactctaatactagcgttctagaagtggtgtccgagaaaccacttagtgaaaggctgaaggtggtccctggggaaaccattgacccaattcctcatcagctgctgagaaagtacataggctatgctagacaatacgtgtatcccagactctctacagaagctgcaagagtcttgcaggacttctaccttgagttgcgtaagcaatctcagagactcaattcatcccccataaccacgcgccagctcgagtcattaatcagactgacggaagcccgcgctcgactcgagctccgagaggaagccaccaaggaggatgccgaggacatagtggagataatgaaatattcaatgctcggtacatactccgacgaattcggaaatctggactttgaaagatcccagcatggctccggcatgagcaataggagcacagccaagcgatttatttccgccttgaacaacgtggcggagaggacctacaataacatatttcagttccatcagctgagacagatagcgaaggagctgaatatacaggttgcagatttcgagaacttcataggatctcttaacgatcagggctacctccttaagaaagggcctaaggtctatcagctgcagacaatgtag

SEQ ID NO: 195227 - DNA, 2523 bp, Artificial Sequence
  Description of Artificial Sequence: Synthetic coding sequence
atgaacggcgagtaccggggccggggcttcggccggggccggttccagtcatggaaacgcgggagaggcgggggcaacttcagcggcaagtggcgcgaaagggaacaccgccctgatttaagcaagacaacaggaaagaggacgagcgagcagaccccacagttccttctcagtacaaaaaccccccaaagtatgcaatctaccctcgaccggttcatcccatataagggctggaagctgtacttttcagaggtgtactccgattcctcaccactcatcgaaaaaatccaggcctttgaaaagtttttcactagacacatagacctgtacgataaagacgaaatcgaaaggaaagggtctatacttgtggacttcaaggaactcacagagggtggggaagtaacgaatttgattcctgacatcgcaaccgagctgagggacgcaccagagaaaaccctggcttgcatgggcctcgcgattcatcaggtcctgacaaaagatcttgagagacacgccgccgagttacaggcccaggaaggtctctctaacgatggggagaccatggtgaacgtgccacatatacacgctcgagtttataattatgaacctctgacacagttaaagaatgtgcgagctaactattacggtaaatacatcgccttacgaggaacggtggtccgggtgagcaatatcaaacctctttgcactaagatggcattcctttgtgcagcttgcggcgaaatccagagctttccgctgcctgatggaaaatactcattacctacgaagtgccccgtaccagtttgtaggggccggagttttacagctctgcgctcgtctcccttaactgtcactatggactggcaatctatcaaaattcaggagctgatgagtgatgaccagcgagaagcaggtaggattcccagaaccatcgagtgcgagttggtgcacgacttggttgactcatgcgtacctggtgatactgttacaatcacaggaatcgtaaaagtaagcaatgccgaagagggaagccggaacaagaatgacaaatgcatgttccttctgtacatcgaggccaattctataagcaattcaaaggggcagaagaccaagagttctgaggatggatgcaagcatggaatgctgatggagttctccttgaaggacttatacgccattcaggagattcaggcggaggaaaatctgttcaagttaattgtcaattctctctgccctgtgatttttgggcacgagctcgtgaaagctggtctggctctggccctgtttgggggtagccagaagtacgccgatgataagaaccggatacctattcgaggcgaccctcatatactggttgtcggtgatcctggactgggcaagagccagatgttgcaggctgcttgtaatgtggccccccggggcgtgtatgtgtgtggcaacacaaccactacatcgggcctgactgttacgttgtctaaagactccagttcgggcgactttgcactcgaagcaggcgccctggtgctgggggaccaagggatttgtggaatcgacgagttcgacaaaatggggaaccagcatcaagctcttctcgaggctatggaacagcagtcaattagtctggcaaaagctggggtggtgtgctcattgccagctagaacttctataatcgcagccgctaaccctgtcgggggtcactacaacaaggcaaagacagtgagtgagaacctgaagatgggaagtgccttgctttctcggtttgacctcgttttcatcctcttggatactccgaatgagcaccatgatcacctgttatcagagcatgtgatagcaattagggccggcaagcagagaaccatttcaagcgctacagtggccaggatgaactctcaggactctaacacaagtgttctggaggtggtcagtgaaaagccactgagcgagcgcctgaaagtggtgcctggggagacgattgaccccatcccacatcaactcttaagaaaatacatcggttatgccaggcagtatgtctacccgagactcagcactgaggccgccagggtcctgcaggacttctacctggaactgcgcaagcagtcccagcgcctgaactcctccccaatcactacccggcagctggagtctctgataagattgacagaagcccgagcccgtctagaattgcgcgaagaggccaccaaggaggatgcagaggatatagttgaaattatgaaatactctatgcttggtacatattcagatgagttcggcaatcttgatttcgaaagatctcagcatggctccggtatgagcaatagatctacagctaaaagattcataagcgctctcaataatgtcgccgaaagaacttataataacatatttcagttccaccagctgcgccagattgctaaagagcttaatatccaagtcgctgattttgagaattttatcggcagtctgaatgatcaggggtacctcttgaagaaaggacccaaggtgtatcagttacagacaatgtag

SEQ ID NO: 195228 - DNA, 612 bp, Artificial Sequence
  Description of Artificial Sequence: Synthetic coding sequence
atgaacggcgagtaccggggccggggcttcggccggggccggttccagagctggaaacgcggccgcggaggcggcaatttcagcggtaagtggcgggagagagagcataggcctgacctctctaagactactggaaagcggacatcagaacagacacctcaatttttgctgagtactaaaacccctcagtctatgcagtcaactttagatcggtttatcccatataaaggctggaaactgtatttcagtgaagtctactcagattcatcaccactgatcgaaaagattcaggcatttgagaagttcttcactcgtcacatcgacctctatgacaaggatgagattgaacggaagggctccatactggtggactttaaggagctgactgaggggggagaggttacaaacctgatccctgatatcgccaccgagctacgggatgcccccgaaaaaacgctggcatgtatgggcttggctattcatcaggttttgactaaggatctggagaggcatgccgcagaacttcaggcccaagaaggcctgtccaatgacggcgagactatggtaaatgtgcctcacatccacttccttaagaagaagaaaaagatttag

SEQ ID NO: 195229 - DNA, 1329 bp, Artificial Sequence
  Description of Artificial Sequence: Synthetic coding sequence
atggagaactggagcaaggacatcacccacagctacctggagcaggaaaccaccggaattaacaagtcaacccagcctgacgaacagctcacaatgaattccgaaaaaagcatgcatagaaagtctactgagctggttaacgagattacttgtgagaatacggagtggcctggtcagcggagtacaaatttccagattatttcctcatatcctgatgacgaatccgtttactgcaccactgagaagtataacgtgatggaacatcgccacaacgatatgcactacgagtgcatgactccatgccaggtcacctccgattccgataaagaaaagaccatcgcttttctcctgaaagagctcgacatcctccggaccagcaataaaaagcttcaacagaaactagccaaggaagataaagaacagcgaaaactgaaatttaaactcgaactgcaggagaaggagaccgaggctaagatcgccgaaaaaacggccgcattagttgaggaagtgtatttcgcccagaaggagcgcgacgaggctgtgatgtcccgcttgcaacttgccattgaagagcgggacgaagccatcgcccgggcaaagcacatggaaatgagcctaaaagtcctggagaatatcaatcctgaggagaatgatatgactttgcaggagctgttgaataggatcaacaatgcggacaccgggatagccatccaaaaaaacggcgcaatcattgttgatagaatctacaaaacgaaggagtgcaagatgcgcatcaccgccgaggagatgtccgctctcatcgaagaacgagacgctgctttgtcaaagtgtaagcgactcgagcaggagctgcatcacgttaaggagcagaatcagacatccgccaataacatgagacatctgaccgctgagaacaatcaagaacgggctctcaaagccaagctgctgagcatgcagcaggctcgggagacagctgtgcagcagtacaagaagctggaagaggaaatccagactttacgcgtgtactatagcctgcacaagtctctgtcccaggaggagaacctaaaggatcagtttaattacaccctgagtacgtacgaagaagctcttaagaatcgagagaacatcgtgtctattacgcagcagcagaacgaagagcttgccacacaactccagcaagcactcaccgaacgggctaatatggagctgcagctacagcacgcccgggaagcgtcgcaggtggcaaacgagaaggtgcagaagctagaaagacttgttgatgtgctgaggaagaaagtgggaacgggcacgatgagaactgtgatttag

SEQ ID NO: 195230 - DNA, 1329 bp, Artificial Sequence
  Description of Artificial Sequence: Synthetic coding sequence
atggagaactggagcaaggacatcacccacagctacctggagcaggaaactacaggcatcaataagtctacccagccagacgaacagctgactatgaactcagagaagagcatgcaccggaagtcaactgagcttgtgaatgagattacttgtgagaatacagagtggcctggacagaggtctaccaactttcagatcatctcctcctatcccgatgatgagagcgtatactgcaccaccgagaagtacaacgtgatggagcaccgtcataatgatatgcactacgagtgtatgactccctgtcaggtcacttctgactctgataaagagaagactatagcctttttgctgaaggaacttgatattctccgcacttccaataaaaaactgcagcagaaacttgccaaggaagataaggagcaaagaaaactcaagttcaaattggagctccaggagaaggagactgaggccaagatcgctgaaaagaccgccgcccttgtcgaggaggtttattttgcacagaaggagagagacgaagccgtgatgagccggctgcagttggcaatcgaggagagagacgaggccatcgcacgtgctaagcacatggagatgagtttaaaggtgctagagaatataaatcctgaggagaacgacatgactctgcaggagctgttaaatagaataaataatgctgacacagggatcgcaattcagaaaaacggcgctatcatagtggatcgaatatataaaacaaaggaatgtaaaatgcgcatcaccgccgaagagatgagcgccttgatcgaggaacgtgacgccgctctgagcaagtgtaaacgcctcgagcaagagttacatcatgtcaaggaacagaatcagaccagcgcaaacaacatgcggcatctgacagcggaaaataaccaagagcgggccttgaaggctaagctgctatccatgcagcaggctcgagaaaccgctgttcagcagtataagaagctagaagaagaaatacaaactctcagagtttactacagcctccacaagtccctgtcgcaggaagagaacctgaaggatcagttcaattacactcttagtacatacgaggaagctctcaagaaccgcgagaacattgtgtctatcactcagcagcagaatgaggagctggctacgcagctacagcaggccctgacagagcgagccaacatggaactccaactgcagcacgcaagggaggcttcgcaggtggcaaacgaaaaagttcagaagctcgaaaggctcgtcgatgtgctccgaaagaaagtcggaacaggaacaatgagaacggttatctag

SEQ ID NO: 195231 - DNA, 786 bp, Artificial Sequence
  Description of Artificial Sequence: Synthetic coding sequence
atgagccggctgcagctggccatcgaggagcgggacgaggccatcgcacgcgccaagcacatggagatgtcgttgaaggtgcttgagaatattaaccccgaggagaacgatatgaccctccaggaattgttgaaccgcatcaataatgctgacactggcattgcaatccagaagaatggagctatcatagtggatagaatctacaagacaaaagagtgtaagatgaggatcacagcagaggaaatgagcgcccttatcgaggagagagacgcggcactgagcaagtgtaagcgactggaacaagaactccatcacgttaaggaacagaaccaaacttccgctaacaatatgagacaccttactgctgagaacaaccaggaaagagccttgaaggctaaactgctgtcgatgcagcaggctagggaaaccgcagtgcagcagtacaaaaaactcgaggaggaaatccagaccctcagagtctactattctttgcataaatctctttctcaggaagagaatctgaaagatcagtttaattacacgctgtctacttatgaagaggctctcaagaatagagaaaatattgtgagcattacacaacagcagaacgaagagctggctacacagttgcagcaggctcttacagagagagcgaatatggagctacagctccagcacgctcgtgaagcttctcaggtggccaatgaaaaagtccagaaactggaaagacttgtggatgtccttcgcaagaaggtgggcacaggcaccatgcggacagtgatttag

SEQ ID NO: 195232 - DNA, 1329 bp, Artificial Sequence
  Description of Artificial Sequence: Synthetic coding sequence
atggagaactggagcaaggacatcacccacagctacctggagcaggagactactgggattaacaaatccacacagcccgacgagcagctgaccatgaacagcgaaaagtctatgcataggaagtcaaccgagttggttaatgagattacctgtgaaaataccgaatggccggggcaaagaagcacgaactttcagataattagctcatatccggacgatgagtccgtgtactgcactacagaaaaatacaacgtaatggagcatagacataatgacatgcactatgagtgcatgacaccttgccaggtaacgtctgactccgacaaggagaagaccatcgcattcctgctgaaagaacttgatatcttgcgcactagcaataagaagctgcagcaaaagttggccaaagaggataaggagcaacggaagctcaaatttaagctcgaactgcaggagaaggagacagaggccaaaatcgccgagaaaaccgctgcgctagtcgaagaagtgtacttcgcacaaaaggagcgtgacgaggcggtgatgagcaggttacagttggccattgaggagcgggatgaagccattgctcgcgcgaagcacatggaaatgagcctgaaagtcctggaaaacatcaacccggaagagaacgatatgacccttcaggagttgctcaatcgcattaataatgctgacacgggaatagcaatccaaaagaacggtgccatcatcgtggatcgcatctacaagacaaaggagtgcaaaatgcgcatcacggccgaggaaatgtcagccctaatcgaagagcgcgatgctgccctgagtaagtgcaagagactggagcaagaactgcatcatgtcaaggaacagaatcagaccagcgcaaacaatatgaggcacctcacagcagaaaacaaccaggaacgggcattaaaggccaagcttctgtctatgcagcaggccagggaaacggccgtgcagcagtacaagaagctggaagaggagatccagacactgcgggtgtactacagtctccacaagagcctaagtcaggaggaaaaccttaaagaccagtttaattacaccctgtcaacgtatgaagaagcactgaagaatcgcgagaacatagtttcgatcacccagcagcagaacgaagaattggctactcagctccagcaggctctgaccgagcgggccaacatggaactacaactgcaacatgcaagggaagcatcccaggtagccaacgagaaggtgcagaagctggaacgcctggtagacgtcttgaggaagaaagtgggcacaggcaccatgcgcacagtgatctag

SEQ ID NO: 195233 - DNA, 1275 bp, Artificial Sequence
  Description of Artificial Sequence: Synthetic coding sequence
atgaacagcgagaagagcatgcaccggaagagcaccgagctggtgaacgaaataacttgcgaaaataccgagtggcctggacagagatccacgaattttcagatcatctcgagctatccggacgacgaatcagtttactgcacaaccgagaaatataatgtaatggagcataggcataacgacatgcattatgagtgcatgaccccttgtcaggtcacatcagactcagacaaagagaaaacgattgcatttctgctgaaggagttggacattctcaggacctctaataaaaagttgcagcaaaagctggccaaagaggacaaggagcagaggaagctcaagtttaagttggagcttcaggagaaggagactgaagccaagatcgccgaaaaaactgcagcactcgtggaagaggtatacttcgctcagaaggaacgcgacgaggccgtcatgtccaggcttcagctggccattgaggagcgcgacgaagccatcgcgcgggccaagcatatggagatgagtctcaaagttctggagaatattaatcccgaagagaatgatatgacgctccaagaattgctaaatcgcattaacaatgccgataccgggatagccatccaaaagaacggggccattatcgtcgatcggatctacaaaacgaaagaatgtaaaatgcgcatcaccgcagaggagatgtctgctctgatagaggaacgggatgcggcactgtctaaatgcaaaagactcgagcaggaactacaccacgtaaaagaacaaaatcagacctccgctaacaacatgaggcacctgaccgcagagaacaaccaagagcgggccctgaaggcgaagctgctgagtatgcagcaagccagagaaacggccgtccagcagtacaaaaaactagaggaggaaattcagactctacgcgtgtactacagcctgcataaaagcctgagtcaggaagagaatttgaaggaccagttcaactacacccttagcacgtacgaagaggccctcaaaaatcgagaaaatattgtgtcgataacgcaacagcagaatgaagagttggcgactcagctccagcaggctttgacagaacgggccaacatggaattgcagttacagcacgcgcgggaggcgtcacaggttgccaatgagaaggtacagaaaagccagatccagatttatttcatccccaacaagaaagatgagcgtgaaaagttcctcatggacaaaagaaggaagatcgtagctcactctaaacagaacagttag

SEQ ID NO: 195234 - DNA, 315 bp, Artificial Sequence
  Description of Artificial Sequence: Synthetic coding sequence
atggagaactggagcaaggacatcacccacagctacctggagcaggagacaacagggattaacaagtcaactcaacccgatgaacagctgaccatgaattcggaaaaatccatgcaccggaaatccactgagttagtgaacgaaataacctgtgagaatactgagtggcccggtcagaggagcaccaactttcaaattattagctcttaccccgacgatgagagcgtctactgtaccacggagaaatacaatgtgatggaacaccggcataatgacatgcactacgaatgtatgaccccttgccaagtgacctag

SEQ ID NO: 195235 - DNA, 387 bp, Artificial Sequence
  Description of Artificial Sequence: Synthetic coding sequence
atggagaactggagcaaggacatcacccacagctacctggagcaggaaacaacgggcattaacaagagcactcagccagacgagcagctcaccatgaatagcgaaaagtcaatgcaccggaaaagtaccgaactagtcaatgagattacatgcgaaaatactgagtggcccggacagaggagcacaaacttccagataatcagctcataccctgatgatgagtccgtctattgtaccacagaaaaatacaatgttatggaacatcgacacaatgacatgcattatgagtgcatgaccccatgtcaggtaacaagtgatagtgataaagaaaagacaattgctttccttctaaaggaactggatattctgaggacatcaaacaagtag

SEQ ID NO: 195236 - DNA, 3912 bp, Artificial Sequence
  Description of Artificial Sequence: Synthetic coding sequence
atgggcgaccccgcccccgcccggagcctggacgacatcgacctgtctgcactgagggaccccgccgggatatttgagctggtggaagtggttggcaacgggacctacggccaggtctacaagggcagacatgtgaaaaccggccaactcgctgccatcaaagtaatggatgtcacagaagacgaggaagaagagatcaaacaggagattaacatgcttaaaaaatactcacatcatcgtaacattgcaacctattacggagccttcattaaaaagtctccccccgggaacgatgaccagctgtggctggtcatggagttttgcggtgccggatccgtgaccgatctggtgaagaataccaagggcaatgcactcaaagaggattgtattgcgtacatctgtcgcgaaatactgcgcggactggcccacctccatgcccacaaggtcattcacagggacattaagggacagaatgtactgttgactgagaatgccgaggtgaaattggttgatttcggggtgtctgcacagttggacagaacagtgggtcgaagaaacacttttattggcacaccatactggatggcacccgaagtgatcgcgtgcgatgagaatcctgacgctacctatgactatcgcagtgatatatggagtctcggcattacagcaatcgaaatggccgagggcgcaccaccactgtgtgatatgcatccgatgagggcccttttcctgataccgcggaacccacctccaagactcaagtccaagaagtggtcaaagaaatttatcgatttcatcgatacctgtctgataaagacctacctcagtagaccgccgacggagcaactgttaaaattccctttcatacgggaccagcccacagagcgacaggtgaggatccagttaaaagatcacattgatcggtccaggaagaagcgcggagagaaggaagaaactgaatatgagtactccggatcagaggaggaagatgactcacatggagaggagggtgaaccttcctctataatgaatgttcctggagagagcacactcaggagggaattcctgcgcctgcaacaggagaataagagcaattcagaggctctgaagcagcagcagcaattgcagcagcagcaacaaagggaccctgaggcccacattaagcatctgttacaccaacgtcagcggaggattgaagaacagaaggaggagcggaggagagtggaagagcagcagagacgcgaaagggaacagcgaaagctgcaagaaaaggagcagcaaaggaggctcgaggatatgcaggctttgcgccgggaggaggaacgcaggcaggccgagagggaacaggagtacaaaaggaaacagttagaggagcagcggcagtctgagagactccagagacaactgcagcaggaacatgcctatttaaagtccctccaacagcagcagcagcagcagcagctgcagaagcagcagcagcagcagctgctaccaggcgaccgcaagcctctctatcattatgggcgggggatgaaccccgccgataagccagcttgggcccgggaggtagaagaacgaacacgcatgaacaagcagcaaaatagtccactggccaaaagtaaacctggatccactggccctgagcctcccatccctcaggccagtcctggtccaccaggacccctcagccagacccctcctatgcaaagaccagtcgagccgcaagaaggcccgcataagtctcttgtggctcacagggtcccccttaaaccgtatgcagcccctgtccctcggtctcaaagtctccaggatcagcccaccaggaatctggcagcttttcccgcgtcacacgaccctgatccagctattcccgccccaacagctacgccgtcagcgagaggtgccgtgattcgccaaaacagcgatccaacaagtgaggggcctggcccctcccctaatcctccggcctgggtccggccagacaacgaagcaccgcccaaggtgccccaacgaacttcgagcattgctacggcgctgaataccagcggggccggcgggagccgcccagcacaggccgtacgcgctagcaatccggatctgaggagatctgatccggggtgggagaggagcgacagcgtcttgcctgcctcgcatgggcatctcccacaggctggctccttagagaggaacagagtgggagtgagcagtaaacctgacagctccccagttttgagcccagggaacaaggcaaagccggacgaccacaggagcagacctggaagacctgcgtcatacaagcgggcaatcggggaggatttcgtcctccttaaagagcgcactcttgacgaagcccccaggcctcccaaaaaagctatggactacagttcaagcagtgaggaagtggaaagctccgaggacgatgaagaggaaggtgaaggcggaccagccgaaggatccagggacactccgggcggccgcagtgatggggacacagacagtgtttccactatggtggttcatgacgtcgaggagattaccggcacccagccaccatacgggggagggactatggtcgtacaacgaacacctgaggaggaaagaaaccttttgcatgcggactcgaacgggtacactaatctgcccgacgtggttcagcctagccacagcccaacagagaatagcaagggacaaagtcctccatcaaaagacggctctggtgattatcaatctcgcgggctggtcaaggcccctggtaaatcttcctttactatgttcgtcgatctgggtatatatcagcccggaggatcgggagattcaatacccattacagcgttggtggggggtgagggtactcggctggatcaacttcagtatgacgtgcggaaggggagcgtggtcaatgttaaccctaccaacaccagagcccattcagagactccggagattcggaagtacaaaaaacgattcaactctgaaatcttatgcgcggcattgtggggggttaacctactggtgggaacggagaatggactgatgctgttggaccggtccggacagggaaaggtctacggcctgatcgggcgaaggaggtttcagcagatggacgtactggaagggttaaatttactcatcacaatcagtggcaagagaaataagctcagagtctactatttgagttggttgagaaataagatactacacaatgaccccgaagtagagaagaaacagggctggaccactgtgggagatatggaggggtgcggacactacagggtagtgaaatacgaacgcatcaaattccttgtcatcgctctcaaatcaagcgttgaagtttatgcttgggctccaaagccataccacaaattcatggcttttaaatcttttgctgatctgccccatcggcctctgctggtggaccttacggtcgaggaaggccaacgtctgaaggttatttatgggagtagcgcaggatttcacgcggtcgatgtggatagcggaaacagttatgacatctacatcccagtccatatccagtcccagatcacacctcacgccatcatcttcctgcccaatacagatggcatggaaatgctgttatgctacgaggacgaaggcgtctatgtgaatacatacgggcgtataattaaagatgtcgtgttgcagtggggcgaaatgcccactagtgtggcgtatatttgctccaatcagatcatggggtggggggagaaggccattgaaatccgctctgttgagacgggtcacctcgacggagtctttatgcataagcgggctcagaggctcaaatttctctgtgagcgcaatgacaaggtgttttttgcttctgtgaggagcggcggtagcagccaggtctactttatgaccttgaaccggaattgcatcatgaattggtag

SEQ ID NO: 195237 - DNA, 3999 bp, Artificial Sequence
  Description of Artificial Sequence: Synthetic coding sequence
atgggcgaccccgcccccgcccggagcctggacgacatcgacctgagcgccctgcgcgatcccgctggtatattcgagttggtggaggtcgtaggcaacggcacctatgggcaggtttacaagggccgccatgtaaaaactggacaactcgctgcaatcaaagtgatggacgtgacggaggacgaggaggaggagataaaacaggagatcaacatgttgaagaagtactcccaccacaggaatattgctacctattacggcgccttcataaaaaagtccccacctggcaatgacgatcaactctggctggttatggagttttgcggtgcaggctccgtgacggatctggtcaagaacactaaaggtaatgccctcaaagaggactgtatcgcttacatttgccgagagatcctccgagggcttgcccatctgcacgcccataaggttattcaccgggacattaaaggacagaacgtactacttactgagaatgcggaggtgaagctggtggactttggagtgtctgcccagctggacaggactgtcggccgacgcaatacctttatcggcacgccttactggatggctcctgaagtaatcgcctgcgatgagaatcctgacgcaacatatgactatcggtcggacatatggagcctaggaatcacggctattgaaatggccgagggagcaccccccctgtgtgacatgcatccaatgcgcgcactcttcctgatcccgcggaaccctcctcctcggctgaagtccaaaaagtggagcaagaagttcattgacttcattgacacttgtctgatcaaaacttatctaagccgtccaccaacggagcaattgcttaagtttcccttcatccgcgatcagccaacagagcggcaggtacggatccagcttaaagatcatatcgaccgcagccggaagaagaggggggagaaggaagaaaccgaatacgaatactcaggctcagaggaggaagatgactctcatggtgaggagggtgagccaagttcaattatgaacgttcctggagagagtacgctccgtcgggagttcctacggctgcaacaggaaaacaaatccaactccgaagcactgaagcaacagcaacaactccaacagcagcagcaaagagatccagaggcccatataaagcacctcctgcaccagcggcagagacgtattgaggaacagaaagaggagcgacgacgcgtggaagagcagcagcgacgggagagggagcagcggaagctgcaggaaaaagagcaacaaaggaggctcgaagatatgcaggctttgcgacgtgaggaagagcgacgacaggccgaaagggagcaagaatacaagcgcaagcagctggaagagcagagacagagtgaacggctgcagcgccagttgcagcaggagcatgcatatctcaaaagtctccagcagcagcagcagcagcagcagcttcagaagcagcaacagcaacagctcttgcctggggaccgcaaaccgttatatcactatggtagggggatgaatcccgccgacaagcctgcatgggcacgggaggttgaggagcggacacgaatgaacaagcagcagaacagccccttggctaaaagcaagccaggcagcaccggccctgaaccaccaattcctcaggcatcccctggcccccctggaccactgtcacagactcctccgatgcagagacccgttgagccacaggaagggccccataagtctctggtggcccaccgcgttcccctgaaaccttacgcagccccagttccgcgctcccagtcccttcaggaccaacccacccggaacctggccgctttccctgcctcccacgaccctgatcccgctattcctgccccaacagcaacaccttccgcacggggagcagtgattagacagaattctgatccaacaagcgaagggcccggcccttcacctaatccccccgcctgggtcagacctgacaatgaggcaccgcccaaggttccgcagagaacatccagtatcgcaacagcgctcaacaccagcggggcgggaggttctagaccggcccaggccgttagggcccgtcccagaagtaactccgcctggcagatttacttgcagagacgggccgagaggggaaccccaaagccgcccggcccgcctgctcaaccccccggcccgccgaatgcatcttctaatcccgacctgaggcggagcgaccccggctgggagcggtctgacagcgtcctgccggcgtctcacggtcatctgccacaggccggctctcttgaacggaaccgtgtgggggtttcaagcaaaccagatagtagtccggtgctcagccctggcaacaaagcgaagcctgacgatcatagaagtcggcctggaaggccagcggatttcgtccttcttaaagagcgcactctggatgaggctcctcggcctcctaagaaagcaatggattactccagctcctccgaggaagtggagtcgtccgaagatgatgaggaggagggagaaggtggtcctgccgaaggtagcagagacacccccggggggagatccgacggggacactgatagcgtgtccaccatggtcgtgcacgacgtcgaggaaattactgggacacagcccccctacggaggcggcaccatggtcgtacagcggacgcctgaagaggagagaaatcttctgcacgctgattctaacggatacactaatttaccagacgtggtgcagcctagccactcaccgactgaaaattctaagggtcagtcccctccgtctaaagatggcagtggcgactatcaatctagggggcttgttaaagccccaggaaaatcaagctttactatgttcgtggacctaggaatatatcagccgggaggttccggcgactcgatccccattaccgccctcgtagggggagagggaacccgactcgatcaactacagtacgatgtgcgcaagggtagtgtcgtcaatgtaaatcctaccaacacaagggctcacagcgagacaccagagattaggaaatacaaaaagcggttcaactcagagatcttatgtgctgctctctggggcgtcaaccttttagtgggcactgaaaatgggctgatgctgctcgatcgctcgggtcagggcaaggtgtacggtctcattggaaggcggcgtttccagcagatggacgtgctggagggcctcaatctgctgatcacaatatcaggcaagcgcaataaacttcgggtatattacctgagctggttgcggaacaagattcttcacaatgatcccgaagtggagaaaaaacagggctggacgacagttggggacatggaaggatgcggtcactatagggtagtgaagtatgagcgaatcaaattcttagttattgccttaaagtcttcggtggaggtttatgcatgggcccccaaaccttatcacaagtttatggcctttaagtcgttcgctgatctccctcaccgcccgctcctcgtcgatctgactgttgaggagggtcagcgcctgaaggtgatctacgggtcgtcagcaggcttccacgctgtggatgtggatagcggaaacagttacgacatttatatccccgtccatatccaaagccagattaccccacacgctataatctttctgcccaacacagatggaatggaaatgctcttgtgttatgaggatgaaggcgtgtacgtaaatacctacggccggatcattaaagacgtggtgctccagtggggggaaatgcctacttcagtggcatacatttgctcaaaccagatcatgggctggggcgaaaaggccatagaaatcagatcagttgaaacaggccacctggacggagtgtttatgcacaagagggcgcagcggcttaaattcctgtgcgagaggaatgataaggtgttttttgccagtgtcaggtctggtggcagcagccaggtctattttatgactctaaatagaaactgtataatgaactggtag

SEQ ID NO: 195238 - DNA, 3939 bp, Artificial Sequence
  Description of Artificial Sequence: Synthetic coding sequence
atgggcgaccccgcccccgcccggagcctggacgacatcgacctgtcagccctgcgggatccggctggaatttttgaactcgtcgaagtagtgggcaatgggacttatgggcaggtgtataagggtcggcatgttaaaactgggcaactggcagccattaaggttatggacgtcaccgaggacgaggaagaagaaatcaagcaggagatcaatatgcttaagaagtacagtcaccacaggaacattgctacctattacggagcttttattaaaaagagcccaccaggcaatgacgatcaactgtggctcgtaatggagttctgcggtgcaggatctgtgacagatctagtgaaaaatactaagggaaatgcactcaaagaagactgtatagcttacatttgtcgcgagatactgaggggcctggcccatctgcatgcccacaaggtgattcacagggatatcaagggccagaatgtgctcctgaccgaaaatgctgaggtcaagctggtcgacttcggtgttagcgcccagctcgacaggacagtcggtcgccggaacacattcatcgggacaccatattggatggccccggaggtgattgcctgcgacgagaacccagatgccacatatgattatcggtccgacatctggtcgctgggcatcacagcaatagagatggctgaaggcgcccccccgctttgcgacatgcaccccatgcgggccctctttctgatcccaagaaatcctcccccgcgtttaaaaagtaagaagtggtccaaaaagtttattgattttatcgatacttgtttgattaagacctacctatctaggcctcccacagaacagctgctgaaatttcctttcattagagaccaaccaaccgagcggcaggtccgaattcaactgaaggatcatatcgataggtccaggaagaaacgcggcgaaaaagaggaaactgaatacgaatattcaggcagcgaggaggaagatgactctcatggagaagaaggggagccctccagcattatgaacgttcctggtgaatctaccctcagaagggagtttcttcgtctacaacaagaaaataagtcgaattctgaagccctcaagcagcagcagcaactgcagcagcagcaacagagggaccccgaggctcacattaaacacctgctgcaccagcgacagcggcgcattgaagagcagaaggaagaacggaggcgtgtggaagagcagcagcggcgcgaacgggagcagcggaaactgcaggaaaaggagcagcagcggagactggaggatatgcaggcactcagacgcgaggaagagcgccgccaagccgagcgtgagcaagaatacaagcgcaaacagcttgaagaacagcgtcagagcgagcgcctgcaaagacagctgcagcaagaacatgcatatctgaaaagcctccaacagcaacagcaacaacagcagctgcaaaagcaacaacagcagcagctgctccccggagacaggaagccattgtaccattacgggcgtgggatgaatccggccgataagccagcttgggcccgggaagtcgaagagagaacaaggatgaataagcagcagaactcacctttggcaaaatctaagcccgggtcaaccggccccgaacccccgatcccccaagcatccccaggtccccccggccccctttcacagactccccctatgcaacggcccgtggaaccgcaggagggcccacacaagagtttgcaagatcagcccacccgtaacctcgctgcatttccagcatcccacgaccccgatccggcaattccagcgccaacagccactcccagcgctagaggcgcggtaattcgccagaattccgatccaacttctgaggggcctggcccaagccccaacccacccgcatgggtgcgtcctgacaacgaggctccccctaaggtgcctcagcggacgagttctattgccactgcgctcaatacctcgggtgctggtggctcccgccccgctcaggctgtacgagcacgcccaagatctaattctgcttggcagatctacctgcagcgccgtgccgaacgcggaacgcctaaacctcctgggccgccggcccaacctcccggccctccaaatgcttcctccaatcctgatctgaggagatccgaccctggctgggaacgctctgacagcgtgctcccagcctcccatggtcatcttccacaagccggctctctcgaaagaaaccgtgtgggtgttagctcaaagcctgactccagtccagtgctatcccctggtaacaaagccaagcctgatgatcatcggtccaggccaggacgtcctgccgattttgtcctgctgaaggagagaacattggatgaagccccaagaccgcctaagaaagccatggattactctagctcttctgaagaagttgaatcttccgaggacgacgaagaagagggggagggagggcctgccgagggatcccgagacacacctggcgggcgctcagatggagacacagatagcgtttccacgatggtggttcatgacgtggaggagatcaccggtacgcagcccccttacggcgggggcacaatggtagtccagcgcacccccgaggaggaacggaatttactgcatgcggactctaacgggtacactaatctcccagatgtagtccagccctctcattcacctactgaaaacagcaagggccagtcccccccatcaaaggacggttcaggggactaccagtctagaggactggttaaggcccccgggaagagctcctttacaatgtttgtggatttaggaatctatcagcccggcggcagcggggatagtatacctattacagcactagtagggggcgaaggcacccggctcgatcagttacagtacgacgtcagaaagggcagcgtagtgaacgtaaatcccaccaacacaagggcacacagtgagactcccgaaatccgtaaatataagaagcggtttaatagcgagattctttgcgccgcactgtggggggtaaacctcttggttggaactgagaatggcctcatgctccttgaccggtccggtcagggtaaggtctacggtttgatcgggaggcgccggttccagcagatggatgtgctggaaggtctaaaccttttaatcaccatctccggtaagcgcaacaagctgcgcgtttactacttaagctggctgagaaacaagattcttcacaacgacccagaagtcgagaagaagcaggggtggactactgtgggggacatggaaggctgcgggcattaccgcgttgtgaaatacgaacgcatcaagttccttgtgatagccttaaagtcctctgtggaggtctatgcgtgggctcccaagccctaccacaaatttatggccttcaagtcattcgcagatcttcctcacagaccgttactggtagatctgacagtggaggaaggccagagactcaaggtgatttacggtagctctgcgggctttcacgcggtcgacgtcgactcaggcaacagctacgatatctatatccctgtgcatattcagagccagataactccccatgctattatcttcctgcctaacactgatgggatggagatgctcctgtgttacgaagatgagggagtctatgtaaacacctatggccgaattattaaggatgtcgtgctccagtggggcgaaatgccaacctcagtggcctacatctgtagcaaccagatcatggggtggggcgagaaagctattgagatccgatccgtcgagactgggcatctcgacggagtgtttatgcataagcgcgcccagcggcttaagtttttgtgcgagagaaacgataaggtgttcttcgcatccgtcagaagcggtgggagcagccaggtttactttatgactttgaacagaaattgtatcatgaactggtag

SEQ ID NO: 195239 - DNA, 879 bp, Artificial Sequence
  Description of Artificial Sequence: Synthetic coding sequence
atgctgctggaccggagcggccagggcaaggtgtacggcctgatcggccgccggcggtttcagcagatggatgtcctggagggccttaatctgctgatcactatcagcggaaagagaaacaagctccgcgtgtattacctgagttggcttagaaacaaaatcctccataacgatccagaggtcgagaagaaacaggggtggactacagtaggtgatatggagggatgcggccactaccgcgtggtgaagtacgaacggatcaagtttctggttatcgccctcaagtcctcagtggaagtgtacgcatgggctccgaaaccttaccataagttcatggcttttaaaagcttcgctgacctgcctcacagacctctcctggtggacctgaccgtcgaggagggacagcgcctgaaagttatctacggcagttctgctggttttcacgccgttgacgtggactcagggaattcctacgatatctacatccccgtgcacatccagtcacagattactccccacgcaatcatatttctgccaaacactgatggcatggagatgctgttgtgctatgaagacgaaggcgtttacgtgaatacgtatggaaggattatcaaggacgtagtgttacagtggggggaaatgccaacctccgttgcatatatttgtagcaatcagatcatgggttggggcgagaaggcgatcgagatccggtcagtagagactggccacctagatggggtgttcatgcataagagagcccagcgcctgaagtttctgtgcgaaaggaacgacaaggttttcttcgcttctgtacggagcggaggttcttctcaggtgtactttatgacactcaaccgaaactgcatcatgaattggtag

SEQ ID NO: 195240 - DNA, 336 bp, Artificial Sequence
  Description of Artificial Sequence: Synthetic coding sequence
atgggcgaccccgcccccgcccggagcctggacgacatcgacctgagtgccctccgtgccctgtggtttcagtttttctatcactcgggaagcagtttggagtccccaggtatgctgaacgggccattccaacaccggaactccaggatcatgacacaccgtagcgctgagaagaccctgttaggttctctgagtctatggaggtggagtgccatggagcctacagacaggtgcacacgggtggggatgagtcgccgcggatcttggctgccatctcggagttggatgagcaggcgcacccgaagaaagcgatcaaatcggaggtcaacttgctag

SEQ ID NO: 195241 - DNA, 1014 bp, Artificial Sequence
  Description of Artificial Sequence: Synthetic coding sequence
atgggcgccgccggcagcagcgccctggcccggttcgtgctgctggcacaaagcaggcctgggtggctcggagttgctgcgctcggactcaccgctgtggctcttggcgcggtcgcttggaggagagcctggcccacaagacgtcgacgcctcctgcagcaggttggcactgtagcgcagttgtggatttatcccgtgaagtcctgcaagggggtcccggtgtccgaggctgagtgcacagcaatgggactgcgcagtggaaatttgcgggaccggttctggctggttattaatcaagaggggaacatggtgactgctcggcaggaaccgcgcctcgtcctgatctcattgacttgcgatggggacactttaaccctatctgcagcttacacaaaagacctcttgctccctattaaaacccctacaaccaatgccgtccacaaatgccgggttcacggtcttgagattgaaggacgcgactgtggggaggccaccgcccaatggattaccagctttctgaaatcccaaccctataggctggtccactttgagcctcacatgaggccaagacggcctcaccagattgccgacctcttccggcccaaggatcaaattgcttactcagacacctcgccatttctgatactcagcgaagcatcactggcagatcttaacagcaggctcgagaagaaggttaaagccaccaactttcgaccaaacatcgtcatctcaggatgtgacgtctatgctgaagactcttgggatgagctgctgataggcgatgtggagctcaagagggttatggcctgttcaagatgtatccttacaactgttgatcctgacaccggtgtgatgtctaggaaagaacccctcgagacattaaagtcctatcgccagtgtgaccccagcgagcgcaaactgtatggaaagtcccctttgttcggccagtactttgttttggaaaaccccggcacaataaaagtgggggacccagtctacctgctgggacagtag

SEQ ID NO: 195242 - DNA, 774 bp, Artificial Sequence
  Description of Artificial Sequence: Synthetic coding sequence
atgggcgccagcagcagcagcgccctggcccggctgggcctgcccgcacgcccctggccaagatggttaggcgtggctgcactgggtctggctgctgtcgctctcggaactgtggcctggcggagagcctggcccaggaggcggaggaggcttcaacaggttggcaccgttgctaagctttggatctatccagtgaaatcctgtaagggagtgccagtttcagaagccgagtgcacagccatgggattaaggtccggtaatctcagggatcggttctggctggtgattaaagaggatgggcacatggttacggcccgacaagaaccacgcttggtgctcatatccatcatctatgaaaacaactgtctgatctttagagcccccgacatggaccagttagttctgccgagcaagcagccctcctcaaacaaactgcataactgcagaatctttggccttgatattaaaggacgcgactgcggaaacgaggccgcgaaatggttcacaaatttcctgaaaaccgaggcatatcgcctggttcaatttgagactaacatgaaggggaggactagtaggaagttgttacccaccctggaccagaatttccaggtggcgtacccagattattgcccacttctgatcatgacggacgcctcactggtagatttaaataccaggatggaaaaaaaaatgaaaatggagaactttagacccaacatagtggtgacgggctgcgacgcgttcgaagaggcatccgccactagacgcgattag

SEQ ID NO: 195243 - DNA, 1008 bp, Artificial Sequence
  Description of Artificial Sequence: Synthetic coding sequence
atgggcgccagcagcagcagcgccctggcccggctgggcctgcccgcccgtccttggcctcgctggctcggagtcgctgccttgggcctcgctgccgttgcgctggggacagtggcttggaggcgggcctggcctaggcgaagaagaagacttcaacaggtcggcactgttgcaaagctctggatctatcctgtgaagtcttgcaagggcgtcccagtgtctgaggctgaatgtaccgctatgggactcaggagcggcaatttgcgcgacaggttctggctggtgatcaaggaagatggccacatggtgaccgcgagacaggaaccacgcttagtgctgatctcaattatttacgagaacaactgtctgatttttcgggctccggacatggatcagctcgtgctgcccagcaaacaacctagctccaataagctgcataattgcagaatcttcggactggacatcaaaggccgggactgcggcaacgaggctgccaagtggttcactaattttttaaagacagaagcctaccggcttgtgcaattcgaaacgaacatgaaaggccgaacttcgagaaaactcttacccaccctcgaccagaatttccaagtcgcctacccggattattgtcctctgctgatcatgacagatgcaagcctggtggatttaaatacccgcatggagaagaaaatgaaaatggagaattttagacccaacatcgttgtgactggctgtgatgcattcgaggaggatacatgggacgaattattgatcggcagcgtggaggtcaagaaagtgatggcttgtcctagatgcattctgactaccgtggaccctgatacaggggtgatcgaccgtaaacagccactggacacgttgaagagttaccgcctgtgcgaccccagcgagagagagctgtataaactcagtcctctgttcggaatctactacagcgtcgagaaaatcggctcactgagggtgggagatccagtctaccggatggtatag

SEQ ID NO: 195244 - DNA, 519 bp, Artificial Sequence
  Description of Artificial Sequence: Synthetic coding sequence
ggccacatggtgaccgcccggcaggagccccggctggtgctgatctctataatctacgagaataattgcctaattttcagggcccccgacatggaccagctggtgcttcctagcaaacaaccaagcagcaacaaactgcacaattgtagaattttcggtctcgacatcaagggcagagattgcggcaatgaagccgccaagtggtttaccaattttctcaagacagaagcttaccgcctcgttcagttcgaaaccaatatgaaggggcgaactagtcggaagctactgcccacattggaccagaattttcaggttgcataccccgattactgtccactgctcatcatgaccgacgctagcctggtggaccttaatacccgaatggagaaaaaaatgaaaatggaaaacttcagaccgaacatcgtggttacgggctgtgacgcttttgaggaagacacctgggacgagcttctaatcggaagtgtcgaggtgaagaaagttatggcttgtcctagatag

SEQ ID NO: 195245 - DNA, 447 bp, Artificial Sequence
  Description of Artificial Sequence: Synthetic coding sequence
atgcccttcgccgaggacaagacctacaagtacatctgccggaacttttccaacttctgtaatgtcgacgttgtggagatactgccctacctgccttgtcttacagctcgcgaccaagatcggctgcgcgctacatgcacactatccggaaacagagatacgctgtggcatctgttcaacacactccagttaccaacctgggccggagaagaaacaccaggcggtcagtcatccggaaggggccttgacttttcatcactgacatcgggagccgtttggctctggcagatgtctgacttttggtcatgtttctcgacgtggacagtgtcaatctggttgatcctgcattgggtactgctccgcttgaacttgcaggtattcgcgaaatgcctcgctcagagtaagtggccactgcttctgccatccctctcgtgtcctacctggtag

SEQ ID NO: 195246 - DNA, 375 bp, Artificial Sequence
  Description of Artificial Sequence: Synthetic coding sequence
atgcccttcgccgaggacaagacctacaagtacatctgccggaacttcagcaacttttgtaacgtggacgtggtcgagatcctgccttatctgccttgtctgacagcgcgcgatcaggaccgtctgagagcaacctgcaccctgtctggaaaccgggataccttatggcacctcttcaacactcttcaacgacgaccaggctgggtggagtacttcattgccgccctgcggggctgcgagctggtggacttagcagacgaagtcgccagcgtctatcagtcttatcaaccacagttcagggcgtcaccagcagacgcgcagcctcagagccatcctaaggaatcacggtggtggcctcctggagtccttctttag

SEQ ID NO: 195247 - DNA, 1200 bp, Artificial Sequence
  Description of Artificial Sequence: Synthetic coding sequence
atgcccgtgcaggagacccaggcccccgagagccccggcgagaactccgagcaggccctacaaacactgagtccaagagcaataccacggaatcccgacggagggcctcttgaaagttcttctgacttggccgcactgagccccttaacgtccagcggccatcaggagcaagacacagagctggggagtacgcacacagccggagccacctctagtcttactccttcgagaggtccggtgagtccaagcgtctcctttcagccgttagccagatcaaccccgagggcttcgcgcctgcctggcccaactggatctgtggtttcaactggcactagcttttcatcaagtagtcctggcctggctagcgcaggggcagccgagggcaaacaaggtgcagaaagcgatcaggcagaacccatcatttgctcctcaggagccgaggctcccgcaaatagcctaccgagtaaggtcccgactaccctgatgcctgtgaataccgtcgccctcaaagtgcccgctaaccctgcctctgtctcaaccgtcccctcaaaattaccaacgtccagtaagccccctggtgctgtgcccagtaatgccttgaccaatccagccccatctaaattgccaatcaactctacaagagccggcatggtgccctccaaggtacccacgagcatggttctaaccaaagtttcagcctcaactgtgccaactgatggatcctcaagaaacgaagagacccctgcagctcccactccggcaggagcaacgggagggagcagtgcatggctcgatagtagctccgaaaaccggggtctgggatctgaactatctaagccgggagtgttggcgagccaggtggactctcccttctcaggctgcttcgaggatctggccatctccgcttcaacaagcctcggtatggggccgtgccatggcccagaagagaatgagtataagagtgaagggactttcggcatccatgtggcagagaatcctagtatccagctgttggagggtaatcctggtccacccgcagatcctgacggaggacccaggccacaagcagatcgtaagtttcaggagagggaagtcccttgtcaccggccttcccctggcgcgttgtggttgcaggtggctgtgaccggggtgctcgttgtgaccctcctcgttgtgctgtatcgccgacgactgcattag

SEQ ID NO: 195248 - DNA, 1623 bp, Artificial Sequence
  Description of Artificial Sequence: Synthetic coding sequence
atgcccttcgccgaggacaagacctacaagtacatctgccggaactttagtaacttttgtaatgtggacgttgttgagatccttccctatctgccatgcctgacggcacgcgaccaggaccgattgcgtgcgacctgtactctatcgggaaatagggacactctgtggcatctgtttaacactctccagcgtaggccaggctgggtcgagtatttcatcgccgctctgcggggttgtgagctggtggacttagccgatgaagtggcttcagtgtatcagtcttaccaaccgaggacgtccgaccggccacccgacccactggaaccgcctagccttccagccgaaaggcccggccccccaacccctgccgcagcacactctatcccttataattcatgccgtgaaaaggagccctcgtatcctatgccagtgcaggaaacccaagcccccgagtcgcctggtgaaaactcagaacaggcactgcagacactgtctcctagagccatcccacgaaaccccgatggcggacctctcgagagcagcagcgatcttgcagccttgtctccgttgaccagtagtggtcatcaggagcaagataccgaactggggagtacccacacagctggcgctacctcttccctgaccccgagccgggggcccgtgagcccgagcgtgagctttcagccccttgctagaagtacacctagggcctctcggctgcctggcccgactggaagcgtggtgagcacaggtacatcattcagtagctcaagcccaggtcttgcctcagctggagctgccgagggtaaacagggcgctgaaagcgaccaggccgagcctatcatctgctcctcaggcgctgaagctcccgcaaactcactgccttctaaagtgcctacaacactgatgcctgtcaataccgtggccctgaaggtgccagccaaccccgcctctgtgagcaccgtgccttccaagctaccaacctcgtcaaaacccccaggggctgttccgtcaaacgcccttacgaacccggcaccctccaaactgccaatcaattccacacgggccggcatggttccttcaaaagtgcctacgagtatggtactgacgaaagtgtccgcctccaccgtacctaccgatggctcctcaaggaatgaagaaactcccgccgccccgactcccgccggcgccacaggcggttcttccgcctggctggatagctcttccgaaaatagaggtttaggctccgaactgtcgaaacccggcgttttggcctcccaggtcgacagtccattctctggatgttttgaggatttagctattagcgccagtacctcactcgggatgggcccgtgccatggaccagaggaaaatgagtacaaaagcgagggaacttttgggatccatgtggccgaaaatccctccatacagctgttggagggcaatcctgggccacccgcagaccctgacggagggccccgcccgcaagccgataggaaatttcaggaacgagaagtgccctgccacagaccttctcctggagcgctgtggctccaggtggcagttaccggggtcctggttgtaacacttctcgttgtactatatcgtagacggttgcattag

SEQ ID NO: 195249 - DNA, 993 bp, Artificial Sequence
  Description of Artificial Sequence: Synthetic coding sequence
atggccgccgccgccggccggagcctgctgctgctgctgagcagccgggggggcggaggaggaggagctggaggctgcggggcgctaactgctgggtgcttccccggacttggtgtgtcacggcatagacaacaacagcatcatagaacagttcaccagcggattgcttcatggcagaaccttggcgcggtttactgctctaccgtggtacccagcgacgacgtgactgtggtgtatcagaatggcctgcctgtcatcagtgttaggcttccttccagaagggagcggtgccaatttactctcaagcccatatcggattcagtcggcgtgtttcttcggcaacttcaggaggaggatcggggtatcgacagagtggccatttacagtcctgatggagtgcgggtagccgcctccacgggcatcgacctgttactattggatgacttcaagctggtgataaatgacctgacttaccacgtccgaccccctaaaagagtggagatgggattttgccacgtgggtcagaatgggtttgaactgctcacctcttcttacttgcccgccagtgcgagccagtcagccgaaattatcgctgtgagaatcgagatctcccgaaaagctgaaaaaagaacgacattggtcctatggggaggacttgcctacatggccacacagttcggaatcctggcacgcctgacatggtgggagtattcctgggatataatggagcccgtgacgtatttcattacatacggtagcgcgatggcaatgtacgcctacttcgtgatgacgcgccaggaatacgtgtatcctgaggctagggatcggcagtatctgctgtttttccataaaggggctaagaaaagtcgctttgatctcgagaagtacaaccaattgaaagatgcaattgctcaagctgaaatggatctgaaacgactgcgcgaccctctgcaggttcatttaccactgcgtcagatcggggagaaggattag

SEQ ID NO: 195250 - DNA, 1056 bp, Artificial Sequence
  Description of Artificial Sequence: Synthetic coding sequence
atggccgccgccgccggccggagcctgctgctgctgctgagcagcagaggcggcggcgggggcggggccggaggctgtggtgctctgacggccggctgttttccaggtttgggcgtctcacgacatcggcagcagcagcaccatcgaaccgtccaccagcgaatcgccagttggcagaatctgggcgctgtctattgtagtaccgtagtgccaagcgacgatgtaacagtcgtgtatcaaaacggcttgccggttatatctgtcaggctacccagcagaagagagcggtgccagtttacactgaagcccatatcagacagcgtgggggtgtttttgcggcagcttcaggaggaagatcgcggcatcgatagagtggcgatatactcaccggatggtgtccgcgtcgctgcctcaaccgggattgatctgctgctgctggatgactttaaactggttatcaatgatcttacctatcatgtgaggccccccaaacgagatctgctctcacatgaaaatgctgctaccctcaacgacgtgaagacgctggtccagcagctttacacaaccctgtgcattgaacaacaccagctgaataaagaacgggaactcattgaacggctggaggatctgaaggaacagctggcccccctcgaaaaagtccgaatcgagattagcagaaaagctgaaaagagaactactctggtgctatggggtggtttagcatacatggcaacccagtttgggatccttgccagactaacctggtgggaatattcctgggacatcatggagcctgtaacctattttattacttacggctccgccatggctatgtatgcttacttcgtcatgacaaggcaagaatatgtttatcccgaggctcgagaccggcagtatctgctcttcttccataagggtgcaaagaaaagcaggttcgatctagaaaaatataatcagctgaaggacgccatcgcccaggccgagatggacctcaaaagattgagagacccacttcaggtgcacctaccattaaggcagatcggcgagaaagactag

SEQ ID NO: 195251 - DNA, 909 bp, Artificial Sequence
  Description of Artificial Sequence: Synthetic coding sequence
atggtgcaccagcggatcgccagctggcagaacctgggcgccgtgtattgctctaccgtggtcccatccgatgacgttaccgtagtttaccagaacggtctgccggtcataagcgtaagactccccagcagacgggaaaggtgccagtttacgctcaagccaattagtgattcagttggtgtcttcttaagacagctgcaagaagaggatagagggatcgaccgtgtagccatctactctcccgacggcgtccgcgtcgctgctagcacaggaatagatctgttgcttctcgatgactttaagctagtcatcaacgacctgacataccatgttagaccgcccaagagggatctgctctcccacgaaaatgctgctaccctcaacgatgtgaaaacgctggtacagcagctgtataccaccctgtgtattgaacagcatcagctgaataaagagagagagctgatagagcgactggaggacctcaaggagcaattagccccacttgagaaagtgcgaatcgaaatttctagaaaagccgaaaaacggacaaccctggttctttggggcggactggcctatatggctactcagtttggcatactagccaggctgacgtggtgggagtacagctgggacatcatggagccggtgacctacttcattacctacggtagtgcaatggccatgtatgcttacttcgtgatgacgagacaggagtatgtatatccagaggcgcgggatcgtcagtacctgctcttctttcacaaaggcgctaagaagagccgatttgatcttgagaaatacaaccagcttaaagacgcaatagcccaagccgagatggacctcaaacggttgagagaccccctgcaagtgcacctgcccctaagacagataggcgagaaggattag

SEQ ID NO: 195252 - DNA, 912 bp, Artificial Sequence
  Description of Artificial Sequence: Synthetic coding sequence
atggccgacgccgccagccaggtgctgctgggcagcggcctgaccatactcagccagccactaatgtacgtgaaagtactgatacaggtgggctacgaaccccttccaccgactatcggccgaaacatctttgggcgacaggtgtgtcaattaccagggttgttctcatatgcccaacacatcgcatccatcgacggccgccgaggtcttttcacagggttgacacccaggctatgcagcggcgtgctgggaaccgtcgttcacggaaaagtgctgcagcattaccaggaaagcgataagggggaagagctgggaccggggaacgtgcagaaagaagtcagctctagctttgatcacgttattaaagagaccacaagggaaatgattgctcggtccgctgcaaccctcatcactcaccccttccacgtgattacattacgaagtatggtgcagtttatcggccgcgagtcaaaatattgcggcctctgtgacagtatcataacgatttaccgcgaagaaggaatcctgggctttttcgctgggctggtgcctcgtctacttggcgatattttgtccctgtggctttgcaactcacttgcttatttggtgaatacttacgccctggactctggcgtgtcgactatgaacgagatgaagtcctatagtcaggctgttacggggttctttgcttcaatgctgacatacccatttgtgctagtaagtaacctgatggcagtgaataactgcggactggcggggggctgccctccctatagtcccatctatacgagctggattgactgttggtgcatgctgcaaaaagaggggaacatgagcagggggaacagcctgttctttcgcaaagtgccttttggcaaaacatattgctgcgacctgaaaatgctgatctag

SEQ ID NO: 195253 - DNA, 468 bp, Artificial Sequence
  Description of Artificial Sequence: Synthetic coding sequence
atggtgcagttcatcggccgggagagcaagtactgcggcctgtgcgacagcatcattactatttaccgagaggaggggattctcggttttttcgccggattagtgccccgcttactaggcgatatcctcagcctgtggctgtgtaattctctcgcctatctagtaaatacctacgcgctagactctggtgtttccactatgaacgaaatgaaaagctactcgcaagccgtaacgggattttttgccagtatgctgacgtacccgttcgtcctcgtcagcaatctgatggcagtgaataactgcggcttggcaggcgggtgtccaccctacagcccaatttatacatcatggattgactgctggtgcatgttgcagaaggaaggcaacatgtcccgaggcaatagcctgtttttccgcaaagtaccgtttggaaaaacctattgctgcgatctgaaaatgcttatctag

SEQ ID NO: 195254 - DNA, 360 bp, Artificial Sequence
  Description of Artificial Sequence: Synthetic coding sequence
atggtgctgcccctgccctggctgagccggtaccacttcctgcggcttcttctccctagttggagtctggccccccaaggcagtcacggctgctgcagtcagaatccaaaggcttcaatggaagaacaaacatctagcaggggtaatgggaagatgactagccctcctcggggtccagggacccacagaactgcagaactggctagagccgaagagctgttagagcaacagcttgagctgtaccaagcgctgctcgagggtcaggaaggcgcatgggaagctcaggctctggtgctgaaaatccagaaacttaaagaacagatgaggcggcaccaggagtctctgggtggtggggcatag

SEQ ID NO: 195255 - DNA, 360 bp, Artificial Sequence
  Description of Artificial Sequence: Synthetic coding sequence
atggtgctgcccctgccctggctgagccggtaccacttcctgcggttactgctgccatcatggagccttgcaccccaagggtctcatggctgctgtagccaaaatcccaaagcctcaatggaagaacagactaactctcggggcaatggaaagatgacttcccccccgagagggcctgggacccatcggactgccgagctggctcgcgccgaagagttgctggagcagcagctcgaactttatcaagcattactggaagggcaagagggagcctgggaggctcaggctttagtgctcaaaattcagaaactgaaggagcagatgaggagacatcaggaaagcctgggcggaggagcctag

SEQ ID NO: 195256 - DNA, 360 bp, Artificial Sequence
  Description of Artificial Sequence: Synthetic coding sequence
atggtgctgcccctgccctggctgagccggtaccacttcctgcggttattgctgccctcatggagcctggccccccagggctctcatggctgttgtagtcaaaatccgaaagcatcaatggaagagcagacaaactcacgaggaaacggaaagatgacttccccgcccaggggcccagggacccacagaaccgccgagcttgcgcgggccgaggagctgctggagcaacaattagaactttaccaggcgctgctggaggggcaggagggcgcatgggaagctcaggcactggtcttaaagattcagaagctcaaggagcagatgaggcgccatcaggagtcgctaggcggcggggcttag

SEQ ID NO: 195257 - DNA, 360 bp, Artificial Sequence
  Description of Artificial Sequence: Synthetic coding sequence
atggtgctgcccctgccctggctgagccggtaccacttcctgcggcttctgcttccttcgtggtccctggcacctcaaggctctcacggatgctgctcccaaaatcctaaggcttccatggaggagcagacttcatcacgcgggaatggaaaaatgaccagcccacctagagggcccggcacccatcgcaccgctgagttagcccgagcagaggaattgctcgaacagcaactcgaattatatcaggcactgctcgagggccaagagggggcttgggaggcccaggcactggtgctgaagattcaaaagctgaaagagcagatgaggcggcatcaggagtcactgggaggcggtgcctag

SEQ ID NO: 195258 - DNA, 360 bp, Artificial Sequence
  Description of Artificial Sequence: Synthetic coding sequence
atggtgctgcccctgccctggctgagccggtaccacttcctgcggctgctactccctagctggagccttgcacctcagggatctcacggctgctgctcccaaaaccctaaagcttccatggaggagcaaacctcttcgcgtggaaacggaaagatgacttctccaccgagagggcctggtacacacagaactgccgaactggcacgagctgaagaactcctggaacagcaattagaactgtatcaggccctgctcgaggggcaagagggggcctgggaagctcaggccctggttctaaagattcagaagttaaaggagcagatgaggcgtcaccaagagtctctgggaggaggagcctag

SEQ ID NO: 195259 - DNA, 360 bp, Artificial Sequence
  Description of Artificial Sequence: Synthetic coding sequence
atggtgctgcccctgccctggctgagccggtaccacttcctgcggctgctgctgcctagctggtccctcgctccacagggctcacacggctgttgttctcagaatcctaaggcttctatggagaagcagaccaattcccgtggcaacggtaagatgacaagccccccaagaggccccgggacccacaggactgcagaactggcccgggccgaggaactgctagaacaacaactagagctgtaccaggccctcttagagggccaggagggggcttgggaggcccaggctctggtgctcaagattcagaagctgaaagagcaaatgcgacgccaccaggaaagtttgggcgggggagcttag

SEQ ID NO: 195260 - DNA, 360 bp, Artificial Sequence
  Description of Artificial Sequence: Synthetic coding sequence
atggtgctgcccctgccctggctgagccggtaccacttcctgcggctcctgctgccatcctggtctttggcgccacaaggaagccacggctgctgctcacagaaccccaaggcatccatggaggaacagacaaattcccgcgggaacggcaagatgacgtctcctccccggggcccaggtactcatcgaaccgccgaactagccagagcggaggagttgctcgagcagcagttagagctttaccaggccctcctggaaggacaggaaggtgcttgggaagctcaggcgctggtcctgaaaatccaaaaattgaaagaacaaatgcgccggcaccaagagagtcttgggggaggggcatag

SEQ ID NO: 195261 - DNA, 360 bp, Artificial Sequence
  Description of Artificial Sequence: Synthetic coding sequence
atggtgctgcccctgccctggctgagccggtaccacttcctgcggcttctcctcccttcatggagtttggctccgcagggctcgcatggatgctgttctcagaaccctaaagcgtccatggaagagcagacgaattcacgggggaatgggaaaatgacaagtcctccgcggggcccaggaactcatcgtaccgccgagttggcacgggcagaggaactgcttgagcagcaactcgaattgtatcaggcacttctagagggccaggaaggagcctgggaggcacaggccttagtgctcaagatccaaaaactcaaggaacagatgcggcggcaccaggagagtctggggggtggcgcttag

SEQ ID NO: 195262 - DNA, 1059 bp, Artificial Sequence
  Description of Artificial Sequence: Synthetic coding sequence
atggagagcggcggccggcccagcctgtgccagttcatcctgctgggtactaccagtgtggtaaccgcagcgctatactccgtctatcgacagaaagcccgagtgtcacaggagctgaaaggagcgaagaaagtgcatcttggcgaggacctaaagtccatcctgtctgaggcacccggtaaatgcgtgccatacgccgttatcgagggtgctgtgagaagtgtgaaggagacgctgaactcccaattcgttgagaactgcaaaggggtgatacagagactgactctacaagagcataagatggtgtggaatcgcactactcatttatggaacgactgttcgaagatcattcatcagaggacaaatacagtaccctttgatcttgtccctcacgaagacggggtggatgtggctgtgcgggttttaaaaccccttgattccgtcgaccttggcttagagactgtgtatgagaagttccatccctcaatccagtcattcactgatgtgatcgggcattatatatccggagaaagacctaaaggtattcaggaaacggaagagatgctgaaagtcggggcaacgctcacgggcgtcggcgaattagtcctagataacaattctgtacgactccagcccccaaagcaaggcatgcagtactatttgtcttcccaggattttgactctcttctgcagcgacaggaatcatcagtcagattgtggaaagtcttagcactcgtttttggatttgcgacctgcgctactctttttttcatcctgaggaaacagtacctgcaaaggcaagagcgcctcaggctcaagcagatgcaagaagaatttcaggagcatgaggcccagttgttatcccgcgcaaagcctgaggatagagagagccttaagagcgcctgcgtggtttgcctgagctccttcaaatcctgtgtttttctggaatgcggccatgtgtgtagttgcaccgaatgctatcgggctctgcctgagccaaaaaagtgcccaatttgtcgtcaggccataacacgggtgattcccctttataacagctag

SEQ ID NO: 195263 - DNA, 2142 bp, Artificial Sequence
  Description of Artificial Sequence: Synthetic coding sequence
atgctgtgcgtgggccggctgggcggcctgggcgcccgggccgccgctctcccaccgcgaagagctgggcgcggctctctggaggctggaatcagggctagacgcgtgagcacaagctggtctccagtgggcgccgcattcaatgtgaagccccagggcagtcggctggacctgttcggagagcgccggggattgtttggagtccccgagttatcagctcccgaaggcttccatatagcacaagaaaaagcgctgcgaaaaacagagttacttgtggaccgggcctgcagcaccccccccggccctcaaactgtcctgatctttgacgaattgagtgactccctctgtcgcgtggccgaccttgccgattttgtgaaaattgctcatcctgagccggcattcagagaagccgcggaggaagcatgccggtcaatagggaccatggtcgaaaagttgaacacaaacgtcgacttgtaccagtctttgcagaaactgctcgctgacaagaagctggtggactccctggatccagagacccgcagagtcgccgaattgttcatgttcgactttgagatcagtggcatccatctggataaagaaaagcggaagcgcgcagtagacctgaatgttaagatcttggatctctcatctaccttcctgatgggcacaaatttcccaaataaaatcgaaaagcacctactcccagaacatattcggcgaaatttcacctccgccggcgatcacatcattatcgatggcctgcacgcggaaagccctgatgaccttgtacgtgaggctgcttataagattttcctgtacccaaatgccgggcaactcaagtgtcttgaggagctgttgtcttccagagatctcttggctaagttggtgggatactccacattctctcatcgggctctgcagggtactatcgctaagaaccccgagactgttatgcagttcctggaaaaactgagtgataagctgagtgagcgaactctgaaggacttcgaaatgattagaggaatgaaaatgaagctcaatccacagaattcagaagtaatgccgtgggaccccccatattactctggagttattagggctgagaggtataatatagaaccgtccctgtactgtcctttcttttcactgggggcttgcatggaaggactgaatatactgttgaaccggcttctcggcatcagtttgtacgcagagcaacctgccaaaggtgaggtgtggtctgaggatgtgcgcaagctggctgttgtacatgagtcggagggcctgctgggctacatttattgcgatttcttccagagggcagacaaaccacatcaggactgccatttcacgatccgaggcggaagacttaaggaggacggcgattaccagcttccagtggttgtcttgatgctgaacttgccccgaagtagcaggtctagcccaactctgttaactccgtccatgatggagaatcttttccatgagatgggccacgcaatgcacagcatgctcggacgtacacgttaccaacatgtgacaggaacgagatgccccacagatttcgccgaagttcccagtattcttatggaatactttgcaaacgactatcgagtggtcaaccaatttgcccgccactatcaaaccggtcagccacttcccaaaaatatggtttcgcgcctttgcgaaagcaaaaaagtgtgtgcagccgcggatatgcagctacaggttttctatgcgaccctggaccagatctaccacgggaaacatcctcttagaaacagcacgactgacatccttaaagagacacaggagaaattttacggcctgccgtacgttcccaacaccgcttggcagttgcgtttttcccatctcgtgggttatggggcacggtattactcttatttaatgtctcgggctgtggcaagcatggtctggaaagagtgttttctgcaggacccttttaacagagccgcaggggagcgctacagaagggaaatgctcgcccacggaggcggccgagaaccaatgctgatggttgaaggaatgctgcaaaaatgtccctccgtagacgattttgtgagtgctttggtgtccgatctcgacctggacttcgagacatttcttatggattctgagtag

SEQ ID NO: 195264 - DNA, 1353 bp, Artificial Sequence
  Description of Artificial Sequence: Synthetic coding sequence
atgagcgccatccaggccgcctggcccagcggcaccgagtgcatcgccaagtacaacttccacggcacagcggagcaagatctacccttttgtaagggagatgtgcttacgattgttgccgtgaccaaggatcccaactggtacaaagctaagaacaaagtggggcgcgaggggatcatcccagcaaattatgtgcagaaacgggagggcgtgaaggccgggacaaagctcagtcttatgccatggttccacgggaagattacccgggagcaggctgaacggctgctctatcctcccgagactggtctgtttttggtccgtgagagtacaaactaccccggggattataccttatgcgtctcctgcgacggtaaagtagaacattatcgaatcatgtaccatgcctccaaactgagcattgatgaagaggtctattttgagaatcttatgcaacttgtcgagcactatacatctgacgctgacggactatgcacccgcctgattaaacctaaagtaatggaaggcactgttgcagcccaggatgagttttaccgctctggttgggccctgaacatgaaggaactgaagttgctacagaccatcggaaaaggcgagtttggagacgtaatgctcggagactaccgaggcaacaaggtcgctgtaaaatgcattaaaaacgatgcaacagcccaggctttcctggccgaagcaagcgtcatgactcaactaagacattcaaacctggttcagctgctaggagtaatagttgaggagaagggaggcctttacatagtcacagagtatatggctaagggctcgttagttgattatctcaggagccgtggaagatctgtgcttgggggtgattgtctgcttaaattttctctggacgtatgtgaagctatggagtaccttgaaggtaataactttgtccatcgcgacttagctgctcgtaacgtgctggtgtcggaggataacgtcgcgaaggtgtcagacttcggcctcacaaaggaggcctcctctacccaagacaccggtaaactcccggtcaaatggacagcccctgaagcacttcgagaaaagaaattttccacaaaaagtgacgtctggtctttcgggattctgctgtgggaaatatacagcttcggcagagtcccatatccccgcattccgctgaaggacgtggttccacgcgtggagaagggctataagatggacgcacccgatggctgtccaccagcagtgtatgaggtcatgaagaactgttggcacttagacgcagccatgcgtccttcgtttttgcagctaagggagcaactggaacacattaagacccatgagcttcacctctag

SEQ ID NO: 195265 - DNA, 1170 bp, Artificial Sequence
  Description of Artificial Sequence: Synthetic coding sequence
atgcgggtgctggtgcggcggtgctggggcccccccctggcccacggcgctcgaaggggtcggccctcccctcagtggcgggcgctagcaagactgggctgggaggactgtcgcgatagcagagtgagggagaaaccaccctggcgggtcctgttcttcgggaccgaccagtttgctcgcgaggccctgcgagccctgcacgcggctagagaaaacaaagaagaggaactcatcgacaaactcgaagtcgtcacaatgccctcacccagccctaaggggctgcccgttaagcagtacgccgtgcaatcacaactgccggtttacgaatggcccgacgttggctccggggaatacgatgtgggcgtggtcgccagcttcggccgcctcttgaacgaagccctcatcctcaagttcccgtatggcattctgaatgttcatccatcgtgtcttcccaggtggagaggtcctgcaccagttatacacaccgtgttgcacggggacactgtgaccggcgtcacaatcatgcagatccgacctaagcgatttgatgtgggaccaatcctcaagcaggaaacagtacccgtgcctccaaagagtacagccaaggaactggaggcagttctgtctcgcctgggagccaatatgttgatcagcgtgctgaaaaatttaccagaatctctgtctaatggccgacagcaaccgatggagggagccacgtatgccccgaaaatctcagcaggaacctcatgcataaaatgggaggagcagaccagcgagcagatctttcggttgtatcgggctattggaaatatcatcccactgcagactctgtggatggcaaacacgatcaagctgttagatcttgtggaggtgaatagttctgtgctcgccgatccaaagctgaccggccaggcgttaatccccgggtccgtgatatatcacaaacaatctcaaattctgctggtgtattgcaaggatgggtggatcggtgttcgaagtgtcatgctgaaaaagagcttgactgcaactgacttttataacggttacctgcacccttggtaccagaagaatagccaggcccagcccagtcagtgcaggtttcagacgctgagattgccaacgaagaagaagcagaaaaagaccgtggccatgcaacagtgcattgagtag

SEQ ID NO: 195266 - DNA, 1749 bp, Artificial Sequence
  Description of Artificial Sequence: Synthetic coding sequence
atggccgtgcccggcgtgggcctgctgacccggctgaacctgtgcgcaagacgccgtacccgcgttcagagaccaattgttcggctgctctcttgccccggaactgtggcaaaggacctgcggagggacgagcagccaagtgggtcagtcgagacaggatttgaggacaagatccctaagcgacgtttctctgaaatgcagaatgagcgtagagagcaagcccagaggactgttttgatccactgccctgagaagatttcagaaaacaaattccttaaatacctaagccaattcggacccattaacaatcacttcttttatgagtctttcggcctgtatgcagtcgttgagttctgtcagaaagaatctattggttctctccagaatggcacacacaccccttccacagcaatggagaccgccattccctttcgctccaggtttttcaacttgaagctaaaaaatcaaacctctgagaggtctcgcgtccgctcatctaaccagctgcctcgctcaaacaaacaactcttcgaactactctgttacgccgagtctattgacgaccagcttaacacgctgttaaaggagttccagcttacagaggaaaacaccaagctgcggtatctgacttgcagtctgatcgaggacatggccgccgcctatttcccagattgcattgtccggcctttcggtagctcggtcaacaccttcggtaaactggggtgtgatttagatatgttcctggatttggatgagacccggaacctgagcgcccataagatcagcggaaatttccttatggaattccaggtaaaaaacgtcccttccgagaggattgctactcagaagattctctctgtgcttggggagtgcctcgatcactttgggccaggctgtgtaggcgttcagaaaattctcaacgccagatgtccactcgtgcgtttcagccatcaagcctcaggattccagtgtgacctcactacaaacaatcgaattgctctgacttcttctgagcttctgtatatttacggggccttagacagcagggtgagggcacttgtcttcagtgtgagatgctgggcaagagcccacagtctgacatcatcaatccccggggcttggattaccaacttttccctgacgatgatggtcattttcttcctgcagcgacgcagtccacccatccttccgacactggacagcctcaagaccttggctgatgctgaagataagtgcgtaattgaaggaaacaattgcacatttgtgcgcgatctgagtagaataaaaccaagccaaaataccgaaaccctggagttgctgctcaaagagtttttcgaatacttcggtaattttgcgtttgataagaacagcattaatatccgccaagggcgggagcagaacaaacccgatagctcaccgctttatatacaaaaccccttcgagacgagcctgaacattagcaagaatgtgagccagagccagcttcaaaaattcgtggatcttgctagggaatcagcttggatattgcagcaggaggacaccgatcgaccttctatatcctctaatcgaccctggggactagtttccctcctgctccctagtgctccaaacagaaagagctttacgaagaagaaatctaataaatttgctatagaaacggttaagaatttgcttgagtcccttaaaggaaaccgaacagaaaatttcactaagaccagcggaaaaaggactatatccactcagacgtag

SEQ ID NO: 195267 - DNA, 2139 bp, Artificial Sequence
  Description of Artificial Sequence: Synthetic coding sequence
atggcctgggccaagaaggtgggcggccgggccggccagggccggtcactgagtcgatgcgatccgataatcctggacccggagtggctttacggtccccccgagggcgaaggtgggcccgaaggggtaggcggcgaaacccgggcctcaatccacccccccctgcgtacgggccgacatcatcagaaggtgaaccataatatccgtgggccagaaggaagtgcgaaagatgctgccccagggggggggggccatcaccaagctggccccggccagcggggtgacgaagatggagcgctgcagcacctgtgcggcgggggtggcggggtcggagtgtctgtgggaaggggtacagggacctctgtcgcagcagaacaccctagcttgcaggttaagctgcttgagctgcaggaactggtcttgcggctggcaggcgatcacaacgaaggacatgggaagtttttagccgccgcacagaatcctgcagacgacccggcccctggagcacctgcgccccaggagctcggggctgccgacaaacagggaggctttgaggataagatccctaagcgcagattttctgagatgcagaacgaaaggcgcgaacaagcccagcggacagtgctcattcattgtcccgagaagatcagcgagaacaagttcttgaagtacttgagccagttcggccccattaacaatcacttcttctatgagtcattcggtctctacgctgtggtggaattttgccagaaggaaagcatcggctcacttcagaacggcacacacacgcctagcactgctatggaaacagccattccattccgctcacgttttttcaacctgaagctcaaaaatcaaacaagcgaacgttctcgcgtgcgctccagcaaccagctaccacggagcaacaagcagctgttcgaactgctgtgttacgccgagtcaatcgacgatcagctgaacactcttcttaaagagttccagctgactgaggaaaacacgaagctccggtatctcacatgtagcttgatagaggatatggccgcagcttatttcccagactgcatagtgcgaccttttggcagctctgtcaacaccttcggcaagctggggtgtgatctcgacatgttcctcgatctggacgagactaggaatctcagcgcccataagatttcaggcaactttctgatggaatttcaggtcaagaatgtacccagtgagagaattgccacgcaaaagatcctctctgttctgggggaatgcttggatcatttcggccccggatgcgtaggcgttcaaaaaattctcaacgccagatgccctttggtaagattcagtcatcaggcgtctggctttcaatgcgatcttaccaccaataacaggatcgctctaacgtcgtctgagctgctgtacatttacggcgctctcgatagccgcgtgcgcgcactggtgttctctgtgagatgctgggcccgcgcacacagtctgacaagtagcattccgggagcgtggatcaccaacttcagcctcaccatgatggtgatttttttcctccaaaggcgaagcccccccatcctcccaacattggattctttgaaaacattggccgacgcagaggacaagtgtgttatagaaggaaacaactgcacttttgtccgagacttgagccgaatcaaaccaagtcagaatacggagaccctggagttacttttaaaggaatttttcgagtatttcggtaattttgccttcgacaagaactcaatcaatattcgacagggacgggagcagaacaagccagactcatcgcccctgtacatccaaaacccctttgaaaccagccttaacataagtaagaacgtgtcgcagtcgcagctccagaagttcgtggacctggcccgcgagtccgcatggatcctccagcaggaagacaccgacaggccgtccattagcagtaatcggccctggggactggtgtccctgctgcttccatctgcccctaacagaaagagctttactaagaaaaagagcaataagtttgctatagagactgtgaagaatctcctggagtcgctgaagggcaatagaaccgagaactttacaaaaacctctgggaagcggactatctccacgcaaacgtag

SEQ ID NO: 195268 - DNA, 660 bp, Artificial Sequence
  Description of Artificial Sequence: Synthetic coding sequence
atgcagaacgagcggcgggagcaggcccagcggaccgtgctgatccattgtcccgagaagatctccgagaacaagttcctaaagtatctgtctcagttcgggccgataaataatcactttttttatgagtcttttgggctctatgctgtagtcgagttctgtcaaaaagagtctataggcagcctgcaaaacggaacgcacactcctagcactgccatggagacagctataccgttccgcagccggttctttaatctgaagctcaagaatcaaactagtgaaagatcccgggtccgctcctcaaatcagctgcctcggagcaataagcagctcttcgaactgctttgttacgctgagtctatcgatgaccagctgaatacacttctgaaggaattccagctgactgaagagaacaccaaactgcgttatctgacatgctctctcattgaagacatggctgccgcctactttcccgactgtattgtgagaccctttgggtcatcagtaaatacttttggcaagttgggatgtgacctggacatgtttcttgacttggatgaaacaaggaacctctcagcacacaagatcagtggcaactttctgatggagtttcaggtaaaaaatgtgccttccgagagaattgcgacacagaagatctag

SEQ ID NO: 195269 - DNA, 453 bp, Artificial Sequence
  Description of Artificial Sequence: Synthetic coding sequence
gacctgcggcgggacgagcagcccagcggcagcgtggagaccggcttcgaagacaaaattcccaagcggcggttttccgagatgcaaaatgaaagacgggagcaggcacagaggactgtgctcattcactgccctgagaaaataagcgaaaacaaatttctgaaatatctgtcgcagtttgggccaattaataaccactttttttacgagtcctttggactgtatgccgtggtcgaattctgccagaaagaatcaattggatcgctgcagaatgggacccacacccccagcactgcaatggagacagccataccattcagatctcgattttttaaccttaagctgaagaaccagactagcgagcgcagccgtgtgcgctccagtaatcaattgccacgcagtaataagcagctttttgaattactctgctatgctgagtcagtgagcttctag

SEQ ID NO: 195270 - DNA, 309 bp, Artificial Sequence
  Description of Artificial Sequence: Synthetic coding sequence
atgttcctgaccgccctgctgtggcggggccggatccccggccggcagtggatcgggaagcaccgccgccccaggtttgtcagcctgcgagctaagcagaacatgatccgaaggctggagatcgaggctgagaaccactactggctgtctatgccctacatgacaagagagcaggagagaggccatgccgccgtacggcgccgcgaggctttcgaagccataaaggccgccgcgacctcaaagttcccccctcaccgatttattgctgaccagctggatcatttaaatgttacaaagaaatggtcatag

SEQ ID NO: 195271 - DNA, 978 bp, Artificial Sequence
  Description of Artificial Sequence: Synthetic coding sequence
atggccgccgccgtgcggtgcatgggccgggccctgatccaccaccagaggcattccctcagtaagatggtgtaccagacatccctctgctcatgcagcgtgaatattagggtgcccaaccgacacttcgcagctgcaaccaaatcagcaaaaaaaactaaaaagggggcgaaggagaaaaccccagatgaaaaaaaggacgagattgagaagataaaggcatatccctacatggaaggagaaccggaggatgacgtgtatctgaagagactgtatccacgccaaatctatgaggtagaaaaagcagtgcacttacttaagaagttccagatccttgattttacaagccccaagcagtcagtctatctggaccttacactcgatatggccttggggaagaaaaaaaacgtcgaacctttcacatccgtcctctccctcccttaccctttcgcctcagaaatcaataaagtggctgtattcacagagaacgcctcggaagtaaagatcgccgaagagaatggtgccgcctttgctggcgggacatctcttatccagaagatctgggacgacgagattgtggcggacttttacgtggcagtgcccgagatcatgcctgagctcaacagacttcgtaagaaactgaataaaaaatatcctaagctttctaggaactccattgggcgcgacatccccaagatgctggagctcttcaaaaatggccatgagattaaggtcgatgaggagcgggagaattttttgcagacgaagattgctaccttggatatgagcagcgatcagatcgcagccaatctgcaggcagtgattaatgaagtttgccggcatcggcctctgaatttgggaccgttcgtggtgcgagcctttttgcgctcaagtacctcggagggactacttctgaagatcgaccccttgcttcccaaggaggttaagaacgaggagtccgagaaagaagacgcttag

SEQ ID NO: 195272 - DNA, 909 bp, Artificial Sequence
  Description of Artificial Sequence: Synthetic coding sequence
atggtgtaccagaccagcctgtgcagctgcagcgtgaacatccgggtccctaacagacatttcgcagccgcgaccaagtcggcaaaaaagacgaagaaaggcgccaaggagaagacgcctgacgagaagaaggacgagatagaaaagataaaggcctatccgtatatggaaggtgaaccagaggatgacgtctacctgaaacggctgtacccccgccagatctatgaggtggagaaagcggtgcaccttctgaagaaattccagatcctggacttcacatcgcctaagcaatccgtgtatcttgatctgaccctggacatggccctgggaaagaagaaaaatgtcgaaccttttacatccgttctgtctctcccatacccatttgcgtcagaaattaacaaagtggccgtcttcactgaaaatgctagtgaagtcaaaattgctgaagaaaacggcgcggcgtttgccggaggcacatctctcatccagaagatctgggatgatgaaatcgtggccgatttttatgtcgctgtgccagaaattatgcctgagttgaatagactcagaaagaagctgaacaagaagtacccaaagctatctcgcaatagtattgggcgagacatacctaaaatgttggaacttttcaaaaacggccacgagatcaaggtcgatgaggagcgggagaactttttgcagacgaaaatcgctacgctggatatgtccagtgaccagatcgctgccaacctacaagccgttattaatgaggtgtgccgccacagacctcttaaccttgggccttttgtggtaagagctttcttgcggagctcgacttcagaaggcttacttctgaaaatagatccactgctcccaaaggagatcaaatcacagcctaagaaaaagaaaaactag

SEQ ID NO: 195273 - DNA, 816 bp, Artificial Sequence
  Description of Artificial Sequence: Synthetic coding sequence
atgatcagcgcccactgcaacctgcacctgcccggcagcagcgactctcccgcctccgccagtcaggtagcaggaatcacggggaggctgcccaccctccagactgtccgatacggatcgaaggctgtgacacgccatcggcgcgttatgcattttcagcggcaaaaactgatggccgtcactgaatacatccctccgaaacctgccatccatccctcttgtttgccttcgcccccaagtcctccacaagaagagattggcttgattaggctgctgcgccgggagattgccgcggtttttcaagacaacaggatgattgctgtgtgtcagaacgtggctctgtctgcggaagacaaactcctgatgcgccaccagctccgcaagcacaagattcttatgaaggtgtttccaaaccaggtgctgaaacccttcctggaggactctaagtaccaaaatctactccccctgtttgttgggcataacatgctgcttgtgtctgaggagccaaaagtgaaagaaatggtgcgaatcctacgcacggtgcccttcctgccgctcctgggcggatgtattgatgacactatcctttcgaggcagggttttattaattattccaaactgccttccttaccgctggttcagggcgagctggtgggaggattaacctgcttgacagcccagactcatagtctcctgcagcaccagccgctgcagctcactaccctcctggatcagtacatccgagaacagcgagagaaggacagcgtcatgagcgccaatggaaagcccgacccagacaccgtgccggactcatag

SEQ ID NO: 195274 - DNA, 786 bp, Artificial Sequence
  Description of Artificial Sequence: Synthetic coding sequence
atggccgccgccgtggccggcatgctgcggggcggcctgctgccccaggctgggaggctgcctactcttcagacagtccggtatggtagcaaggccgtgacccgccacaggagggttatgcacttccaacggcagaagcttatggccgtgaccgagtatatacctcctaaacccgcgatccacccctcttgcctgccatcgccacccagtcctcctcaggaggagatcgggctgatccgattgctgcggcgagagattgccgcggtgtttcaggataaccgcatgatcgccgtgtgccagaacgtggctctctctgctgaagataagctgctgatgcggcaccaactccgaaagcataaaattctgatgaaagtgtttcccaatcaagttttaaagccttttctggaggattccaaatatcagaatcttctccctctgtttgtgggacacaatatgctgcttgtcagcgaggagcctaaggtgaaggaaatggttcggattctcagaacagtaccttttttacctctgctcggagggtgtattgatgataccatcctcagtagacagggatttattaactactccaagctaccctccctccccctggtgcagggcgagctcgtggggggtttgacttgtctgacggcgcagacccacagcctcctccagcaccaaccactgcaactgaccactctgctggatcagtacatccgtgagcagcgggaaaaggacagcgtcatgtccgctaacgggaaaccggaccctgacaccgtccccgactcgtag

SEQ ID NO: 195275 - DNA, 816 bp, Artificial Sequence
  Description of Artificial Sequence: Synthetic coding sequence
atgatcagcgcccactgcaacctgcacctgcccggcagcagcgacagtccagcctccgcgtcccaggtggcagggataaccggcagactgccaaccctgcagacggtgagatatggtagcaaagccgtaaccagacacaggagggtgatgcatttccagcgtcaaaagctgatggcagtgaccgagtatattccccctaagcccgccattcacccatcttgcctgccaagccccccatcaccaccccaagaggaaataggccttattcggttactcaggagggagatcgccgctgtgttccaggacaatcgcatgattgccgtttgccagaacgtagctttatcagccgaagacaagctgttgatgaggcaccagttgagaaagcacaagattttgatgaaggtcttccccaaccaggtgctgaagccattcctggaagattccaagtaccagaacctcctgcccctttttgtgggacacaacatgctcctcgtgagtgaagaaccaaaagtgaaagagatggtcaggatcctcaggactgtcccgtttttgcccttgctgggcggttgtatcgacgatacgatcctgtcccgtcaaggcttcattaactacagtaaactcccatccctgccattggtccagggggagttggtgggtggattaacctgtttaaccgcacagacacacagcctattgcagcaccagcccctgcagctgactacactcctggatcagtacatccgggagcaacgggagaaagacagcgtcatgtcagccaacggcaaacctgatcctgatactgtgccggattcctag

SEQ ID NO: 195276 - DNA, 579 bp, Artificial Sequence
  Description of Artificial Sequence: Synthetic coding sequence
atgagcaagctgggccgggccgcccggggcctgcggaagcccgaggttggtggagttatccgcgccattgtgagggctggactggctatgcccggaccgccactcggacctgtgctcggccaacgaggggtttcaattaatcaattctgcaaagaatttaatgagcgtaccaaggacatcaaagaaggaatccctctccccacaaaaattctggtgaaaccagaccggacattcgaaatcaaaatcgggcagccaacggtgtcctatttcctgaaggcggccgctgggattgaaaagggcgctcggcagactggtaaggaggtagcaggcctagtgactctgaagcacgtatacgaaatcgctcgcattaaagcacaggatgaagcgtttgccctgcaagacgtgcccctatcatccgtggtgcggtctatcatcggctctgcccgcagtctcggaataagggtggtcaaggacctgagctcagaagagctggctgcatttcaaaaagagagggccattttcctcgcggcacagaaggaggctgacctcgcagcccaggaagaagccgccaagaagtag

SEQ ID NO: 195277 - DNA, 546 bp, Artificial Sequence
  Description of Artificial Sequence: Synthetic coding sequence
atgagcaagctgggccgggccgcccggggcctgcggaagcccgaggttggcggagtgatacgggccatcgtccgggcagggttagccatgcccggtcctcccctgggccctgtattggggcaacggggtgtaagtattaatcagttctgcaaagagttcaatgagagaacaaaagacataaaggagggaatccctctgcctactaaaattctggtgaagcctgataggacctttgagatcaagattggccaaccgaccgttagctattttttgaaagccgcggctgggattgaaaaaggcgcccgccaaacagggaaggaggtggccggattagtgacgctgaagcacgtctacgaaattgctcggattaaagcccaggatgaggcttttgctttacaggatgtgcctctttccagcgtggtacgttctatcattggctccgcccggtctttgggcatcagggttgtgaaagaacggtgtagcgccaatgtcctgcggaacgggaaaattagtatgaaagacccatccggcaggtcaagtgtatag

SEQ ID NO: 195278 - DNA, 501 bp, Artificial Sequence
  Description of Artificial Sequence: Synthetic coding sequence
atgagcaagctgggccgggccgcccggggcctgcggaagcccgagcgcggcgtctctatcaaccagttctgtaaggagttcaacgaacgaacgaaagatatcaaagaggggatccccttaccaaccaaaatccttgtgaaaccggaccgcacgttcgagattaaaatcggccagcccactgtctcctacttccttaaagctgctgccggcatcgagaagggggcgcgtcagaccgggaaagaagtggctggactcgtgacactgaagcacgtttatgagatcgcaaggattaaagctcaagatgaagccttcgccctgcaggatgtccctctgtccagcgtggttcggtctataattgggtcggctcgtagcttgggtataagagtggttaaggatctctccagtgaggagcttgccgccttccagaaggagcgcgcaatcttcctggctgcccagaaggaggcggacctggccgcacaagaggaagccgcaaaaaagtag

SEQ ID NO: 195279 - DNA, 891 bp, Artificial Sequence
  Description of Artificial Sequence: Synthetic coding sequence
atggccgccgaggcccgggtgagccggtggtacttcggcggcctggcttcttgtggagcagcatgctgtacccatcccctggatctgttgaaggtgcacctgcagacccagcaggaggtaaagcttcgcatgactggcatggccctcagggtcgtgcgtactgatggaattttggccctgtatagcgggctaagtgcatcgctgtgccgccagatgacttattccctcactagatttgccatatatgaaacggtgcgcgatagagtggccaaaggaagtcagggccctctcccatttcatgagaaagtgcttttgggcagcgttagtggcctcgccggggggtttgttggaaccccggccgacctggttaacgtgcggatgcagaacgacgtgaagcttccacaaggacagcgaaggaattacgctcatgcccttgacggactgtaccgtgtggcccgtgaggagggcctccgaaggctcttctccggcgccaccatggcctcgtcccgtggcgcacttgttaccgtcggtcaactctcttgttacgaccaggccaaacaattggtgctctccaccggctatctctccgacaatatattcactcacttcgtcgcttcctttatcgctgccgccggtgacgagcctcctccacagggcggctgcgccacgttcctctgccagcctcttgacgttttaaagaccaggctgatgaatagtaaaggcgagtatcagggagtgttccattgcgccgtggagactgcaaaactcggacctctggccttttacaagggcctcgtgccggcaggaatcagactgatcccccatacagtgttgacgtttgtctttctggagcagctcagaaagaacttcggcatcaaggtaccttcttag

SEQ ID NO: 195280 - DNA, 537 bp, Artificial Sequence
  Description of Artificial Sequence: Synthetic coding sequence
atgctgcccgccgccgcccggcccctgtggggcccctgcctgggccttcgagcagcagcttttcgccttgccagacgccaggtgccatgcgtgtgtgccgtgcgtcacatgaggagcagcggacaccagaggtgtgaagcactggcgggggcccctctggacaacgcacctaaggaatatccacccaagattcaacaattggttcaggacatagcttcgctgaccctgctggaaatctcggatcttaacgagttgctgaaaaaaacattaaagatccaggacgtgggcctggtccccatgggcggcgttatgagtggggcagtgccagctgctgccgcccaggaggctgtagaggaggacatccccatcgcgaaggagcgtacgcacttcactgtgagattgactgaggcgaaacctgtggataaagtgaaactcattaaggagataaagaactatatcaaggctagcacgtctagccgccaacggtcctggtggtctccctgtcccggtaaccagtcccagtgccgccagtcgtag

SEQ ID NO: 195281 - DNA, 597 bp, Artificial Sequence
  Description of Artificial Sequence: Synthetic coding sequence
atgctgcccgccgccgcccggcccctgtggggcccctgcctgggcttgcgggcagccgccttccggctcgcacgtcgccaagtcccgtgcgtctgcgccgtgagacatatgcgcagttctggccaccagaggtgcgaggccctagccggagcgcccctggacaatgcacctaaggaataccctcctaaaatacagcagctcgtacaggatatagccagcctgacactcttggaaattagcgacctgaatgagcttcttaagaagacactgaagatacaagacgtggggcttgtgcctatgggcggcgttatgagtggcgcggtgcccgccgccgctgctcaagaggccgtggaagaagacatcccaatcgctaaggagagaacacatttcacagtccgattaaccgaggcaaaaccagtggacaaggttaagctaattaaggagattaaaaattacatccaagggatcaacttagtccaagctaagaagttggtggagagcctgccacaggaaattaaggctaatgtggcgaaggcagaagccgagaaaattaaagctgccctggaagccgtcggcggaactgttgtgctagagtag

SEQ ID NO: 195282 - DNA, 864 bp, Artificial Sequence
  Description of Artificial Sequence: Synthetic coding sequence
atggccgccgaggcccgggtgagccggtggtacttcggcggcctggcctcatgcggcgcagcctgttgcacccaccctttggacctgcttaaggttcaccttcaaacccaacaagaagtgaaactaaggatgacaggtatggctttgagggtagtaaggacagacgggattttagccctgtattctgggttatccgccagtctgtgcaggcagatgacttatagcttgactaggtttgcgatctacgagaccgttcgcgatagggtagcaaagggttcacagggtcccctgcccttccatgaaaaggtgcttctcggctcagtctcgggactggctggtggatttgtagggacaccggctgacttggtgaacgttcgcatgcagaacgatgtgaaacttcctcagggacagcgaaggaactacgcccacgccttggacgggctttatcgcgtggctagggaagaagggcttcggcgactcttttccggggccacgatggcatcttcccgcggggctctggtgacggtcggtcaattgtcatgctacgaccaggctaaacagttggtgctgagcacagggtatttgagtgataatatctttacacactttgtggcatcctttattgccggaggttgtgcgacttttttatgccagccgctggatgtcctcaagactcgactgatgaattccaaaggggagtatcagggcgttttccactgtgcagtggaaaccgcaaagctaggaccactggctttctataaagggctggtgcccgctggcatacgcttgattccacacaccgttctgacttttgtcttcctagagcagctgagaaaaaattttggaataaaagtgcctagctag

SEQ ID NO: 195283 - DNA, 1329 bp, Artificial Sequence
  Description of Artificial Sequence: Synthetic coding sequence
atgctgcccgccgccgcccggcccctgtggggcccctgcctgggcctccgtgctgcagccttccggcttgcaaggcgtcaggttccttgtgtgtgtgccgtgaggcacatgaggtcttcaggccaccagcggtgcgaagctttggccggcgcccccctcgataacgcccctaaggaataccctccaaagatccagcaactcgtgcaggatatcgctagtttaaccctcctcgagatcagtgatctcaatgaactcctcaaaaagaccctgaagatccaggacgtcgggctcgtccctatgggtggcgttatgtccggagccgtcccagccgctgccgcccaggaggccgtggaggaggatattccaatcgctaaagaacgcacgcacttcactgtacggctcaccgaagctaaacccgtggataaagtaaagctgattaaagagatcaaaaactacattcaggggataaatctggtgcaagctaagaaactggttgagtcactcccccaagagatcaaggccaacgtcgctaaggcagaagccgagaagatcaaggccgcactcgaagcgactcagcaagaggttaagctgcggatgacagggatggccctccgcgtggtaaggacggacgggatccttgcactgtattcaggcctgtctgcctccctgtgcagacagatgacttacagtctaaccaggttcgccatctacgagacggtcagggaccgcgtggctaaagggagtcaaggcccactgccgtttcatgagaaagtcctgctggggtcggtgtcaggactggctgggggttttgtaggcacccccgcggaccttgtgaacgttaggatgcagaacgacgtcaagcttccccaggggcagcgtcgcaattatgctcatgctttggacggactttatagggtggcccgagaagaaggcttaagacggctcttctctggcgccacgatggcctcgtcacgaggagcacttgtgacggtggggcagttgagctgctacgaccaggcaaaacaactggttctgagtactggatacctctccgacaacatcttcactcactttgttgcgagtttcatagccgggggatgtgccacattcttatgccaacctctggatgtattgaaaaccaggctgatgaattcaaagggggagtaccagggcgttttccattgtgcagtcgaaaccgcaaaactcggaccactggcattctacaagggcctggtgcctgcagggattagacttatccctcataccgtgctcaccttcgtttttctggagcaactgcgtaagaattttggaatcaaggtccccagctag

SEQ ID NO: 195284 - DNA, 735 bp, Artificial Sequence
  Description of Artificial Sequence: Synthetic coding sequence
atgaccggcatggccctgcgggtggtgcggaccgacggcatcctggctctgtactccggtctcagtgcaagcttatgcaggcaaatgacgtacagtctcactagattcgccatatatgagactgtccgcgaccgagtggccaaaggctcacaggggccccttccctttcacgaaaaggtgctcctagggagtgtgtccggtctggccggggggttcgtggggacgcccgctgacttagtgaacgtgcggatgcaaaatgacgtgaaactcccccagggacagcggcgtaattatgcacatgcacttgatgggctgtacagagttgcaagggaagaaggtcttcgtagactgttttctggtgctacaatggcctcaagtagaggcgctcttgtcactgttgggcagctatcctgctatgaccaggccaagcagctcgtgcttagtaccggctatctgtccgataacatctttacacacttcgtggctagcttcatcgctggaggatgtgccaccttcctgtgtcagcccctggacgtgctgaaaacgcggctcatgaactcaaagggcgagtatcaaggggtctttcactgcgccgtggagacagcaaaactgggtccactcgctttctataagggtctggtgcccgccggaattcgccttattccacataccgtcttgacattcgttttcctggagcagttaaggaaaaactttgggattaaggttcccagctag

SEQ ID NO: 195285 - DNA, 438 bp, Artificial Sequence
  Description of Artificial Sequence: Synthetic coding sequence
atggccttcttcaccggcctgtggggccccttcacctgcgtgagcagagtcctctcccaccattgcttcagcacgactggcagtctgagtgccattcagaaaatgactcgggtgcgagtcgtggacaactctgccctgggcaacagcccctaccatcgtgccccacgttgtatacacgtctacaaaaagaatggcgttgggaaggtgggcgatcaaattctgttggctattaagggccagaagaagaaagccctgatagtagggcattgtatgcccggtccaagaatgaccccaagatttgacagtaataacgtggttctcattgaggataatggcaatccggtcggtaccaggatcaagactccgatccccacgtctctgcggaagagggagggcgagtatagcaaagtgttagccattgcacagaacttcgtttag

SEQ ID NO: 195286 - DNA, 891 bp, Artificial Sequence
  Description of Artificial Sequence: Synthetic coding sequence
atggccggccccctgcagggcggcggcgcccgggccctggacctgctgcggggactcccccgagtgagcttggctaacctgaagccgaatcctggatccaagaagccagaacgccggcccagaggacgtcggaggggaagaaagtgcggcagggggcacaagggcgagcggcagcgcggcacccgaccccgcttgggtttcgaaggaggtcagacacccttttacattaggataccaaaatacgggttcaacgaaggccactcatttaggcgccagtacaagcccttgtccctgaaccgactacaatatttaatagatctggggagagtggatccaagtcagcctatagatctgactcagctggtgaacggtcgtggggtgaccatccaacctcttaagcgagattacggtgttcaacttgtagaggagggagccgataccttcactgctaaggtcaatatcgaggtccagcttgccagcgagcttgccattgctgccatcgaaaaaaatggcggagtggtcactactgcattctatgaccctagatccctagacatagtgtgcaagcctgtgccatttttccttcgtggccagccgataccaaagaggatgctgccccccgaagagctggtaccctactatacagatgctaaaaatcgggggtatctcgctgatcctgctaaattcccagaagccagactcgagctcgcgaggaaatatggctacatcctgcccgatattacgaaagatgaactgtttaagatgctgtgcacaaggaaggatccacgccagatcttctttggcctggctcccgggtgggtggttaatatggcagataagaagatccttaaacccacggatgaaaacttgcttaaatattacacaagctag

SEQ ID NO: 195287 - DNA, 756 bp, Artificial Sequence
  Description of Artificial Sequence: Synthetic coding sequence
atgtggcggctgctggcccgggccagcgcccccctgctgcgggtgcctctgtcagacagctgggctttgttaccggcctctgcaggtgtcaaaactcttttgcccgtaccttcatttgaagacgtgtctattccggagaagcccaaacttagatttattgagagagcccctcttgtccccaaggttagaagagaaccaaagaacctgtcagacatacgtggaccgtccacagaagccacagagttcacagagggaaacttcgccatcctcgcgctcggagggggctatctccactgggggcattttgaaatgatgaggctcacgatcaataggtccatggacccaaaaaatatgttcgccatctggcgggtacccgctcccttcaagcccatcacgcgaaagagcgtgggccaccgtatgggcggcggcaaaggcgcgattgatcactacgtgacgcccgttaaagctggccgcctggtggtggaaatgggaggacgctgtgagttcgaggaggtccaaggattcctggatcaggtggcccataagttgcctttcgcagccaaagccgtctcacgcggcaccctggagaagatgagaaaggaccaggaggagagggaaagaaataaccagaatccctggacattcgagcggattgcgactgccaacatgctgggaatcaggaaggtactttctccatacgatttgacgcataaaggcaaatattgggggaaattttacatgccaaaaagggtttag

SEQ ID NO: 195288 - DNA, 528 bp, Artificial Sequence
  Description of Artificial Sequence: Synthetic coding sequence
atgcggctgagcgtggccgccgccatcagccacggccgggtgttcagacgtatggggctaggccccgagtctagaatacatctgttgcgcaatctccttaccggccttgtgcggcatgagaggatcgaggccccttgggctcgggtggatgaaatgcgcggctacgcggaaaaacttattgactatggtaagctgggagacactaacgagcgtgccatgaggatggctgacttctggttgacagagaaagatttgatcccaaagctgtttcaggtcctggctccccggtataaagatcagacaggcgggtatacccgaatgctgcagatcccaaatagatctctcgatcgcgcaaagatggctgtaatcgagtataaagggaactgtttgccgcccctaccattacccaggcgtgatagccacctgaccctgctgaatcaactcctgcagggtttacgacaggatctgagacagtctcaggaagcctcaaaccactcatcgcataccgcgcagacccctgggatctag

SEQ ID NO: 195289 - DNA, 543 bp, Artificial Sequence
  Description of Artificial Sequence: Synthetic coding sequence
atggccctgcggagccggttctggggcctgttcagcgtgtgccggaatccaggttgccggttcgctgctttgagtacctccagtgagccagccgccaagccagaggtggatcctgtggagaatgaggcggtggcccccgagtttaccaaccgcaatcctagaaacctggaactactcagtgtggcacgtaaagaacgcggctggcgcactgttttcccttccagagagttttggcaccggctcagggtgattcggacgcagcaccatgttgaagccttagtggagcaccagaacggcaaggtggtggtgagcgcgagtactagggaatgggctattaaaaaacatctgtacagcactaggaacgttgtggcctgcgagtctatcggccgagtcctcgcccagcggtgccttgaagccgggatcaattttatggtgtaccagccaacaccttgggaggcagcctctgattcaatgaagcgcttgcagagtgcaatgaccgaagggggcgtcgttttacgcgagccgcagaggatttacgagtag

SEQ ID NO: 195290 - DNA, 879 bp, Artificial Sequence
  Description of Artificial Sequence: Synthetic coding sequence
atggccgcctgcatcgccgccggccactgggccgccatgggcctgggtcggtcttttcaggctgcgcgcaccttgctgccaccacccgcctctattgcctgtagagtccatgcggggcccgtccgccagcagagcaccgggccgtccgaacccggggcatttcagccgcctccaaagccagtgatcgtggataaacaccgtcccgttgagcccgaacgtcgattcctttcaccggagtttattcccagacgagggaggactgacccactcaagttccaaatcgagcggaaggatatgttagaacgcagaaaagttctgcacattcctgagttttacgtgggctccattctgcgcgtgaccactgccgacccttacgccagtggaaaaatcagccaattcttaggaatctgcatacaaagaagcggcaggggcctgggcgctacctttatccttcgaaacgtgatcgagggacagggcgtggagatttgcttcgagctgtacaatcctcgcgtgcaagagatacaggtggtgaaactcgaaaagagactcgacgactcactgttgtatctgcgcgacgctctgcctgaatactccacttttgacgtgaatatgaaacctgttgtgcaggagccaaatcagaaggtacccgttaatgagcttaaggtgaagatgaagccaaagccatggagcaagcgatgggagcggccaaacttcaatattaagggtattaggtttgacctctgcctcacagagcagcagatgaaggaggcccagaaatggaaccagccttggctggagttcgacatgatgcgggaatatgacacgtctaagattgaggccgccatttggaaagaaatcgaggcttccaagaggtcttag

SEQ ID NO: 195291 - DNA, 879 bp, Artificial Sequence
  Description of Artificial Sequence: Synthetic coding sequence
atggccgcctgcatcgccgccggccactgggccgccatgggcctggggcgatcttttcaggccgcccgcaccctgcttcccccacctgctagtattgcatgtcgtgtccacgccgggccagtcagacaacagtcgacgggacctagtgaacccggcgcctttcagcccccccccaagccagtcatcgtcgacaagcaccgacccgtggaaccggaaagacggttcctaagtcccgagttcattcctcggagaggcagaacagaccccttaaagttccagatcgagcgcaaagacatgttagaacgcaggaaggtactccacatccctgaattctacgttggatccatcctgcgagttacgactgcagatccatacgcatccggaaagatcagccaattcctgggtatctgtatccagcggagtggacgaggcctgggagcaaccttcattcttagaaatgtgattgaaggacaaggtgtggaaatttgtttcgagttgtataaccctagagttcaggagatccaggtggtgaagctagagaagcgcctggacgactcgttattgtacctgagggacgccctacctgagtactccacattcgatgtcaatatgaagcctgtagtccaggagcccaaccagaaagtgccagttaatgagttgaaagtgaaaatgaagcccaaaccttggagtaagaggtgggaacgacctaattttaacatcaagggcatccggtttgacctgtgtttgacagaacagcaaatgaaggaagctcagaagtggaatcagccctggttagaattcgatatgatgagggagtatgacacgagcaagatcgaagcagcgatttggaaagaaatcgaggcctctaagcgctcctag

SEQ ID NO: 195292 - DNA, 240 bp, Artificial Sequence
  Description of Artificial Sequence: Synthetic coding sequence
aaggtgcccgtgaacgagctgaaggtgaagatgaagcccaagccctggtctaagagatgggagaggcctaacttcaacatcaaaggaatccggttcgatctgtgcctgacagaacagcagatgaaggaggcccaaaaatggaatcagccttggttggaattcgatatgatgcgcgagtatgacacttcaaaaattgaagccgccatatggaaagagattgaggcaagcaaaaggagttag

SEQ ID NO: 195293 - DNA, 918 bp, Artificial Sequence
  Description of Artificial Sequence: Synthetic coding sequence
atggccctgtgcgccctgacccgggccctgcggagcctgaacctggccccaccaactgtcgctgccccggcgccttcactcttccctgccgctcagatgatgaataatggcttacttcagcaaccctctgcgctgatgctcttgccttgtcgacctgtgctgacctcggtcgccttgaacgccaattttgtgagctggaagtccagaaccaagtacacaatcactcccgtcaagatgcgaaagtccgggggacgtgatcacaccggacgtatccgtgttcacgggattggcggcgggcataaacagcgatatcggatgatcgactttctgcgcttccgacccgaggaaacaaaatctggacccttcgaagagaaagttatccaggtacgttacgatccctgtagatctgcagacattgctctcgtggccggaggctccaggaaaaggtggattatcgctacggagaatatgcaggccggcgatactattttaaatagtaatcatatcgggcgcatggcagtcgccgcgcgcgagggcgacgctcatcctctgggagcccttcctgtgggaacattgattaataacgtagagagcgagcccggacggggagcccaatacatcagagctgccggcacctgcggcgtgctgctccgcaaagtgaacgggactgccattatacagctgccatcaaagcgtcagatgcaagtcctggaaacctgtgtggcgactgtaggcagggtgagcaacgtggaccacaacaagcgcgttatagggaaggcgggccgcaatcgctggttaggaaagcgcccaaactccggccgctggcacagaaaaggcggttgggctgggcgtaaaatcagaccacttccacctatgaagagttacgtaaagctcccctccgcttctgcgcagtcatag

SEQ ID NO: 195294 - DNA, 450 bp, Artificial Sequence
  Description of Artificial Sequence: Synthetic coding sequence
atggtgttcctgaccgcccagctgtggctgcggaaccgggtgaccgatcggtatttccgcatccaggaagtgctgaagcatgcgagacatttcaggggacgtaaaaatcgctgctatagactggctgtcaggactgtgatcagagcttttgtgaagtgcactaaagcaaggtatttaaaaaagaagaatatgaggacactgtggatcaaccgcattacagccgcatcccaggaacacggattgaaatatcccgccctcatcgggaatctggtaaagtgtcaggtggagttaaaccgtaaggtgctcgctgatctcgccatttacgaaccaaagacgtttaagtccctggccgcattagctagtaggcgtcgacacgaggggtttgctgcagccctcggcgacgggaaggaaccagaggggatatttagccgagttgttcaatatcactag

SEQ ID NO: 195295 - DNA, 618 bp, Artificial Sequence
  Description of Artificial Sequence: Synthetic coding sequence
atggccgccagcagcctgaccgtgaccctgggccggctggccagcgcctgctcccacagcatcttgcgaccgtctggtccaggcgccgccagcctgtggtccgcctccaggcgctttaactctcaaagtactagctacttgcctgggtacgtccccaaaaccagcctatcgtcccctccatggcccgaggtggtcttgccagatcccgtggaggagacaagacatcacgcagaggtcgtgaaaaaggtcaatgagatgatcgtgacgggccaatacggaagattgttcgccgttgtccattttgcctccaggcagtggaaagtgacttccgaggatttaatcctgattggaaatgagctagacctagcatgcggagagcggatacgcctggagaaggtgctgctggttggcgccgacaacttcacacttctcggcaagccactgctgggcaaggatcttgtgcgcgtggaggccaccgtcattgagaagacggagtcttggcccagaatcattatgaggtttcgcaagaggaaaaacttcaagaagaaacggatagtgacgacacctcagactgttttgagaattaacagcatcgagatcgcgccatgcttgttatag

SEQ ID NO: 195296 - DNA, 843 bp, Artificial Sequence
  Description of Artificial Sequence: Synthetic coding sequence
atggccgccagcagcctgaccgtgaccctgggccggctggccagcgcatgcagccactctatactgcgaccgtccggacctggcgctgcctcactgtggtcggcatcccgacgatttaactctcagagtaccagctacctgccgggctatgtgcccaagacctccctttcatctcccccttggcccgaggtcgtcttaccagatcctgtggaagaaacaagacaccacgccgaggtggtcaaaaaggtcaatgagatgatcgtgacaggccagtacggtagactgttcgccgtggtccatttcgcatccagacagtggaaagttacctccgaagacctgatcttgatcggcaacgagttagacctggcctgtggagaaagaatccggctggaaaaggtcctcctggtgggtgcggataacttcaccttactcggaaagccactgttggggaaagaccttgtgcgagtggaagctactgtcatcgagaaaacggagagctggccacggattattatgcggttcagaaagcgcaagaatttcaagaaaaagaggtccaagttggagaaggtgccattgggtcctgtcgcccggtgctggctgcccagacgaatgcgcaccgaaggtgttgggcatgtggggttgggaactgggagtcccgggcgtagccaaccaggctgtcattgcccactggctacattaattcttgaaggtgcacctagggggtcgagcctcgctccactgctattgcatgccccccgtgtgactccgccccggtccccgtcgccccccaggagtgcacgcgatccgacaagtcttcccttctccagcactctccgcgcgtag

SEQ ID NO: 195297 - DNA, 363 bp, Artificial Sequence
  Description of Artificial Sequence: Synthetic coding sequence
atgatcgtgaccggccagtacggccggctgttcgccgtggtgcactttgcctcccgacagtggaaggttaccagcgaggatttgattcttattggaaacgaactagatctggcctgtggcgagcggatccggctcgaaaaggttctgctcgtaggggccgacaacttcaccctgctcggtaaaccactactgggcaaggatctggtgagggtcgaggccacagtaattgaaaagacggaatcatggcccaggatcatcatgcggttcagaaagaggaagaacttcaagaagaagaggatagttacgaccccacagacagtcctacgcataaactcaatcgagattgctccgtgtctcttatag

SEQ ID NO: 195298 - DNA, 381 bp, Artificial Sequence
  Description of Artificial Sequence: Synthetic coding sequence
atgtggtacctggccaagctgatccggggcatgagcatcgaccaggcactagcgcagctagagttcaatgataagaaaggcgccaaaatcattaaagaggtccttctcgaagcacaggatatggcagttagagatcacaatgtagagtttcggagcaatttgtacatcgcagagagcacatccgggcgtgggcagtgcctgaaaagaatccggtaccatgggcgggggcgattcggcatcatggagaaggtctactgccactactttgtgaaacttgtggaggggccgccacccccccccgaaccgccaaaaactgccgtggcccacgcgaaggaatacatccaacagttgagaagcaggactattgtgcacaccttatag

SEQ ID NO: 195299 - DNA, 699 bp, Artificial Sequence
  Description of Artificial Sequence: Synthetic coding sequence
atggccgccgccgtgctgggccagctgggcaaggacttcctggtggtgaaaagacaaaagggcgtagagatggaatccgaactgaccgcctgcgttgacgtcgctggcgccctctggatacacaatctccggtccagaggtaagctggctctcggcgttctgccacagtcatatatccacactagcgcttcactagatatcagcagaaagtgggagaaaaagaacaagatcgtgtaccctcctcagcttccaggcgagccaagaagaccagccgagatctaccactgcaggcgccagataaagtattcaaaggacaaaatgtggtatctggccaagttgatccggggaatgagtatcgaccaggccctggcgcagttggagttcaacgacaaaaaaggcgctaaaatcataaaagaagtcctgttagaggcccaggatatggctgtgcgggaccacaatgtcgaattccggagcaacctgtacatcgctgagtcaacatccggcagaggccaatgcttaaagagaattcgttaccatgggagaggccgcttcggaatcatggagaaagtgtattgtcactactttgtgaagctggttgaaggacctcccccacctcctgagcctcctaaaacagccgtggcacacgccaaagaatatatacagcagctgaggagtcgcaccattgtccatacactgtag

SEQ ID NO: 195300 - DNA, 639 bp, Artificial Sequence
  Description of Artificial Sequence: Synthetic coding sequence
atggccgccgccgtgctgggccagctgggcgccctgtggatccacaacctgcgctcccgagggaaactggcactcggattgctgtcctttcactccgtgcttcctcagagttacattcatacatccgctagtctcgatattagtcgcaaatgggagaaaaagaacaaaatcgtgtaccccccacaactacccggtgaacctcgcaggccggcggagatctatcactgtcgtagacagattaaatacagtaaggacaagatgtggtatctcgcaaaattaatccggggcatgtctatagatcaagctctcgctcagcttgaatttaatgacaagaagggggcaaagattatcaaggaagtcctgctggaggcacaggatatggccgtccgcgatcataacgtcgaatttaggagcaatctatatatcgccgaatccacaagtggcagagggcagtgcctcaagagaatccggtatcatgggagaggccggttcggaatcatggagaaggtgtactgccactacttcgttaaactggtggaaggaccaccaccgccacccgaaccccccaaaactgctgtggcacacgccaaggaatatatccagcagctgcggtcgcgaaccatagtgcacactctctag

SEQ ID NO: 195301 - DNA, 621 bp, Artificial Sequence
  Description of Artificial Sequence: Synthetic coding sequence
atggccgccgccgtgctgggccagctgggcgccctgtggatccacaacctacgatcgcggggaaaactagccctgggagtgctcccacaatcctacatccatacctcagcctcactggatatttcccgtaaatgggagaaaaagaataagattgtttatccaccccaactgcctggggaacccaggagacccgccgaaatttatcattgccggcgccaaatcaagtacagtaaggacaagatgtggtatctagccaagctgatccggggcatgtcaatcgaccaagctcttgcgcagttagagttcaatgataaaaagggcgccaagataatcaaagaagtgcttctggaagcgcaagacatggccgtgagagaccacaatgtggaatttcgttctaatctctatattgctgagtctacgtccggaaggggacagtgcctcaagcggatacggtaccacggcaggggcagattcggaatcatggaaaaggtctactgccactatttcgtcaaattggtagagggccctcctcccccacctgagccccccaagaccgccgtcgcccacgccaaagagtacatacagcaattgagatcccgtacaatcgttcacaccttgtag

SEQ ID NO: 195302 - DNA, 462 bp, Artificial Sequence
  Description of Artificial Sequence: Synthetic coding sequence
atggcccggaacgtggtgtaccccctgtaccggctgggcggcccccagttgcgggtctttcggaccaatttttttattcagctggtgcgtccgggagtggcccagcccgaagacaccgtccagttcagaatacctatggagatgacccgtgtggatctcaggaactatctggaagggatttacaatgttccagttgctgccgtacgtaccagggtgcagcacggtagcaacaaaaggcgcgatcaccgcaatgtccgtattaagaagcccgattacaaggtggcctacgtgcagctggctcacgggcagactttcaccttccctgacctgttccctgagaaggatgagtcaccagaaggaagtgcggctgacgacctatacagcatgcttgaggaagagaggcagcaacgtcaaagctccgatccacggcgggggggtgtacccagctggtttggcttgtag

SEQ ID NO: 195303 - DNA, 462 bp, Artificial Sequence
  Description of Artificial Sequence: Synthetic coding sequence
atggcccggaacgtggtgtaccccctgtaccggctgggcggcccccagctccgggtctttagaacgaacttctttattcaactcgtgagaccaggtgtcgcacagccagaagatactgttcagtttaggatccctatggaaatgactcgggttgatctacggaactacttggagggcatttataatgtgcccgtggctgctgtgcggactagggtgcaacacgggagcaataaacgccgggaccaccgcaacgttcggatcaagaaacctgattacaaagtcgcttacgttcagcttgcccacgggcagaccttcactttcccagacctgtttcctgaaaaggatgaatcccctgaagggtctgcggctgatgatctctatagcatgctggaggaagaaagacaacagcgacagtccagcgacccgaggagggggggtgttccttcttggttcggcctttag

SEQ ID NO: 195304 - DNA, 651 bp, Artificial Sequence
  Description of Artificial Sequence: Synthetic coding sequence
atgcggctgagcgccctgctggccctggccagcaaggtgaccctgccaccacactataggtacggcatgtcgccacccggatccgtcgcagataagcgcaagaaccccccctggatccgaagacggccggtcgtggtcgaacccatttccgatgaggattggtacttattttgtggggacactgtggagatccttgagggcaaggacgctggaaaacagggaaaggtggtgcaggtgattcgtcagcgcaattgggttgtggtcgggggacttaatacgcattacagatacatcgggaagactatggattaccgcgggaccatgatcccctctgaagccccactcctgcaccgtcaagtgaagctcgtggacccaatggacagaaaaccaaccgagatcgagtggagattcactgaggcaggggagcgagtgcgggtatccaccagaagcgggcggataattcctaaacctgaatttcctcgagcagatggcattgttccagaaacctggattgatggtcccaaggacacctcagtggaggatgccctagagcgtacttatgtcccgtgtctcaaaacgttgcaggaggaggtcatggaagctatgggcattaaggagactcgaaaatacaagaaagtgtactggtactag

SEQ ID NO: 195305 - DNA, 651 bp, Artificial Sequence
  Description of Artificial Sequence: Synthetic coding sequence
atgcggctgagcgccctgctggccctggccagcaaggtgaccctgcccccacactaccgctacggcatgagcccgccgggtagtgttgcagacaagcggaaaaatcccccctggattcgccgaaggcccgtggtggtggaaccaatcagtgatgaagattggtacctgttttgtggagacacagtggaaatactggagggcaaagacgccgggaaacaaggaaaggtggtacaggtgattcgccagcggaactgggtggtggttggcggcttaaatacacactaccggtatatcggcaaaactatggattatcgcggaacgatgataccctccgaggcacctctgctgcatagacaggtcaaactggtggatcctatggacaggaagcctactgagattgagtggagatttacagaagcgggcgagagggtccgtgtgagcactcgctcagggcgtattatccctaagcccgaattcccccgcgctgatgggattgtccctgagacttggatcgatggtcccaaagacacatccgtggaggatgctttagagcggacctatgttccttgcttgaagaccttacaggaggaggtaatggaagctatgggaattaaagagacaagaaaatataaaaaggtttactggtattag

SEQ ID NO: 195306 - DNA, 300 bp, Artificial Sequence
  Description of Artificial Sequence: Synthetic coding sequence
atgcggctgagcgccctgctggccctggccagcaaggtgaccctgccaccccattatcgatatggtatgtcgcctccaggttcagtggccgataagcgtaagaatcctccatggatcagaaggaggcctgtggtcgtcgagcccatcagtgatgaggactggtaccttttttgcggggacacggtggaaatccttgagggtaaggatgcgggaaagcagggaaaggtcgtgcaggtgatacggcaaaggaattgggtcgtcgttggaggcttgaacacccactatcgatacattggatag

SEQ ID NO: 195307 - DNA, 207 bp, Artificial Sequence
  Description of Artificial Sequence: Synthetic coding sequence
atgcggctgagcgccctgctggccctggccagcaaggtgaccctgccaccacactatcggtacggtatgagccctcctggctcagtggcagataagagaaagaaccccccttggatccggcgacgacctgtagtcgtggaaccaatcagcgacgaggattggtacctgttctgcggagacaccgtagaaattcttgaagggaaatag

SEQ ID NO: 195308 - DNA, 522 bp, Artificial Sequence
  Description of Artificial Sequence: Synthetic coding sequence
atgcggctgagcgccctgctggccctggccagcaaggtgaccctgccgccccactaccgctacggaatgagcccacccggaagcgtagctgataagaggaaaaaccccccctggatacgccggaggcctgtggttgtggagcctatttctgatgaggattggtacctcttttgcggggatacggtcgagattctcgaagggaaggacgccgggaagcagggtaaggtggtccaagtgattaggcaaaggaattgggtagtggtggggggccttaatacccattacagatatattgggaaaacaatggactatcgcggcacgatgatccctagtgaggccccccttctgcatcgtcaggtgaagttagtcgaccccatggatagaaaaccaaccgagattgagtggcgctttacagaggctggtgagcgggtccgcgtcagtacccgaagcggccgcattatccccaaaccagagttccccagagccgacgggatcgtccccgagacatggatcgacggctag

SEQ ID NO: 195309 - DNA, 4395 bp, Artificial Sequence
  Description of Artificial Sequence: Synthetic coding sequence
atgttcagcttcgtggacctgcggctgctgctgctgctggccgccaccgcattgcttactcacggccaggaagaggggcaggtcgaaggccaggacgaagacatccctccaatcacctgtgtccagaacggcctgagatatcatgaccgcgatgtctggaagcctgagccgtgtcgaatatgcgtgtgcgacaacggaaaggtgctgtgtgacgacgttatttgcgacgagacgaagaattgcccaggggctgaggtgccagaaggcgagtgttgccccgtttgtcctgatggctccgagtctcctaccgatcaggagacaactggcgtggaaggacccaagggagatacgggaccccgggggcctcgcggccctgcagggccaccaggccgcgatggaatccccggacagcctggactgcccgggccaccaggaccccctggcccacccggtccacctggactgggcggaaatttcgccccccaactgagttacggatatgacgagaaaagcacaggcggcatcagcgtgcctggaccaatgggcccttccggacccaggggacttccaggtccccccggagcccctggaccgcagggctttcaaggcccaccaggtgagccaggggagccaggtgcctctggccctatgggacctaggggcccccctggccccccaggtaaaaatggtgatgatggtgaggctggcaaaccaggaaggccaggggaacgtggccctcctggcccccagggggctagggggttgccagggactgctggcctgcccggtatgaagggccatcggggctttagcggccttgacggggctaagggtgatgccggacccgcaggccccaaaggagagcctggaagccctggtgagaatggagcaccagggcagatgggaccgagggggctgccaggcgagcgaggaagaccaggggctccggggccagcaggagctagaggtaatgacggtgcaacaggagcagcgggcccacctggccccactggcccagctggccctccgggatttcccggtgcagttggcgcaaagggagaggcaggacctcagggaccaagggggtctgaagggccccagggagtgcgtggagagccgggccctccaggccctgctggggcagcggggcctgctggcaacccaggagcagacgggcaacctggagcaaagggtgccaatggggcccctgggattgctggcgctcccgggttccccggagctcgtggaccttccggacctcaggggcctggcggcccacctggcccaaaagggaacagcggcgaacctggggcccctggaagtaagggtgacaccggcgcaaaaggggaacctggccctgttggagtccaagggccgcctgggcctgcgggcgaggaaggaaagcgcggcgccaggggtgagccggggccaacagggttgcccggaccaccaggcgaaaggggaggaccaggtagtcgtggctttcctggcgccgatggggtcgctggccctaagggtcctgccggcgaacgcgggtctccggggcccgccggacctaagggcagtccgggtgaagcaggacgcccaggagaggccggtctaccaggagctaagggccttaccggttcccccggctctcctggtcccgacggcaagactggtccacctgggccagccggccaggatggcaggccaggtccgcccggtccacctggggcccgcggccaggccggggtaatggggttcccaggccccaagggagctgccggcgaacccgggaaagcaggggagcggggcgtgccaggccccccaggcgcggtgggccccgccggaaaagacggcgaggccggcgcccagggcccacctggccctgccggaccagctggggagcggggggagcagggccccgcaggaagcccaggcttccagggattaccggggcctgccggccctcctggagaagcagggaagcccggagagcaaggcgtgccgggagatctgggagcacccgggccaagcggcgcaagaggcgaacggggattcccgggggagcggggcgtgcaagggcccccaggccctgcggggcctcggggagccaacggcgctcccggcaatgatggcgctaagggggatgcgggcgctcctggggcacccgggagtcagggcgccccaggtttgcaaggtatgcccggcgagcgcggagccgccggacttcctggacccaagggagatagaggcgacgcaggacccaaaggcgctgatgggtcaccgggaaaggatggagtgcgcgggctgaccgggccgattggacctccggggcccgccggagcccctggagataaaggcgaatccgggccttccggtcctgccggccctaccggggcccgaggtgcaccaggggatcggggcgaacccgggccacccggtccagcaggttttgcaggaccacccggcgccgacggacaacccggtgccaagggggaaccaggggacgccggggctaaaggtgatgctggaccccccggaccagccggaccggccggaccgccgggtccaattggaaacgtcggagcgccgggagctaaaggagcccgagggtccgcagggcctccgggcgcaaccggattccctggagccgctggacgcgttggccctcctggccctagtggcaacgcaggtccacctggcccgcctggccccgccggaaaagagggtggcaaaggaccccgaggcgagaccgggcccgcaggtcggccaggcgaggtagggcccccaggcccccccggaccagccggggagaagggatctcctggtgccgatggcccggccggtgcgcccggcacgcctgggccacagggaatagcagggcagcgcggcgtggtgggcctgcctggccagcgtggagagcgcggctttcccggactccctggtccgagtggcgaaccgggaaagcagggaccaagcggtgcttcaggggagcgggggccccctggccccatgggtccacccggtcttgccggcccgcctggcgaatcagggcgggagggagcaccgggtgcggagggtagccctgggagagacgggagtcccggcgccaagggtgaccggggcgaaaccggtccggcgggccctccgggagcccccggcgcccctggcgctcccgggccagtcggcccagccggcaagtcgggggataggggggagacagggccagcgggcccgaccgggcccgtgggccccgtgggtgccagagggccggctggaccacagggtccgcgcggcgacaagggggagactggtgagcagggagacagagggataaagggacacaggggcttttccggtctgcagggccccccgggcccccctggtagtcccggggagcagggcccctccggcgctagtggccccgccggcccacgcggcccgccagggtcagccggggcccccggtaaggacggacttaatggacttccaggccctatcggaccacctgggcctcgaggccgtactggggacgcagggcctgtgggccctccaggtccgccggggccccccggcccgcccggacccccctcagccggtttcgatttctccttcctgccacagcctccgcaggagaaggctcacgatgggggaaggtactatcgcgcggatgatgccaacgtggtccgtgatcgggacctcgaggtggacactacactgaagagcctatcccagcagattgaaaatatccgaagccctgaaggctcccgtaagaaccccgcacggacatgccgcgacctaaagatgtgccactctgattggaaaagcggtgagtattggatagaccctaaccaggggtgtaacctggatgcaattaaagtgttctgcaatatggagaccggcgagacgtgcgtctatcctacgcagcccagcgtagcccagaaaaattggtacatatcaaagaaccctaaggacaagcgccatgtatggttcggagagagtatgaccgatgggttccagttcgaatacggggggcaggggagcgatccggcggacgtggccatccagctcacctttctgaggctcatgtcaaccgaagcctctcagaacatcacctatcactgcaagaacagtgtggcctacatggatcagcagactgggaatctgaaaaaggctctgctgcttcaaggaagcaatgaaattgagatccgggctgaggggaatagcagattcacatattctgtcaccgtggatggctgtacctcacataccggggcgtgggggaagacggtcattgagtacaaaaccaccaaaacctctagacttcctattatagacgtagcaccattggatgtgggcgccccagatcaggagtttggctttgacgtgggccccgtgtgcttcctgtag

SEQ ID NO: 195310 - DNA, 285 bp, Artificial Sequence
  Description of Artificial Sequence: Synthetic coding sequence
atggccagcgtggtgctggccctgcggacccggaccgccgtgacctctctgctgagccctaccccggcaaccgccctcgctgtcagatatgcaagtaaaaagagtggcgggtcctctaagaacctcggtggcaaaagtagtgggagacgtcagggtatcaagaaaatggagggccattacgtgcatgctggaaatatcatcgctacccagcgccactttagatggcaccccggggcccatgtgagttgctccgtggctgccccattgttcccatttttggggtag

SEQ ID NO: 195311 - DNA, 282 bp, Artificial Sequence
  Description of Artificial Sequence: Synthetic coding sequence
atggagggccactacgtgcacgccggcaacatcatcgccacccagcgccattttagatggcatccgggggcccacgtgggagtcggaaaaaataagtgtttgtacgcccttgaagaaggcattgtgaggtatactaaagaagtctacgttccccaccctaggaacacagaagccgtggacctgatcacgaggttgcccaagggcgccgtgttatacaagactttcgtccatgtggtgcctgctaagccagagggaacatttaaacttgtagctatgttgtag

SEQ ID NO: 195312 - DNA, 282 bp, Artificial Sequence
  Description of Artificial Sequence: Synthetic coding sequence
atggagggccactacgtgcacgccggcaacatcatcgccacccagcgccattttcgctggcaccccggcgctcacgtcggtgtagggaaaaataagtgtctttacgcactggaggaaggaattgtccggtacactaaggaggtatacgtaccacaccccagaaacacagaggccgttgacctcattacacgcctgccaaagggagcagttctgtacaaaacctttgtgcacgtggtgccggcgaagcccgagggaacattcaagctggtcgcaatgctctag

SEQ ID NO: 195313 - DNA, 771 bp, Artificial Sequence
  Description of Artificial Sequence: Synthetic coding sequence
atgcccctgcacaagtaccccgtgtggctgtggaagcggctgcagctgcgtgaaggaatatgcagtagactcccaggacactacctccggtcacttgaggaggaacggaccccaacccctgtccactataggccccatggcgccaagtttaagatcaacccaaaaaacggccagagggagagggtagaggacgtgcctatcccaatctacttccctcctgagagtcagcgcgggttgtggggcggcgaaggctggattttggggcagatctacgcaaataacgataaactgtctaagcggctgaagaaagtttggaaacctcagttgttcgagagagaattctattcagagattcttgataaaaaattcacggtgaccgtgaccatgaggactttggacctgatcgacgaggcatacggattggacttctacatccttaaaacaccaaaggaggatctgtgctcaaaatttggtatggacctcaagcggggaatgctgctccgcctggcacgccaggacccccaactacatccggaggaccctgagagacgtgccgcaatctatgataaatacaaggagtttgctattcccgaggaagaggctgaatgggttggtctgacgctggaagaagccatcgaaaagcagagacttctggaggagaaagatcccgttccgctttttaagatctacgtggcagaactaattcaacaactgcagcagcaggccctctctgaacccgcagtagtgcagaagcgcgcgtcagggcagtag

SEQ ID NO: 195314 - DNA, 771 bp, Artificial Sequence
  Description of Artificial Sequence: Synthetic coding sequence
atgcccctgcacaagtaccccgtgtggctgtggaagcggctgcagctgagggaaggaatctgctcacgcctgcccggacactatctgcgatctctggaggaagaacggactcctacgcctgtccactacagaccacatggcgctaaattcaaaatcaacccaaaaaatgggcaaagagagagagtggaggacgtgcccatccctatttactttccccccgaaagccagaggggcctttggggaggcgagggctggatcctgggccaaatttacgccaataacgacaagctgtccaaacgcctgaagaaggtctggaagccgcaactgtttgagagagagttttacagcgagatattggataagaaatttacggttaccgttacgatgaggactttagacttgatcgacgaggcttatggcctggacttttatattctgaagacccctaaagaggatctgtgctcgaagtttggaatggacctgaaaagagggatgctcctgcgtctcgcccggcaggatccccagcttcaccccgaggatcccgaacggcgggctgctatctacgataagtacaaggagttcgctattcctgaagaagaagccgagtgggtgggactgaccttagaagaggccatcgaaaagcagcggctgttggaggagaaggacccagttccactgtttaagatctatgtagccgagcttatacagcagttgcagcagcaggcactcagtgaacccgccgtcgttcagaaaagagcaagcggccaatag

SEQ ID NO: 195315 - DNA, 771 bp, Artificial Sequence
  Description of Artificial Sequence: Synthetic coding sequence
atgcccctgcacaagtaccccgtgtggctgtggaagcggctgcagttgagggagggtatctgctcccgactgccaggccattatctccggagccttgaggaggagaggaccccaactcccgtgcactacaggccccatggtgctaaattcaagatcaacccaaaaaatggtcagagggaacgggtggaggacgtgccaataccaatctactttccacccgagtcccagagaggactgtggggcggagaaggctggatcttggggcaaatatatgcaaacaatgacaagctgtccaaaagactcaaaaaggtttggaagcctcagctcttcgagagggagttttactccgagatcctggacaaaaaattcacagtgactgtcactatgcgaacacttgacctgatcgacgaagcctatggtctggatttctatattttgaaggcgtccggtgaggatctgtgcagcaagttcggaatggatctaaaacgtggtatgcttctgaggttggccagacaggatccccagttacacccggaagatccagaaaggagggcagctatttatgacaagtataaggagtttgctatcccagaggaggaagccgaatgggtaggcttgacactcgaagaggcaatcgaaaaacagcggctgctagaagagaaggatccagtcccactcttcaagatctacgtggcggaactaatacagcaacttcaacagcaggcattgtctgaaccagctgtggtgcagaaacgtgccagcggacaatag

SEQ ID NO: 195316 - DNA, 771 bp, Artificial Sequence
  Description of Artificial Sequence: Synthetic coding sequence
atgcccctgcacaagtaccccgtgtggctgtggaagcggctgcagttaagggagggtatttgcagtcgcctgcccggccactaccttcgctcactagaggaagaacggaccccaacaccagttcattataggccacatggcgctaaatttaagataaatcctaagaatggccaaagagaacgggtcgaggatgtccctatccccatctacttcccacccgagtctcagcgcggcttgtggggaggtgagggctggattctgggacagatctatgctaacaacgacaagctaagcaaacgacttaagaaggtgtggaagccccaactgtttgaacgcgagttttactctgagatcttggacaaaaagtttaccgttacagtgaccatgcgcacgctcgacctaatcgacgaggcctacggcctagatttttacatcctgaaagcctcaggtgaggatttatgcagcaaattcggtatggacctcaagaggggaatgcttctgcggctagcgcggcaagacccacaactccaccctgaagatcctgagcggagagccgccatatacgacaaatacaaggaatttgcaataccggaggaggaagctgagtgggttggcctgacgctcgaagaagcaatcgaaaaacagaggctccttgaggagaaggacccggtgcctttatttaaaatttacgtggcggaacttattcagcagctgcaacagcaagccctgagcgagcccgccgttgtccagaagagggccagtggtcaatag

SEQ ID NO: 195317 - DNA, 147 bp, Artificial Sequence
  Description of Artificial Sequence: Synthetic coding sequence
atgagccgggccggcggccggggcgagcagagccggtggggccggagggccgagctccggggccttgggaggcctgaagcacctttacggctgggccccgatgtctgcggttcagtaccttgcgcacgcggggccggttccgagtag

SEQ ID NO: 195318 - DNA, 723 bp, Artificial Sequence
  Description of Artificial Sequence: Synthetic coding sequence
atgcccctgcacaagtaccccgtgtggctgtggaagcggctgcagctacgcgaagggatatgcagtaggttgcccggacactacctcagatccctcgaagaggaaagaacgccaactcctgtgcattaccggccacacggcgctaaattcaaaatcaatcctaaaaacggccagcgagagcgtgttgaagatgtacccatccccatttactttcccccagaaagccagaggggactgtggggcggcgagggctggattctgggccagatatatgcaaataacgataaacttagtaagcgcctcaagaaagtgtggaaaccgcagctctttgaacgagagttttactcagagatacttgataagaaattcactgttacagtgaccatgagaaccttagacctgatagatgaagcttacggcctcgatttttacatcttgaagaccccgaaggaagatttgtgcagcaaattcggcatggatctcaagagagggatgctgctgcggttagctagacaggacccccagcttcacccagaggacccagagcgcagagctgcaatatacgataaatacaaggagtttgccatccccgaagaggaggccgaatgggtgggtctgacactggaggaagcaattgaaaaacagagattgctcgaggaaaaggaccccgtgcctttgtttaagatatacgttgccgagctgatccagcagctgcagcagtag

SEQ ID NO: 195319 - DNA, 657 bp, Artificial Sequence
  Description of Artificial Sequence: Synthetic coding sequence
atgcccctgcacaagtaccccgtgtggctgtggaagcggctgcagttgcgagagggcatctgcagccggctgcccgggcactatctgcgaagcctcgaagaggaacgcacacccacacccgtgcactacagacctcatggcgctaaattcaaaatcaaccccaaaaatggacagagagaaagagtcgaggacgtccccattcctatttactttccccctgagtcccagaggggattatggggcggcgaagggtggatcttgggacaaatctacgccaacaacgacaagctgtctaaacgcctcaaaaaagtgtggaagccccaactatttgaacgggagttttactccgagattctggacaagaaatttactgtgacagtaaccatgcggacattggatcttattgacgaagcttatggtctggatttctacatactgaagacccctaaggaggatctgtgtagtaaatttggaatggacctaaaaaggggaatgctgctccggctggccagacaagacccacagctgcacccagaagaccctgaaagacgagcagcaatttacgacaagtacaaagaatttgccatacccgaggaagaggccgagtgggtgggactgacactcgaagaggctatcgagaagcaacgccttctgtag

SEQ ID NO: 195320 - DNA, 585 bp, Artificial Sequence
  Description of Artificial Sequence: Synthetic coding sequence
atgcccctgcacaagtaccccgtgtggctgtggaagcggctgcagctgcgagagggcatctgcagcaggcttcctgggcactatctcaggtctcttgaagaggagaggacccctacccccgtgcactaccgaccacacggagccaagtttaagattaatccaaaaaacggtcagagggaacgtgttgaggatgtgcccatcccgatctattttccacccgaatcgcaacgaggcttatgggggggcgaaggttggattctgggtcagatttacgccaacaacgataagctgtcaaagcggctcaagaaggtctggaaaccgcagttattcgaacgggaattttattccgaaattctcgacaaaaagttcaccgtgaccgtgaccatgaggacgcttgacctgatcgacgaagcttacggtctcgacttctatatactgaagacccctaaggaggatctgtgttctaagttcggcatggacctgaaacgagggatgctcctacgtttggctcggcaggacccccagctccatcccgaggatccagaaagacgtgcagctatctatgataaatataaggaattttag

SEQ ID NO: 195321 - DNA, 1047 bp, Artificial Sequence
  Description of Artificial Sequence: Synthetic coding sequence
atgcccggctggcggctgctgacccaggtgggcgcccaggtgctgggtagacttggcgacggcttgggagctgctttggggcccggcaatcgcacacacatttggctgtttgttcgtgggctgcatggaaagtcagggacatggtgggatgaacacctgtctgaagagaatgtgcccttcatcaaacagttagtgagtgatgaggacaaggcccaactggctagtaagctgtgtcccctgaaagacgagccatggccaatccacccttgggagccaggatcatttagagtcggcctgatcgctctgaagctgggaatgatgcccttgtggactaaggatggccagaaacacgtggtaacactcctgcaggttcaagattgccacgttctgaagtacacctctaaagagaattgcaacgggaaaatggccacactaagcgtggggggtaagaccgtgagcaggttccgcaaggcgacaagtatcctggagttctatcgtgaactggggctgccaccgaaacaaacagttaagatttttaacattactgacaacgcggcaataaaacccggcacccccttatacgcagctcacttccgtcccgggcagtatgtggacgttacagccaagacgatcggcaaagggttccagggagttatgaagcgctgggggttcaaaggccagccagctacgcacggacagaccaagacacaccggcgacctggagcggtggccaccggggatatcgggcgcgtgtggcccggcaccaagatgcctgggaaaatgggaaacatctacagaaccgagtacgggttgaaggtctggcgaattaataccaagcataacatcatctacgtcaatggcagcgtgccagggcacaagaactgtctggtgaaggtcaaggacagtaaactgcccgcgtacaaagacctcggaaagaatctacctttcccgacttactttcctgacggcgatgaggaagaactcccggaggacctgtatgatgagaatgtttgccagcctggggctcccagcatcacttttgcctag

SEQ ID NO: 195322 - DNA, 1128 bp, Artificial Sequence
  Description of Artificial Sequence: Synthetic coding sequence
atgcccggctggcggctgctgacccaggtgggcgcccaggtgctgggtcggctaggcgacgggctgggggctgcccttggacccggcaacagagtcaccaccaatagccttaacgtcagtctcatccgtcggaacgtgggatccgaggaaaaagtcggggatttaaagaaacggacacacatatggctgttcgtgagaggactgcacggcaagagtgggacttggtgggacgagcatctgagtgaagagaacgtgccgttcatcaagcaactggtgtctgacgaggacaaggcgcagctggcatccaaattgtgccctctgaaggatgaaccctggcccatccatccctgggaacctggcagcttcagagtgggtctgattgcacttaaactgggcatgatgcctctctggacaaaagatggacagaagcatgtggtgaccttgctgcaggttcaggattgccacgtactcaaatacacctctaaggagaattgtaatggcaaaatggccactttaagcgtgggtggtaagacagttagccgattccgcaaggcaactagtatcctggagttttacagagaactgggacttcctccaaagcagactgtgaagatatttaatattacagacaatgccgcaattaagccagggaccccactgtatgcagcacactttcgtcccggccaatacgtggacgtgaccgctaagacgattggtaagggttttcagggggtgatgaaacgttggggctttaagggacagcccgctacacatggacagactaagacacaccggagaccgggagctgtggccacaggcgacataggacgggtgtggcccggcacgaaaatgcccggaaagatgggaaatatctatcgaactgagtatgggctgaaagtgtggaggataaatacaaaacacaacatcatctacgtcaacggatcagtccccggacacaagaactgcctggtaaaagtaaaagacagcaagctccccgcttataaggaccttggcaaaaatctgcctttccccacatatttcccggacggcgatgaagaagagctccctgaagacctttacgacgaaaatgtgtgccagccgggcgcaccttccattaccttcgcatag

SEQ ID NO: 195323 - DNA, 1092 bp, Artificial Sequence
  Description of Artificial Sequence: Synthetic coding sequence
tgattcttccccagccagcgggccagcgccggcgaccggagcggcggacattgtgagaatttcccaaccgcaaccgcgtccacctggaggtggagaggcgatagcctcaaagctgagcggcagggcgcgaggaaatccacacacatttggctatttgttcggggcctgcacgggaaaagcggtacatggtgggatgaacatctttctgaagaaaatgttccatttattaaacagctggtgtccgacgaagacaaggcccagctggcgagcaagctgtgtccactcaaggatgaaccgtggccaatacatccttgggaaccaggaagctttcgggtggggctaattgcactgaagctcgggatgatgcctctgtggactaaagacggtcagaagcatgtggtgactcttctccaggtgcaggattgtcacgtgctgaagtacacttccaaagagaattgcaacggaaaaatggccaccctgagcgtcggtggaaaaacggtgtcacggttcagaaaggccacgtcaatcctggaattttatagggagttaggacttccaccaaaacagaccgtcaagatctttaatatcactgataatgccgcaattaagcctggcaccccgctgtacgccgctcacttcaggccaggacagtatgtggacgtaaccgcgaagactatcgggaaaggcttccagggggtgatgaaaagatggggctttaaaggtcagcccgccacacacggtcagactaagacacaccgcagacccggagcggtcgccaccggcgacatcggccgtgtgtggccaggaacaaagatgccgggcaagatgggtaacatatatagaaccgaatatggtctgaaggtctggagaatcaatactaagcataatataatttatgtaaatggaagcgttccgggccacaagaactgccttgtcaaggtaaaagactccaaattgccagcctataaggacttggggaagaacttaccgtttccaacgtatttccccgacggcgacgaggaggagttaccagaagatctgtacgacgagaacgtatgtcagcctggtgcaccctccatcacgttcgcatag

SEQ ID NO: 195324 - DNA, 486 bp, Artificial Sequence
  Description of Artificial Sequence: Synthetic coding sequence
atggccggcatcctgcggctggtggtgcagtggccccccggccggctgcagaccgtgaccaagggcgtggaatcactgatctgcaccgactggatccgtcacaagtttaccaggtctaggatcccagaaaaggttttccaggcttcacccgaggaccacgaaaaatacggtggcgatccccagaacccccacaaactgcatatcgtaaccaggatcaaatcaactagacgcagaccctattgggaaaaggatataattaaaatgctcggcttggagaaagcccacactccgcaggtacataaaaatatccctagtgtgaacgccaagctgaaagtagttaagcatcttattaggattaaaccactcaaactgccacaaggtctgcccgcagaagagaacatgtccaatacctgcctgaagagcacaggggagcttgtcgttcagtggcatcttaaacccgttgaacagaaggcacacgaaagttag

SEQ ID NO: 195325 - DNA, 486 bp, Artificial Sequence
  Description of Artificial Sequence: Synthetic coding sequence
atggccggcatcctgcggctggtggtgcagtggccccccggccggctccagaccgtgaccaaaggtgtggaatctctgatctgtaccgattggattcgccacaagttcacgagatccaggatccccgagaaagtctttcaggcctcacctgaagaccacgaaaaatacgggggagacccacaaaacccgcataagctgcacattgtaacacgcattaagtccacccggcggcggccttactgggaaaaggatattatcaaaatgctgggcctagaaaaggcacacacgccacaagtccacaaaaatataccctcagtcaacgccaagctcaaggtggtgaagcatttaatcagaattaagccgcttaaattgccacaaggactccccgctgaagaaaacatgtccaacacctgtttaaagtctacaggagaactagtggtgcagtggcacctgaagcccgtggagcagaaggcacacgaaagctag

SEQ ID NO: 195326 - DNA, 705 bp, Artificial Sequence
  Description of Artificial Sequence: Synthetic coding sequence
atggccgagcggggctacagcttcagcctgaccaccttcagcccctccggcaaattggtccagattgaatatgccctagcagcggttgctggtggagcaccttccgtcggtatcaaagcagcaaacggcgtcgtgcttgctacagagaagaaacaaaagtcgatcttatacgatgaacgatctgttcacaaagtcgagcctattactaagcacatcgggctcgtctattctggcatgggacccgactatagagtgctggtccatagggcccggaagctggcccagcagtattatctggtttaccaggaaccaatccccacagctcagcttgtgcagcgtgtggcctccgttatgcaagagtacactcagtcagggggagtgagaccatttggggtcagtttgctcatatgtggctggaatgagggccggccgtacctctttcagtccgacccttctggggcctacttcgcctggaaagccacggcgatggggaagaactatgtgaacgggaagacattcttagagaaacgctacaacgaggacttggaactcgaggacgccatccacactgctatcctcactctgaaggaatcttttgaagggcagatgaccgaggacaacatcgaagttggcatttgtaacgaggctggattcaggcggttgactccaacagaagtaaaagactaccttgcagccatagcatag

SEQ ID NO: 195327 - DNA, 324 bp, Artificial Sequence
  Description of Artificial Sequence: Synthetic coding sequence
atggccctggccatgctggtgctggtggtgagcccctggagcgccgccagaggcgttctcaggaattattgggagaggctcctccgaaagctgccacaatccagaccaggctttccctctcctccctgggggcctgccctggctgtgcaaggacctgcgatgttcactgagccagccaatgacacctccggcagtaaagaaaactctagcctgctcgacagcattttttggatggcagcacccaaaaatcgccgtacaatcgaggtcaatcgatgtaggaggagaaacccacaaaagctcataaaagttaaggtcatgcactag

SEQ ID NO: 195328 - DNA, 279 bp, Artificial Sequence
  Description of Artificial Sequence: Synthetic coding sequence
atggccgtgctggccggcagcctgctgggccccaccagccggagcgccgcattgctaggtggacgttggctgcagccgcgagcatggttaggttttccagacgcttggggcctccctaccccacagcaagctaggggaaaagcaaggggcaacgagtatcagccttccaacatcaagagaaaaaacaagcacgggtgggtgcggcgcctgagcacgccagcgggcgtacaagtgattctgcggagaatgctgaagggacgaaagtccctgagccactag

SEQ ID NO: 195329 - DNA, 513 bp, Artificial Sequence
  Description of Artificial Sequence: Synthetic coding sequence
atggccgccagcgccttcgccggcgccgtgcgggccgccagcggcatcctacggcctctgaacatccttgcaagctctacctacagaaactgcgtcaaaaacgcatccctgatctccgctctgtcaaccggaaggttctcccacatacagactcctgttgtgtcatctaccccccggctgaccacaagcgagcgaaacttgacttgcgggcatacatctgttattctcaaccggatggcccccgtgctcccctctgtccttaagcttcccgtccgcagcctgacctacttctctgcccgaaagggaaagcggaaaaccgtcaaggcggtgatcgacaggttcctccgcctgcattgtggcctttgggttcggcgcaaagcaggttacaagaagaagctgtggaagaagacccccgctagaaagaaacgcttgagggaattcgttttctgcaataagacacagagcaagctgctggacaaaatgacgacctccttctggaagagacggaattag

SEQ ID NO: 195330 - DNA, 567 bp, Artificial Sequence
  Description of Artificial Sequence: Synthetic coding sequence
atggccgccagcgccttcgccggcgccgtgcgggccgccagcggcattttaagacctctgaatatcctggcatcttccacctacaggaattgcgttaaaaacgcaagtcttatctcggcactcagcacaggacgcttctcccatatccagactcctgttgtcagctctacccctaggttaaccacttccgagcggaacttgacttgtggccatacctccgttatcttaaatagaatggcccctgtgctgcctagtgtgctaaagttaccagtacgctctctgacgtacttcagtgctcgcaagggcaagcgcaaaacagttaaggctgtgattgacagatttctgaggctgcattgtggactgtgggtgcggaggaaggctggatacaaaaagaagctctggaagaaaaccccagcaagaaaaaaacgcttacgagagtttgtgttctgcaataagactcagagtaagctgcttgacaagatgaccacctcattttggaaacggaggaactggtacgtcgatgacccttatcagaaatatcatgaccggaccaacctcaaggtgtag

SEQ ID NO: 195331 - DNA, 312 bp, Artificial Sequence
  Description of Artificial Sequence: Synthetic coding sequence
atggccaacctgttcatccggaagatggtgaaccccctgctgtacctcagccgtcacacagtcaagccacgcgcactgtcaactttcttgttcggttctatacgtggagcagcccctgtggcggtcgaaccaggtgctgctgtgcggtctttactgtccccgggcctactgccccatctgctccctgcgctgggcttcaaaaacaagacagttttgaagaaaaggtgcaaggactgctatttggtgaaaagaagaggccgctggtacgtgtactgcaagacccatccccgtcataagcagcgccaaatgtag

SEQ ID NO: 195332 - DNA, 312 bp, Artificial Sequence
  Description of Artificial Sequence: Synthetic coding sequence
atggccaacctgttcatccggaagatggtgaaccccctgctgtacttgtcccgacacacggtcaagcctagggccctttctactttcttgttcgggtctatccgcggagccgcgcccgtggccgtggagccaggggctgccgtccggtcactcttaagccccggtttattaccccatctgcttccagctcttggattcaagaacaaaactgttctgaaaaagaggtgcaaggattgttatctggtcaagaggcgcggcaggtggtacgtgtactgcaagactcacccacgacataagcagaggcagatgtag

SEQ ID NO: 195333 - DNA, 312 bp, Artificial Sequence
  Description of Artificial Sequence: Synthetic coding sequence
atggccaacctgttcatccggaagatggtgaaccccctgctgtacctatcacgacacactgtgaagccaagggccctcagcacgtttttgtttggatccatcagaggtgccgcccccgtggcagtcgagccaggagcagcagtgagatccctgttgagccccgggcttttgccacacctccttcctgcgctgggattcaaaaataaaacagtactgaagaaaagatgtaaagattgctacctggtgaaaaggaggggcaggtggtacgtgtactgtaagacccatccacggcataaacagcgccagatgtag

SEQ ID NO: 195334 - DNA, 312 bp, Artificial Sequence
  Description of Artificial Sequence: Synthetic coding sequence
atggccaacctgttcatccggaagatggtgaaccccctgctgtacttgtctaggcacacagtgaaaccaagagctctcagcacattcctctttggctccattaggggagccgcccccgtcgcggtggagcccggcgctgcggttcgatcactgctgagtccaggacttttgccccatctcttaccggcacttggattcaaaaacaagacagtcctgaaaaagagatgcaaggattgttacctggtcaaacgcagggggcgatggtacgtgtattgcaaaacccatcctcgccacaagcagaggcagatgtag

SEQ ID NO: 195335 - DNA, 1251 bp, Artificial Sequence
  Description of Artificial Sequence: Synthetic coding sequence
atgcacttcgtgccctggctggcccggcccatcttccccccctgggacagaggttacaaggatccaagattctacaggtccccccctctccacgagcatccgctatacaaagatcaagcctgctatatattccaccatcggtgcaggcttctagagggagtgaaacaggcactttggttgactaaaactaaactaattgaaggcctgcccgagaaagtgctatccctcgtggacgatcccaggaaccacatcgagaaccaggatgagtgtgtactgaacgtgataagccacgcgaggctctggcaaaccactgaggagatccccaaaagggagacttattgtcctgttattgttgacaatcttattcagttatgcaagtcccagatcctcaagcaccccagtctggccaggcggatttgtgttcaaaatagcaccttctcagctacatggaatagagagtctctgctgctgcaggtgcggggatctggtggcgcgcggcttagcacaaaggatcccctacccactatcgccagccgggaagagattgaggcgaccaagaatcatgtgttggaaactttctaccctatcagtccaattatcgaccttcacgaatgtaacatctacgatgtgaagaacgacacaggatttcaagaggggtacccgtacccttacccacacacactttatctgttggataaagcgaatttaagaccccacagactccagcccgatcagctaagggccaagatgatcttattcgcattcggcagtgccctggcccaggccaggttgctgtacgggaatgatgctaaggtgttagagcaacccgttgtggtgcagagtgtggggacagatggtagggtgtttcactttctcgttttccagttgaatacaacagatctggattgtaatgagggtgtgaagaacctggcctgggtcgactcggaccaactcctataccagcacttttggtgcctgccggttatcaagaaacgggtcgtggtaaccgggccgtgctttagcaaatcacaaatgagcacttcatttgtcctgacacccagcttcaatgccggggaagaggttatgcagcgaaatctgagggcatcggcctccctgccccctagtaccggaagtccagcttctgaattggttaaagaacaggagcatgcagctgggagggtgctccgtcgagttatgcttgattccgagactcccagggaggagctgcccgcggccgatttctggaagtag

SEQ ID NO: 195336 - DNA, 879 bp, Artificial Sequence
  Description of Artificial Sequence: Synthetic coding sequence
atgagcggcgcctgcgccccccggggcagccggagcctgctgccctggattggctgcacccggtccttagactggtcaccctcaccacttcggggcagatgcacctcatgtccaggatggcggggccggtcattccggcccggcaccgcggccacgagaacgcagggttcaactgccagacctctgttcacctcaattagatgcaccaagacacggcccgcgattagctttacaacagtcgctgcattctctaggagcctgttattgcaggtccgggggtccggaggagcacgcctgagtaccaaagatccactgcctactattgctagccgagaagagatcgaagcgactaaaaatcacgtactggaaaccttttaccccatatctcccattatcgatctgcatgagtgtaatatatatgatgtaaagaacgacactggcttccaggagggctacccatacccatatcctcataccctgtacctgctcgacaaggccaacttgcggcctcacagactccagccggaccagctgcgggccaagatgatactttttgccttcgggtcggccctcgctcaggcccgcttgttgtatggaaacgatgccaaggtgctcgaacagcccgtggttgttcaaagtgtgggtaccgatggccgcgtgtttcacttcctcgtatttcaacttaatacaaccgatctggactgtaatgagggcgttaagaatctggcttgggtcgattccgatcagctgctctatcaacatttctggtgcttgcccgttatcaaaaaaagagtggtggtggaaccggttggacctgtgggatttaaacccgaaacctttcgtaaattccttgcactgtatctgcatggggccgcctag

SEQ ID NO: 195337 - DNA, 1272 bp, Artificial Sequence
  Description of Artificial Sequence: Synthetic coding sequence
atggccctggccagcggccccgcccggcgggccctggccggcagcggccagctgggactcggcggatttggcgctccacggaggggggcctacgaatggggtgtgaggtccacacggaagtctgagcctccccctctcgacagagtctacgaaataccaggcctggagcctataacttttgcaggcaagatgcatttcgtgccatggcttgctaggcccatttttcccccttgggatcgaggatacaaagatcctcgattctatcgtagccctcccctgcatgagcacccactttacaaggaccaggcatgctacatctttcaccatcgatgcagattgcttgagggggtgaaacaggccctttggttgacaaagactaaactgatagagggactgccagagaaggtcctaagtctcgttgacgatccgaggaatcacattgagaatcaggatgaatgcgttctcaatgtgatcagccacgccagactgtggcagaccaccgaagaaatacccaagcgtgaaacttattgtcccgttatcgtcgataatttaatccagttgtgcaaatcacaaattctcaagcatccttcacttgcaagaagaatatgtgtgcaaaattcaaccttttccgctacctggaatagggaaagcttattgcttcaggtgcgtggatctgggggggcacggctgagcacgaaggatccactgccgaccattgctagccgggaggagatagaagcaactaagaatcatgtcttagaaactttttatcccatcagtccaattatagatctgcacgagtgtaatatctatgacgtgaagaatgacactggattccaggagggctatccatacccatacccgcacactctgtacctgctcgacaaggccaatcttcggcctcataggcttcagcctgaccagctgcgggctaagatgatcctcttcgctttcggctccgctctggctcaggcacgtctcttatacggaaatgacgccaaggtgctggagcagcccgtagtagtgcagagcgtgggtaccgacggacgcgtgttccattttctagtgtttcagctgaacactaccgacctggattgtaatgagggcgttaagaacctggcttgggtggattctgatcagctgctgtaccagcacttctggtgtttacccgtgattaaaaagagagtggtagtggaaccagtgggcccagttgggttcaagcccgagacttttcggaagttcctcgcgctgtatctgcacggcgcagcctag

SEQ ID NO: 195338 - DNA, 795 bp, Artificial Sequence
  Description of Artificial Sequence: Synthetic coding sequence
tgaagcctgctgctgcaggtgcggggcagcggcggcgcccggctgagtactaaggacccgctgccgacgattgcttcacgtgaagagatcgaggcaactaagaaccacgtgttagaaactttttatcccatcagccccataattgaccttcacgaatgtaatatctatgatgtaaagaatgacacagggttccaggagggctacccttacccgtacccccatacattgtatctgctagataaagctaacttaaggccccaccggctgcagcccgaccagctcagagcgaagatgatactattcgcatttggctctgccctcgcacaggcgaggttattatacggaaacgacgccaaggtgctcgagcaacctgtcgtggtgcaatctgttggaactgatggacgggtgttccatttcctggtgttccagctcaatacaactgatctggattgtaatgagggcgtgaaaaatctcgcctgggtggattctgaccagttgctgtaccaacacttttggtgtttgcctgtgatcaagaagcgtgtcgtggtgaccgggccatgctttagtaaatctcaaatgtctacaagttttgtccttactcctagtttcaacgccggggaggaagtcatgcagcggaacttaagagcatctgcaagtctccctccatctacaggcagccctgcatccgagcttgtgaaagaacaggagcacgccgcaggccgtgtccttaggagagtcatgctggattctgagactcctagagaagaactgccagcagctgatttttggaaatag

SEQ ID NO: 195339 - DNA, 1143 bp, Artificial Sequence
  Description of Artificial Sequence: Synthetic coding sequence
atggccgccccctggtggcgggccgccctgtgcgagtgccggcggtggcgtgggttttccacctcagcggtcctagggaggcgcacgcctccattgggacctatgccaaactcggatattgacctgtccaacctggagcggctggaaaagtaccgatctttcgatcgctatcgccgccgtgccgagcaggaagcacaagcaccccactggtggcgcacctatcgggagtattttggagagaagaccgaccccaaggagaagattgatatcggcctccctcctcccaaagtgtcgcgcactcagcagctgctggagaggaagcaggcgatccaggaattacgcgccaacgttgaggaagaaagagccgcccgtctcagaaccgcttccgtccctttggacgcagtccgcgccgagtgggaacgaacttgcggcccttatcacaaacagaggttagctgagtattacggactgtacagagatctcttccatggcgccacttttgtccccagggttcctctccacgtcgcgtacgccgtcggcgaggatgacttgatgcctgtatattgtggaaatgaggtgacccctacagaagccgcacaagcccccgaggtgacatatgaggccgaggaagggtcactttggacactgctgctgactagcctggatggccacctgcttgaaccagacgctgagtacctgcactggctgctgacaaatatccccggcaaccgcgtcgctgagggccaggtgacctgcccatacttgcctccctttccagctaggggctccggaattcaccgattggctttcctgctttttaaacaagatcagcccatcgatttcagcgaagacgccaggcccagtccctgttaccaacttgcacagcgtacgtttagaacgttcgacttctataagaaacatcaggaaacaatgactcccgccggcctgtccttttttcagtgccgctgggatgatagtgtcacctacatttttcaccagctgctggacatgagagagccggtgttcgagttcgtgaggcccccgccctatcaccctaaacaaaagaggtttcctcacagacagcccctcagatatctggatcggtatagagattcacacgagccaacctacggaatttattag

SEQ ID NO: 195340 - DNA, 591 bp, Artificial Sequence
  Description of Artificial Sequence: Synthetic coding sequence
atgcccgtgtactgcggcaacgaggtgacccccaccgaggccgcccaagctcctgaagtgacctacgaggccgaggagggttctctctggacactcctgctcactagcttggacggacatttactggaaccagatgccgaatatcttcactggctgctcacaaatatcccgggaaatagagtcgccgaggggcaggtgacgtgtccctacctgccacccttccccgctcgcggtagcgggatccataggcttgcattcctcctgtttaagcaagaccagccaattgacttcagcgaggatgccagaccctctccatgttaccagctcgctcagcgaacgttccggacatttgacttctataagaaacatcaggagactatgactccagcaggactttcattctttcagtgtagatgggatgacagcgtgacctatatctttcaccaacttttggatatgagggagccagtatttgaatttgtcagacccccaccttatcatccgaaacagaagcgttttccacatcggcaacctctccgatatttggacagataccgtgattcacacgaacccacttacggcatctactag

SEQ ID NO: 195341 - DNA, 1062 bp, Artificial Sequence
  Description of Artificial Sequence: Synthetic coding sequence
atggaggccctggccatgggcagccgggccctgcggctgtggctggtggctcctgggggcggtatcaagtggcggttcatcgcgactagcagtgcttctcagctgagcccaacagagcttacagagatgagaaacgacctgtttaacaaggaaaaggcacgacagctctcacttacacctaggactgaaaagatcgaggttaaacacgtgggaaagactgaccctggtacggtgtttgtgatgaacaaaaacattagtacaccatatagttgtgcaatgcatctctctgagtggtactgccggaaatcaatccttgctctggtggatggtcagccttgggacatgtataaaccactgaccaagagctgtgagatcaaatttttgacatttaaggactgtgaccctggtgaagtcaataaggcctactggcggtcctgcgcaatgatgatgggatgcgtcattgagagggcttttaaagacgagtatatggtaaatctggttagggcacctgaagtgccagtgattagcggagcgttttgctatgatgtagtgctggactctaagcttgacgaatggatgcccaccaaagagaacctcagaagcttcactaaggacgcccatgcgctaatctacaaggacctgccatttgagacgctggaagtagaagccaaagttgcccttgaaatattccagcactctaaatataaagttgatttcattgaggaaaaagcaagtcagaatcctgagagaatcgtgaagctgcatcggataggggacttcattgacgtcagcgaggggccgctcatccctcgtacctcaatatgcttccagtatgaggtcagcgctgttcacaacctccagcctacccagccttccctgatccggaggttccagggagtatcactccccgtgcatctcagggcccactttaccatatgggacaaactactggagcggagtcgcaaaatgacacccttccccatcctgctgctctttaccactcaatccttcttcaccactagtccggaatcctacttgctccacggcaccgtgtccgaatag

SEQ ID NO: 195342 - DNA, 1017 bp, Artificial Sequence
  Description of Artificial Sequence: Synthetic coding sequence
atggaggccctggccatgggcagccgggccctgcggctgtggctggtggccccaggaggcgggatcaagtggaggtttatagcaacatctagcgcgagtcaactgagtccaaccgagctcactgaaatgagaaatgacctctttaataaagaaaaagccaggcagttaagcctgacgccgcggaccgaaaagatagaggtcaagcatgtcggcaaaacagatcccggaactgtgtttgtcatgaacaagaacatctcgacaccatactcttgcgctatgcatttatctgagtggtattgcagaaaaagtatcctagcattggtggacggacagccatgggacatgtataagcctttgaccaaatcttgcgaaattaagtttctaaccttcaaagactgtgatccgggagaggtgaacaaggcgtactggcggagctgcgccatgatgatgggatgcgtaatcgagcgagcatttaaggatgaatacatggtaaatcttgttagagcaccagaagtgcccgttatatctggcgccttttgctatgacgtcgtcctcgactctaaattggacgaatggatgccaacaaaggagaacttacgttccttcaccaaggacgctcatgcgctgatttataaagacctgccattcgagacccttgaagtggaagcgaaagttgctcttgaaatctttcagcactcaaagtataaggtcgacttcatcgaggaaaaggcctcacagaatccagagaggatcgtaaagctccacagaataggagatttcattgatgtctccgagggtccactcattccgcgaacctctatctgcttccagtacgaagtgtccgcagtgcataacctgcagcccacgcaaccatccctgatcaggcggtttcagggggttagcctgcctgtgcacctgcgtgcacactttaccatttgggataagctgctcgagcgttcccggaaaatggtgactgaagaccagagcaaggcaactgaggaatgtacctccacttag

SEQ ID NO: 195343 - DNA, 936 bp, Artificial Sequence
  Description of Artificial Sequence: Synthetic coding sequence
atgctgcagttcgtgcgggccggcgcccgggcctggctgcggcccacaggctcccaaggactgagctcactggccgaggaggccgcgagagcaactgagaatcctgagcaggtagcttctgagggattgccagagccagtacttcgtaaggtcgaattgccagtgccgacacatcggaggccagttcaggcctgggtggagtctctcagaggttttgagcaagaacgggtgggattagccgacttgcacccggacgtgttcgctactgctccccgcctcgacatccttcatcaggtcgctatgtggcaaaaaaattttaaaagaatctcgtacgccaagaccaagacccgcgccgaggtgagggggggcggcagaaaaccgtggcctcaaaagggtacgggccgagcccgccatggaagcatccgaagcccactgtggcgtgggggtggcgtggctcacggccctagagggcctacatcttactactacatgctccctatgaaggtccgggccttggggcttaaagtcgcccttactgttaaactcgcccaggacgacctccacattatggattctctggaactgccgaccggcgacccgcagtacctcactgagctggcacattatcggagatggggagacagcgtattactagtagacctgacccacgaggagatgccccagagtatcgtggaagccacctcccgcctgaagacttttaacctgattcccgccgtggggttgaacgtccacagtatgctgaagcatcaaacgcttgtgcttaccttgcctacagtggccttcctcgaggataagctcctgtggcaggattcacgctatcggccactgtatccattcagcttgccatactccgacttcccacgccctctgcctcatgcaactcaggggcctgccgcaacaccataccattgctag

SEQ ID NO: 195344 - DNA, 936 bp, Artificial Sequence
  Description of Artificial Sequence: Synthetic coding sequence
atgctgcagttcgtgcgggccggcgcccgggcctggctgcggcccacggggagccaaggcctaagcagcctcgccgaggaggccgccagagctacagagaacccagagcaagtcgcctccgagggccttccagaaccagtgctcagaaaggtggagttgcccgtgcctacccacaggcgccccgtgcaggcctgggtggaaagcctcagggggttcgagcaggagcgcgtgggcttggcagatttacatccggacgtgtttgcgacggctccacgactggacatactgcaccaagttgccatgtggcagaaaaacttcaaacgcatctcctatgcaaagaccaagactagagctgaggtgcggggagggggtcgcaagccctggccccagaagggcaccggacgggcccgacatgggtccatccggtcccctctgtggaggggtggaggagtcgcccatggcccgagaggaccgacgagttattactatatgcttccaatgaaggttagggccctcggcttgaaagtcgccctgacagtgaagcttgctcaagacgatctccacataatggatagcctcgaactgccgaccggcgacccgcagtacctaaccgagttggctcactacagaagatggggcgactctgttctcctggttgacttgacacacgaggaaatgccacagagcatcgtagaggctacaagcagacttaaaacgtttaatctcattccagcagtggggttaaacgtgcactccatgctcaagcaccaaacgcttgtgctgaccttgccaaccgtcgcatttctggaggataagctcctttggcaggatagccgctataggccactttatccctttagcctgccatattctgatttcccgcgccctctcccacacgccacacaaggcccagcagctacaccctatcactgctag

SEQ ID NO: 195345 - DNA, 792 bp, Artificial Sequence
  Description of Artificial Sequence: Synthetic coding sequence
atgctgcagttcgtgcgggccggcgcccgggcctggctgcggcccaccggcagccagggccttagcagcctagcggaggaggccgcccgagcgacagagaaccccgaacaggtggcgagtgaggggctgccagaaccagtcctcaggaaagtcgagctgcccgtccccacccataggcggcctgtccaagcttgggttgaaagcttgcgcggatttgaacaagagagggttggattggccgacctccatccagatgtgttcgccacagccccgaggctggacatcctgcaccaggtcgctatgtggcaaaaaaacttcaaaagaatctcatatgcgaaaaccaaaacccgcgcggaagtcagggggggtggtagaaaaccctggccacagaagggcaccggaagggctcggcacggaagtattcggagtcccctctggcgcggaggcggcgtggcacacggcccacgcggacctacatcctattattatatgctgcctatgaaggtgagagctctggggctcaaagtggcccttactgtgaaactggcccaggacgatctacatataatggattctctcgaacttcccacgggcgatccccagtacctgaccgaactggcacactaccgcaggtggggagattcagtgttgttagtggatcttactcacgaggagatgccacagagcatcgttgaggccacctcccgcctcaaaacttttaatctgatccccgcagtgggggagcagagagcccaagcacccagggtgcgcatgtgcaggctgcggtgttag

SEQ ID NO: 195346 - DNA, 792 bp, Artificial Sequence
  Description of Artificial Sequence: Synthetic coding sequence
atgctgcagttcgtgcgggccggcgcccgggcctggctgcggcccacggggtcacagggtctatctagcctggctgaagaggccgctagagctaccgagaatcccgaacaggtcgcttctgaggggctgccagaaccggtgctacgcaaagtggaactccccgtccccacacacaggagaccagtgcaggcttgggtcgagtcactcagaggattcgagcaggagagggttgggctggccgacctccatccagatgtgtttgccaccgcacccaggctagacatccttcaccaggttgccatgtggcaaaaaaacttcaaaaggatatcttacgccaagactaagacccgggcagaagtgagaggggggggaaggaagccttggccacagaaagggactgggcgggcccgccacggctcaatccggtccccactttggcgcggagggggcgtagcccacggcccccgtggcccaacctcttattattacatgctgcccatgaaagtgcgcgcattgggactcaaggtggccttgaccgtgaagctagcacaagacgatctgcatattatggacagcctggaactgccaacaggggacccgcagtatctgaccgagctcgcccattacagaaggtggggcgatagcgtccttctagttgacttgacacacgaggagatgcctcagtcgatcgtggaagctaccagtagactaaagaccttcaacctgatccccgctgttggggagcaacgggcccaggccccacgcgtccgtatgtgtaggctgcgctgctag

SEQ ID NO: 195347 - DNA, 414 bp, Artificial Sequence
  Description of Artificial Sequence: Synthetic coding sequence
atgggcgtgctggccgccgccgcccggtgcctggtgcggggcgccgacaggatgtctaagtggaccagtaaacgtggtcctcgtagtttcagggggagaaagggccggggggctaagggaattggattcctgacaagtggctggcgatttgtccagattaaggagatggtccctgaattcgtcgtgccagaccttaccggtttcaagctcaaaccctacgtgtcttatctggcccccgagagtgaagagacaccgttaaccgccgctcagctgttttctgaggcggttgctcctgctattgagaaggattttaaggacggcacatttgatcccgacaacttggagaagtacgggttcgagcctacgcaggaggggaaactgttccagctttacccgagaaatttcctgcgttag

SEQ ID NO: 195348 - DNA, 429 bp, Artificial Sequence
  Description of Artificial Sequence: Synthetic coding sequence
atgggcgacgtgaaggagaactacctggagaccttcatcagcagccctaaattcggaaggacctgcgctgacggcgccctctactgtgtgtgtcacaagagcacctactctccactgcccgacgactataattgcaacgttgagctggcgctaacatcagacgggaggactatcgtgtgctaccacccttccgtagatattccctatgaacacaccaaacccattccacggccagatccggtgcacaataacgaggaaacccatgaccaggtgcttaagacgaggcttgaggagaaagtggagcatctggaggagggcccaatgattgaacaactatcaaaaatgttcttcaccaccaagcaccgctggtacccccatggccgctaccaccgttgtagaaagaatctgaacccacccaaagatcgttag

SEQ ID NO: 195349 - DNA, 429 bp, Artificial Sequence
  Description of Artificial Sequence: Synthetic coding sequence
atggccgtggccgccgtgaagtgggtgatgagcaagcggaccatcctgaagcatctgttcccggtgcagaacggagccctttattgcgtctgccacaagtctacctacagcccattgcccgatgattataactgcaacgtggaacttgcactgactagtgacggacggacaatcgtttgttaccacccatctgtcgacatcccttacgagcacacaaaaccaattcccaggccagatccggtccataataatgaagagactcacgatcaagttttgaaaacccggctggaggagaaggtcgagcacctggaagaagggccaatgatagagcagctgtccaagatgttctttacaaccaaacacaggtggtatcctcatggccggtaccacagatgcagaaagaatcttaatccacctaaggataggtag

SEQ ID NO: 195350 - DNA, 429 bp, Artificial Sequence
  Description of Artificial Sequence: Synthetic coding sequence
atggccgtggccgccgtgaagtgggtgatgagcaagcggaccatcctgaagcatttgttcccagtgcagaatggagcgctgtactgcgtgtgtcataaaagtacttactcccctctgccagatgactacaactgtaacgtagaactggccctaacatcagatggtagaacaattgtctgttaccacccttcagtagacataccttatgagcatactaagccgattccccgacccgaccctgttcacaataatgaggaaacccacgaccaagtgttgaagacgagattagaggagaaggtggagcaccttgaagaaggccccatgattgagcagttatcaaaaatgtttttcaccacgaaacatagatggtatccccatggacggtaccacagatgtaggaagaatcttaatccaccaaaagatcgatag

SEQ ID NO: 195351 - DNA, 429 bp, Artificial Sequence
  Description of Artificial Sequence: Synthetic coding sequence
atggccgtggccgccgtgaagtgggtgatgagcaagcggaccatcctgaagcatctgtttcctgtccagaatggagcactttactgcgtgtgtcataaatccacatattcacccctcccagatgactacaactgcaatgtggaactagcccttacctccgatggtcgaaccattgtatgctatcatccaagcgttgatatcccatacgagcacaccaagcctatcccgaggccggatcctgtgcacaacaatgaggaaacccatgaccaggtgttgaaaacacggttggaggagaaggtcgagcatttggaggaggggcccatgatagaacaacttagtaagatgttttttaccactaagcacagatggtacccgcacgggaggtatcataggtgccgcaagaaccttaatcctccaaaggatcgttag

SEQ ID NO: 195352 - DNA, 609 bp, Artificial Sequence
  Description of Artificial Sequence: Synthetic coding sequence
atgaccgcccggggcacccccagccggttcctggccagcgtgctgcataatggactcggacggtacgtgcagcagctacagaggctgtccttctccgtgagtagggatggagcctcaagtaggggggccagggagttcgtggagcgcgaggtgatagattttgcacgccggaaccctggcgtcgtgatctacgtgaatagccgcccttgttgtgtccccagggttgtcgctgaatacctgaatggggctgtgcgggaggaaagcatccactgtaagtccgttgaagaaatttcaaccctggtccagaagctggcggatcagagtggactggatgtgattcgtatccggaagcctttccataccgacaacccctcaattcagggtcagtggcacccatttaccaacaagcctactaccttcaggggactcaggccccgagaagtacaggaccccgcgcccgcgcaggataccgggctgagactgagcgcggtggctcctcagatattgctccccgggtggccggaccctatttccgtgcaaagctccgatctcccttgggggaacactcactaccgccctgagcccttgagctcaaccacctggctgtag

SEQ ID NO: 195353 - DNA, 648 bp, Artificial Sequence
  Description of Artificial Sequence: Synthetic coding sequence
atgaccgcccggggcacccccagccggttcctggccagcgtgctgcacaatgggctcggaagatatgtacagcagctccagagactgagctttagcgtctctagagatggcgcttcgtctaggggcgcacgtgaatttgtggaacgagaggtgatagacttcgccaggcggaatcctggagtggtcatatatgtgaatagtaggccttgctgcgtgccccgagtcgtggctgagtacctcaatggtgccgtccgagaggaaagcattcattgcaaaagtgtggaggagatctctactcttgttcaaaagctggctgatcaatcgggccttgacgtcatcaggattagaaaaccctttcataccgataatcccagcatacagggccagtggcatcctttcaccaacaagcctaccacctttcgcggcctacgtccacgagaagtgcaggaccccgctcccgcacaagacaccggactgaggttatccgcagtagcgccccagatactgctgccggggtggccagacccaccggacctgcccactgttgaccctatctctagctccctcacttccgctcccgcaccaatgctgagcgcagtcagttgcctgccaattgtccccgctctgactacagtctgctctgcctag

SEQ ID NO: 195354 - DNA, 480 bp, Artificial Sequence
  Description of Artificial Sequence: Synthetic coding sequence
atgaccgcccggggcacccccagccggttcctggccagcgtgctgcacaatggactggggagatatgttcagcagctgcaacggctcagtttctcggtgtcaagagacggcgctagttcgcgcggtgctcgtgagttcgtcgagcgggaagttatagatttcgcacgtcgcaacccaggcgtcgtcatttacgttaacagtcgcccttgctgcgtgccaagggtggtcgccgagtacctgaatggcgccgtcagagaagagagtattcattgcaaatcagttgaggaaattagcactttagtccagaaattagccgaccagtctggtctggacgtgattaggatcaggaaaccattccatacggataacccgtcgattcaaggacagtggcacccttttaccaacaagcctaccacattccggggtttacgcccacgcgaggtacaagaccccgcccccgcacaggtgcaagcgcaatag

SEQ ID NO: 195355 - DNA, 708 bp, Artificial Sequence
  Description of Artificial Sequence: Synthetic coding sequence
atgaccgcccggggcacccccagccggttcctggccagcgtgctgcacaatggattgggaagatatgttcaacagctccaaaggttgtccttctcagtgagcagagacggagcctcatcccgaggtgcccgtgaattcgtcgaaagggaggtgatagactttgcacgtagaaatcccggggtcgtcatttatgtgaatagtcggccctgttgtgtccctcgtgtcgtggcagagtacctgaatggggctgttcgagaggaaagcatccactgtaaatctgtggaagaaatatctaccctggttcagaaattggccgatcaatccggtctggacgttattagaattcgcaagcctttccatacagataacccttccatccagggtcagtggcacccattcaccaacaagccaaccacattccggggcctcaggccaagagaggtgcaagatcctgctcctgcgcaggacgctgctgaatttctgggcgagggggccggcccctgttggtacagtatcgtggctctgccacaaaagcacattgcgatcgccattcatcccccgcagcccgctggacagtgccaccaggccattggccactggcctgagactgtgtgttcttgcactgccgacccgcctgctagactcgccaggcctaacatatctagcgtgataagatctagtcttggcaagtaccccctgcctagctag

SEQ ID NO: 195356 - DNA, 495 bp, Artificial Sequence
  Description of Artificial Sequence: Synthetic coding sequence
atgaccgcccggggcacccccagccggttcctggccagcgtgctgcacaatggcctgggaaggtatgtgcagcagctacagagactctctttctccgtcagccgtgacggagcttcttccagaggcgcgcgcgagttcgttgagcgggaagtcatcgatttcgctagacgcaaccccggggtggtgatttatgttaattccagaccatgttgcgttccccgggtggtagccgagtacctcaatggcgctgtgcgtgaagaatccatccattgtaaaagcgtggaggagatctcgacactggtccagaagctggctgaccagagtgggcttgacgtcattagaatccgcaagccttttcacacagacaaccccagtatccagggacagtggcatccattcactaataagccaacaacctttaggggtcttcgcccccgagaggtccaggaccccgcacccgctcagtgcttgctcttaggggcagtgactttgtag

SEQ ID NO: 195357 - DNA, 480 bp, Artificial Sequence
  Description of Artificial Sequence: Synthetic coding sequence
atgaccgcccggggcacccccagccggttcctggccagcgtgctgcacaatggattgggtaggtacgttcagcagttgcagcggctcagtttctctgtttctcgtgacggcgcgtcaagcagaggcgcgcgcgagtttgtggagcgagaagttatcgactttgccaggcggaacccaggggtggtgatctacgtgaacagccggccatgctgcgttcctcgcgtggttgctgagtacctgaacggggccgttagagaggaatcgattcattgcaagagcgtcgaggaaatctccacactcgtgcagaaactggccgaccagagtggcttggacgtgattaggatccgtaagccttttcacaccgacaacccctcaattcaggggcagtggcacccctttaccaataaaccaacaacttttagaggccttagaccacgggaggttcaggatccagctcccgctcaggtgcaggctcagtag

SEQ ID NO: 195358 - DNA, 555 bp, Artificial Sequence
  Description of Artificial Sequence: Synthetic coding sequence
atgaccgcccggggcacccccagccggttcctggccagcgtgctgcataatggcctgggacggtatgtgcagcagctgcagcggctgagtttcagcgtgagccgggatggtgcttcaagcaggggcgctcgggagttcgtagaaagagaagtgatcgattttgcgcgccgaaatccaggcgtggtgatttatgtgaacagccgaccttgttgtgtcccaagggtggtggctgaatacctgaatggagctgtgcgtgaagagtcgatacactgcaagtccgtggaagagatttcgaccctggtgcagaaactggccgatcagtctggtctcgacgtcatcagaattcgaaaaccgttccacacagataatccaagcattcaggggcagtggcatccatttactaacaaacccaccacttttcgcgggctcagacccagagaggtgcaggaccccgcaccagcacaagacacaggcctacgcctgagtgcagtggctccccaaattctgctgcccggttggcccgacccgactagggcgacccgggctactcgttag

SEQ ID NO: 195359 - DNA, 786 bp, Artificial Sequence
  Description of Artificial Sequence: Synthetic coding sequence
atgaccgcccggggcacccccagccggttcctggccagcgtgctgcacaacgggcttggacgctatgtacagcagctgcaaaggctgtctttctccgtgagccgagacggagcctcttctagaggggctagagaattcgtcgagcgagaagtcattgattttgcgaggcggaatccaggggttgtgatttatgttaacagccggccgtgctgtgttccccgggtagtcgctgaatatctgaatggcgctgtgcgcgaggagtccatccactgcaagtccgtcgaagagatctccacactggtccagaagctcgctgaccaaagcggactcgacgtgattaggattcgcaaaccgttccacactgacaatccatcaatccaaggacagtggcaccccttcaccaacaagcctacgacattccggggactcaggcccagagaagtccaggaccctgcccctgcccaagacgcagccgaatttctaggagaaggcgccggcccttgctggtatagtattgtggcgctcccccagaaacacattgccatcgccattcaccctccacagcccgcagggcaatgccaccaggctattggacattggccggagaccgtttgttcctgtactgctgatccccccgccagactagcaaggccaacccggcctccccattctggatcatacttgatactgatcgacctgtgtagttcaccctacgccgtgcggagttttttacctcccgattgcccgtgtaccgatcattgcgtactgagtgtgaaagccgcatag

SEQ ID NO: 195360 - DNA, 510 bp, Artificial Sequence
  Description of Artificial Sequence: Synthetic coding sequence
tgaggcacccccagccggttcctggccagcgtgctgcacaacggcttgggacggtatgtccagcaactgcaaagactgagcttttcagtgtcccgcgacggcgccagtagtcggggcgccagagagttcgtcgagcgtgaggtgattgattttgcgagacgtaaccccggggttgtcatctacgtgaacagcaggccatgttgtgtacccagggtggtggctgagtatcttaatggcgcagtgagagaggaatctatccattgtaagtccgtcgaggagatttccacactggtgcagaaattagccgatcagagtggtcttgacgtgatcagaatccggaagccgtttcataccgacaatccctctattcaagggcagtggcaccccttcacaaataaaccaactacctttagagggctgagaccacgtgaggtccaggaccccgctcccgcccaggatgccgccgagtttctgggggagggggccggcccgtgctggactctggcatag

SEQ ID NO: 195361 - DNA, 999 bp, Artificial Sequence
  Description of Artificial Sequence: Synthetic coding sequence
atggccagcggcctggtgcggctgctgcagcagggccaccggtgcctcctcgcaccagtggccccaaaacttgtaccacccgtgagaggcgtgaaaaagggattcagagcggcatttcggttccaaaaagaactggagcgacagcgtctgctacggtgccctcctccaccagtcagaagatcagaaaaaccaaattgggattatcacgcagagatccaagcatttgggcacaggttgcaagaaaacttcagcctcgacctacttaaaacggcctttgtcaattcatgttacatcaagtccgaagaagctaaaaggcagcaattaggcattgagaaagaagctgttctcctgaacttgaaatcgaaccaggaactcagcgaacaaggcaccagtttttcgcagacttgtctcacccaattcttagaggacgaataccccgacatgccaaccgagggaattaaaaatctggtagattttctgactggggaagaagtggtgtgtcatgtggctcgcaacctggctgtagaacaacttaccctgtccgaggaattcccagtgccccctgctgtgttgcagcagacgttttttgccgtaatcggagctctgttacagtcctccggaccagaacgtaccgcgctgtttattagggacttcctcattactcagatgaccgggaaggaactgtttgagatgtggaagataatcaatcccatgggtctccttgttgaggaacttaagaaaagaaatgttagtgctcccgagagtcggctcactcgccagagtggaggcacaaccgcgctgcctctctacttcgtcgggctttactgtgacaagaaactgatagccgagggacctggagagactgtccttgttgccgaggaagaagccgctcgtgttgccttgcgcaaactctacggcttcacagaaaacagaaggccttggaattattctaagcccaaagaaaccctgcgagcggaaaaatctatcaccgcatcgtag

SEQ ID NO: 195362 - DNA, 921 bp, Artificial Sequence
  Description of Artificial Sequence: Synthetic coding sequence
atggccgcccccatcccccagggcttcagctgcctgagccggttccttggatggtggttcaggcagccggtgttggtgacacaatcagctgccatcgtccctgtgaggacaaagaaacgatttacccccccgatataccagccgaaatttaagactgaaaaagagtttatgcaacacgcacgaaaggctgggctcgtcattcctccagagaagagcgatcgatcaatccacctggcatgtacggcaggcatttttgatgcctatgtgccccccgaaggcgatgcgaggatcagttccctgtccaaggaaggactgattgagagaacagaacgcatgaagaagactatggccagccaagtgtcaatcagacggattaaagattacgacgcaaatttcaaaatcaaagacttcccagagaaagcgaaggatatttttatagaagcccacttgtgcctgaacaacagcgaccacgacaggcttcacacactagttactgagcactgtttccccgatatgacatgggatatcaagtataaaaccgttagatggagcttcgtggaatcacttgaaccaagtcacgttgttcaggttagatgttccagcatgatgaatcaaggcaacgtttatggacagattaccgtgcggatgcatacacggcaaacactggccatttatgatagattcggccggctgatgtacggccaagaagatgtgccaaaggacgtgctcgagtatgtggtgtttgaaaagcaactgacaaacccctacggctcctggagaatgcataccaaaatcgtgccaccctgggctccacctaagcagccgatcttgaagactgtcatgattccggggccccagctgaagcccgaggaggagtacgaggaggcccaaggcgaggctcagaaaccacagctagcctag

SEQ ID NO: 195363 - DNA, 693 bp, Artificial Sequence
  Description of Artificial Sequence: Synthetic coding sequence
atggccgccgccggcctggccctgctgtgccggcgggtgagcagcgccctgaaatcaagcaggagtcttattacccctcaagtcccagcttgcacaggacttctgcacactacgctgagtagaaaaggcctcgaagagttctttgacgatcccaagaattggggtcaagagaaagtaaagagtggcgccgcctggacgtgtcagcagttgagaaacaagagtaacgaagacttacacaagctttggtatgtgctcctcaaggaacggaacatgctgttgaccttggaacaggaggccaaaaggcagcgactgccaatgccttcaccagagagactggataaagtggtcgattccatggacgcactcgataaggtggtccaggaacgtgaagacgcccttcggctactgcaaacaggacaggaaagggcccgccccggcgcttggcgccgggatatttttggaagaattatctggcacaagttcaaacagtgggttattccatggcatttgaacaaacggtataatagaaaaaggttctttgccctgccttacgtggaccacttcttacgacttgaacgcgagaaaagagccaggataaaggcaagaaaggaaaatcttgagcgcaagaaagctaagattcttctgaaaaaattcccccatctggccgaggctcagaagtcctctttagtttag

SEQ ID NO: 195364 - DNA, 423 bp, Artificial Sequence
  Description of Artificial Sequence: Synthetic coding sequence
atgctgctgaccctggagcaggaggccaagcggcagcggctgcccatgccttcccctgagagattagacaaagtggtggactctatggacgcgctggataaggtcgttcaggaacgcgaggacgctttacggttattacagaccgggcaagagcgcgccagaccaggcgcgtggcggcgcgatatttttgggagaatcatttggcacaaatttaaacagtgggtgataccttggcacctgaataagagatataacagaaagcggttctttgctctgccatatgtggatcactttctgcgcctggaaagagagaagcgcgcccgcattaaggctcgcaaggaaaatctggaacggaaaaaggctaagatcctgttaaaaaagttccctcacctcgctgaggcccagaaaagttccctggtctag

SEQ ID NO: 195365 - DNA, 753 bp, Artificial Sequence
  Description of Artificial Sequence: Synthetic coding sequence
atggccgccgccggcctggccctgctgtgccggcgggtgagcagcgctctgaaaagtagtagatcactcatcacgccacaggtgccagcctgcacagggttctttctgtctttactgcctaagtccaccccaaacgtcacctcatttcaccagtatcgcctattgcacactactctgagccgtaaggggctggaagaattttttgatgatccaaagaactgggggcaggaaaaggtgaagtcgggcgctgcctggacctgtcaacagctgagaaataagagcaatgaggatcttcataagctctggtacgtgttgctcaaagagcgcaatatgttactgaccctggagcaggaggccaagcggcaacgactccccatgccttcacccgaaaggctagataaagtggtcgatagtatggatgccctggacaaggtggttcaagagagggaggatgccttgagactgcttcagaccggtcaggaacgggccaggcctggggcctggcgccgcgacatctttggacgaatcatttggcacaaatttaaacagtgggttattccttggcatctgaataaacgctacaatcgaaagcggttctttgctctgccctacgtcgaccattttttgaggctggaacgcgagaagagggctcggatcaaggctaggaaggagaaccttgagcggaagaaggcaaagattctcctgaagaaatttccgcacctggctgaggcacagaaaagtagtctagtttag

SEQ ID NO: 195366 - DNA, 639 bp, Artificial Sequence
  Description of Artificial Sequence: Synthetic coding sequence
atgagcggcaccctggagaaggtgctgtgcctgcggaacaacaccattttcaaacaggctttttctctgttaagattcagaacctccggtgaaaaacctatctacagcgtgggaggcatcttactgtccatatccagaccatacaagacaaaaccgacccatgggatcgggaagtataagcacctgatcaaggcagaggaaccgaaaaaaaagaagggcaaggttgaggtccgagcaattaacttaggaacagactacgagtatggtgtgctgaacatccacttaacagcatatgacatgactctcgctgagtcgtacgcacagtacgttcacaatctctgcaattcactctccatcaaagttgaggagtcctacgctatgccaactaagactattgaagtcctacagctgcaggaccagggcagtaagatgctcttggatagcgtattgacaacgcacgagcgcgtggttcagatttccggcttgtccgccaccttcgctgaaatttttctggaaatcatacagtcatcgctgcccgagggtgtccgactttccgtaaaggaacacaccgaggaggacttcaaagggcgctttaaggcccgccccgagcttgaggagctactggctaagctgaagtag

SEQ ID NO: 195367 - DNA, 585 bp, Artificial Sequence
  Description of Artificial Sequence: Synthetic coding sequence
atgggcctgagcagctgccggaagaccagcagcggcctgcccctgattttgcattatggcgggatcctattgtccatctctagaccttataaaacaaagccaactcatgggataggcaaatataagcatctaatcaaggctgaggaacccaagaaaaaaaagggcaaggttgaggtgcgggctatcaatcttggaactgattatgagtatggtgtactgaacatacaccttaccgcatatgacatgacgcttgcggaatcctacgctcagtacgtgcacaacctgtgcaacagcctctcgattaaagtggaggagtcctatgctatgcctacaaagactattgaggttctgcagctgcaagatcaggggtccaagatgctcctcgactcagtgctgacaacacatgaacgtgttgtgcaaatctccggcctgagcgccacattcgcggaaatttttttggaaatcatacagtccagcctacccgagggcgtccgtctctccgttaaagagcacacagaggaggacttcaagggtaggttcaaagcacgcccagagctagaggagttgctcgcaaaactcaaatag

SEQ ID NO: 195368 - DNA, 501 bp, Artificial Sequence
  Description of Artificial Sequence: Synthetic coding sequence
atggccgccaccatgttccgggccaccctgcggggctggcggaccggtgttcagagagggtgcggtctccgcttattgagtcaaacacagggacccccagattacccccggtttgtggaaagtgttgatgagtatcagtttgtggaaagattgctccccgcaactcgcattccggaccccccaaagcatgaacactatcccaccccttccggatggcagccccctagggacccacctcctaatttgccttatttcgtacgccgaagccggatgcacaatatcccagtctataaggatattactcacgggaaccgccagatgactgtgatacgcaaagtagaaggagatatctgggccctgcagaaagatgtggaagatttcctaagtccactgttggggaagactcccgtgacgcaggtcaacgaggtgacgggaacacttcggattaaggggtatttcgaccaggagctgaaagcatggctcctagaaaaaggcttctag

SEQ ID NO: 195369 - DNA, 501 bp, Artificial Sequence
  Description of Artificial Sequence: Synthetic coding sequence
atggccgccaccatgttccgggccaccctgcggggctggcggaccggcgtacagcggggctgtgggcttagactgctatcccagacacagggccctccagactacccccgcttcgtggagagtgtcgatgagtaccagttcgtcgagcggttactgcctgccacaagaattccagacccccccaaacacgagcattatccgacaccctctggatggcagcctcccagggatccaccgcccaacctcccttacttcgtgcggaggagccgcatgcacaacattcctgtttacaaggatattacacacggcaatcgtcagatgacagtcatccgtaaggttgagggggacatttgggctctccaaaaggacgtggaggactttctaagccctctgctcgggaagacacctgtgacacaggtcaatgaagtaactggcacgttaagaattaaaggctatttcgatcaagaactaaaagcatggctactggagaagggcttctag

SEQ ID NO: 195370 - DNA, 477 bp, Artificial Sequence
  Description of Artificial Sequence: Synthetic coding sequence
atggccgcccggagcgtgagcggcatcacccggcgggtgttcatgtggaccgtttcagggacaccctgtcgcgagttttggtcacgatttcgaaaggagaaggaacccgttgtcgttgagacagtggaggaaaaaaaagaacccatcctagtgtgccctccactgcgaagtcgcgcctataccccgcctgaggacttgcagtcccgtttggagtcatatgtaaaagaggtttttgggtcctccttgccttccaactggcaagacattagcctagaggactctaggttgaagtttaacctgctggctcacctcgcggatgacctcggtcatgtggtaccaaactcgcgtctgcatcaaatgtgtcgtgtcagggacgtgctcgatttttataatgttcccattcaggatagatccaagttcgacgaactgtcagcctccaacttgccacctaacctcaagatcacttggtcatattag

SEQ ID NO: 195371 - DNA, 408 bp, Artificial Sequence
  Description of Artificial Sequence: Synthetic coding sequence
atggccgcccggagcgtgagcggcatcacccggcgggtgttcatgtggaccgtgagcggtaccccttgtcgcgaattttggtcaagatttcggaaggagaaggaacccgtcgtggtcgagaccgtggaggagaagaaggagcccatactggtttgccctccactccgatcaagagcctatactccaccagaagacctgcaaagccgactggaaagctatgttaaggaggtgttcgggagttccctacctagtaattggcaagatatttccttagaagacagtagactaaaattcaaccttctagctcacctggcagacgatttaggccatgtggtgccaaacagtagattgcatcagatgtgcagaggatatagctttgaggaaggcaagattcaactcggcatctag

SEQ ID NO: 195372 - DNA, 1146 bp, Artificial Sequence
  Description of Artificial Sequence: Synthetic coding sequence
atggccagccccagcctggagcggcccgagaagggcgccggcaagtcagagtttaggaaccagaaacccaaacctgaaaatcaggacgaatcggagctcttgactgtccccgacggatggaaggagccggcttttagtaaggaagataacccccggggccttcttgaggaatcatcgttcgccaccctttttccaaagtacagggaagcatatttaaaggagtgctggcctttagtgcagaaggccctaaacgaacatcacgttaatgcgaccctggacctcatcgaaggctctatgaccgtgtgcacaacaaagaagacttttgacccttatatcatcattcgcgcccgtgacctcatcaaactgctcgccaggtctgtgtcgtttgagcaggcagtccgcatcctgcaggacgacgtagcttgtgacatcataaaaattgggtctttagtccgtaacaaagagcggtttgtgaagcgcagacaaagactgatcgggccaaaaggcagcacactcaaggctctcgagctcctcaccaattgttacattatggtccaagggaacacggtttcagccattgggcccttcagcggactcaaggaagtgaggaaagtcgtcttggacacaatgaagaatattcaccccatttacaatatcaagagcttgatgattaagcgggagctggccaaggactctgaactcaggtcacagtcttgggaaaggttcttacctcagttcaagcacaaaaacgtaaataagaggaaggaacccaagaaaaaaactgtgaaaaaagaatacacacctttcccccccccccagccagaatcgcagattgataaggagctggcgtctggcgagtacttcctgaaggccaatcagaagaaacgccagaagatggaagctataaaggctaagcaagctgaggcaatcagcaaaaggcaagaggagagaaacaaagcgttcattccgcctaaagagaagcctattgtgaagcccaaggaggcctcaaccgagacaaaaattgatgttgccagcataaaagaaaaggtgaagaaggccaagaataaaaagctaggggccctcacagcagaggagattgcccttaagatggaggccgatgagaaaaagaagaagaagaaaaaatag

SEQ ID NO: 195373 - DNA, 372 bp, Artificial Sequence
  Description of Artificial Sequence: Synthetic coding sequence
atggccgccctgggcaccgtgctgttcaccggcgtgcggcggctgcactgctccgtggcagcttgggcaggcgggcaatggaggttgcagcagggtctggccgctaacccgtccggctacggaccactgacagaattacctgattggagttacgccgatggtaggcctgctccaccaatgaagggacagctgcggcgcaaggccgagcgcgaaacttttgccagacgagtcgttctcctatcacaggagatggatgctggcctgcaagcatggcagctaagacagcagaagctccaggaagagcagcgtaaacaggagaacgctctgaaaccaaagggcgccagcctcaagtcaccactgccttctcaatag

SEQ ID NO: 195374 - DNA, 369 bp, Artificial Sequence
  Description of Artificial Sequence: Synthetic coding sequence
atggccgccctgggcaccgtgctgttcagcgtgcggcggctgcactgttcagtggccgcctgggcagggggtcagtggcgattgcagcaggggttggcagcgaacccttcaggatacgggccactcaccgagctccctgattggtcctacgccgacggccggccagcccctcccatgaagggacaattgcgccgtaaggctgagagagaaaccttcgccaggagggtggtgcttttatcccaggagatggacgccggtctacaggcttggcaattgaggcagcagaaactgcaggaagagcagcggaagcaggagaacgcattaaaaccgaagggggcatcacttaagagccccctgcctagtcagtag

SEQ ID NO: 195375 - DNA, 264 bp, Artificial Sequence
  Description of Artificial Sequence: Synthetic coding sequence
atggccgccctgggcaccgtgctgttcaccggcgtgcggcggctgcactgctccgtggctgcctgggcagggggccagtggcgcctacagcaaggcttagccgcaaacccctccggttacggccctctgacagaacttccagactggagttacgccgagacatcctgcactgcagtgaccggaaatggccgctggattacctctatggccgcccaggcagccgaggtcgctggccgcactaaggaagctggtaagtgtagctag

SEQ ID NO: 195376 - DNA, 195 bp, Artificial Sequence
  Description of Artificial Sequence: Synthetic coding sequence
atgaagggccagctgcggcggaaggccgagcgggagaccttcgcccgccgagtagttttacttagtcaggagatggacgccgggctgcaggcttggcagctcagacagcagaaacttcaggaggagcaaagaaaacaagagaacgccctcaagccaaagggggcttcactgaagtcacccctcccctcacaatag

SEQ ID NO: 195377 - DNA, 195 bp, Artificial Sequence
  Description of Artificial Sequence: Synthetic coding sequence
atgaagggccagctgcggcggaaggccgagcgggagaccttcgcccgccgggttgtcctgctgtcccaggagatggacgccgggctgcaggcctggcagttgagacagcaaaaattacaggaggaacagaggaagcaggagaatgctctcaaaccaaagggagccagcctaaagtccccactgcctagccagtag

SEQ ID NO: 195378 - DNA, 195 bp, Artificial Sequence
  Description of Artificial Sequence: Synthetic coding sequence
atgaagggccagctgcggcggaaggccgagcgggagaccttcgccagaagagtggtgttactgagccaggagatggacgcaggactgcaggcctggcaattgaggcagcagaagctccaagaagagcagagaaagcaagaaaatgccctgaaaccaaagggggcaagccttaagtcacctctgcctagccagtag

SEQ ID NO: 195379 - DNA, 339 bp, Artificial Sequence
  Description of Artificial Sequence: Synthetic coding sequence
atggccgccgccctggcccggctgggcctgcggcccgtgaagcaggtccgggtccaattctgcccatttgagaaaaacgttgagtccacccggacgtttctgcaaactgtgtcttcagagaaagtgcgttctaccaacttaaattgcagcgtcattgcggatgtccgacatgatggatctgagccatgtgtcgatgttttattcggcgatggtcacaggctgatcatgcgcggcgcccatcttactgcgctcgaaatgctgaccgccttcgctagccacatacgggctagagacgccgcaggaagcggcgataaaccaggcgcagacacagggcgctag

SEQ ID NO: 195380 - DNA, 417 bp, Artificial Sequence
  Description of Artificial Sequence: Synthetic coding sequence
atggccaccaagcggctgttcggcgccacccggacctgggccggctggggtgcctgggagttgctcaatcctgcgacctccggcaggttgttggccagggattatgctaagaagcctgtgatgaagggggcgaagtccggcaaaggagctgtcacgtcggaagccctcaaagatcccgacgtatgtacagaccctgtacagttgacgacatatgccatgggtgtaaacatctataaggaaggacaggatgttcccctgaagccagacgcagagtacccagagtggctgttcgagatgaatttgggcccccccaagactctggaagagctggaccccgaaagccgtgaatattggcgcaggcttcgcaagcagaatatctggagacacaacagactgagtaagaataagaggctatag

SEQ ID NO: 195381 - DNA, 387 bp, Artificial Sequence
  Description of Artificial Sequence: Synthetic coding sequence
atggccgccgtgggcagcctgctgggccggctgcggcagagcaccgtaaaggccactggccccgcccttaggaggcttcacacctcctcttggcgagcagattcatccagggccagtctgactcgggtgcaccgtcaggcctatgctaggctctatccagtgctcctggtgaagcaggatggttccactattcatataaggtacagagagcccagacgaatgttagcaatgcctattgacctggatactctgtccccggaagaacgccgtgccaggcttaggaagagagaggctcagctccagtctaggaaagagtacgagcaggaactgtcagatgacttgcatgtggagcggtatagacagttttggacccggacaaagaagtag

SEQ ID NO: 195382 - DNA, 387 bp, Artificial Sequence
  Description of Artificial Sequence: Synthetic coding sequence
atggccgccgtgggcagcctgctgggccggctgcggcagagcaccgttaaagccacaggccccgctctgaggagacttcatacctcttcctggcgggccgactccagcagggccagtctgacaagagttcacaggcaggcatacgccagactttatccggtactactcgtaaaacaggacggttcaactatacatatccgttaccgcgaacctaggcggatgctggccatgcccattgacctggacacactctctcccgaggagagacgagcaaggttaaggaaacgggaagcccaacttcaatccaggaaggagtacgaacaagagctatccgacgaccttcacgtcgaaaggtacagacagttttggacacggacaaagaaatag

SEQ ID NO: 195383 - DNA, 387 bp, Artificial Sequence
  Description of Artificial Sequence: Synthetic coding sequence
atggccgccgtgggcagcctgctgggccggctgcggcagagcaccgtgaaggcaacaggcccggccttgcgccgattgcatacctcttcttggcgggcagactccagtagggccagtttgacccgggtgcacaggcaggcttacgccaggctatatccagtgctgttggttaagcaagatggatctacaattcacatccggtacagggaaccccgcaggatgctggcgatgcctatagatcttgacaccctctcgcctgaagaacgccgggcccggctaagaaagagagaggcccaactgcaatccaggaaagagtacgagcaggaactgagcgatgacctgcacgtggaacggtacaggcagttttggacgagaaccaaaaaatag

SEQ ID NO: 195384 - DNA, 387 bp, Artificial Sequence
  Description of Artificial Sequence: Synthetic coding sequence
atggccgccgtgggcagcctgctgggccggctgcggcagagcaccgtcaaagcaactggacctgccctccggaggctgcacacttcttcatggagagccgattcaagtcgtgcctctcttactagagtccacaggcaggcttacgccagactgtaccccgtgctccttgtgaaacaggatggaagcaccatacacatacgctatcgtgaacctagacgcatgctagccatgcctatagatctagataccctgtcaccggaggaaaggagagcacgcctgagaaaacgggaggctcagcttcaatcaagaaaagagtatgagcaggaattgagcgacgatttgcacgtagagagatacagacagttctggacacgcacaaagaaatag

SEQ ID NO: 195385 - DNA, 495 bp, Artificial Sequence
  Description of Artificial Sequence: Synthetic coding sequence
atggccgccgtgggcagcctgctgggcctggccgccagcagctggctcggcgggcagaacgcatcagatcacagtctctggctgctgcgcaagccgcgggggtcctcctgccctgggaccggtcatcagctgtgcaggctgaggcagagcacagtaaaagcaacgggcccagctttaaggagactgcacacaagcagttggagagccgacagctcccgggcctctttgacccgcgtgcatcgtcaagcatacgcccgcctctaccccgtgctgctcgtgaaacaggatgggagcaccatccacattcggtacagggaaccaagacgcatgctcgcaatgcccatcgatctggatacactctcacctgaagagcgccgagcccgactcaggaagagagaggctcagctgcagagtagaaaggagtacgaacaggaactgtcagatgaccttcacgtggaaagataccggcagttctggacgagaaccaagaaatag

SEQ ID NO: 195386 - DNA, 378 bp, Artificial Sequence
  Description of Artificial Sequence: Synthetic coding sequence
atggccgccgtgggcagcctgctgggccagagcaccgtgaaggccacagggcccgctctaagaaggctacacacgagttcctggcgcgctgactcctcaagagctagtctgacacgcgtacaccgccaagcatatgctcggctgtatcccgtcctgctggtaaaacaggacggatcaacgatccacataaggtatagggagccccgacgcatgctggccatgcctatcgatctggacaccctctctccagaagaacgccgcgccaggctgcgtaagcgggaggcacagttgcagagccggaaggagtatgagcaagagctgtctgacgacctgcatgttgagagatatcggcaattctggacaagaaccaagaagtag

SEQ ID NO: 195387 - DNA, 387 bp, Artificial Sequence
  Description of Artificial Sequence: Synthetic coding sequence
atggccgccgtgggcagcctgctgggccggctgcggcagagcaccgtcaaagctactggccctgcattgagacggttgcataccagctcatggagagctgatagctcccgggcctcgctcacacgggtccaccggcaggcgtatgcccggctgtaccccgttttgctggtgaagcaagacggcagcaccatacatataaggtaccgcgagccacgaaggatgcttgccatgcctatcgatctggatactttgagccccgaggaacggcgagcccggctcaggaagagagaagcccagctgcaatcccgcaaagagtatgagcaagagctctccgacgacctacatgtcgaaagataccgacagttctggacccgtactaagaagtag

SEQ ID NO: 195388 - DNA, 387 bp, Artificial Sequence
  Description of Artificial Sequence: Synthetic coding sequence
atggccgccgtgggcagcctgctgggccggctgcggcagagcaccgtcaaggcgaccggaccagccctccgccggttgcacacttcttcctggcgcgccgacagcagtagggcttcactaaccagagtgcacaggcaggcttacgcaagactgtatcctgtcctactggtgaaacaggacggttcaactatccatataagatatagggaacctagacgcatgctggccatgccaatcgatctggacacgctgagccctgaagagcgacgagccagattacgaaagagagaagcccagctgcaaagccgaaaagagtatgaacaggagctttcagatgatctccatgtggagaggtacaggcagttctggaccaggacaaagaagtag

SEQ ID NO: 195389 - DNA, 387 bp, Artificial Sequence
  Description of Artificial Sequence: Synthetic coding sequence
atggccgccgtgggcagcctgctgggccggctgcggcagagcaccgtgaaggccacgggacccgctttaaggcgcctgcacacaagctcatggcgggccgacagcagcagagcgtcactgacgagagtccaccggcaagcgtacgcacgactgtatcctgttctgctggtgaaacaggacggcagcactatccacattcgatacagggagccccgccgaatgcttgccatgcctattgaccttgatacactcagccctgaagaaagaagagcccgacttaggaaacgtgaagcccagctccagtctcgcaaggaatacgaacaggaactgtccgacgacttgcatgtcgagcgctatcgccaattttggactcgcaccaagaaatag

SEQ ID NO: 195390 - DNA, 387 bp, Artificial Sequence
  Description of Artificial Sequence: Synthetic coding sequence
atggccgccgtgggcagcctgctgggccggctgcggcagagcaccgtgaaagctacagggcccgccctgagacgtttgcacacgtcaagttggagggccgactctagtcgtgcctccctcacaagggtgcaccgtcaagcgtatgcaagattgtacccagttcttctagtcaaacaggatggatctactattcacattcggtatcgtgagccccggaggatgctcgccatgcctatcgatctggacacactttcaccggaagaacgcagggcaaggctgcgcaaacgcgaggcccaactgcagtccaggaaggaatatgagcaggaactctccgacgacctccatgttgaaagataccggcaattttggacgagaacaaaaaaatag

SEQ ID NO: 195391 - DNA, 495 bp, Artificial Sequence
  Description of Artificial Sequence: Synthetic coding sequence
atggccgccgtgggcagcctgctgggcctggccgccagcagctggctggggggtcagaatgcctccgatcacagcctctggctgcttagaaagcctaggggatctagttgccctggcacagggcaccagctctgtaggctcagacaatccacagtgaaggctacaggcccagcactgcgcaggctgcacacatccagctggcgtgccgattcatcacgggccagcctgacgagggtgcatagacaggcctatgctcggctctatccagtgcttctggtgaagcaggacgggtccactattcatatcagatatcgcgaaccgagacggatgttagccatgccaatcgacctggacacactgagtcccgaagaacgtcgcgctaggctgcgaaaaagagaggcgcagttgcaaagtcgcaaggagtatgagcaggaactgtctgatgacttgcacgtagaacggtataggcagttctggacgaggactaaaaaatag

SEQ ID NO: 195392 - DNA, 387 bp, Artificial Sequence
  Description of Artificial Sequence: Synthetic coding sequence
atggccgccgtgggcagcctgctgggccggctgcggcagagcaccgtcaaggccacaggccctgctcttcggaggctgcacacatcgtcttggagagctgactcgtcgagggctagtctgacaagggtgcatcggcaagcttacgcccggttgtatcctgtgttactggtcaagcaggatggctcaaccatacatattcgctacagggagcctcgacggatgttagccatgccgatagacctggacacactgtctcctgaggaacgtcgcgcgcgattgcggaagcgcgaggcccagctgcagtccagaaaagaatacgagcaggagctgtcagatgacttgcacgtggagcgatataggcagttttggactcgaacaaagaagtag

SEQ ID NO: 195393 - DNA, 387 bp, Artificial Sequence
  Description of Artificial Sequence: Synthetic coding sequence
atggccgccgtgggcagcctgctgggccggctgcggcagagcaccgtgaaagctacaggaccagcccttaggcgccttcatacatcatcgtggcgagctgactcttctagggcctccctgacgagagtgcaccggcaagcctacgcgcgtctgtatccggtcctgctcgtgaagcaagacggatctacaatccacatccgctaccgagagccacgccggatgctagccatgcctatagatttggacaccctgagccctgaggagcgcagggcccgcctccgaaagcgggaggctcaactgcagagtcgcaaggagtacgagcaggaactctcagatgacttacacgtggaacggtacagacaattctggaccagaactaaaaagtag

SEQ ID NO: 195394 - DNA, 387 bp, Artificial Sequence
  Description of Artificial Sequence: Synthetic coding sequence
atggccgccgtgggcagcctgctgggccggctgcggcagagcaccgttaaggccaccggccccgcattgaggcggctccatacatcctcttggcgggccgactcttcccgtgcttctctcacaagggtgcaccgacaggcctacgctcgactgtatccagtcctgctggttaagcaggatggttctaccattcacattagataccgggagcctcgacgcatgttggctatgccgatcgatcttgataccctttctcccgaagagcggagggccaggttaagaaagagggaagcccagctgcagagcagaaaggagtacgaacaggaactctcagacgacctgcatgtggagaggtatcgacaattctggaccaggaccaaaaagtag

SEQ ID NO: 195395 - DNA, 387 bp, Artificial Sequence
  Description of Artificial Sequence: Synthetic coding sequence
atggccgccgtgggcagcctgctgggccggctgcggcagagcaccgtgaaagccaccgggccagccctgaggcgcctccatacgagcagctggcgggctgactcttctcgcgcatccctgacccgagtccaccgccaggcctatgcaagactgtacccagtgcttttagtgaagcaggacggatccacaatacatattcgctacagggagcctcgacgcatgttggccatgcctatagacttggacaccctatcccccgaagaacgacgcgctcgtctccgaaagagagaggcacaactccagtctagaaaggaatacgagcaggagctgtccgacgacctgcatgtggagcgctacagacagttttggaccaggaccaaaaagtag

SEQ ID NO: 195396 - DNA, 387 bp, Artificial Sequence
  Description of Artificial Sequence: Synthetic coding sequence
atggccgccgtgggcagcctgctgggccggctgcggcagagcaccgtaaaggccaccggccccgcccttagacgattgcatacgtcgagctggagggccgatagctcccgcgcatccctgacacgggtacatcgccaggcctatgctaggctttaccctgtgctcctggtcaagcaagatgggtctacgattcacattcgatatagggagccccggaggatgttggccatgcccattgatctggatactttatcaccagaggaaagaagggctcgactgcggaagagagaggcacagttgcagtcaaggaaagaatacgagcaggagctgtctgacgacttgcacgtggaaaggtacaggcagttctggacaagaaccaagaagtag

SEQ ID NO: 195397 - DNA, 387 bp, Artificial Sequence
  Description of Artificial Sequence: Synthetic coding sequence
atggccgccgtgggcagcctgctgggccggctgcggcagagcaccgtcaaagcaactggacctgctcttcggcgtcttcatacatcaagttggcgggctgactcatctcgggcctctctaaccagagtccatcgccaagcctacgccaggctgtatcccgtacttctggttaagcaggacgggagcaccatccacatccgctaccgtgaaccccgacgtatgttggcaatgcctatcgatctagataccctgagtcctgaagaaaggagggcgcgactgaggaagagagaggcacagctccagagcaggaaggaatacgagcaggagcttagtgatgacctacatgtagagagataccgtcagttctggactaggaccaagaaatag

SEQ ID NO: 195398 - DNA, 387 bp, Artificial Sequence
  Description of Artificial Sequence: Synthetic coding sequence
atggccgccgtgggcagcctgctgggccggctgcggcagagcaccgtgaaagctacaggtcccgccctgagacggctccacacaagcagttggcgcgccgactcgtcacgcgcgagcctaactcgagtgcacaggcaagcctacgctagattgtatcctgtcctcctcgtgaagcaggacggctcgacaatacacatacggtacagagagcccaggagaatgttggcgatgccgatcgatctggatacactgtcccctgaggaacgacgcgccaggctgcgtaagcgggaggcacagctccagtctagaaaagagtacgagcaggagctatcagatgacttacacgtcgaaaggtatagacagttctggactagaacaaagaaatag

SEQ ID NO: 195399 - DNA, 387 bp, Artificial Sequence
  Description of Artificial Sequence: Synthetic coding sequence
atggccgccgtgggcagcctgctgggccggctgcggcagagcaccgtgaaggctactggccctgccttaagaagactccatacttcctcctggcgggccgacagttcacgggcttcgctgactagagttcaccgccaggcttacgcacggttataccctgtgctgctagtcaagcaggatggctcgaccattcatatccggtaccgtgaaccacgccgaatgcttgctatgccgatagacctagatacgctatcaccagaggagcggagagctcgtttgcggaagcgtgaggcccagcttcagtccaggaaagagtatgaacaggaactgtctgatgacctccatgtggaaaggtaccgacaattctggaccaggactaaaaaatag

SEQ ID NO: 195400 - DNA, 387 bp, Artificial Sequence
  Description of Artificial Sequence: Synthetic coding sequence
atggccgccgtgggcagcctgctgggccggctgcggcagagcaccgttaaagcaaccggcccagctctgaggaggctccatacctcttcttggagggccgatagctcaagagctagcctcacacgtgtccatagacaggcatatgcacgcttatatcctgttttactcgtgaaacaagatggttcaaccatacacattcgctaccgggagcctcgtcgaatgctggctatgccaatcgacctggatactctttcaccggaggaacgtcgtgcccgcctcaggaagcgcgaggcacagctgcaatcaaggaaggagtacgaacaggagctgtcggatgatctgcatgtggaaaggtaccgccagttttggacacggacaaagaagtag

SEQ ID NO: 195401 - DNA, 495 bp, Artificial Sequence
  Description of Artificial Sequence: Synthetic coding sequence
atggccgccgtgggcagcctgctgggcctggccgccagcagctggctgggcggacagaacgcctccgaccatagcctctggcttctacgtaaaccacgaggtagctcctgtccaggcactggtcaccaactgtgtaggctgaggcaatccacagttaaggccaccggccccgcactcaggcgcctacacacaagtagctggcgcgccgactcctctcgcgcatcacttactcgagtccacaggcaggcctacgcacgtctgtatccggtgctgctggttaaacaggacggttcaaccattcatattaggtaccgggaacctcgccgcatgctggcaatgcccatcgatcttgacacattatctccagaggagcgccgcgctcgactgcggaagcgggaggcccagctgcagagccgcaaggagtacgaacaagaactatctgacgacttgcatgtggagaggtacagacaattctggacaagaaccaagaagtag

SEQ ID NO: 195402 - DNA, 231 bp, Artificial Sequence
  Description of Artificial Sequence: Synthetic coding sequence
atggccgccgtgggcagcctgctgggccggctgcggcagagcaccgtcaaagctaccggccctgcactcaggcggctgcatacatctagttggagagccgacagttccagggcctcactgacccgcgtacaccgccaggcatatgcccgcctgtatcctgtgctacttgttaaacaggatggctctactatacacattagatatagagaaccaagacgtatgctggcctag

SEQ ID NO: 195403 - DNA, 702 bp, Artificial Sequence
  Description of Artificial Sequence: Synthetic coding sequence
atggccgcccccgtggtgaccgcccccggccgggccctgctgcgggctggcgccggtagattactacggggaggagtgcaagagctgctgaggcccagacatgagggtaacgcccctgatctcgcctgtaacttctctctgtcacagaaccggggaaccgttattgtggagaggtggtggaaggtccctctcgccggtgaaggacggaaaccaagactgcacagaaggcatcgagtgtataagctggttgaagacactaagcatcgaccaaaagagaacctggagctcatcttgactcagagcgtcgaaaacgtgggagtgcgaggagacctcgtgtcagtgaagaagtctttaggaaggaatcgcctcttaccacaggggctggccgtctacgccagccctgagaataaaaaactgtttgaggaagagaaactgttgcggcaagaaggtaaacttgagaaaattcaaacaaaggcaggagaagctctcggtgtcgtggttgccccacataccctcaagctgcctgaggaacctatcactaggtggggggagtactggtgtgaggtgacggttaacggtttagacacagtgcgggttcccatgtctgtagtcaattttgagaagccaaagacaaaaaggtacaaatactggctggcacaacaagctgctaaagcgatggcaccaacctccccccagatctag

SEQ ID NO: 195404 - DNA, 804 bp, Artificial Sequence
  Description of Artificial Sequence: Synthetic coding sequence
atggccgcccccgtggtgaccgcccccggccgggccctgctgcgggctggggctggcaggctacttaggggaggcgtgcaggagctgctgcggcccagacacgagggtaatgcccctgacttggcgtgtaactttagcctgtctcaaaataggggcaccgttattgtggaaagatggtggaaggtgccgcttgctggagaaggtaggaagccccggttacataggaggcaccgcgtatataaacttgtggaggacactaagcaccgacctaaggaaaaccttgaactgattttgacacagtcagtggaaaacgttggggtgcgaggagacctcgtttctgtgaaaaagagcctggggaggaacagactgttgccgcaggggctcgctgtatacgcatccccagagaataaaaaactgttcgaagaagaaaaactactgaggcaagagggcaaactggagaaaatccagacgaaggcgggagaagccaccgtgaagtttctgaagtcttgccgtctcgaggttgggatgaagaacaacgtaaagtgggagctcaaccccgaaatagtcgctcgacacttttttaagaatttgggagttgtggtcgctccacacacgttaaaattgccggaagaaccaatcacccgatggggggagtattggtgcgaggtgaccgtgaacggactggacaccgttcgggtgcccatgtctgtggtgaactttgaaaagcctaagaccaagcgatacaagtactggctagctcagcaggctgcaaaagcaatggcccccaccagtcctcaaatctag

SEQ ID NO: 195405 - DNA, 606 bp, Artificial Sequence
  Description of Artificial Sequence: Synthetic coding sequence
atggccgcccggaccgccttcggcgccgtgtgccggcggctgtggcagggtttagggaacttctcagttaacacttctaaaggcaatacagctaagaacggcgggttgctcctgtctacaaacatgaagtgggtccagtttagcaacttacacgttgacgtgcccaaggacctgactaagccggtggtcactataagcgatgagccggacatcctgtataaaagattatctgtgctggtcaaaggccacgacaaggccgtgcttgattcgtacgagtacttcgcggttctcgcggccaaggagctgggcattagcatcaaggttcacgagcctcccaggaaaattgagcggtttacactgctgcagagcgtgcacatttataaaaagcaccgagtgcagtacgagatgaggactctataccggtgtcttgaactggagcacttaacagggtcaacggcagacgtgtacttagaatacattcagcgcaatcttcccgagggcgttgctatggaagtgactaagacacagctggagcagctccctgagcacattaaagaacccatctgggagactctctcagaggagaaagaagaaagtaagagttag

SEQ ID NO: 195406 - DNA, 585 bp, Artificial Sequence
  Description of Artificial Sequence: Synthetic coding sequence
atgcaggccgtgcggaacgccggcagccggttcctgcggagctggacctggccacaaactgccggccgcgtcgtggcgaggaccccggccggcaccatttgcacaggtgctagacagctgcaggatgcggcagctaagcagaaagtggagcaaaatgctgccccatcacatacgaagttctctatttacccccccatcccaggcgaagaatccagcctgagatgggccgggaaaaagttcgaggagatccccatcgcacatattaaggcctcccataataatacccagatacaggtggtgtctgcatccaacgaaccgctggcattcgcatcatgcgggactgaagggttcaggaacgccaagaaagggacaggaatcgcagctcagaccgctgggatcgccgcagcagcacgtgccaaacagaagggtgtgatccacatcagagtcgtggtgaagggtctgggtccaggccgattgtccgctatgcacggcctgattatgggaggactcgaagtgataagtatcaccgataatactcccataccacacaacggatgtagaccccggaaagctaggaagctgtag

SEQ ID NO: 195407 - DNA, 486 bp, Artificial Sequence
  Description of Artificial Sequence: Synthetic coding sequence
atgcaggccgtgcggaacgccggcagccggttcctgcggagctggacgtggccccagacagcggggcgggtagttgctagaacacccgccggcactatttgtaccggggcaagacagctgcaggatgcagccgccaagcaaaaggtagaacagaacgcagcaccttctcacaccaagttcagcacacaaattcaagtggtgtcagcgtccaatgaacctctggcttttgcctcttgtgggacagagggcttccgcaacgcaaagaaaggaaccggcattgcggcgcagacagcaggcattgcggctgctgcccgggccaagcaaaagggagtgatacatatccgagtggtcgtgaagggattaggccctggcaggcttagtgcgatgcatggcctgatcatgggtggcctggaagtcatctcaatcacggacaacacccctattccccataatggttgccgtcccagaaaggctaggaaattgtag

SEQ ID NO: 195408 - DNA, 417 bp, Artificial Sequence
  Description of Artificial Sequence: Synthetic coding sequence
atgagctggagcggcctgctgcacggcctgaacaccagcctgacctgtgggcccgcccttgtaccgcggctgtgggccacttgctccatggcaactctcaatcagatgcataggctggggcctcctaagcgaccacctagaaaactgggcccaaccgaaggcaggccccaactaaaaggcgtggtactatgtaccttcacccgaaagccaaaaaagcctaatagtgctaatcgaaagtgctgtcgcgtgaggttgagcaccggacgggaagctgtctgttttattcctggggaaggacacaccctgcaagaacaccaaatcgtgctggtcgagggaggccgcacgcaggacctcccaggcgtcaagttgacagtggtccgaggcaaatatgattgcgggcacgttcaaaagaaatag

SEQ ID NO: 195409 - DNA, 417 bp, Artificial Sequence
  Description of Artificial Sequence: Synthetic coding sequence
atgagctggagcggcctgctgcacggcctgaacaccagcctgacctgcgggcccgccctggttcctagactgtgggccacctgctcaatggcaacccttaatcagatgcacaggctcggcccgcccaagagaccacctcgcaaattaggtcccaccgagggacgtccgcagcttaagggagttgtcttgtgcacctttacaaggaaacctaaaaaaccaaattcagccaatagaaagtgttgccgcgtgagactctctactgggagggaagccgtgtgctttatccccggggagggccatacacttcaggagcatcagatcgtgctggtcgagggaggccgaacgcaagacctcccaggcgtgaagttgacagtggtgcgcggaaagtatgactgtggacatgttcagaagaagtag

SEQ ID NO: 195410 - DNA, 417 bp, Artificial Sequence
  Description of Artificial Sequence: Synthetic coding sequence
atgagctggagcggcctgctgcacggcctgaacaccagcctgacctgtggtccagcactggtgcccagactgtgggccacatgctctatggctaccctgaaccagatgcatcgcctgggaccgcccaaaagaccgccgcgcaagcttgggccaacagagggaagaccacagcttaagggtgtcgtcctctgcactttcactagaaaaccaaaaaagcctaacagcgcaaataggaagtgttgccgggttagacttagtactggccgggaggctgtttgtttcatacctggcgagggtcacacactgcaagaacatcagatcgtactcgtcgagggcggaaggacccaggaccttcccggcgtcaagctgaccgtggtccgcgggaagtacgattgcggtcacgtgcaaaagaagtag

SEQ ID NO: 195411 - DNA, 387 bp, Artificial Sequence
  Description of Artificial Sequence: Synthetic coding sequence
atggccgccttcatgctgggcagcctgctgcggaccttcaagcagatggttccgtcctcagcttctgggcaggttcgcagtcactacgtcgattggcgtatgtggagggatgtgaagcgccggaagatggcctacgagtatgctgacgagcggctgcgtataaatagcctccgcaaaaataccattttacccaagatccttcaggatgttgccgatgaagagattgccgcgctgcctagagactcttgcccagttcgcatcagaaaccgatgcgttatgaccagtcggccacgcggagtgaagcggcgctggcgcttgtcccgcattgttttccggcacctggccgatcacggacagctctctggcatccagagagcaacctggtag

SEQ ID NO: 195412 - DNA, 774 bp, Artificial Sequence
  Description of Artificial Sequence: Synthetic coding sequence
atgctgcgggtggcctggcggaccctgagcctgatccggacccgggcggtgactcaggtcctggtgccaggcttacctggcggcggctcagcaaaatttccattcaaccagtgggggttgcagccacgctcactactgttgcaggccgccagagggtatgtcgtgcggaaacccgcccagtctagacttgacgatgaccccccccccagcacgctactgaaggactatcagaacgtccccggaattgagaaagtggacgatgttgtcaaacgcttgttgagtctggagatggccaataagaaggagatgctcaagattaaacaagagcaattcatgaagaagatcgttgccaacccagaggacacaaggtccttagaggcccggatcatcgcgctttccgtgaaaattcggagctacgaggagcacctggaaaagcatcgcaaagataaggcacacaagcgctatctgctgatgagcattgaccagaggaaaaagatgctgaaaaaccttcggaacaccaactatgatgtgttcgagaagatttgttgggggctgggcatcgagtacaccttccctccactctactaccgacgtgctcatcggcgctttgtaacgaagaaggctctttgtatacgcgtgtttcaggaaactcagaaactcaagaagagacgccgtgccctgaaggcagccgcagcggcacagaaacaggccaaaagacgaaacccagactccccagctaaggcaatcccaaaaaccttgaaagatagtcagtag

SEQ ID NO: 195413 - DNA, 300 bp, Artificial Sequence
  Description of Artificial Sequence: Synthetic coding sequence
atggtgcacctgaccaccctgctgtgcaaggcctaccggggcggccacctgaccattagactggccctgggggggtgcaccaaccgtcccttctatcggattgttgctgctcacaacaagtgccccagggacggtcgttttgtggagcagctcggatcctatgatccacttcccaattcacacggtgagaaactcgtggcgctgaatctggatagaatacgccactggatcggatgcggcgctcacctgtccaaaccgatggagaagctcctgggacttaagtacagccacgtcttctag

SEQ ID NO: 195414 - DNA, 414 bp, Artificial Sequence
  Description of Artificial Sequence: Synthetic coding sequence
atggtgcacctgaccaccctgctgtgcaaggcctaccggggcggccatctgacaatacgtcttgcgttgggaggatgtacaaatagacctttctatcgcatcgtcgccgctcataataaatgcccacgagacgggagattcgtagagcagctcgggtcttatgatcctttgcccaattcccatggagagaaacttgtcgcgcttaacctcgatcgcattcgccattggataggctgtggagctcacctgagtaagccaatggaaaagctgctagggctggccgggttcttccccctgcaccctatgatgatcacgaacgcggagagattgcggcggaaacgcgcacgtgaggtgctactggcctcacaaaagaccgatgcagaagcaacagatacagaggccacagagacatag

SEQ ID NO: 195415 - DNA, 372 bp, Artificial Sequence
  Description of Artificial Sequence: Synthetic coding sequence
atggtgcacctgaccaccctgctgtgcaaggcctaccggggcggccacttgactattagattagctctcgggggatgtaccaacagacctttctatcgcattgtggccgcacacaacaaatgccctagagacggtcggtttgtggaacaactggggagctatgacccactccctaattcccacggcgaaaagcttgttgctcttaatctggatcggatccgccattggatcgggtgcggtgcccacctgagcaagcccatggaaaaactcctgggcaagaccgacgcacgtttccccgagcagggggaagaaagacccgagcagcaccattttccagaggacttggcccctgcccgcggaaggggcctgtag

SEQ ID NO: 195416 - DNA, 393 bp, Artificial Sequence
  Description of Artificial Sequence: Synthetic coding sequence
atgagcgtggtgcggagcagcgtgcacgcccggtggatcgtgggcaaggttattggaacaaagatgcagaaaactgccaaggttagggtcactcggctggtcctggacccctatctgctgaagtacttcaataagcggaagacttacttcgcacacgatgcgctgcagcagtgcaccgtgggtgatatcgtactgctccgcgcactgccagttcccagggcgaagcacgttaaacacgagctggcagagattgtgtttaaagtgggcaaggtgatcgatcctgtgaccgggaagccatgtgctggcactacctacctggagtctcccctgtcttccgaaacaactcagttgtccaagaatctggaggagctcaacatctcctcagcccagtag

SEQ ID NO: 195417 - DNA, 390 bp, Artificial Sequence
  Description of Artificial Sequence: Synthetic coding sequence
atgagcgtggtgcggagcagcgtgcacgcccggtggatcgtgggcaaagtcattggcaccaaaatgcagaagacggccaaggtccgcgtgaccagacttgtattggatccctatctcctcaagtactttaacaaacggaagacttatttcgcccacgatgccctgcaacagtgtacagtgggtgatatcgttctgctccgcgctctccccgtccccagagcaaagcatgtgaagcacgaattggcggaaatcgtctttaaagttggtaaggttattgatcccgtcaccggtaaaccatgtgccggcaccacttacctggagtcacccctgtcctctgagactacgcagctgtctaagaacctagaggagttgaatatcagttctgcatag

SEQ ID NO: 195418 - DNA, 384 bp, Artificial Sequence
  Description of Artificial Sequence: Synthetic coding sequence
atggccgccctgaaggccctggtgagcggctgcggccggctgctgagaggcctactggccggacccgccgccacatcctggagtcgccttccagcacgggggtttagggaagtggtggagacccaagaaggtaaaaccactatcatcgagggtcgaattacggccaccccaaaggagtcacctaaccctcctaacccctctggccagtgtccaatctgcaggtggaatctgaagcataagtataattacgacgatgtgttattactttcacagttcatccggcctcatggtggcatgctccctcggaagatcacgggcctgtgtcaggaagagcatcggaagattgaggaatgtgtgaagatggctcatcgtgccggaacttag

SEQ ID NO: 195419 - DNA, 813 bp, Artificial Sequence
  Description of Artificial Sequence: Synthetic coding sequence
atggccgccctgaaggccctggtgagcggctgcggccggctgctgcgcgggttgctggcgggcccagccgccacttcctggtctcggttacccgccaggggctttagagaagttgtggaaacccaggaagggaaaaccacaataatcgagggaagaatcactgcgacgcctaaggaaagtccgaatccccccaatccaagtggccagtgccccatctgtcggtggaatctgaagcacaaatataactacgatgacgtgttgctactgtcacagtttatccgcccgcacggaggtatgttgcctcgcaaaattactggcctctgtcaggaggagcaccgcaagatagaggagtgcgtgaaaatggcacacagagctgggagaagaccttggggccccaggggggccgaggggtgtaggcattcactaccaacacagttaccacatgtcagcgctccccccggtcgcaaagtggacatccggtccgttaattacacccaccaccctatgcctaccttccctctcccctgggccttcccactggcaccctcggagctgcagagagagctgcagagactgtcacccctgcctcgacactctgggctcttgcccaatcatcgccctcgcctgcctgaaggcgttgtgcctaagtcaaaaccccagctcaataggtacctaacacgctgggcccctggttctgtgaagcccatctacaaaaagggtcctcgctggaaccgcgtgcgcatgcccgttggaagccctctcctccgcgacaacgtctgttacagtcgcaccccatggaagctataccactag

SEQ ID NO: 195420 - DNA, 591 bp, Artificial Sequence
  Description of Artificial Sequence: Synthetic coding sequence
atggccgccctgaaggccctggtgagcggctgcggccggctgctgagagggctgcttgctgggcctgccgctacgtcttggagtcggctccctgctcgaggattccgcgaagtggtagaaacccaagaaggaaaaacaactatcatcgaaggacgaatcaccgccacacctaaagaatctcccaacccccccaacccttccggacagtgccccatctgccgctggaatctgaagcacaaatataactacgatgacgtgctgcttctgtcccagttcatcagaccccatggtgggatgttaccgcggaaaataacggggctttgtcaggaagagcaccggaaaattgaagaatgtgtgaagatggcacatcgggccggcctgctccccaatcaccgtcccaggttgcctgagggggtggtgcccaagtctaagccacagctgaatcgatatctgacacggtgggcgccaggatctgtgaaacctatctacaaaaaaggcccaaggtggaatagagtccgcatgccagtggggtctccattacttcgcgacaacgtttgttacagccgaacaccctggaagctatatcactag

SEQ ID NO: 195421 - DNA, 795 bp, Artificial Sequence
  Description of Artificial Sequence: Synthetic coding sequence
atggccgccctgaaggccctggtgagcggctgcggccggctgctgagaggcttattagccgggcctgcagccactagttggtctcgcctgccagcccgaggctttcgcgaggttgtcgagacccaggaaggtaaaactaccattatcgagggtcggatcactgccacaccgaaggaaagtcccaaccctcctaaccccagtggacagtgtccaatctgtcgatggaatttgaagcacaaatacaattatgatgatgtattgctcctcagtcagttcatacgcccccatggtggcatgttgccaagaaagatcactgggttatgtcaggaggagcacaggaagatagaagagtgtgtgaaaatggcccatagagccggtagaagaccgtggggcccaaggggtgctgagggctgtcgccatagtttaccgacccagcttccccatgtgtcagccccacctggccgaaaagttgatattaggtcggtgaactacactcaccacccgatgcccaccttcccgctcccctgggcatttccattagcacctagcgagctccaaagggagttgcagcgcctctctcctctgccgcgacatagcggtctcttacccaatcaccggcctcgtctgcctgaaggagtggtcccaaagtccaagccacagctgaatcgatacctgacacggtgggccccaggctcagtcaagccgatttataagaaagggccgcgctggaaccgggtgagaatgcccgtgggcagtccactactccgtgacaacgtctgttactcccggacatag

SEQ ID NO: 195422 - DNA, 777 bp, Artificial Sequence
  Description of Artificial Sequence: Synthetic coding sequence
atggccgccagcgtgctgaacaccgtgctgcggcggctgcccatgctctcactatttagaggctctcacagggtacaggtgccccttcagactttatgcactaaggccccctctgaagaggatagtttgtccagtgtacccatctcgccttataaagatgagccctggaagtatctggaatctgaagaataccaagaaaggtatgggtcccggcccgtgtgggccgattatcgacggaatcacaagggaggtgtccccccacagcggacaagaaagacttgtattagacgtaacaaagtggtcgggaatccttgtccaatatgccgggaccacaaactgcacgttgactttcgcaacgtgaaattattggaacagttcgtgtgtgcccatacaggtataatcttctacgccccatatacgggtgtgtgcgtgaagcagcacaagcgtcttacacaagctatacagaaggcacgagatcacgggctactaatttatcatattccgcaagtcgaaccccgtgatctggacttttccacaagccacggtgccgtaagcgccacgcccccagctccgaccctcgtgtctggcgacccgtggtacccatggtacaactggaagcaaccacctgagagggagctgtcgagactgcggaggctgtaccagggtcacttgcaggaggaatccggccctccgcccgagagtatgccaaaaatgcctccacgcaccccagctgaggccagttccactggacaaaccggtccacagagcgcactctag

SEQ ID NO: 195423 - DNA, 777 bp, Artificial Sequence
  Description of Artificial Sequence: Synthetic coding sequence
atggccgccagcgtgctgaacaccgtgctgcggcggctgcccatgttgagccttttcagagggagccatcgcgtgcaggtaccgctgcagacgctctgcaccaaagcaccgagtgaggaagattcactctccagcgttccaatctccccttacaaagacgaaccctggaagtatttggaatctgaggagtaccaggagcggtatggcagtcggcccgtgtgggcggactaccggcgcaaccacaagggcggggttccacctcaacgcactcgaaagacttgtattaggcggaataaggttgtgggaaatccctgccctatttgccgggatcacaagctgcatgtggatttccggaacgtgaagctgctagagcagttcgtatgcgctcacactggcataatcttctatgctccttacacaggggtctgcgtgaaacagcataaaagactgacacaggctatccaaaaagctcgcgaccatgggctactgatctaccacatcccgcaggtcgagcctagggacctggattttagcacatcccacggagccgtgtctgctactccccccgctccaacactggtctcaggcgacccatggtacccctggtacaattggaagcagccacctgagagggagctgagtaggctgcgcagattgtaccagggacacttgcaggaggagtcagggcccccaccagagtccatgcccaagatgccgccacgcaccccagccgaagcgagttccacaggtcagaccggtcctcagtctgcactctag

SEQ ID NO: 195424 - DNA, 648 bp, Artificial Sequence
  Description of Artificial Sequence: Synthetic coding sequence
atggccgccagcgtgctgaacaccgtgctgcggcggctgcccatgctctccctgtttcggggctcacaccgggtgcaggtgcccctgcaaaccctgtgtactaaagcccctagcgaggaggattcgctgtcttccgtgcccatatctccttacaaagacgaaccatggaaatatctagaatcggaggagtaccaggagaggtatggctccagacctgtgtgggccgactacaggcgaaatcataaaggaggcgtccctcctcagcgaacccggaagacttgtatcaacgtcaagcttctggagcagttcgtgtgcgctcatacggggatcatcttctacgctccctacaccggcctgctcatatatcacatcccacaggtcgagccccgagatctggacttctcaacttcccacggggccgtgtccgctactccccccgctcccacattagtgtccggcgacccttggtacccatggtataattggaaacagcctcccgagagagaactgagcagacttaggaggctgtaccaaggccatctccaagaggagtccgggccgcccccagagtctatgcctaaaatgcctccacgaactcctgccgaggcatcctctacaggtcagaccggcccacagagtgccctgtag

SEQ ID NO: 195425 - DNA, 648 bp, Artificial Sequence
  Description of Artificial Sequence: Synthetic coding sequence
atggccgccagcgtgctgaacaccgtgctgcggcggctgcccatgctcagcctttttagggggtcccacagagtgcaggtcccactgcagacactttgcaccaaggcgccgagtgaagaggatagcttgtcctctgtacccatttctccatacaaggacgaaccctggaagtaccttgaaagtgaagagtatcaggaacggtatggatcccgcccggtttgggccgactatcgtcgtaatcataagggaggcgtaccaccgcagcggactagaaagacatgtatcaatgtgaagctgctggagcagttcgtctgcgcgcatacaggcatcatcttctacgcaccctacacaggacttctcatctaccatattccgcaggtcgaacctcgcgacctggacttctccacatctcacggagcagtgtctgccaccccccccgctcccaccctggtcagtggagatccctggtatccatggtacaactggaaacagccacctgagagggaactgtcacggctacgcagactgtatcagggccatttgcaggaggagagcgggcctcccccagagagcatgccaaagatgcccccacgcacccctgctgaagcttcttcaacgggacaaacaggcccacagtcagccctctag

SEQ ID NO: 195426 - DNA, 777 bp, Artificial Sequence
  Description of Artificial Sequence: Synthetic coding sequence
atggccgccagcgtgctgaacaccgtgctgcggcggctgcccatgctttccctgtttcgcggtagtcatcgcgtacaggtgcccctccagacactgtgtacaaaggcaccatcggaagaggattccctgagcagtgtgccgatttcgccttacaaagacgagccttggaaatacttggagagcgaggagtaccaggagcgctacggctctcgacctgtgtgggcagattaccggaggaaccacaaaggaggggtccccccacagcggaccagaaaaacatgtatccggcgcaataaggtcgtgggcaacccttgtccaatttgcagggaccacaaactccacgttgactttcggaatgtcaagctcctggagcagtttgtctgcgcccacacagggatcatattctacgcaccttatacgggcgtctgcgtgaaacagcataaacgcctgacccaggccatccagaaggcgagggaccacggtctgctcatataccatattccccaagtggagccccgcgatttagactttagtacctcccacggcgccgtgtccgcgacaccccccgcccccacactggtgtcaggagacccttggtatccatggtacaattggaagcagcctcccgaacgcgagttgagcagattgagaaggttataccagggacatcttcaagaggaatcgggtccacccccggagagcatgccaaaaatgccccccagaacacccgccgaggcctcctcaacaggacagaccgggcctcagtccgctctttag

SEQ ID NO: 195427 - DNA, 648 bp, Artificial Sequence
  Description of Artificial Sequence: Synthetic coding sequence
atggccgccagcgtgctgaacaccgtgctgcggcggctgcccatgttgtctctgttcaggggcagtcaccgcgtccaggtaccactacagacactctgcaccaaggcgccatccgaggaggattcactctccagcgttccaatctccccctacaaggacgagccttggaagtatctggagagcgaggagtaccaggagagatatgggagtcgaccggtgtgggccgattataggcggaaccacaaaggcggggtccccccacaaagaacacgtaagacctgcataaacgtaaagctgctagagcaattcgtctgtgcccacactggcataatcttttacgcgccgtatactggtcttctgatttaccatattccacaggtcgagccgagggaccttgacttttccacaagccacggggccgtctctgccactccgccagctcccactctggtgagcggtgacccctggtatccatggtataactggaaacagcccccggaaagagagctctcccgactgcgacggctctatcaaggacacctgcaggaagagtcgggccccccccccgaatccatgcctaagatgccacccaggacccctgctgaagcaagctccaccggtcagactggacctcagagtgccctgtag

SEQ ID NO: 195428 - DNA, 648 bp, Artificial Sequence
  Description of Artificial Sequence: Synthetic coding sequence
atggccgccagcgtgctgaacaccgtgctgcggcggctgcccatgttgtctctattccgcggctcccacagagtgcaggtaccattgcagactctgtgcaccaaggccccctccgaggaagattcattatcctcggtgcccatctcaccatacaaggacgaaccttggaaatacctcgaatccgaggaataccaggaacggtacggttctcgccctgtctgggctgactatagaaggaaccacaagggcggcgttcctccccagcggacccgaaagacttgtatcaatgttaagcttctggaacaattcgtgtgcgctcatactggcattatcttttacgccccgtataccggtctgctgatttaccatattccccaagttgaacctagggacctggacttttcaacctcacacggagcagtgtcagcaacccctccggcacccaccctggtctccggggatccttggtacccttggtataactggaagcagccgcccgaaagagaactgagtcgtctccggaggctctatcagggacatttacaggaggagagtgggcctccaccagaatccatgcccaagatgccccctaggacgcctgctgaggcctcatctaccgggcagactggcccacagtctgccctatag

SEQ ID NO: 195429 - DNA, 777 bp, Artificial Sequence
  Description of Artificial Sequence: Synthetic coding sequence
atggccgccagcgtgctgaacaccgtgctgcggcggctgcccatgctgagcttattccgggggagtcaccgggtgcaggtgccactccagactttatgcacgaaggctccctccgaagaggatagtctgagtagtgtcccaatctcgccatacaaggatgaaccctggaagtacctggaaagcgaagaataccaggagcgatatgggtcccgccccgtctgggccgattatcgacgtaatcataagggcggcgtgcccccacaaaggaccaggaagacctgcatccgccgcaacaaggtcgttggcaacccctgcccaatatgccgggaccataagctccatgtagacttccgcaatgttaaattattggaacaatttgtttgcgctcacacaggcatcatattctatgcaccctacaccggcgtttgtgtgaagcaacacaagcgtctgacccaagccatccagaaggcccgagatcatggactgctgatctatcacatccctcaggtggaaccccgcgacctggacttttccactagtcacggcgctgtgagtgcaaccccgccagcccccacccttgtctcaggtgacccttggtacccctggtataattggaaacagccacccgaacgtgagttatcacgccttcgtaggctgtaccagggtcacctacaagaagaatctggtccaccaccagaatccatgccaaagatgccaccacggacaccagctgaggccagctcgacggggcagactggcccccagtccgcactatag

SEQ ID NO: 195430 - DNA, 648 bp, Artificial Sequence
  Description of Artificial Sequence: Synthetic coding sequence
atggccgccagcgtgctgaacaccgtgctgcggcggctgcccatgcttagtttgttccgaggtagccaccgggtgcaagtgcctcttcagacgctctgcactaaagctccttcagaagaggattccctttcctcagtacccatttccccctataaagacgaaccttggaagtaccttgaaagtgaagagtatcaggagcgttacggctctaggccggtctgggccgattatagacgaaaccacaagggaggcgtgcctccccagaggaccaggaagacttgtatcaacgtgaaactgctcgagcagttcgtttgcgcacacaccggaattatattttatgccccgtacacaggcctgctgatttaccacatccctcaggtagagccaagagatctcgacttttccacatcccacggtgccgtttctgcaactccacccgccccaactctcgtgtctggcgatccttggtacccttggtacaattggaaacagccccccgagcgagaactgtctcggctccgcagactttaccagggccacctgcaggaggaatccggcccccccccagagagtatgccaaaaatgccccccaggacgccagctgaagcatcctctaccggtcagaccggtccacagtctgccttatag

SEQ ID NO: 195431 - DNA, 777 bp, Artificial Sequence
  Description of Artificial Sequence: Synthetic coding sequence
atggccgccagcgtgctgaacaccgtgctgcggcggctgcccatgctctcactttttcggggttcacaccgagtgcaggtgcccctccagaccctttgtactaaggcaccttctgaagaagattctttgtcatcggtgcccataagcccctataaggatgagccttggaaatacctggagtcagaggagtatcaagagaggtatggttcccgccccgtgtgggccgactaccggaggaatcataaagggggtgttccacctcagagaacacgcaagacatgtattcgacggaacaaggtggttggcaacccttgtccaatttgcagagatcacaaactccacgtggacttcaggaatgttaagttgctggagcagttcgtttgtgcacatacaggcatcattttttatgccccttacaccggtgtctgcgtcaagcagcataagcgcctgacccaggctattcaaaaggccagagaccatgggctgctcatatatcacattcctcaggtggagcctcgcgatttggatttttcaacctcacatggtgcagtgtccgccactccaccagcacctacactcgtatccggcgacccttggtacccttggtataattggaaacagcctccagagagagaactgagccggctacggcggctgtatcagggccacttacaggaagaaagcgggccacctcccgagtcaatgcctaagatgccaccaaggacacctgcggaagcaagcagcaccggccagactggtccccagtccgccttatag

SEQ ID NO: 195432 - DNA, 648 bp, Artificial Sequence
  Description of Artificial Sequence: Synthetic coding sequence
atggccgccagcgtgctgaacaccgtgctgcggcggctgcccatgctttcactgtttaggggctctcatcgggtccaggtgcctttgcagacactctgtacaaaggcaccatccgaagaggactccctgagttccgttccaatttcaccttacaaagatgaaccctggaagtatctggaatccgaagagtaccaggaaaggtacggttccaggcccgtctgggccgactaccgaaggaaccataaagggggggtcccccctcagcggactcgcaagacttgtattaacgtgaagctgctggaacagttcgtgtgcgcacatacaggcattatcttctatgccccatatactggtctactcatatatcacattccacaagtcgagcccagagacctggatttctccacttcccacggagcagtctcagccactccccctgcaccaacactggtaagcggtgacccttggtatccatggtacaactggaaacagccacccgaaagagaattgtcacgattaaggcgcctataccagggacacctacaagaggaatcaggccccccaccagagtctatgcctaaaatgcccccacgaactccagcagaggcctcaagcacaggacagacgggcccacagagcgcactctag

SEQ ID NO: 195433 - DNA, 648 bp, Artificial Sequence
  Description of Artificial Sequence: Synthetic coding sequence
atggccgccagcgtgctgaacaccgtgctgcggcggctgcccatgctgtccctatttagagggtcccacagggtgcaggtgcctctccagacgctctgcacaaaggcgccctccgaggaggactcattatctagcgtgcctatatctccctataaggatgagccctggaagtacttagagtccgaagaataccaggaaaggtacggcagtcgaccagtttgggccgactataggagaaatcacaaagggggtgtgcctcctcagagaacacgaaagacttgcattaatgtgaagctcctggagcagtttgtttgtgcccatacaggtatcatcttctacgccccatacacaggcctgctgatttaccacatccctcaggtcgaaccaagagatcttgacttttctacctctcacggcgctgtatctgctactccccctgccccaaccctggtgtccggcgatccctggtacccttggtacaactggaagcagcctcccgaacgcgagttgtcgcgcctccgccgtctgtaccagggccatcttcaggaggagtccgggccccccccagaatcaatgcctaagatgccacctcgcactccggccgaagcaagtagtaccggacagacaggaccacagtcagctctctag

SEQ ID NO: 195434 - DNA, 777 bp, Artificial Sequence
  Description of Artificial Sequence: Synthetic coding sequence
atggccgccagcgtgctgaacaccgtgctgcggcggctgcccatgctctctctattcagggggtctcaccgcgtccaggttccccttcagacactctgtaccaaggctccctccgaggaagatagcctgtcctctgtcccaatttctccatacaaggatgagccctggaagtacctggagtccgaggagtatcaggagagatacggaagccggcccgtttgggctgactatcggcggaatcacaagggaggagtgccaccccagcgtacacgcaaaacttgtattcggcgcaataaagtggtgggcaacccctgtccgatctgccgcgatcataaactgcatgtagatttccgcaatgtgaaactcctggagcagttcgtgtgcgcccacactgggattatcttctacgctccatatacgggggtttgtgttaaacaacacaaaaggttgacccaggcaatccagaaggcccgtgatcacggactgctgatttaccacatccctcaagtagaaccaagggacctggatttcagcacctcacacggtgcagtgagcgcaacaccgcctgctccaactctcgtgtccggcgacccttggtatccttggtataactggaaacagcctccagagagagagctttctagactgcggaggctctaccaagggcatctacaagaagagtctggacccccccccgagtccatgccgaagatgcctccaagaaccccggccgaggccagctccactggccagactggccctcagagcgccctttag

SEQ ID NO: 195435 - DNA, 777 bp, Artificial Sequence
  Description of Artificial Sequence: Synthetic coding sequence
atggccgccagcgtgctgaacaccgtgctgcggcggctgcccatgttgagcctttttcgaggctctcatcgagtgcaagtaccgcttcaaacgctgtgcaccaaagccccctctgaggaagattccctctcatccgttcctataagcccttataaagacgagccgtggaagtatctggagtctgaggaataccaggagcgatacgggagccggcctgtgtgggccgactatcggagaaaccataagggcggtgtacctcctcaacgcacacgaaagacatgcatccgccgtaacaaggtcgtaggaaatccctgtccaatttgtcgtgaccacaaactgcatgtggacttcaggaacgtcaagctactggaacagttcgtgtgcgctcacacaggtatcatattctacgcaccatacacaggtgtatgcgtgaaacagcataagcgattaactcaggccatacaaaaggcccgagaccatggcctgctcatttaccacatccctcaggtggagccacgggacctggatttcagcacatctcacggagctgtgtcggcgacgccacctgcccctacgctcgtgtctggagacccctggtatccttggtacaattggaaacagccccctgaaagagaactttctcgcctgcgaaggctataccagggccatctccaagaggagtctgggccaccccccgagagcatgcctaaaatgcctcctaggactcccgccgaggcttcctcgacagggcaaacaggaccacagagtgccctgtag

SEQ ID NO: 195436 - DNA, 366 bp, Artificial Sequence
  Description of Artificial Sequence: Synthetic coding sequence
atggccgccagcgtgctgaacaccgtgctgcggcggctgcccatgctgtccctgtttcgggggtcccatagggtccaggtcccattgcagaccttgtgcaccaaggccccctccgaggaagactccctttcaagtgtaccaatttctccctacaaggacgaaccatggaaatatttggaatctgaggaataccaggaaaggtatggctctagacccgtctgggcagactataggaggaatcataaaggaggggtccctccacagcggacccgaaaaacatgtatcaggcgcaataaagtggtaggcaatccctgcccgatatgtcgcgatcacaagctccatgtggactttagggagagcgtctag

SEQ ID NO: 195437 - DNA, 366 bp, Artificial Sequence
  Description of Artificial Sequence: Synthetic coding sequence
atggccgccagcgtgctgaacaccgtgctgcggcggctgcccatgttgagtctgttccggggtagccatagggtacaggtgccactgcagacactgtgtaccaaggccccatctgaggaagactccctgagcagcgtccctataagcccctataaggacgagccatggaagtatctcgagtccgaggaataccaggagaggtacggaagccgacccgtgtgggcagattatcggcggaaccacaaggggggagtgcctccacagcggacgagaaagacctgcatccggaggaataaagtggtcggcaacccttgtccaatttgccgggaccacaagctgcacgtggatttccgagaatccgtgtag

SEQ ID NO: 195438 - DNA, 366 bp, Artificial Sequence
  Description of Artificial Sequence: Synthetic coding sequence
atggccgccagcgtgctgaacaccgtgctgcggcggctgcccatgctgtccctttttcgcgggagccatagagtgcaggtgcccttgcagacattgtgtaccaaggctccctcagaggaggatagtctatcctctgttcctatcagcccttacaaagatgaaccttggaagtacctggaatctgaggagtatcaggaaaggtacggttcccgcccagtttgggcagattacagaagaaatcacaaggggggggtaccgcctcagcggacccgcaagacatgtatcaggagaaacaaggtggtgggtaatccctgcccgatttgcagagaccacaaactgcatgtcgacttcagggaatccgtgtag

SEQ ID NO: 195439 - DNA, 366 bp, Artificial Sequence
  Description of Artificial Sequence: Synthetic coding sequence
atggccgccagcgtgctgaacaccgtgctgcggcggctgcccatgctgtcactattcagagggagccatagagtgcaggttcccctgcaaacactttgcacaaaggctccatccgaagaagactctctcagttcggttcccataagcccatataaagacgagccatggaagtatttggagtcggaggagtatcaggaaagatacgggtcccgacccgtctgggccgattacaggcggaatcacaaaggtggggttccccctcagagaacaaggaaaacatgcataagacgcaacaaagttgtaggcaacccatgccctatttgtagggatcataagttgcacgtggattttcgtgagtctgtttag

SEQ ID NO: 195440 - DNA, 366 bp, Artificial Sequence
  Description of Artificial Sequence: Synthetic coding sequence
atggccgccagcgtgctgaacaccgtgctgcggcggctgcccatgctctctttgttccgcggtagccacagagtgcaggttccgctgcaaacactatgcacaaaggcaccatcagaagaggattctctgtctagcgttccaatcagcccttacaaggacgaaccttggaagtatcttgaatcagaagaataccaagaacgctacgggtcaagacccgtttgggccgattaccggagaaaccacaagggaggtgtcccccctcagcgtaccaggaaaacctgcatccgacgaaacaaggttgtgggaaatccgtgccccatctgtcgcgaccacaagctccatgttgacttccgtgagagcgtgtag

SEQ ID NO: 195441 - DNA, 366 bp, Artificial Sequence
  Description of Artificial Sequence: Synthetic coding sequence
atggccgccagcgtgctgaacaccgtgctgcggcggctgcccatgctctctctctttcggggatcacaccgcgtgcaggtgccacttcagacactgtgtaccaaggctccttctgaagaagactctcttagttctgtaccaataagtccttataaggacgagccctggaagtatctcgagagtgaggaataccaggaacggtatgggtccagaccggtctgggccgactaccgaagaaaccataaaggaggtgtccccccacagcgtacacgcaaaacttgtatccgacgcaacaaggtggttggaaacccatgtcccatctgccgggaccacaagttgcacgttgacttccgggagtcagtgtag

SEQ ID NO: 195442 - DNA, 366 bp, Artificial Sequence
  Description of Artificial Sequence: Synthetic coding sequence
atggccgccagcgtgctgaacaccgtgctgcggcggctgcccatgttgtctctgtttcgtgggtcacatcgcgtccaagtgcctctccagaccttgtgtaccaaagctcctagcgaggaagattctctgtcttcagtcccaatctctccctataaagacgagccctggaaatacctggaatcagaagaatatcaggaacgatatggttcaaggccagtgtgggcggattaccgccgtaaccataagggaggagtgccgccgcagcgaactaggaagacttgcattcgccggaacaaagtcgtgggcaatccctgccccatctgcagagatcacaagctccatgtagacttcagggagtcagtttag

SEQ ID NO: 195443 - DNA, 429 bp, Artificial Sequence
  Description of Artificial Sequence: Synthetic coding sequence
atggccgccgtggtggccgtgtgcggcggcctgggccggaagaagttgacccacctggtgactgcagccgtgtcgctgacccatcctggcacccacaccgtgctttggcggcggggatgctctcaacaagtaagcagcaatgaggacttgccaatctctatggaaaatccctataaggaaccactcaaaaaatgtatcctttgtggtaagcacgttgactacaagaatgtacagctgctgtctcagtttgtgagcccatttactggatgcatctatggccgacacataaccggactgtgcggcaaaaagcagaaggagatcacaaaagcaatcaagagagcccagattatgggatttatgcctgtaacctataaagatcccgcctatctgaaagacccgaaagtttgcaatatccgctatagagaatag

SEQ ID NO: 195444 - DNA, 345 bp, Artificial Sequence
  Description of Artificial Sequence: Synthetic coding sequence
atggccgccgtggtggccgtgtgcggcggcctgggccggaagaagttgacacatctggtgactgcggccgtgagtttgacccacccagggacgcatacagtcctatggaggcgggggtgcagtcaacaagtatctagtaatgaggacttgttactctcccagttcgtgagccctttcaccggctgtatctacggtcgacatattacgggcctgtgtggcaaaaagcaaaaagaaatcacgaaagcaatcaaacgcgcccagattatggggtttatgcctgtgacctataaggatcctgcctacctgaaagatcccaaagtgtgtaacattcggtatcgggaatag

SEQ ID NO: 195445 - DNA, 891 bp, Artificial Sequence
  Description of Artificial Sequence: Synthetic coding sequence
atggccaccagcagcgccgccctgccccggatcctgggcgccggcgctcgggccccgtcccggtggttggggtttctggggaaagctacccccagacccgcacgcccctctcggagaacactggggagtgctaccgctctcatgattcgcgaaagcgaggatagcacggacttcaatgacaaaatcctgaacgagccacttaaacattctgacttcttcaatgtgaaggaactgttcagcgtgcgcagcctgtttgatgccagagtacaccttgggcataaggctggctgcaggcaccgctttatggagccgtacatcttcggatctaggcttgatcacgatatcatcgatctggaacagaccgcgacacatctgcagctagctctgaatttcaccgcccacatggcttatcgtaagggcatcatcctgtttatctcaagaaatagacaattttcttacttaatagaaaatatggcccgtgattgcggcgagtacgcccacacccgttacttccgcggcgggatgcttacaaacgccagacttctttttggccccacagtaagattaccagatcttattatcttcctccatacccttaataatatcttcgaaccccacgttgcagttagggacgctgccaagatgaatatcccaaccgtcggcatcgtggatacaaactgcaatccatgtctgatcacttatcccgtgcctggcaacgatgatagcccattagccgttcatctatactgccgccttttccaaaccgccattactcgtgctaaggaaaagcgtcagcaggttgaggccttgtacagattacaagggcaaaaagaacctggggatcagggccccgcccatcctccaggcgcagacatgtctcacagtctgtag

SEQ ID NO: 195446 - DNA, 891 bp, Artificial Sequence
  Description of Artificial Sequence: Synthetic coding sequence
atggccaccagcagcgccgccctgccccggatcctgggcgccggcgcccgagccccgtccagatggctggggtttctaggaaaagccacacctaggcctgccaggccgtctaggcgcacgcttggcagcgccaccgccctcatgattcgcgaatctgaggatagcaccgattttaatgataaaatcctcaatgagcctctgaagcacagcgatttcttcaatgtgaaggagctgttcagcgtccggagtctgttcgacgcccgggtgcatctcgggcataaagccgggtgtcggcacaggtttatggagccttatatttttggatctcggctcgatcacgacatcatcgacttggaacaaacggcaacacatctacaactggccttaaacttcacagcccatatggcctaccggaagggaatcatcctcttcatctcaagaaacagacagttcagctatctgatcgagaatatggcccgtgactgtggcgagtacgcgcataccagatacttcagggggggaatgttaaccaatgctcggcttttgttcggccccaccgtgcggctgcccgacctgatcatcttcttacacaccctgaacaatatcttcgagccacacgtcgctgttcgtgatgcagccaagatgaatatcccaactgtgggaattgtcgacacgaattgcaacccatgtctcatcacatatcccgtgcctggtaacgacgactctccactggcagtgcatctttattgccgcctcttccagaccgctattactagggccaaagagaagcgccagcaggtggaggctttgtatcgactccagggacaaaaggaacccggcgaccaggggccagcacacccacctggcgccgatatgagccacagcctgtag

SEQ ID NO: 195447 - DNA, 813 bp, Artificial Sequence
  Description of Artificial Sequence: Synthetic coding sequence
cggcggggccccctgggcatgcggtggggcgccggcgtggtgcactcagggctgggagctagaacaagtatttatttcccacccggagctagggcaccctcccggtggctcggctttctagggaaggcaactccccgcccggcaagaccaagtaggcggactctcgggtccgccaccgcgttgatgattcgtgaatccgaggacagtacagattttaacgataaaatattgaacgaaccccttaagcatagcgactttttcaatgttaaagagctgttctccgtcaggtccttgttcgacgctagagtgcatctcgggcacaaagcaggatgtcgacaccgtttcatggaaccatatatttttggtagtcgccttgatcacgacatcatagatctggaacagacagcaacccacctccagctggccctcaacttcactgctcatatggcctacagaaagggtataatactcttcatctctcgtaaccgacagttttcttatttgattgagaacatggccagagactgtggagaatatgcgcacacccgatactttcgaggggggatgctcacaaacgcccgccttctgtttggccccaccgtacggcttcccgatctcattatcttcctgcatacgctgaacaatatattcgagcctcacgtggctgtgagggacgctgccaagatgaacatcccaaccgtagggatagtggataccaattgcaacccttgcctcatcacataccctgtgcctgggaatgatgactccccactggccgttcatctctactgccgcctattccaaactgcatag

SEQ ID NO: 195448 - DNA, 264 bp, Artificial Sequence
  Description of Artificial Sequence: Synthetic coding sequence
atggccaagcacctgaagttcatcgcccggaccgtgatggtgcaggagggcaacgtggaatccgcttataggacactgaacaggatactcacaatggatggactcattgaggacataaagcaccgcagatattatgagaagccttgcagaagacggcagagagagtcctacgaaagatgcaggagaatttataacatggaaatggcaagaaaaatcaatttcttgatgcggaagaaccgcgcagacccctggcaaggatgctag

SEQ ID NO: 195449 - DNA, 264 bp, Artificial Sequence
  Description of Artificial Sequence: Synthetic coding sequence
atggccaagcacctgaagttcatcgcccggaccgtgatggtgcaggagggaaatgtggaatcagcttaccgaaccctgaatagaatactcacaatggatgggctgatcgaagatatcaagcaccgccgttactatgaaaaaccttgcagacgcaggcagcgggagtcttacgaacgatgtcgacggatatacaatatggaaatggcgagaaaaataaacttcctcatgcgcaagaatagagccgacccttggcagggctgttag

SEQ ID NO: 195450 - DNA, 1083 bp, Artificial Sequence
  Description of Artificial Sequence: Synthetic coding sequence
atggcccccctgggcaccaccgtgctgctgtggagcctgctgcggtccagtcccggagtagagcgggtgtgctttcgagcccggattcagccttggcatggaggtctgttgcagcctctgccatgtagctttgagatgggcctgcctagacgacgcttcagttccgaggctgcggagtccggcagcccagagaccaagaagcctactttcatggacgaggaggtgcagagcattctgaccaagatgaccggcctgaacctgcaaaagacctttaaacccgccattcaggaacttaagccccccacttataagctcatgacccaggcccaacttgaagaggcaacaaggcaggcagtggaagcagctaaagtgaggttgaaaatgcccccagtcctcgaagaacgggtacctatcaatgacgtgcttgcagaagataaaatactcgaaggtactgagactactaagtatgtctttaccgatatatcgtatagtatccctcaccgagaacgttttatcgttgtccgggagccgagcggcacactacgtaaggccagctgggaagagcgggacaggatgatccaggtgtactttcccaaggaggggaggaaaatactaacccccatcatttttaaggaggaaaacctacgaaccatgtactcacaggaccgtcatgttgatgttttgaatctgtgttttgcacagttcgaacctgacagtaccgaatacatcaaagtgcatcacaagacctatgaggatatagacaaacgtggcaagtatgacctgctcagatccacgagatattttggtggaatggtatggtatttcgtgaacaacaaaaagattgacggactactcattgatcaaattcaacgggacctcatagacgacgcgacaaatcttgttcagctgtaccacgtgctgcaccctgacggccaatccgcgcaaggcgctaaggaccaggcagctgaaggcatcaatttgataaaagtgtttgccaagacagaggctcagaagggggcctatatagaattgaccctccaaacataccaggaggccctgtcccgacactccgccgcttcgtag

SEQ ID NO: 195451 - DNA, 1080 bp, Artificial Sequence
  Description of Artificial Sequence: Synthetic coding sequence
atggcccccctgggcaccaccgtgctgctgtggagcctgctgcggagttccccgggcgtggagagagtgtgtttccgtgctcggatacagccatggcatggcggcttactgcaaccgctcccatgctcttttgaaatgggactgcctagaaggcgcttctcctctgaggccgaatcaggaagtcctgaaaccaaaaagcccacattcatggatgaggaggtacaatctattctaactaagatgacaggtttgaacctacagaagacattcaaacccgcaattcaagagctgaaaccccccacatacaagctgatgacccaggcacagttggaagaagctacgcgtcaggcagttgaagctgccaaggttcggttaaaaatgcctcctgtgctcgaagaaagagtccccattaatgacgtgctggccgaggataagatcctggagggcaccgagactaccaaatacgtgtttacagacatatcatactccatcccacaccgggagcgattcatcgttgttcgggaaccctccggtactcttcggaaggcgtcatgggaggagcgggatcgcatgatacaggtgtacttcccaaaggaggggcgcaaaattcttacccctattatcttcaaggaagaaaacctgaggacaatgtattcccaggacaggcacgtagacgtgctgaatctgtgtttcgcgcagtttgaaccagactctaccgagtacatcaaggtgcaccataagacttatgaggatatcgacaaaagaggaaagtatgatctgttgcggagtacccgttattttggaggcatggtgtggtattttgtgaacaacaagaaaatcgacgggttacttatagatcagattcagcgggatctgatcgatgatgctaccaatcttgtccagctgtaccacgttctccacccagacggtcaaagtgcccagggagcgaaggaccaggcggcagaaggtatcaacctgatcaaggtttttgccaagactgaggcacagaagggcgcgtacatcgagctgactctccagacgtaccaggaagcactctccaggcatagtgccgcgtcctag

SEQ ID NO: 195452 - DNA, 960 bp, Artificial Sequence
  Description of Artificial Sequence: Synthetic coding sequence
atgagccggaacgagaccgagcaccggtacctgggcacccacttcggcgcagagagtggaagtccagagaccaaaaagccgacctttatggatgaggaagtccagtctatcttaacaaagatgacgggcctgaatctgcagaagactttcaaacccgcgatccaagagttgaagccacctacctacaaactgatgacacaggcccaactggaggaggcgacaagacaggcagtagaggctgccaaggtacggctgaaaatgccccccgttctcgaagagagagtgcctatcaatgatgtcctcgccgaggataagatacttgaagggactgagaccacgaagtatgtattcacagacatcagctactccatcccccaccgtgagcggttcattgttgttcgggagccgtctgggactctgaggaaagcttcctgggaagagcgtgatcgtatgatacaggtgtatttccctaaggaaggccggaagatcttaacccccatcatcttcaaggaggaaaaccttaggacgatgtattctcaggacaggcacgtggatgtgctcaacctctgttttgcccagtttgaaccggactccactgagtacatcaaggtccaccacaaaacatacgaggacattgacaaacggggaaaatacgatttgcttcgctctactcggtactttggaggcatggtgtggtactttgtaaacaacaaaaaaatcgacggtctgttgattgatcaaatacagcgagaccttatcgacgacgctaccaacttggtgcaactttatcacgtactgcaccccgacgggcagtctgcccaaggagccaaggaccaggccgccgaggggattaatctgattaaagtgttcgctaaaaccgaggcccagaaaggagcctacatcgagctgacactccagacctaccaggaggctctttctaggcacagcgcggcatcatag

SEQ ID NO: 195453 - DNA, 1083 bp, Artificial Sequence
  Description of Artificial Sequence: Synthetic coding sequence
atggcccccctgggcaccaccgtgctgctgtggagcctgctgcggagctctcccggggtcgaaagagtatgctttcgcgccaggatccagccatggcacggaggcctgttgcagcccctgccgtgttctttcgagatggggttacctaggagacgattctcgtccgaggcagccgagagtggcagtccggagactaagaagcccacattcatggacgaagaggtccagagcattctgactaagatgacagggctgaacctccaaaagacattcaaaccggctatccaggagctaaaacctccaacatacaaactgatgacccaggcacagctcgaggaagcaacacgtcaggcagtggaggccgctaaagttcgactgaagatgcctccggttctggaggaacgagtaccaattaacgacgtgctggctgaagacaaaattctggagggaaccgagaccacgaagtatgtctttaccgacataagttactccattccccatcgagaaaggttcatcgttgtacgagaacctagcgggacgcttcgaaaagcctcttgggaggaacgggacaggatgatccaggtgtactttcccaaagaagggcggaaaattctcacgcccattatttttaaggaggaaaatttgcgtaccatgtactcacaggaccgacacgtggacgtgctgaacttgtgcttcgcccagttcgagcccgacagcactgagtacatcaaggtacaccacaaaacatacgaagatatcgacaagcgtggcaaatacgatctgcttaggagtacacgatactttggagggatggtctggtactttgtgaacaataaaaagatcgatggcctgttgatagatcaaattcagagagacctgattgatgacgcaacaaatctggttcagctttatcacgtgctgcacccagatggtcagtctgcgcaaggagccaaagatcaagctgctgaggggattaatctgattaaggtattcgccaagaccgaggctcaaaaaggcgcatatatcgagctgacactgcaaacctatcaggaagcactgtcgcggcacagcgctgcctcatag

SEQ ID NO: 195454 - DNA, 507 bp, Artificial Sequence
  Description of Artificial Sequence: Synthetic coding sequence
atggcccccctgggcaccaccgtgctgctgtggagcctgctgcggtccagtcccggtgttgaaagggtgtgctttagggcacggattcagccatggcacgggggcctgcttcagccacttccttgtagtttcgagatggggctgccgcgaagaagattctccagtgaggctgaaagtggcagccccgaaacaaaaaagcccacatttatggacgaggaggtgcaatccattctcaccaaaatgacaggacttaatctccagaaaacctttaagcccgccatccaagagctaaagccccccacatataaactcatgactcaggcccagctcgaggaggccacccggcaggccgttgaagctgcgaaggtgaggctgaaaatgcctccagttctagaagagagggttccaattaatgatgtgttggctgaggacaagatcctagaaggcacggagactacaaagtacgtcttcacagatatcagctattccattccgcacagatgctag

SEQ ID NO: 195455 - DNA, 573 bp, Artificial Sequence
  Description of Artificial Sequence: Synthetic coding sequence
atggccggcagccggctggagaccgtgggcagcatcttcagccggacccgcgacttggtgagagccggtgtcttaaaggagaaacctctgtggtttgatgtgtacgatgcgttccccccgctacgagagcctgtttttcaacgtccgagagttcgttacggaaaggcgaaagcacctatacaggacatctggtaccacgaagacagaataagggctaaattctactcagtttacggctcaggtcaaagggcttttgatctattcaacccaaactttaagtcaacctgtcagcggtttgttgaaaagtatactgagctccagaagctgggtgagactgatgaggaaaagctgttcgttgagaccggaaaggcattgctcgccgagggtgtgatcctccggcgggtaggcgaggctagaacgcaacacggcgggagtcacgtctctcgcaaaagtgaacacttgagcgtaaggccacagactgcacttgaggaaaatgagactcagaaagaagttccccaagaccagcatttagaagctcccgccgatcagtccaagggactgctgccgccatag

SEQ ID NO: 195456 - DNA, 504 bp, Artificial Sequence
  Description of Artificial Sequence: Synthetic coding sequence
atggccgccagcgtgtgcagcggcctgctgggcccccgggtgctgtcctggtctagggagctgccttgtgcctggcgtgctttgcacactagtcccgtgtgtgctaagaaccgagccgctcgggtcagggtcagcaagggcgataaacccgtgacctatgaagaggctcacgctccccattatattgcccatcgaaagggctggttgtctcttcacacagggaacctcgacggtgaagaccacgcagcagaaaggaccgtcgaggatgtatttctccgtaagttcatgtgggggaccttccctggatgtctggcagatcaactcgtgctcaaaaggcgtgggaaccagttggaaatttgtgctgtagtgcttcggcagctttcccctcacaagtattattttttggtgggctacagtgagaccctactgagttacttctataagtgtcctgtgcgccttcatctacaaaccgtaccctccaaagtggtctataagtatctctag

SEQ ID NO: 195457 - DNA, 522 bp, Artificial Sequence
  Description of Artificial Sequence: Synthetic coding sequence
atgcccatgaagggccggttccccatccggcggaccctgcagtacctctctcagggcaatgttgtctttaaagattccgtgaaagtaatgactgttaactataacacccacggggaactgggagaaggggcacgtaaatttgtcttctttaacatccctcaaattcagtacaagaacccctgggttcaaatcatgatgtttaagaatatgacacccagcccttttctacgcttttacctcgattccggcgagcaggtgttagtcgatgttgaaaccaagagcaacaaggagattatggaacacattagaaagatcttgggcaaaaacgaggagaccctcagagaggaggaggaggaaaaaaagcagcttagtcatcccgcaaatttcgggcctcgcaaatattgccttagggagtgtatctgtgaggtggagggccaggtgccctgtccgagccttgtcccacttcctaaagaaatgcgtggtaagtacaaggccgccttgaaggccgatgctcaggattag

SEQ ID NO: 195458 - DNA, 333 bp, Artificial Sequence
  Description of Artificial Sequence: Synthetic coding sequence
atgcccatgaagggccggttccccatccggcggaccctgcagtacctgagtcaggggaatgtggtgttcaaagattccgtgaaagttatgacagtcaattacaatactcacggagagctgggcgaaggtgctcgaaaattcgtttttttcaacatacctcagatccaatataagaatccttgggttcagattatgatgtttaaaaacatgacccccagcccatttttgagattttatctcgattcgggggaacaggtgctggtagacgtcgagacaaaaagtaacaaagagataatggagcacatccggaaaattctgggcaagaacgagtag

SEQ ID NO: 195459 - DNA, 390 bp, Artificial Sequence
  Description of Artificial Sequence: Synthetic coding sequence
atgcccatgaagggccggttccccatccggcggaccctgcagtacttgtctcaggggaatgttgttttcaaggactctgtgaaggtcatgaccgttaattataacacgcatggcgagttgggagagggcgcccggaagtttgtttttttcaatatcccccaaattcagtataaaaacccgtgggtccagataatgatgtttaagaacatgaccccatcgccatttctccggttctatcttgggaaaccaagtggtaaacggcgacgccgcaagtcctctttcctaacacaacccacgtccgccctggaaagcactgcttgtggcagcgcatcagtgaaatggaaagggcgctgtcctgctcccgcatggtgccactaccctcgtcgatag

SEQ ID NO: 195460 - DNA, 333 bp, Artificial Sequence
  Description of Artificial Sequence: Synthetic coding sequence
atgcccatgaagggccggttccccatccggcggaccctgcagtacctgagtcagggtaatgtggtcttcaaggatagtgttaaagtgatgactgtgaattacaacacccacggagagttaggcgaaggggcgcgcaagtttgtctttttcaacattccccagattcagtataagaatccctgggtgcagatcatgatgtttaagaatatgacaccctcccccttccttcgcttttatctcgattccggtgagcaagtactcgtggatgtagagacaaaaagcaataaggagatcatggaacacatccgtaagatcctgggaaaaaatgaatag

SEQ ID NO: 195461 - DNA, 438 bp, Artificial Sequence
  Description of Artificial Sequence: Synthetic coding sequence
atgcccatgaagggccggttccccatccggcggaccctgcagtacctgtcccagggtaacgtggtgtttaaagatagcgtgaaggtgatgactgttaattacaacactcatggcgaacttggcgagggggccaggaaatttgtgttctttaatatcccccagatccaatacaagaacccgtgggtgcagattatgatgtttaaaaacatgacaccttcacccttcctgaggttctacctggactccggcgaacaggtcctcgtagacgttgaaactaaatcaaacaaagagattatggagcacatacgcaaaatactcgggaagaacgaacattacctcgccgcccctagtaaacccgtgtcatccgcagtggtgcccgtcacccaggaagcggaggctggaggcagcctcgagccacgcagactgagactcgaatag

SEQ ID NO: 195462 - DNA, 618 bp, Artificial Sequence
  Description of Artificial Sequence: Synthetic coding sequence
atgctgcgggccctgagccggctgggcgccggcaccccctgccggcctcgtgcacccctggtcttacccgccagggggagaaagaccagacacgacccattagccaagtctaagatcgagcgggtgaatatgcctccggccgtagacccagctgagttttttgtgctcatggaacggtaccaacattacagacagacagtgagagctttaagaatggagttcgtgagcgaggtgcagaggaaagttcacgaggcaagagctggcgtgttggctgaaaggaaagcactcaaagatgccgcggagcaccgcgaactaatggcttggaaccaggccgagaatcggcgactacatgagctccgcatagcgcgcctgaggcaggaggagagggaacaggagcaacgacaggccctggaacaggcccggaaagccgaagaggtccaagcctgggcccagaggaaagaaagggaagtcctccagctgcaagaggaggtaaagaatttcattaccagggaaaatttggaggcaagggtcgaggcggctctggactcacggaagaactacaattgggcgatcacaagagagggtctggttgtgcgaccccagcggcgtgattcatag

SEQ ID NO: 195463 - DNA, 1245 bp, Artificial Sequence
  Description of Artificial Sequence: Synthetic coding sequence
atggccgccagcatcgtgcggcggggcatgctgctggcccggcaggttgttctgccacagctttctccagccggcaagcgctatttgctgagctctgcctacgtagattcccacaaatgggaggcacgagagaaagagcactactgcttggctgatctggccagccttatggataagactttcgagcggaaactgccggtaagctctctaaccatcagcaggctgatcgataatatatccagcagagaggagatagaccatgccgaatattatttatataaatttagacattcaccaaattgttggtacctgcggaattggaccattcatacttggataagacagtgcctgaagtatgatgcgcaggataaagcattgtacacccttgtgaacaaagtgcaatatggaatttttccagacaactttacctttaacttacttatggattctttcatcaagaaagagaactacaaagatgccctctcagtggtgttcgaggtcatgatgcaagaagcatttgaggtgccttccacccagttgctctctctttacgtcctttttcactgtctggccaaaaagaccgacttttcatgggaggaggaaaggaactttggcgctagtctgctcctcccagggctgaaacaaaagaattccgtaggattctcatctcagctatatggttatgcactgctcggcaaagtcgagctacagcaaggcctgcgggctgtttaccataacatgccgctaatttggaaaccgggttacctggatagagctctgcaggtgatggaaaaggtggccgcatcccctgaggatattaagctgtgcagggaggctctagacgttctgggagccgtgctaaaggcactgacttccgctgacggcgcctctgaggagcaaagtcagaatgacgaggacaatcaggggagcgaaaaactcgtagaacagctggacattgaagagacagagcagagcaagttgccacaatacctcgagcgcttcaaagccctccatagcaaactgcaagcacttggtaaaatcgaatctgaggggctcctcagcctgaccacccagctcgttaaagagaaactgtccacatgcgaggcagaagacatcgctacctatgagcagaatcttcagcagtggcatttggacttggttcagctcatccagagggagcaacagcagcgagaacaggcaaagcaggagtatcaagcccagaaagccgcaaaagcttccgcctag

SEQ ID NO: 195464 - DNA, 1077 bp, Artificial Sequence
  Description of Artificial Sequence: Synthetic coding sequence
atggacaagaccttcgagcggaagctgcccgtgagcagcctgaccattagcagattgatcgacaacatctcgtctagggaagaaattgatcacgcagagtactacctgtataagttcagacatagtcccaactgctggtacctaagaaactggaccatacacacctggattagacagtgcctgaagtacgacgcccaggacaaagcactgtacacactcgtgaacaaggtgcagtacggcatatttcccgataatttcaccttcaatcttctgatggatagctttataaagaaggaaaactacaaggatgcactgagtgtggtgtttgaggtaatgatgcaagaggcctttgaggtgccctcaacccagctcctgagtctctatgttctcttccattgcctggcaaagaaaaccgacttcagttgggaggaggaacgcaattttggggctagcctccttcttcccgggctgaagcaaaagaactctgtagggttttcgtctcaactgtacggctacgctctactgggcaaggtggagctccagcaggggttgcgtgcagtatatcacaatatgcccctgatttggaaacctggctatcttgaccgggcccttcaggtgatggaaaaggtggccgcctctccagaagacattaagctctgcagagaagccctggatgtcctgggtgccgtcctgaaggcattgactagcgccgacggggctagcgaggaacagtcccagaacgatgaggataaccagggcagcgaaaaacttgtcgaacagcttgacatagaggaaaccgagcagtcaaaactgcctcagtacctggagcgctttaaggctctccatagtaaactgcaggccctgggaaagatagagagcgagggcctgctcagtcttactacccagttagtgaaggaaaagctctccacatgcgaggccgaggatattgctacatatgaacagaacctccagcaatggcatctggacctggttcagctgatacagcgcgaacagcagcagagagaacaggccaaacaggaatatcaggcacagaaggcagctaaggcttcggcctag

SEQ ID NO: 195465 - DNA, 1287 bp, Artificial Sequence
  Description of Artificial Sequence: Synthetic coding sequence
atggccgccagcatcgtgcggcggggcatgctgctggcccggcaggtggtgcttccccaattgtctcccgccggcaaaaggtatctcctgagctcagcctacgtggatagccataaatgggaggcccgggagaaagaacattactgcctggccgatttggcctcactgatggacaagaccttcgaacgcaaactccctgtgtcgagccttaccatttccaggctaatagacaacatttcttcacgtgaagaaatcgatcatgccgaatattatctctataaaaaaggtgagtgctccagcagcaatccacagaactattctagattcaggcacagccctaactgttggtacttacgaaattggactatccatacatggattcggcagtgccttaaatatgatgcccaagataaggcgctatacactctggtgaacaaagttcagtatgggattttccccgataattttacttttaatttattaatggactcttttatcaaaaaagagaactacaaggacgctctttcagtcgtctttgaagtaatgatgcaggaggctttcgaagtgccatccacccagctgctcagtctgtatgtcctctttcactgtctcgctaaaaagactgacttctcatgggaggaggagcggaattttggcgctagcctacttctgccagggctaaaacagaaaaactcggtagggttctcatctcagttgtatggctatgcgctcttagggaaggtcgagctacaacaggggctcagggccgtttatcacaatatgcctcttatctggaaaccaggctacttggatagggctctgcaggtaatggaaaaagtggctgcctctccagaagacatcaaactgtgcagagaagccttagatgttctgggcgcagtccttaaagctctgaccagcgctgacggagcttctgaggaacagtcccaaaacgatgaagacaaccagggatccgaaaagttggtcgagcagttggacatcgaggagacggagcagtctaagttgccccagtatctcgagcgttttaaagctctacactcaaagctccaggccttaggcaagattgaatctgaggggctgttatctctcactacgcaactggtaaaagagaagcttagcacgtgtgaggctgaagatatcgccacctacgaacagaaccttcagcagtggcatctggatctggtccagctgattcaaagggaacagcaacagcgagagcaggctaagcaggaatatcaggcacaaaaagccgccaaagcctcagcatag

SEQ ID NO: 195466 - DNA, 564 bp, Artificial Sequence
  Description of Artificial Sequence: Synthetic coding sequence
atggccgccctgtgccggacccgggccgtggccgccgagagccacttcctccgagtcttcctattcttcagaccttttcggggtgtcgggactgagagcggtagcgagtctgggtcatcgaatgcaaaggaacctaagacccgtgctggcgggttcgcaagcgcattggagcgtcactcagagttgctgcagaaagtggagcctctccaaaaaggtagtcctaaaaacgtggaatctttcgcgagcatgctgaggcattcccctctgactcagatggggcctgccaaggataaactggtgatcggtcggatattccatattgtagaaaatgatctttatatcgactttggtgggaaattccattgcgtatgccgtaggccggaggtggacggtgaaaaataccaaaaaggtaccagagtgaggttgagactgctggacctggagttgacgtctaggttcctcggcgccactacagataccaccgtcctagaggctaatgctgtgctgttggggattcaggagtctaaggatagcagaagtaaggaagaacaccacgagaaatag

SEQ ID NO: 195467 - DNA, 1320 bp, Artificial Sequence
  Description of Artificial Sequence: Synthetic coding sequence
atggccgccgcccggtgctggcggcccctgctgcggggcccccggctgtccctgcacacagccgcaaatgcggctgctactgccactgagaccacatgtcaggacgttgccgccacgcctgtggccaggtacccccccatcgtcgcctccatgactgcggactccaaagccgctcgtctcaggaggatcgagagatggcaagcgaccgtgcatgcggctgaaagcgtggacgagaaactgcgcattttgaccaagatgcaattcatgaaatatatggtctacccccagacgttcgcccttaatgccgaccgatggtaccagtattttacaaagaccgtctttcttagcgggctgccaccccctcctgccgagccagagccagaacctgagcctgagccagaacccgcgcttgatctggccgcattacgagccgtagcctgtgattgtctgttacaagaacacttctacctgagaaggagaagacgagtacacagatacgaggagagtgaggtgatttccttgccctttcttgatcagctggtaagtacgcttgtggggttactcagcccccacaatcccgctctggctgccgcggcacttgattaccggtgtcccgtgcacttctattgggtcagaggagaggaaattatcccccgaggacaccgcaggggaagaatcgacgatttgagatatcagatcgatgacaagccaaacaatcaaatccggatttcgaaacagctcgccgagtttgtgcccctggactacagcgtccccatagaaattcccactattaaatgtaaaccggacaaactgccgttgttcaaaagacaatacgagaaccatatcttcgtgggcagtaagaccgcggatccatgttgttatggccacacccagtttcatttgcttccagacaagctgcgccgggagaggctgttgcggcagaactgtgccgaccagatcgaagtggtgttccgcgctaatgccatcgctagcctttttgcctggactggagcacaggccatgtatcagggcttctggtctgaggccgacgtaacaaggccattcgtttcccaggctgttataacagatgggaagtatttctcatttttctgctaccagttgaatactctggccctcacaacccaggcagaccaaaacaacccgaggaagaatatctgctggggaacgcaatctaaaccgctttacgagacgattgaggacaatgacgtcaaaggcttcaatgacgatgttctgctgcagattgttcacttcctcctaaatagacctaaagaggaaaaatctcagcttctcgagaactag

SEQ ID NO: 195468 - DNA, 1188 bp, Artificial Sequence
  Description of Artificial Sequence: Synthetic coding sequence
atgttcccccgggtgagcaccttcctgcccctgcggcccctgagccgacaccccctgtcaagtgggtccccagagactagcgcggcggccataatgctcttgacagtccggcacggtacggtccggtatcggtcttctgcactgttagcacgcactaaaaataatatacagagatacttcggaactaactctgttatctgcagcaaaaaagataagcagtcggtacggaccgaggaaacatcaaaagaaacctctgagagccaggatagtgagaaagagaataccaagaaggatttactcggaatcattaagggcatgaaagtggaactttccacggtgaatgtcaggaccaccaaaccgcccaaacgccgccctctaaaatccctggaagcaacattgggtcgcttgagacgggccaccgaatatgctcccaaaaaacggatcgagccactctcaccagagctcgtcgccgccgcttccgctgtagccgactcccttccgttcgataaacagaccacaaaatctgaactgctgtctcagctccagcagcatgaggaggaaagccgtgcgcagcgggatgcgaagcgtcccaagatatcgttttccaatataatcagtgacatgaaggttgcaaggtccgccacagcgagggtgcggtcacggcctgagcttaggatccagttcgacgaggggtatgacaattatcctggacaggaaaaaacggacgatctgaaaaaaagaaagaatatctttactggcaaacggcttaatattttcgatatgatggctgtcacaaaggaagcccctgagacagacactagcccgtctctgtgggatgttgagtttgccaagcagttggctaccgtgaatgaacagccacttcagaacggctttgaagagcttatccagtggaccaaggaaggaaagctctgggaattccctattaacaacgaggcaggatttgacgacgacggatccgagtttcatgaacatatttttctggaaaaacacctagagtccttcccgaagcaggggccaatccgccacttcatggaactagtcacatgtgggttgtccaaaaacccttatctttctgttaaacagaaggttgagcacatcgagtggttccgtaattacttcaatgaaaagaaagacatactgaaagagagtaatatacagtttaattag

SEQ ID NO: 195469 - DNA, 321 bp, Artificial Sequence
  Description of Artificial Sequence: Synthetic coding sequence
atgagcagcctgagcgagtacgccttccggatgagccggctgagcgcccgattgttcggggaagtcactcggcccactaacagtaagagtatgaaagttgtgaagctgttttcggaactgcccttagccaagaaaaaagaaacctatgactggtacccgaaccatcatacctatgcggagctgatgcagaccttgagatttctcggcctgtaccgggatgagcaccaagactttatggacgagcagaagcggctcaagaagctgcgggggaaggaaaagccaaaaaaaggcgaaggaaagagagccgcgaagcggaaatag

SEQ ID NO: 195470 - DNA, 321 bp, Artificial Sequence
  Description of Artificial Sequence: Synthetic coding sequence
atgagcagcctgagcgagtacgccttccggatgagccggctgagcgcaaggctttttggagaggtgacacgcccaactaacagtaagtcaatgaaggtcgtcaagttattcagcgaactacccctcgctaagaagaaagagacttacgactggtaccccaaccatcacacctacgccgagctgatgcagactctgaggtttttaggtctgtatcgggatgagcaccaggacttcatggacgagcagaagaggctgaaaaagttgaggggtaaagaaaagccaaagaagggagaaggcaaacgagcagctaaaagaaaatag

SEQ ID NO: 195471 - DNA, 321 bp, Artificial Sequence
  Description of Artificial Sequence: Synthetic coding sequence
atgagcagcctgagcgagtacgccttccggatgagccggctgagcgcccggctctttggtgaagttacccggcccacaaactcaaaaagcatgaaagtggtaaagctgttcagcgagcttcctctggcaaaaaaaaaggagacatacgactggtatccgaaccatcatacctatgccgagcttatgcaaaccttgaggttcctcgggctgtacagggacgagcaccaggactttatggatgaacagaagcgccttaaaaagttaagaggaaaggaaaaaccaaagaaaggggaggggaaacgtgccgcaaaaaggaagtag

SEQ ID NO: 195472 - DNA, 321 bp, Artificial Sequence
  Description of Artificial Sequence: Synthetic coding sequence
atgagcagcctgagcgagtacgccttccggatgagccggctgagcgcacgtttgttcggagaagtgacgagacctactaattccaagagtatgaaggtcgttaagttgttttccgagctacccctcgccaagaaaaaagagacttatgactggtatcctaatcaccatacgtacgcagagcttatgcagacattgaggtttttagggctgtaccgggacgaacatcaggactttatggacgaacagaagcgattgaaaaaacttagaggcaaagagaagcccaagaagggcgagggcaaacgtgcagccaaacgaaagtag

SEQ ID NO: 195473 - DNA, 339 bp, Artificial Sequence
  Description of Artificial Sequence: Synthetic coding sequence
atgagcagcctgagcgagtacgccttccggatgagccggctgagcgctaggctgttcggcgaagtcaccagaccgaccaatagtaaatctatgaaagttgttaaactgttctcagagctgccccttgctaaaaaaaaggagacctacgactggtacccaaaccatcatacttacgctgagctgatgcagacccttcggtttttagggttgtaccgcgatgagcaccaggacttcatggatgagcagaagagacttaagaagctgcgggggaaagaaaaaccaaagaagggcgagggcaagcgggctgctaagcggaaaaaaaaaaagaaaaaacgttag

SEQ ID NO: 195474 - DNA, 678 bp, Artificial Sequence
  Description of Artificial Sequence: Synthetic coding sequence
atggcccggaagaaggtgcggccccggctgatcgccgagctggccaggagggttagggctttgcgggagcagctaaatcgacctcgcgattcacaattgtacgcggtggattacgaaaccttgacgagaccattcagtggacggcgcttacctgtgagagcctgggccgatgtgcgcagagaaagcaggctgctgcaactgctgggccgcttacctttgtttgggctgggaaggctcgtaaccaggaaatcatggctctggcagcatgatgagccatgctactggcggctgactagggtcaggcccgactataccgcccaaaatctagaccatggcaaagcctggggtatcttgacatttaaagatgcttcgttctcaagctccgggaagacggagtctgaggctagggagattgaacatgttatgtaccacgattggcgcctggtaccgaaacatgaggaggaggcatttaccgcatttacccctgctcctgaggactcgttagcatccgtcccatatcctccattactgcgtgcgatgattatcgctgaacggcagaagaatggcgacacatctaccgaggagcctatgctcaatgtgcagagaatcagaatggagccttgggactatcccgcgaaacaggaagataaaggaagagctaaagggacaccggtgtag

SEQ ID NO: 195475 - DNA, 657 bp, Artificial Sequence
  Description of Artificial Sequence: Synthetic coding sequence
atggcccggaagaaggtgcggccccggctgatcgccgagctggccagaagagtcagagcattgcgagagcaactgaataggccacgagactctcagttatatgcagtcgattatgaaacactgacaagacccttctccggtcgccgcctgcctgtgcgagcttgggctgatgttcgacgcgagtcccggctactgcaactgctggggcgcctgcccctgttcgggttaggaagacttgtaacccgtaaaagctggctttggcagcatgacgagccatgctattggcggctgaccagggtgagacctgactacacagcacagaacctcgatcatgggaaggcctggggtattttgacctttaagggaaaaacagaatctgaggctcgggaaattgagcatgtgatgtaccacgattggcgactggtgcctaagcatgaggaggaggcttttacggccttcacacctgcaccagaggatagtcttgcatccgtgccgtatccgccactccttcgtgccatgatcatcgcagaaaggcaaaaaaacggtgatacgtctaccgaagaacctatgctgaacgtccagaggattcggatggagccctgggattacccggctaaacaggaggacaaaggacgggccaaaggcaccccagtctag

SEQ ID NO: 195476 - DNA, 972 bp, Artificial Sequence
  Description of Artificial Sequence: Synthetic coding sequence
atggccgccgccgccctgcccgcctggctgagcctgcagagccgggcacgtacgctgagagctttcagtacggctgtatatagcgcaacgccagtgccgacacctagcttaccagagagaacgcctggcaatgagcggccccctcggcggaaagccctccctccacgaaccgagaaaatggctgtggatcaggactggccttctgtgtaccccgtcgctgccccattcaaacctagcgcagtcccattgccagtgaggatgggatatccagtgaagaagggggtgcctatggccaaggagggtaacctggagcttctgaaaatacccaactttctccacctgacacccgtcgcaataaaaaaacactgtgaggcccttaaagacttttgcaccgagtggcccgctgccttggactccgacgaaaagtgtgaaaagcacttcccgatcgagattgactctacagactacgtatctagtgggcccagcgtgcgaaacccacgggcgcgggtggtggtgctgagggtgaaactgagttctttgaacctggatgaccatgcaaagaaaaagctgattaaactggtgggggaacgctattgcaaaaccacagatgtccttaccataaaaaccgataggtgtcctcttaggcggcagaattatgattacgcagtatacttgctgaccgtattgtaccacgagtcctggaacactgaggaatgggagaaatccaagactgaggctgacatggaggagtatatctgggaaaatagcagctccgaacgcaatatcttggaaacgctcttacagatgaaggccgcagagaagaacatggagatcaacaaagaagagctgttgggcacaaaggagattgaagagtataagaaatcagtcgtctcattgaagaatgaggaggaaaacgagaactcaattagccagtataaagaatccgtcaaaaggctcctaaacgttacctag

SEQ ID NO: 195477 - DNA, 864 bp, Artificial Sequence
  Description of Artificial Sequence: Synthetic coding sequence
atggccgccgccgccctgcccgcctggctgagcctgcagagccgggcacgcacactgcgggctttttccaccgccgtttattcagcaacacctgttcctacacccagcctgcccgagaggacaccgggtaacgagcggcctcctagaaggaaggcactaccacctagaacggaaaagatggcagttgaccaggactggcctagtgtctatcccgttgctgcacccttcaaaccatcagcagtccccctgccagttcgtatgggatatcctgtgaagaagggtgtccctatggctaaagagggaaacttagagctgctgaaaatccctaatttccttcatctgactcccgtagccattaagaaacattgtgaggcactgaaagacttctgtacagagtggccagctgcactcgactctgatgagaagtgcgaaaagcactttccgatagaaatcgactccactgactatgtcagttccggaccaagtgtaaggaatcctagggctcgggttgtagttctgcgcaggtgcccattacgaaggcagaattatgattatgccgtttacctgcttactgtactgtaccacgaaagctggaataccgaggaatgggagaagtccaagacggaggcagatatggaagagtacatctgggaaaactcctcctctgaacgtaacattttggaaacactcctgcagatgaaagccgcagagaaaaatatggaaatcaacaaggaagagttgctcgggaccaaggaaatcgaagaatataagaagagtgtggtgtctctgaagaatgaggaggagaatgagaactctatcagtcaatataaggaaagcgtcaaacgcctgctcaacgtcacatag

SEQ ID NO: 195478 - DNA, 585 bp, Artificial Sequence
  Description of Artificial Sequence: Synthetic coding sequence
atggccgccgccgccctgcccgcctggctgagcctgcagagccgggcccggacgttgcgggcatttagcaccgccgtttacagcgcaacacctgtacctactccttctctgcccgagcgtacaccaggaaacgagcgcccccctaggaggaaagcccttccacccaggactgagaaaatggccgttgatcaagactggccgtctgtatatcctgtcgccgccccctttaaaccatccgccgttcctctccccgtgagaatgggctatcctgttaagaaaggggtgccaatggctaaggaaggaaatctagagttgcttaaaataccaaattttctacacctgacacctgttgctataaagaaacattgcgaagctctgaaggacttttgtaccgaatggcccgcggcactggactcagacgaaaagtgcgagaaacacttccccatcgaaatcgacagcacagattacgtatctagcggtccaagcgtgcgtaatcccagggcgcgggtagtcgtcttgagggtgcctttcaaggaagctgagctgaggctttgctcagtatccacaaatagcgttataccttag

SEQ ID NO: 195479 - DNA, 312 bp, Artificial Sequence
  Description of Artificial Sequence: Synthetic coding sequence
atgatgggcagcaagatggccagcgccagccgggtggtgcaggtggtgaaaccacatacccctctgatccgctttccggatcgacgagacaatccaaaacctaacgtgtctgaagccctcagaagcgctggactgccgtcccactcctctgttatttcgcagcacagcaaggggtccaaatctccagatctgctgatgtaccagggtccgccagacacagctgaaataatcaaaacgcttccacagaaataccgcaggaaacttgtgtcccaggaggagatggaatttatccagagaggcgggcccgaatag

SEQ ID NO: 195480 - DNA, 1293 bp, Artificial Sequence
  Description of Artificial Sequence: Synthetic coding sequence
atggccaccgccgtgcgggccgtgggctgcctgcccgtgctgtgctcaggcaccgcgggtcatctgcttggaagacaatgtagcctcaacactctacctgccgcctcaatcctggcctggaaatcagttctgggaaacggccatttaagctcactgggcacgagagacactcacccctacgcttcccttagtcgcgccctgcagacacaatgctgcatcagcagccccagtcacttgatgagccagcagtaccggccttacagcttcttcaccaaactcaccgctgacgaactttggaagggcgccttggccgagactggggcaggcgccaaaaagggacggggcaagcggacaaaaaaaaagaaaagaaaggacctcaatagaggccagataatcggcgagggtaggtacggcttcctgtggcccgggctgaacgtgcccctcatgaagaacggagctgtgcagactatagcccagcgctccaaggaggaacaggagaaggtggaggcagatatgatccagcaacgcgaggagtgggaccgtaagaagaagatgaaagtaaagagagaacggggttggtctggaaactcctggggtggaatctcccttggacctcctgatcctggcccatgcggcgaaacctacgaagactttgatacacgtattcttgaggtaagaaacgtgttcactatgactgcaaaggaggggagaaaaaagtcgatccgggtgctggtggctgtcgggaacgggaagggagcagccggtttcagtattggtaaagctactgacaggatggacgcgttccggaaggcaaaaaatagggctgtgcatcatctgcactacattgagaggtacgaagaccatactattttccacgatatttctctgcggttcaaaaggactcacattaagatgaagaaacagcctaaagggtacgggttaagatgccacagggccatcatcaccatctgtaggctgattggaatcaaggacatgtacgccaaagtgagtggcagcatcaatatgctgtctttaacacaaggtctgttcaggggattgagccggcaggagacacatcagcaactagcggataagaagggcctgcacgtggtagagattcgggaggagtgtgggccattgcctattgtggttgcttcgccccgcggtcccttgcgtaaggaccccgagccagaagatgaagtccccgacgtcaaattagactgggaagacgtcaagacagctcaaggtatgaagcgctcagtttggtccaatctaaagcgggccgctacctag

SEQ ID NO: 195481 - DNA, 378 bp, Artificial Sequence
  Description of Artificial Sequence: Synthetic coding sequence
atgccccggtacgagctggccctgatcctgaaggccatgcagcggcccgagaccgcggctacgctcaaaagaactatcgaggctctgatggatcgaggcgcaattgtccgggatctcgagaatttaggagagagggccctcccctaccggatctccgcccatagccagcagcacaaccggggcggctactttctggtcgatttctatgcccccactgctgcagtggaaagcatggtggagcacctcagccgggacatcgacgtgattcgagggaatatcgtgaagcaccctctgacccaggagctgaaggaatgtgaaggcatagtgccggtccctctggccgagaagctttactcgacgaagaagcggaaaaaatag

SEQ ID NO: 195482 - DNA, 729 bp, Artificial Sequence
  Description of Artificial Sequence: Synthetic coding sequence
atggccgcccccgccgtgaaggtggcccggggctggagcggcctggctttaggggtgcgtcgggctgtcttacagttacccggtttgacgcaggttcggtggagcagatactcacctgaatttaaagacccgctgatcgataaggaatactaccggaagcccgtagaggagctgaccgaggaagaaaagtacgtgagagagctgaagaaaacccagctgattaaggccgcaccagccggcaaaaccagtagtgtcttcgaagaccccgttatcagcaaatttacgaatatgatgatgattggcggaaataaagttctggcccgctcgttaatgatccagactctcgaggccgtcaaaaggaaacaattcgagaagtatcacgcagcaagcgctgaggagcaggcgactatcgaaagaaatccctatacaatttttcaccaggcgctgaagaactgcgaacccatgattggtctagtccccatactcaagggcgggcggttctaccaggtgcctgtcccacttccagaccgcaggcggagatttttagctatgaagtggatgatcacagagtgcagagataagaaacaccagcgtaccttgatgccggaaaaactcagccacaaacttctcgaagcgtttcataatcaaggacccgtgatcaaacggaagcatgatctgcataagatggccgaagctaacagagcgctggcccactacaggtggtggtag

SEQ ID NO: 195483 - DNA, 1191 bp, Artificial Sequence
  Description of Artificial Sequence: Synthetic coding sequence
atggccgccccctgcgtgagctacggcggcgccgtgagctaccggctgctcctgtggggccggggctctctggcccggaaacagggattgtggaaaactgctgcacctgaactgcagacaaatgttaggtcacagatcctacgcttaaggcatacggcctttgttataccaaaaaagaatgtgcccacttctaaacgcgagacctacacggaggacttcattaaaaaacagattgaggaattcaatatcggcaagaggcatttagcaaatatgatgggagaggatcctgagacgttcacacaagaggacatcgatcgggccatcgcttacctgttcccttccggcttgttcgaaaaacgcgccaggcccgtgatgaaacaccccgagcagatctttcctaggcagcgggcaatccagtggggagaggacgggaggcccttccattacttattctacaccggaaaacagtcctattacagcctcatgcacgatgtatatggaatgctgctcaacttggaaaaacatcagtctcatctgcaggccaagagcctgttaccagaaaaaactgtcactcgggatgtcattgggagcagatggttaattaaggaggaactcgaagaaatgcttgtggaaaagctgagtgacctggattatatgcagttcatcagactgttggagaagctcctcacatcacagtgtggggcagcagaggaagagtttgtgcagaggtttagacggagcgtcactctggagtccaaaaagcaactgatcgagccagtgcaatacgatgagcagggcatggcgttctctaaaagtgaggggaagaggaagacggccaaggctgaggccattgtttacaagcatggatctggacggattaaggtgaacgggatcgattaccaactgtatttccctattactcaggatcgggaacagctgatgtttccatttcactttgttgatcgccttggtaaacacgatgtcacctgtacagtgagcggggggggaaggtctgctcaagcaggcgccattagactcgccatggcgaaggctctttgcagcttcgtgactgaagacgaagtggagtggatgcgccaggccggattgctgactaccgacccgagggttcgtgaacgtaaaaaacccggccaagaaggggcacggagaaagttcacctggaaaaaaagatag

SEQ ID NO: 195484 - DNA, 1122 bp, Artificial Sequence
  Description of Artificial Sequence: Synthetic coding sequence
atgtgggtgtgcagcaccctgtggcgggtgcggacccccgcccggcagtggcgaggactgctacccgcctctggctgccacgggcccgccgcctccagttactccgcatcagccgagcccgccagagtcagagccctggtatatggacaccacggagatcccgcaaaagtcgtggagttaaagaacctcgagttggctgccgtgaggggctccgacgtccgcgtcaagatgctggctgcccctataaatccatccgacatcaacatgattcagggaaactatggcttcttgcccgaactccctgctgtggggggcaatgagggagttgcccaggtggtggccgtcggaagcaacgtaaccggattgaaaccgggggattgggtgattcctgccaacgccggccttggtacgtggcgaactgaagccgtgttcagcgaggaggctctgattcaagtgccgagcgatatcccgttacagtcagcagccaccctgggtgtaaacccctgcactgcgtataggatgctgatggatttcgaacagcttcagcctggggattcagtaatccagaacgcatctaactccggggtgggtcaagccgtgatccagatcgccgccgctctgggtctgcggaccatcaacgtggtcagggacaggcccgacatccagaagttgtcagatcgcctgaagagcttgggagccgagcacgtgatcaccgaagaagaattgcgtagaccagagatgaaaaatttctttaaggatatgccccaaccccggctggcattaaactgtgtgggaggaaaatcttctacggagctgcttcgacagttggccaggggcggcacaatggtcacctacggaggcatggccaagcaacccgttgtagcctcagtttcactcctgattttcaaagatctgaaactacgcggcttctggctatcacagtggaaaaaggaccattcgcccgatcagtttaaggagcttattctcaccctgtgcgatctgatccggcggggccaactgactgcccctgcatgttctcaggtgcctcttcaagactatcaaagcgccctcgaagcctctatgaagccctttatcagttcaaagcagatactcacgatgtag

SEQ ID NO: 195485 - DNA, 894 bp, Artificial Sequence
  Description of Artificial Sequence: Synthetic coding sequence
atgctggccgcccccatcaaccccagcgacatcaacatgatccagggaaactacgggttcctgcctgaattgccagccgtaggcggcaacgaaggggtggctcaggtggtggctgtggggtccaacgtgactggactgaaacccggggattgggtaatccccgccaatgctgggctcggcacgtggagaactgaggccgtgttttccgaggaagccctgattcaggtgccttcagatatcccactgcaatctgccgctacactgggcgtgaacccttgcactgcttataggatgctcatggactttgagcagttgcagccgggcgattccgtgatccagaatgccagcaattctggcgtgggtcaggcggttatccaaatagccgccgcattgggacttcgcacgattaatgtcgtgagagaccgcccagacatacagaagttgagtgaccggttgaaaagcctcggcgcagagcacgtgattaccgaagaagaattgaggcggcccgaaatgaaaaacttctttaaggacatgccccagccccgcctagcgctcaactgcgtcggaggaaaatcttctactgagctgctgcgccagcttgctcgcggcggcacaatggtcacctacggtggcatggctaagcagccagtagttgccagcgtgtcattgttgatctttaaggaccttaaactgcgaggattctggttatcacaatggaagaaagaccactcgccagaccaattcaaagaactgatcctgaccttatgcgatctgatccggagggggcaactgactgcaccagcctgtagccaggttccactccaagattaccagtcggcattggaggctagcatgaaaccttttatatcttctaagcagattctcactatgtag

SEQ ID NO: 195486 - DNA, 789 bp, Artificial Sequence
  Description of Artificial Sequence: Synthetic coding sequence
atgatccagggcaactacggcttcctgcccgagctgcccgccgtgggcgggaacgagggggtggcacaggtggttgccgtgggttctaatgtgacagggctaaagcccggcgactgggtgattccagctaacgcgggcttaggaacatggaggaccgaagctgttttttccgaagaggccctgatccaggtgccctctgacatccctctgcagtcagccgccacactcggggtgaacccatgcactgcctacagaatgcttatggactttgaacagttgcagcccggagacagcgtcatccaaaacgcgagcaacagtggggtaggacaggccgtaattcagatcgcggctgccctaggcctccgaaccatcaatgtggtgcgtgatagaccagacatccagaagcttagtgatcggctcaagtcactgggggctgaacatgtgatcactgaggaagaattgcgccgacctgaaatgaagaatttcttcaagatacgcaaactgagactgcgcaaagaagaaatgctaaaccagaatcatattgtgtataaaggctcccgagagagtgagctagctagtgtgtcacccaacagcaagccactgaacttacctgaacctccaccacataacatgcctagacacgcaccagctacggcatgcagtcaattgtgctggtgggagaagctgcatcgcgcagccgccgcagttagcgcctggcggaatcatggcaatctttggggtgacggacaagccgcacgtagaagtctatgtgagcccgcccacttctag

SEQ ID NO: 195487 - DNA, 570 bp, Artificial Sequence
  Description of Artificial Sequence: Synthetic coding sequence
gccaccctgggcgtgaacccctgcaccgcctaccggatgctgatggacttcgagcagctgcaaccaggcgacagtgtgatccaaaacgcctctaactcaggcgtgggccaggccgtaatccaaatcgcggccgcactggggcttcgcactatcaacgttgttagagacaggcctgatatccagaagctgtcagacagattaaaatcgctcggcgcggaacacgtgataactgaagaggagcttcgccgaccagaaatgaagaatttctttaagatcagaaagctgagactgaggaaggaggaaatgctgaaccaaaaccatattgtgtacaagggtagtcgggagtccgagctagcaagcgtcagccctaattcgaaacctcttaacctgccagaacccccgcctcataacatgccaaggcacgcgcctgccaccgcttgcagccaactatgctggtgggagaagctgcaccgggccgccgcagccgtgtctgcctggcggaatcacgggaacctgtggggagacggacaggcagcccggagaagtctatgtgaaccggcccatttttag

SEQ ID NO: 195488 - DNA, 1200 bp, Artificial Sequence
  Description of Artificial Sequence: Synthetic coding sequence
atgcagagcctgagcctgggccagaccagcatcagcaagggcctgaattaccttactatcatggcccctggcaacctgtggcacatgcggaataacttccttttcggatctcgctgttggatgactagattctcggccgagaacattttcaagagcgtgtcgtttaggctatttggcgtgaaatgtcacaataccgactccgagccgctgaagaacgaagatcttctgaagaacctattaactatgggcgtagatatcgacatggcccgaaagcgccagccaggcgtcttccatcgtatgatcaccaatgagcaagatttgaaaatgtttctgctctccaagggagcatcaaaggaggtgattgccagcatcatcagccgttatccgcgggcaattacacgcacgcctgaaaatctgtctaagaggtgggatctttggaggaaaatcgtgacaagcgatctggaaattgttaatatccttgaacgtagccctgaatccttctttaggagtaataataatttaaacctggagaataatatcaaatttctgtactcagttggactgactcggaagtgcctgtgccggctgcttaccaatgcacccaggacattctctaactctctggacctgaacaagcagatggtcgagttcctgcaagccgctggcctaagcctcggacacaatgatcctgccgactttgtgaggaaaattattttcaagaacccattcatcctcatccagagcaccaagagagtaaaggctaatatcgagttcttgcgatctactttcaatctcaactctgaggagcttctggtgttaatatgtggccccggggccgaaattcttgatttatccaatgattatgcccggaggtcttatgccaatatcaaggaaaaactgttctccctcggttgcaccgaggaggaagtgcaaaagtttgtcctgagttaccccgacgtgatttttctagcagaaaaaaaattcaacgataagatcgattgcctcatggaagaaaacattagcatcagccagatcatcgaaaacccgagggtcttggactcatcaatctctaccctgaagtcccgaatcaaagaattagtaaatgccggctgcaatttgtctaccctgaacatcaccctgctgagctggtctaagaaacgctacgaggccaaactgaagaagctttcccggttcgcatag

SEQ ID NO: 195489 - DNA, 477 bp, Artificial Sequence
  Description of Artificial Sequence: Synthetic coding sequence
atgcagagcctgagcctgggccagaccagcatcagcaagggcctgaattatctgacaatcatggctccaggaaatctgtggcacatgagaaataattttctgttcggttcccgctgctggatgacgaggttctccgccgagaacatatttaagtctgtgtcttttagattgttcggagtgaagtgccataacaccgactccgaacccctgaagaacgaagacttactgaagaatttactaaccatgggcgtcgacatcgacatggcacggaagagacagcccggcgtttttcataggatgattaccaatgagcaggacctgaaaatgttcttgctctctaaaggagcaagcaaggaagtgatcgccagcataatcagtcgctatccaagggctatcactcgcacacctgaaaacctcagcaaaagatgggatctctggcgcaaaattgtgacctctgatctcgaaatagtaaattag

SEQ ID NO: 195490 - DNA, 2184 bp, Artificial Sequence
  Description of Artificial Sequence: Synthetic coding sequence
atgaaccagaagctgctgaagctggagaacctgctgcggttccacactatatacagacagctgcacagtctctgccaacgaagggcactgcgtcagtggcgtcatgggttttcttccgcctaccccgtctggacagcccaactttgtgcctggccctggccaaccgacgttctcactggcgcagctttatcccaatacagactcctcgttaccaagaaagaagaaggcccatggaagtctcagctgagctccacgaagagcaagaaagtggtcgaggtgtggattgggatgactatcgaagagctcgctcgtgcgatggagaagaataccgactatgtctacgaagccctcttaaacactgacattgacatcgattcgttggaagcagacagtcacttggacgaagtctggattaaggaagtcatcactaaggccggtatgaagcttaaatggtctaagttgaaacaagacaaggtcagaaagaacaaagatgcagtaagaagaccccaggctgaccccgctttactaacacccaggtcaccagtggtgactattatgggacacgttgaccatggcaagacaacactcctcgacaagttcaggaagacacaggtggctgccgttgaaacaggaggaatcacgcagcacattggcgccttccttgtgtctcttcctagtggggagaagataacctttcttgatacccctggtcatgctgcattttctgcaatgagagcccggggggcacaggtcactgatattgttgtacttgtggttgcagccgacgacggggtaatgaagcagactgtggaaagtattcagcacgccaaagatgcccaggtgcctatcattctcgccgtgaataagtgtgataaagcagaggctgaccctgaaaaggtcaaaaaggaactacttgcttatgatgttgtctgtgaggactatggtggcgatgtgcaggccgttcctgtgtccgctcttacaggcgataacctgatggctcttgctgaagcaacagtcgccctggccgaaatgttggaactgaaggcagaccccaacgggcccgtcgagggaactgttattgagagcttcaccgacaaggggagggggctggttacgacggccatcattcagagaggaacgctcagaaaggggagcgtccttgtcgcggggaagtgctgggcaaaggtgaggctgatgttcgacgagaacgggaagactattgatgaggcttaccccagcatgccggtgggtatcacgggctggagggacctgccctctgccggggaggagattctggaggtggaatccgaaccacgggcaagggaagtagtggattggaggaaatatgagcaagaacaagaaaaaggccaggaagacctcaaaattattgaagagaaacggaaggaacataaggaagcccatcaaaaagcccgggagaagtacggtcatcttctgtggaagaaacggagcatccttagatttctggaacggaaagagcagatcccgctaaagccaaaagaaaaacgggagagagactcaaacgtcttaagcgtgataataaagggtgatgttgacggatccgtcgaagccattctgaacatcatagatacatacgatgcatcccacgagtgtgagctcgagttggtccactttggagttggcgatgttagcgcgaatgacgtgaatctggcggagacattcgacggtgtgatttacggttttaatgtgaacgccggcaacgtgattcagcagtcagcagcgaagaagggcgtgaaaataaaactccataaaattatctacagactcgtcgaggatcttcaggaggaactgagtagccgcctaccttgcgcagtggaggagcatcctgtcggtgaggcctctatcctcgcgaccttttccgtgacggaagggaaaaagaaggtgcctgtcgccgggtgtcgcgttcaaaagggccagctagaaaaacaaaaaaagtttaagttgacaaggaatggtcacgtgatctggaaggggtccttgacctccctgaagcatcataaggacgacattagtattgttaaaaccgggatggactgcgggctgagcctggacgaggacaacatggagttccaggtgggcgatcgaattgtgtgttatgaggagaaacaaatccaggccaagacatcctgggatcccggcttctag

SEQ ID NO: 195491 - DNA, 219 bp, Artificial Sequence
  Description of Artificial Sequence: Synthetic coding sequence
atgaaccagaagctgctgaagctggagaacctgctgcggttccacaccatctaccggcagttgcatagcctgtgccaaagacgggcactcaggcagtggcgacatggtttcagttcagcttaccccgtgtggaccgctcagctttgcgcatggccttggccaaccgatgttttgaccggcgctgctctaagccagtaccggttgcttgtcaccaaatag

SEQ ID NO: 195492 - DNA, 2184 bp, Artificial Sequence
  Description of Artificial Sequence: Synthetic coding sequence
atgaaccagaagctgctgaagctggagaacctgctgcggttccacaccatctaccgccaactgcattccctgtgccagcgacgtgctctcaggcagtggcggcacggcttctctagcgcatatccagtttggaccgcgcagctgtgtgcatggccttggcctaccgatgttctgaccggcgccgctctgtcacaatacaggctgctggtcactaagaaagaagaagggccttggaagtcacagctgtctagtacaaaatctaagaaagtcgtcgaggtctggattggtatgacaattgaggaattggcccgagcaatggaaaagaacaccgattatgtgtatgaagcactgctaaataccgacatcgatatagactccttagaggccgattctcacctcgatgaagtatggattaaagaggttattacaaaggccggaatgaagctgaagtggtcgaagctcaaacaggataaggtccgaaagaataaggatgctgtccgcagacctcaagctgatcctgcccttctaaccccaaggtctcctgtggtcactatcatggggcatgtggaccatgggaaaactacactgctggataaatttcgcaagacacaggtagccgctgtcgagacaggtggcattacccagcacataggggctttccttgtttcccttcctagcggagaaaaaatcacattcctcgacacacctggccacgcagccttctcagctatgcgcgcccgcggcgctcaggtaaccgacatcgttgtcctcgtggtcgccgctgatgacggtgtgatgaaacaaacagtggaatcaattcagcacgctaaagacgcacaggtgcctattatcctggccgttaacaagtgtgacaaggccgaagcagacccggaaaaggtcaaaaaggaactgttggcctacgatgtggtctgtgaagactatggcggggatgtacaggcagtccctgtgtccgccctcacaggtgacaacctcatggccctcgccgaagcaactgtggctctagccgagatgttagagcttaaagctgaccctaatggccccgtagagggcacagtgattgagtcgttcactgataaggggcgaggtctggtgacaaccgctatcatccaaaggggaactctaaggaagggaagtgtcctggtcgcagggaagtgttgggccaaagtccgcctgatgttcgacgaaaatgggaaaactattgacgaggcttatccttccatgcctgtcggaattactggatggagagacctgccaagcgccggcgaagagatcctggaagtcgagtctgagcctagggcccgtgaggtagtggattggagaaagtatgagcaggaacaggagaagggccaagaagaccttaaaatcatcgaggagaagagaaaggaacataaagaggcccatcaaaaggccagagagaaatatggacacctgctgtggaagaagaggtcaattttgcggtttctggagaggaaggaacagatacctctcaagcctaaagaaaaaagagagcgcgatagtaacgtgctcagcgtgatcattaagggcgacgtggatggttccgtcgaagctattctgaatatcatcgatacctacgacgctagccatgaatgcgaattagaactggtgcacttcggggtaggagatgtatccgctaatgatgtcaatctcgctgagacattcgatggcgttatttacgggttcaacgtaaacgcgggcaacgtgatccagcagtcagccgcgaaaaagggagtaaaaatcaaactccacaaaattatctaccgactcgtagaggacctccaagaagagctctcttccagacttccatgtgcggtggaggagcaccccgtgggggaggcctcaatcctcgccacgtttagtgtcaccgaggggaagaagaaggttccggttgctggatgtcgggtgcaaaagggacaattggagaagcagaagaagttcaagttgaccagaaatggccatgtaatatggaaagggagcttgaccagcctcaagcatcacaaagacgatatctccatagttaagactggtatggactgtggcctgagcctggatgaggacaacatggagttccaggtgggtgacaggatcgtgtgttacgaggagaaacagattcaggctaaaactagctgggatcctggcttctag

SEQ ID NO: 195493 - DNA, 2184 bp, Artificial Sequence
  Description of Artificial Sequence: Synthetic coding sequence
atgaaccagaagctgctgaagctggagaacctgctgcggttccacaccatctaccggcagctacacagcctctgtcagcgcagggcccttcgtcagtggcggcacggtttttcttcagcatatccagtgtggaccgcccaactctgcgcctggccgtggcccacagacgtgctgacaggggcagccctaagtcagtacaggttgcttgtaacaaaaaaggaagagggcccttggaagtcacagctgagttctactaagtctaaaaaggtggtggaggtgtggatcgggatgacaatcgaagagcttgcgagggccatggagaaaaacactgactacgtatacgaggccctgttgaacactgatatagacatcgactcacttgaagctgattcccacctggacgaagtttggattaaggaagtgattactaaagctggtatgaagctgaagtggagcaagctgaagcaagacaaagtgaggaagaataaggatgccgtgcggcgcccacaggcagatcccgccctgctgaccccccgatctccagtggtcactatcatgggtcacgtggatcacggcaaaactacactgttagataaattccgcaaaacacaggtggcggctgtggagacaggaggcattacgcagcacattggagccttcctggtcagtcttcctagtggggagaagataacttttctggacacccccggacacgccgctttcagtgcaatgagggctcgtggagctcaggtcaccgacatcgtggtgcttgtggtggctgccgatgatggggtgatgaagcagaccgtggagtccattcaacatgccaaagacgcccaggtgccaatcatcctggcggtgaataaatgtgataaagccgaagcagaccccgagaaagtaaaaaaagaactgcttgcctatgatgtggtttgcgaggattacggcggtgacgtacaggcagtgcctgtgtctgccctcacgggtgacaatctgatggctttggccgaggcaaccgtggccctagccgagatgctggagctgaaggccgatccaaacgggcctgtagagggcacagtcattgaatcattcaccgataaaggccggggcctcgtcacaacggctattatacagagagggacccttcgcaaggggagcgtgctggtggccggcaaatgttgggcgaaagtcagactgatgttcgacgaaaacggaaagacaatcgacgaagcttacccgagcatgcccgtggggatcaccggatggcgagacctgccttctgcaggagaggagattctcgaggtggaaagtgaaccaagggccagggaagtggttgattggcgaaaatacgagcaggagcaggagaagggtcaggaggacctgaagatcatcgaagaaaaaaggaaggaacataaagaagcacatcaaaaggcgcgggagaagtatggccacttgctctggaagaagcgctcaatcctgaggttcttagagaggaaagaacagatcccgctcaaacctaaggagaagcgggagcgagacagcaacgtgctgtcagtgattatcaagggtgacgtggacgggtctgtagaggcaatcctgaacattattgatacatacgacgcttcacacgagtgtgagctggagctagtccattttggggtcggggacgtgtcggcgaacgacgtcaatttggccgaaacctttgatggggttatttacggcttcaacgtgaacgctgggaatgttatacagcaaagcgcggcgaaaaagggagtgaagataaaactgcacaagatcatttaccgtctcgtcgaggacttgcaggaagagctttcttcccgcctgccctgcgcagtagaagagcacccggtgggtgaggcaagcattctggccacattttctgtcacagaaggaaagaagaaggtgccggtggctgggtgtcgagtgcagaaaggccagctcgaaaagcagaagaagttcaagttaacccgcaatgggcatgttatctggaaaggctccctgacctccttgaagcaccacaaggacgatatttctatagtcaaaaccggcatggactgcggcctttctttagacgaggacaatatggagttccaggtgggggaccgcatagtttgttatgaggaaaagcagattcaggccaagacgtcatgggatcctggtttttag

SEQ ID NO: 195494 - DNA, 213 bp, Artificial Sequence
  Description of Artificial Sequence: Synthetic coding sequence
atgaaccagaagctgctgaagctggagaacctgctgcggttccacacaatttacaggcagctgcactccctatgccaaaggagggcgctcaggcagtggagacatggttttagttccgcctatcccgtgtggaccgcccagctgtgtgcttggccctggcccacagacgtgctcactggagcagcactgtcccagtatcgcctgctcgtttag

SEQ ID NO: 195495 - DNA, 24 bp, Artificial Sequence
  Description of Artificial Sequence: Synthetic coding sequence
atgaaccagaagctgctgaagtag

SEQ ID NO: 195496 - DNA, 33 bp, Artificial Sequence; identical to SEQ ID NO: 89302
  Description of Artificial Sequence: Synthetic coding sequence

SEQ ID NO: 195497 - DNA, 81 bp, Artificial Sequence
  Description of Artificial Sequence: Synthetic coding sequence
atgaaccagaagctgctgaagctggagaacctgctgcggttccacactatctaccgacagttgcactccctttgccaatag

SEQ ID NO: 195498 - DNA, 216 bp, Artificial Sequence
  Description of Artificial Sequence: Synthetic coding sequence
atgaaccagaagctgctgaagctggagaacctgctgcggttccacaccatatatagacagctgcactcgctctgtcagagaagggcactgaggcaatggcggcatggcttctcgtcggcctaccctgtctggacagcgcagctctgcgcctggccatggcccacagatgtgttgaccggtgccgccctgagccagtacagactattggtgacatag

SEQ ID NO: 195499 - DNA, 1398 bp, Artificial Sequence
  Description of Artificial Sequence: Synthetic coding sequence
atgaaccagaagctgctgaagctggagaacctgctgcggttccacactatttaccggcagcttcattctttgtgccaacgcagagcgctcaggcagtggaggcatgggtttagtagtgcctaccctgtctggaccgcccagctatgcgcctggccttggccgacagacgtcttgactggggccgcactgtctcagtacaggctcctcgtaacaaagaaagaggagggaccttggaaatctcagttgtccagcaccaaatctaaaaaagtggtagaagtatggataggcatgacaatcgaggaactggcccgagcgatggagaaaaacactgattacgtttacgaggctctgctgaacaccgacatagatattgattcactagaggctgatagccatttagacgaggtgtggatcaaagaggtgatcaccaaagcaggtatgaaactcaagtggagcaagctgaaacaagacaaagtccgtaagaataaggacgcagtgcgtcggccacaagctgaccccgctctgctcacccccaggtccccagtcgtaaccattatggggcatgtggatcacggcaagacaacactgctcgacaagttccgtaaaacacaggtcgcggccgtcgagaccggagggattacacagcacatcggcgcctttctcgtgtccctcccctctggggaaaagatcacctttctggacacaccaggacacgccgcctttagcgctatgagagccaggggggcccaggtgacagatatcgtggtcctggtggtggccgctgacgatggtgtaatgaaacagaccgttgaatcaattcaacacgcaaaggacgcccaggtgccaataatccttgccgtgaataagtgcgataaagcggaggccgacccggagaaggtgaaaaaggagctacttgcctacgacgttgtctgcgaggactatggaggggacgtgcaggcagtccccgtgagcgccctgacgggagacaatcttatggccctcgccgaggcaacagtggcactcgccgagatgctggagcttaaagccgacccgaacggccctgtagaaggcacagtcatcgaaagttttaccgataaggggagagggttagtgactaccgcaataatccagaggggaacactgagaaagggcagcgttctggttgcaggaaagtgttgggccaaggtgcgactgatgttcgatgagaacggaaagacaattgacgaggcgtaccctagcatgcccgttggcattactggctggcgtgacctaccttctgccggcgaagaaatactggaggtcgaaagtgaaccaagggctcgcgaggtggtcgattggcgaaagtatgagcaggagcaggagaaagggcaggaagacctgaaaaaagaaaagaattag

SEQ ID NO: 195500 - DNA, 456 bp, Artificial Sequence
  Description of Artificial Sequence: Synthetic coding sequence
atgaaccggcacctgtgcgtgtggctgttccggcaccccagcctgaacggctatcttcagtgtcacatccagttgcactcccatcaatttcggcagattcacttggatacaaggctgcaagtgtttaggcaaaaccggaattgcatcttgcacttattgtccaagaattggtcccgacgttattgtcatcaagacactaagatgctatggaaacacaaggctcttcagaaatacatggaaaatctcagtaaggagtaccagacactggagcagtgtctgcaacacatccccgtgaacgaggaaaatcgccggagtctgaatagaagacacgctgagctcgctccgctcgctgctatctaccaggagatacaagaaactgagcaggccatcgaagagctcgaatcaatgtgtaagaagacggagagctgttcagttgcccaggcaggaatgcaatag

SEQ ID NO: 195501 - DNA, 1338 bp, Artificial Sequence
  Description of Artificial Sequence: Synthetic coding sequence
atgaaccggcacctgtgcgtgtggctgttccggcaccccagcctgaacggatatttgcagtgccatattcagctgcattcccatcagttccgtcagatccacctggacacaaggctgcaggtctttagacagaaccggaactgcattctgcatctccttagcaaaaattggtcccggaggtattgtcaccaggacaccaaaatgttatggaaacacaaggcactacagaaatacatggaaaacttgagcaaagaatatcagactctcgaacagtgtctgcagcacatccctgtgaatgaagaaaaccgccgaagcctaaaccgacgacatgctgagctggctccactcgccgcgatttatcaggagatccaggagacagagcaggccattgaggagctggaatcaatgtgcaagagcctaaacaaacaggatgaaaagcagctgcaggaactggcacttgaggagaggcagaccatcgatcagaaaattaacatgttatacaacgaactattccaatcactggtcccaaaggaaaaatacgataagaacgacgttatcctagaagtgactgccggacgcaccacaggtggggatatctgtcagcagtttactcgagagatcttcgacatgtaccaaaactattcttgctacaaacattggcagttcgagctgctgaattacacaccagccgattacggaggacttcaccatgctgcggctcgtatatctggagatggtgtttataaacatctgaagtacgagggcgggattcatagggtgcagcggattcccgaggtgggcctgagctctcgtatgcaaagaattcatactggaacgatgagcgtgattgtcctaccgcagcccgacgaagtggacgtcaaactcgatccaaaggatctgcggattgatacattccgcgctaaaggcgccggtgggcagcacgtcaacaagacagactctgccgttaggctggtgcatatcccaactggcctggtagtggaatgccagcaggagaggagccaaattaagaataaggagattgctttcagagttcttagagcccgtctctaccagcagatcattgaaaaggacaagcggcagcagcaatctgcccgaaaactgcaggtgggaacaagggcacagagtgaacggattcgaacttacaatttcacccaagatagggtgtctgatcacagaattgcatacgaagtcagagacatcaaggagtttctgtgtggcggcaaaggcttagaccagctcattcagcggctcctgcagtctgccgacgaggaagctattgctgaattactcgatgaacaccttaagagcgctaagtag

SEQ ID NO: 195502 - DNA, 1338 bp, Artificial Sequence
  Description of Artificial Sequence: Synthetic coding sequence
atgaaccggcacctgtgcgtgtggctgttccggcaccccagcctgaacggttatctgcagtgccatatacagctccactcccatcagttcagacagattcatctggacacgaggcttcaggtcttcaggcagaatcgtaattgtatcttgcatcttctaagtaagaactggagtcggcggtactgccaccaggatactaaaatgctttggaagcataaggctttacagaagtatatggaaaatctgtctaaagagtaccaaaccctggaacagtgtttgcagcatatcccggtgaatgaagaaaatcggaggtctctgaacagacgccatgcagaattggcacccctggccgctatttaccaagagatacaggagacagagcaggctatcgaagaattagagagtatgtgcaagtcattaaataaacaggacgagaaacaattgcaggaactggcattagaggagaggcagaccatagaccagaagatcaatatgttgtacaatgagctcttccagtctttggtgcccaaggagaagtatgataagaatgacgtaatcctagaagttacagctggccgcacaactggtggggacatttgtcagcagttcacgcgagaaatctttgatatgtatcagaattattcatgttacaagcattggcagttcgagctgcttaattacacacccgcagattacgggggcctgcatcacgcggctgcacggattagcggcgatggtgtctataagcacctgaagtacgaggggggtattcaccgtgtgcagagaattcccgaagtgggtctcagcagcagaatgcagaggatccacacgggaactatgagtgttatcgtacttccccaaccggatgaggtcgatgtcaagctggacccgaaagatctgcgcatagatactttccgagcaaaaggagctggaggccaacacgtgaacaaaaccgattctgctgtcaggctggttcatattccgaccgggttagtagtggagtgtcagcaagaacgcagtcagatcaagaacaaggaaatcgcttttcgggtgctccgcgcaagactctatcaacaaatcatagagaaggacaaacgtcagcaacagtctgcacgcaagcttcaagtgggcacccgcgctcagtctgagagaattcgtacctacaactttacccaggacagggtgagcgatcaccggatagcctacgaagttcgcgacatcaaagaattcttatgcggaggcaaggggctcgaccaattgattcaaaggttattacaaagcgcggatgaggaggccattgccgaactgctcgatgaacacctcaagagcgccaagtag

SEQ ID NO: 195503 - DNA, 1407 bp, Artificial Sequence
  Description of Artificial Sequence: Synthetic coding sequence
atgggcaacggcgaggtggtgctgttcagcgacgccgagatgaaccgacatctttgcgtgtggctttttcggcatccatcgctaaacggttatctgcaatgccacattcagctgcactctcaccaatttagacagatccacttagacaccagacttcaggtgttccgtcagaacaggaattgcattctccacctcttatcaaagaactggagcaggcggtactgccatcaggatacaaaaatgctttggaagcataaggcactacaaaaatacatggaaaatctctccaaagagtatcagacactggaacagtgtcttcagcatatccccgtcaacgaagaaaataggcgaagcctgaaccggaggcacgcagagctggcacctttggcagctatctaccaagagatccaggaaactgagcaggctatcgaagaactggagtctatgtgcaaaagcctcaacaagcaagatgaaaaacagttgcaggagctggctctggaggaacggcagacaatcgaccagaaaattaatatgctctacaacgagctgttccaaagcctggtccctaaggaaaagtacgataagaacgatgtgattctggaagtcacagcaggccggactactggaggggatatttgccaacagtttactcgggagatcttcgacatgtaccagaactattcctgttacaaacactggcagttcgaattgctgaactacactcccgctgactatggaggactccaccatgccgcagcccgcatcagcggggacggagtctataagcatttgaagtacgagggaggaatccacagagtgcagaggatccctgaagtgggcctttcatctagaatgcagcgaattcataccgggactatgtcggtgatcgtcctgccccaacctgacgaggtggatgtgaaacttgatccaaaggacctgagaattgatacattcagggcaaaaggggccgggggccagcatgttaacaagacagactcggccgtgagactggttcacattccaaccggactggtggtggaatgccagcaagaaaggagccaaatcaagaacaaggagatagcctttcgagtcctgagggcacgtctgtaccaacagattattgagaaggacaagaggcagcagcaatccgccagaaagttgcaggtgggcaccagggctcaaagcgagagaattagaacatacaacttcacacaggaccgcgtgtcagaccacaggattgcctatgaagtgcgggatattaaggctcagtcccattccacgggcggttctagggacccggcgcacagtacatttttgtccctggatagcgtgcgaagcccaggtattctgatcatgacaagttctgtccggaacttttatgtggtgggcagggcttggatttcttag

SEQ ID NO: 195504 - DNA, 2274 bp, Artificial Sequence
  Description of Artificial Sequence: Synthetic coding sequence
atgagcctgctgttcagccggtgcaacagcatcgtgaccgtgaagaagaataaacgccacatggccgaagtaaacgcctcgccgctgaaacactttgttactgcaaaaaaaaagattaacggaatcttcgagcaactcggcgcctacattcaggaatctgccaccttcttggaagacacgtaccggaacgccgagctggatccagtgactactgaggagcaagtgctcgacgtgaaaggctatcttagtaaggtgagagggatatctgaagtcctggcccgaaggcacatgaaggtggctttcttcgggaggacatccaacgggaagagcacagtcatcaacgctatgctgtgggacaaggtgctgccgtctgggataggtcataccacaaactgcttcctgcgggtcgaaggaaccgacgggcacgaagcctttctgttaacggaaggctcagaagaaaaacgctctgctaaaactgtcaatcagcttgcacacgctctgcaccaggataagcagttacacgctgggtctctcgtctccgttatgtggccaaacagcaaatgccccttgctgaaggatgacctggtgctgatggacagcccagggatagacgttacgacagagctggacagctggattgataagttttgccttgacgccgacgtttttgttctagtcgctaattccgagagcaccctgatgcagacggagaagcatttttttcataaggtgagcgaaaggctatctcgtccaaatattttcattctcaacaacaggtgggatgctagtgctagcgagccagaatacatggaggaggtgagacgccagcatatggagaggtgtacaagtttccttgttgacgaattaggggttgtcgatcgctcacaggctggagaccgaatctttttcgttagcgccaaggaggtgcttaatgcacgaatacagaaagcacaggggatgcccgaaggtggtggcgcattggcagaaggcttccaagtgcgaatgttcgagttccaaaattttgagcgaaggttcgaggagtgtatatcacagagcgcagtgaaaacaaaattcgagcagcacaccgttcgggcaaagcagattgctgaagctgtgagactgattatggatagcctgcacatggctgcgagagaacagcaggtgtactgtgaagagatgagggaagaaaggcaggacaggctgaaattcattgataaacagctagagctcctggcacaggattataagttacggataaaacagatcacagaggaggtcgagcggcaggtatctaccgctatggctgaggaaatcaggcgactgtccgtgctggtggatgactatcaaatggacttccatccctcgcctgtggtgctgaaggtctataagaacgaactgcatcggcacatcgaggaaggcctgggtagaaatatgtcagacaggtgtagtaccgcgattacgaacagcctccagactatgcagcaggatatgattgatggcctgaaaccactgctccctgtttcagtcagatcgcagattgatatgctggtgcccaggcagtgtttctccctcaactacgatttaaactgcgacaagttgtgcgcagatttccaggaagacatagagttccacttttcactcgggtggaccatgctggtgaaccgctttctgggaccaaaaaattctcggcgggccctaatgggatacaacgatcaggtgcagcggccgatcccattaactccagccaatcctagcatgccccctctccctcaggggagccttacgcaggaagagttcatggtctctatggtcacaggcctggcttctctgacatcgagaacaagtatggggatactggtggtcggtggggtagtttggaaggccgtgggctggcgcttgatcgccctcagcttcggcctctacggacttttatacgtatacgaaaggttaacctggactacaaaggccaaagagcgggccttcaaacggcagttcgttgagcatgcgtctgaaaaactacagctggttatctcttacaccggatcgaactgctcccaccaggtgcagcaggagctgagtgggaccttcgctcatctgtgtcagcaggtcgatgtcactcgcgaaaatttagagcaagaaatagctgcaatgaacaagaagatcgaagttttagattcacttcagagcaaggctaaattgctcaggaacaaagctggttggcttgactcagaactgaatatgtttacccatcagtatctccagccatcgcggtag

SEQ ID NO: 195505 - DNA, 1311 bp, Artificial Sequence
  Description of Artificial Sequence: Synthetic coding sequence
atgcacccccacctgagcaccctgagcctgccccggcggcggagcatggcattcctgtccagttggggcgccttggcggaaggttttcaggtgcgcatgtttgagtttcagaacttcgagcggagattcgaggaatgcatctctcaatccgcggtcaagacaaagttcgagcagcatacagtacgcgctaagcagatcgccgaggccgtacgacttattatggactctcttcacatggccgcccgtgagcaacaggtgtactgtgaagagatgagggaagagagacaggataggctgaagttcatcgacaaacaattggaactgctggcccaggattataaacttaggatcaaacaaatcaccgaggaagtggagcggcaggtgagtaccgcaatggcagaggaaattaggagactgagtgttttggtcgatgactaccagatggacttccaccctagccccgtggtccttaaagtgtacaaaaatgaacttcacaggcacatcgaggaggggctaggaaggaacatgtccgatcggtgttccaccgcaattactaatagccttcaaacgatgcaacaagatatgatagatgggttgaagcccctgcttcccgtatctgtgcggagccaaattgatatgctggtcccacgacagtgcttcagtctgaactacgatttgaactgcgacaagctgtgtgctgacttccaggaggatatcgagttccatttctccctgggctggactatgctcgtaaatcggtttctcggcccgaaaaactctaggcgggcccttatgggctataatgaccaggtgcagcgccccatccctctcactccagcgaaccccagcatgcctccactgcctcaaggatctttaactcaggaagagtttatggtatctatggtgacgggactcgccagcctgacttcgagaaccagtatgggcatcctcgtggttggaggcgtggtttggaaagccgtggggtggcgcctgatcgcactgtcgttcggtctgtacggtcttctgtatgtctacgaacgcctaacctggactactaaggctaaggagcgagcattcaagagacagttcgtggaacacgctagtgagaagttgcagcttgtgatcagttacaccggctccaactgtagccaccaggttcaacaggagctgagtgggactttcgctcatctgtgccagcaggtagacggcgagacactgtctgaacgctccatggcaaagagcacactgatgctcctgacgctgctcttcctgtgtagcttcgctggcgcgcaagatgttctaactcagtag

SEQ ID NO: 195506 - DNA, 297 bp, Artificial Sequence
  Description of Artificial Sequence: Synthetic coding sequence
atgagcctgctgttcagccggtgcaacagcatcgtgaccgtgaagaaaaataaacgtcacatggctgaggtgaatgccagtcctctgaaacattttgttacggccaaaaagaaaatcaacgggatctttgaacagctcggtgcatacattcaagagagtgctacgttcctagaggacacgtaccggaatgctgagctggacccagtgacgactgaagagcaggtgctcgatgttaagggttacctttccaaggtgcgaggaatctctgaggtgcttgcgagaaggcatatgaagtag

SEQ ID NO: 195507 - DNA, 2274 bp, Artificial Sequence
  Description of Artificial Sequence: Synthetic coding sequence
atgagcctgctgttcagccggtgcaacagcatcgtgaccgtgaagaaaaataagagacacatggccgaggtaaacgcatcccctcttaagcattttgtgacggcaaagaaaaagattaacgggatattcgaacagctaggtgcatacattcaagagtcggctactttcttagaggatacttaccgcaacgcagagcttgaccctgtgacgactgaggaacaggtcctcgacgtcaagggctacctcagcaaggttcgcggcatctcagaggtactcgctcgcagacacatgaaggtagctttcttcggacgaacatcaaatgggaagtctacagtcataaacgcaatgctgtgggataaggtgctccctagtggaataggccacaccactaactgttttctccgcgtcgaggggaccgatggccatgaagctttcctgttaaccgaaggttcagaggaaaagcgcagtgccaaaactgttaatcagctagcacatgccctccatcaggataaacagcttcatgctgggagtctcgtctctgtcatgtggcctaatagtaaatgccctctgctgaaggatgatttggtgctcatggactcaccaggaatcgacgttacgaccgaactggactcatggattgacaagttctgcttggacgcagacgtgtttgtgttagttgccaacagcgaaagtacactgatgcagactgagaagcacttcttccacaaagtgtccgagaggttatcccggcctaacattttcatcctgaataatcgatgggatgcaagtgcaagcgagccagaatatatggaagaagtaagacgtcagcacatggaaagatgtacaagtttcctggttgatgaactgggcgtagtggatcgcagtcaggctggcgatcgcattttctttgtttccgcaaaagaagtgctcaacgcacgcatacaaaaggcacagggaatgccagagggcgggggagctcttgctgagggttttcaggtgagaatgttcgagttccagaactttgagcgtagatttgaggagtgcattagccagtcagctgtgaagaccaaattcgagcagcacacagttcgtgccaagcagattgccgaggctgtccgtctcatcatggatagtctgcacatggcggctcgtgaacaacaggtatactgtgaagagatgcgggaggagagacaggataggctgaaatttatcgataagcaactagagttattggcccaggactacaaactaagaattaagcaaattactgaagaagtggagcgacaggtatccaccgctatggcagaggagatccgccgcctatcagtgttagtggatgactatcagatggactttcatccaagtccagtggtgctcaaagtctacaaaaatgaactgcataggcatattgaggagggtctggggaggaatatgagtgaccggtgtagcacggctataaccaactccctccagacgatgcagcaggatatgatagacggactcaaacccttgctgcctgtctctgttcgctcacagatcgatatgctggtgcctcgtcaatgcttctccttgaactacgatctcaactgtgataaactttgcgccgattttcaggaagacattgagttccacttctccctcggatggacaatgcttgtgaaccgattcctgggacccaaaaattccaggcgcgccctaatgggctataacgaccaggtgcagcgaccgatacccttaactccggccaacccctctatgcccccgctgccacagggaagtttgacacaggaagagtttatggtgtcgatggtgacagggctagctagcctaacgtctcgcacttcaatgggcattcttgtggttgggggagtcgtgtggaaggccgttggctggcgcctaattgcgttatcattcggcctgtatgggctgctttacgtttacgaaaggctcacttggacgactaaagctaaagagagggccttcaaacgccaattcgtggagcacgcatctgaaaagctgcagctcgtgatctcttacactggttccaactgctcgcaccaggtgcaacaggaactgtctggtacttttgcccacctgtgccagcaggtggatgtgactcgggagaatctcgaacaggaaatcgccgccatgaacaaaaagatcgaagtgctcgattcactgcagtcaaaagctaaactactccggaataaagccggatggctagactcggaattgaatatgtttacccatcagtatctgcagcctagccgatag

SEQ ID NO: 195508 - DNA, 1395 bp, Artificial Sequence
  Description of Artificial Sequence: Synthetic coding sequence
atgagcctgcacttcctgtactactgcagcgagcccaccctggacgtgaaaatcgccttttgtcaaggttttgataaacaggtagatgtgtcttatattgccaaacattataatatgagcaagagtaaagtggacaaccaattctattctgttgaggtgggggactccaccttcactgtgcttaaacggtatcagaacctgaaacccattggatcaggagcccagggtatcgtttgtgcagcttacgatgccgtactcgataggaatgtggctatcaagaagttgtcaagaccattccaaaatcagactcatgcaaaaagagcttatcgcgagctggtcctcatgaagtgcgtcaaccacaagaacattattagcctgctgaatgtgttcacaccccagaagactctcgaagagtttcaggatgtatatctggtaatggagctgatggacgccaacctatgccaggtgatccaaatggaattagaccacgagagaatgagttatctgctgtaccagatgctctgcggtatcaagcacttacactctgccgggataatccaccgcgacctgaaaccatccaatattgtggtgaaatccgactgcaccctgaaaatcctggattttggcctggccaggacagccgggacatcttttatgatgacaccctacgtcgtaacacgatactatcgagcacctgaagttatcctcggaatggggtacaaagagaacgtggatatctggagtgtgggctgcatcatgggagaaatggtacgtcacaagatcctgtttccgggtcgcgattacattgatcaatggaacaaggtcatcgaacaactcggaacaccatgtccggagttcatgaaaaaactgcagcctacagttaggaattacgttgaaaaccggccaaagtatgccgggctgacttttcctaagctgtttccggattcactcttccccgctgacagcgagcacaataagctgaaggcctctcaggcccgcgatctgctcagtaaaatgttggttatcgatcccgctaaacgaatcagcgttgacgatgctctgcagcacccatacatcaacgtctggtacgacccagccgaagttgaggcccctccgcctcagatctacgacaaacagctggatgagagagagcatacgattgaggagtggaaggaactcatatataaggaggtaatgaactccgaagagaagactaaaaacggagtcgtgaagggccagcccagtccttccggcgccgctgtgaatagtagcgagagcctgccacccagctcttccgtcaacgatatctcatcgatgtcaacagaccagactttggcctccgacacagactcaagccttgaggctagcgctgggcccctgggttgttgccgctag

SEQ ID NO: 195509 - DNA, 1269 bp, Artificial Sequence
  Description of Artificial Sequence: Synthetic coding sequence
atgagcctgcacttcctgtactactgcagcgagcccaccctggacgttaaaatagccttttgtcagggcttcgacaaacaggtagatgtcagctacatcgccaagcactataacatgagcaagtctaaggtggataaccaattttatagtgtggaagtgggagattccacctttacagttttgaaacgatatcaaaacttgaaacctataggttccggcgctcaaggaattgtgtgcgcagcatatgatgccgtcctggaccgcaacgtggccatcaagaaattgtctcgaccatttcagaaccaaacccatgccaagcgcgcctaccgggaacttgtacttatgaaatgtgtcaatcataaaaacataatctcgttactgaacgtctttacgccccaaaagacacttgaagagtttcaagacgtctacctggttatggaattgatggatgctaacttatgtcaagtcatccagatggagcttgatcacgaacgtatgtcatatctcctttatcagatgttatgcggaatcaaacatctccactccgcaggaattatccatagggacctgaagcccagcaacatcgtagttaagtctgactgtactctgaaaatactcgatttcggactggccaggactgccggcacttccttcatgatgaccccatatgtggtcacacggtactatagggccccagaagtcattctgggtatgggatataaagaaaatgtggatatctggagtgtaggatgtatcatgggggagatggtccgccataagatcctgttcccagggagggactacatcgatcagtggaacaaggtcatcgaacagttgggtaccccttgccccgaattcatgaaaaaactgcaacccaccgttaggaattacgtagaaaatcggccgaagtacgcagggctgacgttcccaaagctgtttcccgacagtctttttcctgcggattctgaacataacaagctcaaggcatctcaggctcgggacttactctcaaaaatgctcgtcatcgaccccgcgaagagaattagcgttgacgatgcacttcaacacccatacatcaacgtgtggtacgacccagctgaggttgaagcacccccgccccagatttacgacaaacagctcgatgagagggaacacacaatcgaagagtggaaggaattaatctacaaggaagtaatgaatagtgaagaaaagactaaaaacggggttgtgaagggtcagccctcacccagcgcacaggttcaacagtag

SEQ ID NO: 195510 - DNA, 960 bp, Artificial Sequence
  Description of Artificial Sequence: Synthetic coding sequence
atggagctgatggacgccaacctgtgccaggtgatccagatggagctggatcatgaacgaatgtcctatctgctatatcagatgctgtgcggaataaaacacctgcactctgccggaatcatccaccgcgacctaaaaccatctaacatagtggtaaaatctgattgcaccctgaagattcttgattttgggctcgctcgcacggccggaacatcattcatgatgacaccctatgtggtgacccggtactaccgggcacccgaggtgattctgggaatggggtataaggaaaacgtcgatatatggagcgttggttgtatcatgggagagatggtgagacacaaaatactctttcccggcagagactatattgaccaatggaacaaggtgatcgagcaactaggaaccccgtgtcccgaattcatgaagaaactccaaccaaccgtcagaaattatgtggaaaatcgaccgaaatacgctggacttactttccccaaattattcccagattccctctttcctgccgatagcgaacacaataagcttaaggcatcgcaggcccgggatcttctttcaaaaatgctcgtcatcgatcccgccaagcggattagtgttgacgatgccctgcagcacccatacattaatgtttggtatgatccggcagaagtcgaggcacctcctcctcagatctacgataagcagttggatgagagggagcatacgattgaggagtggaaagaattgatatacaaggaggttatgaattcagaagagaagactaagaacggggtcgtgaagggccagccttcgccttccggcgctgctgtgaactccagtgagagcctgccccccagttcgagtgttaatgacatctcaagcatgtcgacagaccagaccctggccagcgacaccgattctagtctggaggccagcgccgggccccttgggtgttgcaggtag

SEQ ID NO: 195511 - DNA, 834 bp, Artificial Sequence
  Description of Artificial Sequence: Synthetic coding sequence
atggagctgatggacgccaacctgtgccaggtgatccagatggagcttgaccacgaacgaatgtcctatcttctgtaccagatgctgtgtgggattaagcatttgcactctgcagggataatccaccgagacctgaagccaagcaatattgtggttaagagcgactgtacacttaagatcctggactttgggcttgcacgcacagcgggcacgtcatttatgatgaccccttacgtcgtgacccgttattatcgtgccccggaagtcatactgggcatgggttataaagaaaacgtggatatctggagtgtgggctgcatcatgggagaaatggtccgacacaagatcctcttcccgggtcgtgattacatcgaccaatggaacaaagtgattgaacagctgggcaccccatgtccagagttcatgaagaaactccagcccacagtacggaactatgtcgagaatagacccaagtacgccggcttgacgttcccaaagcttttccctgactccctttttccggcagattctgagcacaacaagttgaaggcatcacaggcccgagacttattatcgaagatgctggtaatcgaccccgccaagaggataagcgtggacgatgccctgcagcatccctatatcaatgtgtggtacgatccagcggaggtcgaggctccacccccccagatttacgacaagcagttggatgaacgcgagcacactattgaagagtggaaagagttgatctataaggaagtaatgaactcagaagagaagacaaagaatggggttgtcaaaggtcaaccctctccctccgctcaggtgcagcagtag

SEQ ID NO: 195512 - DNA, 1269 bp, Artificial Sequence
  Description of Artificial Sequence: Synthetic coding sequence
atgagcctgcacttcctgtactactgcagcgagcccaccctggacgtcaagattgcgttctgccaggggttcgataagcaagtggatgtcagttatattgcaaagcactacaatatgagcaagagtaaagtggacaaccagttctactcagtagaagtcggagatagtaccttcacagtcttgaagagatatcagaatctgaagcctattggcagtggggctcaggggatcgtttgtgcggcatacgacgcggtccttgaccgaaacgtggctattaagaaactcagtcggccctttcagaatcaaacacacgccaaaagagcataccgcgaactcgtcctgatgaagtgtgttaatcacaagaacattatttccctgcttaacgttttcacccctcagaagactctggaggaattccaagatgtatatctcgtaatggaactcatggacgctaatctgtgccaggtcattcagatggagctagaccatgaacgcatgagctatttactgtatcaaatgttgtgcggcataaagcaccttcattctgcaggaatcattcaccgggatttgaaacccagtaacatcgtggtaaagtcggactgtaccctgaagatactggacttcggtctggccagaactgccggtacaagcttcatgatgacaccttacgtggtgactcgatattatcgcgccccggaagtcattctgggcatgggctataaagagaacgttgatatctggtcagtcggctgtattatgggggaaatggttaggcataagatcttgtttcctggtagggactatatcgatcagtggaataaggtcatcgagcagctgggtacgccctgcccagaatttatgaagaagcttcagcccacagtaagaaattatgtggaaaatcgaccgaaatacgccggcctgactttcccaaaactgtttccagactcactattccccgctgattcagaacataacaagctgaaagcatcacaagcccgggatctcctctccaagatgctggtgattgatccagcgaagaggatttccgtggacgacgccctgcagcatccctacattaacgtctggtacgatccggctgaagtggaggccccgccaccacagatttacgataagcagctagacgagagggagcacactatagaggaatggaaggaactcatctacaaggaagtgatgaacagtgaggagaaaaccaaaaacggagtggtaaagggccagccttctccatcagcccaggtgcagcaatag

SEQ ID NO: 195513 - DNA, 1281 bp, Artificial Sequence
  Description of Artificial Sequence: Synthetic coding sequence
atgagcaagagcaaggtggacaaccagttctacagcgtggaggtgggagattctacgtttaccgtcctgaagcggtatcaaaacctgaaacctatcggttcaggagcacaggggattgtgtgcgcagcatatgatgccgtgttagaccgaaatgtcgccattaaaaaattaagtaggccattccaaaaccaaactcacgcaaagcgggcataccgtgagttggtcctcatgaagtgtgtgaatcacaagaatataataagcctcctgaacgtgtttactccccaaaaaaccttggaagaattccaagatgtctatctggtgatggagctcatggacgccaacctctgtcaggtaatccagatggagttggatcacgagcgcatgagctatctcctgtatcaaatgctgtgcggcattaagcatctgcactctgcggggatcatccatagggacctgaaaccatccaatattgtagtgaagtccgattgcaccctgaaaatactcgattttggcttagcacgaacagccggcacctcctttatgatgaccccatacgtggtaaccaggtactacagagcccccgaagtgatcttaggtatgggctataaggagaatgtagatatctggtccgtgggctgtattatgggggaaatggtgcggcacaagatcctttttccgggccgcgactatatcgaccaatggaacaaagtgattgagcaacttggtaccccatgtcccgagtttatgaagaagcttcaaccaacggtgcggaactacgtggaaaacaggcctaagtacgccgggttaacttttcccaaattgtttcccgactctttatttccggctgattctgagcacaataaactgaaggcgtcacaggcgcgcgacctgctgagcaagatgttggtgattgaccctgctaagagaatatcagtggacgacgccctgcaacacccttacattaacgtgtggtatgatccggcagaagtggaagccccccccccccagatatatgataaacagctagacgagagagagcacaccatcgaagaatggaaagaacttatctataaggaggtgatgaattcagaggagaagacaaagaacggggtcgtaaaaggccagccctctccaagtggagcggccgtgaactcatccgaatccttgccgccaagctcaagtgtcaatgatattagtagcatgtcaaccgaccagaccctggcgtctgacactgattcctcacttgaggcatctgcgggacctctgggatgttgtaggtag

SEQ ID NO: 195514 - DNA, 1281 bp, Artificial Sequence
  Description of Artificial Sequence: Synthetic coding sequence
atgagcaagagcaaggtggacaaccagttctacagcgtggaggtgggggattccaccttcaccgtgctgaaaagataccaaaatctgaaacccatcggatctggcgctcaaggaatagtgtgcgcagcttacgatgccgttctggataggaacgtggctattaagaaattgagccgtccatttcagaaccaaacacacgcgaagagggcttacagagaacttgtgctgatgaagtgtgtaaaccacaagaatattatctctttgcttaatgtgtttacaccacaaaagaccctggaggaattccaagatgtgtatttagtgatggagctgatggatgctaacttatgtcaggtcatccagatggagctggatcatgagcgcatgtcctatctactgtaccagatgctttgcgggataaagcacctgcattctgctgggatcatccatcgagacttgaaaccttctaatattgtcgtcaaatcagactgtactctgaagatcttagattttggcctggctagaacagctgggacctctttcatgatgaccccttacgttgttacccggtattaccgagccccagaagtgatcctaggcatgggctataaggaaaatgtcgatatttggtcagtcggttgcattatgggagaaatggtgcggcacaagattctcttccccggacgggattacatcgatcagtggaataaagttatcgagcagctaggtaccccctgcccagaattcatgaaaaaattacagcctacagtgcggaactacgtcgagaacagacctaaatacgcaggattgactttccccaagctgttcccagattcactgtttccagctgacagtgagcacaacaagctgaaggcctcccaagctagggatcttctgagtaagatgcttgtcatagatccggcgaagcggatttcagtggacgatgcacttcaacacccctatataaacgtgtggtatgaccctgccgaagttgaggccccccctccccagatctatgacaaacaactggatgaacgagagcacacaatcgaggagtggaaggagttgatttataaggaagtcatgaactctgaggagaaaaccaaaaatggagtggttaaaggtcagccctcccctagcggcgcagcagtaaatagctcggagagcctgccaccaagttcctcagtgaacgatatttcatccatgtccactgaccagaccctcgccagtgacaccgactcatcccttgaggcatccgcaggccctctgggatgttgcagatag

SEQ ID NO: 195515 - DNA, 960 bp, Artificial Sequence
  Description of Artificial Sequence: Synthetic coding sequence
atggagctgatggacgccaacctgtgccaggtgatccagatggagctggaccacgagagaatgtcctatctgttgtaccagatgctatgcgggattaagcacctccactcggccggaattatccaccgggatctgaaaccgagcaacatcgtcgtgaagtcagactgtaccctgaaaatcctcgacttcgggctcgctcggactgccgggacgtctttcatgatgacaccgtacgtcgtgacacgctactaccgggcacccgaggtgatccttggtatggggtacaaggagaatgtcgatatgtggtctgtggggtgtatcatgggagagatgatcaagggagccgtgctcttccccggaacagaccacatcgatcagtggaacaaagtgatagaacagctgggaaccccttgtcccgagttcatgaaaaagctgcagcccaccgtgaggaattatgtggagaacaggcccaaatacgccgggctgacattccctaagctgtttccagactccctttttcccgctgattcagaacacaataagctcaaagcatctcaggccagagacctactgtctaagatgctagtgattgaccctgcaaaacgcatctctgttgacgatgcactgcagcacccttacatcaatgtgtggtacgatccagcggaagtcgaagccccccctccacagatttatgataagcagctagacgagcgagagcacaccattgaagagtggaaagagctgatttacaaggaggtgatgaactcagaggaaaaaacaaaaaatggagtcgtgaagggccaacctagcccgtccggcgccgcggttaacagctcagaatctctaccaccaagttcatcagtaaatgacatctcttccatgagtacagatcagacgctagcctctgataccgattcatcgctggaagcaagcgcaggccctctgggctgctgccgatag

SEQ ID NO: 195516 - DNA, 102 bp, Artificial Sequence
  Description of Artificial Sequence: Synthetic coding sequence
atgagcaagagcaaggtggacaaccagttctacagcgtggaggtgggcgattccacttttacggtcctgaaacggtaccagaatctcaagcctataggatag

SEQ ID NO: 195517 - DNA, 156 bp, Artificial Sequence
  Description of Artificial Sequence: Synthetic coding sequence
atgagcctgcacttcctgtactactgcagcgagcccaccctggacgtcaaaattgctttctgccaaggctttgacaaacaggttgatgtgtcttatatcgcaaagcactacaacatgagcaagtcaaaggtggataatcagttctattctgtatag

SEQ ID NO: 195518 - DNA, 276 bp, Artificial Sequence
  Description of Artificial Sequence: Synthetic coding sequence
atgagcctgcacttcctgtactactgcagcgagcccaccctggacgtaaagatcgccttctgccaagggttcgataaacaggtggatgtcagctatattgcaaaacattataatatgagcaaaagtaaggtggacaaccaattctactcagtggaagtgggggactcaactttcactgtcctgaaaagataccaaaatctgaagcccataggatcaggcgctcagggcatagtctgcgctgcatacgacgcagtgctggataggaatgtggcctag

SEQ ID NO: 195519 - DNA, 225 bp, Artificial Sequence
  Description of Artificial Sequence: Synthetic coding sequence
atgagcaagagcaaggtggacaaccagttctacagcgtggaggtgggcgactctactttcaccgtcctaaagaggtatcagaatctgaaaccgattggcagtggcgctcagggcattgtttgtgccgcgtacgatgccgtcctggacaggaatgtagccattaagaagttgtcccggcccttccagaatcagactcacgccaagcgtgcgtaccgagagctttag

SEQ ID NO: 195520 - DNA, 366 bp, Artificial Sequence
  Description of Artificial Sequence: Synthetic coding sequence
atgagcctgcacttcctgtactactgcagcgagcccaccctggacgtgaagattgccttttgtcagggcttcgacaaacaggttgacgtgtcgtatatcgcaaagcattacaatatgagtaaatccaaagtcgacaaccaattctattccgtcgaagtgggagatagcaccttcacggtactaaaaaggtaccagaatctgaaaccaattggcagcggcgcacagggcattgtgtgcgcagcatatgacgccgtactggaccgcaatgtggccattaagaaactgtccagacccttccaaaaccagactcatgccaaacgcgcttaccgtgaactagtgctaatgaaatgcgtgaatcataagtag

SEQ ID NO: 195521 - DNA, 354 bp, Artificial Sequence
  Description of Artificial Sequence: Synthetic coding sequence
atgagcctgcacttcctgtactactgcagcgagcccaccctggacgtcaaaatcgccttctgtcagggatttgacaaacaggttgacgtgtcttatatcgcaaaacactacaatatgagcaaatctaaggtggataaccagttttattctgtagaagtgggcgactccacatttactgtactcaagcggtatcagaacctgaagcccatcggctcaggagcgcagggcattgtttgtgctgcttatgatgccgtcctcgatcggaacgtcgctatcaagaaattgagcaggccattccaaaaccagactcacgcaaaacgagcatatagggagctggtcttgatgaagtgttag

SEQ ID NO: 195522 - DNA, 426 bp, Artificial Sequence
  Description of Artificial Sequence: Synthetic coding sequence
atgagcctgcacttcctgtactactgcagcgagcccaccctggacgtgaagatcgcattttgccagggatttgacaagcaggtggacgtttcctatattgccaaacactacaacatgagtaaatctaaggtggataatcagttttacagcgtcgaggttggggactctacgtttactgtactgaagaggtatcagaacctgaagcctattgggtctggcgctcaagggatcgtgtgtgctgcatatgatgcagtactcgaccgtaatgtggccattaagaagctgtcccgaccctttcaaaaccagacacatgctaagagggcttacagggaacttgtgctcatgaagtgcgtgaaccacaagaacatcattagcctccttaatgtatttacgcctcagaaaaccctagaagaattccaggactag

SEQ ID NO: 195523 - DNA, 255 bp, Artificial Sequence
  Description of Artificial Sequence: Synthetic coding sequence
atgagcaagagcaaggtggacaaccagttctacagcgtggaggtgggtgattcaaccttcaccgtgttaaagcggtaccaaaatctgaagcccataggatccggcgctcagggaattgtctgcgccgcctatgacgctgttctggaccggaacgtggctatcaaaaagctgagcaggccatttcagaaccaaacccatgccaagagagcctacagagagctagtgctcatgaaatgtgtgaaccacaagaactag

SEQ ID NO: 195524 - DNA, 159 bp, Artificial Sequence
  Description of Artificial Sequence: Synthetic coding sequence
atgagcaagagcaaggtggacaaccagttctacagcgtggaggtgggagacagcaccttcaccgtcctcaagagatatcagaatttaaagcccatcggttccggcgcacagggtattgtctgtgcagcatatgatgcggtcttggatcggaacgtgtag

SEQ ID NO: 195525 - DNA, 147 bp, Artificial Sequence
  Description of Artificial Sequence: Synthetic coding sequence
atgagcctgcacttcctgtactactgcagcgagcccaccctggacgtgaaaatcgccttctgccagggctttgataaacaggtcgacgtaagttacatagctaaacactataatatgtctaaaagtaaagtcgataatcagttttag

SEQ ID NO: 195526 - DNA, 1008 bp, Artificial Sequence
  Description of Artificial Sequence: Synthetic coding sequence
tgaaacgtggccatcaagaagctgagccggcccttccagaaccagacacacgctaaacgggcttaccgagagctggtcctcatgaagtgtgtgaaccacaagaacatcatctcactcctaaacgtgttcaccccacagaagactttggaagagtttcaggacgtatacctcgtcatggaactgatggacgctaacctttgccaagtaatccagatggaactcgatcacgagcgcatgtcctacctcctctatcagatgttatgcggaataaagcacctccactccgccggcataatccatagagacctgaaaccttcaaacatcgtcgtcaagagtgactgcacactgaagatactcgacttcgggctggccaggaccgccggcaccagctttatgatgacaccctatgtggttacccgctactatagggccccagaagtaattttgggcatgggctacaaggagaatgttgacatgtggtccgtgggatgtatcatgggcgagatgatcaagggcgccgtcctgtttcctgggacagaccacattgatcaatggaacaaggtgattgagcagctaggcaccccatgccccgagttcatgaagaaactccaacctactgtcagaaattatgtcgaaaatagacctaagtacgctggccttacattccctaaattgtttccagactctctgtttcctgctgacagcgaacacaacaagctgaaagcttcccaggcccgcgatctcctgtcgaagatgttggtgattgaccccgctaagaggataagcgttgacgatgctctgcagcacccctacattaacgtgtggtacgatcccgccgaagtggaggcccccccccctcagatctatgataagcaactcgacgagcgcgagcacacaatcgaagagtggaaggaactgatctacaaagaggtgatgaatagtgaggaaaaaacaaagaacggcgtcgtcaagggtcagccgtctcccagtgcccaggtgcaacagtag

SEQ ID NO: 195527 - DNA, 1764 bp, Artificial Sequence
  Description of Artificial Sequence: Synthetic coding sequence
atggccgagaagggcgactgcatcgccagcgtgtacggctacgacctggggggccgcttcgtggactttcagccactagggtttggagttaatgggttggtactgtcagctgtagactccagggcctgcaggaaggttgctgtgaagaagattgccctttctgacgcccgcagtatgaaacatgcgttgcgggaaataaaaataattagacgattggatcacgataacatcgtcaaggtctacgaggtcttggggcctaaaggtaccgacctgcagggcgaattgtttaagtttagtgtcgcgtacatcgtgcaggagtacatggagacggaccttgcacgcctgcttgaacagggtactcttgctgaggagcacgctaagctgttcatgtaccagctgctaaggggactgaaatacatacactcggctaatgtattacacagagacctgaaacccgccaatattttcatatccaccgaagacctggtactgaagatcggcgactttggcctcgctcgaattgtcgaccagcactacagccacaaaggctatctatctgaaggcctcgtgactaaatggtataggagcccacgtctgctgctttccccaaataactacacgaaagccattgacatgtgggctgcaggctgcattctggcagagatgttaactggaagaatgctgttcgctggcgctcatgagctagagcagatgcagctgatcttagagacgattccggtcatcagggaggaggacaaggacgagcttttgagagtgatgcctagctttgtctcctcaacttgggaggtaaagcgacctctacggaaactccttcccgaggtgaactctgaggcaatcgatttcctggagaagattctgactttcaatccaatggacagactcaccgccgaaatgggccttcagcacccctacatgtccccatattcttgccccgaagacgagcccactagccaacaccccttcagaattgaagatgagattgacgatatcgtcctcatggccgccaaccaatcccagctctcaaactgggacacctgtagcagccggtaccctgtctccctgtcgagtgatctcgagtggagacccgatcggtgccaagacgcctctgaagtgcagcgggatccaagagccggctccgcgcctcttgcggaggatgtgcaggtcgatccccgcaaggacagtcacagctcgtccgaacgattcttggagcagtcccattctagtatggagagggcatttgaagccgactacggtcgcagctgcgactacaaagtcgggagtccatcttacttagacaaacttctgtggagagacaacaagccacaccactacagtgaacccaagctgattttggatctgagccattggaaacaggccgccggggccccaccaaccgctaccgggctggctgatactggagcacgggaggacgagccagcgtccctgttccttgaaatcgcacagtgggtgaagagtactcaggggggacctgagcatgcaagcccccccgcagacgacccagagcggaggctgtctgcttctcccccggggcgtcccgcaccagtcgacggtggcgccagtcctcaattcgatctcgatgtcttcatcagcagagcacttaaactgtgcactaagcccgaggacctgcccgataataagctgggcgacctgaatggggcgtgtattcccgagcaccctggtgacctcgtgcagactgaagcattctccaaggagagatggtag

SEQ ID NO: 195528 - DNA, 1131 bp, Artificial Sequence
  Description of Artificial Sequence: Synthetic coding sequence
atgtgggccgccggctgcatcctggccgagatgctgaccggccggatgctattcgctggcgcacatgaactcgagcagatgcagctcattcttgagacaatacctgtgattcgcgaagaggataaggatgaactgttgagagtgatgcctagcttcgtgagttcgacctgggaggtgaagcgccctctacggaagctgctccccgaagtgaacagcgaagccattgactttctcgagaaaattctgaccttcaatccgatggataggctgaccgcagagatgggcttgcagcatccttacatgtccccctactcctgcccagaggacgagcccactagtcagcatcccttccgcatcgaagacgaaattgacgatatagtgctgatggccgcaaatcagtctcaactttctaactgggatacatgttccagcaggtaccctgttagcctttcatcagatctagagtggcgtccggataggtgtcaggatgcctcagaagtccagagggacccacgggctggcagcgctcctctggcagaggacgtgcaggtggaccctaggaaagactcccacagctctagtgagcgctttctggagcagtctcatagctccatggaacgagcctttgaggcagactacggaaggtcatgcgattataaggtcggcagccctagctatctggacaagctcctctggagagacaataaaccacaccattacagcgaacctaagcttatcttggacctgagtcactggaaacaagcagccggtgcccctccaaccgcaactggattggctgatacaggagcaagagaggacgagccagcctcactcttcctggaaatcgcacagtgggtgaagtcaacacagggggggcccgaacatgcttctcctcccgcagacgatccagaaagaaggctgagtgcatcccccccagggagacctgcccctgttgacggcggtgcatcacctcagttcgatctggacgtcttcataagtagagcccttaaactgtgtaccaaaccagaagatctgcctgacaataaattgggggatttaaacggcgcatgtattccagaacaccccggcgatctggtgcagaccgaagccttctccaaggagcggtggtag

SEQ ID NO: 195529 - DNA, 2034 bp, Artificial Sequence
  Description of Artificial Sequence: Synthetic coding sequence
atggagagcgacctgcaccagatcatccacagcagccagcccctgaccctggaacacgtgcggtatttcctctatcagctccttcgcggtctcaagtatatgcatagtgcccaggttattcatagagaccttaagccgagcaatctcctggtgaatgagaattgcgagctgaaaatcggggacttcggcatggcacgtggactttgtacatccccagccgaacaccagtatttcatgacggagtatgtggccacacgatggtaccgggccccagagttgatgctctcattacatgagtacacacaggcaattgatctgtggtcagtgggctgtattttcggcgagatgctggcgagacgtcagctgtttcctggaaaaaactacgtgcaccagctccagttgataatgatggtgctggggactcccagtcctgcagtgatacaagcagtgggagcggagagggtccgtgcctacatccagtccttgcctcctcgccaacccgttccatgggaaacggtgtaccctggggccgatcgtcaggctctgagcttgcttggtcgcatgctcagatttgagcccagcgcgcgcatctcggcagccgctgcactccgacacccctttttggcaaagtaccacgacccagatgatgagccggactgtgccccaccattcgacttcgcatttgatcgggaagccttaaccagggagcgcataaaagaggcgatcgttgccgagatcgaagattttcatgccaggcgagagggcattcgccagcagatccggttccaaccctccttacagcctgtcgcatccgagccggggtgcccagatgtggaaatgccttcaccctgggcaccctcaggcgactgtgccatggaatcccctccacccgctccaccaccctgcccagggccggctcctgacacgatcgacctgacactccagcctcccccaccagtgtcggaacctgccccccccaagaaggatggcgccatctctgacaacactaaagcagcactgaaggcagcactcctcaaaagtctacgatcaaggttaagagacgggccatcggctccattggaggctcccgaaccgaggaaaccggtgacggcccaagaacgccagagagagcgggaggagaagcgcaggaggcggcaggagcgggctaaggaacgggagaagcgccgacaggaacgggaaagaaaagaacggggagcgggggcaagcggtggaccaagcacagatcctctggccgggttggttcttagcgacaacgaccgcagcctgctagagcgttggacacggatggcgagaccagctgcaccagcgctgacgagtgtgccggctcctgcacccgccccaacacccacccctacacctgttcagccgacgtcccctccacccggcccagtggctcagcctaccggaccccagccacagagcgccggtagtacctccgggccagttccccagcctgcctgtccaccccccggcccggcaccccacccaaccggtccgcctggaccaattccagtgccagcacccccacagattgcgacgtctacttcactcctggctgcccagtcactggttcccccgccaggcctgcctggtagctctaccccgggcgtgttgccttactttccacccggattgccaccgcctgatgccgggggggccccccaaagctccatgtcagagtcaccggacgtaaacctcgtgacacagcagctgtctaagtcccaggtcgaggatccactgccacccgtgttttccgggacccccaagggatccggggccggctacggtgtggggtttgacctggaggagtttctcaatcagtcctttgatatgggtgtggctgatggtccccaggacgggcaggctgactccgcgagcctgagcgccagtcttcttgccgactggctggaaggtcacggaatgaatcctgcagacatcgagtccttacaacgcgaaattcagatggactccccaatgctgctggccgatcttccagacctgcaggatccctag

SEQ ID NO: 195530 - DNA, 2451 bp, Artificial Sequence
  Description of Artificial Sequence: Synthetic coding sequence
atggccgagcccctgaaggaggaggacggcgaggacggcagcgccgagccacctggccctgtcaaagccgaacctgcacacactgctgccagtgttgccgcaaaaaatcttgccctcctgaaagctcgaagcttcgacgtaaccttcgatgtgggagatgaatacgagatcatcgaaactattggaaatggcgcctacggggtggtcagcagcgcccgccgcaggctgactgggcaacaagtggctattaagaagattccgaatgctttcgatgtcgtaaccaatgctaagagaacgcttagagagctaaagatactcaagcactttaagcatgataacatcatcgcaattaaagatattctgaggcctaccgttccatacggggagttcaagagtgtttacgtggtactggatctcatggaaagtgacctccaccagattattcacagctcccagcctctgacactcgagcacgttaggtactttctctaccagctcttgcggggcctgaagtacatgcattcagcccaggtcatccatagggacttgaagccctccaacttattggtgaacgagaattgcgagctcaagatcggtgactttggaatggcccgtggactgtgcacgagtccagctgagcatcagtacttcatgaccgagtatgttgcaaccaggtggtacagggcgcctgaactcatgctgtcccttcacgaatacacccaggctattgacctgtggagcgtcggatgcattttcggtgaaatgctggcacgccgccaactattcccagggaagaactacgtgcatcagttacagctgattatgatggttctcggtaccccctcccccgcggtgatacaggccgtgggcgctgagcgggtacgggcatatatccagtctctgcctccaaggcaacctgtaccctgggagacagtctaccccggcgcagacaggcaggctctgtcactcttagggcgcatgctgaggtttgaacctagcgctaggatttctgcagctgctgctctcagacatccgtttttggccaagtatcacgacccagatgatgagcctgactgcgcccccccattcgactttgcatttgatcgggaggctctgacccgggagcgaataaaggaggccatcgttgccgagattgaagacttccatgccagaagggaagggatcaggcagcagatcagatttcagcctagcttgcagcccgtcgccagcgaaccggggtgccccgacgtggaaatgccgagtccttgggccccatctggagattgtgctatggagtcccccccccctgctccgcccccgtgtcccggaccagccccggacacaattgatctcactctgcagccgccgcctcccgtttcggaacctgcgccccctaagaaggatggagcaatctcagataacaccaaagccgcacttaaggccgctctgctgaaaagcttgaggagccggctgcgtgacggaccttctgcgccactggaggccccggagcctcgtaagcccgttaccgcccaggagcggcagcgagagagggaggagaaacgcagaagacgtcaggagagggcgaaagagcgggagaaaaggcgccaagagagagagaggaaagaaagaggagccggcgcgagcgggggacctagcaccgatccattagctggtctggtgctcagtgataacgataggtcacttctcgaacggtggacgcgcatggccaggcctgcagcccccgctctaactagtgtaccagcacctgccccggctccaactcctactcctacacccgtgcagcccacctcccctcctccagggcccgtggcacagcctacagggccgcagcctcagtcagccggctccaccagtgggccggttccacagcccgcctgtccaccgcctggcccggccccacaccccaccgggccgcccggacctatccctgtgccagctccaccacagatcgccacctcaacgtccctcctggccgcccagtcgctggtgcctcctcctgggcttcctggcagttcaacccccggtgtgctcccatattttcctccgggactgccgccccctgatgcaggaggagctccgcagtcaagcatgagtgagtctcctgacgttaacttggttacgcaacagctgagcaagagtcaggtcgaagatccacttccacctgttttttccggaacacctaagggcagcggcgctgggtacggcgtcggttttgatcttgaggagtttctcaatcaaagctttgacatgggtgtagcagatggacctcaggacggccaggccgatagtgcatccttaagtgccagtcttctcgctgattggcttgagggacatgggatgaaccctgccgatatagagagtctgcagagagagattcagatggactcccctatgctgctggccgacttacctgatctgcaggacccctag

SEQ ID NO: 195531 - DNA, 2451 bp, Artificial Sequence
  Description of Artificial Sequence: Synthetic coding sequence
atggccgagcccctgaaggaggaggacggcgaggacggcagcgccgagccgcccgggccagttaaagctgaacccgcccataccgcagcctcggtcgcggcaaagaatctggccctcctgaaggctcggagcttcgacgtaacttttgacgtgggagatgagtacgaaatcatagagactattggaaacggagcttacggggtggtctcttcagccagacgtagactgaccgggcagcaggtcgcgatcaagaaaattccaaatgctttcgatgtggtaactaatgcgaagagaacccttagggagcttaagatcctaaaacactttaaacacgacaatataatcgctatcaaggatatcctgcgacccactgtaccctatggagaattcaagtcggtgtatgtggttcttgatctaatggagtccgatcttcaccaaatcatacattctagccaacctctgacactggagcatgttaggtattttctctaccagctgctgcggggtttgaagtatatgcactctgcacaggtcatacacagggacctgaagccatcaaatttactggtcaatgagaactgtgaacttaagatcggagacttcggaatggcccgaggtctgtgtactagccccgcagagcaccagtactttatgaccgagtatgtggccaccagatggtaccgcgccccggagctcatgttgagcctccacgaatacacccaggccatcgacctttggtccgtggggtgtatctttggcgaaatgctggcacggcggcagctgttccctggcaaaaattacgtgcatcagctacaactcatcatgatggtgctaggcaccccatccccagctgtgatccaggctgtcggagccgagcgcgttcgtgcatatatccagtcactgcctcctcgccagccagttccttgggagactgtgtaccctggagcagacagacaggcactgagtcttttaggcaggatgctgaggtttgaaccctctgcacgtatctccgcggccgccgctctccgccacccgttcttggccaaataccatgaccccgatgatgagcctgattgtgctcccccttttgattttgccttcgatcgcgaagctcttacacgcgagaggatcaaggaagctatcgtggcagaaatcgaggactttcacgcccgacgggaaggtattcggcagcaaattcgcttccaaccaagtcttcagcccgtagcctctgagccagggtgtccagatgtcgaaatgccgtctccatgggccccgagcggcgattgtgctatggaatctccacctcccgctcctcctccctgtcctggccccgctccggataccattgatctgacactgcagccaccaccaccagtgtctgagccggctcccccgaagaaggacggggccattagcgataacacaaaggccgcattgaaagccgcactgttaaagtcactgaggtcacggctgcgggatgggccgtccgcccctctcgaggcaccggagccccgaaaacccgtaaccgcacaggaaagacagagggaacgagaggaaaaacggaggaggagacaggagcgcgcaaaagagagggagaagagaagacaggagagagaaagaaaagagcgtggtgctggggcaagcggggggccttctacagacccactcgccggattggtactgtctgacaacgatcggtccttgttggagcggtggacccgcatggcaaggcctgctgcgccagctcttactagcgtgccagcccctgcgccagcccccactcccaccccaacccctgtccaacccacgtcccctcctcctggtccagtcgctcagcccactggaccacagcctcagagcgctggctctacttccggccccgtgccgcagcccgcatgcccccctccggggccagcccctcatccaaccgggccccccggacccattccggtgccagcccccccccagatcgcaactagcactagcctgcttgccgctcagtcactcgtgccaccacctggccttcccgggtcttccactccgggcgtcctgccatactttccccctggcctccctccgcccgacgccggaggggccccacagtcatctatgtcagagtcccccgatgtcaacctggtgacccagcaactcagcaagagtcaagtggaagatcccctgccccctgtcttcagtggtacccctaaaggaagtggagcaggctacggcgtagggttcgacctcgaggagttcttgaatcagtctttcgacatgggcgtagccgatggacctcaagatggccaagccgactctgcttcattgtctgcgagtctcctcgcagactggctcgagggccacggtatgaatcccgctgacattgagtcattacagcgggaaatccagatggacagcccaatgctcctcgccgaccttcctgacctgcaggatccttag

SEQ ID NO: 195532 - DNA, 2451 bp, Artificial Sequence
  Description of Artificial Sequence: Synthetic coding sequence
atggccgagcccctgaaggaggaggacggcgaggacggcagcgccgagcccccaggccctgtgaaggccgaaccggctcacaccgctgcgtccgtcgccgctaagaatctggctctgcttaaagcgagatcatttgacgtgacttttgatgtgggtgatgaatacgagatcatcgaaacaattgggaacggagcctatggtgtggtgagcagtgccagacggcggctgaccggccagcaggtggcaataaaaaagatcccaaatgccttcgatgtggtaaccaatgccaaacgaactttgcgcgagctcaaaatcctgaaacacttcaagcatgataacattatcgcaattaaagatatccttaggccaaccgtgccctacggggagttcaagtcagtctacgtggtcctcgatctgatggagagtgatctgcaccagatcatccattcctcccagcctcttaccttggagcacgtgcgttactttctttatcagctgctgcgaggcctgaaatacatgcactctgctcaggtcattcatcgggatctgaagccgtctaatctgctcgtcaacgaaaactgcgagcttaaaattggggattttggcatggcacgcggactttgtaccagtcccgccgagcaccaatacttcatgaccgaatacgtggccacacggtggtatagagccccagagctgatgctgtctttacacgaatatacccaggcaattgatttgtggtccgtgggttgtatcttcggagaaatgctggcccggcggcaattgttccctgggaaaaattatgtccaccagctgcaattgattatgatggtgctggggacaccttctccggctgttattcaggccgtcggcgctgaaagagtccgcgcttacatacagtctcttccaccgagacaaccagtcccctgggagacggtgtatccgggcgccgaccggcaggcgctatccctcctgggacgcatgctgcgcttcgaacctagcgctagaatttcagcagcggccgccctgagacatccattcctggctaaataccacgatccggatgatgagccggactgtgctcctccttttgattttgcctttgaccgcgaagcactcaccagggaacggattaaggaggctattgtcgctgagattgaagattttcacgcccgcagggaggggattcgtcagcagatccggttccagccttcgttgcagcccgtggccagcgagccaggctgtcctgacgtagaaatgccttccccctgggcccctagtggtgactgtgctatggaaagtcctccgccggctccccccccatgccccggcccagctcctgataccatcgacttaaccctgcaacctcccccgcccgtgtccgaacctgcacctccgaagaaagatggcgccatctcggataacactaaggccgccttgaaggccgccttgcttaaaagcctgcgcagtcgacttcgagacggtccgtcagccccactagaggcacccgaaccaaggaagcctgtgaccgcccaagaacgacaacgtgagcgggaagagaagcggaggagaagacaggagcgggccaaagagcgggagaagaggcggcaggagagggaaaggaaggaacggggagctggcgcatcaggggggccctctaccgaccccttagctggcctagtgctgagcgacaacgacagaagcctgctagagcgatggacacggatggcacggcccgcggccccagcactaacctctgtgccagctccagccccggcccctactccaacccctactccagtgcagcccacctccccacctcctggtccagtggcccaacccacaggaccccaaccacagtcggcgggctctactagcggaccagtgccacagcctgcttgccccccccccggccccgctccacaccctactggcccacccggacctattcccgtgcccgcccctcctcagatcgctacaagcacctcactcttggccgcccagtccttagtgcctccccccggattgccaggatccagtactccaggcgtcctgccatacttccctcccgggctgcctccccccgatgccggaggtgccccacaaagcagtatgtccgagtcgccagacgtcaatctggtgacacagcagttatctaagagtcaggtagaagatcccctgccaccggtcttttctgggaccccaaaagggtcaggagcgggctatggtgtgggctttgatctggaggaatttttaaaccaatcctttgacatgggcgtggctgacggccctcaggacgggcaggccgactctgcctctctatccgcttcactgttagccgattggttggaaggtcatggaatgaatcctgcagatattgaatctcttcaaagggagattcaaatggactcccccatgctgctggctgatctccccgatcttcaggatccttag

SEQ ID NO: 195533 - DNA, 726 bp, Artificial Sequence
  Description of Artificial Sequence: Synthetic coding sequence
atggccgagcccctgaaggaggaggacggcgaggacggcagcgccgaacctccagggcccgttaaggccgagcctgcgcacaccgctgcaagcgtcgccgccaagaacctggctctccttaaagctaggagcttcgacgtgacatttgatgtgggagatgagtatgagattatagaaaccattgggaatggggcctatggcgtcgtttcttcagcacgtcgaaggcttacaggtcagcaggttgcgattaaaaagatcccgaatgccttcgatgtggtaaccaatgcaaagcgaacactacgtgagctcaagatactcaaacactttaagcacgataacatcatcgccattaaggatatcctgcgccccactgttccttacggggagtttaagagcgtgtacgtggtgctggacctgatggaatcagatctccaccagatcatccatagctcccagcccctgacactagagcacgtacgctatttcttataccagctgttacgcgggttgaaatacatgcactccgctcaggtgattcaccgggacctgaagccgagcaatctgttagtgaacgaaaactgtgaattgaaaataggagacttcggcatggccaggggactgtgcacctctcccgccgaacatcagtattttatgactgaatatgttgcgacaagatggtatagggcccccgagctgatgttaagcctgcacgagtatactcaatag

SEQ ID NO: 195534 - DNA, 2136 bp, Artificial Sequence
  Description of Artificial Sequence: Synthetic coding sequence
atggccgagcgggagagcggcggcctgggcggcggcgccgccagcccccctgccgcgtcccctttcctcggtttgcacatcgctagccccccaaactttcggcttacccatgatatcagccttgaagagtttgaagacgaagatctgtctgagatcaccgacgagtgtggaatttccctgcagtgcaaagacactctgtccctcaggccgcccagggctgggctgctgtcagctggcggaggaggtgcagggagccgcctccaggctgaaatgcttcagatggacttaattgatgcaacaggagatacacctggtgcagaagatgacgaggaagatgacgatgaggagcgcgcagcccgcaggccgggcgctggcccaccaaaagcagagagtgggcaggaacccgcttcaagaggtcaggggcagtcacaggggcagagccagggacctggcagtggcgacacatatcgacctaaaagaccaactacattaaacttgtttcctcaggtgcccagaagccaagacactctgaataacaattccctcggcaaaaagcactcctggcaggatagggtctcccgcagctcgagcccactgaaaacgggcgaacagacacctcctcacgaacacatttgcctaagtgatgagctgcctcctcagtcaggcccggcacctacaaccgatagaggtacttctacggactccccctgcaggaggagcactgccactcagatggccccaccaggcggacccccggccgctcctcctggcggtcgaggccactctcatagggatagaatccattatcaggccgatgtcaggttggaggccacagaagaaatctaccttacacccgtgcaacgacctcctgatgccgcggagccaactagcgcatttctgccccctacagaaagtaggatgtcagtgtccagcgatccagatcccgccgcttaccccagtacggcaggtaggccacacccctctataagtgaagaggaggaggggtttgactgcctgtcaagcccagaaagagccgaaccgccagggggtggatggcggggatccctaggggaacccccccccccgccccgcgcttcattatcttctgatacgtcagctctgagttacgatagtgtcaagtatacccttgtagttgacgaacatgctcagctggagctggtgtctctaagaccctgttttggcgattacagtgatgagtccgatagtgctaccgtttatgataactgcgcttccgttagcagcccctacgaaagcgctattggtgaagagtacgaagaagccccgaggccacagccccccgcatgtctgagcgaagacagtacgcccgacgagcccgacgtgcatttttctaagaaatttttgaatgtctttatgagcggccggagcaggtcgtcaagtgccgaatcttttggattattctcttgcataatcaatggggaagagcaggagcaaacccaccgcgccatttttcggtttgttccccgtcacgaggacgagctggaactcgaggtggatgatccacttctggtggagctacaggctgaggattactggtacgaagcctataacatgcggacaggggcccgtggcgtctttcccgcctattacgcaatcgaagttaccaaggaacccgaacacatggcagcacttgctaaaaacagcgactgggtggatcaattccgggtgaaattcctgggctcggtgcaggtcccataccataaaggaaacgacgtgctctgtgcggcaatgcagaagattgccacaacccggagacttaccgttcacttcaatcctccaagcagttgcgtcctagaaatctcggtccgtggagtaaagatcggtgtgaaggcggacgattctcaggaagccaaggggaataagtgcagccacttctttcaactcaaaaatataagcttctgcggctatcatcctaagaataataagtattttggttttattaccaaacatcctgccgatcataggtttgcctgccatgtctttgtgagtgaggatagcactaaggctttggccgaaagtgtgggcagagcatttcagcagttctacaagcagttcgtggagtacacctgtcctactgaggacatctacctggagtag

SEQ ID NO: 195535 - DNA, 1797 bp, Artificial Sequence
  Description of Artificial Sequence: Synthetic coding sequence
atgctgcccgacttccccagccccagcacctgggcccccggcctgttgctacccagtggccccgcactgctgtccccgtccgtactgcaagatagtctttccctcggacgcagtgaacaaccacacccaatttgctctttccaggacgatttccaggagtttgagatgatcgatgataacgaggaggaggatgatgaagatgaggaggaggaagaggaggaagaggagggcgatggcgagggacaagagggcggggatccaggctctgaagcacccgcacctggacccttaatcccttccccgagtgtggaggaacctcacaaacacagaccaactacacttcggctcaccaccttgggcgcccaagacagtcaagaccccgaggccgcagctggcccaggcggagttgaacttgtggacatggagacactgaaccccaccagagatactatcaccccgctgtgggcagcccctggccgagcagcaaggccgggacgtgcctgttcagccgcgtgctccgaggaagaagatgaagaggatgacgaagaggaggaagatgctgaagactctgcaggctcgcctggagggcgcggaacaggaccctctgccccacgtgatgcatctctggtctatgatgcggttaagtacaccctcgtggtagacgagcatactcaactggagctggtatctttgagacggtgcgcagggctggggcatgactccgaggaggacagtggaggagaagcctcagaagaggaggctggggccgccctgctgggtggagggcaggtgtcaggcgacaccagtcccgacagtcctgatttaactttttcgaagaagttcctgaacgtcttcgtcaattccacttctagaagctccagcaccgaatcgtttggtctgttctcttgtctggtgaacggggaagagcgggaacagacacatcgtgccgtgttccgcttcatcccgcggcatcctgatgaactagagctggatgtggatgaccccgttttggtcgaggcggaggaggacgatttctggttcagaggcttcaacatgaggaccggcgagagaggagtatttcccgctttttatgcacacgcagtcccaggcccggcgaaggacctcctcggatcaaaacgctccccttgttgggtggagcgtttcgacgtccagttcctcgggtccgttgaggttccttgtcaccaggggaacgggatcctgtgcgcagctatgcagaagattgcaactgccaggaaactgaccgtgcatctccggcctcctgcttcatgtgacttggagattagcttgcgaggagtgaagctgtcattgtcaggggggggccctgaatttcagaggtgttcacacttcttccagatgaaaaacatttctttctgtggttgccacccacggaacagttgcgaggccccccaaggggctgcattccaatgggaacgcggggtggaccgcaagcgagttctgcagacaagaggaaatgttcagcctcaccttggggcaggacagggcgcggccttgaaccgcgccacggaagggagctctactggcagcgagaaaggcgaatggacgccactcgtgattatggagttaactcagtccgtaaatagttgctatttcggttttatcactaaacaccccctcctgtctcggttcgcatgtcacgtgttcgtctcccaggagagcatgcgacctgttgcccaatctgttggccgagcctttctggagtattatcaagaacacctggcatatgcttgccctactgaggatatctacctagaatag

SEQ ID NO: 195536 - DNA, 2472 bp, Artificial Sequence
  Description of Artificial Sequence: Synthetic coding sequence
atggccgaccgggccgagatgttcagcctgagcaccttccacagcctctcccctccagggtgccgacctccacaagacatttcattggaggaattcgacgacgaagatctgtcagagattaccgatgactgcggcctggggctgtcttatgactcggaccattgcgagaaggattctctttccctcggaaggtctgaacagcctcaccctatttgttccttccaggacgacttccaggagtttgagatgatcgatgataatgaggaagaagacgatgaggatgaggaggaggaagaggaggaggaggaaggagacggcgaagggcaggaaggaggggatcctggctcagaggctcctgctcccggcccactgattccgtcacctagtgtggaagagccccacaagcacagacccactaccctaagattgacaacattgggagcccaggatagcctcaacaataacggcggcttcgaccttgtccgccccgcgtcctggcaagagactgcattatgctcacccgctccagaggctctgagagagctgcccggccctttgcccgcgacagataccgggccaggcggcgctcagtcacccgtgaggcctggttgcgattgcgaggggaatcgcccagccgaacctcccgctcctgggggtacctccccatccagcgacccgggcattgaggctgacctgaggtcacggtcaagcgggggcagagggggccggcgctcctcacaggagctctcaagtcccggtagcgattccgaagatgctggcgggcgcctcggaaggatgattagtagcatcagcgaaactgagctcgagctgagttccgacggcggaagtagctcctcaggccgaagctctcatctgaccaattccatcgaggaggcttcttcaccagcgtcagagccagagcctcctcgggaacctcccaggcggcccgcatttctgcctgtgggccccgatgacactaatagtgaatacgagtctggctcagagtcagaaccagacctgagtgaggacgcagatagtccttggttattgagcaatctggtgtcacgtatgatttccgaggggagttctccaatcagatgccccgggcagtgcctgtcccctgctccccggccaccaggcgagccagtgtcccccgccgggggggccgcgcaggatagccaggatccagaagccgccgctggtccaggaggggtagagctggttgatatggagaccttgtgcgctccaccccctcccgcccccgctgcaccccgacctggtccggctcaacccgggccctgcctgtttctgtctaaccccacccgagatacaattacccccctatgggctgccccaggtagggctgctcgccccggtcgcgcctgcagcgctgcttgctcagaggaggaggacgaggaagacgacgaggaagaagaagacgccgaagattcagcgggatcaccgggagggcggggaaccgggccctctgcccccagggacgcctcattggtttacgatgctgtgaagtatacgctggtggtggatgagcatactcagttggagctggtttccttgcgccgctgcgccggacttgggcatgactcagaagaggactcagggggtgaggcctcagaagaggaggcaggcgcggcattgctgggcggagggcaagtctcgggagataccagccctgatagtcccgatcttacattcagtaagaaattcctgaatgtgttcgtaaatagcacgtctagatcgtctagcacagagagctttggtctctttagctgcctggttaatggggaggagcgcgaacagacacatcgtgcagtattccggtttatcccaaggcaccccgatgaattagagctcgatgtggacgacccggtgctggtagaagcggaagaggacgacttctggttccggggctttaatatgcgcacgggcgagcgaggggtttttcccgcattttatgcacatgctgtgcccggcccagcaaaagatctcctcggttcaaagaggagcccgtgctgggtggaaaggttcgacgttcaattccttggcagcgttgaggtcccatgccaccagggcaatggtatcctctgcgccgccatgcagaaaatagcaaccgctcggaaactgaccgtgcacctgagaccacccgcatcctgtgacttggagatttccttaagaggggtgaagctcagcctgtcaggcggcggccccgagtttcagcggtgcagtcactttttccagatgaaaaatatcagcttttgcgggtgccaccctaggaacagttgctattttggatttatcactaaacatccgctccttagtagatttgcctgccatgtgttcgtctctcaggagtctatgcgccccgtggctcagtcagtcggtcgagcttttcttgagtattatcaggaacacctggcatacgcatgcccgaccgaagatatttacctggaatag

SEQ ID NO: 195537 - DNA, 1335 bp, Artificial Sequence
  Description of Artificial Sequence: Synthetic coding sequence
atggccgaccgggccgagatgttcagcctgagcaccttccacagcctcagcccccccggttgccgccccccccaggacatttcacttgaggagtttgacgatgaggacttgtcagaaataacggatgactgcggattagggctatcctacgactctgaccactgtgagaaagattcactgtcacttgggcgaagtgaacagccgcaccctatttgttcctttcaagatgattttcaggagtttgaaatgatcgacgacaatgaggaggaggaagacgaggaggatgatgaagaggaagaggatgcagaggattcagcgggcagccccggaggaagggggaccggcccctctgccccaagagatgcttccctcgtttacgatgctgtgaagtacaccttggttgtcgatgagcacactcagttggaactcgtgtctctccggaggtgcgctgggctcggtcacgacagtgaggaagattccgggggggaggcttccgaggaagaggctggggcagcgttgttgggagggggccaggtatccggggacacctcaccagattcacctgatctgactttttcaaagaagttcctaaatgtttttgtgaactcaacatcaagatctagttctacagagtcctttggcctgttctcctgcctcgtgaacggagaggagcgagaacagacacatcgagcagtctttaggtttatccccagacatcctgacgaactcgagctggatgtggatgaccctgtcctggtcgaagccgaagaggacgatttttggtttcggggcttcaacatgaggacaggagagagaggggtcttcccagctttctatgcccacgccgttccgggaccggctaaggatctgctcggaagcaaaaggagtccctgttgggtcgaacgcttcgatgtgcaattcttgggaagcgttgaggtaccttgtcaccagggcaatggtatcctttgtgcagctatgcaaaagatcgcaacggctcgcaagcttactgttcatctgcgccctcctgcaagttgcgacctggagatttccttacgcggcgtcaagctctccctgtctggcggtggtcctgaattccagcggtgttctcacttttttcagatgaagaacatttcattctgtggctgccacccccgaaactcgtgttactttggtttcatcaccaaacaccctctgttgtctagatttgcctgtcatgtgtttgtcagtcaggaatccatgagaccggtggcacaaagcgttggccgtgcgttcttggagtactaccaggagcacctggcctatgcctgcccgactgaggacatctacctggagtag

SEQ ID NO: 195538 - DNA, 1677 bp, Artificial Sequence
  Description of Artificial Sequence: Synthetic coding sequence
atgatcagcagcatcagcgagaccgagctggagctgagcagcgacggcgggagctcctcgtctggcagatcaagtcatcttactaattctatcgaggaggcgtcaagtcctgctagtgagccagagcctccacgtgaaccccctcgtcgccctgccttccttcctgtgggtccagatgatacaaattcggaatacgagagtggatctgagtctgagcctgatctgagcgaggacgctgactcgccatggcttctgtcaaatttagtgagcagaatgattagtgagggcagcagtccaattaggtgcccgggccagtgtctcagccctgctcctaggcccccaggggagcccgtttcgcctgcaggaggcgctgcccaagattcccaggatcccgaagccgctgctggccctgggggggtggagctggtggatatggagactctgtgcgccccaccaccacctgccccggctgctccaagacctgggccagctcagcccggcccctgcctattcttgtctaatcctaccagggatacgattacacccctatgggctgcaccgggtcgtgccgccagacctggcagagcttgtagcgcggcttgctcagaagaggaagatgaagaagatgatgaagaagaagaggacgctgaggattcggctggctctcctggaggacgcggaaccggcccttctgcacccagggacgcctctctcgtctatgacgccgtcaaatatacattggtggttgacgagcacacccagttggaactcgtcagtctcaggcgctgtgctgggctcggacacgacagcgaggaggactctggtggggaggcatccgaagaagaagctggcgccgcgctgttaggtggcggacaggtttctggagatacatcaccggacagtccagacttgactttttcaaagaagttcctgaacgtttttgtgaattccacttctcggtcatcatccacagagtctttcggattgttctcttgcctcgtcaatggagaggaacgcgagcagacacacagggctgtgttccggtttatcccgagacatccagatgaactggagttagatgtcgatgatcctgtgctggtcgaagccgaagaagatgacttttggtttcgaggattcaacatgaggactggcgaaagaggagtcttcccggcattttacgcacacgccgttccaggccccgccaaggacctgctcgggtcaaaacggtctccctgttgggtggagaggttcgacgtccagtttctggggagcgtggaggtgccctgccatcagggtaatggtattctgtgcgctgccatgcaaaaaattgcaacagcccgaaagctcaccgttcatctgcgccccccggcatcctgtgacctggaaatatccctccgcggagtgaaactatccctgtcaggtggtggccctgaatttcaaaggtgcagccatttttttcaaatgaagaatatcagtttttgtggctgccacccacgaaactcctgttactttggttttatcactaagcaccccctgctgagccggttcgcctgccacgtgttcgtgtcacaggaatccatgcggcccgtagctcaatccgttggaagggccttcttggaatattaccaggaacatctggcttatgcctgcccaacagaagacatttacctcgagtag

SEQ ID NO: 195539 - DNA, 1677 bp, Artificial Sequence
  Description of Artificial Sequence: Synthetic coding sequence
atgatcagcagcatcagcgagaccgagctggagctgagcagcgacggcggttcttcaagcagcggacgcagttctcatctgaccaatagtattgaggaggctagctcaccggcctccgagcctgaaccgccaagggagccacccagacgcccagcttttctccccgtgggccctgatgacaccaatagtgagtacgagtcagggagcgaatctgagcctgacctgagtgaagatgccgactcaccatggttattaagcaaccttgtaagcaggatgatcagcgaaggctcttcaccaatcagatgcccaggacagtgtttgagtcccgcccctcggccgcctggagagcctgtgagccctgcggggggtgcggcacaggatagtcaggatcccgaggccgccgctggccctggcggagtggagctagtggatatggagaccctttgcgctcctccgccccccgcgccagctgccccccgaccaggcccagctcaaccgggaccctgtctcttccttagcaatccgacaagggacacgatcaccccgctttgggccgccccgggcagggcagctaggcccggacgcgcttgctctgctgcttgctcagaagaggaggatgaagaagacgatgaggaggaagaagatgcagaggattcagcgggctcacctgggggaaggggaactggaccaagcgccccgagagatgcaagtctggtctacgacgcggttaagtacacacttgtggtcgacgagcatactcagttagagttagtgtctttacggcggtgtgccgggctgggacacgatagcgaggaagatagcggtggggaagcatccgaggaagaagcaggggccgccttactcggcggcggccaggtcagcggggatacatcacctgactctcctgaccttactttcagcaaaaagttcctgaacgtgttcgtgaactcgacatcgcggtcttctagtaccgagagttttggtttgttctcatgcctggtcaacggcgaggagcgtgaacaaacccaccgagctgtgttcaggttcatcccaagacatcccgatgagcttgaactagacgttgacgaccctgttctggttgaggcggaggaagacgatttctggttccgaggtttcaacatgagaacaggcgagagaggcgttttcccagctttctatgcacacgcagtccccgggccagccaaagatctccttgggtctaaacggagcccctgttgggtagaaagattcgatgttcaattcctcgggagcgtagaggtcccgtgccaccagggaaacgggatcctgtgcgctgccatgcagaaaattgcaactgcccgcaagcttacggtacatttgagaccacccgcaagctgtgacctggagatttccttacggggggtcaaactgtccctttctggcggcggacccgagtttcaaaggtgttcccactttttccagatgaaaaacatctccttttgcggatgccacccccggaattcttgctacttcggttttattactaagcaccccctcctaagccggttcgcttgccacgtctttgtcagccaggaaagtatgagacctgtggcacagtcggtcggacgcgctttcctcgaatactaccaggagcacctagcttatgcatgccccaccgaggacatctatctggagtag

SEQ ID NO: 195540 - DNA, 1641 bp, Artificial Sequence
  Description of Artificial Sequence: Synthetic coding sequence
atggccgaccgggccgagatgttcagcctgagcaccttccacagcctctccccacctggatgccgaccccctcaagacattagcttggaggagtttgatgacgaggacctctcagagattaccgatgactgcggactaggactgagttacgactctgatcattgcgagaaggactcgttgagcctcggtcgcagcgaacagccacaccctatctgttcattccaggatgacttccaggagttcgagatgatcgatgataatgaagaggaagatgacgaagacgaggaggaagaagaggaggaggaggaaggcgacggtgaaggccaggagggtggagatccaggaagtgaggctccagctcctggacctctgatccctagtcctagtgtagaggagccccacaaacaccgccctaccaccctgcgtctcactaccttgggggcccaggactccctaaacaacaatgggggatttgacttggtgagaccagcgtcttggcaagaaaccgctctctgttcgcctgcccccgaggctctgcgcgagctgcccggtcccctgcccgctactgatactggaccgggcggcgctcaatcacccgtgcggcccggctgtgactgcgaaggaaatagacccgcagagccccctgctccgggaggcacaagtccgtctagcgacccgggtattgaagctgatttacgaagtcgaagcagcgggggtagggggggtaggcgctctagccaggaactaagctcaccaggttcagatagcgaggatgcaggaggtcgcctcgggagaatgatctcttcaatctccgaaacagagctcgaattgtccagtgatgggggctcttcatcctcaggcagatcctcccacttgacttttagcaaaaagttcctcaatgtgttcgttaatagcacgtctagatcctcctccactgaatcttttgggttattctcctgtctggttaatggagaagagagggaacagacccatagggccgtctttcgatttatcccccggcatcctgacgagctcgagttagacgtcgacgatcccgtcctggtggaggcagaggaggatgacttttggttccgtggctttaacatgcgaacgggcgagcgcggggtctttcccgctttctacgctcacgccgtgcctggcccagccaaggacttgctcggctccaaaaggtcaccatgctgggtcgaaaggttcgatgtccagtttttggggtccgtggaagtcccatgtcaccagggcaatgggattctgtgcgcagctatgcagaagattgccactgctagaaaactgaccgtgcatctgcgtccaccagcctcttgcgacctggagatctcactgaggggcgtgaagctttccctcagcggaggaggtccggaatttcagagatgctcccacttttttcagatgaagaacatttccttctgtggttgtcacccacgcaactcctgctattttggcttcattactaaacacccactgctgagccgctttgcatgtcatgtcttcgtatcacaagagtcgatgcggccggttgctcagtccgtaggccgggcttttctcgaatattaccaggagcacctagcttacgcttgtccaacggaagatatctatctggagtag

SEQ ID NO: 195541 - DNA, 1149 bp, Artificial Sequence
  Description of Artificial Sequence: Synthetic coding sequence
atgagcgacagcaagtgcgacagccagttctacagcgtgcaggtggccgactcaacctttaccgtgctaaagcgttaccagcagctcaagccgatcggatccggggctcagggtatagtttgtgccgcattcgacacagtgctaggtattaacgtcgccgtgaagaaactctcacgcccattccagaatcagacacatgcaaaacgtgcatatcgtgagctggtactcctgaagtgcgtcaatcataagaatatcatcagcctgcttaatgtgttcactccccagaagaccctagaagagtttcaggacgtataccttgtgatggagctgatggatgccaacctgtgtcaagtcatacatatggaattggatcacgaacgcatgtcctacctactgtaccaaatgttatgcggcattaaacatctgcatagtgcaggaatcattcaccgggatctgaaaccttccaatattgtggttaaatccgactgcacccttaagattttggattttggactggcacggactgcgtgtacgaacttcatgatgactccctacgtggtcacgcgatactatagagctcctgaggtgatactgggaatgggttacaaggaaaacgtcgatatctggtcggtgggctgcattatggccgaaatggtgctacacaaagttttgtttcctggccgggattacattgatcagtggaacaaggtaatcgaacagctgggaactccgagcgccgagtttatgaagaaattacagcctactgttagaaactatgtggagaaccggccaaaatatccaggcatcaagttcgaggaactcttcccagattggattttcccatcagaatccgaaagagataaaattaaaacttctcaggcacgggacctgcttagcaaaatgctcgttatcgaccctgataagaggatttccgtggatgaagccctgcggcatccctatatcacagtgtggtatgatcctgccgaagctgaagcccctccgccgcagatctacgacgcccagcttgaggaaagagaacatgcgattgaggaatggaaggagctgatctacaaggaggtcatggactgggaagagagaagcaagaacggcgtcgttaaggaccagccatctgcgcagatgcaacagtag

SEQ ID NO: 195542 - DNA, 1149 bp, Artificial Sequence
  Description of Artificial Sequence: Synthetic coding sequence
atgagcgacagcaagtgcgacagccagttctacagcgtgcaggtggccgacagcacattcactgttctgaagaggtaccagcaactgaagcctattggcagtggcgcacagggcatcgtctgtgctgcgtttgacactgtgctgggcataaatgtggcggttaaaaagctgtctcgccccttccagaaccagacccatgcgaaacgggcttaccgcgaattggtcctccttaaatgcgtaaaccataagaatataatatcactgctgaatgtgtttaccccccaaaaaactctcgaagaatttcaagacgtatatcttgtcatggagttgatggatgcaaacctctgccaggtgatccatatggagttagatcatgagcgcatgagctatttactgtaccagatgctctgcgggataaagcacctgcattcagccggtattatccacagagacctgaagccctcaaacatcgtggttaaatctgactgcacactgaaaatcctggacttcgggctggctagaaccgcttgcactaatttcatgatgaccccgtatgtggtgacacgctattacagggctcccgaagtgattcttggcatgggctacaaagaaaacgtagacatctggagtgtggggtgtataatgggggagctggtcaagggctgcgtaatattccagggaacagaccacattgaccagtggaacaaggtaatcgagcaattagggacccccagcgccgagttcatgaagaagctgcagcccaccgtccggaattacgtcgaaaataggcccaagtacccagggataaagttcgaagagctgtttcctgactggattttccctagtgaatccgagagggataaaatcaaaactagtcaggctcgcgacctgctcagtaagatgctcgtgatagaccccgataaaagaattagtgtggatgaagcactgcgccacccatacataaccgtctggtatgatcccgccgaagctgaagcccctcccccacaaatttatgatgcacaactggaagagagagaacacgccattgaggagtggaaagaactcatctacaaagaggtgatggactgggaggagagatccaagaacggagtggttaaggaccagcctagcgctcagatgcagcagtag

SEQ ID NO: 195543 - DNA, 375 bp, Artificial Sequence
  Description of Artificial Sequence: Synthetic coding sequence
atgagcgacagcaagtgcgacagccagttctacagcgtgcaggtggccgactccacttttacagtcttgaagcgctaccaacagctgaaaccgatcggtagcggcgctcagggaatagtatggaggcaccactgctctgccttgcccttcatcggacgtatgcgcccggtgtctgtcatcgtgaccccatggatcaatcaagaagggatgttgtgtgaaggactgggctggccgagtctgccatggtgtttgacatccaccgtgtgccccgcccagaacgtgcggatcgtcagcttgactctgaatgtctcgcttctgcacggtaaaacagtctctagacgttctattacaggacagctaaaatgctgtatatag

SEQ ID NO: 195544 - DNA, 729 bp, Artificial Sequence
  Description of Artificial Sequence: Synthetic coding sequence
atgagcgacagcaagtgcgacagccagttctacagcgtgcaggtggcagactccactttcaccgtcctgaaacggtatcagcagctcaagcctatcgggagtggggcacaggggatcgtgtgcgcagcctttgacactgtgcttggcattaacgtggctgttaagaaattgagtagaccattccaaaaccagacacacgctaagcgtgcttatcgtgagctggtactgctcaaatgtgtaaaccacaagaacatcataagcctgttgaacgttttcactccccagaaaactcttgaagaattccaagacgtttatctggtcatggagctcatggacgctaacctatgccaagtgatccatatggaactagaccacgaacgcatgtcttatctgctgtaccaaatgctctgcggaatcaagcacctccatagtgcaggaattatccacagagacttgaagcctagcaacatcgtggttaaaagcgactgcacacttaaaatattggacttcggcctggcgaggaccgcttgtacgaactttatgatgactccttacgtggtaacccggtactatcgcgctcctgaagtcatccttgggatggggtacaaggaaaatgtggatatttggtccgttggctgtattatgggtgagctggttaaagggtgcgtaatctttcaggggacggacaggattcttccgagagatctcggtccagctatgttgtcttag

SEQ ID NO: 195545 - DNA, 1275 bp, Artificial Sequence
  Description of Artificial Sequence: Synthetic coding sequence
atgagcgacagcaagtgcgacagccagttctacagcgtgcaggtggccgacagtacctttacagtgttgaaaagataccagcagctgaaacccatcggcagcggcgcacaggggatcgtatgtgcagcgttcgatactgttctaggtatcaacgtggctgtgaagaaattgagccgcccctttcagaaccagacacatgctaaacgagcgtaccgggagctcgttctgctgaagtgcgtcaatcacaagaacatcatttcacttctaaacgtgtttaccccacagaaaaccctcgaggagtttcaggacgtgtatttagtgatggagctaatggatgcgaatctgtgccaagtgatccatatggaactcgaccacgagaggatgagttacctcctgtaccagatgttatgcggcatcaagcatctgcattctgctggaatcatacatcgagatctaaaaccttctaatatcgtagtcaagagtgactgtactctgaaaattctcgattttggcttagcaagaaccgcttgtactaatttcatgatgacgccctatgtagtgactcggtattatagagctccagaggtgattcttggtatgggctataaagaaaatgttgacatctggagcgtgggatgcatcatgggggagttggtaaagggatgcgtgatcttccagggcactgaccacatcgatcaatggaataaagttatagaacagctgggaaccccttctgcagagttcatgaaaaaactgcaacctacagtcagaaattacgttgagaaccggcctaagtacccaggcataaagttcgaggagctctttcccgactggatctttccttccgagagcgaaagagacaaaatcaaaacatcccaagcacgcgacctgctgtcaaaaatgttggtcatagatcctgataaaagaatcagcgtcgacgaagcccttcgccacccctatataacagtatggtatgaccccgccgaggcagaagctcctcctcctcagatatatgatgcccaactggaggaaagggagcacgccatcgaagaatggaaggagctgatttataaggaagtaatggactgggaagagagatccaagaatggcgtggtgaaagaccagccctccgacgccgcagtaagtagtaatgcaaccccaagccagtcttcatcgatcaatgatatctcctctatgagcaccgagcaaaccctggcaagtgatacggactcctccctggatgctagtacgggaccgctcgaagggtgtcgttag

SEQ ID NO: 195546 - DNA, 1275 bp, Artificial Sequence
  Description of Artificial Sequence: Synthetic coding sequence
atgagcgacagcaagtgcgacagccagttctacagcgtgcaggtggcagatagcaccttcacggtccttaaacggtatcagcagctgaagccaattgggtctggcgcacagggaatcgtatgtgctgcttttgatacagtgttggggatcaatgttgcagtgaaaaagctatcaagacccttccagaaccagacccacgctaaacgagcatacagagagttggtgctgctgaagtgtgtgaatcacaaaaatattatctcacttttgaacgtgtttaccccacaaaagacactcgaggagttccaagacgtctacctcgtcatggaactaatggacgcaaacctgtgccaggtgatccatatggagctggaccacgaaagaatgagctatctgctctaccagatgctttgtggaattaagcatctgcacagtgcaggcattatacatcgcgatctcaagccatcgaatattgtggtgaagagtgactgcacactgaagattcttgattttggacttgctcggaccgcctgtacaaacttcatgatgacgccttacgttgtgacccgttattatagagctcccgaggttattttaggaatgggctacaaggagaacgtggatatctggtcagtggggtgcattatggccgaaatggtcctgcataaggtgctgttccctggtcgggactacatcgatcagtggaacaaagttatcgagcagctgggaactccctcagccgagtttatgaaaaagctgcagcctactgttcgaaattatgtggaaaataggccgaagtatccaggcattaaatttgaagaactatttccagattggatatttccgtccgagtcggaacgcgataagattaagacatcccaggctagagatcttctgagcaagatgctagtgatagatcctgataaaaggatcagcgtggatgaagccttacgccatccctacattaccgtgtggtatgacccagctgaagccgaagccccccccccccagatttacgatgcacaactggaagagagagaacatgcaattgaggaatggaaggagctcatttataaagaggtgatggattgggaagagagatctaagaatggtgtggtgaaggatcaaccatccgatgctgcagtctccagtaacgccaccccatctcagtcaagcagtattaacgatatttcttccatgtccactgagcaaacgcttgcatccgacactgacagctctttggacgccagcacgggccctctcgagggatgtcgatag

SEQ ID NO: 195547 - DNA, 315 bp, Artificial Sequence
  Description of Artificial Sequence: Synthetic coding sequence
atgagcgacagcaagtgcgacagccagttctacagcgtgcaggtggccgactctacctttacagtgctcaagaggtatcaacagctgaagccaatcggctctggggctcaggggattgtatgcgctgccttcgacactgttctgggcattaatgtggctgtaaagaaactgtcgcgtccgttccaaaaccagacacatgccaagagagcatacagagagctcgttttgctgaaatgtgttaaccacaaaaatatcatatcactactgaacgtgtttactccccaaaagaccctagaagaatttcaagacgtgtag

SEQ ID NO: 195548 - DNA, 645 bp, Artificial Sequence
  Description of Artificial Sequence: Synthetic coding sequence
atgagcgacagcaagtgcgacagccagttctacagcgtgcaggtggcagatagtacatttactgtgctgaagaggtatcagcaactaaagccaatagggtcaggggctcagggcattgtttgtgcagccttcgacactgtgttagggatcaatgtggcagtaaaaaagctctcgaggccgtttcaaaatcagacccacgccaagagggcataccgagaactggtcctgttgaaatgcgtgaatcacaagaacattatttctctgctcaacgtttttaccccccagaagacactggaggagtttcaggacgtatatctggtgatggagctcatggacgctaacctctgccaggtgatccacatggagctggaccacgaaagaatgtcgtacttgctctaccagatgctctgcggtattaaacatctgcacagcgccgggattattcatcgagacttaaagcctagtaatattgtggttaagtccgattgtaccctcaagattcttgatttcggactcgcgcggactgcatgcactaactttatgatgactccgtacgtagttaccagatactacagagcccctgaggtaatattaggcatgggctacaaagaaaatgctatcaaatactggacactgtggcactag

SEQ ID NO: 195549 - DNA, 1347 bp, Artificial Sequence
  Description of Artificial Sequence: Synthetic coding sequence
atgctgtggctggccctgggccccttccccgccatggagaaccaggtcctcgtcatccgtattaagattcccaacagtggggccgtagattggacagtacactccgggccccagctgttattcagagatgtcctggacgttattggccaggtgttgcccgaggcaaccaccaccgcatttgaatatgaggatgaagacggagacaggatcaccgtacgctcagacgaagaaatgaaggcaatgctaagttactattactcaactgttatggaacagcaggtgaatggtcagcttattgagccactccagatttttccccgggcttgtaagcctcctggtgaacggaacatacacggcctgaaggtgaatactcgcgcaggcccttcacagcatagctcccccgcagtttccgatagtctaccttctaacagcctgaaaaagtctagtgccgaactgaagaagattctagccaatggacagatgaacgaacaggatattcgctatagggatacattagggcacggtaatggcggcaccgtctacaaggcatatcacgtgcctagcgggaagatcctcgccgtgaaagtaattctgctcgacataactctggaactgcaaaagcagatcatgtccgagctggaaattctgtacaaatgcgacagctcttacattatcgggttttacggagccttttttgtcgaaaaccggatatcgatctgcacagagttcatggatgggggcagcctcgacgtttacaggaagatgcccgaacatgtgcttgggaggatcgctgtagctgtggtcaagggcctaacatatctctggtctcttaaaatcctgcaccgcgacgtgaagccttctaatatgctagtcaacacgcgaggacaggttaagctgtgcgatttcggcgtgtcaactcagctggttaattccattgctaaaacctacgtaggcacaaacgcttatatggcacccgaaaggataagtggtgagcagtacggcatccacagcgatgtatggagcctgggaattagttttatggagctggccttagggcgctttccataccctcagatacaaaaaaatcagggaagtttaatgccgttgcagctcttgcagtgtatcgtggacgaagacagtcccgtcttacctgtgggagaattctcggagccttttgtgcactttatcactcagtgcatgcgcaaacagcccaaagagcgcccagcccctgaagagcttatgggccatcccttcatcgtgcaatttaacgacggtaatgccgccgtcgtcagcatgtgggtctgtcgcgccctggaggaaaggcgttcccagcaaggacctccctag

SEQ ID NO: 195550 - DNA, 1317 bp, Artificial Sequence
  Description of Artificial Sequence: Synthetic coding sequence
atgctgtggctggccctgggccccttccccgccatggagaaccaggtcttagttatccgtatcaagatcccaaacagtggcgctgttgactggaccgtgcattccggcccacagctactcttccgcgatgtgctggacgtgatcgggcaggtactgcctgaggctaccacgactgcctttgaatacgaggatgaggatggtgataggatcaccgtgcggtcggatgaagaaatgaaggctatgctgtcatactactacagtacagtcatggaacaacaggtcaatggccaactcatcgaaccccttcagatctttccccgggcttgtaagccccccggagagcggaacatccacggccttaaagtcaataccagagccggaccgtcgcagcattcatcccccgccgtctccgacagtctccccagcaattccctgaagaaatcttctgctgagctgaagaaaatcctggccaacgggcagatgaatgaacaagacattcggtacagagacactctaggccacgggaatgggggcacagtgtataaagcttatcacgtcccaagcgggaagatcctggccgtgaaagttatcctgctcgacataaccttggagctgcaaaagcaaatcatgagtgaactggaaattctatataagtgtgattcttcttacatcattggattctatggagccttctttgtcgaaaataggatatctatttgtacggagttcatggacggaggcagtctcgacgtatatcgtaagatgcccgaacatgtgttgggaagaatcgccgtggccgtagtcaaaggcttgacctatttgtggagcctcaaaatcctgcatcgtgacgtgaagccatccaacatgctggtgaatacccgcgggcaggtgaaactctgtgatttcggggtctccacacaactcgtgaattctatcgctaagacttacgtgggcacaaatgcatacatggcccccgagcgcatctccggtgagcaatacggaatccacagtgatgtgtggagtctcggcatcagcttcatggagatccagaagaatcaaggcagtctcatgccgctgcaattgttgcagtgcattgttgacgaggattcacctgttctgccagtaggcgagttttctgaaccctttgtgcattttatcacccagtgtatgagaaagcagcccaaagagagaccagctcccgaagaactgatgggccatcccttcattgtgcagttcaacgatggcaatgctgccgtggttagcatgtgggtgtgccgcgcactggaagagcgaagatctcagcagggtccaccatag

SEQ ID NO: 195551 - DNA, 1335 bp, Artificial Sequence
  Description of Artificial Sequence: Synthetic coding sequence
atgctgtggctggccctgggccccttccccgccatggagaaccaggtcctggtcatccggatcaagataccaaattcaggtgctgtagattggacagtccacagcggaccccagctactcttccgcgacgtgcttgatgtgatcggccaggttcttccagaagctacgacaaccgcctttgagtatgaggatgaggatggtgacaggataaccgtgcggagcgacgaggaaatgaaggctatgctgtcctattattacagcactgtaatggagcagcaggtgaacggacagctcattgaacccctgcagatcttcccaagggcgtgcaagccccctggggagcgtaatatccacggacttaaggttaacaccagggctggcccctctcagcactcatctccagccgtctccgactctctgccctccaactccctcaagaaaagttccgccgaactgaagaaaatcctcgcgaatgggcaaatgaacgagcaggatatcaggtatcgggacacactgggccatggaaatggtggaactgtgtataaggcttatcatgtgccttccggtaagatcctggccgtcaaggtgattctgctggacattaccctcgaactccagaaacagatcatgagtgaactggaaatcctgtacaagtgcgacagttcctacataattggcttctatggcgcattttttgtagagaaccggatcagcatctgcaccgaattcatggatggcggcagtctcgacgtgtaccggaagatgccggaacacgtgttgggcaggatcgcagtggccgttgtgaagggcctgacatacctgtggagtctcaagatcctgcatcgcgatgtaaaaccgagtaatatgctggtaaataccagaggccaagtcaagctctgcgacttcggagtgagcacacaactggttaatagcatcgcaaagacgtacgtcggtacaaatgcgtacatggcgcctgagagaatctccggcgaacagtatggcatccacagcgatgtctggtcattgggcatctcctttatggagattcagaaaaaccaaggatccctgatgccgttgcaacttctgcagtgtattgtggatgaagactcgcctgtgctgcctgtcggagagtttagcgagcctttcgtccatttcatcacgcaatgtatgaggaagcagccaaaggaaaggcccgcccccgaggaattgatgggccatccttttattgtgcaatttaacgatggcaacgcagccgtggtcagcatgtgggtctgcagagcactggaagagaggaggtcccccgcctcactgccttcaccaagttcgagcatctag

SEQ ID NO: 195552 - DNA, 1239 bp, Artificial Sequence
  Description of Artificial Sequence: Synthetic coding sequence
atgatggagggccacttcccccagagcgacgtgatcggccaggtgttgccagaggccactactaccgcgtttgagtatgaggacgaggacggcgacaggatcaccgtaagatctgacgaagagatgaaggccatgctgtcctactattatagtaccgtgatggaacagcaagtcaacggccagctgatcgaaccccttcaaatattcccgcgggcttgtaagcctccgggagagcggaacattcatggccttaaggtaaatacacgggccggaccaagccaacacagctcaccagccgtatccgactcattgccaagcaatagtttgaagaagtcgtccgccgaacttaagaagatcctggctaatggacaaatgaatgagcaggacatccgatatagagatacactgggccacggcaacgggggaaccgtgtataaagcttaccatgtgccttccggcaaaatactggcggtcaaggtcatactcctcgatattaccctggaactccaaaagcagataatgagcgaactggaaatcttatataagtgcgactcatcatatatcattgggttttacggtgcttttttcgtggaaaaccggataagcatttgtacagaattcatggatggcggctcacttgacgtttacaggaaaatgcctgaacacgtcctcggacgtatcgcagtggcagtggtcaaaggtctaacctatttgtggtccctcaagatcctgcaccgggacgtgaaaccatctaacatgcttgttaacacacggggccaagttaagctgtgtgacttcggagtctcaacccagctggttaattccattgccaagacttacgtaggaactaacgcatatatggccccagaacggatttccggcgagcagtacggaattcattccgacgtatggtccctgggtattagcttcatggagctcgccctcggacgttttccttaccctcaaattcagaagaatcaagggagcctgatgcctctgcaactgcttcagtgcatcgtggatgaggattctccagtgctgccagtcggagaattttccgagccattcgtacactttatcacccagtgcatgcgcaaacaacccaaggaacggccagcacctgaagaactgatgggccacccgttcatagtccagtttaacgatggaaatgctgcggtggtgtcaatgtgggtttgccgcgcgcttgaggagcgccggagccagcaaggccctccttag

SEQ ID NO: 195553 - DNA, 1005 bp, Artificial Sequence
  Description of Artificial Sequence: Synthetic coding sequence
atgagccagagcaagggcaagaagcggaaccccggcctgaagatccccaaagaggccttcgaacagcctcagacttcaagcaccccgccacgagatctcgacagcaaggcctgtatctcaattggtaatcagaatttcgaggtaaaagccgacgatctggagccgattatggaactggggcgaggtgcctacggcgtggttgagaaaatgagacacgttcctagcggacagatcatggctgttaagcgtattcgagccaccgttaatagccaagaacaaaaacgcttgctgatggacctggatattagcatgcgcacagtggactgcccctttacagtaactttttatggcgcgctattcagagagggggacgtctggatttgtatggagttaatggacacatcccttgacaaattttacaagcaggtgatcgacaaaggccagactattcctgaagacattctcgggaaaattgctgtgtccattgtgaaggccctggagcatctgcattcaaagctttctgtgatccatagagacgtgaagccctctaacgttcttatcaacgccctcggacaggtgaagatgtgtgattttggcataagcggctacctggtggactctgtggccaagactattgacgcgggatgcaaaccgtacatggctcccgaaagaatcaacccagagcttaaccagaagggatacagcgtcaaatcagatatatggtcactagggattacaatgatcgagctcgccatattgcgatttccatacgattcttgggggacgccttttcagcagctgaagcaggtggttgaggagccatcgccccaacttcccgccgacaagttttcagctgagtttgtggatttcacatctcagtgtttgaaaaagaacagtaaggagcggcctacatacccggagctaatgcagcacccattttttaccctccacgaaagcaaaggtaccgacgtcgcctcctttgtaaagctgattttgggagattag

SEQ ID NO: 195554 - DNA, 1005 bp, Artificial Sequence
  Description of Artificial Sequence: Synthetic coding sequence
atgagccagagcaagggcaagaagcggaaccccggcctgaagatccctaaagaggcctttgaacagccgcagacttcttcaacacctccgagagacttggactcaaaagcctgtatctcaattggcaatcaaaattttgaagttaaggctgacgacttagagcccatcatggagctgggacgaggcgcctacggagtagtggagaaaatgaggcatgtaccgtccggtcagattatggccgtaaaaagaattcgggcaaccgtaaactcccaggagcagaagcggcttctcatggacctggatatttccatgcgcactgtggactgtccgttcacagtgacgttctacggtgccctgtttagggaaggcgatgtttggatctgtatggagttgatggacacatcactggacaagttttacaaacaggtgattgacaaggggcaaactattccggaggatatcctgggcaagattgccgtttccatcgtgaaggctctggaacaccttcactccaaactctccgtgatccatagggacgtaaagccttccaacgttctgatcaacgccctcgggcaagtgaaaatgtgtgactttgggatttctggataccttgttgattcagttgccaaaacgatcgacgccgggtgcaagccctatatggctcccgagcggatcaatcccgaactcaaccagaagggatactcggtaaagagcgacatctggagcctgggaatcacaatgattgagcttgccatcctccgattcccctatgatagctggggaactccattccaacaactaaagcaggtagttgaggagccctcccctcaactccccgctgataagtttagcgccgagttcgtggacttcacatcccagtgcttgaagaagaactctaaagagagaccaacttaccccgagttgatgcagcatcccttctttacccttcatgaatctaagggaacagacgtcgcctcctttgttaaactgatcttaggcgactag

SEQ ID NO: 195555 - DNA, 2865 bp, Artificial Sequence
  Description of Artificial Sequence: Synthetic coding sequence
atggaggaggaggagggcgccgtggccaaggagtggggcaccacccccgctggtccagtttggacagccgttttcgattatgaggctgccggggatgaggagctcactttgaggcgcggagatcgcgttcaggtgctgtcccaggattgcgccgtctccggcgatgaagggtggtggaccggacagctcccatccggtcgggtgggagtgtttccctctaactatgtggcaccgggagctcctgccgcacctgctggcttgcagctgccccaggagataccatttcacgagctacagctcgaagaaatcattggcgtggggggctttggtaaggtgtacagggctctctggagaggggaagaagttgccgtaaaggctgcaagactcgaccctgagaaggaccccgcagttacggccgaacaagtctgtcaggaagcgcgcttatttggcgctcttcagcatccaaatatcatcgccctacggggggcatgcctgaatcctccgcatctgtgtttggttatggagtacgcccgaggaggggccctgtctcgggtccttgcgggaagaagggtgcctccgcacgttcttgtgaattgggcggtgcaagtcgctcgaggcatgaattatctccacaatgatgctcccgtacctattattcaccgagatctcaagtccatcaacatacttattcttgaagcgatcgaaaaccataatctcgccgacacagtgttgaagatcacggatttcgggctggcccgagagtggcataaaacaaccaagatgagcgcggctgggacatatgcctggatggctccagaggtcatcagactgtcgctgtttagtaagagtagtgatgtgtggagtttcggagtactgctctgggaattgctgacaggagaagtgccatatagagagatcgacgcacttgcagtggcttacggagtggctatgaataagctcacgttgccgatccctagtacttgtccggagcctttcgccaggttattggaggagtgttgggacccggacccacacggcaggccagattttggctctatcttgaaaaggctcgaagttattgagcagtcagccctctttcagatgcccctggagtcttttcatagtctccaggaggactggaaactggaaatccaacatatgttcgacgatctaaggactaaagagaaggagctgagatcacgcgaagaagaactcctgagggcggcgcaggagcaaagatttcaagaggagcagcttcgtcgacgtgaacaagagctggctgagcgggaaatggacattgtggagcgggagttacacctgctgatgtgtcagcttagtcaggaaaagccaagagttcggaagcgtaaaggtaacttcaaaaggagccggttacttaagcttagggagggtggaagtcatatttccctgccttctggcttcgagcacaagatcacagttcaggcgtcccctacgttggacaaacgaaaggggtctgatggtgccagtcctcccgcatctccgtcaattatcccgcggctgagagccatacggctcacccccgttgactgcggagggtcgagctctggctcaagcagtggcgggtcaggtacttggagtagagggggcccccctaagaaggaagaactggtgggtggaaagaagaaggggcggacctggggccccagtagtaccttacaaaaagaaagggtcgggggggaagagcggctgaaaggcctgggggagggttccaagcaatggtcttcctctgcccctaatctcggtaaaagtcctaaacatacccccatagcccccgggtttgcaagcttaaatgagatggaggagttcgctgaagccgaggatgggggttcatccgtgccgcccagcccatactcgacaccaagctacctaagtgtgcctttgccagcagagcctagtcctggagctagggcgccatgggaaccaactccctccgcgccccccgcccggtggggccatggggcacggaggaggtgtgaccttgctctgctgggctgtgcaacattactaggcgctgtgggtctgggtgcagacgtggcagaggctcgcgccgctgatggggaggagcaacgtaggtggttagacgggctgttttttccccgggcgggacggttcccccgtggactgagtcccccagctagaccccacgggcgccgggaggacgtcggcccaggtctgggcctggcccccagtgcaaccttggtgagcttgagcagcgtgtccgattgcaattcaaccaggtcattgcttcgcagcgacagcgacgaagcagccccagccgccccctcaccaccgccatctccgcctgctccaacaccaactccatctccatcaactaatccactggtcgacctggagctcgaatcgtttaaaaaagaccccaggcagtcgctgacccccactcatgtgactgctgcgtgcgctgtcagcagaggccatcgaaggacccctagtgatggagccctggggcagcgcggtccccctgaaccggccggacatggcccagggcctcgcgatcttctagattttcctcgcctgcccgacccacaggctctcttcccagcccggcggagaccacctgagttccccggcagaccaacaaccctgactttcgcgccccgtcccaggcccgcggcttcccgtcccagacttgacccttggaaattagttagttttggtcgcactttgacgatcagccctcccagtaggccagacacaccggagtcccccggtccaccttccgtgcagccgaccctcctggacatggacatggaaggccagaatcaggattcaactgtgcctttatgtggcgcgcacggcagccactag

SEQ ID NO: 195556 - DNA, 2544 bp, Artificial Sequence
  Description of Artificial Sequence: Synthetic coding sequence
atggagcccctgaagagcctgttcctgaagagccccctgggcagctggaacggatctggaagcggcgggggaggtggagggggaggcggccgccctgagggctctcctaaagcagccggctatgccaacccagtgtggacagcgctctttgattatgaacccagtggccaggatgagctagctttgcggaagggcgatagagttgaagttctatctcgtgacgccgccattagcggagacgaggggtggtgggccggtcaggtcggcggccaggtcggcatatttccgagcaattacgtgtccagaggcggaggacctcccccatgtgaggtcgcttcctttcaggaactgcgcctcgaagaagtgattgggatcgggggcttcgggaaggtgtatcggggatcctggaggggcgagttagtcgctgtcaaagctgctcgccaggacccagacgaggacatttcagtcaccgcagagtccgtgaggcaggaggcccgtctctttgccatgctcgcacatccaaacatcatcgccttaaaggccgtgtgcctcgaggagcctaacctctgcctagttatggagtatgctgccggcggcccgctgagccgtgcactagccggccggagggtcccgccacacgtgctagtcaattgggcagtacaaattgcacggggtatgcattaccttcactgtgaagcattggttcccgtcattcatagagatctcaagtccaacaatattttactgctgcagcccatcgagtctgacgacatggagcacaaaacattgaagattacagatttcggcctggcccgagagtggcacaaaaccactcaaatgtctgctgctggtacttacgcgtggatggcccccgaggtgattaaagcaagtacctttagcaagggctcagatgtttggagcttcggcgtgctgttgtgggagctgttgactggggaggtgccctacaggggcatcgactgtctggccgtcgcttatggcgtggctgtgaacaagctaactttaccgatcccctccacttgccccgagcccttcgctcaacttatggctgattgctgggcgcaggacccccatcgtcgacccgatttcgcttctatactgcagcagctggaggccctcgaagcccaggtccttagggagatgcccagggattcctttcacagcatgcaggaaggctggaaacgtgaaatccagggtctgttcgatgagcttagagccaaagaaaaagaattgctctcccgggaagaggaattgactcgcgctgctcgcgagcagcgcagtcaggctgagcagctgcgacggcgcgagcacctcctcgcccaatgggagcttgaggtgtttgagcgggaactcaccctgctgctccaacaagtggacagagagaggccacacgtacgccggcggaggggtacttttaagcgaagtaagctacgtgcccgcgatggaggcgagcggatctccatgcctctggatttcaagcacaggatcaccgtgcaggctagcccgggcctcgaccgtcgtcggaatgtgttcgaggtggggcccggggattccccaaccttccctaggttccgcgcaattcagctcgaaccggccgaaccgggacaggcatggggtcggcagtcacccaggcggcttgaagattcatctaacggcgaaagacgggcatgctgggcatgggggcctagctctccaaagccgggcgaggcccagaacggccggaggaggagcagaatggatgaagccacgtggtatctggactcggatgactcctccccactcggctctccgtcaacccctcctgctctaaacgggaatccccctaggccgtccttggaacccgaagagccaaagaggcccgttccagcagagcggggcagctcatccggcactcctaaacttattcagagggctctactgagagggaccgcacttctcgccagcctaggacttggccgtgacttgcagcctcccggaggtcccggcagagaacgtggtgaaagtccaactaccccaccaacaccgacccctgcgccatgcccaacggagccacccccgtcaccgctgatctgcttcagcctcaaaacacctgactcacccccaactcccgctccactcctcctggacctgggcattcccgtgggccagcgatccgctaagtctcccaggagagaggaggaaccccggggaggcacagtttcacctcccccaggcactagtcggagcgcccctggaacaccaggcaccccccggtcaccacccttaggattgatctctagacccagacccagtccactccgatctcggatcgacccgtggtcttttgtgagcgctggccctcgtccctcccctctgcctagcccacaacccgctccgcgccgggctccctggactctgtttcccgacagcgacccgttctgggactccccccctgccaatcctttccagggtggaccacaggactgtcgtgcccagactaaagacatgggggcacaggccccgtgggtcccggaagccggcccttag

SEQ ID NO: 195557 - DNA, 1773 bp, Artificial Sequence
  Description of Artificial Sequence: Synthetic coding sequence
atggagcacaagaccctgaagatcaccgacttcggcctggcccgggagtggcacaagacaacacagatgtccgctgcggggacatatgcctggatggctccggaggtgatcaaagcctccacattttcaaaaggcagtgacgtgtggagttttggcgtgctgctgtgggaattgctgaccggggaggtaccttatagggggatcgactgcctggctgtggcctatggcgtggctgtgaataagctgaccttacccatcccttcgacctgtcctgagccattcgcccaacttatggccgactgctgggctcaggacccccacaggagaccggactttgcaagtatcttgcagcagttagaggccctagaggcgcaagtactgagggagatgcccagagattcctttcacagtatgcaggagggctggaaaagagaaatccagggactgttcgatgagctgagggctaaggaaaaggagctcttgtctagggaagaagagttgactagagctgcaagggagcagaggtctcaagcagaacagctcaggcgaagggagcacctgcttgctcagtgggagctcgaggtctttgagagggaactcacactgctactacagcaggttgacagggaaaggccacacgtcaggcggcggagaggcacctttaagaggtcaaaactccgtgctagggacggcggtgagagaatcagcatgccacttgatttcaagcaccggattaccgttcaagcttccccaggattggaccgcagacggaacgtattcgaagtgggtccaggtgacagccccaccttcccacgcttccgggctattcagctggaacctgccgagccaggccaggcttgggggcgccagtctcccagacgtttggaggacagcagcaatggggagcggcgggcctgttgggcctgggggccttcatctccaaagccaggcgaggcccagaatggccgcagacggtctaggatggatgaggccacttggtacttggactctgacgattcttcaccattgggttccccctctacccctcctgcgctgaacggaaatcctccaaggccgagcctggagccagaagagccaaaacgtcccgtgccagctgaaaggggcagtagcagcggtacccccaagctgatccagcgagccctgctccgaggcaccgcactgctggcaagcctgggtcttggaagggatttacaacccccaggaggcccaggccgagagcggggggagtctccaaccacaccccccacacccaccccagctccctgtcccaccgagcctccgccctcccccctgatctgttttagtttgaagactcctgactctccccctactccagcccctttacttctggatctggggatccctgtgggccagagatcagcaaaatctcctagacgagaagaggaacctcgtggtgggacagtctcccctcctcctggcaccagcagatcagctcctggtacacccgggacgcctcgttcaccgcccctgggattaatatcccgacctcggccctcccccctcagatcacgaatcgatccatggtcttttgtgtctgccgggcctcgcccctcacctcttccttctccacagccggcacctagacgggccccatggaccttgttccccgacagcgaccctttttgggactcccccccagctaatccttttcaggggggcccccaagactgcagagcacagacaaaggacatgggggctcaggcaccttgggtcccagaagcgggtccatag

SEQ ID NO: 195558 - DNA, 2580 bp, Artificial Sequence
  Description of Artificial Sequence: Synthetic coding sequence
atggcctgcctgcacgagacccggacccccagccccagcttcggcggcttcgtgtctaccctgagcgaggccagcatgaggaagctcgacccagacacctcagactgtactcccgaaaaggatcttacaccaacccatgtgctgcagctgcatgagcaggacgccggcggccccggcggcgctgctgggagccccgagtcgcgcgcttctagggtccgggctgatgaggtccgtctccagtgccaaagtggtagtggatttctagaggggctgttcggctgcctgagacccgtgtggaccatgataggaaaagcctatagcacagagcacaagcagcaacaagaggatctgtgggaagtacctttcgaggagattctcgacctgcagtgggtgggctcaggagcccagggagctgtctttcttgggaggttccatggggaggaggtggccgtaaagaaggttcgcgatttgaaggaaacagatatcaaacacctgaggaaactcaagcatccaaatatcataacttttaagggggtgtgtacccaagccccttgctactgtattctgatggagttttgcgctcagggacagctatatgaagtcctgagagcgggaaggcccgtgacgccctcacttcttgtagactggagtatgggcattgctggggggatgaattacctacacctccacaaaatcatccaccgggacttgaagtctccaaacatgcttatcacctacgatgatgttgtgaaaatctcggactttggcacttccaaagagctgagtgataaatcaacaaaaatgagcttcgcggggaccgtggcgtggatggctccggaggttattcgtaacgagccagtcagtgagaaggtcgacatatggagtttcggtgtcgttctctgggagctgcttactggagagatcccgtacaaggacgtggattcttctgctattatttggggcgtgggctctaattcactgcacctgccagtgccctcatcctgtccggacggcttcaagattttactgcggcagtgctggaatagtaagcccaggaatcggccaagctttcggcaaatcttactacatctcgacatcgccagcgcggacgttctgtccacaccccaggaaacgtattttaagtcccaggcagagtggagggaggaggttaaattgcatttcgagaagatcaagtccgaaggcacctgccttcatcggctggaggaggaactggtgatgcgccggagggaagaactgaggcatgccctcgacattagggagcactatgaacggaagttggaaagggcaaacaatctgtacatggagttaaatgccctgatgctgcagttggagctaaaggaaagggaattgctgcgaagggaacaggctctcgaaaggagatgcccaggcctcttaaagccccatccatcaagaggactgttacacgggaatacaatggagaaactcattaagaagcgaaatgtgccgcaaaagctttcacctcactcgaagagaccagatatcttgaaaactgagagcctgttgcccaagctcgacgctgcccttagcggagtgggcttacccggttgtcccaagggtcctccatcgcctgggaggagtcggcgcgggaagacgcggcatcggaaagcttcagctaaagggtcgtgtggtgacctccccggtctgcgaactgcagttccccctcacgagcccggcggtccagggtccccaggcggtctgggcggcgggccatcagcttgggaggcctgccccccagcgctgcggggtctccaccatgacctgctcctcagaaagatgagttccagcagcccggacctgctctctgcggctcttggctcgcgtggtagaggtgctacagggggcgctggggaccctggctccccccctcccgctaggggagatacccctccatccgagggttctgcaccagggtcaacttcccccgactcccctggaggcgctaagggggaacctccgcctcctgtgggcccgggggagggagttggcctgttgggaactgggcgggagggcaccagcggccggggagggtcaagagctgggtcacagcacctgactccagccgcccttttatatcgagcggccgtaactagatcccagaagcgtggcatcagctctgaggaggaagaaggtgaagtggactctgaggtggagcttacatcctctcagagatggccccagtctcttaacatgagacagtccttgtctacatttagctccgaaaacccctcagacggagaagaagggacagcaagcgaacccagcccctcaggtacacctgaggtgggatcaactaacactgatgaaaggccagatgaacgcagtgatgacatgtgctctcaggggtctgagattccgctagatccaccccccagcgaagtcattccaggaccagagcccagcagcctaccgattcctcaccaggaactcctgcgcgagaggggcccacctaactccgaggattctgactgcgactcgaccgaactggataactcaaatagtgtcgatgcactcaggccaccagccagtctgccaccttag

SEQ ID NO: 195559 - DNA, 2901 bp, Artificial Sequence
  Description of Artificial Sequence: Synthetic coding sequence
atggccaacttccaggagcacctgagctgcagcagcagcccccacctgcctttcagtgaatctaaaaccttcaacggcttacaagatgagctcacagcaatggggaaccaccccagtcccaagttactggaggaccagcaggaaaaagggatggtccgaaccgagctaattgagtcagtgcactctcccgtcactaccacagtactgacttcagtatccgaagatagtagagaccagttcgaaaattctgtgttgcaactaagggaacacgacgaatcagaaactgccgtgagtcaggggaatagtaatactgtcgatggagagtcgacaagtggtaccgaggatatcaaaatacagttctccaggtctggcagcggaagcggagggtttctggaggggttgttcggttgtctgagaccagtctggaatattattgggaaagcttacagcaccgattataaactccaacagcaagacacgtgggaagtgccatttgaggaaatcagtgagctgcagtggctgggcagtggggcacagggtgctgtgttcttagggaagttccgcgccgaagaagtggcgatcaaaaaggtcagagagcagaatgaaaccgacatcaagcatctgcgaaaactgaagcaccccaacatcatcgccttcaaaggcgtgtgcactcaagccccatgctactgtatcatcatggagtattgcgcgcacgggcagctatatgaagtacttagagccggcaggaagattacacccaggctgctagtggactggtctaccggaatcgcatcaggcatgaactatcttcacttgcacaagattatacaccgcgacttgaagagccctaacgttctggttacacatactgatgccgtcaagatctcagatttcggtacttctaaggaattatctgacaaaagtaccaaaatgtcatttgccgggactgttgcttggatggcccctgaggtcattaggaacgagcctgtttccgaaaaagtcgacatctggtccttcggcgtagtgctttgggaacttcttaccggcgaaatcccttataaggatgtcgattcatcagcgataatttggggggtcggctctaacagtttacacctgcctgtccccagcacatgccccgatggctttaagatcctaatgaaacagacttggcagtccaagccacggaaccgcccttcctttcgccagactctgatgcacttagacatagcctcagctgatgtcctcgccaccccacaagagacttatttcaagagtcaggccgagtggagggaggaagtaaaaaagcatttcgagaagattaagtccgaaggcacgtgcatccacagattggacgaggagctgatcaggaggaggagggaggaattgcgacatgctcttgacatcagggagcactatgagagaaaactcgagcgtgcaaataacctctacatggaactgtctgcgatcatgctacagctcgagatgagagagaaggaattgattaaaagggagcaggccgtggaaaaaaagtatccaggcacatacaaacgtcacccagtgcggccaataattcatccaaatgccatggagaagttaatgaagaggaagggagtgccccacaagtcaggcatgcagaccaaaagaccggatctcctccgctctgaagggatccccacaactgaagtggcccccactgcttcgcctctgtctggaagcccaaagatgtcaacttctagttccaaatcccgctaccgatctaagcctaggcataggagaggaaactccagagggtcccatagcgattttgccgctattctgaaaaaccagcctgcgcaggagaacagtcctcatccaacgtaccttcatcaggcacagtctcagtaccccagtctgcatcatcataactctcttcagcagcagtaccagcagcctcctccggccatgagccagtctcaccacccacgactgaacatgcacggccaagacattgccacgtgtgcaaacaaccttagatattttgggcctgcagccgcacttcggtccccattgtccaaccatgctcaacgtcagctgcctggtagcagcccagacttgatatccactgcaatggccgcagactgctggagatccagcgaacccgacaagggacaggccggcccatggggctgctgtcaggccgacgcttacgacccctgtcttcaatgcagaccggagcaatacgggtccctggacatcccctctgctgagcctgtgggacgctcccccgacctgagcaaaagcccggctcacaaccccttgttggagaatgcgcagagctctgagaagacagaagaaaatgagtttagcggttgtcgcagcgaaagttccctaggtacttcccatcttgggacaccgcctgctcttcctagaaaaactcgacccctccagaagtcaggggatgacagctctgaggaagaagagggagaggttgattcggaggtggagttccctagacggcagcggcctcatcggtgtatttcctcttgccagtcatactcaaccttttcttctgagaacttctcggtctctgacggagaagagggtaacacctccgaccacagtaattcccccgacgagctggccgacaagcttgaagaccgactggctgagaagttggacgatctgctgtcccagactcccgagattcctattgatataagcagccactcagacggtctgtctgataaggaatgtgcagttcgaagggttaagacacagatgtcattaggcaagctctgtgtggaggagcgggggtatgagaaccccatgcagtttgaggaatccgattgcgatagttccgacggtgagtgttccgatgcgaccgtacggactaacaaacattactcctccgctacttggtag

SEQ ID NO: 195560 - DNA, 2901 bp, Artificial Sequence
  Description of Artificial Sequence: Synthetic coding sequence
atggccaacttccaggagcacctgagctgcagcagcagcccccacctgccctttagcgaatccaagacttttaacggcctgcaggatgagctaactgccatgggtaatcatccaagcccaaaactgctcgaggaccagcaggagaaaggaatggttcgtacagaactgatcgaatccgtgcattccccagtgaccactaccgtcctgacaagcgtctccgaggatagccgcgatcagttcgagaattcagtgctccaactcagggagcatgacgagtcagagacagccgtcagccagggcaattcgaacactgtggacggcgagtctacgtctggcactgaggatattaaaatccagttcagccggagtggtagcggatcgggcgggtttcttgaggggctctttgggtgcctgaggcccgtgtggaacatcattggcaaggcctacagcacggactacaagctgcagcagcaagacacgtgggaggtacctttcgaggagatttcagagctgcagtggctgggctctggcgcccagggagcggtgtttttggggaaattccgcgccgaagaagtcgccatcaagaaagtccgcgaacagaacgagacggatatcaaacatttaaggaagcttaaacatcctaacattatcgcattcaaaggggtgtgtacccaagccccctgctattgcatcataatggaatattgtgcacacggccagctgtacgaagtgttacgcgccggacgcaagatcacaccacggctgctggtggattggtccacgggcattgcttccggaatgaactacttgcacctacataagatcatccaccgggatttgaaaagccccaatgtacttgttacacacaccgacgcagtgaagatcagtgacttcggcacgtccaaggagctatccgacaagtctacaaaaatgagtttcgctggtactgttgcgtggatggcccccgaggtgatccgcaacgaacctgtcagcgaaaaagttgatatatggtcatttggggtggtgctctgggaacttttaacaggcgagatcccttacaaagatgtggacagtagtgcaatcatatggggagttggatccaacagcttgcatctgcctgtgcccagtacctgccctgatggctttaaaatactgatgaaacaaacatggcagtcaaagccacgcaatcgacccagttttcgccagaccctgatgcacctagatatcgcctcagcggacgttcttgccaccccgcaagaaacttactttaaatcacaggctgagtggagagaggaggtaaagaagcactttgagaaaatcaaatctgaaggcacctgcatccaccgtcttgatgaagagctcatcaggcgccgtagagaggagctgagacacgcactggacatccgagagcattacgagcgcaaactggaaagggctaataacctctatatggaactgagtgccatcatgctccagttggagatgagagaaaaggagcttattaaacgagagcaggctgttgagaagaagtaccccggcacatataagagacacccagtgcggcccatcattcatcccaacgctatggagaaactcatgaagcgtaaaggtgtcccgcataaaagcggtatgcagaccaagcgccccgacctgctccgatccgagggaattcctacaacagaggtagcacccaccgctagccccctgagcggttcgcccaaaatgagtacgagcagttcaaaaagtcgctatcgctcaaaaccccgacaccgaagaggaaattctcgcggatctcactctgactttgcggcaatcctaaagaatcaaccagcccaagagaatagcccacaccctacctatctgcaccaggcccaaagtcaatacccctctctgcatcatcacaacagccttcagcaacagtaccagcagcctcctcctgcaatgtcacagagccaccacccccgcctgaatatgcacggccaggacatcgcaacatgtgcaaacaatttacggtacttcggtcctgccgccgcgctccggtctcccctgtccaatcatgctcagcgccagttgcccggtagttcacctgacctgataagtaccgccatggccgccgactgttggaggtcatccgagccggataagggccaggctggtccatgggggtgttgccaggccgacgcctacgacccttgccttcaatgtcgccccgaacagtatggaagcttggacatccccagcgccgaaccggtgggccgctcgcccgacttatccaaaagccccgcgcacaaccctctgctagagaatgcccagtcaagtgagaagacagaagagaatgagtttagtggttgccggtcagaatcttccttgggcacctcgcatctgggtacccctccagcactcccccgaaaaacacgtccgttgcaaaagtcaggggacgattccagtgaggaggaggagggagaggtcgattccgaagtcgagtttccgcgacggcagcggcctcacagatgcatatcgtcttgccaatcctattccaccttcagtagtgaaaattttagcgttagtgatggagaggaaggaaacacaagcgatcatagtaactcacccgatgagttggcagataaacttgaggacagactcgccgagaaactggatgacttgctgtcccaaaccccagagatccccatagatatctccagccactccgatgggctaagtgacaaggaatgcgctgtacggcgagtcaagacccagatgtctttaggaaaactctgtgtcgaagaacgcggatacgagaacccaatgcaatttgaggagagcgactgtgactcttcagacggcgaatgctccgacgccaccgttcgcaccaataagcattattcaagcgcaacttggtag

SEQ ID NO: 195561 - DNA, 414 bp, Artificial Sequence
  Description of Artificial Sequence: Synthetic coding sequence
atggccaacttccaggagcacctgagctgcagcagcagcccccacctgccattctctgaatctaaaaccttcaacgggcttcaggatgagctaactgctatggggaatcacccatccccaaagctgcttgaggatcagcaggaaaagggtatggttcgaactgagctgattgagagcgtgcactccccggtgactactactgtgcttactagcgtatcagaggattccagggaccagtttgaaaattccgtcctgcaactacgtgagcacgacgagagcgaaaccgctgtgagtcaggggaactctaacaccgtcgacggtgaatctacctctggcacggaggatatcaaaatccaatttagccggagtgggtctggcagcggaggcttcctcgagggactatttggatgttag

SEQ ID NO: 195562 - DNA, 342 bp, Artificial Sequence
  Description of Artificial Sequence: Synthetic coding sequence
atggccaacttccaggagcacctgagctgcagcagcagcccccacttgcccttttccgaaagcaaaactttcaatggtctgcaggatgagctgactgcaatgggaaatcatccaagccctaagctgctggaagaccaacaagagaagggaatggtccggacagaactgatagagtcagtgcactctccagtgactactacggtgctgacctctgtgtctgaggactcacgagatcagttcgagaactcagttcttcaactgagggagcacgacgagagcgagacagccgtcagtcaggggaacagtaatactgtggacggagaaagtacttccgggacatag

SEQ ID NO: 195563 - DNA, 2469 bp, Artificial Sequence
  Description of Artificial Sequence: Synthetic coding sequence
atgagctacgtggagtgcaagtgcctgcagctggagaacaagaacacctgggaggtgcccttcgaagagattagtgagttgcagtggcttggatccggcgctcaaggtgcagtctttcttggaaaatttcgggctgaggaggtggcaattaagaaggtgagagagcagaatgaaaccgatatcaagcatctccggaagctgaaacacccaaacatcatcgcgtttaagggggtgtgtacgcaggcaccttgttactgtatcattatggaatattgcgcgcacgggcagctctacgaagtcctgcgcgctgggcgtaaaatcaccccacgtctgttggtcgactggagtaccggcatcgcctctgggatgaactacttgcatttgcacaagatcatccatcgggacctgaaaagccctaatgtactggtgacgcataccgacgcggtgaagatcagcgactttgggacatctaaggaattatcagataaaagcacaaaaatgagcttcgcaggaacagtggcctggatggctccagaggtgatccgcaatgaacctgtgtctgagaaggtggatatttggtcttttggagtcgtcctttgggagctgctgactggagagattccgtacaaagatgttgattcaagcgctataatatggggtgtcggctcaaatagtctgcacctgcctgttcccagcacatgcccagacgggtttaaaatcctgatgaaacagacatggcagtccaagcccaggaaccgaccctcctttaggcagaccctcatgcacctggacatagcgtctgccgacgtcctggcaactcctcaagagacgtatttcaagagtcaggccgagtggagagaggaggtgaagaaacattttgagaaaatcaagtcagaggggacatgtattcacagactggatgaagagctcatcagaaggagaagggaagagctgcggcatgcgctagacatacgggagcactatgagcggaagctggagcgcgcaaacaatctctatatggaactgtctgccataatgctacagctagaaatgagggaaaaggaattgataaaacgcgaacaagcggttgagaagaaatatcctggaacttataagcggcatccagtgcggccaatcatacatcccaacgccatggaaaaattaatgaagcgcaaaggcgtccctcacaaaagcgggatgcaaaccaagcggccggatttgctgaggagtgaaggcattccaaccaccgaagtggcacccactgcgagccctctgtccggcagcccgaaaatgtccacctctagtagtaagtcacggtataggtctaagcccaggcaccgccgcggcaacagtagaggatcacatagcgattttgccgcgatcttaaaaaatcagccagcacaagaaaattctccccaccctacctaccttcaccaagcacagtcgcagtacccttccttacaccaccataattctcttcagcagcaataccagcagcctcccccggccatgagccaatctcaccacccacggctgaacatgcatggtcaggacattgccacttgtgccaacaatctacgttactttggccccgctgctgcactccggagtcctctctctaatcatgcacaaaggcagctgccagggtcttcgcctgatttgataagtaccgccatggccgctgattgctggaggtccagtgaaccagacaagggtcaggccggtccttggggctgttgccaggccgatgcatatgacccctgccttcagtgtcgcccggagcaatacggatctcttgacataccttcagctgaacccgtgggacgctcaccagacctcagcaagtccccggcacataacccactgctggagaacgcacagagctccgaaaaaaccgaagagaatgaattctccggatgccggtccgagagttctctgggaactagtcacctgggaacaccacccgctcttcctagaaagacccggcccctccagaagtcaggggacgactcaagcgaagaagaggaaggggaagtggactccgaggttgagttcccccgccgccagcgtccccacagatgcatttcatcctgccagtcctacagcacattttccagtgagaacttcagcgtgtctgacggtgaagaaggaaacacatcggatcatagcaactctcccgacgagctggccgacaaactggaagatcggctggctgaaaaactggatgacctcctaagccagacacctgaaattccaatcgacatcagctcccattctgacgggcttagcgacaaggaatgcgcagttcgcagggttaagactcagatgtctctggggaagctgtgtgtggaggagcggggatatgaaaacccaatgcagttcgaagagagcgattgtgatagttctgatggcgagtgcagcgacgccaccgttcggacaaacaagcactattcctctgcaacatggtag

SEQ ID NO: 195564 - DNA, 2280 bp, Artificial Sequence
  Description of Artificial Sequence: Synthetic coding sequence
atgtactgcggcatccagatcctggccctgtgggagcggggcgtgtgcacacaggctccatgctactgcataatcatggagtactgtgcgcacggccagctgtatgaagtactacgggccggccgcaaaataacacctcggctcctcgttgattggagcaccgggatcgcctcaggaatgaactatctccatttacacaaaatcatacaccgagaccttaaaagccccaatgtactggtgacgcataccgacgcagtaaagatcagcgactttgggaccagcaaggagctttcggacaaaagcactaaaatgagttttgcaggcacagtggcctggatggctcctgaagtgatcaggaacgaaccagtctctgagaaagtggatatctggagctttggcgtggtattgtgggaactgctgactggagagatcccatataaagatgtagattcatccgccatcatctggggggtcggctccaactctcttcacctcccggtgcccagcacctgccctgatggattcaaaatcctcatgaagcagacctggcaatccaagccgagaaaccgcccctcctttcggcagaccctcatgcaccttgacatcgcctctgcagatgtgctcgccacaccacaagaaacatacttcaagtcccaggcagagtggcgcgaggaagtgaagaagcacttcgagaagatcaagtcagagggcacttgtatccaccggctcgatgaggaattaatacggagacggagggaagaacttaggcatgcattagacataagagaacattatgaacgcaagttagagcgcgctaataatctctatatggagctgtccgctattatgctccagctggagatgcgagaaaaggaattaatcaagcgagagcaggccgtcgagaagaagtaccccggaacttacaaacgtcacccagtcagacctataatccacccaaatgccatggaaaagctgatgaaacgaaaaggagttccgcataagagcggtatgcagacaaagaggcctgacctactccggagtgagggtattccaaccacggaagttgcccctactgcatcacccctttccggctcccctaagatgtccaccagcagctctaaatctcgctataggtcaaaaccgcggcatagaaggggcaattcacggggaagtcactcagacttcgctgccatcctgaaaaatcagccagctcaggagaactcaccacatcctacttacctacaccaggctcagtctcagtaccccagcctccaccaccacaacagcctgcaacagcagtatcagcaaccgccccccgccatgagccagtcacaccatccgagacttaacatgcacgggcaggacatagcaacatgtgcgaataatctccgctactttggtccggcggctgctttgcgctcccctctctccaatcacgcccagagacaacttccaggctcgtcccctgatctcatttccacagcaatggcggccgattgttggaggtcttcagaacctgacaaaggccaggctggaccatggggctgttgccaggcggatgcctacgatccatgtttgcagtgccgtccggagcagtatggttcactggatataccgagcgcagagccagtgggcaggtcccctgatttgtctaagtcccctgcacacaatccgctcctggaaaacgcccagtcctcagagaaaactgaggagaacgagttttctggttgccggtcagaaagctcactgggaacatcacacctggggaccccaccagctttaccaagaaaaaccagaccgttgcagaagtctggagacgattccagcgaagaggaggagggtgaggtagatagtgaagtcgaattcccaagaaggcaacgcccccataggtgtatatcctcgtgtcagagctatagtactttttcatctgagaacttttcagtcagcgatggggaagaaggtaacacctccgaccactccaattcccccgatgaactcgctgacaagttggaagatcggctcgcagagaagcttgacgacctgctctcccagacaccagaaataccgatcgacatcagctcccactcggacggtctgagtgataaggagtgtgcggtgcggcgcgtgaagacccaaatgtcacttgggaaactttgtgtcgaggagcgtggttatgaaaatccgatgcagttcgaggagtctgactgtgactcctcagacggtgaatgcagcgacgccaccgtgagaacaaataaacattatagctccgctacgtggtag

SEQ ID NO: 195565 - DNA, 2841 bp, Artificial Sequence
  Description of Artificial Sequence: Synthetic coding sequence
atggccgtgatggagatggcctgccccggcgcccccggcagcgccgtaggacagcaaaaggaactgccaaaagccaaggagaagactccccctctgggaaagaaacaatcatctgtgtacaagctggaggcggtggagaaaagtccggtgttttgtggcaaatgggaaatcctgaacgatgtgatcacaaaggggaccgctaaggagggcagcgaagccggccctgccgccataagtatcatcgcccaggctgagtgcgaaaactcccaagaattttctcccacattttctgaaagaattttcatcgcaggttccaagcagtactctcaatcagagtcactcgaccagatcccaaacaacgtcgcccatgctacagagggaaagatggcccgggtttgttggaagggtaaacggaggtccaaagctcgcaagaagcgcaaaaagaagagctccaaaagtctggcccatgcaggtgtggctcttgcaaagccactgccaaggacgcccgagcaagaatcctgcaccattcctgtgcaggaagatgaatcacctctgggggctccatacgtgcggaatacaccccaatttacaaaacccctcaaagaacctggactcggtcagctgtgttttaaacaactgggggagggactccgcgccctacccaggtccgaactgcacaagctgatttctcccctgcagtgcttgaatcatgtgtggaaattgcatcatccgcaggacggaggtcctttacccctgcccacacatcccttcccctacagtcggctcccccatccatttccttttcaccctttacaaccttggaaaccccatccattagaatccttcctgggtaaacttgcctgcgtagatagccagaagccgctcccggaccctcacctcagtaaactggcttgcgtggactcaccaaagcccctgcccggaccccacctggaaccctcatgccttagtcggggagctcatgagaagttctcagttgaggagtacttggtgcatgcacttcagggatcagtctcatcaggacaggctcactccttaacctcgttggcaaagacttgggcggcacgaggttcaaggtcacgcgaaccttccccaaagacagaagataatgaaggtgtactgctcaccgagaagctgaaaccagtggattatgaataccgagaagaggtgcattgggctacacatcagctgcgccttggccgcggtagcttcggtgaggttcatcggatggaagacaaacaaacgggctttcagtgtgccgtcaagaaagtacgtctggaggtgtttcgggcagaagaactgatggcatgcgctggactcacttctcccaggatcgtccctctgtacggagcagtaagggagggaccatgggtgaatatcttcatggagctacttgagggcggatccttgggtcagctggtgaaagagcagggttgcctccccgaggaccgagccttgtattaccttggacaggctctcgaaggactggagtacctgcattctcgcagaatcctgcacggagacgtgaaggctgacaatgtgttattgagttctgacgggtcccacgcagccctatgtgactttggccacgcggtctgcctgcagcctgatggccttggcaagtctctcctcaccggtgattatattcccggaaccgagacccatatggctccagaagtcgtgcttggccgcagttgcgacgcaaaggtggatgtatggtcttcctgctgcatgatgctgcatatgttgaatgggtgtcacccctggacccagttcttcaggggacccctctgtttgaagattgcctcagagccacccccagttcgggaaatacctccttcctgtgcaccactcaccgctcaggctatccaggagggcctacggaaggaaccaatccatcgcgtgtctgccgcggaattagggggaaaagtgaaccgtgcccttcagcaagtgggtgggctgaagtccccatggaggggcgaatacaaagagccacgacaccctccccccaaccaagcgaactaccaccaaacacttcacgctcagccacgcgagttgtctcctcgcgcaccggggccacggccggctgaggaaaccaccggaagagctcctaagctgcagcctcctctcccacccgaacctcccgaacccaacaagagcccaccacttactttgtccaaggaagagagtggtatgtgggaaccattaccgctcagctccctagagcccgcgcccgccaggaatccgtccagtcccgaaagaaaagccacagtgccagagcaggagctgcagcagctagaaattgagctgttcctcaacagcttgtctcaacctttcagcctggaggagcaggaacaaattctgtcatgtttgtctattgattctctttccctgtccgacgacagcgaaaagaatccgtccaaagcctcacagagttctcgggacactctttcctctggagtgcactcgtggtccagtcaggcggaggctcggtctagctcctggaatatggttctggcccgcggaagaccaactgataccccttcttacttcaacggcgtcaaagttcagattcagtctcttaacggggagcatctgcacatccgtgaatttcatagggtgaaagtaggagatattgccaccggaatcagctctcaaatccctgcagctgctttttccctggtaaccaaggacgggcagcctgtccggtatgacatggaagttcccgattccggcatcgacttgcagtgcacattagcgcctgatggcagtttcgcgtggtcttggagagtcaaacacggccagttagagaaccgcccctag

SEQ ID NO: 195566 - DNA, 1302 bp, Artificial Sequence
  Description of Artificial Sequence: Synthetic coding sequence
tgcttcaagcagctgggcgagggcctgcgggccctgccccggagcgaactacataagctgatcagtcctttacagtgtctgaaccatgtttggaagctccaccacccccaggacgggggtccgctgcccttgccaacgcaccaccccttcccatttcacccactccagccatggaaaccgcaccccctcgaaagcttcctgggtaagctggcttgcgttgacagccaaaagcctttgcccgaccctcacctgtctaaactggcatgtgtggactccccaaagcctttgcctgggcctcacctagagccctcctgtttaagccgcggcgctcacgagaagttttcggtggaagaatacctagtgcacgctcttcagggctctgtatcttccgggcaggcgcacagcctaacttccttagcaaaaacgtgggcagctaggggctcacgatcgagggagccctctcccaagaccgaagacaatgaaggcgttctactcacagagaagcttaagcctgtggattatgagtatcgcgaggaggttcattgggccactcatcaactcagactgggtcgcgggagcttcggggaagtccacagaatggaggataaacaaactgggtttcagtgcgccgtgaagaaagtgaggctcgaagtgttccgggccgaggaactcatggcatgtgccggactcacttcgccccggatcgtccctctctacggggcagtgagggaggggccttgggtcaatatttttatggaactgttagaaggaggatcattggggcaattagtgaaggaacaaggatgcttgccagaagaccgtgctttatattacctggggcaagctttggagggactggagtacctgcatagccggagaatactgcacggagacgtaaaggccgacaacgtgctgctgtctagcgacggtagtcatgctgccctatgtgacttcggacatgccgtgtgtttacaacccgatgggctgggaaagagtctgctaaccggcgattacatccctggaacagaaactcatatggccccagaggtggttctggggcggagctgtgacgctaaggtggacgtttggtccagctgctgcatgatgcttcacatgctgaacggttgtcatccttggacgcagttcttcagaggaccactgtgcctcaaggtcggtgacggaactcagcacggccagcagggagagcttcaaggccccggagcacaggcagcaggatggcgggggtgttctgcagtggctgatggagctagaggaggactagtgattcatgtcgggtcctag

SEQ ID NO: 195567 - DNA, 3942 bp, Artificial Sequence
  Description of Artificial Sequence: Synthetic coding sequence
atggagagcggcggcggcaacgcccccgccggcgccctgggcgccgcttccgaatctccacaatgtcctcccccacctggggttgaaggggccgccgggccagccgaacccgacggagccgctgaaggagctgcaggaggttccggcgagggcgagtcggggggcgggccgcggcgcgcacttagagccgtgtacgtcaggtccgagtcttcacagggcggcgcagcaggcggacctgaagccggggcgcgacagtgtcttctgcgcgcctgtgaagcggagggagcccacttaacatctgttccctttggcgagctcgattttggggaaaccgctgtcctcgatgccttctacgatgctgatgtagctgtggtcgacatgtctgatgtgagccgccagccctcactgttttaccacctaggcgttcgggaatcctttgacatggccaacaacgtcattctttaccacgacacggacgctgatacggctctgagcctaaaagatatggtaactcagaaaaacacagcaagttcaggcaactattattttatcccttacatagtcaccccgtgtgccgattatttctgctgcgaatctgacgcacagcgcagagcctcggaatatatgcagccaaactgggacaatattcttggacctctgtgcatgcctctagtggatcgcttcattagcctgctcaaggatatacacgtgacttcgtgcgtatactataaggagacgctgctgaatgatattaggaaggcacgggaaaaataccagggggaggaattagcaaaggagctagcgcgtataaagctgcggatggacaataccgaggtgctgacgtccgatataatcattaatctactgctaagttacagggatattcaagactatgacgccatggttaaactggtggagactctcgaaatgcttcccacctgtgatttggcggaccagcacaatattaaattccattacgcgttcgcattgaacagaaggaatagcaccggcgatagagagaaagcactgcagatcatgctgcaggtgttgcagagctgcgatcaccccggacctgacatgttctgcctgtgtggaaggatatacaaggacatctttcttgactcggattgcaaggacgacactagtcgcgactcagcaatcgaatggtaccgtaaaggctttgagctccagagctccctctacagcggtataaaccttgcggtcctcctcatagtcgccgggcagcaatttgagacatccctagaactacgtaagataggagtgagattaaactcactgctagggcggaaaggatctctggaaaaaatgaataactactgggatgttggccagtttttttctgtttctatgctcgcccatgacgtgggcaaagccgtccaggccgccgaacggctgtttaagctgaaacccccagtgtggtacctgaggagcctggtgcagaacttgttgctcatacgtcgattcaagaagaccattatcgaacacagtccccgccaagagaggctgaacttttggcttgacatcatattcgaggccaccaacgaagtcacaaacgggctgcgctttccagttctcgtgatcgaaccaactaaagtgtaccaaccatcttatgtatctataaacaacgaggccgaggagaggaccgtgagtctgtggcacgttagtccaacggaaatgaaacagatgcatgaatggaatttcacagcgtctagtatcaaaggtatctctctttcaaagtttgatgagcgctgctgctttctctatgtgcacgacaatagcgacgattttcagatctacttttctacagaggaacagtgttcgcgcttttttagcttggtgaaagagatgataaccaatacagcaggtagcacggtcgagttggagggcgaaacggatggggacacgcttgagtacgaatatgatcatgatgccaacggtgagagggtggtgctaggaaagggcacctatggtatagtctatgcgggccgagacctgtctaaccaggtccggattgccatcaaggaaattcctgagagagactcgcggtattcccagccacttcatgaagagattgctctccacaagtatctcaagcaccgaaacatcgtgcagtatctgggttccgtgagtgaaaatggttacatcaagatcttcatggaacaggtccccggcggatcactgtctgccctcctgcgttctaaatggggccctatgaaagaacctaccatcaaattttacactaagcagatcctggagggcctgaagtatcttcacgaaaatcagatcgtccaccgcgatataaaaggcgacaacgtgctggtgaatacgtatagtggggtggtgaagattagtgactttgggacatccaaaaggttagccggcgtgaacccctgtaccgagacattcactggaacgcttcagtacatggccccagaaattattgatcagggacccagaggatacggcgcccccgccgacatatggtcactcggatgtaccataatcgaaatggccaccagtaagcctccctttcacgaattaggtgagccccaagctgccatgtttaaagtggggatgtttaagattcatcccgagatacctgaggccttgagcgccgaggcccgtgcgtttattctgtcctgtttcgagccagatccacacaagagggcaacaaccgccgagctgctgcgggaaggcttcctgcgacaggtcaacaagggcaagaagaaccggattgcgtttaaacccagtgagggaccgagaggggtggtcctcgccctacccacacagggagagccaatggctacctccagttcggagcacggatccgtgtcgccagattcagacgcccagccagacgctctcttcgagcggacgagagcaccacgtcaccacctggggcatttactgtcggtgcccgacgaatcgagcgctttggaggaccgcggcttagcctcaagccccgaagaccgggaccagggcctctttctgctccgcaaggactcagaacggcgggctatcctatacaagatactgtgggaggaacagaatcaagttgcttctaatctgcaagagtgcgtggctcagtctagtgaagagcttcacctgtccgtcggccatataaaacagataattggcattctgagggactttattcgatctccagaacacagagtaatggcaactaccatcagcaagcttaaggttgacctagatttcgactcatcatcaatcagtcagattcacctggtactgtttggctttcaggacgcagttaacaaaattctccggaaccatctcataaggcctcattggatgttcgcaatggacaatataatccgaagggctgtgcaggcagcagttacaatcctgatccccgaactgcgagcacacttcgaacccacctgcgagaccgagggagttgacaaagacatggacgaagctgaggaaggttacccccccgccaccgggcctggtcaagaggcacagccccaccaacagcatctctctctccagcttggtgagctgcgccaagaaacgaatcgcctactagagcacctcgtggagaaagagagggagtaccagaacctgctcaggcagacactcgagcagaagacgcaggagctctaccatctacagttgaagctcaagagcaactgtattactgaaaatcccgccgggccatacggccagagaactgataaggagctgatagactggttgagactgcagggagcagacgcgaagaccatagaaaagatagtggaggaaggatatacactgtctgacattctgaacgaaatcacaaaagaggatctccggtacctgcggctcaggggaggcttactctgccgcctgtggagtgcagtttctcagtatagacgcgctcaggaagcttcggaaacgaaggacaaggcctag

SEQ ID NO: 195568 - DNA, 4677 bp, Artificial Sequence
  Description of Artificial Sequence: Synthetic coding sequence
atgcgggaggccgccgccgccctggtgcccccccccgccttcgccgtaacaccagccgccgccatggaggagcctccacccccccctccccctccaccccctccgcctgaaccagagaccgaatcagagcccgagtgctgcttagctgccagacaggaggggaccctgggcgacagcgcatgcaaatcacccgagtctgacctggaagattttagtgacgaaactaatactgaaaatctgtatggtacatctcccccatccactccccgccagatgaagaggatgagtaccaagcaccaaaggaataatgtgggcaggcctgcttcacgttccaatctgaaagagaagatgaacgccccaaaccagccaccccacaaagataccggaaagaccgtggagaacgtggaagagtacagttacaagcaagaaaaaaaaatccgggctgccctccgcaccacagagcgcgatcgcaagaagaacgtccagtgcagctttatgctcgactcagtgggcggaagcctgccaaaaaaatcaataccagatgtggatttgaataagccctacctgagccttggatgctctaatgctaagttgcctgtaagtgtgcccatgccaattgcgagacccgcaagacaaacaagtagaacagactgtcccgctgaccgcttgaaattcttcgagacgctgagattgttgctgaaattgacgtctgtgtccaaaaaaaaggatagagaacaaagggggcaggaaaatactagcggtttttggctgaatagatctaacgagttgatctggctggaactccaggcttggcatgccgggcgtaccatcaacgaccaggacttctttctctataccgcaagacaagccatccctgatattatcaacgagatcctgacatttaaggtcgattacggtagctttgccttcgttagggacagggctggcttcaacggcacctccgttgagggccagtgcaaagctacccctggtaccaagatagtgggatactctacccaccatgaacacctccagcggcagcgtgtgtcctttgagcaggtgaaacggatcatggaactactcgaatatattgaagcactctacccgagtcttcaagccctgcagaaggactacgagaagtatgcagcaaaagattttcaggaccgggtgcaggccctctgcctttggctcaatatcacaaaggacctgaatcaaaagctgcgcatcatgggtactgtgcttggcattaagaacttatcagatattggctggccagtgtttgaaatcccatccccaaggccaagtaaggggaacgaacccgagtatgagggggatgacactgagggtgagcttaaggaactcgaatccagcaccgacgagtcagaggaggagcagatcagtgatcctcgagtgcccgagattcggcagccaattgacaacagttttgatatacagagccgggactgtattagtaaaaagcttgaaaggctggagagcgaggacgatagtctggggtggggcgctcctgactggagtacagaagcaggattcagtcgccattgcttaacatctatatatagaccattcgtggacaaggccttgaagcaaatggggctgcggaaactcatacttaggctacataagttgatggacggaagtctccagagagctcggatcgccttggttaagaacgatcgccccgtggaatttagtgagtttccggaccctatgtgggggagcgattacgtgcagctgtcccgtaccccaccatcatctgaagaaaagtgctcggccgtgtcttgggaggagttgaaagccatggatctcccaagttttgaacccgctttcctggtgctctgcagagtattgctgaacgtgatacacgagtgtctcaaactcagactcgaacaaagacccgccggagagccctcactcctgagcataaaacagctggtgagggaatgcaaggaggtgttgaagggtgggctcctaatgaaacagtattaccagttcatgttgcaagaggtactagaggacctggagaaacccgattgtaacattgacgccttcgaagaagatctacataagatgttgatggtgtattttgactacatgaggtcctggatccagatgctccaacagctccctcaagcctcacacagcctaaaaaatttgctcgaggaggagtggaactttaccaaagagatcactcactacattagaggaggagaggcgcaggccggaaaactgttctgcgatattgcgggcatgcttctgaaatctaccggctctttcctcgaatttggactgcaggaatcttgcgccgagttttggacatccgccgatgactcatctgcctccgatgaaatcagaagaagcgtaattgaaatctccagggcacttaaagagctttttcatgaagctcgcgagcgggcaagcaaagctctcgggtttgctaaaatgctgcggaaggatctcgaaatcgctgccgaatttagactttcagcccctgtgagggaccttctggacgtcctgaaatctaagcagtacgtgaaggtccagattcccggtcttgagaacctgcagatgtttgtacccgacacactcgccgaggaaaaaagtatcatcctccagttgctgaatgcggccgctggtaaggattgctccaaagattccgatgatgtattgattgacgcctacctcctgctgacaaagcacggagatagggcacgcgatagcgaggactcctgggggacctgggaggctcagcctgtaaaagtggtcccacaagtggaaacagttgacactttgagatcaatgcaggtggacaaccttctccttgtggttatgcagtcggcccatctgaccattcagagaaaggcattccagcagtcaatcgaaggtctgatgaccctgtgccaggaacagactagttcgcaacccgtgattgccaaggcccttcaacagctgaagaatgatgccctggagctctgtaacaggatctctaacgccattgatcgggtggaccatatgttcacgagcgaattcgacgccgaagtggacgaatcagaatcggttaccttgcagcaatattacagggaggcgatgatccagggctacaatttcggatttgagtatcataaagaagtggtacgtctgatgtctggtgagtttaggcagaagatcggtgacaagtacatctcctttgcacgcaagtggatgaactatgtgctgactaaatgtgagtctgggagaggaactaggccacggtgggccacacagggtttcgattttctccaagccatcgaacctgcattcatcagcgcactcccagaagatgatttcctatcactgcaggcccttatgaacgaatgcataggccacgttattgggaagcctcattcccccgtgacaggcttgtatctagccattcacagaaattcaccaaggcccatgaaagtgccccggtgtcactctgatcctccaaatcctcatcttatcattccgacgccagagggcttcagggggagttccgtgccagagaacgaccgcttggcatccatcgccgccgagctgcagtttcgctctctgtctaggcattcttctcccacagaagaacgggatgagccagcttaccctcgcggagattctagcggtagcacacggagatcctgggagctgcgcacacttataagtcagtccaaagacaccgcttccaagctgggccctatagaagctatacagaagtctgtccggctgttcgaagagaaacgctatcgggagatgaggcggaaaaacattattggacaagtgtgtgatacgcctaagagttacgataatgtcatgcacgtcggccttcgcaaggtaacatttaaatggcagcgggggaataagatcggggagggtcaatacggaaaggtgtatacctgcatcagtgtggacacaggcgagctgatggccatgaaagagattcgattccagccaaatgaccacaagactatcaaggagactgcggatgagctcaaaatcttcgagggcatcaaacaccctaaccttgtgcgctacttcggcgtagaactgcacagagaggagatgtacatctttatggagtactgcgatgagggtacactggaggaagtgagtcgcctggggctccaggaacatgtgataagactctattcgaagcaaattacgatcgcaattaacgtcctccacgaacatgggatcgtgcacagagacatcaaaggagctaacatctttctcacctctagtggactgataaaactaggcgacttcgggtgctcagtcaagctgaagaacaacgctcaaacaatgcctggggaggtgaacagtacgctcggcaccgccgcttatatggcaccagaagtcatcacccgggcaaaaggagagggccatggtcgcgcagctgacatctggagtctgggatgtgtggtcatcgaaatggtcacggggaaacggccttggcacgaatacgagcacaattttcaaattatgtataaagttggtatgggccacaaaccaccaatccccgaaagattaagtcccgaggggaaggattttcttagccattgtttagaatcagatcctaagatgcgctggaccgctagtcagcttctggatcactcctttgtcaaagtgtgcacagacgaggaatag

SEQ ID NO: 195569 - DNA, 4827 bp, Artificial Sequence
  Description of Artificial Sequence: Synthetic coding sequence
atgcgggaggccgccgccgccctggtgcccccccccgccttcgccgtgacccctgctgctgcgatggaagagcccccccccccaccccctcctccgcccccacctccagagccggagactgagagtgagcctgagtgttgtctcgctgcacggcaggaaggtacacttggggacagcgcatgcaaaagtcccgaatctgatctagaggatttttccgacgaaactaatactgaaaacctgtacggcacctcccccccgtcaaccccccgccagatgaagcgtatgtctaccaagcaccaaagaaataacgtcggccgccccgcaagtaggagcaacctgaaagagaagatgaacgccccaaaccagcccccacacaaagataccgggaaaacagtggaaaacgtggaagaatacagttataaacaagagaagaagatacgagcagctctaagaacgactgaaagggatagaaaaaagaatgtacagtgctcttttatgctcgactcagtaggcggctctctaccaaaaaaaagtatacccgacgttgatttgaacaagccctatctctccctgggatgttcaaacgctaagctgccagtctcagtgccaatgcccattgccagacccgccaggcagaccagtcgaacagactgtccggccgacagacttaagttttttgagactctgaggctcctgcttaaactgacaagcgtgtccaaaaaaaaggaccgtgaacagagaggccaagaaaatactagcggcttctggcttaatagatcaaatgaactcatttggcttgagcttcaggcttggcacgcaggcagaactataaatgatcaggacttcttcttgtacactgccagacaagccatccccgatatcatcaacgagatactcaccttcaaggtggattacggatcttttgcctttgtaagagaccgcgcggggtttaacggcacctccgtagaggggcagtgtaaagctactccaggcacgaaaatagtaggttactctacccatcacgagcatttgcaaaggcagagagtgtcattcgagcaggtcaaaaggataatggagttactggagtacattgaggcgctttatcctagcctacaagccctgcagaaggactacgagaaatatgctgccaaagactttcaggatcgagtccaagcactgtgcttgtggcttaatattaccaaagacttaaaccagaagcttagaattatgggcactgtgctggggatcaaaaatctgtccgacatagggtggcctgtttttgaaatcccatctcctcgcccatctaaaggtaatgagccagaatatgaaggtgatgacaccgagggcgagttgaaggaattggagagctctaccgatgaatctgaggaagagcaaattagtgatcctagagtgcccgaaattagacagcccattgacaattctttcgatattcaatcccgcgattgcatctccaagaagctggagaggctggagtccgaagacgattccctgggctggggtgcccctgactggagcaccgaagctggcttctcccgacactgcctgaccagcatctatcgacccttcgtggataaagccctgaagcaaatgggtttgcggaagctcatcctccgactccacaaacttatggacgggtcactgcagcgagccaggattgctcttgtcaaaaacgatcgcccagtggaatttagcgaatttcctgacccgatgtgggggagcgactacgtgcagctatcccgaacaccccctagttcggaggagaagtgttcggcagtgagctgggaagagcttaaagctatggacttgccctccttcgaaccagcttttttggtgctgtgtcgtgtactgctcaacgtgattcacgagtgtctgaagttgcgccttgagcagcggcctgctggcgagccctcacttctgagtattaagcagctggtacgggaatgcaaggaggtgctgaagggaggtctgttgatgaagcaatattatcagtttatgctacaggaggtgctggaagatctggagaaaccggactgcaacatagacgcttttgaagaagacttacataagatgctgatggtgtattttgattacatgcggtcctggattcagatgctgcagcaactgcctcaagctagccattcactgaaaaacctcttggaggaggagtggaacttcacaaaggagattactcattatattagaggaggtgaagcccaggccggaaagctgttttgcgacattgctggcatgctactcaaaagcacaggaagctttctcgagtttggattacaagagtcctgtgccgagttttggacatcagccgatgactcgagcgcttctgacgagatcaggaggagtgttatcgaaatcagccgcgcactcaaagaacttttccatgaggcacgggagagggcgtccaaggcgttaggctttgctaaaatgttgagaaaagatctagagatcgccgcagagttcagattgagcgcacccgtgcgagatttactggacgtgcttaaaagtaaacagtacgtgaaggtgcagataccagggctggaaaatctgcaaatgtttgttcccgatactctggctgaagagaagagcattatcctccaactgctcaatgcggcagccggtaaggattgttccaaggacagcgatgacgtgctgatcgacgcctatctgctgctgacgaaacatggagacagagctagggactcggaggacagttggggcacatgggaagcgcaacctgtgaaggtggttccacaggtggagacagtcgataccctgcgcagcatgcaggtggacaacctgctgctggttgtgatgcagtcagctcacctgaccatccagcgtaaagcctttcagcaaagcatcgagggcctaatgaccctttgccaggagcaaacatctagccaacccgtgatcgccaaggcactgcagcaactgaagaacgatgcattagaactctgcaatcgcatctccaatgcaattgatcgcgtggatcatatgtttacgagtgagttcgacgctgaggtcgacgaaagcgaaagcgtcaccttacaacagtattaccgggaggccatgattcaaggatacaatttcggtttcgaataccacaaagaggtggtcaggcttatgagcggcgagttccggcagaagattggtgataagtacattagtttcgccaggaaatggatgaattatgtcctcaccaagtgtgagtccggccgagggacccggccccgctgggctacacagggatttgactttctacaagcaatcgaacccgcttttattagtgccttgcccgaggacgactttctgagtctccaggccttgatgaatgaatgcatagggcacgttattgggaagccgcactcccctgtgacaggtctgtaccttgccattcaccgaaactccccccgaccaatgaaggtaccgagatgccactcagatcccccaaatccgcacctgataattccgacccccgaaggattttccacgcggtcaatgccaagcgacgcccgctcacacgggagccctgcagctgcagccgcagccgctgccgcagccgtggcagcaagtcggccttcgccttccggaggagacagtgtgctgccaaagtccataagctccgcccacgatactcgcggatcctctgtcccggagaatgaccgcctagctagcatagccgcagaattgcagtttaggtcactttcaaggcacagctcaccaaccgaggaacgagacgaaccggcgtatcctcggggcgattcttctgggtcgacaagacggtcttgggagctgcgaacactgataagccagtctaaagacactgcctctaagctgggcccaatagaagccattcagaaaagtgtgcgcctcttcgaggagaagcgctatcgcgaaatgcgacgcaaaaatatcatagggcaggtctgcgacacacctaagtcgtacgataatgttatgcacgtgggccttagaaaagtgacctttaagtggcaaaggggtaacaaaattggtgaaggacaatacgggaaggtatacacatgcatctctgtggacacaggggagttaatggcgatgaaagaaattcgattccaaccaaacgatcataaaacaatcaaagagacagcggatgaattgaagatttttgaaggtatcaagcaccctaatctggtgagatactttggagtggagctgcaccgggaggagatgtacatcttcatggaatactgtgacgaaggcacactcgaggaggtgtcacgcctgggactccaggaacatgtgatacggttgtattccaagcagattacaatcgccataaatgtcctgcacgagcatggaattgtccaccgagatattaagggggccaacatttttttaacctcctccgggctgattaagttgggcgacttcggctgctccgtgaagttaaaaaacaacgcccagactatgccgggcgaggtgaactctacccttggaactgccgcttacatggctccagaggtgatcacccgggccaagggagagggtcatgggcgagcagctgatatttggtcattagggtgtgttgtcatcgaaatggtaaccgggaagaggccttggcatgaatacgagcacaactttcagatcatgtataaagttggaatggggcataaaccacctatacccgagagactttcaccagagggtaaggactttttaagccactgcctcgagtctgatccaaagatgcgttggacggctagccagcttctcgatcactcattcgttaaagtctgtactgacgaagagtag

SEQ ID NO: 195570 - DNA, 4497 bp, Artificial Sequence
  Description of Artificial Sequence: Synthetic coding sequence
atgcgggaggccgccgccgccctggtgcccccccccgccttcgccgtgacgcccgccgcggctatggaggagccccccccgcctcctccaccgcctcctcctccccctgagccagagacagagtctgaacctgaatgttgcctggcagcacgacaggaaggaaccttaggagactctgcttgcaaatctccagaaagcgacctggaggatttttcagacgagacaaacacagagaatctgtacggcaccagccctccatcaactccacgacagatgaaacgaatgtcaacgaaacatcagagaaacaacgtgggccgccccgctagtcggagcaatctcaaggaaaaaatgaacgccccaaatcagccaccgcacaaggacactggaaaaactgtagaaaacgtagaagaatattcctacaagcaggaaaagaagatcagagctgcgctcagaacgaccgagagggataggaaaaaaaatgtccaatgctcctttatgttagactcagtgggaggcagtctcccaaaaaaaagcattcccgacgtggatctcaataagccttatttgtcccttggatgcagcaatgccaagctccccgtgtccgtccccatgccgatcgctaggccagcccggcagacttctcgcaccgactgtccggcagacaggcttaagtttttcgaaaccctgcgcttgctgttgaaactcaccagcgtgtcgaagaaaaaggatcgggagcaaagagggcaggaaaacactagcggcttctggcttaacagatctaatgaattgatttggttagaactgcaggcctggcacgccggccgtactattaatgaccaagacttctttttatataccgcacggcaggcaattcctgacattattaacgaaatcctcacctttaaggtcgactacggcagcttcgcattcgtgcgggaccgcgcgggattcaacggcacctccgttgaaggtcagtgtaaggccactcctgggacaaagattgtgggctacagcactcatcacgagcacctgcagcgccaacgggtctccttcgagcaagttaagcgcatcatggaattattggagtatattgaggctttgtaccccagcttgcaggccctacagaaagactatgaaaagtatgctgccaaggattttcaagatcgtgtgcaggccttgtgcctgtggttaaacatcacaaaggatctaaatcagaagttacgcatcatggggacggtgctaggcatcaaaaacctttcggacattgggtggcctgtgttcgaaataccaagcccaagaccatcaaaaggcaacgaacctgagtatgaaggcgacgacaccgagggcgagctgaaagagctggagagctcaactgacgagagcgaggaggaacaaataagcgacccaagagtgcccgagatccggcagccaatcgataattcgttcgatatccagtctagggactgcatttcaaaaaagctggagcgactggaatccgaggatgattctttgggatggggcgcgcctgactggtccaccgaagcaggattctctagacactgtctgacgagcatctatcgccccttcgtggacaaggcactcaagcagatgggactgaggaagcttattctcagactgcataagctgatggacggatctctccaacgggctaggatcgcactcgtgaagaatgaccgccccgtggagttctctgaattccccgatcccatgtgggggtcagactatgtgcagcttagcagaaccccccccagcagtgaggaaaagtgctcagcagttagttgggaagagttgaaggctatggatctgccaagcttcgagccagcatttctcgtcctctgccgagttctcctgaacgtgattcacgaatgtttaaaacttcgtctggagcagagaccagccggagaacctagtctgctgtctattaaacagctggtgagagagtgcaaggaagtgctcaagggtggcctgctcatgaaacagtattatcagttcatgctccaggaggttctggaggacctcgagaagccggattgtaacatcgatgccttcgaggaagatctgcacaaaatgctcatggtgtatttcgactatatgcggagttggatccaaatgcttcagcaattgcctcaggcaagtcactctctgaagaatctgctcgaggaggagtggaactttaccaaggagataacgcactacatcagaggtggcgaggcccaggccggcaagctgttctgtgacatcgctgggatgctcctgaaaagcacaggatcctttctggaattcggattgcaggaatcttgcgctgagttctggacaagcgcagatgactcatccgcatctgatgagatccgccgttcagtcatcgagatatccagggcgttaaaggagttgttccacgaggcacgcgagagagcttccaaagcactgggcttcgcaaaaatgttgcgcaaagacctggagatagcagcagagtttcgactctcggccccagtaagggatttgctcgacgtgctcaaatcgaaacagtacgtgaaagtccagatacctggcttagagaatcttcagatgttcgttcctgacacattagcagaagagaaatccatcattttgcagctgttaaatgccgccgccggcaaggactgttccaaagatagcgatgacgtcctgattgatgcctatctgctcctgaccaaacacggtgaccgggcgcgcgactccgaagatagttggggaacgtgggaagcccagcctgtgaaggttgtgccacaggtagagaccgttgacactctgcgaagtatgcaggtggataacctcctgctggtggtgatgcagagcgctcatcttacgatacaaagaaaggctttccagcagagtattgaagggctaatgacgctgtgccaggaacagacttcctctcaacctgtgatagcaaaggctttgcagcaattgaaaaacgacgcattagagctctgcaaccgcatctccaacgccattgatagagtagatcatatgtttacctcagagtttgatgcagaggtcgacgagtcagagagcgtcaccctccagcagtattatagggaggctatgatccaaggatacaatttcggcttcgagtatcacaaagaggtggtccggcttatgagcggcgagtttcgtcagaagatcggggataagtatatttcctttgcaagaaagtggatgaactatgtgctgaccaagtgtgagtcgggaaggggaacgcgcccaaggtgggctactcagggcttcgatttcctccaagcaattgaacccgctttcatttccgccctccccgaggatgatttcctgagtttacaggccctgatgaacgaatgcatcggccacgttattggaaagccccatagtccggtcacaggcctctatctggcgatccatagaaactctccccgccccatgaaagtacctcgctgccactcagatccacccaaccctcatttaatcatcccaactcctgagggttttagaggaagttctgtgcctgaaaacgatcgactggctagcatcgccgccgagctccagtttaggagtctgtcccggcacagcagccctaccgaggagcgggacgagcccgcttatcccagaggagatagctccggcagcacccgacgttcctgggaactgagaaccctaatcagccagtccaaggacacagcctctaaactgggtcctatcgaggcaattcagaaatcagtacggctgttcgaagagaagaggtaccgcgagatgcgcaggaaaaatattatcggacaagtatgcgatactccaaagtcatatgacaacgttatgcacgtcggactgaggaaagttacctttaagtggcaacgaggcaacaaaattggggagggacagtatggcaaggtgtatacatgcattagtgtcgataccggggagctgatggctatgaaagagatccggtttcagcccaacgaccacaagactattaaagagacggccgatgaacttaaaatattcgagggaataaaacaccccaacctggtgcgatacttcggagtcgagctgcatagggaagagatgtatatattcatggagtactgcgatgaaggaacgctggaggaagtgtcacggcttggtttacaggagcatgtaatccggttgtattctaaacagataaccatcgcgatcaacgtgctccatgaacacgggattgtgcatagagatatcaaaggtgcaaacatctttttaacctccagcggactgattaagctcggcgactttgggtgctcagtgaaattgaagaataacgcacagaccatgcccggtgaagtgaactctacgctgggtactgccgcttacatggccccggaggtcatcacaagggctaagggcgagggacacggaagggcagcagatatttggtctcttggctgtgtggtaattgagatggttacggggaaaatctgcaaggacactgaatag

SEQ ID NO: 195571 - DNA, 324 bp, Artificial Sequence
  Description of Artificial Sequence: Synthetic coding sequence
atggaggagccccccccccccccccccccccccccccccccccccgaacccgaaaccgagagcgaaccagaatgttgtctagcggcaagacaagaagggacgctgggcgactcagcctgcaaaagccccgaatctgacctagaggacttttcagatgagactaacacggaaaacctatacggtaccagccccccaagcacccccagacaaatgaaaagaatgtccaccaaacaccagcgcaacaacgtgggtcggcctgcctccaggagtaatttgaagggagtgcgacagatttcccacgctgtgagcagctctctcaactag

SEQ ID NO: 195572 - DNA, 1866 bp, Artificial Sequence
  Description of Artificial Sequence: Synthetic coding sequence
atggagcaggtgcccggcggcagcctgagcgccctgctgcggagcaagtggggcccccttaaagataatgagcaaaccatcgggttttataccaagcagatcctggagggcctgaaatacctgcatgataatcaaatcgtgcatagagacatcaaaggagacaatgtgcttatcaatacctatagcggggtgctgaagatctccgattttggcacttccaagaggctggctgggatcaacccctgcacggaaacctttaccggtacactgcaatacatggctccagagattatagacaaagggccaaggggctatgggaaggcggccgacatttggagtctgggctgcacaatcatcgagatggctactgggaagccgcccttctacgagctgggagaaccgcaggcagctatgttcaaggtgggaatgttcaaagtgcaccccgaaattccagaatcaatgtccgctgaagcgaaagcctttatactgaagtgcttcgagccagaccccgataaacgcgcttgtgctaacgatttgctcgtggacgaattcctcaaagtgtcgtctaagaaaaagaaaactcagccgaagttgagcgccctgagtgctggcagcaacgaatatttaagaagcatatcactgcccgtccctgttctggtggaagacacgagcagttcttccgagtatggatctgtgtctcccgacactgagcttaaagtggatccattctcttttaagacaagggctaagtcctgcggggaaagagacgttaagggcatccgtacgctgtttctcggcatccccgatgagaactttgaggaccattccgcgccgccttccccagaggagaaagattcaggattcttcatgctgaggaaagatagcgagaggcgtgcgaccctccatcgcattcttaccgaggaccaggataagatcgttaggaacctcatggaatcccttgcccaaggcgcagaagagcctaaacttaagtgggagcacatcaccacactgatcgcctccctaagagagttcgtgcgctctactgatcgtaaaatcattgccactacactttcaaagctaaagctggagttagacttcgattctcatggaatttctcaggtgcaagtagttcttttcggattccaggacgcagtaaataaagtgctacggaatcacaatattaagccgcactggatgtttgccctggattccattatccgtaaagccgtgcagacggcaataactatactggtgcccgagctccgacctcacttctcgttggcttctgaatccgacaccgccgatcaggaggacctcgatgtggaagacgatcacgaggaacaaccatccaaccaaaccgtgaggagaccccaggctgtcatagaggacgcagtcgccacaagcggagtctcaaccttgtccagcaccgtttcccacgacagccagtccgcgcaccgaagccttaatgtccagctgggtaggatgaagattgagactaacaggctgttggaggagttggtgcgtaaagagaaagagctacaggctctcctgcatcgcgctatcgaggaaaaagatcaagaaatcaagcacctcaaactgaagtcccagcccatcgagatcccagagctccccgtgtttcacctcaacagctctgggaccaatacggaggacagcgagttgaccgattggctgcgcgtaaatggtgccgacgaggacacaatttctaggttcctcgccgaggactatacgctgctggatgttctctattatgtcactagggatgacctgaagtgcctgaggctcagagggggaatgctctgtaccctgtggaaggcaataattgactttcgaaataagcagacttag

SEQ ID NO: 195573 - DNA, 4125 bp, Artificial Sequence
  Description of Artificial Sequence: Synthetic coding sequence
atgagcaccgaggccgacgagggcatcaccttcagcgtgcccccctttgcccccagcggcttctgtactatccccgaggggggcatctgtagacgcgggggtgctgccgcagttggtgagggtgaggaacaccagcttcccccaccacccccaggaagcttctggaacgtcgagagtgccgcggcaccaggcattgggtgtcccgctgcgacctcttcctctagcgcaacgcgtggacggggatctagcgtggggggggggtcccggaggaccaccgttgcttacgtgatcaacgaagcttctcaggggcagttggtggtggccgagagtgaggctctccaatcactgagagaggcttgcgagacagtaggagcgacattagaaactctgcacttcggcaaactggacttcggggagaccaccgtgctcgataggttttataatgcggacattgctgtggtggagatgtcagatgcgtttagacagccatcattattctaccatctgggcgttcgggaatctttcagcatggccaacaatatcatcctgtactgcgatactaactccgattcgctgcagtccttaaaggaaatcatctgccaaaagaacactatgtgtactggtaattatacattcgtaccgtacatgataacaccacacaacaaggtttactgctgtgatagtagcttcatgaaaggattgaccgagttgatgcagcctaattttgagttgctcctgggtcctatctgcctgccccttgttgacagattcattcagctgttgaaggtcgcccaagcgtcctcctcccagtatttccgagagtctatcctcaatgatatacgcaaagcacgcaacctctatactggaaaggagctggccgctgagctggcacgtattcggcagcgtgttgacaatattgaggttctcacagccgatattgttattaacctgcttctgagctatagggatattcaagactacgactcgattgtgaaactggttgagacactagagaaactgcccactttcgacctggcgagccatcaccacgtcaagtttcattatgcctttgccctgaacagacggaatttgcccggggaccgtgcaaaagccttggatattatgattcccatggttcagagtgagggtcaggtagccagcgacatgtactgtcttgtggggagaatctacaaggacatgttccttgattctaactttaccgacaccgagagcagggaccacggtgcttcctggttcaaaaaagccttcgaatctgagccaaccctgcagagtggcattaactatgccgtgctactcctagccgctggccaccagttcgaatcctcgttcgagctgaggaaagtgggtgtgaagcttagctctttgttgggtaaaaaaggaaatcttgaaaaattgcagagctactgggaggtaggattttttctgggagcctctgttctggcaaatgaccacatgagagtgattcaggcaagtgagaagttgtttaaactcaagacccctgcctggtatcttaaatccatagtagagaccattctgatttataagcacttcgtgaagctcactacagagcagccagtagccaagcaagagttagtggatttctggatggattttctcgtggaagccactaagaccgatgtaacagtggtccgctttcctgtactaatccttgagcccactaaaatttaccagcccagctacttatctattaataacgaggtggaggaaaagaccatctctatctggcacgtgcttccagatgacaagaaagggatacatgagtggaatttctcagcctctagcgttcgcggcgtgtccatcagtaagtttgaagaacggtgttgctttctgtatgtactacacaacagtgacgattttcagatttatttctgcacagagttgcattgcaaaaaattcttcgagatggtgaacaccattaccgaggaaaaggggcgctctaccgaagaaggcgactgtgaatcagatttgctggagtatgactacgagtacgacgagaatggcgaccgagttgtcttaggaaagggcacgtacggcatcgtctacgcaggccgcgatctgagcaaccaggttaggatcgctataaaagaaatcccagagagagacagtagatacagccagccgctgcacgaggagatcgcactccacaaacacctgaaacacaagaatattgtccagtatttaggcagcttttccgagaatggctttatcaaaatcttcatggaacaagtcccagggggcagtttgagtgcactcctccggagcaagtggggccctcttaaagacaacgagcagacaataggattctacacaaaacaaatccttgagggcttgaaatacttgcatgataatcagattgtccaccgtgacattaaaggcgataacgtgcttattaacacatattctggggttctgaaaatcagtgatttcggaaccagcaaacgcctggccggtatcaacccctgcaccgagacgttcacaggcacacttcagtacatggcaccggaaattatcgataagggtccacgagggtatggcaaggcggcggatatttggtcattggggtgtaccatcattgagatggcgacagggaaaccgcctttttacgagctgggagagccacaagcggctatgttcaaggtgggaatgttcaaggtccatcccgagatccctgaaagcatgagcgctgaggccaaagcctttatcctgaaatgctttgagcccgacccagacaagcgggcttgcgccaacgacctccttgttgatgagtttcttaaggtatcctctaaaaaaaagaagacgcagcccaaactcagcgcgttatcagctggatccaacgagtacctgcgctctattagtttacccgtgccggtcctggtggaagatacgtcatcgagcagcgaatacggatccgtttcccctgacactgaactgaaggtggaccccttttcattcaagacccgcgctaagagctgcggcgaacgggacgtcaagggcatacggaccctgttcctgggtatacctgacgagaattttgaagatcactctgcccctccgtcacccgaagagaaggatagcgggttctttatgttgcggaaagattcagagagacgtgcaaccctgcatcgcattctcacagaggaccaggataagatcgtgaggaaccttatggagagtctggcccagggagctgaagaacccaaacttaaatgggaacacattactacacttatcgcaagccttagggagttcgtgcgctccacagaccggaagattatagctaccactctctccaaattgaagctggagcttgattttgatagccacggcatctctcaggttcaggttgttctattcggattccaggacgccgtcaacaaggtgttgcggaatcacaacataaaacctcactggatgtttgccctcgatagcattattagaaaggcagtgcagaccgctatcacaattctggtgccggaattgagaccacattttagcctggcatctgaatctgataccgcagatcaggaggacctggatgtggaggacgatcacgaagaacaaccatctaaccagaccgtccggcgtccgcaggccgtgattgaggatgctgtggccaccagtggtgtgtcaactctgagttccacggtctcccacgattctcagtccgcccatcggagcctcaatgtccaactcgggcggatgaagattgaaacaaacagactcctggaagagctggttcggaaggagaaggaactgcaggcactgttgcaccgggcgattgaagaaaaagaccaagaaatcaaacacctcaagttgaagtctcaaccaattgagatcccagagcttcccgtcttccacctcaattcatcaggcacaaacactgaagactctgaactcactgattggctgagagttaatggagctgacgaggacacaatcagccggtttctggcagaggattatacactcctggatgtactgtactatgtgacccgggatgaccttaaatgtctaaggcttagaggcggaatgctctgcactctgtggaaggcaatcattgatttccgtaacaagcagacttag

SEQ ID NO: 195574 - DNA, 3771 bp, Artificial Sequence
  Description of Artificial Sequence: Synthetic coding sequence
accctgcagcgggccagcggcgccgccaccgaggccccccggcggagtgaacctccccctggcagcggtgtgccctcaggtgagcgcgctccagaacggagacggcggcggggcggagaaggcgccgcccgtgatggatcatgcctcgcccgtcgcgcgcgatcaagcccagaactgtggctggccagaaggtgcggctgggctggcgatgccgcagcggtcgctgcgcgacctggagagatgagcacagaggctgacgagggcatcacattttccgtgcctccatttgctcccagtgggttttgtaccattcccgagggcggcatctgtcgacgcggtggggcagcagctgtgggggagggggaggaacatcagctgcccccaccgccaccgggtagtttctggaatgtggaaagcgccgctgctccaggcatcgggtgccctgcagctacctcaagctcttccgcgactagggggagaggttcttcagtgggcggcggatccaggcgtacaacagtggcctacgttattaacgaggcatcccagggccaactcgtggtcgctgaatccgaggctctgcagagcctccgagaggcctgcgagaccgttggcgctacactcgagacgctccatttcggcaagttagatttcggggagactactgtgctcgataggttttacaacgccgacatcgctgtcgtggagatgtctgacgccttccggcagccctcactgttctatcacctgggcgtacgggagtccttttcaatggctaataatattatcctgtattgcgatactaactccgactccctgcaaagtctcaaagagatcatctgccaaaagaacacaatgtgcacaggcaattatacgtttgtgccttatatgataactccacacaataaagtgtattgctgcgacagtagctttatgaaagggctcacagagctgatgcaaccaaactttgagctgctgctgggccccatatgcttaccgcttgttgacaggtttatccagctgttgaaagtggcgcaagcctcatcaagtcagtacttccgtgagagcattctcaacgatatccgaaaggcacggaacctgtataccgggaaggaacttgcggcggagcttgccaggatccgacaaagagtcgataacattgaggtgctcacagccgacatcgtgattaatttgctgctgtcttatagggacattcaggattatgactctattgtgaaattagtcgaaacattagaaaaactgcctactttcgacctggcgtcccaccatcacgtcaagttccattacgctttcgctctcaatcgcagaaatctgcccggggatagagccaaggcattggatataatgattccaatggtgcagtcagagggccaagttgccagcgacatgtattgcttggtgggcagaatctataaagatatgttccttgactcaaactttacagataccgagtctcgtgatcacggggcgtcctggttcaagaaagcatttgagtcagagcccaccttgcagtcaggcattaattacgctgtactcctcctggccgcaggacaccaatttgaatcgagctttgagttgagaaaagttggagtgaagctctctagcctgctaggcaagaagggaaatttggaaaagttgcagtcatattgggaggttggattttttttgggtgctagcgtacttgctaacgaccacatgagggtgattcaggcctcagaaaagctgtttaaacttaaaactcccgcttggtatctgaaaagtattgtcgagaccatcctgatctacaagcatttcgtgaagctcaccaccgagcagccagtggccaagcaggagcttgtcgatttttggatggattttctcgttgaggccaccaagacagacgtgaccgtggttagattccccgttcttatcctcgagccaaccaagatctatcagccgagttacttgtctatcaataacgaagtggaggagaagactatctcaatttggcacgttttacctgacgacaagaagggaatccatgagtggaacttctctgccagttcggtcagaggagtttccatctccaagtttgaagagcgctgctgctttctgtatgtcctgcacaattctgacgacttccaaatatatttttgcaccgaactgcactgtaaaaagttcttcgaaatggtgaatactatcactgaggagaaaggaaggtccactgaggaaggcgactgcgaaagcgaccttctggaatatgactatgagtacgatgagaatggcgatcgggtagtcctgggtaaaggcacttatgggatcgtatacgcaggcagggatttatccaatcaggttcgtatcgccatcaaagaaatcccagagcgcgattcccgttattctcaacctttgcacgaagagatcgcgcttcataagcacctaaagcacaagaacatagtgcagtacttgggctcattttcagagaatggattcataaaaatttttatggagcaggttcccggcgggtccctgtccgccctgctgcggagcaaatggggtccgttgaaagataacgagcagacaattggcttctacacaaagcaaattctggagggattgaagtatcttcacgataaccagattgtgcaccgtgatattaagggcgacaatgtccttatcaacacttattcaggtgttctcaagatcagcgactttgggacctcgaagagactggccgggatcaatccctgcactgaaacctttaccggaaccctacagtacatggcaccagagattattgacaaaggcccgagaggctatggtaaagccgccgacatctggagcttggggtgcactattatcgaaatggccacgggcaagccacccttttatgagcttggtgaaccccaggcagcgatgttcaaggtgggcatgtttaaggtgcacccagagattcctgaatcaatgtctgccgaggctaaggccttcattttaaaatgcttcgagccggacccagataagcgcgcttgcgctaacgacctgctagtggatgagtttttgaaggtcagctctaaaaaaaagaagacacagcccaagcttagtgacttatccatagctcaggcggagtatttgaggagcatatccttgccggtgcccgtgctcgttgaggatacctcctcctcaagtgagtatgggtccgtctcacctgatactgagctgaaggtggatcctttttctttcaagactagggccaaatcgtgcggcgaacgcgacgtgaaaggcatacgtactttattcctgggtatacccgacgagaacttcgaggaccacagcgcccccccgagccccgaggagaaggactccggtttttttatgctgaggaaagattctgaacgccgagccaccctccaccgaatcctgaccgaggatcaggataagattgtaagaaatctcatggagagcttggcacagggcgccgaggagcccaagttaaagtgggaacacattactacactgatagcctctctaagggagttcgtccgttccactgaccgtaagattatcgccaccactctgagtaagcttaagttggagctcgacttcgacagtcacgggatttctcaggtacaggtggttctgtttgggttccaggacgcagtcaacaaggtactacgcaatcacaacataaagccccattggatgttcgccctcgattctataatcagaaaggctgtacagacagctattactatcttggtccccggcatcaaaccatag

SEQ ID NO: 195575 - DNA, 3867 bp, Artificial Sequence
  Description of Artificial Sequence: Synthetic coding sequence
atggccggcccctgcccccggagcggcgccgagcgggccggcagctgttggcaggacccacttgcagttgctcttagtcgcggtcgacagctggccgctcccccaggcaggggatgcgccaggagccgcccactgtccgtggtttatgtcctgaccagggagccacagccaggactggagcccagggagggtaccgaggctgagccattgccactcagatgtctcagagaggcctgtgcccaggtgccccgcccaaggcctccaccgcaactgcgcagcctgccgtttggtactttggagctcggtgataccgccgcattggatgcattctataacgcagacgtggtggtcttggaggtgagcagttccctggtccagccttccctgttttatcacctgggagtgcgggaaagtttttccatgaccaataacgtgctactttgtagccaggcggacttgccggaccttcaggccctaagagaggacgtattccagaagaattccgattgcgtgggctcatacactttgatcccttatgtggtcactgctaccgggcgcgttctgtgcggcgacgcgggacttctgaggggattagcagatggccttgttcaagccggggtcggtaccgaagctctcttgaccccgctcgtggggcgccttgcccgactgctggaagccactcccactgactcttgtgggtattttagggagaccatacggagggatattcgccaggcccgggaacggttttcggggcctcagctccgccaggagctcgcacgcctgcagagacgcctggatagcgtagaattgttatctccagatatcatcatgaacctgctgctgtcgtaccgcgacgtccaggattattcagctatcatcgagcttgtggagacactgcaggcacttcctacctgcgatgtggcagaacagcataacgtatgcttccactacacctttgctctcaatcggaggaaccgacccggggaccgagcaaaagctctgagcgtcctgctccccctcgtccagctggagggcagcgtcgcaccagacctgtactgtatgtgtggcagaatatataaggatatgtttttctcctctgggtttcaggatgcagggcacagagaacaggcctatcattggtatagaaaggcctttgatgttgaaccatccttgcacagcggcatcaacgccgctgtgctgctgatcgcagcaggccaacacttcgaagattccaaggaactcaggctgattggaatgaaactgggatgtctcctggccagaaagggatgtgttgagaagatgcaatactattgggatgtgggcttctacctgggcgcccagatcctcgccaacgacccgacacaggtggttctggctgctgaacagctttacaaactgaacgctccaatttggtatttggtgagcgtgatggaaactttcctactctaccagcacttccgtccgaccccagagcctccaggtggacctccgagacgagcccatttttggcttcactttctcctgcagtcttgtcagccatttaagacagcgtgcgcccagggagatcagtgtctggttcttgttctggaaatgaacaaagtgcttctgcctgcgaagctggaagtgaggggcaccgacccagtttctaccgttacattaagtctgctggagccagagacgcaagacataccgtcctcctggactttccccgtggcgagtatttgcggcgtgtcagcttcgaagcgtgacgagcgatgttgctttctgtacgccttgccgcctgcccaggacgtgcagctctgttttccttcagtgggccattgccagtggttctgcggattgatacaagcctgggtcacaaacccagactcgaccgccccagctgaagaggccgagggagcaggggagatgctggagtttgattatgagtataccgagaccggcgaaaggctggtcttgggtaaggggacatacggggtagtatatgctggaagagatcgacacacaagggtaagaatcgccatcaaggagatccctgaacgggatagccgctttagtcagccactgcacgaggagatcgcccttcatcgtagactgagacataagaatattgtgcggtatttaggcagcgcgtcccagggcggctatctaaagatttttatggaggaggtgcccggcggatcattaagcagtctattaagatcagtttggggtcctttgaaagacaatgagtccaccattagtttctacacacgccagatcctccagggtctgggatacctgcatgacaaccacatcgttcacagagatattaagggggacaacgttctcattaatacctttagcggcctgttgaagatatcagactttggaacctccaagcggctagcaggtataacaccttgcacagagacgtttactggcactcttcagtatatggcaccggagatcattgatcagggaccccggggatacggcaaagccgccgatatctggtctcttggatgcaccgttatcgaaatggccaccggccgcccgccatttcatgaactcggttctccacaggctgcaatgtttcaggtgggtatgtataaagtgcacccgcccatgcctagctctctgtctgcagaggcccaagcatttcttctgaggacgtttgaaccagatcccagactccgggcttctgcacagacattgctcggcgatccattcctacaacccggcaaacgctctcgttcgcccagctcccctcggcacgctccaagaccgtccgatgctccctccgccagtccgacaccttcagccaatagtactacccagagtcagacctttccttgcccacaggcaccttcccaacatcccccgtcaccgcctaagcgatgtctaagttacggcggcacttcccaattgagagtgccagaagagccggctgctgaagagcctgctagcccggaagaatcaagtggcctctctttgttgcatcaggaatccaaaagaagagcgatgctggctgccgtcttggagcaggagctccccgccctcgccgagaacctgcaccaggagcagaagcaggagcagggagctaggctggggcggaatcacgtggaggagttgctgcgctgtttgggcgcccacattcatacccccaatcggagacagctggcacaagaactgagagcactgcagggccggctcagggcacagggtctgggacccgctctcttgcaccggcctctgtttgccttcccagatgcagttaagcagattcttagaaagaggcagatccgcccccattggatgttcgtgctagattcgttactgagccgggcagtgcgcgctgccctaggggtgctggggcccgaagtcgaaaaggaagccgtgagccctcgaagcgaagagctgtcaaatgagggcgattcccagcagagtcctggacaacagtctcctctgcctgtggaacccgagcagggccccgccccactaatggtccagttgtctttactccgtgccgaaacagaccggttgagggaaatcctagccggcaaggagcgagagtaccaagcacttgttcaaagagcactgcagcgactgaatgaggaagccagaacatacgtgctggctcctgaaccgcccacagcgctcagcacagatcaaggcttggtgcagtggctgcaagagttaaacgtcgattcagggacgattcagatgctcctgaatcatagcttcacgcttcacaccctgctgacctacgccactcgggacgatctgatatacactcgtataagaggagggatggtttgccgtatctggcgagccatcctggcccagcgggctggcagtacgcctgtgactagcggcccatag

SEQ ID NO: 195576 - DNA, 315 bp, Artificial Sequence
  Description of Artificial Sequence: Synthetic coding sequence
atggtgcagctgagcctgctgcgggccgagaccgaccggctgcgggagatcctggcaggcaaagagagggagtatcaggctctggttcagcgagctcttcagcgactgaacgaggaagcaagaacatatgtgttggcacctgaacctcccactgccttatcgactgatcagggtctggttcagtggttgcaggagttgaatgtggactctggcacgatccagatggggagagacggcatgccccatttggaagggcacctcggtaccgccagccgcatacacacaagccacctgtggaccctgagggctgaatag

SEQ ID NO: 195577 - DNA, 3843 bp, Artificial Sequence
  Description of Artificial Sequence: Synthetic coding sequence
atggccggcccctgcccccggagcggcgccgagcgggccggcagctgttggcaggatccattagctgtggcactgtcccgaggaaggcaactggcggccccacccggcagaggatgcgcacgaagcaggccattatctgtggtctatgtgcttacacgcgagccgcagccaggcctggaaccacgtgaaggaacagaggctgagccgctgccactgaggtgtctcagggaagcatgtgcgcaggttcctcgcccaagaccccccccccagttgcggagtctcccttttgggaccctcgagctcggcgatactgccgcgttagatgccttctacaatgccgatgttgtcgtgcttgaagttagcagctccctagtacagcctagcttgttctaccacctgggggtgagggagtcattctctatgactaataacgtacttttgtgctcacaagccgaccttcctgacctgcaggcccttcgcgactgcgtgggcagctatactctgataccatacgtggtcactgcaactggtcgcgtgttgtgtggagatgctggtctactccgcggcctggctgatggcctggtccaagctggtgtgggaaccgaagccctgctgaccccattggtcgggaggttggctaggctgctagaggctactccaacggactcatgtgggtatttccgagagacaatccggagggacatccgacaggccagggaacgtttttcaggaccacagctgaggcaagagctggcccgcctgcagagacgactcgattcagtagagctgctgagccccgatatcataatgaaccttctgctgtcttaccgtgatgtgcaagactattctgcgattattgagctggtggagactctccaggccctccccacctgtgacgtggccgagcagcacaacgtgtgttttcactacacattcgcactgaatcgcagaaatcgacctggtgaccgcgcaaaggctctctcggtgctactccccctcgtccaactggaaggatctgttgcgcctgacttatattgcatgtgtggccgcatttataaggatatgtttttctctagtggattccaggacgctggtcatagagaacaggcttaccattggtacagaaaggccttcgatgtggagccctcactacacagtgggataaacgccgccgtgctgcttattgctgcaggtcagcatttcgaagattcgaaagaattacgcttgatcgggatgaagcttggctgcttactggcccgcaaggggtgcgttgagaagatgcaatattattgggatgtgggattttacttaggcgctcagattctcgcaaatgaccctacgcaggtggtcctggccgccgaacaactctataagcttaacgccccgatttggtatctggtgagcgtcatggaaaccttcctactgtaccagcacttcagacccacccctgaacccccaggggggcctcccaggagggcccatttctggttacatttcctgctgcagagctgccagccattcaaaaccgcatgcgctcaaggggatcaatgcctggtgctcgtgctggagatgaacaaggtcctgcttcccgccaagctggaggtgcgaggcaccgatcccgtgtcgacagttaccctctctctcttggaacccgagacccaggacattccctcctcttggacctttcccgtggccagtatatgcggtgttagtgctagtaagagggatgagcgttgttgctttctttacgccctccccccagctcaggacgtccagctatgttttcccagtgttggtcactgccagtggttttgcgggttaatccaggcgtgggtgacaaaccccgatagcactgctcccgccgaggaggccgagggagctggcgagatgctcgaatttgattacgagtacaccgagaccggcgaaaggctggttctgggtaagggaacatatggagtggtttatgccggaagagaccgccacacaagagttcgcatcgccataaaagagattcccgagcgcgactcccgcttttcacagccgctgcacgaagaaatcgctctccacagacgactgcggcataaaaacatagtgcgatatctcggctccgcttctcagggcggctatctgaagatcttcatggaagaagtccccggcggtagtctctcatctttgctccgcagcgtgtggggccctcttaaagataatgagtcgaccatttctttctatacaaggcaaatccttcaggggttgggctatttacacgacaatcatattgtgcatcgagacatcaagggcgataacgtactgatcaacacctttagcggcctattgaagatctcagatttcgggacaagcaaacggctggccggaattactccttgtaccgaaacctttactggtacactacaatatatggcaccagaaatcatcgaccaaggcccacgcggctacgggaaggctgctgatatttggtcgctgggttgcacggtgatagagatggctaccggtagacccccctttcacgagctgggcagcccgcaggctgccatgttccaggttggcatgtataaggttcacccgccaatgcctagctccctctctgccgaagcccaggcctttttgctgcgaacattcgagccagaccccagactgagagcctctgcgcaaactctcttgggcgatccattcttacaacccgggaaaaggtcacgtagcccctctagcccccgccatgcccccaggccgagtgacgccccatccgctagtcctaccccctctgccaacagcaccacccaatcccagacctttccatgcccccaggcgccctctcagcacccaccaagcccgccgaaacgatgcctatcttatggtggcaccagtcaactgcgcgtccctgaggaaccagccgctgaagagcccgcttcaccggaagaatctagcggcttaagcctgttgcatcaagagagcaagcggcgagcaatgcttgccgccgttctcgaacaggagctgccagccctcgccgagaatctccatcaggagcagaaacaagaacagggagccagactcgggcgcaaccatgtggaggaattactacgttgcctgggtgcacatatccacactcccaacaggaggcagctggcacaggaactccgcgcactacaagggaggcttagagctcagggcttgggtccagcccttctgcaccgcccgctcttcgcgttccctgacgctgttaaacagattctcagaaaacgacagattaggcctcactggatgttcgtgctggacagcctgctgagcagggcggttcgcgctgccctgggcgtgcttggaccagaggtggagaaggaagctgtgagtccccgatctgaggagctgagtaacgaaggggattcccagcagtctcccgggcagcaaagtcccctgccagtagaacctgaacaaggcccggccccattgatggtgcagctgagcttgcttagggcggagacggaccgattaagggagatacttgccggcaaggaacgggagtaccaggcgctcgtgcaacgagcccttcagagattaaatgaggaggcccgtacctacgtgctcgcacctgagccaccaacggccctatcaaccgaccagggcttggtccagtggttacaggagttgaatgtagactccggaactatccagatgctcctcaaccatagctttactttacacaccctactaacatatgctacacgtgacgaccttatttacacacgaatcagaggtggaatggtgtgtcgcatttggagggcgatcctggcccagcgtgccgggagtactccagtgacctccggaccttag

SEQ ID NO: 195578 - DNA, 2397 bp, Artificial Sequence
  Description of Artificial Sequence: Synthetic coding sequence
tgaatgaacctgctgctgagctaccgggacgtgcaggactacagcgccattatagagcttgtggagacactgcaggcactccctacctgcgatgttgccgagcagcataacgtctgcttccattacactttcgcactcaacaggaggaatcgtcctggcgaccgagctaaggcactgtccgtgctgctacctctggtgcagttggaaggttctgtggcacccgatttgtactgtatgtgcggaaggatttataaagacatgtttttttcgtccggcttccaggacgctggacacagggaacaagcataccactggtatagaaaggcattcgatgtggagccttctcttcatagcgggatcaacgctgctgtgcttctgatcgcagcagggcagcactttgaagatagcaaagagctgcggttaataggaatgaagttgggatgcctcctggcgcgaaagggatgcgtggaaaagatgcaatattactgggacgttgggttctatctgggagctcagattctcgctaacgaccctacccaagtggtgctcgctgcagagcaactatataagctgaatgcgcctatatggtacttggtgagtgtgatggagaccttcctgctctatcaacactttaggccgactcccgaacctccaggcggcccaccacgacgcgctcatttttggcttcatttcctgctgcaaagctgtcagccttttaagactgcgtgcgcccagggcgaccagtgtctcgtgctcgtgctggaaatgaataaggtgctcctccctgcaaagttagaggtgcgaggtacagatccagtatcaacagtgaccctgagtctccttgagcctgagacacaagacataccctcaagttggactttccctgttgcatccatatgcggagtcagcgccagcaaacgcgacgaacggtgttgtttcctgtacgctctaccccccgcgcaggatgtgcagctctgttttccgtcagtcgggcattgccagtggttctgcggtctgatccaagcttgggttactaatccggattcgacagccccagctgaagaggccgaaggcgctggcgagatgctcgagtttgactacgaatacacagagaccggcgaacgcctagtgcttggcaaaggcacctatggggtggtgtacgctggtcgagacaggcatacacgagtgcggatcgctatcaaagagattcccgagcgggactctaggttctctcagcctctgcacgaggagatcgccctgcatcgaagactgaggcataagaatattgtgcgctatctgggcagcgcctctcaaggaggttacctcaagatcttcatggaagaggtgcctggaggatccctcagcagcctgttgcgtagcgtatggggccccctcaaggacaatgaatcaactatttccttttacacccgtcagattctccaggggttaggctatctgcatgacaatcacattgttcaccgagacattaagggagacaatgtcttgataaacacattctccggcctactaaagatcagtgatttcgggacttccaaaaggctcgccggcattactccctgtactgaaacattcacagggacacttcaatatatggctccagagatcattgatcaggggcctcgagggtacggaaaagccgctgacatctggtctcttgggtgcacagtaattgagatggcaactggtcggcccccatttcatgagctcggctccccacaggcagccatgtttcaggttgggatgtacaaagttcaccctccaatgcctagcagtctgagcgcagaagctcaggcctttttactcagaactttcgagcccgacccgagactgcgcgcctccgctcagactttgctgggggacccatttctgcagccaggcaagcggagcaggagtccctcatctcctcgccacgctccacgccctagcgacgctccttctgccagtcccaccccctctgcgaactctacaacgcagtcacagacttttccctgtcctcaggcaccttcccagcaccctcctagcccacctaagcgatgcctttcctatggaggcacatcacagctcagagtacctgaggagccagccgccgaggaaccagcctctcccgaagaatcttcggggctgtcgctgctgcaccaggagagcaagcgtcgcgctatgttggctgcagtgctcgaacaagagctgccagccctggcggagaacctgcatcaagaacagaagcaagaacagggggcacgcctaggcaggaaccacgttgaagagctgctacgatgcttaggagcacacatccatactcccaaccgccgccagctggcacaggaactgcgagcactgcagggatggatgaacggtgaggacaagggaagcttctag

SEQ ID NO: 195579 - DNA, 249 bp, Artificial Sequence
  Description of Artificial Sequence: Synthetic coding sequence
tgagagtaccaggccctggtgcagcgggccctgcagcggctgaacgaggaagcccgaacatatgtactcgcccccgagccgcctaccgccctttccacggatcaaggcttggtccagtggctgcaggagttaaatgtggactctggtaccatccagatgggaagagacggaatgcctcacctggaaggtcacctgggcactgcttccaggatccacacttcccacttatggactctgcgggccgaatag

SEQ ID NO: 195580 - DNA, 3867 bp, Artificial Sequence
  Description of Artificial Sequence: Synthetic coding sequence
atggccggcccctgcccccggagcggcgccgagcgggccggcagctgctggcaggaccctctcgcagtggctttgagccgcggccgccagttggccgcgccgccaggccggggatgcgcccggtcccggcccctttctgtcgtgtatgtcttaacacgagagcctcagcccggactggagcctagagaaggcacggaggccgagcctctgccgctgaggtgcctgagggaagcttgtgcacaggtgcccagaccgcgccctcccccccagctgcgttctctcccattcggcaccctggagctcggggacacagcagctctcgatgccttttataacgccgacgtagtggtcctcgaagtttcgtcctctctggtccagcctagccttttctaccaccttggcgttagagaaagttttagcatgaccaacaacgtccttctttgctctcaagctgacctccccgacttgcaggccctgcgtgaagacgtttttcagaaaaattctgactgtgttggctcatatacactgataccatatgtcgtgacagcaaccggacgggtgttgtgcggcgacgcgggcttgctgagaggtttggccgacgggctggtccaagcaggcgtgggcaccgaagccctgctcacccccctggtaggtcgcctcgccagattattggaagccacacctacggacagctgcggctattttcgggaaacgatcagacgagatatcaggcaggctagggagcgcttttcaggccctcagctgagacaggagctagctcgtctgcagagacgactggactctgtagagcttttgagccccgatataataatgaacttgctactctcctacagggacgtgcaagactattccgccatcatcgagttagtggagacactacaggctttgccaacttgcgacgtggctgagcagcataacgtgtgctttcattatacctttgctctgaatagacgaaatagacctggcgatcgtgccaaggccttgagcgtgcttctcccactggtgcagctggagggctcggtggcccccgacctttattgtatgtgcggtcgtatctacaaggacatgttcttctcttcagggttccaagacgccgggcatcgggagcaggcctaccactggtatcgcaaagcctttgacgtcgaacctagtcttcactcaggtattaatgccgccgtgctgctgatcgccgcagggcagcattttgaggattccaaggagttaagattgatcggcatgaagctcggctgtctgttggctaggaagggctgtgtcgaaaaaatgcagtattactgggatgtgggattttatctgggcgcccaaatactagccaatgatccaacacaagtggtgctcgccgctgaacagctctacaaactgaacgcccctatctggtacctggtttccgtgatggagacattcctcctgtaccagcatttcaggccaactcccgagccccctgggggaccgcccagaagggcccacttctggttacacttcctgttgcagtcttgtcaaccattcaagaccgcatgcgctcagggtgatcagtgcttagtgctggtgctggagatgaataaggttctgttaccagcgaaacttgaagtgagggggactgatccagtttccactgtgacactgtctctcctcgaaccagaaacacaagatattccgagttcctggacatttcctgtggcaagtatctgcggggtgtctgcctccaagcgcgacgaacggtgttgtttcctctatgcattaccgcctgctcaggacgtccaattatgttttccctctgtgggtcattgccagtggttttgcgggttaattcaggcgtgggtcactaacccagactctacagctcccgctgaagaggctgaaggcgccggggagatgttggagttcgactatgagtataccgaaactggggagcgactggtgctgggcaagggaacgtatggagttgtctatgcaggtagagacagacacacacgcgtgcgcatcgccatcaaagagattcctgaacgtgactcacgatttagccaacctctacatgaggagatagcgctccacaggcggttgcggcacaaaaatattgttagatacctggggtccgctagccagggggggtatcttaaaattttcatggaagaggtccctggagggagcctcagcagcctgctacggtctgtttggggtcccctgaaggacaatgagtccactattagcttctacactagacagatactacaggggcttggctaccttcacgacaatcatatcgtgcaccgcgacattaaaggggacaatgtcctgatcaataccttctcgggcctgttgaagatcagcgattttggtacatccaaaagactggcgggcatcaccccctgtactgagacttttaccggtactctccagtatatggcccccgagatcattgaccaaggacccaggggttatggcaaggccgcagacatatggagcttgggctgcacagtcattgagatggcaacgggccgtcccccctttcacgaactagggtcccctcaggcagccatgtttcaggtcgggatgtacaaggtccaccccccaatgccctcaagcctgtcagccgaagcgcaggcatttttgttgcgtacctttgagcccgacccaaggctcagggcttccgcacagactctcctaggagacccctttctgcaaccaggaaaacggtcacggtccccatcgtcccctaggcacgcgcctaggccgtcagacgctccatccgccagtccgacacccagtgcgaacagtacgacacaaagtcaaacatttccctgtcctcaggctccatcgcagcatcccccctcaccccctaagaggtgtctgagctacggcggcacaagccagctaagagtgcctgaagagcctgccgctgaggaacccgcgtccccggaggagagttctggcctgagccttttacaccaagagtctaaacggagggctatgctggccgccgtgttagagcaggagctcccagcgctggcagagaacctgcatcaggagcaaaagcaggaacagggagctcggctcggcagaaaccacgtggaagaattactgagatgcctcggagcccacattcataccccgaacagacgacagctggcccaagagctgagagcactgcagggacgcctccgcgcgcaggggcttggccctgcactcctgcataggcccctgtttgcattccctgatgccgttaaacaaatcttgaggaagagacagattagaccacattggatgttcgtcttggactcgttgctttcacgggccgtgagagcagcgctgggggtgctgggccctgaggtggagaaggaagcagtcagccccagaagcgaggagctgagcaacgaaggagattcgcagcagagcccagggcagcagagccctctgccggttgagccagaacaggggcccgctcccctcatggtgcaattatcacttctcagagcagagacagataggcttcgggaaatcctggccggtaaggagagggagtaccaggcactcgtacagcgagcactgcaacggctcaatgaggaagctcggacatatgttctcgcccccgagcccccgactgccctatctactgatcagggcctggtgcagtggctgcaggaacttaacgttgacagcggtactattcaaatgttgcttaatcactcctttacccttcacaccctgctaacatacgccaccagagacgatctcatttacactagaataaggggcggtatggtgtgtagaatctggagagccattttggcacagcgagccggctccacccccgtgacatccggtccgtag

SEQ ID NO: 195581 - DNA, 2394 bp, Artificial Sequence
  Description of Artificial Sequence: Synthetic coding sequence
atgaacctgctgctgagctaccgggacgtgcaggactacagcgccataattgagctcgtggaaacgctccaggcattgccaacttgcgacgtcgccgaacagcacaacgtttgtttccattatacattcgcgctgaacaggcggaaccgaccaggtgatcgggcgaaagcattaagtgttttactgcccctggtgcaactcgaggggtctgtagcacctgacttgtactgtatgtgtgggcgtatctacaaggacatgttctttagctctggattccaagacgcaggacatcgagagcaggcttatcactggtacagaaaagcttttgacgtagagcccagcctgcactccggaatcaatgcagccgtccttctgatcgctgctggacagcacttcgaagacagcaaggaactgagactcatcggcatgaagctcggctgtttgctggcaagaaaaggatgtgtcgagaagatgcaatattattgggatgtcggcttctacttgggtgcacagatcctcgccaacgatcccactcaggtggtgctggccgccgagcaattgtacaagctaaacgctccgatctggtacctcgtcagtgttatggagactttcctactgtaccagcatttcaggcccacacctgagccacccggggggccgccccgtcgcgcacacttctggctccattttctgctgcaatcttgtcagccattcaaaactgcttgtgctcaaggtgatcagtgtctcgtactggtactcgaaatgaacaaggtcctccttcctgcaaaattagaggtccggggtaccgaccccgtgagtaccgtgacactctccctgctggagccagagacacaagatatccctagctcatggaccttcccagtggccagcatatgcggcgtgtcagcatctaaaagagacgagcggtgttgcttcctgtatgctctcccacccgcccaagacgttcaattatgctttccttcagtaggacattgccagtggttttgtggactgatccaggcctgggtgacaaaccccgactcaaccgcgcctgctgaggaggcagagggtgccggcgaaatgctagagtttgactacgagtataccgaaacgggagagcggctagtcctcggcaaggggacatacggcgtggtgtacgctggaagagacagacacacccgcgtacggattgccatcaaggaaatccccgagagggacagtcggttctcacagccacttcacgaggaaatcgctctgcacaggaggttgagacacaagaatatagtgcggtacctcgggtcagctagccaaggaggctatttgaagattttcatggaagaagtgcctggtggaagcttatccagtcttctcagatcagtgtggggaccactgaaagacaatgaatcaacgatatcgttttacactcgacaaatactgcagggcctggggtacttgcatgacaaccacatcgttcaccgcgacatcaagggcgacaacgtgcttatcaacacattttccgggctccttaagatctctgactttggcacctctaaacggctcgccggcatcaccccctgcacagaaacttttactggaacactgcaatatatggcacccgaaatcatagaccagggccctcgaggatacgggaaagccgccgacatctggtcactgggatgtaccgtgatcgaaatggccacaggacgccctcccttccatgagctgggctcccctcaagcagccatgtttcaggtgggaatgtacaaagtacacccgccaatgccctcgtctctcagcgcggaagcccaagcctttttgcttagaacgtttgaaccggatccacggttgagggcttcagcccaaacactgcttggggatcctttcttgcagccaggaaagcgctcgcggtccccgtcttcgccacgacacgccccccgacccagcgatgccccttccgcttctccaacacccagcgcaaattctacaactcagagccagacgttcccatgcccacaggccccctcacagcaccctccttcacctcccaagaggtgcctgtcatatggaggcacatcacagctacgagttcctgaggagcccgccgccgaagagcccgcctcacctgaggaatcctctgggctgagcttactgcaccaagagagcaaacggagggctatgttagctgcggtgcttgagcaggaacttccagcattggctgaaaacctccaccaggaacagaaacaggagcagggagctcgcctgggccgcaatcacgtcgaggaacttttgcgatgtctcggcgcgcatattcacactccaaaccgccgacaattggctcaggagcttcgagcactccagggttggatgaacggagaagacaaggggtccttttag

SEQ ID NO: 195582 - DNA, 783 bp, Artificial Sequence
  Description of Artificial Sequence: Synthetic coding sequence
atggacatcgccagcaccaacaccagcaacaagagcgacaccaacatggagcaggtgcctgccaccaacgatactatcaaaagactggaatctaagctgttaaagaaccaggcaaagcaacagagtgaatccgggcgcctgagtttgggcgctagcaggggttcttccgttgagtctctcccccccacatccgaggggaaacgaatgtctgccgatatgtcagaaatcgaggccagaattgctgcaaccacagggaatggccagccacgccggagatcaattcaagatttaaccgtcaccggtaccgagcccgggcaggtctcgagtcgtagctcctcgcctagtgttaggatgatcaccacctccggacccaccagcgagaaaccaacccgctcacacccttggacccccgacgactccaccgacaccaatggctcagacaactcgatccctatggcctacctgacactggaccatcaattacagcccctggctccttgccctaactccaaggaatctatggccgttttcgagcagcactgcaaaatggcgcaggagtatatgaaggtacagactgaaatcgctctgctcctacagagaaagcaggaactggtagctgagttggaccaggatgagaaagaccagcagaatacctcccgccttgtgcaagaacataagaagctactcgacgaaaacaagtccctgagtacatattatcaacagtgcaagaagcagctggaggtcatacgctctcagcaacagaagcgccaaggaaccagttag

SEQ ID NO: 195583 - DNA, 1557 bp, Artificial Sequence
  Description of Artificial Sequence: Synthetic coding sequence
atgagcaccgccagcgccgccagcagcagcagcagcagcagcgccggggaaatgattgaagctccgagccaggtgttgaattttgaagagattgactataaggaaattgaagttgaagaagtggtgggaagaggcgcgtttggagtcgtctgcaaggccaaatggagggcaaaagacgtcgctatcaaacagatagaatccgaaagcgagagaaaggctttcatcgtggaactgcggcaactgtcccgggtaaatcaccccaacattgtaaagctgtacggggcttgcttgaaccctgtatgcctggttatggagtacgcagaaggaggcagcctgtacaatgtgctgcacggggcagaacctttaccctactataccgcagcccacgcgatgtcatggtgcctgcagtgttcccaaggtgttgcttacctgcactccatgcagccaaaggcccttatacacagagaccttaaacctcccaacttactcctggtggcgggcggcactgtgctgaagatttgcgactttggcaccgcatgtgacattcagacccacatgacaaataacaaggggtcagccgcgtggatggcacccgaggttttcgagggatctaattactccgaaaagtgtgatgtgttttcatgggggatcatactctgggaggtcattacccgaagaaaaccattcgacgagatcgggggcccagcattccgtatcatgtgggcagtgcataacggcaccagaccccccctgataaaaaatctgccaaaaccgattgaatctctgatgactcgttgttggagcaaggacccaagccaacgcccttccatggaggagatcgtgaaaattatgacgcacttgatgcgctacttccccggtgccgacgaaccactgcagtacccatgtcaatattcagacgaggggcagagcaactcagctacttccactggtagcttcatggatatcgcttctactaacacgtccaacaagagtgatactaacatggagcaggtgcccgctactaacgacacaatcaaacgcctggaaagtaaactgttgaagaaccaggccaaacagcagagcgaatctgggcggctcagtttaggagccagtcggggatcgtctgtggagagtctccccccgacttctgagggcaagaggatgagtgcagacatgagtgaaattgaagcacgtatcgccgcaactacagcatatagcaagccaaaacggggacaccggaagaccgcctccttcggcaacattctcgatgtccctgagattgtgattagtggtaacggacaacccagaagaagatccattcaggatttaaccgtgactggtacggagcctggccaggtgtcctctcggagctcatccccgtcagtgcggatgatcaccacatcaggacctactagcgaaaagccaactcgttctcatccttggacgccagacgacagcaccgatactaatggctctgacaacagcatcccaatggcttatctgactcttgatcatcagctccaggcacgcactagttgccggactggccctgggtag

SEQ ID NO: 195584 - DNA, 1476 bp, Artificial Sequence
  Description of Artificial Sequence: Synthetic coding sequence
atgagcaccgccagcgccgccagcagcagcagcagcagcagcgccggggagatgattgaggctccctcccaggttctgaactttgaagaaatcgactataaggagatcgaggttgaggaagtcgttggaaggggcgcgtttggagtggtgtgcaaggccaaatggagggcaaaggatgttgctattaagcagatcgagagcgagtccgagaggaaggcattcatcgtcgagctgaggcagcttagcagggtgaaccacccaaacatcgtgaagctttacggagcatgtctcaatcccgtatgcctggtcatggaatatgccgagggcggatccctgtacaatgtgctccacggagctgaaccgttgccatactacactgctgcgcacgctatgagttggtgtctgcagtgttcgcagggagtggcctacctgcactccatgcagccaaaggctttgattcacagagacctgaagccgcccaacttgctgctagtggccgggggaactgtgctgaaaatatgcgactttggcacggcctgtgatatccagacccacatgacaaacaataagggttcagcagcgtggatggctccggaagtgtttgagggatcaaactactctgaaaaatgcgatgtgtttagctggggcattatcctatgggaagttattaccaggcgtaaaccctttgatgaaattggcggaccggcttttcgaattatgtgggctgtccacaatggaacccgcccgccgctgatcaaaaaccttcccaaacctatcgaatctctcatgaccaggtgctggtctaaggacccatctcagagaccaagtatggaggagatcgtgaaaatcatgacacatctgatgaggtactttcccggcgctgacgaaccgcttcagtacccatgccagtactcagatgaagggcaatccaacagcgccacctcaacaggatcctttatggatatagccagcaccaatacttctaataaatcagacactaacatggagcaggttccagccacaaatgataccattaaacggttggagtccaagttgctgaagaaccaagcgaagcagcagtctgaaagcggcaggttgtcactaggggccagtagaggatcatctgtagaaagcctgcctccaactagcgaaggcaagagaatgtcagcagatatgagcgagatagaggcccgcatagctgctaccactggcaatggacagcccaggagaaggtccatccaggatctaactgttacaggaacggagccaggtcaggtctccagccggagctcatcccccagtgtaagaatgatcacaaccagcggaccaaccagtgagaagcccactagatcacatccttggaccccagacgattctacagatacaaatgggtcagacaattctattcctatggcatacctcaccttagatcaccaactgcaagcccggacaagctgcagaaccggtcctggctag

SEQ ID NO: 195585 - DNA, 1821 bp, Artificial Sequence
  Description of Artificial Sequence: Synthetic coding sequence
atgagcaccgccagcgccgccagcagcagcagcagcagcagcgccggtgagatgattgaggccccaagccaggtcctcaacttcgaagagatcgattataaagagatcgaggtggaagaagtggtgggcagaggcgcctttggtgtagtatgcaaggccaaatggcgcgccaaggacgtcgccatcaaacaaattgagtctgagtcagaacgtaaagctttcatagttgagttgagacaattatcaagagtgaatcatccgaacatagtcaagctttatggtgcctgtttgaaccccgtctgcctcgtgatggaatatgccgaagggggatcgctgtacaatgtcctacacggcgctgaacctctcccatattacactgcagcacatgccatgtcatggtgccttcagtgttctcagggggtggcctacttgcacagcatgcagccgaaggccttgatccaccgcgaccttaagcctcctaatcttctcctagtcgcagggggcacagtgctaaagatatgcgactttggaaccgcttgtgatatacaaacacatatgacgaataacaaaggatcagccgcatggatggcccctgaggtcttcgagggctctaactatagcgagaagtgcgacgtgttcagctggggaataatcctgtgggaggttatcactcgacgtaaaccctttgacgaaattggcggcccggcgtttaggatcatgtgggcagtgcataacggaaccagacccccgttgatcaaaaatttaccgaagcctatagaaagtttaatgacaagatgctggtccaaggacccaagccagagaccctcaatggaggaaatagtcaagatcatgactcatttgatgaggtactttcccggagccgacgagccccttcaatacccgtgccagtactccgatgaaggtcaatctaactccgccacatccactggctcctttatggatattgctagtacgaacacctctaataagagtgacaccaatatggaacaagtgcctgccacaaatgacactatcaaacgtctagaatctaagctgttgaagaaccaggcgaaacagcagtcggaaagcggtcgcctcagccttggtgcctccagagggtcatctgttgagagcctcccccctacctccgaggggaagcgaatgtccgccgacatgtcagagattgaggctagaattgcagctaccactgcatactctaaacccaagcgcgggcatcgcaaaacagccagtttcggcaacattctcgatgttcctgagattgtgatttctggcaatggacagccacgtaggcggagcattcaggatctgaccgtcacaggaacggaaccaggccaggtgagcagccgcagtagctcacccagcgtcagaatgattacaacatctgggcccacctcagaaaaacctacacgcagccatccatggaccccagatgattcgacagacactaatggctctgacaacagtatccccatggcttatctgacgctcgatcaccaacttcagcctcttgccccctgtccaaattctaaagagtccatggccgtgttcgagcagcactgcaagatggcacaggagtatatgaaagtacagaccgaaatcgccctgctccttcagaggaagcaggagttggtcgctgagctggaccaggatgagaaggatcagcagaatacctccaggctggtgcaggaacacaaaaaattgttggatgagaacaaatccctctccacttattatcagcagtgcaagaaacaactagaagtgatccggagccaacagcaaaagcgccaaggtacgagctag

SEQ ID NO: 195586 - DNA, 1740 bp, Artificial Sequence
  Description of Artificial Sequence: Synthetic coding sequence
atgagcaccgccagcgccgccagcagcagcagcagcagcagcgccggagagatgattgaggctcccagtcaggtgctgaacttcgaggaaatcgattataaagagattgaagtggaggaggttgtgggtagaggtgcctttggcgttgtgtgcaaggcgaaatggcgcgctaaggatgtggcaattaaacagatcgaatctgaaagcgagagaaaagccttcatcgtggaacttagacagttgagcagagtgaaccacccaaatattgtgaaattgtatggggcctgcctcaatcctgtgtgcctcgtgatggagtatgccgagggaggctcgctctacaatgtgctgcatggggccgaaccactgccctactataccgcagcccatgcgatgagctggtgcctgcagtgtagtcaaggcgttgcctacctgcactcgatgcaacctaaagctcttatccaccgcgatctgaagcctccaaacctcttactagtagcaggcggcactgtgttaaagatatgtgacttcggcaccgcctgcgacatccagactcatatgacaaacaataaggggtcagctgcatggatggcgccagaggttttcgaaggatctaattacagtgagaagtgtgacgtttttagctggggaattatcttgtgggaagtcatcaccaggaggaaacctttcgacgaaatcggggggccagcttttaggattatgtgggctgtgcataatgggacgcgtcccccactgataaaaaaccttccaaaaccaatcgaatcactcatgacaagatgttggtcaaaggatcccagtcaaagaccatctatggaagaaatcgtgaagataatgacgcatttgatgcgatacttccccggagctgatgagccccttcaatatccttgccaatactccgacgagggccagtccaactccgcaacatccaccggttcgttcatggatatcgctagcaccaatacctccaataaaagtgacaccaatatggagcaggttcctgcaacgaacgatacgattaagaggctggagagcaagctccttaagaatcaggcaaagcaacagtcggagtctggtcgcctgtctttgggggccagccgagggagctccgtggaaagcctcccacccacctctgagggaaagaggatgtctgccgacatgagcgaaattgaggcgagaatcgccgcaaccaccggtaacggccagcctcggcgacgcagcatacaggatctgaccgtaacgggcaccgagcccggccaggtgtcctctaggtcctcctcacctagcgtacgtatgataaccacctcaggccctacctccgaaaagccaactagatcccacccttggacaccggatgatagcacggatactaatgggtccgataacagtatccccatggcctatcttacccttgaccatcagctacagcctcttgccccctgtcccaacagcaaagaaagtatggctgttttcgagcagcactgcaaaatggcacaggaatatatgaaggtgcagactgaaatcgcgctgttgctgcagaggaagcaggaactggtggcagaactcgaccaggacgaaaaagaccagcagaatacctcaaggctagttcaggaacacaagaagctactcgatgagaataagtctctatcaacttattatcagcagtgtaaaaagcaactggaagtcatccgaagtcaacagcagaaacgacagggtacttcctag

SEQ ID NO: 195587 - DNA, 1257 bp, Artificial Sequence
  Description of Artificial Sequence: Synthetic coding sequence
atgagcaccgccagcgccgccagcagcagcagcagcagcagcgccggcgaaatgattgaagccccaagccaggtactgaacttcgaggagattgattacaaggaaatcgaagtcgaggaggtggtcggacggggtgccttcggcgtggtgtgcaaagccaagtggagggcaaaagatgtggccattaagcagatcgaatctgagtccgaacggaaggccttcatcgtcgaactgagacagctgtctagggtcaatcatcccaacctgctgctcgtcgccggcgggacagtgttaaagatttgcgatttcggcactgcatgtgacatacaaacccatatgaccaataacaagggttcagcggcgtggatggctcccgaggtattcgagggttctaactattctgagaagtgtgatgtattcagttggggtatcattctctgggaagtgatcactcgtcggaaacctttcgatgagatcggtggcccagcctttagaatcatgtgggctgtgcacaacggaactcgccccccccttattaaaaacttgccaaagcccatagagtccctgatgacaaggtgctggagtaaagatcctagccagcgaccaagcatggaagaaatcgttaagatcatgactcacctgatgcgatactttccaggcgctgatgaacctctgcagtacccatgccaatattccgatgaaggccagagcaattcagcaacaagcacaggcagcttcatggatattgcttcaaccaatacttccaataagagtgatacgaatatggagcaggtgccggctactaatgacactatcaagcgcctcgagagcaaattgctgaagaatcaagccaaacagcagagcgaatcaggtcgattgtctcttggggcctctcggggaagtagcgttgaaagtctgccgcccacatctgaagggaagagaatgagcgcagacatgagcgaaatcgaggctagaattgctgccacaactggtaacgggcagccacggcgcaggtcaattcaggatcttacagttacaggcaccgagccaggacaggtttcaagtagatcttcatctccctcagtgaggatgataaccacatctggacctacctctgaaaaaccaaccagatcccacccatggacccccgacgacagtacggacaccaacggctccgacaactccattcctatggcctacttaaccctggaccaccagctgcaggccaggactagctgccgaacaggacctgggtag

SEQ ID NO: 195588 - DNA, 1404 bp, Artificial Sequence
  Description of Artificial Sequence: Synthetic coding sequence
atggagtacatgagcaccggcagcgacaacaaggaggagatcgacctactcataaagcacttaaacgtgtctgatgtgatcgacataatggagaacctttacgctagcgaggagcctgccgtttacgaacccagcttgatgactatgtgccaggactcaaaccagaatgacgaaagaagcaagagccttctcctgtctggtcaagaggtgccatggctgagctccgttagatacggcacagtcgaggacttactcgccttcgcaaaccacatctcaaacactgcaaagcacttctacggccaacggccccaggaatctgggatcctgttgaatatggttatcaccccacagaacggcagataccagatagactccgatgtgctgctaatcccttggaagcttacatatagaaatatcggtagtgatttcatcccaagaggcgcatttggcaaagtgtacctcgctcaggatattaaaacgaagaaaaggatggcctgcaagttaatcccagtggaccaatttaaacccagtgatgtagaaatacaggcctgcttccgccatgaaaatatcgctgagctatatggcgcagtcctgtggggagaaacggtgcacttgtttatggaggccggagaaggggggagtgtactggagaagctagaaagctgcggccccatgagggagttcgagattatctgggtcactaagcatgtattgaaaggactcgactttcttcactcaaaaaaggtgatacaccacgatattaagccctctaatattgtgttcatgagcactaaggccgtcctggtggactttggtttgtcggtacagatgaccgaagacgtctattttcccaaggatttgcgcggcacagaaatctacatgtcgccagaggttatactgtgcagagggcactcaaccaaggctgacatctacagcctgggcgctactctcattcatatgcaaactggcacgcctccttgggtaaagcggtatcctcgctccgcatatccatcctatctttacatcatccataagcaagcccctcccctggaggatattgctgatgactgctcgcccgggatgcgagagctgattgaggcatctctcgaacgcaatcccaaccaccgccctcgggcagccgacctcttaaaacatgaggcacttaacccccctagggaggaccagcctcggtgtcagagtttggattccgcactgcttgagaggaagaggctcctgagccgcaaagaactcgaattgccagagaatatcgcagattcaagctgcaccggatccacagaggagtccgagatgctgaaaaggcagcgatccctgtatatagatctcggagcactggccggatattttaatcttgtgagaggtccacctacccttgagtacggatag

SEQ ID NO: 195589 - DNA, 1404 bp, Artificial Sequence
  Description of Artificial Sequence: Synthetic coding sequence
atggagtacatgagcaccggcagcgacaacaaggaggagatcgaccttctcattaagcatctcaatgtgtctgatgtcatagatatcatggagaatctctacgcctccgaagagccagccgtctatgagccaagcctgatgacaatgtgtcaagattctaaccaaaacgatgagcggagcaagtcgctgctgttgtcggggcaagaggtcccgtggttatccagtgtgaggtacggtacagtagaagatttgctcgcatttgcaaatcatattagcaacacagccaaacatttctatggccagcgccctcaggaatcgggaatccttctcaacatggtaattacaccccaaaatggtcgctatcagattgacagcgacgttctgcttatcccttggaagctgacctaccgaaatatcggatctgactttatacctcgaggggccttcggaaaagtatatctcgcacaggacatcaagactaagaagcggatggcttgtaaactcattccagtggatcagtttaagccatctgatgtggagattcaagcatgctttcgacacgaaaacatcgccgagttgtacggagctgttctgtggggtgaaaccgtgcacctattcatggaggcaggggaggggggctctgtgctggagaaactggagtcgtgtggcccaatgagagaattcgaaatcatttgggtgacgaagcatgtcctgaaggggctggattttctgcactctaaaaaggtcattcaccatgatatcaagccgagcaatatcgtctttatgagcaccaaagcagttttagtagactttggattgtcggtgcagatgacagaagacgtctactttcccaaggatctgcgaggcacggaaatttacatgtcccccgaggttatcctatgcaggggccacagtaccaaagcggatatctacagcctgggtgctactttgattcatatgcaaactggcacaccgccctgggttaagagatatccccgatccgcctaccctagctacctttacattatacacaaacaggccccacccctggaagacatcgccgacgattgtagccccgggatgcgcgagcttatcgaggcatcacttgagagaaacccaaaccatagacctcgcgcagccgacttgcttaagcacgaagccctgaacccaccccgagaggaccagccccggtgccagtcgctggactcggccttgctggaacggaagcgcttacttagtcgaaaagaactggaactgccagaaaatattgctgactcatcatgcacagggtcgacagaagaaagcgagatgctgaaaagacaacggtcactgtacatcgatttaggtgcgctagctggctacttcaaccttgttcgtggcccaccaacccttgagtatggttag

SEQ ID NO: 195590 - DNA, 399 bp, Artificial Sequence
  Description of Artificial Sequence: Synthetic coding sequence
atggagtacatgagcaccggcagcgacaacaaggaggagatcgaccttctgataaagcatttgaacgtgagcgacgtcatcgatataatggaaaatctgtacgcatccgaagaaccggcagtgtacgagccttcactgatgacaatgtgtcaggacagcaatcagaacgacgagaggagtaaatctctgctgctgtcaggacaggaggttccttggctgtcctcagtccggtacggtacagtggaagatctgctggctttcgcgaaccacatttcaaatacagctaagcacttctacggacaacggccacaggagtctggcatcctgctcaacatggtccgcttcttcccaatcagttgggtgttgtgtgcccagctgtcatattgttcgttcatatag

SEQ ID NO: 195591 - DNA, 1404 bp, Artificial Sequence
  Description of Artificial Sequence: Synthetic coding sequence
atggagtacatgagcaccggcagcgacaacaaggaggagatcgacctgctgatcaaacatctcaacgtgtcagacgtcatagacattatggagaatctgtatgccagcgaggagcctgccgtgtacgagccaagcttaatgaccatgtgtcaggatagcaatcagaacgatgagcggtccaaatcccttctgctctcaggccaggaggttccatggctgtcatctgtgagatacggcacagtcgaggacctcctggcctttgccaaccatatcagcaacacggcgaagcatttttacgggcagaggccccaggagtcaggcatcctcctgaacatggtaatcactccccagaacggcaggtaccaaatcgattctgacgtgttactcatcccatggaagcttacttaccgaaatataggcagcgatttcatacctcgcggcgccttcggtaaagtgtatcttgcacaagatatcaagacgaaaaagagaatggcctgtaaactgattccagtagatcaattcaagccgagtgacgtggagatccaggcatgctttaggcatgaaaacatcgcagagctctacggcgcagttttatggggtgagactgtgcacctctttatggaggctggagagggcggaagcgtgctggaaaagctggaatcgtgcggccccatgcgggagttcgaaatcatctgggtgacaaagcacgttctcaagggtcttgatttccttcatagcaaaaaggtgatccaccacgacattaagcccagcaatatcgtttttatgtctacaaaagccgttttggtcgacttcggtctgtcagtccagatgactgaggacgtttattttcctaaagacctgagaggcactgagatatacatgagcccagaagtaatcctgtgcagagggcattccaccaaggcagacatatattccctgggcgccactttaattcatatgcagacagggaccccgccatgggtcaagcggtatccgcggtcggcctatccgagctatctttacattatccataagcaggcgcccccattagaggatatcgccgatgactgcagccctggcatgcgcgaactgatcgaagcctccctcgaacgcaaccccaatcaccgtccccgtgctgctgacttgcttaagcacgaagccctgaaccccccacgggaagatcaacctcggtgccaaagcctggacagcgcccttttagaacggaaaaggctactttctcggaaggagcttgagctcccggagaatatcgccgactctagctgcactgggtcaactgaagagtccgaaatgctgaaacggcaaaggtccttatacatcgacctcggcgcactggcgggatatttcaacctggtgcgaggaccccccaccctggaatatggctag

SEQ ID NO: 195592 - DNA, 672 bp, Artificial Sequence
  Description of Artificial Sequence: Synthetic coding sequence
atggagtacatgagcaccggcagcgacaacaaggaggagatcgacttgctaatcaagcacctgaacgtgagcgatgttatcgatattatggagaatctgtatgcttctgaagaacccgctgtatacgaaccaagtttaatgacaatgtgtcaggactctaaccagaacgatgagaggagcaagtcgctgctgctgtcaggtcaggaagttccatggctcagtagtgtccgctatggaactgttgaggacttactggcatttgccaatcatattagcaatactgccaagcacttttacggtcaacggccccaggagtctggcatcttgctgaacatggtcattactccacagaatgggcgataccaaatcgattcggatgtactcctgattccttggaaacttacttaccggaacatcggtagcgatttcatccccaggggtgctttcggcaaggtttatctggctcaggacatcaagacgaaaaagagaatggcatgcaaactgattcctgtcgatcagttcaagccttcagatgtggagatacaggcctgttttaggcatgaaaacatcgctgagctgtacggagcagtgctgtggggcgagaccgttcacctgttcatggaggctggcgagggcggtagtgtcctggagaagttggagtcttgcgggtag

SEQ ID NO: 195593 - DNA, 768 bp, Artificial Sequence
  Description of Artificial Sequence: Synthetic coding sequence
atggagtacatgagcaccggcagcgacaacaaggaggagatcgaccttcttataaaacatcttaacgtctccgacgtgatagatataatggaaaatttgtatgcctctgaggaacccgctgtgtacgaaccttctctaatgactatgtgtcaggacagtaaccagaacgacgaaagatctaaaagtcttctactgagcgggcaggaggtcccctggctatctagcgtccggtatggaactgtggaggatctgttggccttcgccaatcacatttccaacacagcgaaacatttctacggccaacgtcctcaggagtccggaatcctgctaaacatggtgattacgcctcagaacggacgctatcagatcgactccgacgtactgttaatcccatggaaattaacttaccgtaatataggcagcgactttattccaaggggcgcttttggaaaagtctatctcgcacaggatatcaagacaaagaagcgcatggcctgtaaattgatccccgtcgaccagtttaaaccttccgatgtggaaatccaagcttgtttccgtcacgaaaacattgcagagctatatggggcagtgctgtggggagagactgtgcacctattcatggaggccggcgagggaggatctgtcttggagaagctcgagtcatgtgggcctatgcgcgagtttgaaatcatatgggttactaagcacgtcctcaaaggtttggactttctgcacagtaagaaagtgattcatcacgatatcaagtag

SEQ ID NO: 195594 - DNA, 573 bp, Artificial Sequence
  Description of Artificial Sequence: Synthetic coding sequence
tgagtggaggacctgctggccttcgccaaccacatcagcaacaccgcaaaacacttctatggacagagaccccaggagtccggcatcctgctaaacatggtcatcacacctcagaacggaaggtatcagattgattcagatgtgctgctgattccctggaagttaacgtatcgtaacatcgggtctgattttatccctagaggcgcttttgggaaggtgtacctggcccaagacatcaagaccaaaaagcggatggcatgcaaactcattccggtagaccagttcaagccatctgatgtcgagattcaggcctgttttcgccatgaaaacattgccgagctgtatggcgccgtgctgtggggcgaaaccgtccatctgtttatggaggcgggagagggcggaagtgtgctcgaaaaactggagtcctgcggtccaatgagagaattcgaaatcatctgggtcaccaagcacgtgctcaaggggctggatttcttacactctaaaaaagtgattcaccacgatataaagcgaaaatacctgtggacctacacatttcttgctcagcgcgactag

SEQ ID NO: 195595 - DNA, 1404 bp, Artificial Sequence
  Description of Artificial Sequence: Synthetic coding sequence
atggagtacatgagcaccggcagcgacaacaaggaggagatcgaccttttaatcaaacacctcaacgtctcagatgttatcgacatcatggagaacctttatgctagtgaggaacctgcggtgtacgaaccctctctgatgaccatgtgtcaggactccaatcagaacgatgaaaggtctaaatcattactcttatctgggcaggaagtgccctggttgtcaagcgttagatacggtacagtggaagatctcctggcctttgcaaaccatatcagtaacacagcgaagcacttttacgggcagcggcctcaagaaagcggtatactccttaatatggtcattacaccacaaaacggaaggtatcagatcgatagcgacgtgctcctgataccctggaagctgacttatcgcaatatcggctcagatttcataccgcgcggagcattcgggaaagtttacctagcccaagacatcaaaacaaagaagcgcatggcctgtaagctcatccctgtggatcaattcaagccctccgatgtggaaattcaggcatgctttagacatgagaatatcgccgagctatacggggccgtcctgtggggtgaaacagttcacttatttatggaagcaggtgagggcggttctgttctcgagaagttggagtcatgcggtcctatgcgcgagtttgagatcatctgggtgactaagcacgtcctgaaaggcctagactttctgcattccaagaaagtgatccaccacgacattaagcccagcaacatcgtgttcatgagtactaaggccgtcctcgtggactttggcctgagcgtgcagatgaccgaggacgtttacttccccaaagacctccgcggtaccgagatctacatgtcccccgaggtgattctttgccgaggacatagtaccaaggcagacatctactccttgggggctactcttatccacatgcagacaggtacacctccatgggttaaacggtatcccagaagcgcttaccccagttatctgtatattatccacaagcaggctccacccctggaggacattgctgacgattgctcaccgggaatgagagagctgatagaagcctctcttgagagaaatcctaaccaccggccacgagcagctgatctgttgaagcacgaagccctgaacccgccccgcgaggaccagcccagatgccagtctttggattccgctcttctggagcggaaaagacttctcagtcggaaggaactcgagctgcccgagaacatcgccgattcgtcttgcaccggatccaccgaagagagcgaaatgttgaaaagacagaggagcctgtacattgacttaggagccttggcaggctactttaaccttgtacgggggcctcctaccctcgaatacgggtag

SEQ ID NO: 195596 - DNA, 3357 bp, Artificial Sequence
  Description of Artificial Sequence: Synthetic coding sequence
atggagcccagccgggccctgctgggctgcctggccagcgccgccgccgctgctccccctggtgaagatggggccggtgcaggggcagaggaagaggaagaagaagaagaggaggccgcggctgctgtggggccgggcgagctgggctgtgatgcgcccctgccatattggacggccgttttcgaatacgaagccgccggcgaggatgagcttaccctgcgactaggggacgtggtcgaagtcctttccaaagacagccaagtgtccggggacgaaggatggtggaccggccaattgaaccaacgcgtcggtattttcccatccaattacgtgactccacgcagcgctttcagtagtagatgtcaacccgggggggaagatcctagctgttatcctccaatccaattgcttgagatcgacttcgccgaactaaccctggaagagatcattggtatcggtggcttcggcaaggtgtacagagcgttttggattggtgatgaggttgccgtgaaagctgcccggcacgacccggatgaggatatctcccagacaatcgagaacgtgagacaggaagccaaattgttcgcaatgctcaagcaccctaacatcatcgccctgagaggcgtttgcttgaaggaaccaaacctttgtctggtgatggagtttgccagaggcgggcctctgaatagggtgctaagtggtaaacgcatcccgcccgacatcctggtgaactgggccgttcagatcgcccgtggaatgaactatctgcatgacgaggccatcgtacccattattcacagggacctgaagtcctcaaacatcctgatcctccaaaaggtcgagaatggcgatctgtccaataagattttgaagatcactgacttcggactggcccgggagtggcaccgcactaccaagatgtcggctgcgggcacttacgcgtggatggctccagaggtgatcagagcctctatgtttagtaaaggatctgatgtgtggagctacggcgtgcttctgtgggagcttctgacaggtgaggtaccttttaggggaattgatggtctggccgtggcatatggagttgctatgaataagctggctctgcccattccttcaacatgtccagagcctttcgccaagctaatggaggattgctggaatccagatccacacagccgcccttcatttactaacattctcgatcagctgacaacgattgaagagagtggcttcttcgagatgccaaaagatagtttccactgccttcaagataactggaaacacgaaatccaggagatgtttgatcagctgcgggcgaaagagaaagagctcagaacttgggaagaggagttgacacgcgcagccctgcagcagaagaatcaggaggaacttctcagacggcgggagcaggaacttgccgagagggagattgatattctggagagggagctcaacatcataattcatcagctgtgccaggaaaaaccgcgtgtaaaaaaacgtaaggggaaattccgcaaatctagactgaaactcaaggatgggaacaggatctcactgccatctgactttcagcacaagtttaccgtgcaggcatctcccacaatggataaaagaaaatccctgatcaactcacgttcctcgcctcccgcatctccgactattatcccccgactgagggcaattcagctgacccctggggagtctagtaaaacctggggccggagctcagtggtgccaaaggaagaaggcgaggaggaggaaaagcgggctccgaagaaaaaggggaggacatggggcccagggacgcttggtcagaaggagctggctagtggcgacgaaggttctccccagcgacgcgagaaggccaacgggttatcaacaccttccgaatctccccatttccacctgggattgaagagcctggtcgatggatataaacagtggtcctcttcagcaccaaacctcgtaaaaggacctaggtcgagtcccgccttaccagggttcacttctcttatggagatggctcttctggctgcctcttgggtcgtgcctatagatatcgaagaagatgaagattctgaaggaccaggctctggcgaatctcgtctgcagcactctccctcccagagttacctttgcatcccattcccgcggggtgaagatggtgacggaccaagctcagatggcatccacgaagagccaacacccgttaattcagccacttccactccccaactgacccccacaaatagtctaaagagggggggggcacaccatagaaggtgcgaggtggcactgctcggttgcggcgccgtcctagctgccacaggcctcggatttgacctcctggaggcaggcaaatgccagctcctgccgctggaagaacctgagccccccgcaagggaggagaaaaagagaagggaaggtctcttccagcgttcgtcccgtccccgccggagtaccagtcctccaagcagaaagctgttcaaaaaagaggaaccaatgttgttactgggtgacccctccgcttccctgactttgctgagtctctcaagtatttccgagtgcaacagtactagaagtctcttgcgctctgattcggatgagatcgtcgtgtatgagatgcctgtaagtcccgtagaagccccccccctgtccccctgcacccataatcccctggtcaacgttagagttgagcggtttaagcgtgaccctaatcagtcattgacgcctactcatgtcaccttaacgacaccatctcagcccagctctcaccgcagaacaccttcagatggagctctgaaacccgaaacactgctagccagtcggagtccgtcctcaaacggtttgtcaccatctccaggggctggaatgctgaaaacaccttcaccatcacgggatccaggtgaatttccacgactgcctgatcccaacgtggtgttcccccctacacccaggcggtggaacacccaacaggacagcacattggagaggccaaagaccttagagtttctgccacggccccgcccctcagcaaaccggcagcggctagatccatggtggttcgtgagtccctcacatgcacggagtacatcccccgcgaacagcagctccactgaaacaccatccaatttggactcgtgtttcgcatcctctagctcaactgttgaagagagacccggcctcccagcgttgctccccttccaagcaggtccactccctcctaccgagaggacgttgcttgaccttgatgctgaaggccaatctcaagactcgacagttcccctatgccgtgccgagttaaacacgcaccggccagccccttatgaaattcagcaagagttctggtcttag

SEQ ID NO: 195597 - DNA, 2463 bp, Artificial Sequence
  Description of Artificial Sequence: Synthetic coding sequence
ctggtgctgatcctgcagaaggtggagaacggcgacctgagcaacaagatcctaaagatcacagacttcggcttagcacgtgaatggcatagaacgactaagatgtccgccgctggaacttacgcttggatggcacctgaggtgatcagagctagcatgttttcaaaaggttcagatgtttggagttacggcgtgttgttgtgggagttactcaccggagaagttccttttcgagggatagacggcctggccgtcgcatacggcgttgctatgaacaagctggccctgcccatcccttctacctgccccgagccttttgcaaaattaatggaggactgttggaatccagacccgcacagccgccctagcttcacaaacatactcgaccagctcactactatcgaggagtcagggttctttgaaatgccaaaagacagtttccactgtctccaagataattggaaacacgaaattcaggagatgttcgatcaattgcgagctaaggaaaaggagctgcggacatgggaggaggagctaactcgcgccgctctccaacaaaaaaaccaggaagaattactgagaaggcgtgagcaggaactggctgagcgcgagatcgatatattggagagagaactcaatattatcattcaccagctctgtcaggagaagcctcgggtgaagaagcgtaaagggaagtttcgtaagagtagacttaagctgaaggatgggaatcgtatctccctgcctagtgattttcagcataagtttactgtgcaagcatcccctaccatggacaagcggaaatctttgataaacagtcggtcttctccacctgcaagccctacaatcatacctaggttgcgagccatccagttaactcctggcgagtccagcaaaacctggggcagatcttccgtggtacctaaagaggaaggagaggaggaggagaagagggctccgaaaaaaaagggccgaacatggggcccggggactctgggtcagaaggagctagccagtggtgacgaaggacttaagagtctggtcgacggatataaacagtggagtagtagcgccccgaacctcgtgaaagggccaaggtccagtccagccctgccaggctttacatccttaatggaaatggcttgtttctcttctacacttgtcattttcactgaagatgaggactccgaaggcccaggtagcggtgaatctagactccagcacagcccaagtcaatcctatttgtgtatccctttccctcgaggcgaagatggtgatgggcccagttcagacgggatccacgaggaacctaccccagtgaatagcgcaacctccacccctcagctgactcccacaaattccctaaaacggggcggagcacaccaccgtagatgtgaggtcgccctgctgggctgtggggctgttctcgccgccacaggtctcggcttcgacctactggaagctggaaaatgtcagctgcttccactggaggaaccggagccccctgctcgtgaagagaaaaagcgccgggaggggttgtttcagcgctcctcaagaccccgtcgcagtacttcaccgcccagtagaaagctgttcaagaaagaggaacccatgctgctgcttggggacccatctgccagtttaactctgctcagcttatcatccatttctgagtgcaattcaacgcgatcattgcttcgttccgattctgacgaaatcgtggtttatgaaatgccagtgtcaccggttgaagcccccccactgtccccctgtacccataaccctctcgtcaatgtacgggttgagcgattcaaacgggatcccaaccagtcattaactccgacgcatgtgacacttactacaccttcccagccctcttctcatcggcggacaccctccgacggggccctgaagcctgaaacactgctagcttctaggagccccagcagcaacggcctgagtccttctcctggcgcagggatgttaaaaactcccagccccagtagggacccgggtgaatttcccagactacccgatcctaatgttgtgtttcccccaaccccccggcgatggaacacccagcaggattctacccttgagcgcccaaagaccctagaatttctgccaagacctcggccttcggccaataggcagcgccttgatccttggtggttcgtttcaccatcacacgcgcggtccacatctcctgccaacagctccagcacggaaacgccatcaaatcttgattcctgcttcgcttccagcagctccactgttgaagagaggccaggactccccgctctgctgcctttccaggcaggaccacttcccccaacagagcgcacattgttagacctggacgccgaggggcaatctcaggactcgaccgtacctctgtgccgggcagaattaaacactcacagacctgccccttacgaaattcaacaggagttctggtcctag

SEQ ID NO: 195598 - DNA, 3315 bp, Artificial Sequence
  Description of Artificial Sequence: Synthetic coding sequence
atggagcccagccgggccctgctgggctgcctggccagcgccgccgctgcggcacctcctggagaagacggggccggcgccggcgccgaagaagaagaggaagaagaagaagaagctgccgctgccgttggccctggcgagctgggctgcgatgcacccctaccttactggactgcagtgttcgagtatgaagcagcaggtgaggatgagttaaccctgcgcttgggagacgtcgtcgaggtcctcagcaaggacagtcaggtctccggcgatgagggatggtggactgggcagctgaaccagcgggtggggatcttcccatcgaattacgttacaccccgtagtgcctttagttcacgttgccaacccggaggagaggatccttcttgttatccgccaattcagcttctggaaatagactttgccgaactcaccttagaggaaatcattggaatcggtggttttggcaaagtttacagagctttttggataggcgatgaagtggccgtgaaggccgcccggcacgatccagacgaagacatctcgcagacaatcgagaacgtaagacaggaggcgaagctttttgcaatgcttaaacacccgaacatcattgccctgcgtggagtctgcctgaaagaacctaacctctgcctggttatggaattcgcacgtggcggacctctgaatagagtgctgagtggcaagcgcatcccaccagatattctagtcaattgggcagtgcagattgccagagggatgaattacctccacgatgaggccattgtgcccattatccaccgcgatctgaaatcttccaatattctgatcctgcagaaggtagaaaacggcgacctgtccaacaaaatattgaagataaccgattttgggctggcccgcgagtggcacaggacaacaaaaatgagcgcagcagggacgtacgcatggatggctcctgaagtcatccgggcatctatgtttagcaaggggagcgatgtctggagctatggtgttctcctgtgggaactactcacaggggaggtgccttttcgcggcatcgacggcctagccgtggcctatggggtcgccatgaacaagttggccttgcctatcccctccacctgtccggagccgttcgcaaaactgatggaagactgttggaatcccgacccccattcacggccgtccttcaccaatattctcgatcagctgacaactatcgaagagtccgggttctttgagatgccgaaggattcattccattgcctacaggataattggaaacacgagattcaggaaatgtttgaccagctgagggcaaaagagaaggagctgaggacgtgggaggaagaactgactagggcagcccttcagcagaagaaccaggaagagctgctcaggagacgtgagcaagaattagccgagcgtgagattgatatcctggaacgcgaactgaacatcattatacatcagttgtgtcaagagaagccaagggtaaaaaaacgaaaaggcaagttccgcaagtccagactgaaactcaaggatgggaacagaatcagcttgccatcggatttccaacataagtttactgtccaggcgagccctacaatggacaagaggaagagcctgatcaactcacgaagctcgcctccggcctcccccaccatcataccacggctgagggcgatccagctgactccaggcgagtcaagtaagacgtggggtagatctagcgtggtgcccaaggaggaaggcgaagaggaagaaaagagggcacctaaaaagaaggggcgcacttggggccccggaaccctcggccagaaggagctagcctcaggggatgaaggctccccccagcggagagagaaagccaatggtctctcaaccccctcagagtcgccacattttcatctgggactgaaatcccttgtggacggatacaagcagtggtccagctctgccccgaatcttgtgaaggggccaagaagctctcccgctttgcccggcttcaccagccttatggaaatggaggatgaggacagcgagggtcccgggtctggcgaatcccgcctgcagcactccccctcacagagctacctgtgtataccttttcctcggggagaagacggcgatggcccttcatcagacggcatccacgaagaacccacccctgttaactcggccaccagtaccccacaacttacccctactaactcattgaagaggggaggcgcacaccaccgaagatgcgaggtcgctctgcttggatgtggtgcggtgttggccgcaacaggactggggttcgatcttttagaggctgggaagtgccagcttctcccactggaggagcctgagccaccagcacgcgaggagaaaaagcgccgagagggcctgttccagcgtagctcacgacccaggagaagtacctctcccccttcccgaaagctctttaagaaagaggagcctatgctgctgctcggcgatcccagcgcaagcctcacgctgttgtctctgagctccatcagcgaatgcaacagtacacgctctctgttgagaagtgacagcgacgagattgtcgtgtacgagatgcccgtatccccagtagaggcccctcccctgagcccatgtacacataaccccctggttaatgttcgggtggaaaggttcaagcgagatccaaatcaatcactgacccctactcacgtcacactgacaacgcctagtcaacctagcagccaccgcaggacaccctcagatggggccctcaagccggaaacacttctggcatctcgcagcccttcgtccaatggcctatctcccagtccaggagcagggatgctcaaaacacctagcccctcaagggacccgggcgagttccctaggcttcccgaccccaacgtggtctttcctcctacccctagaagatggaacacccaacaagactcaaccttagagcgtccaaaaaccctcgagtttctccccagacccaggccttcagcaaatcggcagagattggacccatggtggttcgtgagcccaagccatgctaggtctaccagtcctgccaactcatcaagcacagagaccccatccaacctggactcatgttttgcctcttcctctagcactgttgaagagaggccgggcttgccagccctgctgccgtttcaagccggccctctccccccaaccgagaggaccctgcttgaccttgatgccgagggtcagagccaggactctaccgtacctctttgtcgggcagagttgaatacccatcgacccgccccctatgaaatccagcaggagttctggtcctag

SEQ ID NO: 195599 - DNA, 1005 bp, Artificial Sequence
  Description of Artificial Sequence: Synthetic coding sequence
atggccctgcggtggggcatcgtgagcgtgggcctgatcagcagcgacttcacagccgtcctacaaactcttcctcgctcggagcaccaggtggtcgcggtggctgcacgggatctttcaagagcgaaagagtttgcccagaagcatgatatccccaaggcctatggatcctatgaggagctggccaaggatccttccgtggaggtggcttatatcggcacacaacacccgcagcataaagctgcagtgatgttatgccttgccgctgggaaagctgtgctgtgcgagaaaccaaccggagtcaatgcagcggaggtgcgtgagatggtagctgaggcccgcagtagggctctattcctgatggaggctatatggactcgatttttcccagcttctgaggcactgcgttctgtgctggcccagggtacacttggggacttgagggtcgcccgcgccgaatttggaaaaaatctcattcatgtgcctagggccgtggaccgggcccaagcaggcggggccttattagacatcggaatttactgcgtgcagttcactagcatggtttttggtggacagaaaccagagaagatctcagtggtcggccggcggcacgaaacaggcgtcgacgataccgtgactgtgctgctccagtatccaggtgaggtgcatgggtccttcacatgttccatcactgtacaactaagcaacactgcgtcagtgagcggcacaaagggcatggtccagctgctcaatccctgttggtgtcccacggagctggtcgttaagggagagcataaagaattccctctccctcctgtgcctaaagattgtaacttcgacaatggcgctgggatgtcctatgaagctaagcatgtgtgggaatgtctcaggaaaggtatgaaagaatcacccgtgatccctctttccgagagtgaactattggccgatatcctggaagaagtcaggaaagctatcggagtgactttccctcaggataagcggtag

SEQ ID NO: 195600 - DNA, 2466 bp, Artificial Sequence
  Description of Artificial Sequence: Synthetic coding sequence
atggacgtggtggaccccgacatcttcaaccgggacccccgggaccactacgatttgctgcagcggcttgggggggggacttacggcgaggtgtttaaggcccgtgataaggtgtctggcgatctcgtcgcacttaaaatggtcaaaatggagccggacgacgacgttagcaccctccagaaagaaatcctgatcctgaaaacctgcaggcacgcaaacatcgtagcatatcacggcagttacctgtggctgcaaaagttgtggatctgtatggagttctgcggcgccgggtccttgcaagatatctaccaggtcaccggttctctgtccgagctgcagatttcctatgtatgcagagaagtgctgcagggcttggcttacttgcactcccagaagaagattcatcgcgatatcaagggggccaatatcctgattaacgacgcgggggaggttcgtttggcagacttcggtatctcagcgcaaattggcgccactctcgccaggagactatcattcattggaacaccctactggatggctcctgaagtggccgcagtcgccctgaagggggggtataatgaactgtgcgacatttggtctcttggcattacagcaatcgaactcgccgagttacagcctcctttgttcgatgtgcaccccctgcgcgtgctgtttttgatgaccaaatccggataccagccaccacggctgaaggaaaagggaaagtggtcagctgcctttcataactttattaaggtgacccttaccaagagcccgaaaaagcgacctagcgcgactaagatgctctcacatcaactcgtttctcagcctggcctgaaccgagggttgattctagatctgctggataagttgaaaaaccctggcaagggtccgtcaatcggcgatattgaagatgaagagccagagctgccgcctgccattcctcggcgaattaggtccacccaccggtccagcagtctcggtatacctgatgcagattgttgtaggaggcatatggagtttaggaagctgcgggggatggaaacccgcccgcccgccaacacggcacgactccaacctcccagggacctgcggagctcttctccccggaaacaactatctgaaagctccgatgatgactacgatgatgtggacatcccgactcctgccgaggacacaccgcccccactgcctcccaaacctaaattcaggtcacccagtgacgaaggtccaggatcaatgggagacgacggtcagctttctcctggtgtgctggtgagatgtgcgtcaggcccacccccgaatagccctcggcctgggcctccccccagtacatcctctccccatttgactgcacatagtgaaccttcactttggaatccaccatccagggaattggacaagccacctcttttgcctccgaaaaaagaaaagatgaaacgcaagggatgtgccttgctcgtgaaattgttcaacgggtgcccgttgcgaatccattctactgcagcttggactcaccccagtacaaaggatcagcacctgctgttgggggccgaagagggcatcttcatattgaaccgcaacgatcaagaggctaccctcgagatgctgtttccatcgaggaccacatgggtgtatagcattaacaatgtcttgatgtcactaagtggtaagacccctcacctgtattctcactcaatactcggactgctggaaaggaaggaaacccgggccggcaacccaatcgctcatattagcccccaccggcttcttgctcgcaagaacatggtgagcaccaaaatacaggatactaagggctgccgggcatgctgtgtggcggaaggagcatcatcaggagggcccttcctgtgcggggctctcgaaacctctgtggtgctgctgcagtggtatcaaccaatgaacaagtttctcctggttcggcaggtgttgtttccactaccgacgcccctttcagtgtttgccttgttgacagggcccgggtccgagcttccagccgtgtgcatcggcgtgagccctggccgtcccgggaagagcgtcttgttccacactgtgcggttcggggctctgagctgttggctcggagagatgagcacggagcatagggggcccgttcaggtcacacaggtcgaggaagatatggtcatggtcttaatggacggcagcgtgaagttagtgacacccgagggttctccagtccggggcctcagaacaccggagattccgatgacagaagccgtggaagccgtggctatggttggcggtcagctgcaggctttttggaagcatggggtgcaggtttgggcactgggctctgaccaactcctgcaagagctcagagatcccacactgacatttcggctgctgggatctcctcgccctgtcgtggtggagacccgaccggtagacgacccaacagccccttcaaacctttatatccaggagtag

SEQ ID NO: 195601 - DNA, 720 bp, Artificial Sequence
  Description of Artificial Sequence: Synthetic coding sequence
atggagttccggaagctgcggggcatggagacccggccccccgccaatacggcacgcctgcaaccaccacgagacttgcgttcaagttccccccgtaagcaactttccgaaagctcagacgacgactatgatgacgttgacatacccacaccggcagaggatacacctccacccctgccaccaaagcccaagttccgttctccgtcagacgaaggaccagggtccatgggcgacgacggtcagctctccccaggggtactggtgcgatgtgcctccggcccaccccccaattcgccgcgcccagggcctcccccctcgacaagcagtccccatctgaccgctcactccgagcccagcctctggaacccaccatctagggagttggacaaaccccccctgttgcccccaaaaaaggaaaagatgaagcgaaagggctgcgctctgttggtcaaattgtttaacgggtgccccctacgcatccatagtaccgccgcgtggacccatccatccacaaaagatcaacacctgctgcttggcgccgaggaagggatctttattctcaaccgaaatgaccaggaagccaccctcgagatggagcgcccccccacgtgcatcctgatcgctagcctcgcctgttggaatggcaagcgccctgaacaggagacaccatctctgactttggctccaacagcatattggcagggcactagctcacaatag

SEQ ID NO: 195602 - DNA, 2502 bp, Artificial Sequence
  Description of Artificial Sequence: Synthetic coding sequence
atggacgtggtggaccccgacatcttcaaccgggacccccgggaccattatgatctgttacagaggctgggcggtggaacctatggggaagtgtttaaggcacgcgataaggtttctggtgacttagttgcccttaagatggtcaagatggaaccagatgatgacgtatctactctccagaaagaaattttaatcctgaagacatgccgacacgctaacatagtggcttaccatggtagctacttgtggttacagaaattatggatttgtatggagttttgcggcgccggctcactccaggatatctaccaggttactgggtccttgtccgagttacagatatcctatgtctgtagggaagtgcttcaggggttagcgtatctacatagccagaaaaaaatccaccgggatataaagggcgccaacatacttataaatgacgcaggagaagtacgcctggcagactttggaatcagtgctcaaatcggtgccactctggcacgcagactatcgtttatcggcaccccctactggatggctcctgaggtggccgccgtggctctgaagggtggatataatgaactgtgtgatatatggtctctggggatcactgctattgagttggctgaactccaaccacctctgtttgacgtgcacccacttcgggtgctgtttttaatgactaaaagcgggtaccagccaccgagactcaaagagaaaggtaagtggagtgctgccttccacaatttcattaaagtgacattaacaaagtcaccaaagaagcgcccatctgccaccaagatgttaagccaccagttagtgtcacagccagggctaaatcgaggccttatcctagacctgcttgataaattaaaaaaccctgggaaaggaccctctatcggggacattgaagatgaggagccagagcttcctcctgcaataccccggagaattcgatccactcaccgatcttcttccttgggaatccccgatgctgattgctgccgacgccatatggagtttagaaagctccgggggatggaaacgagacctcccgccaatacagccagactgcagccccctagagacctgaggtccagctcccctcgaaagcagctctccgagtcctcagatgacgattacgacgacgtagacattccaactccggcagaagacaccccgccacctctgcctcctaagccaaagtttaggagtccaagcgacgaaggcccaggatcaatgggcgatgatgggcagctgtccccgggagtgctggtccgttgtgcaagcggacctccccctaactctcccagacctggcccacctccatctacctccagcccacatttaactgcacacagcgagccttctttgtggaacccaccctcacgggagctcgacaagcctcctctacttcctccgaaaaaagaaaagatgaagaggaaggggtgcgcacttttagtaaagctgtttaatgggtgccctcttaggatacacagcacagcagcttggactcatccgtccacgaaagaccagcacctgcttctgggagccgaggagggcatctttatattaaaccggaacgaccaggaagctaccttagaaatgctctttcccagtcgcaccacttgggtttactccatcaataatgtcctgatgtccttaagcggcaagactccccacctgtatagccactcaattctgggccttcttgaacggaaggagacccgggccggcaatcccatagcccacatatccccccatcggctgctagcacggaaaaacatggtgtcaactaagattcaggatacaaagggttgccgagcttgctgcgtcgccgagggcgcttcctccggcgggcccttcctgtgcggagccctagagacatcggtggtgctcttgcagtggtatcaaccaatgaacaagtttctattggtgagacaggttttgtttcccctcccaactcctctttcagtattcgccctcctcaccggacctggttcagagttgcccgctgtgtgcataggcgtcagtccaggccgaccggggaaatctgtgctttttcacactgtccgttttggcgccctgagttgctggttgggagaaatgagtactgagcacaggggaccagttcaagtgacacaggtggaggaagacatggtgatggttttgatggacgggtccgttaagctagtaacccccgaaggtagcccggtccgtggactgaggaccccagagattcctatgacagaagctgttgaagccgtggcaatggtgggaggacagctgcaggctttttggaagcacggggtgcaggtgtgggctctggggtcggaccagcttctgcaagaattaagggacccaacattgaccttcagactgctgggatctccgcgactcgagtgctccggtactatcagtccacactgtaatttacttttacctgggtcttctaatagccctgccagtgcctctagggtcgctggcatcacagggctgtag

SEQ ID NO: 195603 - DNA, 2463 bp, Artificial Sequence
  Description of Artificial Sequence: Synthetic coding sequence
atggccctgctgcgggacgtgagcctgcaggacccccgggaccggtttgagctattgcagagagttggggccggcacatacggagacgtgtataaggcgcgggatacggtgacttccgagcttgcggccgtgaaaatcgtcaaactcgatccaggcgacgacatctcatcgctgcagcaggaaataaccatcctgcgagagtgtcgtcatcccaatgttgtcgcatacataggatcttacctgcgcaatgatcgtttgtggatttgtatggagttttgcggcgggggttcacttcaggagatatatcacgccacaggccctctcgaggagcggcagattgcttacgtctgtcgagaggccctaaaaggactccaccacctccactctcaggggaaaatccaccgggatattaagggagcaaacctcctgctgaccctccaaggcgatgtgaaattggctgacttcggggtatctggggaactcaccgctagcgtggctaaacgaaggagcttcattgggaccccgtattggatggcacctgaagtcgccgcagttgagcgcaagggaggctacaatgagctatgtgacgtgtgggccctcgggatcaccgcgatcgagctcggagaattacagccccccctgttccatctccatcccatgcgcgccctcatgctgatgtccaagtccagctttcagccaccaaagctaagggataaaacgagatggacacagaacttccaccactttctcaaattggctctcactaagaaccctaagaagaggccgacggcggaaaagctgctccagcacccattcaccacccagcagttgccacgcgccttactgacccagttgctggacaaagcttccgaccctcacctggggaccccaagtccagaagattgcgaattggaaacctacgacatgtttcccgacaccatccactccaggggacagcacggacccgctgaacggacaccttctgaaatccaatttcaccaagtgaagttcggagcgcctagacggaaagaaacagatcctctgaatgagccctgggaagaagagtggacgttgttaggcaaagaggaattatcaggcagccttctccaatcagtccaagaggccctggaggaaaggtctctgaccatcagatcagcatccgagtttcaagaattagactctccagacgatacaatgggaacgataaagcgtgcacctttccttggcccattgcccactgacccacccgcggaagaacccctgagctcaccacccggaaccctcccccctccaccgagcgggccgaattcctccccgttgctgccaactgcgtgggcgacaatgaaacagagggaagaccctgaacggtccagttgtcacggactgccaccaacaccaaaggtgcacatgggggcctgctttagcaaagtgttcaacgggtgtccactcaggattcatgccgcagtgacttggattcatcctgttacccgggaccagtttttagtagtgggggccgaggagggaatatatactctgaacttgcacgagctgcacgaggacactcttgaaaagctgattagccacagatgtagctggctgtactgtgtgaataatgtcctgctgtcactcagtggaaaatccacgcacatctgggctcatgacctgccgggcctatttgagcagagacggctgcagcagcaagttccgctgtccatacctacgaaccgcctgacccaaaggattattccgaggcgttttgctctttcgactaagatacctgacacaaaggggtgtctgcagtgtagggtcgttcgcaacccctataccggggcaacattcctgctagccgctctgcccacctccctcttgctgctgcaatggtatgagccgctccagaaattcctcttgctgaaaaacttcagtagtccactgccatcccctgcggggatgttggagccccttgttctcgacgggaaggagctcccgcaagtttgtgtcggcgctgaaggtcccgaagggcctggttgcagagtgcttttccacgtgcttccattagaagcgggactgactcctgacattctgatcccacccgaaggaattccaggcagcgcacagcaggtcatccaggttgatcgtgacaccattctggtctccttcgagcgctgtgtgcgtatcgtgaacatgcagggagaacccacagccactctggcccccgagctgaccttcgatttcccaattgagaccgtggtttgcctgcaagactcagtgcttgctttctggtcccatggaatgcaggggcgcagcctcgataccaatgaggtcacccaagaaataacagacgaaacccgaatatttagagtgctgggcgctcaccgcgacatcatattggagtctattccgaccgataacccagaagcacactcaaacctttatatcctgacagggcatcaatctacatactag

SEQ ID NO: 195604 - DNA, 2541 bp, Artificial Sequence
  Description of Artificial Sequence: Synthetic coding sequence
atggaggcccccctgcggcccgccgccgacatcctgcggcggaacccacaacaagattacgagcttgttcagagagtcggctcaggtacatatggagacgtgtacaaggccaggaatgtgcacactggcgagcttgctgcagtcaaaatcattaagctcgagcccggcgacgacttctccctgatacagcaagagatatttatggttaaagagtgcaagcattgcaacatcgtggcctatttcggaagctacttgtcgagggagaaactgtggatttgcatggaatactgcggaggcggttcccttcaagacatctaccatgtgacaggaccactgagcgagcttcagatcgcctacgtgtgtcgggagaccctgcagggcctcgcctatctgcacacaaagggcaaaatgcaccgggatatcaagggagcaaatattctgctgactgaccacggggacgtgaagctagcagactttggggttgcagcaaagatcaccgccacgattgccaagcggaaaagtttcatcggaactccttactggatggctccagaagtcgcagctgttgaaaagaatggggggtataatcaattgtgtgacatatgggccgtaggtattactgccatcgaactcggggagctgcagcctccaatgttcgatttgcaccccatgagagccctatttcttatgagtaagtccaatttccagcctcctaaacttaaagataaaaccaagtggtcaagtaccttccacaatttcgtcaagatcgccttaaccaaaaacccaaagaagagaccaacggccgagcggctccttacacacacctttgttgcacagcctggcctgtctcgagcactcgccgtggagctactcgacaaggtgaacaatccggataaccacgcccactacacggaagccgacgatgacgatttcgagcctcatgctatcataaggcatacaattagatccaccaaccgaaacgcgcgagctgagcgtacagcttctgagatcaattttgataagctgcagtttgagccaccgttaaggaaggaaaccgaggctcgcgacgagatgggactcagcagcgacccgaacttcatgctccagtggaatccatttgttgatggtgctaatacaggaaagagcactagcaagcgtgccatcccaccgccactgccccctaagccaaggatttccagttaccccgaggataacttccccgacgaagagaaggcttccacaatcaagcattgcccagatagcgagagccgggcccctcaaattctgaggcgccagagctctccgtcctgcggacctgtggctgagacttcctcaattgggaacggtgacgggatcagtaagctgatgtcagaaaacaccgaaggctcagcgcaagcgccccaactcccaagaaagaaagacaaaagggactttccaaagcctgctattaatggcttacctcctacgcccaaagtactgatgggggcatgctttagtaaagtgttcgatggttgtcctctgaaaatcaattgcgccacaagctggatccaccctgatacgaaggatcaatacataatttttgggacagaggatggcatttatactctgaacttaaacgagttacatgaggctacaatggaacaattattcccacggaagtgtacctggctctacgtgatcaacaacacactgatgtccctgagcgtggggaagaccttccagctgtactcccacaatttaattgcgctgtttgaacacgctaagaagcccgggttggcagcacatatccagacacacagattccccgaccgcatcttgcctagaaagtttgcccttacgacaaaaatccccgataccaagggatgtcacaaatgttgcatcgtgcgcaacccttacacgggacacaagtatctgtgcggagccctgcagagtgggatcgttttgctccagtggtacgagccgatgcagaaatttatgctgatcaaacatttcgattttccgctcccctccccgctgaacgtttttgaaatgttagtaattcccgagcaggagtatcccatggtgtgtgtggccatatcaaagggcacagaaagtaaccaggtcgtgcagttcgagaccattaacctgaactcagcctcctcatggttcacggaaatcggagcaggcagccagcagctcgactccattcacgttacacagctagaacgcgacacggtgcttgtttgccttgataagttcgtgaagatcgtcaacctgcagggtaaactgaaatcttcaaagaagcttgctagcgaactgtccttcgattttagaatcgagagcgtcgtgtgcttgcaagattccgtgctagccttttggaaacatggaatgcaggggaagagctttaaatccgatgaggttactcaggagataagtgatgaaacacgagtgtttcgcctgcttggatccgatagggtagtggtgctggagagtcggcctacagagaacccgacggctcacagcaatctgtatatcctagccgggcatgaaaacagctactag

SEQ ID NO: 195605 - DNA, 699 bp, Artificial Sequence
  Description of Artificial Sequence: Synthetic coding sequence
atggccaccgccgagagccgggccctgcagttcgccgagggcgccgcttttcccgcctaccgtgccccgcatgccggaggcgccctgctcccccccccaagccccgctgccgcactcttgcccgctccgccggcaggtccggggcccgcaaccttcgctggtttccttgggagggaccctggccctgcaccgcctccaccggcctccctgggctcccccgctccgcccaaaggggccgcggccccttcagcgagtcagaggagaaagcgtacatcttttagcgcggagcagctgcagttgctcgagttggttttcagaagaaccaggtatcctgacatacatctcagggagagactggcagccctcaccctacttcccgagagtcggatccaggtatggtttcagaacagaagggccaagtctagacggcaatcaggcaaaagtttccaacctctggcacgccctgaaataattttgaaccattgtgcccctggtacagaaaccaagtgcctcaagcctcagctcccgctggaagtcgatgtcaactgcttgcctgaaccaaacggcgttggcggaggaatttccgactcatcctctcaagggcagaacttcgagacatgttcccccctgagcgaggatattggctcaaagctcgactcttgggaggaacatattttctcagcttttggaaacttttag

SEQ ID NO: 195606 - DNA, 723 bp, Artificial Sequence
  Description of Artificial Sequence: Synthetic coding sequence
atggccaccgccgagagccgggccctgcagttcgccgagggcgccgcctttcctgcctatcgcgcccctcatgcaggcggcgccttgctgccccccccctcgccagccgctgcgctgctccccgcaccaccggctggccctggcccggcaacgtttgcgggatttttgggacgggaccccgggccagcgcctcccccacccgcctccttgggaagtccagcccccccaaagggcgctgccgcgccatcagcctctcagagacgaaagagaacttcattttcagcagaacagctccaactgcttgaacttgtattccgccggacacggtatccagatattcacttaagagagcgccttgccgccctgactctccttcctgagagcaggatacagttactcttttcaccactgttccaggtgtggttccagaatcgccgagctaaaagcaggcgtcagtccggcaagagctttcaaccactggcacgccccgaaatcatacttaaccactgcgccccagggacggaaacaaagtgcctcaagccgcaactccccctcgaagtggatgtcaactgccttcccgagccgaatggcgtaggaggcggtatatcagattcctcatcccagggccagaatttcgagacttgctcccccctctctgaagatatcggcagcaagctggatagctgggaggagcacattttttccgcctttggcaacttctag

SEQ ID NO: 195607 - DNA, 882 bp, Artificial Sequence
  Description of Artificial Sequence: Synthetic coding sequence
atggccaccttcagcggccccgccggccccatcctgagcctgaacccccaggaggacgtcgaatttcaaaaggaggtggcccaggttcggaagcggataactcagaggaagaagcaagagcagctgacgcctggcgttgtttacgtacgccaccttcctaatctgttggacgagacacagatcttttcctactttagccagttcggaacggtgacacgtttccggctatcccgtagtaagcgcaccggaaattctaaaggctatgcatttgtggaattcgagagcgaggatgtggccaagatcgtggccgagaccatgaacaactatctgtttggagaaagattgcttgaatgtcacttcatgcccccggagaaggtgcacaaggagctgtttaaggattggaacattcctttcaagcagccctcttaccctagcgtaaaaagatacaataggaataggacgctgacgcagaagctgcgcatggaagagcgattcaaaaaaaaggagcgtctcctgcgtaagaaactcgctaaaaaggggatcgactacgattttccttcgttgattctccagaagacggagagcatctccaagaccaaccggcaaacgtcgacaaaagggcaggttctccgaaaaaagaagaagaaggtcagcgggactctggacaccccagagaagacggttgattcccagggccccacaccagtgtgcacacctacctttctcgaacggcgaaagagccaggtggctgaactgaacgacgatgacaaggacgatgagattgttttcaagcagccaatatcgtgcgtcaaagaagagatccaggagactcaaacacccacacatagccgaaagaagagacggagatctagcaatcagtag

SEQ ID NO: 195608 - DNA, 1257 bp, Artificial Sequence
  Description of Artificial Sequence: Synthetic coding sequence
atggccccccggggccggcggcggccccggccccaccggagcgagggtgccaggcggagtaagaacactttggagcggactcactctatgaaagacaaggcaggacagaaatgtaaacccattgatgtgttcgattttcctgacaattccgacgttagtagcattggacggttgggagaaaacgaaaaggatgaggagacatatgagacgtttgaccctccactccattccacagctatatacgctgatgaggaggaattcagtaagcattgcggattatctctgagctcaacaccgccgggcaaggaggccaagcgaagctcggatacctccggcaacgaagctagtgaaatcgaatcagtgaaaataagtgctaaaaaacctggacgcaagctgagacctatctccgatgattctgaatccattgaagagtccgacacaagacgtaaagtgaagtccgctgagaaaatcagtacacagcgccacgaggtaattcggactacggccagctcagagctcagcgaaaaaccagctgagagtgtgacctctaaaaagaccggaccattaagtgctcagccgtctgtggagaaagaaaacttagcaattgaatctcagtctaagacccaaaaaaagggcaagatctctcatgacaagcgcaagaagtcaagaagtaaagcaattgggtctgatacctccgacatcgtgcatatctggtgccctgagggcatgaagacatctgacatcaaggagttaaacatagtcctaccagagttcgagaaaacgcatctcgagcaccagcagaggattgaaagcaaggtgtgtaaagctgctatcgctactttctatgtcaacgtgaaggaacagttcattaagatgttaaaggagtcacagatgctcactaacttaaaacgtaagaacgctaagatgatcagtgacatcgagaaaaaacggcagcggatgatcgaagtgcaggacgaactgctgcgcctggaaccgcagctgaagcaattacagactaagtacgatgagctcaaggaacgcaaaagtagtctgaggaacgctgcctattttttgagcaacctgaagcagctgtaccaggactactcagatgtgcaggcccaagaaccaaacgtgaaggagacctacgatagctcatcattacctgcactcctgttcaaagccagaactctgctgggtgcggaatcacacttaagaaatataaaccatcagctagaaaagctgctggaccaaggctag

SEQ ID NO: 195609 - DNA, 963 bp, Artificial Sequence
  Description of Artificial Sequence: Synthetic coding sequence
atggccccccggggccggcggcggccccggccccaccggagcgagggcgctagacggagtaagaataccctggaaaggactcattccatgaaggacaaggccggtcagaagtgcaagccaatcgatgtatttgactttcccgacaacagcgatgtgagctctatcggccgcctaggcgagaatgaaaaagatgaagaaacatacgagacatttgacccgccgctgcattccacagcgatatatgccgacgaggaggaattttcaaagcattgcgggctaagcttgtcctccactccccccggcaaggaggccaagagaagctccgatacctcaggaaacgaggctagtgagatcgaaagcgtcaagatcagcgcgaaaaagcccgggaggaagctcaggccgatctccgatgattcggagagcattgaagagtctgacacgcgaagaaaggtaaaatctgcagagaaaatttccactcagagacatgaggtgatccgtaccaccgcatcctctgagctgagcgaaaagcccgctgaaagtgtgacgtccaaaaagaccgggccactctcagcccagccctctgtagagaaagagaatctggcaattgagagtcaaagtaaaacccagaagaagggcaagatctcccacgacaaaagaaagaaaagccggagtaaagcgataggctccgatacttctgacatagttcacatttggtgcccagaagggatgaaaacatctgatattaaagagcttaacattgtgttacctgaatttgagaagactcatttagaacaccaacagaggatcgaatccaaagtctgcaaggctgcgattgccacattctatgttaacgttaaagagcaatttatcaaaatgttaaaggagagtcagatgctgactaatctgaagagaaaaaacgctaaggtgcgtgctacagcagaaacaacaacaaataaaatatag

SEQ ID NO: 195610 - DNA, 963 bp, Artificial Sequence
  Description of Artificial Sequence: Synthetic coding sequence
atggccccccggggccggcggcggccccggccccaccggagcgagtctgcgagacggtccaaaaacactttggaaaggacacactccatgaaggataaagcaggccagaagtgcaagcctattgacgtcttcgacttcccagacaatagcgatgtatcatccattggcaggctgggagaaaacgaaaaggatgaggagacctacgaaacctttgatcccccattgcacagcaccgccatctacgctgacgaggaagagttctcgaagcattgtggtttatctctatctagcacgcctcctggtaaagaggccaagaggagctccgatacaagtggcaatgaggctagcgaaatcgaatcagtgaagatcagtgccaaaaaaccagggaggaagctacgccctatttccgatgatagcgagagcatcgaagaaagcgatactcgacggaaggtgaaaagcgcggaaaagatctccactcagagacatgaagtgatcagaacaaccgcctcatctgaactcagcgaaaaaccagcggaaagcgtgacgtctaaaaagactggtccattgtctgcccagccctcagtggagaaagaaaacttggcaatcgagagtcaatcgaagacacagaagaaaggcaagatcagccacgataaacgaaagaaatcccgatcgaaggctatcggcagcgatacttccgatatcgtgcacatttggtgccctgaggggatgaagactagcgacattaaggagttaaacattgtgctgccggagtttgagaaaactcacctcgagcaccaacaacggattgagtctaaagtgtgcaaggctgccatcgctaccttctatgtcaacgtcaaagagcagtttataaagatgctcaaggagtctcagatgctgactaacctgaagaggaagaacgccaaagtgagggctactgctgagactacaaccaacaagatttag

SEQ ID NO: 195611 - DNA, 1014 bp, Artificial Sequence
  Description of Artificial Sequence: Synthetic coding sequence
atggccccccggggccggcggcggccccggccccaccggagcgagggagcccgcagatctaaaaacacactggagcgcacccactctatgaaagataaagccgggcaaaagtgcaagcctatcgatgtgtttgacttcccagataattctgacgtctcatccataggcaggttgggcgaaaatgaaaaggacgaggagacctacgagactttcgatccccccttgcattctactgctatctatgcagacgaggaagagttctccaagcattgcggactgagcctctcatcaacacccccaggaaaggaagctaaacgatccagcgacacatctgggaatgaagcttccgaaatagaaagtgtgaaaatctcagcgaaaaagcctgggcgtaagctgcgacccatcagcgatgattcagagagcattgaggaaagtgacactaggagaaaggtgaaaagtgcggagaagatttccacacagaggcatgaagtgataaggaccacagcctcctccgagcttagcgagaaacctgccgagtcagtcaccagcaaaaagacagggccactgtccgcacagccatctgtggagaaggagaacctggcaatcgaatctcagtcgaagacgcagaaaaaggggaaaattagtcatgacaagagaaagaaatctaggtccaaggccataggctccgacacatcagacatcgtgcacatatggtgccctgaggggatgaagacttccgatatcaaagagctgaatattgttcttccagaattcgagaaaacgcatctggaacatcagcagcggatcgaatctaaggtgtgcaaggctgctatcgctaccttctatgtgaatgttaaagagcagttcattaagatgctcaaggagagccagatgcttactaatttgaagcggaaaaacgctaagatgatctctgacatcgaaaaaaagaggcagcgaatgatcgaggtccaagatgaactgttgcgcttgtggacaggggccggactgtggtag

SEQ ID NO: 195612 - DNA, 2760 bp, Artificial Sequence
  Description of Artificial Sequence: Synthetic coding sequence
atggccgccgacgtgttcatgtgcagcccccggcggccccggagccgaggacggcaggtacttttgaagccgcaggtgtcggaggatgacgacgatagcgacaccgatgaaccaagcccaccgcctgcatctggagctgcaaccccagcccgcgcgcacgcaagcgcagccccacctcctcctcgggcaggacctggcagagaagagccacctcgtcgccaacagatcatccacagtggtcactttatggtatcctccccccatcgcgaacaccccccaaagaaaggctacgacttcgataccgtgaataaacaaacatgccagacttactctttcggaaaaacatcttcttgccacctaagtattgatgcctccctaacaaagctgtttgagtgtatgaccctcgcctatagtggcaagctagtaagtcccaagtggaagaacttcaaaggactaaagctccaatggcgggataagattcgacttaacaacgcaatttggcgagcctggtatatgcagtaccttgaaaaacgtaagaacccggtatgccactttgtgacacccttggacggatcagtggatgtggatgaacatcgaagacccgaggccattacaacggaaggaaaatactggaaaagccgcatcgagatcgtgattagggagtaccacaagtggcgcacctacttcaaaaagcgcttgcaacaacacaaggatgaggacctgtcatccctggttcaagatgatgacatgctttactggcacaaacacggagatggatggaagaccccagttcccatggaggaagaccctctccttgacaccgatatgctcatgtccgagttcagtgacaccctgttcagcaccctttcaagtcatcaacccgtggcctggccaaacccacgggagatcgcccacttgggaaatgcggacatgatacagccaggcctcatcccattacaacctaaccttgactttatggacaccttcgaaccgtttcaggacctattttccagctccagatccatctttgggtccatgctacccgcctccgccagtgctcctgtccctgatccaaacaatccaccagcacaggaaagtatactgcccactacggcgctccccacagtgagccttcctgactcccttattgctccaccgactgccccctctcttgcccatatggatgaacaagggtgtgagcatacttctagaactgaagatccttttatccagccaactgactttgggcctagtgagccgccactgagcgtgccccagccattccttcccgtatttaccatgcccttactctccccgtcccccgcccccccccccatctcccctgtacttcctctcgtgcctccccctgcgaccgcactgaatccaccagcacctcctacgtttcaccagccacaaaaatttgcgggagtgaacaaggccccatccgtgattacacatactgctagcgccacgctcacccacgacgctcccgctacaactttttcacagagccagggtctggtgatcaccacccaccacccagccccgtctgcagccccttgtgggctggccttgagcccagtgacccgacctccccagccgaggctgaccttcgtgcacccaaagcccgtgtctctgacaggcggacggccgaagcagccccataagatcgtccctgcaccaaagcctgagcccgtgtcccttgtgctcaagaacgctcggattgcccccgcagcattctccggccagccccaggccgtgattatgacttcaggccccttaaagagagaagggatgttagcctcgacagtctcacagtctaatgtggtgatcgccccagccgcaattgccagagccccaggagtgccggaatttcattcgtctatcctggtaactgacctggggcacggcacctcctccccacctgcccctgtgagccggctcttccccagcactgcacaggatcctttggggaagggagagcaggtccctttgcatgggggaagccctcaggtcacggtaaccgggccctcacgggattgtcctaattccgggcaggccagtccatgtgcgtcagagcaatctcccagcccacagtcccctcagaacaactgttccgggaaatccgatccaaaaaacgtggccgccctcaagaacaggcagatgaagcacataagtgctgaacaaaaacgaaggttcaacatcaagatgtgcttcgacatgttaaactcgctgatctcaaacaacagcaagttaaccagccacgcgatcactctccagaagaccgttgagtatattactaagctccaacaggaaagaggccaaatgcaggaagaggcccgacgcctgagggaagagattgaggagttgaacgctaccattatttcctgtcagcagctgcttccggctactggggtgccagttacaaggcggcagtttgaccacatgaaggacatgttcgatgagtatgttaagacccgcacattacaaaattggaaattctggatcttttctataatcatcaagcctttgtttgaatcttttaaaggcatggtgagcactagtagcctggaggagcttcaccggacggccctgtcatggttggaccaacattgtagcttgcctattcttcggccgatggtcctgtccaccttgaggcagctctcaacaagcacctccattctcactgacccagctcagttgcccgagcaggccagcaaagccgtaactcgaattgggaagaggcttggagagtcctag

SEQ ID NO: 195613 - DNA, 657 bp, Artificial Sequence
  Description of Artificial Sequence: Synthetic coding sequence
atggacgagcagggctgcgagcacaccagccggaccgaggaccccttcatccagcctacagacttcggaccctcagagcctcctttgagcgtacctcctccgccaatatcaccagttctccccctcgttcccccacctgccaccgcattgaatccccctgctcctccaacgtttcatcaacctcagaaatttgcaggcgtgaataaggccccgtccgttataacgcatacagcctcagcaactctgacccacgatgcacccgcaactacttttagtcagtcacagggtctcgtgatcaccacacaccaccctgccccctcagcagccccttgtggtctagctcttagtcccgtgactaggccccctcaacccaggttgactttcgtccacccaaagccagtgtctcttacaggtggaaggcccaaacaaccccacaagatcgtgcccgctcctaagcctgagcctgtgagtctggtgcttaaaaacgcaaggatcgcacccggggagccaggcggtgagacgcaatgcggcgcacctcctgatcccgagggctgttttcctataccaaaggcctttaagctagttactactactacgactttggtctgtacatgtatgcggacccacattcatctcaacgagaccaaggtgagctag

SEQ ID NO: 195614 - DNA, 1581 bp, Artificial Sequence
  Description of Artificial Sequence: Synthetic coding sequence
atggacgagcagggctgcgagcacaccagccggaccgaggaccccttcattcaacccacagactttggcccatccgaacctcccctttccgtacctcagcctttcttgcctgtgttcacaatgccacttctttcccctagtccagctcccccacccatctccccagtgctgcctctggtccctccccctgccaccgccctcaatcctccagcgcctcctacattccaccagcctcaaaaattcgccggggtcaataaggccccaagcgttattacccacacagcatcagccacactgacacacgacgccccagccacaaccttttcacagtcccagggcctggtgataacaacacatcacccagccccgagcgcagcaccctgcggtttggctctcagtcctgtaacacggccaccccagccacggcttacgttcgtccaccctaaacccgtttccttgacaggaggtcgacctaagcagccccacaagatagtccctgctcctaagccagaaccagtgtccctggtgcttaaaaacgctcggatcgcacccgcagccttttcaggacagcctcaggctgtgataatgaccagtggccccctgaaaagggagggaatgctagcaagtactgtctcgcagagtaacgttgtgatcgctcccgccgctattgctagggcccccggagtgccagaattccacagtagcatcctcgtgaccgatctaggacatggcacctcatcccctcctgccccggtgtcccggctttttccatctaccgcgcaggatccactcgggaagggggagcaagtgccattgcacggaggttcccctcaggtaaccgtgacgggtcccagccgggattgtcccaattcaggtcaggcgtccccttgtgcctccgaacaatcacccagcccccagagtccacaaaataattgctctgggaagtccgatcccaagaatgttgccgccctgaagaatagacagatgaaacacatcagtgctgaacaaaagaggcgcttcaatattaaaatgtgtttcgatatgctcaattctttgattagcaataactctaagctgacttcccatgctattacactgcaaaagactgtggagtatatcacaaaattgcagcaggaaagaggccagatgcaggaggaagcacgccgcctgcgagaagagattgaggagctcaacgcaactattattagctgccagcagctgctgcctgccacgggtgtccccgtgaccaggcgacaatttgatcacatgaaagacatgttcgacgaatacgtaaaaactcgaacccttcagaactggaagttctggattttctcaatcataataaagccactctttgaatcattcaagggcatggttagcacatctagcctcgaggagttacataggacggcgttaagctggctggatcagcactgcagtctgccgatccttagacccatggttctgagtacactgagacagctgtctacttccacaagcattctcaccgatccagcacaactgccagagcaagcttccaaagccgttacccgaatcgggaaacgactcggagagtcttag

SEQ ID NO: 195615 - DNA, 2559 bp, Artificial Sequence
  Description of Artificial Sequence: Synthetic coding sequence
atggccggcgccctggccggcctggccgccggcctgcaggtgcccagagttgcgcctagtcctgactctgatagtgacacagactccgaagacccgtcactgagaaggagcgccggtggactgctgcgctcccaggtcatacactctgggcacttcatggtgtcatctccgcactccgactccctgccgcggcggcgggaccaggaggggtcagtgggaccctctgatttcggtcctcgatctatcgatccaactctgacgcggctgttcgagtgtctctcgctcgcttactctgggaagttggtaagccccaagtggaagaactttaagggcctgaaattgctgtgtcgtgacaagattaggctgaacaacgccatatggagagcatggtatatacagtacgtgaaaagaaggaaatcccctgtgtgtgggtttgttacccctctccaaggccctgaggccgatgctcaccgtaaaccagaagctgttgtactggaaggaaactactggaaacggaggatcgaggtcgtcatgagagagtaccacaagtggagaatatattacaagaagaggctccgaaaacctagcagagaagacgatctgctggcccccaagcaggcagaaggtaggtggcccccccccgaacagtggtgtaaacaactgttttcaagtgtcgtgcctgttcttctgggtgatccagaagaagaaccaggcggaagacagctgctagacctgaattgctttcttagcgacatcagtgatactctttttactatgactcagtctggtccctctcctctgcagctcccacccgaggacgcctatgttggaaacgccgacatgattcagccggatctgacacccctgcagccttccctagatgacttcatggacatctctgattttttcactaattctaggctgccacagcctccaatgccttctaacttcccagagccaccatccttctctcccgtagttgactctctattcagtagtggaaccctgggaccggaggtccctccagcatcttcagctatgactcatttgagcggacactccaggctgcaggcaagaaattcttgcccaggcccattagactcttccgcgttcctgagctctgattttctcctaccagaggaccctaagccacgactgccaccccccccggttcccccacccttactgcattatcctccccccgccaaagttcccggcctggagccttgtccccccccccccttcccccccatggcccccccaaccgccctgctgcaggaggagccgctgttcagcccacgtttcccatttcctaccgttccaccagccccaggcgtatcccctctgcccgcccctgccgcctttcccccaacaccgcagtccgtcccaagcccggcccctacacctttccccatcgagttgttgccactgggatatagtgaacctgcgttcggtccatgcttctccatgccacggggtaagccccccgctcctagcccacgggggcagaaagcctcccctccaactctcgctcctgctaccgcatccccacccacaacggctgggtccaacaatccctgcctgactcagcttctcacagccgcaaagcccgagcaagccctggaacctcccctggtcagctccacactcctgagaagccccggtagccctcaggaaaccgttccagagtttccctgcacatttttgcctcctactccggcccctacaccccctcgccctccaccagggccagcgactttagcccctagccgaccgctattagtacctaaagccgagcgactgagtccccctgccccgtccggctccgagagacgattgagcggagatctgagctccatgcccgggccggggaccctgtcagtgagggtgagcccaccccagcccatactgagcagaggccggccagatagcaacaagactgaaaacaggcgaatcacccacatctcggccgaacagaagagacgtttcaacatcaagcttggctttgacactctccacggcctggtcagcaccctgagtgcccagccatcactgaaggtctctaaggccaccacactgcagaagacggcagaatacatacttatgctgcaacaggagagggccgggttacaggaggaggcacagcaattacgggacgaaatcgaagagctgaacgccgccatcaatctctgccaacagcagctccctgccacgggcgttccgattacccaccagcggttcgatcaaatgcgggacatgtttgacgattatgtacgcactcggacactgcacaattggaaattttgggtgttctccattctgatacggcccttgtttgaatctttcaatggcatggtgagcacagcatccgtccacacccttaggcagacaagtcttgcttggttagaccagtactgctccctgcctgcattaagacccaccgtgctgaactctctcagacaactaggcaccagcacttcaatcctaactgaccctgggcggattccggaacaagccactagagcggtaaccgagggtactctgggcaagccattgtag

SEQ ID NO: 195616 - DNA, 2496 bp, Artificial Sequence
  Description of Artificial Sequence: Synthetic coding sequence
atggccggcgccctggccggcctggccgccggcctgcaggtgcccagagtggccccatcccccgactcggactccgacactgatagcgaagacccctcgctaagacggtcggctggggggctgctcaggtcacaagtgattcacagtggccacttcatggttagttcgccacatagcgatagccttccaagaaggcgggaccaagaaggaagtgtaggccctagcgattttggtcccaggtctatcgatcccactctcacacgcctctttgaatgcctttctcttgcatattcgggcaaactagtttcacccaagtggaaaaactttaagggcctgaaactgctgtgtagggataagataaggcttaacaatgcaatatggcgagcttggtacattcagtacgttaagcgccgcaagagcccagtgtgcgggttcgtgactccactgcagggaccggaagcggacgcccatcggaaaccggaagccgtcgtgctggagggaaactattggaaacgcaggatcgaggtcgtgatgcgggaataccacaagtggcgaatttactataaaaagcgcctccggaagcccagcagggaggacgacttactggctcctaagcaggctgaaggcaggtggccaccacctgaacagtggtgcaagcagctcttctcatccgtcgtacccgtgttacttggggacccagaggaggaacctggcggtcgtcagctgctggatctgaattgcttcctgtcagatattagcgatacacttttcacaatgacacagtccggtccttctccactccagctcccacccgaagacgcgtacgtgggcaacgccgatatgatccagcctgatctcaccccactgcagcctagcctggatgactttatggacatcagtgactttttcaccaacagtcggctaccgcagccacccatgccatccaatttccccgagcctcctagtttttctcctgtggtggactcactgttttcttctgggactcttggacctgaggttccacctgctagttcagcgatgacacatctctctggccactccaggctgcaggctaggaattcctgccctgggcccctggatagctcggcatttctgtcctccgacttcctgctgccggaggacccaaaaccacgcttacctccacctcccgttccgccacccctgcttcactaccctccacctgccaaggttcccggcctggaaccttgccccccaccacctttccctcccatggcccctcctacggcgttgctgcaggaggagcctctgttcagcccacggttcccctttcccacggtccccccagcccctggagtctctccactgccggctcccgctgcgtttccccctactcctcagagtgtgccttccccagcccctacaccatttccgattgaactactccccctgggctactcagagcccgcctttgggccatgtttcagcatgccacgcgggaagccaccggcaccatctcccagaggtcaaaaagccagccctcctactcttgcccccgcaacagcatcccctccaacaactgccggctcgaataacccatgtctcacccaactcctgacagccgcaaaacccgagcaggcactggagccgccccttgtgtcctccacgcttttgcgctccccaggcagcccccaggaaactgtgcccgaatttccttgcacgtttctccctcctaccccagccccaactccacccagacctccgccgggacctgccacattggctccttcacgccccctgctagttccaaaagccgaaagactctcgcccccagcaccaagtgggtctgaacgccgcctcagtggcgatttgtcatcaatgccaggccccggtactttgagcgttagagtttcccctccgcaacctatcttgtcacgcggaagacccgactccaacaagaacagacgaatcactcatatttctgctgagcagaaacgtcgttttaacatcaagctgggctttgataccctgcacggcctggtgtcgactttaagcgcccaacccagccttaaggagcgggccggcctacaggaggaagctcagcagctgagggacgagatcgaggaactgaatgccgccataaatctctgccagcaacagctcccagctaccggcgtccctatcacacaccaacggttcgaccaaatgagggacatgttcgacgactatgtcagaaccagaaccctgcataactggaagttctgggttttcagcatcctcattcgccccctgttcgaatctttcaatggcatggtctcaaccgccagcgtacatactcttaggcaaacatctctggcttggttggaccagtattgctcactgcctgctctgaggcccaccgtcctgaacagcctgaggcaattggggacctcaacctctattctcaccgatcccggtagaattcccgaacaggcaacaagggccgtgacagagggaaccctcgggaaacccctttag

SEQ ID NO: 195617 - DNA, 2280 bp, Artificial Sequence
  Description of Artificial Sequence: Synthetic coding sequence
atggccggcgccctggccggcctggccgccggcctgcaggtgccccgcgtcgcccccagcccggactccgactctgacactgactctgaagacccatctctgagaagatccgccggggggcttctgcgctcgcaggtaattcattcgggacactttatggtgtctagcccccatagcgatagccttccccgaagacgtgatcaggaaggctccgttgggccctccgacttcggaccccgtagtatcgacccaacactgaccagactgtttgaatgtcttagcctcgcctattcaggcaaactggtttcacctaaatggaagaattttaaggggctgaaattgttatgtagggacaagatcagactaaacaacgccatctggagggcctggtatattcagtatgttaagagaaggaagagtccagtatgcggatttgtgactccactgcaggggccagaggcagatgcacaccggaaacctgaggcggtagtgctagaaggcaattactggaaacggcgcatcgagctgcctcccgaagacgcctacgtgggcaatgcggacatgattcaacctgatcttacaccgctgcagccgtctctagatgatttcatggacatctccgacttcttcaccaactcccggctgccgcagccacccatgccctcgaactttccggaacctccatccttctcaccagtagtggactcactgttctcttcggggaccctgggtcccgaagtgcctcccgcttctagcgcaatgacgcatctatccgggcattcaaggcttcaggcccgcaacagttgccccggcccactcgattctagcgcatttctatcctcggattttctcctgcccgaggacccaaaaccaagactgcctcccccacccgttccacccccacttttgcactacccacctccggcgaaggtgccgggactggaaccctgtcctcccccaccgttcccgcctatggctcctcctaccgctctgttacaggaggagcctctcttctctccacgctttccctttcctacagttccaccagctccaggcgtcagtcccctaccggcacccgccgcctttccaccaactccccaatctgtgccatctccagcccctactccattcccaatcgagcttttgcccctgggatactcagaaccggccttcggaccttgctttagcatgcccagaggaaagccccccgctccatcccctagaggccagaaggcttctcctcccactcttgccccggcgaccgcgtcccccccaactacagcaggtagcaacaatccttgcctgactcagctgttaacagctgcgaagcctgaacaggctctcgagccgcctctggttagcagtactctactccgcagcccaggctccccccaggagactgtgccagaattcccctgtacgtttttaccacctacccccgcccctacccccccaagaccaccccctggacctgctaccttggctccgagtcggccgctgctggtacctaaagcagaacgtcttagtcctcctgctccttcaggatcggaaagacggctgagcggggacttaagctccatgcctgggccggggaccctgtccgtgcgcgttagccccccgcaacccatcctgtctcgggggcggccagacagcaataaaactgagaatcgacgaatcacccacatcagcgcagaacagaaaagacgctttaacatcaaactgggttttgatacactgcacggacttgtgtctactctatcggctcagccctcgctcaaggtctccaaagcaaccacgctccagaagactgccgagtatatattgatgttgcagcaagagagagccggcctccaagaagaggcccaacagcttcgggatgagatcgaagaactcaacgccgccatcaatctctgccagcagcagctgcccgccactggagtccccattacccatcagaggtttgaccagatgagggacatgtttgacgattacgttagaacccggaccctgcacaactggaaattttgggtcttcagcatcctgattagaccactcttcgaaagcttcaacggcatggtaagcactgcttccgtgcataccctccgacaaacatccctcgcatggctggaccagtactgctcgcttcccgccctgagaccaactgtgctgaatagccttaggcagctcggtactagtacctctatcctgacagatcctgggcggatacccgagcaagccactcgcgccgtgaccgaaggcaccctgggcaagccattatag

SEQ ID NO: 195618 - DNA, 2553 bp, Artificial Sequence
  Description of Artificial Sequence: Synthetic coding sequence
atggccggcgccctggccggcctggccgccggcctgcaggtgccccgcgtggcccctagtccagactcagattccgataccgacagcgaggacccctcactcagaaggtctgccggcggactgctcaggtcacaggtgatccactcagggcatttcatggtttcgtctccccacagtgacagcttaccacgaaggcgggaccaagagggctctgtgggaccaagcgatttcggcccccgcagtatcgatcccacactgacccggctctttgagtgcttgtcattagcctattcaggcaagttagtgtcacctaagtggaagaatttcaaaggattaaaacttctgtgccgggacaagattagactgaataatgcaatttggagggcatggtatatccagtacgtaaaaagacgtaagagccctgtgtgtgggttcgtcactccactgcaagggcctgaagcagatgcacacaggaagcccgaagcagttgtgttggaaggaaattactggaagcgcagaatcgaggtggtaatgagagagtaccataagtggagaatatattataaaaagcgcctgcggaagccctcacgcgaggacgacctgctggcccccaaacaggcagagggcagatggccgcccccagagcagtggtgtaaacagttgttcagcagtgtcgtgcccgtgttacttggggatccagaagaagagcctggtggccggcagctgctcgacctgaattgtttcttgtctgatattagtgacacgctattcactatgacacagtctgggccaagcccccttcaattgccaccggaagacgcttacgtaggaaatgcagatatgattcaaccggatttaaccccactgcagccaagtcttgatgatttcatggacatctccgattttttcacaaactctaggttgcctcagccaccaatgccttccaacttcccagagccccctagcttctctccagtcgtggacagcctgttttcatcaggcactctgggccctgaggtgcccccagccagctctgccatgacgcacctttcaggccacagtagactgcaagctcgtaattcatgcccaggaccccttgattcatctgctttcctctcgtccgactttctgctgcccgaggaccccaaacctcgattaccacctccccccgtgccaccccccctgttacattatcctccacctgcaaaggtccccgggttggaaccctgtccgccccccccattccctccgatggctccaccaacagctcttttacaagaggaacccctgttttcacccagattccccttccccactgtcccccccgctccaggggtgagccctctgcctgcgccagccgcttttcccccaaccccacagtctgtcccaagtccagctcccacaccctttccaattgaactgctgcctctgggctactccgagcccgcattcgggccatgtttttctatgccaagaggcaagcctcccgccccatctcctcgcgggcagaaggcaagcccacccaccctggctcctgccactgcgtctccccctacgactgctggctctaataacccttgcctgactcagctgctgacagcagcaaaaccagagcaggcgttggagcctcccctcgtgtcgagcaccctactccggagccccggctcccctcaggaaactgtgccagagtttccctgcacgtttctcccacctacccccgcgccaacacctcccaggccgccacctgggcctgcgaccctggctccctcacgccctctactggttccgaaagcggagaggctgagccccccagcccccagtggatcggagcggagactaagcggtgacctgagttcgatgcccggccctggaacgcttagcgtgagggtgtctccaccacaacccatcttgtctaggggccgacccgactcgaacaagaacaggaggattacacacattagtgctgagcagaagagaagatttaacattaaattagggtttgacacactgcacggtttggtgagcaccctctctgcgcagccttccttaaaggttagtaaggcgactacactgcagaaaactgccgagtatattttaatgctacagcaagagcgggccgggctccaagaggaagctcagcaactgcgagacgaaatcgaggagttgaacgccgccatcaacctgtgtcagcagcaactgccagctacaggtgtgccaataacacatcagaggttcgaccagatgagagatatgtttgacgactacgtcaggacccgcaccttgcacaactggaaattctgggtcttcagcatcctgatccgtcccctctttgagagcttcaatggcatggtgtctacagcctcggtacataccctgcggcagacttcactcgcttggctcgatcagtactgctccttacctgcactgcgacccacggtgcttaattcactccggcagttgggtacctccacaagcattctaactgacccaggaagaattcctgagcaggccacacgtgccgtgacagaggggactttgggcaagccactgtag

SEQ ID NO: 195619 - DNA, 2502 bp, Artificial Sequence
  Description of Artificial Sequence: Synthetic coding sequence
atggccggcgccctggccggcctggccgccggcctgcaggtgccccgcgttgccccatcacccgatagcgattctgatacggatagcgaggatccatccttgagacggtccgcaggcgggcttttacgtagccaggtcatccacagtggtcacttcatggtctcttcaccacacagcgatagcctcccgaggagaagggaccaagaagggtcagttggaccctccgattttggaccccggtccatagatcccaccctgactaggctctttgagtgtctgtctttggcatattctggcaagttggtttcacctaaatggaaaaattttaaaggcctcaagctgctttgccgcgacaaaatacgcctcaataatgccatctggcgggcatggtatatccagtatgtgaaaaggagaaagtcaccggtgtgtggtttcgtaacccctctgcaggggccagaggccgacgctcatcgcaaaccagaagccgtggttttggaaggaaactactggaaacggcgtatcgaagtcgtcatgagagagtatcacaagtggcggatttattacaagaagcggctgagaaagccttcgcgagaagatgacctgttagcaccgaagcaggcagagggccgctggccgccgcccgagcaatggtgtaaacagctattcagcagcgtggtcccagtgttgctgggagatcctgaagaggaaccaggcggaagacagttgctggacctcaactgcttccttagtgatatcagtgacaccctttttactatgacacagtcagggccctcccccctccaactgcctccggaagacgcttacgtaggaaatgcggatatgatccagccagatctcactcctctgcagccttccctcgacgatttcatggatatttctgatttctttaccaacagtagactcccccagccccccatgccaagcaacttccccgagcccccaagcttctcacctgtggtagattctctcttttcttctgggacacttggtcctgaggtcccgccagcctcctccgccatgacccacttgtcaggtcactcaaggcttcaggcgagaaacagctgtcctgggcctctggactcttccgccttcctgagctctgacttcttactgcctgaggatcccaaaccaagattgcctcctccaccagtcccaccccccctgctccattaccccccccctgctaaggtccccggcttagaaccctgtcctcccccccccttcccccccatggctcctccgacggctctgctgcaggaagaaccgctcttcagcccaaggttcccatttcccacagtcccacccgcacctggggtatccccgctccctgccccggctgcatttcctcctacaccgcagagcgtcccttctcccgcaccgaccccattccctatcgagctgctgcccctcggctacagcgaaccagccttcggcccgtgttttagtatgcctagaggcaaaccgcccgcccccagtcctcgggggcagaaggcctccccccccactctggccccagccacagcttcacccccgaccacagctgggagcaacaacccttgtctaactcagctgttaaccgcagcaaagcctgagcaagccctggagcctcctctagtaagctctacactcctgcggagtcccggctcaccacaggagaccgtgccggagttcccatgcactttccttccacctacgccagctccaaccccacctcgaccacccccaggaccagcaaccctcgccccatctaggccacttctggtgccaaaggcggagagactttcaccccctgctccgtccgggtccgagagaaggctgagcggtgatctgtcgagcatgccaggaccggggactttatccgtgagggtgtcaccacctcagcccattttatctcgcggaagacccgattcaaacaaaacggaaaacaggagaatcacacatatcagcgcggagcagaaaagaagatttaacattaagctcggctttgataccctccacgggctcgtttcaaccttgagcgcccagccatccctgaaggaaagggccgggctgcaggaggaggcccagcaactgagagacgagatcgaggagctcaatgccgcgatcaacttatgccaacagcagctccccgccaccggcgtgccaattacacaccagaggtttgaccagatgagggacatgtttgatgactatgtcagaaccagaaccctgcataattggaaattctgggtatttagcatcctgatccgccccctgtttgagtcattcaacggaatggtgtccacagccagtgtccacactctcaggcagaccagtctcgcatggctcgatcagtattgcagcctccctgcgctcaggccgacagttttgaattcgctccgacaactgggaacctctacttctatactgactgatccagggaggattcctgagcaggccacccgggccgtgactgaaggaactctgggcaagcccctctag

SEQ ID NO: 195620 - DNA, 1059 bp, Artificial Sequence
  Description of Artificial Sequence: Synthetic coding sequence
atgaacaccatcgtgttcaacaagctgagcggcgccgtgctgttcgaggacggcggcgctagcgaacgtgagcgaggcgggcgcccttattccggagtgctggactccccccacgcccggccggaagtaggtattcctgatggacccccacttaaggacaatctgggcctccgacatcgccggactggcgcccgccagaacggcgggaaagtccggcataagcgccaagctctgcaagacatggccaggccccttaaacagtggctgtataaacatagggacaatccatatccaactaagaccgagaagatactactggctctaggctctcagatgaccctggtccaagtgtcaaactggtttgcaaatgccagacgacgcttgaaaaatactgttaggcagccggatctgagctgggctttgcgaatcaaattgtacaataagtatgtgcaaggcaatgccgagaggctctctgtcagctcggacgactcatgtagcgaagacggcgaaaatccccccaggacccatatgaacgaaggcggatataatacgcccgtgcaccacccagtaatcaagtctgaaaatagtgtaattaaagccggcgtgcgacctgagagccgtgcctccgaagattatgtcgcaccccctaaatataagtcttccctgcttaacagatacctgaatgatagtttacgccatgtgatggccaccaacacaaccatgatgggcaaaactcgacagcgtaatcattctggtagtttctcctcaaatgagttcgaggaagagctggtatccccatcatcctctgaaaccgagggcaacttcgtgtaccgaacagacacactggaaaacgggtcaaacaagggggagtcggccgccaacaggaagggacctagtaaagacgacacctactggaaagagattaacgctgcaatggcactgactaatcttgctcagggaaaagataaactccaggggactacctcatgtataattcaaaaaagttcccacattgctgaggtgaagacagttaaggtgcctctcgtccagcaattttag

SEQ ID NO: 195621 - DNA, 1059 bp, Artificial Sequence
  Description of Artificial Sequence: Synthetic coding sequence
atgaacaccatcgtgttcaacaagctgagcggcgccgtgctgttcgaagacgggggggcgtctgaaagggaaagagggggcagaccttattccggcgttctagacagcccacatgcgcgtcctgaggtgggtataccagacggcccaccgctgaaggacaatctgggtctgcggcatagacggaccggagcacgacagaacgggggaaaagtgcggcacaagagacaagcactccaagacatggcacggcctctcaagcagtggttatataagcaccgagataacccatatcctacaaagacagagaagatcctgttagctctcgggagccagatgactctggtccaggtgagcaactggtttgcaaacgcgcggaggagactcaagaatactgtccggcagccggacctctcctgggctttgcgcataaaattatacaataagtacgttcaagggaatgcggaacggcttagcgtctcctccgacgactcatgctccgaagacggcgagaacccccccagaacacatatgaacgagggtggatacaacactcctgtccatcacccagtcatcaagtcagagaattctgtaatcaaggccggcgtccgtccagagagccgggcctccgaagattatgttgctcctccgaaatacaaatccagtctactgaatcgatatttgaacgattcacttcgccatgtcatggctacaaacaccacaatgatgggaaagacccgccaaagaaaccactccggcagcttcagctcaaacgaattcgaagaggaactggtttcccccagctccagtgagactgaaggaaacttcgtgtaccggactgacacactggaaaacggatcaaataagggcgagtcagctgctaataggaaggggccaagtaaggacgacacatactggaaagagatcaatgccgcaatggccctcacaaacctcgcccaagggaaggataagctgcaggggaccacatcgtgcattattcaaaaatccagtcatattgccgaggtgaaaacagtaaaggtcccgttggtgcagcaattctag

SEQ ID NO: 195622 - DNA, 177 bp, Artificial Sequence
  Description of Artificial Sequence: Synthetic coding sequence
atgaacaccatcgtgttcaacaagctgagcggcgccgtgctgttcgaagacgggggtgcatcagagcgggaaagaggaggcagaccctacagtggggtgctcgactcgcctcatgcaagacctgaggttggcatacctgatggacctccgttaaaggataatctcgggctgcgctag

SEQ ID NO: 195623 - DNA, 288 bp, Artificial Sequence
  Description of Artificial Sequence: Synthetic coding sequence
atgaacttcgacttccccttcaagaagggcagcggcatccccctgcttaccacaaacctaagcccgcagtgtctctcactgctccacgcgatggtggcatatgacccagatgagagaatcgcagctcaccaggccctgcagcacccctattttcaggagcagcgcacacagaatggctctgaagacgaggccagcgccgtattgctgcctatccaaacccgctcgtctcttaatcccctgctgagtacctgtatgctgccaggtcgctccgtcaccctgctggtatag

SEQ ID NO: 195624 - DNA, 1260 bp, Artificial Sequence
  Description of Artificial Sequence: Synthetic coding sequence
atgaagaactacaaggccatcggcaagatcggcgagggcaccttctctgaggtgatgaaaatgcagagtctgagggacggaaattactacgcctgtaaacaaatgaaacaacggtttgagagcatcgaacaggtgaataatctgagagaaattcaagctctgaggaggctgaacccacatccaaatattctgatgttgcacgaggtggtgttcgaccgtaagtcaggttctctcgcattaatttgtgagctgatggacatgaacatttatgagcttatcaggggacggcgataccctctgtcggaaaaaaagatcatgcattatatgtaccagctatgcaagtccctcgatcatattcaccgcaacggaattttccaccgggatgtgaagccagaaaatattctgataaaacaggacgtactcaaactcggcgatttcggcagttgccgctcagtttattcaaagcagccatatacagaatacatctctacaagatggtaccgggcccctgagtgtctgcttacagacgggttttacacctataaaatggatctgtggtccgcagggtgcgtgttttacgagatcgccagtctacagcctctgttccctggagttaatgagctagatcaaatctccaagattcacgatgtgatcggtacgcctgcccagaagatccttacaaagtttaaacaaagtcgcgcaatgaactttgactttccatttaaaaagggcagcgggataccgttgctgactaccaacttgtctcctcagtgcctgtccctgttgcatgccatggtggcctatgatcctgacgagaggatcgctgcccaccaggccctgcaacacccctattttcaggagcagcgtaagacagagaagagagcgctcggtagtcatcggaaggcaggtttcccagagcaccctgtcgccccagaacccctgtccaacagctgccagatcagtaaggagggtcgcaagcaaaagcaaagtcttaagcaagaggaggacagaccaaaaagacggggacccgcttatgtaatggagcttccgaagttgaaacttagtggagtggtcagactgagcagctatagctcaccgaccttgcagtccgtactgggttcaggcactaacggtagggttcctgttctgagaccactcaaatgtatcccggcttctaagaagaccgatccacagaaggacctgaagccagccccgcagcagtgccgactgccaaccatagttagaaaaggtggtagatag

SEQ ID NO: 195625 - DNA, 2667 bp, Artificial Sequence
  Description of Artificial Sequence: Synthetic coding sequence
atggccggcgccgccgccgagagcggccgggagctgtggaccttcgcaggtagccgggacccgtccgccccgaggctcgcgtacggctacggaccggggtcactgcgagagctgagagccagggagttttcaaggttagccgggactgtctacctggaccatgctggtgccacactgttttctcagtcgcagctggagtcttttaccagcgatctaatggagaacacctatggcaacccccatagccaaaatatttcctcaaagctgactcatgacactgtggaacaggtgagatacaggattttagcccatttccatacaaccgccgaggactacaccgtgatattcaccgcgggaagtaccgctgctcttaaactcgtggcggaggcgttcccctgggtgtcccagggacccgagagcagcggctcgagattttgttatctgaccgactcacatacaagcgtcgtgggcatgaggaacgtcaccatggcaatcaatgttatcagtacaccagtgagaccggaggacctatggtcggccgaggaaaggtccgctagcgcgtctaaccctgattgtcagttaccacatctgttttgctacccagctcaatcgaactttagtggggtgcgctaccctctgtcatggattgaagaggttaagagcggccggctgcatccggtgagcacacccggcaagtggtttgtactcctagacgctgcctcttatgtgtcgacatcacccttggacctgtccgcacaccaagcggactttgttcccatctctttttataagattttcggcttcccgacagggttgggagccttgctggttcataaccgggctgcaccactgctccgaaaaacgtacttcgggggtgggacagcttcggcctacctcgcaggtgaggacttctatatccctaggcaaagcgtagctcagcgctttgaggatgggaccatttctttcctcgatgtgatcgccctgaaacatggattcgataccctggaacgattgacaggaggaatggagaacatcaaacaacatacatttaccttagcccagtatacttatgtcgctctctccagtcttcagtacccaaacggcgccccggtggtgcgaatttattctgactccgagttctcctcgcccgaggtccagggccccataattaatttcaacgtgctggacgataaggggaacattatcgggtactcgcaggttgacaagatggcctctctttacaacattcacctgagaacgggctgtttctgcaacacaggcgcatgtcagcgccacctgggtataagcaatgaaatggttaggaagcatttccaagccggacacgtatgcggcgataacatggacttgatagatggacagcccaccgggtcagtccggatcagcttcggctacatgtccactttggatgatgtacaggcttttctcaggtttatcatcgatacccgattacatagcagcggagactggcccgtgcctcaagcacacgccgacactggcgagactggcgcccccagcgctgattcccaggccgacgttatacctgccgtcatgggcaggcgatccctcagcccacaggaagacgcactaaccggctctagagtttggaataactcaagtaccgtaaacgccgtgccagtagcaccccctgtctgtgacgttgcacggacccaaccaacaccatccgagaaggccgcaggagtgctggaaggcgcactggggccacatgtggtcactaacctgtacctctaccctataaaaagttgcgccgcgttcgaggtgacaaggtggcccgttggcaaccagggattgctgtacgatcggagttggatggtggtgaatcacaatggggtttgcctcagccagaagcaggagccccggctgtgtctgatacagcctttcattgatttgagacagagaatcatggtgatcaaggccaaaggcatggagcctatcgaggtcccactggaggagaattctgagaggactcagatacggcaatcgcgcgtctgcgcggaccgggtgtctacctacgactgtggagaaaagatcagctcctggttgtcaacattttttgggagaccatgccaccttatcaagcagtcctcgaattcccagcggaatgccaagaagaaacatgggaaagatcaattgcccggaaccatggctactttatcgctggtaaatgaggctcaatacctcctgattaatactagctccatcttagaactgcatagacagctcaatacttctgacgaaaatggcaaggaggagcttttttcattgaaggacttgagtctgcggttccgagctaacattattattaatgggaagcgggcgttcgaggaagaaaaatgggacgagattagtataggctcactgagattccaggtgttgggtccatgccaccgatgtcagatgatctgcatcgaccagcagacgggtcagcggaaccagcacgtgtttcagaagctctctgaatctagggaaacaaaagtcaatttcggcatgtatctgatgcacgccagccttgacctgagcagtccttgtttcttgtctgttgggtcccaggttctcccagtcctgaaagagaatgttgagggccacgacctgcccgcaagtgagaaacaccaggatgtgacttcctag

SEQ ID NO: 195626 - DNA, 1863 bp, Artificial Sequence
  Description of Artificial Sequence: Synthetic coding sequence
atggccgcccggcccctgagccggatgctgcggcggctgctgcggagcagcgccaggagctgctcctcaggtgcccccgtgacgcagccctgtcccggggagtccgctcgcgctgcctcagaggaagtgtctcggaggaggcagttcctgagagagcacgcggcaccttttagcgcctttctgacggactccttcgggcgtcagcacagctacctgcggataagcctcaccgagaagtgcaacctgcggtgtcagtattgtatgcccgaggagggcgtgcctctgactcctaaggctaacctcctcactaccgaagaaattctgactctggctcgactgttcgtgaaagaggggattgacaaaattcgcctcacaggcggtgaaccattgattcgccccgacgtcgtcgacatagtagcacagcttcagcgccttgaaggcctgaggacaattggcgtgactacgaatggcatcaaccttgccagactgttgccacaactacaaaaagcggggttatccgctatcaacatctcattggacaccttggtacccgcaaagtttgagttcatcgtgcgtaggaaggggtttcacaaagttatggaaggtattcacaaagcaattgagctgggttataatcccgtgaaagttaattgtgtggtcatgcgagggctaaacgaggacgaactgctggatttcgcagctctgacggagggccttcccctagacgtcaggtttatagagtatatgcctttcgatggcaacaagtggaacttcaagaaaatggtgagctataaagagatgctggatacagtgcgccagcagtggcccgaactggagaaagtccccgaggaggagtcatccacagccaaggcatttaagattccaggattccaggggcaaatcagctttatcacctccatgtctgaacatttctgtggaacatgtaaccggctgaggatcaccgccgacggaaacttgaaagtctgccttttcggcaacagcgaagtgagcctgcgcgatcatctgcgggccggcgcttctgagcaagagcttctgcggatcatcggggcagcggtgggacgcaaaaagcgacagcatgctgaacttttcctcatgttcccaaatagtccaccagcgaacccatccattttttcttgggaccctttgcatgtgcagggactgaggcccaggatgtctttctcttcccaggtcgcgacactctggaagggatgtcgcgtgccccagaccccacccctcgcccagcagcgtctgggctccggctccttccagcggcattataccagtcgggccgactccgacgctaacagcaagtgtctctcgcctggaagctgggcttctgctgctccctctggcccgcagctcaccagcgagcagttaacccacgttgactccgagggccgtgccgctatggttgacgtcggaagaaaacccgacacggaaagggtcgcagtggcttcggctgtggtgctcctgggacccgtggcatttaaactcgttcagcagaatcagttgaagaagggggacgccctggtggttgctcaactggcaggcgttcaggccgcaaaggtgactagccaactgattccattgtgccatcacgttgccctgagccacatccaggttcagttagagctggacagcacacgtcacgccgtgaaaattcaggcgtcctgcagagccaggggccctacaggcgtggaaatggaggctctaacatccgccgcagttgccgcactgactctgtacgacatgtgcaaagctgtctcccgtgatatcgttttagaagagataaaactcatcagcaagacggggggacagcgcggagatttccaccgcgcttag

SEQ ID NO: 195627 - DNA, 1911 bp, Artificial Sequence
  Description of Artificial Sequence: Synthetic coding sequence
atggccgcccggcccctgagccggatgctgcggcggctgctgcggtcaagcgctaggtcctgttcctccggggcaccagtcacacagccttgtcccggggaatcagcacgggctgcctcagaagaggtcagccgtcgcagacagttcttgcgtgagcatgctgcccctttctcagcgttcctgaccgactcttttggaaggcaacatagctatctgaggatttccctgaccgagaagtgcaatcttcgttgccagtactgtatgccagaagagggagtgcctttaactcccaaagccaacttgttaacaactgaagagatacttactctggcacggttgtttgttaaggaaggcattgataagatcagactaaccggcggcgagcccttgattcggcccgacgttgtcgatatcgtagcacagctacaaagactcgaagggcttaggacaatcggagtgactacaaacggtataaacttggcaagactgctcccccagttgcaaaaagctgggttgagcgctattaacatctccctggataccctcgtgcctgctaagtttgagtttattgtgcggcgaaaaggattccacaaggtaatggagggcatacacaaggcaattgagctaggctataacccagtcaaggtcaactgcgtcgtgatgaggggtctcaatgaagatgaattgctggattttgctgctctgacagaaggcctaccacttgacgttagatttatcgagtacatgcctttcgacggcaataagtggaacttcaaaaagatggtgtcctacaaagagatgctggatacagtaagacaacaatggccggagcttgaaaaagtaccggaagaggaaagcagcaccgctaaggcttttaagatccccggatttcaaggccaaatctcattcataacctccatgtccgaacatttctgcgggacatgcaacagattaaggataacagccgatgggaacctcaaagtttgcctattcggcaactccgaagtgtcccttagagaccatctaagagccggagcgagtgagcaggaactcctgcgtatcataggagctgcggtggggcggaaaaaaagacaacatgctggcatgttttctatctctcagatgaagaaccggcccatgattttgattgaactctttcttatgtttcctaattctcctcccgcgaacccctccatctttagttgggatcccctacatgttcagggcctgagaccgagaatgagttttagttctcaagtcgctaccctctggaaggggtgccgggtccctcaaactccaccacttgcacaacagcgcctggggagcggtagttttcagaggcactataccagcagggccgatagtgacgcaaattctaaatgcttgtctcccggttcctgggcctccgcagccccttctggccctcagctaacttcggaacagcttacacatgtagatagcgagggacgcgctgccatggttgatgtgggcaggaaacccgataccgagagagtcgcagtggcctccgcagtcgttctcctgggtccagtggcctttaagcttgtgcagcagaaccagctgaaaaagggagacgcgctcgtggtggcacagctggctggagtgcaggctgccaaggtgacgagccagctcatcccactgtgtcaccacgttgccctctcccatatccaggtccaactggagctggacagcacccgccacgctgtgaaaattcaggcatcatgcagagctagggggccaaccggggtggagatggaagccctgaccagtgcagctgtcgccgccttgaccctgtatgacatgtgcaaggccgtgagtagggacatcgttctagaagagattaaattgatttccaagacgggaggacagcgcggggacttccaccgggcctag

SEQ ID NO: 195628 - DNA, 456 bp, Artificial Sequence
  Description of Artificial Sequence: Synthetic coding sequence
atgcccttcgacggcaacaagtggaacttcaagaagatggtgagctacaaagaaatgctggatacagttaggcagcaatggccagaactggagaaggtccctgaagaggagagtagcactgccaaggcgtttaaaattcccgggttccaaggacagatctcttttatcacttcaatactgaccgtcgcgcgttcctgttggccattgtttctctggccgccaagcagtgagaccggctgtgcacatatgggccatagtccaaaagatagctgtcagacaacccagcctaccccaggacccgtgcacggctgctccactcatccgtctctgttctggtcgatctcaggaaaagaaaaattgatgatcgactgcctgcatcctcactccgctcagatcaaactgagatgccaactgtgtcgctgcaaaaatgaggacactgtctgggttgggcactag

SEQ ID NO: 195629 - DNA, 1071 bp, Artificial Sequence
  Description of Artificial Sequence: Synthetic coding sequence
atgtggaagagctggaagctgcggaccgacgtgcgggaggtgagccgccgccgccagtttttgcgcgaacacgcagcacccttctctgcattcctgaccgactccttcggccgccagcacagctatctgaggatctccttgacagagaaatgcaacctgagatgccagtactgcatgcctgaggaaggagtgccccttactccgaaggccaatctgctgaccaccgaggagatcctgacactggccaggctcttcgtcaaggagggtatagataagatccgtctgacgggcggggagcctttgattcgccccgacgttgtcgacattgttgctcagctgcagcgacttgaaggacttcgaactatcggggtgaccactaacgggataaatctggcacgtctgttgcctcaactgcagaaagctggcctgtccgccatcaacatttcactggatactctggtgcccgccaagtttgagttcatagtgcgcaggaaaggctttcacaaagtgatggaagggatccacaaggctatagagttaggatacaaccctgttaaagtcaactgtgttgtgatgcgcggcctgaatgaggacgagctgcttgattttgccgctctcaccgaagggctcccccttgacgtccgatttatcgaatacatgcctttcgacggtaacaaatggaacttcaagaagatggtgtcctataaagagatgctcgacacggtgagacagcaatggccggagctggaaaaggtcccagaagaagaaagcagcaccgccaaagctttcaaaattccggggttccagggacaaatcagctttattacctctatgtctgagcatttttgcggcacctgcaatcgtctgaggattacagccgacggcaatctgaaagtgtgcctgtttggtaacagcgaggtgagcctgcgcgatcacctgagggcaggcgcttccgagcaggagttattgcgtatcattggtgccgctgtgggaagaaagaaacgccagcatgccggaatgttctcaatttctcagatgaagaatcgccccatgatactgatcgggggatag

SEQ ID NO: 195630 - DNA, 1158 bp, Artificial Sequence
  Description of Artificial Sequence: Synthetic coding sequence
atgtggaagagctggaagctgcggaccgacgtgcgggtgcgggagggcgccggcggtagcccctgtgcatcctcgcagcctgggtccaggggcccctgttttctgccagggttgagcagccaggaggtgagcaggagacgtcagttcctcagagaacacgccgcccctttctctgcttttctcaccgatagctttggtcggcagcactcctatctgagaatttcactgacagagaaatgtaacttgagatgccagtactgcatgcctgaggagggggtgccactgacaccaaaggcgaatctgctgacaaccgaagagatccttacgctggccagattgtttgtcaaagagggtatcgacaagattcggctcacgggcggcgaacccctgatacggcccgatgttgtggacatcgtggcccagctccagcgtctggagggcctacgtactataggagtgacgacaaacggaatcaacctggccagactgttacctcagctccagaaagcgggtctttccgcgatcaatataagcctggacacacttgtacccgccaaattcgagttcattgtgaggcggaagggctttcacaaggtgatggagggcatccacaaggcaattgagctgggatacaaccctgttaaggtgaattgcgtagtcatgcgaggtctaaacgaggacgagctattggatttcgctgctctaacagaaggacttccgctggacgtgcgatttatagagtacatgccttttgacggtaacaaatggaactttaaaaaaatggtgtcttataaggagatgctggatactgttcgccagcagtggcccgagctggagaaggttcccgaggaggagagcagtacagccaaagcatttaaaattcccgggtttcaggggcaaatttcattcatcacttctatgtcagagcatttttgcgggacctgcaacaggctgaggatcacagccgacggaaatctgaaggtctgtctgtttggaaactccgaagtatcccttcgggaccatttgagagcaggtgcctctgagcaggagctgcttcgcattatcggcgccgccgtcgggagaaaaaaacggcagcatgccggaatgttttccatttcccagatgaagaatcgacctatgatcctaatcggaggctag

SEQ ID NO: 195631 - DNA, 1158 bp, Artificial Sequence
  Description of Artificial Sequence: Synthetic coding sequence
atggccgcccggcccctgagccggatgctgcggcggctgctgcggtctagtgccaggtcctgtagctccggcgcccctgtcacccagccgtgcccgggcgagtctgccagggccgctagtgaggaggtgtcacgacgccgacaatttctgagggagcacgcagcccctttttcagcattcttaacagatagctttgggagacagcacagttatctgagaatttcactgaccgagaaatgcaatttacgttgtcaatactgcatgcctgaagagggagtcccgctgacccccaaagctaatctcctgaccaccgaagagatcctaactctggccaggctcttcgtcaaagagggaatcgataagatcaggctgaccgggggggaacccctaatcagacctgacgttgtcgatattgttgctcagctgcagcgcctcgagggactgcggaccattggagttacaaccaacggaattaacctcgcccgtctactcccacagctgcagaaggctggcctatccgcaatcaacatttcccttgatacccttgtgcccgccaaattcgaattcatcgtccgcagaaagggttttcataaagtgatggagggcatacacaaagccatcgagctgggttacaacccagtgaaagtcaactgtgtggttatgaggggtttaaatgaggatgagctgctggacttcgccgcgctgactgaagggttacctttggacgtcaggttcattgagtacatgccgttcgacgggaacaaatggaatttcaagaagatggtctcgtacaaggaaatgttagacactgtgcgtcagcagtggccagagctcgagaaagtgcccgaggaggagagctccactgccaaagccttcaagattcctggtttccagggacagatcagctttatcacgtctatgtcagaacatttctgcggcacctgtaatcgcctgcggatcacggcagacggcaacctcaaagtctgtctcttcggcaattccgaggtgagcctgcgagaccatctaagagctggtgcaagtgaacaggagttgctgcgcatcatcggtgctgccgtgggtcgtaagaaaaggcagcacgcaggcatgttctccatctcgcaaatgaaaaacaggccaatgatcctgatcggcggctag

SEQ ID NO: 195632 - DNA, 1602 bp, Artificial Sequence
  Description of Artificial Sequence: Synthetic coding sequence
atgcccgaggagggcgtgcccctgacccccaaggccaacctgctgacaactgaggagatcctgacactggcacggttgtttgtgaaagaaggtatcgataagatccgccttacaggaggagagccgttgattcggcccgacgtggtcgatatcgttgctcagttgcagagactcgaggggctgcgtaccatcggtgtgaccacaaatggaattaatttggctaggctgcttccccaactccagaaagctgggttgtctgctatcaacatttcactagatactctggtgcccgctaagtttgagtttatcgtgagaagaaaggggttccacaaggttatggagggaatacataaagctatcgaactgggctataatcctgtgaaggtgaattgcgtcgtgatgagaggacttaacgaggatgagctgctggacttcgcagcattaacggaaggccttcctctggacgtcaggtttatcgagtatatgccgtttgacggaaacaagtggaatttcaagaagatggtgtcatataaggagatgcttgacacggtccggcagcaatggcccgaactggaaaaggtccctgaagaggaatctagcactgcgaaggcattcaagatacctgggttccaggggcagatatcttttataacaagcatgtccgaacatttttgtgggacgtgcaaccgtcttcggatcaccgccgacggtaacttgaaggtctgcctgtttgggaatagcgaggtcagcctccgggatcatctgcgggccggcgcctccgagcaagagttgttgagaattataggtgctgcagtgggtcggaaaaagagacaacacgctgagcttttcttgatgttccccaattcaccgcccgcaaacccctcaattttttcctgggacccactgcacgtccaaggcctccggccccgcatgtctttttcaagccaggttgccacactgtggaagggttgtcgcgtgcctcagacaccaccgctggcgcagcagcgccttgggtccgggtccttccagaggcattacacatcaagggcagactccgacgctaactctaaatgcttgtcccccggaagctgggcttccgccgcacctagcggcccccagctcacatccgagcaactcacccatgttgacagtgaaggccgcgctgccatggtggatgtcggacggaagccggatactgagagagtcgctgtggcgagcgctgtcgtgttactagggccagtagcctttaaactagtacaacagaatcagcttaaaaagggcgatgctttagtggttgcccagcttgccggggttcaggccgctaaggtgacttcacagctaattccattgtgccaccacgtagcgctgtcacatatccaggtccagctggagcttgattccacacggcacgcagttaagatccaggcctcctgcagggctaggggcccgacaggcgtcgagatggaggctctgacgtctgctgcagtggcagcattaactctgtacgacatgtgcaaggccgtgtcaagagatattgtactagaggagatcaagctgatatccaagaccggcgggcagcggggagattttcaccgggcctag

SEQ ID NO: 195633 - DNA, 1911 bp, Artificial Sequence
  Description of Artificial Sequence: Synthetic coding sequence
atgtggaagagctggaagctgcggaccgacgtgcgggtgcgggagggcgctggtggatctccctgcgctagcagtcagccagggagtcgtggtccatgctttcttccaggcctgtcttctcaggaggtctcccgcaggagacagttcctacgagagcacgctgcaccattctccgcctttctgaccgactcattcgggcggcagcactcatacttgcgtatttctcttaccgaaaaatgtaaccttcggtgccagtactgtatgcctgaggagggcgtgcctctgacgccaaaagcgaatcttcttacgacagaggagatcctgactttagcacggctcttcgtaaaagaaggaattgataaaatcagactaaccggcggagagcctttgattcgacctgacgtggtagacatcgtggcgcagttgcagcggctggaaggtcttcgcactataggagtgactacaaatggcatcaacttagctcgcctcctcccccaattacagaaggctggcctcagcgccatcaatatctctctggacaccctagtccccgccaagtttgagttcatcgtgcggcggaaggggttccataaagttatggaaggaatccataaggctattgaattggggtacaatccagtcaaggtgaattgcgtcgtgatgcgaggccttaacgaagacgaattgcttgactttgccgccctgacagaaggactgcctttagatgtccgtttcatcgagtacatgcccttcgacggaaataaatggaactttaagaagatggtcagctataaggagatgctcgatacagtccgtcagcagtggcccgagctggaaaaagtgcccgaagaagaaagctccaccgcaaaggctttcaaaatccccgggtttcagggccagatcagcttcattacctcgatgtcagagcacttctgcggcacatgtaaccggctccgcattaccgcagatggcaacttgaaggtatgtctatttggaaactcagaagttagcctgcgagaccacctgcgagccggagcatccgagcaggaattactgcgtattatcggggctgcagtcgggcgaaagaaacgacagcacgccggcatgttttcaattagccaaatgaaaaatcgccccatgatcttgatcgagctcttcctaatgtttccaaattcgcctcctgccaacccctcaatatttagctgggacccgctacacgtgcaaggcctcagaccccgaatgagcttctcatctcaggtcgcgaccctgtggaagggctgcagagttccgcagacaccgccattggcccagcagcgcctgggctccggatcctttcagagacattatacgtctcgcgcagacagtgacgcaaactcgaagtgtctcagccccgggagttgggcctctgccgccccctctggcccccagctgacaagcgagcaactgacacatgtcgactctgaggggcgcgcggccatggtagatgtggggagaaagcccgacacagaacgcgtggccgtggcctcggcggttgtgcttctgggacccgtcgctttcaagctcgttcaacagaatcaactgaagaagggggatgccctcgtggtcgctcagctggccggtgttcaagcagccaaagtcacatcgcagttgatcccgctctgccatcacgtggctctttcccacatccaggttcaactggaactcgacagcacacgacatgccgtgaaaattcaagcctcttgtcgggcccgtgggccaactggggttgaaatggaggctttgacgagtgcagcagtggctgccctcactctgtacgatatgtgcaaagcggtttctcgggacatcgtgctggaggagattaaactaatttccaaaacaggggggcaaagaggggactttcaccgggcctag

SEQ ID NO: 195634 - DNA, 1071 bp, Artificial Sequence
  Description of Artificial Sequence: Synthetic coding sequence
atgtggaagagctggaagctgcggaccgacgtgcgggaggtgagccggcgccggcagtttctcagggaacacgccgctcctttctccgcttttctgactgattcatttggcagacagcacagttatttgcgcatcagcctcacagaaaaatgcaatctccgctgtcaatactgtatgccagaagagggcgtgcctcttactcctaaggcgaacctgcttacgactgaggagatcttgactttagcacgattgttcgtaaaagagggtattgacaagatacgcctgacagggggcgaacccctcatccggccagacgttgtggacatagtggcgcagctgcagcgcctcgaaggcttgagaacaatcggcgtgacaacgaacggtattaatctggctagattgctgcctcagttacagaaggcaggcctctctgccatcaatatctctttagacaccctcgttccagccaagtttgagtttatcgtaagacgaaaaggttttcacaaggtcatggaaggcatccacaaagccattgaactgggctacaatcctgtgaaggtcaactgtgtggtgatgagaggccttaatgaggacgagctgctggatttcgcagcacttaccgagggtcttccacttgacgtgagattcattgaatatatgccatttgacgggaataagtggaattttaaaaagatggtaagctataaagagatgcttgacaccgttcgccaacagtggcccgagcttgaaaaggtcccagaggaggaatcgtccaccgccaaagcttttaagattcccgggtttcagggccagatctcatttatcacatccatgagcgagcacttctgtggtacttgtaacagacttcgcatcacggccgacggcaatctcaaagtttgtctcttcggaaactctgaggtgtccctgagagaccatcttagagcaggcgcttctgaacaggagctcctgagaattatcggcgctgccgtcgggagaaaaaagcgtcagcatgccggaatgtttagcattagtcagatgaagaatcgaccaatgatcctgattggcggctag

SEQ ID NO: 195635 - DNA, 267 bp, Artificial Sequence
  Description of Artificial Sequence: Synthetic coding sequence
atggtgcccctgtgccaggtggaggtgctgtacttcgccaagagcgccgaaattacaggggtgagatcggaaaccatttcagtcccccaggaaatcaaagcccttcagctgtggaaagagatcgagacccgccatcctggacttgcagacgtgcggaaccagatcatattcgctgtccgccaggagtacgtagagctcggcgatcagctccttgttctgcagcccggagacgagattgcagtcatccccccaatcagtggaggctag

SEQ ID NO: 195636 - DNA, 567 bp, Artificial Sequence
  Description of Artificial Sequence: Synthetic coding sequence
atgagcagcctggagatcagcagcagctgcttcagcctggagaccaagctgccactctctccaccgcttgtggaggactctgcttttgaaccatccaggaaagacatggatgaagtggaagagaaatccaaagacgtgataaattttaccgcagaaaagttgtcggtggacgaagtcagccagctggttatcagccccctctgtggcgctatcagtcttttcgtggggacgactcggaataactttgagggcaagaaggtcatttccctggagtacgaagcttatctgccaatggccgaaaatgaggttcggaaaatttgttctgacatccgccagaaatggcctgttaagcacattgcagtcttccataggctaggtctggtgcccgtgtccgaggccagcatcattatcgctgtgtcaagcgctcaccgcgccgccagcttagaggcagtgtcttacgcgatcgatacgctgaaagccaaggtacctatttggaagaaggaaatctatgaagagtctagtacttggaaaggcaacaaagagtgtttttgggcaagtaacagttag

SEQ ID NO: 195637 - DNA, 267 bp, Artificial Sequence
  Description of Artificial Sequence: Synthetic coding sequence
atggtgcccctgtgccaggtggaggtgctgtacttcgccaagagcgccgagataaccggagtgcggagcgaaaccatttctgttccacaggagataaaggcgctgcaactctggaaagagattgagactaggcaccccggacttgctgatgttaggaatcagatcattttcgcagtgaggcaggaatatgttgagctgggcgaccagcttctggtcctgcaaccaggagatgagattgcagtcatcccacccatttcagggggttag

SEQ ID NO: 195638 - DNA, 267 bp, Artificial Sequence
  Description of Artificial Sequence: Synthetic coding sequence
atggtgcccctgtgccaggtggaggtgctgtacttcgccaagagcgctgaaataacaggggtacgctctgaaactatttcagtgccacaagagattaaggccttgcagctgtggaaggagattgaaactcgtcatcccgggctggccgatgtgcgcaaccagataatcttcgccgtgaggcaggagtacgtcgagcttggcgaccagctcctggttctgcagccaggggacgaaatcgccgtaatcccccccatttcaggaggctag

SEQ ID NO: 195639 - DNA, 267 bp, Artificial Sequence
  Description of Artificial Sequence: Synthetic coding sequence
atggtgcccctgtgccaggtggaggtgctgtacttcgccaagagcgcagagatcactggagtgaggagcgagaccatttcagtgccccaggaaatcaaggcattacagttgtggaaagaaattgaaacacgtcaccccgggttagcagacgttcgcaatcagattattttcgccgttcggcaggagtacgttgagctgggggatcaactgctagtgctgcagccgggcgatgaaatagccgttatacctcctatttctggtgggtag

SEQ ID NO: 195640 - DNA, 462 bp, Artificial Sequence
  Description of Artificial Sequence: Synthetic coding sequence
atgagcagcctggagatcagcagcagctgcttcagcctggagaccaagttaccactgagccctcctttggtggaggatagcgcgtttgaaccctccagaaaagacatggacgaggttgaagagaaatctaaggacgtcatcaattttactgctgagaagctcagtgtcgatgaggtgagccagctggtgatctcacctttatgcggggccataagtttgttcgtagggaccacccgtaataactttgaaggcaagaaggtgatcagtttagaatacgaagcttatttaccaatggccgagaatgaagtgcggaaaatttgcagtgacataaggcagaagtggcccgtcaaacacatcgcggtgttccaccgactgggccttgtgcctgtgtctgaggccagtatcattattgcagttagctccgcccaccgcgcagcatcactcgaggccgtctcttactag

SEQ ID NO: 195641 - DNA, 1644 bp, Artificial Sequence
  Description of Artificial Sequence: Synthetic coding sequence
atggaggtgggcggcgacaccgccgcccccgcccccggcggcgccgaagaccttgaggatacccagttcccatccgaggaggcccgggagggggggggggtgcatgccgttcccccggatcccgaagacgaagggctggaggagaccgggagcaaggataaagaccagccccccagtccttcaccccctccacagtccgaagccttgtcctccaccagccggctctggtctcccgccgcccctgaaaactcccccacctgtagtccagaatcatcgagcgggggccagggaggagatccttcagacgaagagtggcgttcgcagagaaagcatgttttcgtgttgtctgaggctggcaaaccaatctacagccgctatggaagcgtggaggctctaagtgccactatgggggtgatgaccgctctggtgtcatttgtgcagtctgccggcgacgccattcgggccatctacgccgaggaccataaactcgtgtttctgcagcagggccctctgctgttagtagccatgtcacgcacctcccagagtgctgcccagctgcgaggtgagctgctggctgtgcacgcacaaattgtgtcaacactgacgagggccagcgtggctcggatattcgctcacaagcaaaactacgacctgcggcgactgttagctggcagcgaaaggacactggatcggttgctggatagcatggaacaggatccaggcgcgctgctcctgggagctgtgcgctgtgtcccactcgcccggcctcttcgggacgcattgggcgctcttctgaggagatgtacagcccctggactggcactgagcgttctggcagtaggcgggcggctgataactgccgcccaggagcgtaatgtgctcgcagaatgtcgcctcgatcccgccgacctacagctcctcctcgactgggtgggcgctcctgcctttgcggccggggaggcctgggccccagtgtgcctgccacggtttaaccccgatggcttcttttacgcatacgtggctcggctcgacgctatgccagtctgcctgctgctgctgggcacacagcgcgaggctttccacgcaatggccgcttgcagacgtctggtggaagatgggatgcacgcccttggcgccatgcgagcgctaggtgaagccgccagcttcagcaacgcttcctctgcaagtgctccagcttactccgtgcaggctgtgggtgcccccggattgaggcatttcctgtataaacccctggacattccagaccatcatagacaattgccacaatttacatctccggaactcgaagctccatattccagggaggaggaaaggcagcggctatctgatctgtaccatagactgcatgcccggttacacagcacatccagacccctgaggctgatctatcacgttgcagagaaagagacactgctagcttgggtgacaagcaaatttgagctttacacatgcctgtcccctctagtaacaaaggctggagcaatcctggtcgtaacaaaactgttgaggtgggtcaagaaagaagaggaccgactgtttattcgatacccgcctaaatattcaaccccgcccgccacttcaacagaccaggcagctcataacggactctttacaggcctatag

SEQ ID NO: 195642 - DNA, 438 bp, Artificial Sequence
  Description of Artificial Sequence: Synthetic coding sequence
atggaggtgggcggcgacaccgccgcccccgcccccggcggcgccgaggacctggaggacactcagttcccttcagaggaggctcgtgaaggcggaggggtgcatgctgtgccaccggatccagaagacgagggactggaagagaccggctctaaggacaaggatcaaccacctagcccgagccctcccccccagtccgaagctctgagctcaacctctcgcctctggtctcccgcagcccccgagaatagccccacctgttctcctgagtcctcatctgggggccagggcggcgatccttccgatgaagaatggaggtctcagcgtaacggctgccgcacgtgtacgactgcctgtatgttagtgtctacagcccctcccgatccctgtgctagttttacgacttggcttaggaggagacactactggccaggttag

SEQ ID NO: 195643 - DNA, 1317 bp, Artificial Sequence
  Description of Artificial Sequence: Synthetic coding sequence
atggaggtgggcggcgacaccgccgcccccgcccccggcggcgccgaagacttggaggatacccagttcccttccgaagaggctagagaaggtgggggagttcatgctgtgccaccagacccagaggatgaaggcttagaggagaccgaggaccacaagttagtgttcctgcagcagggcccccttttgcttgtggccatgtctcggaccagccagtcagccgcgcagctgaggggagagctgctagcagttcatgctcagatagtgtccaccctgacccgggccagcgtcgcacgtatctttgcccacaagcagaactatgacctaagacgtctccttgccggctctgagcgcacattggacaggctgctagattcaatggagcaggaccctggtgcactcttactgggtgccgtgcgatgcgtgccactggcccgccctctcagagacgccctaggtgcccttcttaggcgttgcacggcccccggattggctctgagcgtgctggcggtgggtgggcggcttatcaccgcagctcaggaacgaaacgtcctggctgaatgccgactggatcccgccgatctgcagctcctgctcgattgggtaggggcccctgcttttgctgcaggagaagcctgggctccagtttgtctgcctagattcaacccagacggcttcttttacgcttatgtcgcaagactcgatgctatgcctgtttgcttgcttctgttgggtacccaacgcgaagctttccacgccatggccgcgtgtagacgattggttgaggacggaatgcatgcactcggggctatgcgcgccctaggggaggcagcgtcctttagtaatgctagttctgcaagcgcccctgcctactctgtgcaggccgtgggggcccccggtctccgccacttcctctacaaacccctggatattcctgatcaccaccgacaactaccacagtttacttcgcccgagttagaggctccatattcccgagaggaggaacggcaacgcctttctgacctgtatcaccgcctccacgcccgccttcattcaacaagccgccccctgcggttgatttaccacgtggccgagaaagaaacgctcctcgcttgggtgaccagcaagttcgagctgtatacctgcctgtctccccttgttacaaaggctggcgccatccttgttgtgaccaaattgttgcggtgggtaaaaaaggaagaagataggctgtttatcaggtacccgccgaaatatagcaccccgcctgccacaagcactgaccaggctgcccacaatggcctgttcacggggctctag

SEQ ID NO: 195644 - DNA, 1206 bp, Artificial Sequence
  Description of Artificial Sequence: Synthetic coding sequence
atggtgagcggccagctgcggttcggcgtgaagaccgaggaccacaagcttgtatttttgcagcaggggcccctgctcctggtggcgatgtcacggaccagtcagtctgcagcacagttgcgcggggaactgctggcagtacatgcacagatcgtgtccacgctgacaagagcctctgtcgcccggatctttgcgcacaagcagaattatgacctgcggcggctactggcaggcagtgagcggacgttagaccggctgttagactcaatggagcaggaccccggggctctgctcctgggggctgtgaggtgtgtacctctggcacgcccactgcgcgatgctttgggggcactgctgcggcggtgcactgccccaggcctggcactgtccgtgttggccgtgggtggccgtctcattactgctgcccaggaaagaaatgtgctggccgaatgccgtctggacccagccgatttgcagcttctgctcgattgggtaggggcacccgccttcgccgcaggagaagcatgggcacctgtgtgtctgcctaggttcaatcctgacggtttcttttatgcttacgtggcgagactagacgccatgcccgtgtgcctcctgctgctgggaacacagcgggaggccttccacgctatggcagcttgccgacgcctggtggaagatggcatgcacgctctgggtgcaatgcgcgccctgggagaggccgcctctttttcaaacgctagctctgcttcggcccctgcctactcagtacaggccgtcggcgccccgggcttacgccactttctttacaaaccactcgacatccccgatcatcaccgtcagcttccccagtttacaagcccagaactggaagcaccttacagcagggaagaagaacgccaaaggctgagcgacctttaccatcggctacatgctaggctgcattccaccagcaggcctctccgtctgatctatcacgtagccgagaaagagactttgctggcttgggtgacaagtaaatttgaactgtacacctgcctctcgcccttagtgacaaaagcaggagcgatactggtggtcaccaaactgctgagatgggtgaaaaaagaggaggaccgcctgttcataagataccctcctaaatattctacccctccagcgacctccactgatcaagctgctcataacggattgtttaccggtctttag

SEQ ID NO: 195645 - DNA, 1584 bp, Artificial Sequence
  Description of Artificial Sequence: Synthetic coding sequence
atggagaaccaggagaaggccagcatcgccggccacatgttcgacgtggtcgtcatcgggggcggcattagtggcctatccgccgccaaactccttaccgaatatggggtgagcgtccttgtcctggaggcccgcgaccgcgttggcggacgtacctacaccatacgtaacgagcatgtggactatgtcgacgttggcggggcctacgtgggccccacacagaacagaatcctgaggcttagtaaagagctgggcattgagacctataaggtcaatgtatccgaaagactagtccagtatgtcaaagggaagacctacccattccgaggagcttttcctcccgtgtggaatcccatcgcatatttggactataataacttgtggaggactattgataacatgggcaaggagataccaaccgacgcaccttgggaggctcaacatgcagacaaatgggataaaatgaccatgaaggaactgatcgataagatatgttggactaaaacggccaggaggttcgcctatctgtttgtgaacattaacgtgacatctgagccccacgaagtctcggctttgtggttcctttggtacgttaaacagtgtgggggtaccacccgcatctttagtgtcactaacgggggccaggagcggaagttcgtgggggggagtgggcaggtgtcagaaagaattatggacctgctgggggaccaggtgaaactcaaccaccccgtgacacacgtggatcaatcatcagataacattataatagagaccttaaatcatgagcactacgagtgtaaatacgtgatcaacgcgattcctccaaccttgacagcaaagatacatttcagaccagaattgcccgccgaacgtaatcagttgatacagcggctgcctatgggcgctgttatcaaatgcatgatgtattataaggaagcgttctggaaaaagaaggattactgcggctgtatgatcatagaggacgaagatgctcctatctctatcacactggacgatacaaagccagacggttctctgcctgctatcatgggctttatcttggctcgcaaggcagatcgtctcgcaaagttgcataaggagattcgcaaaaagaagatctgtgaactatacgctaaggtgctgggctcccaagaagccctgcatccggtacattacgaggagaagaactggtgcgaagagcagtactctggtgggtgctacactgcatacttccctcctggaatcatgacacagtatgggcgcgtcattcggcagccagtgggtagaattttcttcgcaggaactgagacggccaccaagtggagcggatacatggagggggccgtggaggccggcgagcgggccgcacgggaagtcttaaacggactggggaaagttactgaaaaagacatctgggtgcaagaacccgagagcaaggatgtacctgcggtggaaatcacccacaccttctgggagcgcaatcttccttccgtgagtggactgcttaaaatcatcggattttctacaagcgtgaccgcgctcggatttgtgctttacaagtataagctgctaccccgatcctag

SEQ ID NO: 195646 - DNA, 1185 bp, Artificial Sequence
  Description of Artificial Sequence: Synthetic coding sequence
atgggcaaggagatccccaccgacgccccctgggaggcccagcacgcagataagtgggacaaaatgactatgaaagagctgatcgataagatatgctggacaaaaacagccaggcgctttgcttatctttttgttaatatcaacgtgacctccgagccccacgaggtatcagcactttggtttctctggtacgtgaagcagtgcggagggacaacaaggatctttagtgtgacgaacggcggtcaagaaagaaagttcgtgggcggcagcggccaagtatctgagcgcataatggacttgctgggagatcaggtgaaacttaaccaccccgtgacacacgtggatcaatccagtgacaacatcatcatcgaaacccttaatcacgagcactacgagtgcaagtacgttataaacgcgatcccaccaaccctcactgccaagatccactttcgaccagaactccctgccgaaagaaaccagctcattcaaagactgcccatgggggcggtgattaagtgcatgatgtactacaaagaagcattctggaaaaagaaagattactgtggctgtatgataatcgaagacgaagatgctcctatcagcatcaccctggacgacacaaaaccagatggatccttgccggcgattatgggctttattctggcacgcaaggccgacaggctcgccaagctgcacaaggagattcgcaagaagaagatatgcgaattgtacgccaaggtactcggatcacaggaggctctgcatcccgtacactacgaggagaagaattggtgcgaagagcagtacagcggcggctgctacactgcatacttccctcccggaatcatgacccaatacggccgggtaatacggcagccagtcgggaggattttcttcgctggaacagagacagctactaagtggtccgggtacatggagggagccgttgaagccggtgaacgggcagcgcgcgaggtcctcaacggcctggggaaggttaccgagaaggacatctgggtgcaagagcccgagtccaaggatgtccctgctgttgaaatcacccacaccttttgggaaagaaacctgccctcagtctccggactgctgaagatcatcggtttcagcacctctgtgaccgctctcggcttcgtgctgtacaaatataagctgctgcctaggagctag

SEQ ID NO: 195647 - DNA, 1563 bp, Artificial Sequence
  Description of Artificial Sequence: Synthetic coding sequence
atgagcaacaagtgcgacgtggtggtggtgggcggcggcatcagcgggatggcggccgccaagctgctccacgacagcggacttaatgtcgtcgtgttagaggctcgagacagagtgggcggacgcacatacacgttgcggaaccagaaagtgaagtacgtcgatctgggcggctcatatgtgggccctacccagaacagaatcttgcgattggcgaaggaactgggccttgaaacttataaggtaaatgaggtcgaacggcttatccaccacgtgaagggtaagtcctacccattcagggggccattccccccagtgtggaacccaataacttacctggatcacaacaacttttggcggactatggatgatatggggcgggagatcccaagtgatgccccctggaaagctcccctggcggaagagtgggacaacatgacgatgaaagagctgctggacaagttgtgttggaccgagagcgcaaaacagctagccacattgttcgtgaatctgtgcgtcactgccgagacccatgaggtttccgcactgtggtttctctggtacgtcaagcagtgtgggggcacaactcgcatcatttcaacaaccaatggcggacaagaaaggaagtttgtgggtggttctggccaggtttcagagcgtataatggatcttttgggcgaccgtgttaagttagagagaccagttatatatattgaccagacgagggaaaacgttctggtcgaaacgctgaatcacgagatgtacgaagctaaatacgtgataagcgcaatcccgccaacactgggaatgaagatccacttcaatccacctctccctatgatgcggaatcagatgattacacgcgtgcccttgggaagcgtgatcaagtgcattgtatattacaaggaacccttctggagaaaaaaggattactgcggcaccatgatcatcgacggcgaggaagctcctgtagcctatactcttgacgacacaaagcccgagggaaattacgctgctataatggggtttatccttgctcacaaggcacgtaagctcgcccggctgactaaggaggaaagattgaagaagctttgtgaactgtacgcaaaggtgctgggcagtttggaggctctggagcccgtacactatgaggaaaaaaactggtgtgaggagcagtattccggtggctgttatactacatatttccctccgggtatactaacccagtacggccgcgttctgaggcagcccgtggatcgaatctattttgcaggcacggagaccgccacccattggagcggctacatggagggagcggtagaggctggtgagagagcagctagagagattctccacgcgatgggtaagatccctgaggacgagatttggcagtccgagcctgaaagtgtggacgtccccgcgcaacctattactactacctttttggagagacacctgccaagcgtgcctggactgcttcgcctaatcggacttacaacaattttttcggccactgctctaggatttctggcccacaaacgggggttactcgttagggtatag

SEQ ID NO: 195648 - DNA, 1515 bp, Artificial Sequence
  Description of Artificial Sequence: Synthetic coding sequence
atggccgccgccaagctgctgcacgacagcggcctgaacgtggtggtactggaggcccgcgatagggtggggggacggacctacaccttgcgcaatcagaaggtaaagtatgttgatctgggtggcagctacgttgggcctacccagaacaggattctacggctggcaaaagaattaggacttgagacatataaggtaaatgaagtggagaggttgattcaccacgtgaagggtaaaagttaccccttcagaggccctttcccaccggtttggaacccaatcacgtatctcgaccacaataacttctggagaaccatggacgatatgggccgcgagattcctagtgatgcaccctggaaggctccacttgccgaggaatgggataacatgaccatgaaagaattactagacaagctatgctggacggaatccgccaaacagctggcaactctcttcgtgaacctgtgtgtcacagcagaaacccacgaggtgagcgctctgtggtttctgtggtacgtaaaacagtgcggagggactacgcgcataattagcacgacaaacggcggtcaggagcgcaagttcgtcggagggagcggacaagtttctgagagaatcatggatctgcttggcgaccgcgtgaagctggaacggcctgtcatctacatcgaccagacaagagaaaacgtgctagtggaaacactgaatcatgaaatgtacgaagcaaagtatgtaatctcagcaatacccccaaccctcggcatgaagattcacttcaacccccccctcccaatgatgagaaaccagatgatcaccagggtccctttaggatctgtcatcaaatgtattgtttactacaaggagccattttggaggaagaaagactactgcggtaccatgatcattgatggcgaggaagcacctgtagcatatactttggacgacacaaagcctgagggtaattacgcggcaatcatgggattcatccttgcgcacaaggcccgaaagctggcaaggttgactaaagaggagagacttaaaaaactgtgtgagctctacgccaaggtgcttggctcactagaagcacttgagccagtgcactacgaagagaagaactggtgcgaagaacagtacagcggcggatgctacacaacctacttccccccggggattctgactcagtatggtcgggtgctgaggcagcccgttgacagaatttactttgccggaaccgagaccgctactcactggagcggttacatggagggcgccgtcgaagccggtgagcgggcggcaagagaaattctgcacgcgatggggaagatccccgaagacgagatttggcagtctgaacccgaaagtgtcgatgttccagctcagccgattacgacaactttcctggaaaggcacctgccttctgtgcctggcctcctacgccttatcggccttactacaatcttctcagcaactgcattgggcttcctggctcacaagagaggcctcctcgtgcgggtgtag

SEQ ID NO: 195649 - DNA, 1236 bp, Artificial Sequence
  Description of Artificial Sequence: Synthetic coding sequence
atggccgccgccaagctgctgcacgacagcggcctgaacgtggtggtgctggaagctcgggacagagttggaggtaggacgtataccttaagaaaccaaaaggtgaagtacgtggatctgggggggtcatacgtcgggccgactcaaaacaggattcttagactggccaaggagttgggtttggagacttataaggtgaacgaggtggagaggctgattcatcatgtgaagggtaagtcctatccttttcgcggcccctttccgcctgtctggaatccaatcacttatctagaccacaacaatttctggaggaccatggacgacatggggcgagaaattccctcagatgcaccttggaaggccccactcgccgaagagtgggacaatatgacaatgaaggagctgctggacaagctctgttggaccgagtctgccaaacagttggccacactgtttgtcaacctatgcgtaacagccgaaactcacgaggttagtgccctgtggtttttatggtatgtgaaacagtgcggcggcaccactaggataataagtacaacaaatggcggccaggagcggaagtttgtcggaggcagcggtcaagtcagtgagaggatcatggacctgctcggcgatagagtgaaactagagagaccggtgatttatattgaccagacaagggagaatgtcttggtggaaactctgaatcatgaaatgtatgaagctaagtacgtgattagcgctatcccgcctacccttggaatgaagattcactttaatcccccgttgcctatgatgcgtaaccaaatgatcacaagagtccccctgggctcggttataaaatgcatagtgtactataaggaaccattttggcggaaaaaggattactgtggaacaatgataatcgatggagaggaggcgcccgttgcctatacactggatgacaccaaacccgagggcaattatgccgcaattatggggtttatactggcccacaaggccaggaaattagctaggcttacgaaggaagagagattgaagaaactctgtgagttgtatgccaaagtccttggatctctagaggccctggaagggagcacgccagcttctggacaggacctcttatgcagacatagggactgccacactctggagcgcctgcacggaggtggttgtagggggcgcggagaatcctctccccgggaccctgcctgccacggagaagacagtcgcggttag

SEQ ID NO: 195650 - DNA, 741 bp, Artificial Sequence
  Description of Artificial Sequence: Synthetic coding sequence
atgttcgccccccggctgctggacttccagaagaccaagtacgccaggttcatgaaccacagagttccagcccacaagaggtatcaacccactgagtacgagcacgccgccaattgcgcaacccatgcgttttggataattccctccatcctggggtcttcaaacctgtacttcctcagcgatgacgattgggagacgatttcagcgtggatctacggtctcggcctctgtggcttatttgtggtcagcaccgtgttccacacaatcagctggaagaagagccatctgaggatggtggagcactgtcttcacatgttcgatcggatggtgatttacttctttatcgccgcgagttatgctccatggctcaacctccgcgagctgggcccgtgggctagccacatgcgctggcttgtgtggataatggccagcgttggaacgatatacgttttcttctttcacgaacggtataaacttgtcgaactcctctgttacgtcgtcatggggttctttcccgcactggtgatcttgagcatgcctaacaccgaggggatatgggaactggtgaccggaggcgtgttttactgcctgggaatggtcttctttaagtccgacggacgcattccattcgcgcacgccatatggcatctgttcgttgcatttggcgcaggcactcactattatgccatttggagatacctctatctgccatccactctgcagactaaggtttctaagtag

SEQ ID NO: 195651 - DNA, 813 bp, Artificial Sequence
  Description of Artificial Sequence: Synthetic coding sequence
atgttcgccccccggctgctggacttccagaagaccaagtacgcccgctttatgaatcatagagtccctgcgcataaaagataccagcccactgagtacgaacatgctgccaactgcgctacccacgccttttggatcattccttcgatactgggaagctctaatctctatttcctgtccgatgacgactgggagacgatcagtgcctggatttatggcctcggcctctgcggcctgttcgttgtttccaccgtctttcacaccatctcttggaagaaatcacaccttcggatggtggaacactgtctgcatatgttcgaccggatggtaatttacttctttattgccgcaagctacgccccctggctgaacctcagagagctcggaccttgggcaagccatatgagatggctcgtgtggatcatggccagcgtgggcactatctacgtttttttctttcatgagcgaaccggctcgtgcgtgcagttcctccgcggtgaagcatgtcctaaagctggtaccgcctgcctcccagctaggtacaagttagtggaactgttgtgctacgtggtgatgggcttcttccctgctcttgtcattttaagcatgcctaacaccgaaggaatctgggagctcgtcaccggaggggtgttttattgcctgggaatggtgttttttaagtcagatgggagaatcccgttcgcccacgccatttggcacctgtttgtggctttcggcgctggcacacactattatgccatttggcgatacttgtatcttccttccacactgcagacaaaagtatccaaatag

SEQ ID NO: 195652 - DNA, 582 bp, Artificial Sequence
  Description of Artificial Sequence: Synthetic coding sequence
atgttcgccccccggctgctggacttccagaagaccaagtacgccagatttatgaaccaccgcgtgcctgctcacaaaaggtatcagcctacggaatatgaacacgcagctaactgcgctacccatgctttttggattatcccatctattctggggagcagtaatctgtacttcttgtccgatgacgattgggaaactatttccgcctggatctatggcttaggactgtgcggactcttcgtagtgagcacggtattccacaccatttcctggaaaaaaagccacctgaggatggttgagcactgtctccacatgtttgacagaatggtgatttacttctttattgctgcctcttatgctccatggctgaacttacgggagctcggcccttgggccagtcatatgcgctggctcgtctggatcatggcgtcagttggaaccatctatgtctttttctttcacgagcgctacaaattggtggaactgctatgctatgtcgtgatgggtttctttccggcgcttgtcatcttgagtatggccggcaagctgcgacccggtatgacgtgtctgaagagacagtag

SEQ ID NO: 195653 - DNA, 942 bp, Artificial Sequence
  Description of Artificial Sequence: Synthetic coding sequence
atggagaccggccccgaggaccccagcagcatgcccgaggagagctctcccagacggactccccaaagcatcccctatcaggatctgcctcatctggtgaacgctgacggtcagtacctattttgcaggtattggaagccgaccggtacccccaaagctctgattttcgtctctcacggtgcaggagaacacagtggacgctacgaagaattggcaagaatgttaatgggcctcgacctgctagtgttcgcacatgatcacgtggggcatggccagtccgaaggcgagcgaatggtggtgagtgacttccacgtattcgtacgcgatgtcttgcagcacgtcgatagcatgcagaaggattatcccgggctgcccgtctttttattaggccacagtatgggcggcgcaattgcgattttgactgccgcagagcggcctgggcacttcgcggggatggtgctcatctcccctctagtgctcgctaatccagaatccgcaactactttcaaggtactggcagctaaggtgttgaatctggtgctgcccaacctcagcctcggccctatcgatagttccgtgttatcccgcaataagaccgaagtcgatatctacaatagcgacccactgatctgtagagcaggtcttaaagtctgtttcgggatacaactgctgaatgcagtctctagagttgagagggcgctacccaaattaactgttccctttctcctattgcaggggtccgctgaccggctgtgcgactcaaagggagcctaccttctgatggaacttgccaagagccaagacaaaactctgaagatctacgagggcgcctatcacgtgttgcacaaggagctgcctgaggtgaccaattccgtgtttcatgaaatcaatatgtgggtgtctcagagaactgctaccgccggcacagcgtcccccccatag

SEQ ID NO: 195654 - DNA, 912 bp, Artificial Sequence
  Description of Artificial Sequence: Synthetic coding sequence
atgcccgaggagagcagcccccggcggaccccccagagcatcccctaccaggaccttccacacctggtcaatgcagatggtcagtatctgttttgccgctactggaaaccaaccggcacccctaaggctctaatttttgttagtcatggcgccggcgagcactccggcaggtatgaggagctggctagaatgctgatggggctagatctgttggtttttgcccatgatcatgttggccacggtcagtccgagggagaaaggatggttgtcagtgacttccatgtctttgtgcgcgacgttctccagcatgttgactccatgcagaaggactaccccggcttacctgtgttcctcctcggccatagtatggggggggcgatcgctatactaacagcagccgagcgccctgggcattttgctggcatggtgttgattagccccttagtcttagcaaaccccgagtctgccacaacttttaaggtactcgctgccaaggtgttaaatctggtcctccctaacctgagcctggggccaatcgattcaagtgtcctgtcccgcaacaagaccgaagtcgatatatataactccgaccctctcatatgtcgcgctggcctgaaagtgtgttttggcatacagctgttaaacgcagtgtcgcgggtcgagcgcgcgcttccaaaactcacagttccttttctgttgttgcagggttcagctgaccgactctgcgacagcaagggggcctacttattgatggagctggctaagtctcaggataaaaccctgaagatctacgagggcgcttatcacgtcttacacaaagagttaccagaggtaaccaattccgtgttccatgaaatcaatatgtgggtctctcaacgcaccgcaacagctggcaccgcctctcccccttag

SEQ ID NO: 195655 - DNA, 912 bp, Artificial Sequence
  Description of Artificial Sequence: Synthetic coding sequence
atgcccgaggagagcagcccccggcggaccccccagagcatcccctatcaggatctgccccaccttgtaaatgcagatggtcaatatcttttctgccggtattggaaacctaccgggacacccaaggcgttgatattcgtctcccacggcgccggtgagcattcaggccggtatgaggagctcgcccggatgctcatgggcctggacctgttggtgttcgcgcatgaccacgttggtcacggtcaatccgagggggagagaatggtggtgagcgacttccacgtgttcgtgcgagacgtacttcagcacgtggacagcatgcaaaaagattaccccgggctccctgtgttcctgctgggacactccatgggaggcgcgattgcgattcttactgccgccgagcgccccggccatttcgccggaatggttctgatctcgccactggttctcgctaacccagagtcggcaaccacctttaaggtactggccgcaaaagtgcttaatcttgtgctgcccaacctctctttggggcctatcgattcgagcgtattaagccgaaataagacagaggtcgacatttacaactccgatcctctgatatgccgcgctggcctgaaggtttgcttcggcatccagttactgaatgctgtgtctcgtgtggaaagggccctgcccaagctaaccgttcccttcctcctgcttcaggggtcagcagaccgtctgtgcgactcaaagggcgcctacctccttatggagctggcaaaatcccaggacaaaaccctaaagatatatgaaggagcctaccacgtcctgcacaaggaactacctgaagtcacgaattctgtattccacgagatcaatatgtgggtttcacaacgaaccgcgacagccggaactgcgtcaccaccctag

SEQ ID NO: 195656 - DNA, 852 bp, Artificial Sequence
  Description of Artificial Sequence: Synthetic coding sequence
atggagaccggccccgaggaccccagcagcatgcccgaggagagctcgccacggcgtacgcctcagtccattccttatcaagacctccctcacctggtgaatgctgatggccagtacctgttctgtcgctactggaagcctacaggaacccccaaggctctgattttcgtaagtcatggggcaggagagcacagcggtcgatatgaagaacttgctaggatgctcatggggctagacttgctggtttttgcccatgaccacgtcggccacgggcaaagtgagggagaaagaatggtggtctccgattttcacgttttcgtgcgagatgtgttgcagcacgtggacagcatgcaaaaagattatcctggactcccggtttttcttctgggtcacagcatggggggtgctattgccatcctgacggcagctgaaaggcccggacacttcgctggcatggtgttaatctcccctctggtgctagccaatccggaatccgctactaccttcaaagtagacatctataactcagaccctctaatctgccgtgcgggcttgaaggtgtgcttcggcattcagctgctcaatgcagtgtcacgagtagagcgagcactgccgaagctcaccgtgccgttcctgctgctccaaggttctgccgacagactctgcgatagcaaaggggcatacttgctaatggaattggccaaatctcaggataagactctaaaaatttacgaaggggcatatcacgtgcttcacaaggaactgcctgaggtgaccaatagcgtgttccacgagattaatatgtgggtcagtcagcggacagcgactgccggtaccgctagcccaccttag

SEQ ID NO: 195657 - DNA, 234 bp, Artificial Sequence
  Description of Artificial Sequence: Synthetic coding sequence
atgcccgaggagagcagcccccggcggaccccccagagcatcccctaccaagaccttccgcacctggtgaatgccgacggtcaatatctgttttgccgctattggaagcctactggaactccgaaagccttgatatttgtctcacatggggcaggcgaacatagtggaaggtatgaggagttggcccgcatgctgatggggctggatttgctcgtgttcgcccacgatcattag

SEQ ID NO: 195658 - DNA, 942 bp, Artificial Sequence
  Description of Artificial Sequence: Synthetic coding sequence
atgaagacccggcccgaggaccccagcagcatgcccgaggagagctctccccgacgcacaccgcagtcaataccctaccaggaccttcctcacctggtgaacgcagacgggcagtacttattctgcagatactggaagcccaccggtacccctaaggctctaatctttgtctcacacggggctggagaacactccggtcgctacgaagagctggccaggatgctgatgggactagacctactggtgtttgcacacgatcacgttggccatggccagagtgaaggggaacggatggtcgtcagtgacttccacgtcttcgtgcgggacgtgctgcaacacgtggacagcatgcagaaagactacccggggctccccgtatttctcctggggcactccatgggtggagctatcgctatcctgaccgctgcagaacgccctggacatttcgctggcatggtgctcattagccctctcgtgctcgctaaccctgagtcggctactacatttaaggtcttggccgccaaggttttgaatctggtcctgcctaacctgtccctcggccctatcgacagcagcgtgttaagccggaacaagacggaagttgatatctataactctgatcccctgatctgtcgcgccggactaaaagtgtgctttggcatccaactccttaacgcagtctcccgtgtcgaacgggccctgcccaaactcactgtgccctttctcttattgcaggggtctgctgatcgtttgtgtgatagcaagggagcttacctcctgatggaattagctaaatcccaggacaaaacactgaagatctatgagggcgcttatcacgtcctgcataaggaactgcccgaggtcaccaattcagtgttccacgaaatcaacatgtgggtgtcacagcgaaccgccaccgccggaaccgcctcgcccccatag

SEQ ID NO: 195659 - DNA, 1842 bp, Artificial Sequence
  Description of Artificial Sequence: Synthetic coding sequence
atgtgctgctggcccctgctgctgctgtggggcctgctgcccggcaccgccgccggcgggagcggcaggacctacccccatcgtacactcttagatagcgaaggaaaatactggctgggatggtctcagcggggctcacagatcgcgttccgtcttcaagtaaggactgcaggttatgtgggcttcggcttttctccgacaggcgctatggccagtgccgacatagtggttgggggtgtggcccacggtcgtccttatctccaggattacttcaccaacgccaacagagagctgaaaaaagacgcccaacaagactaccatctcgaatacgccatggaaaatagcactcacacaatcatcgagtttactagggagctgcacacctgcgacataaacgacaaatcaatcaccgactcaactgtgcgagtcatttgggcataccatcacgaggatgctggagaggcaggtccaaaataccacgatagtaacaggggcaccaaatctcttcgactgctcaaccccgaaaaaacttctgtgcttagcaccgctctgccgtatttcgacctggtgaaccaagacgtgcctattccaaacaaggatactacgtattggtgtcagatgtttaagatccccgtgtttcaagaaaagcatcatgtgataaaggtggaacctgtgatacagcgcggtcatgagagcctcgtgcatcacattctgctgtaccagtgttctaacaacttcaacgactcagtgttggagtcagggcatgaatgttatcaccccaacatgcccgacgccttcctgacctgcgagactgtgatttttgcttgggcgatcggcggcgagggattttcctaccccccccacgtaggactgtctctgggaacccctcttgatccacactacgtactcctagaggtccattacgacaatccgacatatgaggagggtctgattgacaattctggactgcgtctgttttatacgatggatatccgaaagtacgacgccggagtgatcgaagcgggcctctgggtaagcctttttcacaccattccacccggtatgcccgaattccagtccgagggtcactgcacactggagtgccttgaggaggcccttgaggctgaaaaacctagtgggattcacgtttttgccgttttgctgcacgcccacttggcaggtagagggattaggctccgccattttcgaaaaggcaaggagatgaaactgttagcttatgacgatgacttcgacttcaattttcaagaatttcagtacctcaaggaggaacagacaatcctgccaggggacaaccttatcacagagtgtaggtataataccaaagaccgagccgagatgacttggggaggcctgagcaccaggagcgaaatgtgcctgtcataccttctgtactatcctagaattaacttgaccaggtgtgcctccatccctgacattatggaacagctccagtttatcggggtcaaggagatctacaggcctgtgaccacatggccctttatcattaagtccccgaaacagtataaaaatcttagcttcatggacgccatgaataaattcaagtggaccaagaaagaggggctgtctttcaacaagctggtgttgtccctgccggttaatgtgagatgctctaagacagataatgccgaatggtcaatccagggcatgacagccctgcctcctgacatcgaaagaccttataaagctgagcctcttgtgtgtgggaccagctctagctcctcgctccatcgggacttttctattaatctgctcgtttgtttactcctgctctcttgtactctgagtacaaagagtctctag

SEQ ID NO: 195660 - DNA, 1023 bp, Artificial Sequence
  Description of Artificial Sequence: Synthetic coding sequence
atgagcgagctggagcagctgcggcaggaggccgagcagctgcggaatcagatccaggatgctagaaaagcttgtaacgacgccacgctggttcagatcacctccaacatggattctgtgggccggattcagatgcgaacacgacgtaccttgaggggtcatctggcaaaaatatatgctatgcattgggggtatgatagccgtcttttggtgtcagcatcccaggacggaaagctcattatctgggacagttacaccaccaacaagatgcatgcgattccgctgaggagcagctgggtgatgacatgtgcctacgccccttccggcaactatgtagcgtgcggcggactggacaacatctgctccatctataacctcaagacccgagagggaaacgtgcgagtcagcagggagctccccggccacacagggtacctttcatgctgccggttcttggatgacagccagattgttacaagcagtggagacacaacctgcgctttgtgggacatcgaaacagctcagcaaacaaccacttttacaggccattctggagacgtgatgtcactgtcactgtcccctgacatgcgcactttcgtgtccggcgcctgcgatgcctccagcaagctgtgggatatccgggacggaatgtgtagacagagcttcaccggccacgtgtccgatatcaatgccgtctctttcttccccaatggctacgcttttgctacaggtagcgacgatgccacctgccgcctcttcgacctgcgggccgatcaggaactgttactttactcccacgataacataatctgcggaataacgtccgtagctttctctaagagcggccgccttctactagctggatacgatgacttcaattgcaatgtttgggacacactgaagggagaccgtgcgggtgtactcgcggggcacgacaatcgcgtaagctgtctcggcgtaaccgatgatggaatggccgtcgcgaccggatcatgggacagtttcctgcgcatttggaattag

SEQ ID NO: 195661 - DNA, 1089 bp, Artificial Sequence
  Description of Artificial Sequence: Synthetic coding sequence
atggcccccaagcaggaccccaagcccaagttccaggagggcgagcgcgttctgtgcttccatggcccattactatacgaagcaaagtgcgtcaaggtcgcgattaaagataagcaggttaagtactttatccactactcaggctggaacaaaaagtcagctgtaaggccgcgacgaagtgaaaagtctctgaaaacccatgaagacatagtagcattgttccctgtgcctgaaggcgcccccagtgtgcaccacccccttctgacatcctcctgggatgagtgggtccctgagagccgcgtgttgaaatatgttgatacaaaccttcagaaacagcgggagctccagaaggccaaccaggagcagtacgcggagggaaaaatgaggggtgctgcacctggtaagaagacctctggtctacagcaaaagaacgtagaagtaaaaacgaaaaaaaataagcagaaaacacctggtaatggagacggcggatctacgtcagagacgcctcaacccccgaggaagaagcgcgccagagtggatcccaccgtggagaatgaggagacctttatgaatagagttgaggtcaaggtgaagattccagaggagctcaagccgtggctggttgacgactgggacttgattactcggcaaaagcagctcttctatttgcccgccaagaaaaacgttgatagtatcttagaggactatgccaactataagaagagccggggtaacacagacaacaaagagtacgccgtcaatgaagtcgttgcaggcattaaggagtatttcaatgtcatgctgggcacccagctgctttataaatttgaacggcctcagtacgccgagatcctggcagaccaccctgacgcacctatgagccaggtgtacggggccccgcacctgctacggttgttcgtccgtattggggccatgttagcctacactccccttgacgagaagagtctggcacttctcctcaactacttacatgattttctaaagtatttggccaagaactcagccactctgttctcggcatcggattacgaagtcgcaccaccggaatatcatcgcaaagctgtttag

SEQ ID NO: 195662 - DNA, 1047 bp, Artificial Sequence
  Description of Artificial Sequence: Synthetic coding sequence
atgatccccttcccccacccccaggtgaccgacgccctgggccggtactcgaattacatcctctcctccactgttgagagtcctagtctacgcagcatgaatttcgagaaacaaggcgagagagtcctctgttttcatggccccttgctgtatgaagctaaatgtgttaaagtcgcaattaaagacaagcaagtgaaatacttcatccattacagcggctggaacaagaattgggatgaatgggtgccagaaagccgtgtacttaaatatgttgatacgaacctgcagaaacaacgagagctgcagaaagctaatcaagaacagtacgccgaagggaagatgcgcggcgccgctccaggcaaaaagactagcggacttcagcagaagaatgttgaggtgaaaacaaaaaaaaacaaacagaagacaccaggaaacggtgatgggggctccacctcggagaccccgcagccgccccgaaaaaaaagagcccgcgttgaccccactgtggagaacgaggaaactttcatgaatcgggtcgaggtgaaggtgaagattccggaggaactgaagccttggctggtcgatgattgggacctcataacaaggcaaaagcagctcttctatttacctgctaagaagaatgtggatagcatcttagaagactacgccaactacaagaagagccgcggcaatactgacaataaagaatacgctgtgaatgaagtagtcgctggcataaaggaatacttcaacgtgatgctgggaacacagttactctataaatttgagcgaccgcagtatgcagaaattttggccgatcatccagacgctcccatgtcacaggtctatggtgcaccacacctcctcaggttgtttgtccgaatcggagcaatgctggcatatactccactggatgaaaaaagcttggcccttctgctgaattatctgcacgacttcctgaaatatctggccaagaacagtgccaccctcttttctgcttctgattacgaggtggccccacctgagtaccatcggaaagctgtgtag

SEQ ID NO: 195663 - DNA, 972 bp, Artificial Sequence
  Description of Artificial Sequence: Synthetic coding sequence
atggcccccaagcaggaccccaagcccaagttccaggagggcgagagggtcctttgtttccacggcccactgctgtacgaagcgaaatgcgttaaagtggccataaaagacaaacaggtgaagtacttcatccactattccggatggaataaaaactgggatgagtgggttcccgaatctcgggtactaaagtacgtcgacacaaatttacaaaagcagcgagaactccaaaaagctaatcaagagcagtatgccgaaggaaagatgaggggggccgcccctgggaagaaaaccagcgggttgcagcagaagaatgttgaggttaaaactaaaaagaacaagcagaaaaccccaggaaacggggacgggggctctactagcgaaactccccaaccacctcggaagaagcgcgcaagggtcgaccccactgtggagaacgaagagacatttatgaaccgcgtagaagttaaagtcaaaattccggaagagctgaagccttggctggtcgacgattgggacttgattaccaggcagaagcaacttttctacctcccagcgaagaagaatgtcgattcaatcctagaagactacgcaaattacaagaagtcgcggggaaatactgataacaaggaatacgcagtgaatgaagtagtggctggaatcaaggaatattttaatgtgatgttgggtacacagttgttatacaagttcgaacgtcctcagtatgccgagattcttgccgatcaccccgacgccccaatgtcgcaggtgtatggagccccccatctgttaaggctcttcgtcagaatcggagctatgctcgcctacaccccgcttgacgagaaaagtcttgctctactcctgaattacttacacgacttcctaaagtacctggctaagaatagtgcaaccctgttctctgcgtcagattacgaagtggccccccccgaataccatcgtaaggccgtctag

SEQ ID NO: 195664 - DNA, 708 bp, Artificial Sequence
  Description of Artificial Sequence: Synthetic coding sequence
atgcggggcgccgcccccggcaagaagaccagcggcctgcagcagaagaatgtggaagtgaaaaccaaaaagaacaagcagaagacgcctggaaacggagatggtggatccacaagtgagacgccccagccaccacggaagaaaagagctagagtcgacccaaccgtggagaatgaggagacctttatgaacagggtggaggtgaaggtaaagatccctgaggaattgaagccatggttggtggacgactgggacctgatcaccaggcaaaaacaactcttttatctcccagcaaagaagaacgtggactccatacttgaagactatgccaattacaaaaaatcaagaggaaatacggataataaggaatacgctgtgaatgaggtggtggctgggattaaggagtactttaacgtgatgctgggaacacagttgctctataagttcgagaggcctcaatacgccgagattctagcagaccatcctgatgcccctatgtcccaggtctacggcgcacctcatctcttaagactgtttgtgaggattggtgccatgcttgcatacaccccactcgatgagaaatcactggccctgctgctcaactatcttcatgattttctgaagtatctggctaagaattcggccaccctgttctccgcttcggattatgaggttgcccccccagagtaccatcgaaaagctgtttag

SEQ ID NO: 195665 - DNA, 708 bp, Artificial Sequence
  Description of Artificial Sequence: Synthetic coding sequence
atgcggggcgccgcccccggcaagaagaccagcggcctgcagcagaagaacgtggaggttaagacgaaaaagaacaagcagaaaactccaggtaacggcgatgggggaagtactagcgagactcctcaaccccccaggaaaaagagagccagggtggacccgaccgtagaaaatgaggaaactttcatgaaccgcgtggaggtcaaagtaaagatccctgaggagctgaaaccctggctcgtcgacgattgggacctaattacaagacagaaacagcttttctaccttcccgctaaaaaaaatgtggactccatcctagaagactacgccaactataaaaagtcacggggtaataccgataataaggaatatgccgtcaacgaggttgttgccggcattaaggagtactttaatgtgatgctcggtactcagctcctctacaagttcgaacgtccgcagtacgcagagatcttggcagaccacccagacgcccctatgtcgcaggtatatggcgctccccacctactccgcttgtttgttagaattggcgccatgctcgcctataccccattggatgaaaagagcctagccctgctcctgaattatctccacgattttcttaagtatctcgcaaagaactctgccaccctgttcagcgcatccgactacgaggtggcaccccctgaataccaccgaaaggccgtttag

SEQ ID NO: 195666 - DNA, 345 bp, Artificial Sequence
  Description of Artificial Sequence: Synthetic coding sequence
atggtgagccggaaggccgtggccgccctgctggtggtgcacgtggccgccatgctcgccagtcagacggaggcattcgtgcccatttttacctatggagaactgcagaggatgcaggagaaggagagaaacaagggtcaaaaaaagtctctgagcgtgtggcaacggagtggcgaggagggccctgtggatcctgccgaacctattagggaggaggagaacgaaatgatcaagctgaccgcacccctagagattggtatgcgcatgaattctcgccagctggaaaagtatccagctacactggaggggctgctctccgagatgttaccccaacatgcgaagtag

SEQ ID NO: 195667 - DNA, 348 bp, Artificial Sequence
  Description of Artificial Sequence: Synthetic coding sequence
atggtgagccggaaggccgtggccgccctgctggtggtgcacgtggccgctatgttggcgagccagacagaggcattcgtgccaatatttacgtatggcgagttacagaggatgcaggagaaggaaagaaataaggggcagaagaaatccttatccgtgtggcagaggagcggagaggagggcccagtagaccccgcagagccaatcagagaggaggaaaatgaaatgatcaagctaaccgccccactggaaatcggcatgcggatgaattctcgacagctcgagaaatacccagcaacccttgagggcctgctttcagagatgctgccacaacacgccgcaaagtag

SEQ ID NO: 195668 - DNA, 327 bp, Artificial Sequence
  Description of Artificial Sequence: Synthetic coding sequence
atggtgagccggaaggccgtggccgccctgctggtggtgcacgtggccgcaatgctcgcttcacagaccgaagccttcgtgcctatttttacttatggagagctgcagagaatgcaggagaaagagcggaataagggtcaaaaaaagagcctcagcgtctggcagcgctccggggaggaaggaccagtggatcccgccgaaccaattcgggaagaggaaaacgagatgattaagctgaccgctcccctagaaatcggcatgcgcatgaactcccggcagctagagaaatacccagctacacttgaaggactgctcactgccaaatag

SEQ ID NO: 195669 - DNA, 1011 bp, Artificial Sequence
  Description of Artificial Sequence: Synthetic coding sequence
atggcccggcggcggagccagcgggtgtgcgccagcggccccagcatgttaaactctgctaggggtgctccggagctgttgagaggaaccgctaccaatgcagaggtgagcgctgcagcggcgggggcaacaggtagcgaggagttaccacctggcgaccgcggatgcagaaacggcggggggcgcggccccgccgcgaccacttcctctactggcgttgcggtgggggccgagcatggggaggactcactgtcccggaagccagaccctgagcccggtcggatggatcaccaccaaccggggactgggagatatcaggtgttgctgaatgaagaagataattctgagagttccgccattgagcaacctcccacgtccaatcccgcccctcagatcgtccaggccgcctccagcgcccctgccctcgagacagactcgagccctccaccctactccagtatcaccgtggaagtgccaacaacttccgacaccgaagtgtatggtgaattctacccagttccccctccttactccgtggccacttcccttcctacatatgatgaagcagaaaaggcaaaggcggcagcaatggcagcagccgccgcagaaacatcacagcgtatacaggaggaagagtgccctccaagggatgacttctccgacgcggaccagttgcgggttggcaacgatgggatctttatgttagccttcttcatggcgttcatctttaattggctaggattttgtctgtcattttgcataactaacacgatagccgggcgctatggagcgatttgcggattcggactgagcctcattaaatggatcttaatcgtcaggttcagtgactattttacggggtacttcaacggccagtattggctgtggtggatttttttggtgcttgggcttctccttttctttcgtggttttgtgaactacctgaaagtgaggaatatgtcggagtctatggcggccgcccatcgcactcgttatttcttcttgttgtag

SEQ ID NO: 195670 - DNA, 1161 bp, Artificial Sequence
  Description of Artificial Sequence: Synthetic coding sequence
atgggcagcccctggaacggcagcgacggccccgagggcgcccgggaacctccttggccagccctccccccgtgcgatgaaagacggtgctcaccgttccctctaggagccctggtacccgtcacagcagtgtgtctgtgtttgttcgttgtgggcgtgagtggtaacgtggtcaccgtcatgctgatcggaagatatcgggacatgcggaccactacgaatttgtatttaggcagcatggctgtgagtgatcttctgattctcctgggactgcctttcgacctgtatcgtttgtggcgctcccgtccatgggttttcgggccgttactgtgcagattgtcactgtacgtcggagaaggatgtacgtatgcaaccttgctgcacatgaccgccttaagcgtcgaacgttacctggccatctgtcggcctctccgcgcccgggtccttgtgacacggaggcgcgttagagctcttatcgccgtgctatgggccgtggctctgctgtccgctggtcccttcctcttcctggtcggtgtggagcaagatcccggcatctctgtcgtgcctggattaaatggtacggcgcgtatcgccagctctccccttgccagtagtcctcccttgtggcttagccgagcaccccccccgtcccccccgtccggccctgagactgctgaagccgccgctctcttctctagggagtgcagaccgtctccggctcaactgggcgcactgagggtgatgttatgggtaaccaccgcctatttctttcttccatttctgtgcctctctattctctacgggcttatcggacgtgagctgtggagtagccgacggcctcttcgtgggcctgccgcttcaggaagggagagagggcacagacagacagtacgcgtgctacggaaatggagccgcaggggaagcaaggacgcgtgcctgcagtcagcaccgcccgggactgcccagaccctcggaccactccctctgctggcccaactgtgggctccgcttccggcaccattccccatcagcatccccgcctccacaagacgaggaggggggagcgggatatataatctgcttgttgcactcccccgctggcaaaatcatctgcacaaacatggacgtttcgctgatgacgttctgctttcagtgctatag

SEQ ID NO: 195671 - DNA, 1206 bp, Artificial Sequence
  Description of Artificial Sequence: Synthetic coding sequence
atggagaagagcaagaacttccggatcgacgccctgctggccgtggatccccctcgggcagcaagtgcccagtcagcgcctcttgctctcgtgacaagcttggccgccgctgctagtggaaccggcgggggcggcggaggcggtggagccagcggtggtacttctggatcgtgctctcccgccagtagcgaacccccagccgcgccagcggaccggctgagggctgagtctcccagtcctcctcgccttttagctgctcattgcgctttgctgcccaagccaggatttctaggcgcaggaggcggcggcggcggtaccggaggagggcacggagggccccatcaccatgcccatccaggagccgcagcagctgcggcagccgctgctgctgccgctgcggctggcggactcgctcttggcctgcacccaggaggggcacagggcggcgcagggctccccgcccaggccgcactgtacgggcacccagtgtatggttattcagccgcggcggctgccgctgcgctggcgggccagcaccctgcgctctcctatagctatccacaggtgcaaggagcccatcccgcgcaccccgcagatcctatcaagttaggcgccgggacgttccaattagaccagtggctgcgagcatccacagcggggatgattctgcctaagatgcccgacttcaactcacaggcgcagagcaacctgctggggaagtgcaggaggccaagaaccgctttcacatctcaacagcttcttgaactggagcatcagttcaagctcaacaaatacctgtctcggcctaagaggttcgaggttgccacatcgcttatgcttactgaaacgcaggtcaagatctggtttcaaaaccgccggatgaaatggaaaagatccaagaaagcaaaggagcaagcggcacaggaggcagaaaaacagaagggaggcggcggaggagctggtaagggtggggccgaggagcccggcgcggaggaattgctggggcctcctgccccaggcgataaagggtccggacgaaggttacgcgaccttagggacagcgaccctgaggaagacgaggacgaggatgatgaagaccacttcccctatagcaacggcgcttccgttcacgcagcgtccagcgattgctcctcagaggacgacagcccaccaccgcgcccgagccatcagccagcgccccagtag

SEQ ID NO: 195672 - DNA, 696 bp, Artificial Sequence
  Description of Artificial Sequence: Synthetic coding sequence
gccgccgccgccctggccggccagcaccccgccctgagctacagctatcctcaggtacagggggctcaccctgctcaccccgcagaccctataaaacttggagcaggaactttccagttggatcagtggctcagagcatccacggctggaatgattctccctaagatgcccgatttcaatagccaggcacaatcaaatttactgggaaagtgtaggaggccccgtaccgctttcacctcccagcagctcctggagttagaacatcaattcaagctaaacaaatacctgagtcggcccaagagattcgaggttgctacctcactgatgttgacagagactcaggtcaaaatctggttccagaaccgcagaatgaaatggaagcgctctaagaaggcgaaagaacaggcggcgcaagaggccgagaagcagaaggggggcggcggcggagcaggtaaggggggagccgaggagccaggcgccgaagagttactggggcctccagctcccggcgacaagggaagtggacgcaggttgcgagacctacgcgactctgaccccgaggaggacgaggacgaagacgacgaggaccactttccttattcaaacggcgcctccgtccacgctgcctctagcgattgcagcagcgaagacgatagtccacctcctcgcccttcacatcagcctgcccctcaatag

SEQ ID NO: 195673 - DNA, 570 bp, Artificial Sequence
  Description of Artificial Sequence: Synthetic coding sequence
atgggcggcctgagcaccgtgggcgcctgccccggcatcctgggcgcccagcaggcccaggctcagagcaacctcctggggaagtgtcgcagaccaagaaccgcattcacgtctcagcagctgttggaactcgaacatcaatttaaactcaataagtacctctctcgacccaagagatttgaagtggcgacatccctgatgttgacagagactcaagtgaagatctggtttcagaacagaagaatgaaatggaagcggagcaagaaagccaaggagcaggctgctcaggaggccgagaaacagaaaggcggagggggaggcgccgggaagggtggggccgaggaacctggagctgaagaactgctcggaccaccagcccccggagacaaggggagcgggagaagactgcgggatctccgcgactctgaccccgaggaggacgaggatgaggatgacgaggaccattttccttattccaacggtgcctccgtccacgctgcgtcctccgattgcagctctgaagatgatagccctccccccagaccatctcaccaaccagctccccaatag

SEQ ID NO: 195674 - DNA, 1692 bp, Artificial Sequence
  Description of Artificial Sequence: Synthetic coding sequence
atgcccagcaagttcagctgccggcagctgcgggaggccggccagtgtttcgagtctttcctggtagtacgggggctcgacatggagaccgaccgagagaggctgcggacaatatacaatagggactttaaaatctcttttgggaccccggctccagggttctcgtccatgctctacgggatgaagatcgctaacctggcctatgtgaccaaaactcgcgtacggtttttcagactggacaggtgggccgatgtaaggttccctgaaaagcggcggatgaagctggggagcgatatttccaaacaccacaagagccttctggctaagattttctacgatagggcggaatacttacacgggaaacatggcgttgatgttgaggtccagggaccgcatgaggctagagatgggcagctgctgatccgacttgacttgaatcggaaagaagtccttacacttagactgagaaatggaggcacccagagtgttacactgacgcacttattccctctgtgccgtactccacaatttgcgttttacaatgaagaccaggaactgccctgcccattgggacctggggagtgttacgagctgcacgtacactgcaagacatcatttgttggatattttccggccaccgtgctctgggaacttttgggccccggtgaatctggaagtgagggagccgggactttttacatagccaggtttcttgccgctgtagcgcattccccgctcgcggcacagcttaagcccatgactccattcaaacgaaccagaataactggcaatcctgtggttacgaatcggatcgaagaaggagaaaggcctgatcgcgctaaggggtacgacttggagctgtctatggcactcggaacctattaccctcccccgcgactccgccagctgctcccaatgttgctacagggtactagcattttcaccgcccccaaggagatcgccgaaatcaaggcacaactcgagactgccctgaagtggagaaattatgaggtgaagttgcggctgctgctccacctcgaggagttacaaatggaacatgatatcagacactatgatctggaatccgttccaatgacatgggatcctgtggaccaaaatccccgacttttgaccctggaagtgccaggtgtaactgagtcaagacccagtgtgttacggggcgatcatctgtttgcacttctgagttcagagacacaccaggaagacccaataacctataaaggatttgtgcacaaggtggagctcgatagggtcaaattatcattcagcatgagcctgctttccagattcgttgatggtctaaccttcaaggtcaatttcacattcaataggcagccactcagagttcagcacagagccctggaactgacagggcggtggctgctgtggccaatgctgttccctgttgctccaagggacgtacccctactgccctctgacgtgaaactgaaactgtatgaccgttccctggagagcaacccagaacaactccaggccatgaggcacattgttaccggcaccacccgccctgctttaaccgcctgtctcacccttaatcagaatcccgctgaactgcccctgcagggcacaggcagacttggtgagggtgtgtataacccaagccacagtacgccctcacccgccggagagaacgacacttcctcctgctag

SEQ ID NO: 195675 - DNA, 3012 bp, Artificial Sequence
  Description of Artificial Sequence: Synthetic coding sequence
atgcccagcaagttcagctgccggcagctgcgggaggccggccagtgctttgaaagcttcttggtggttagagggttggatatggagaccgatcgggagcgtctgcggaccatctacaaccgcgactttaagatctctttcgggacccctgcgcctggatttagctctatgctgtacggaatgaagatcgctaatctggcatacgtaacgaagacccgcgtgcgattctttcggctcgatcgctgggcggatgtacggttcccagagaaaagacgaatgaagctagggtcagatatcagtaaacatcacaagagccttctcgctaaaatcttctacgaccgggcggagtatctgcatggcaagcacggagttgatgtcgaggtgcagggaccacacgaggcccgcgacgggcagctcttaatacggctagaccttaacaggaaggaggtgctcactctgaggctgcggaatggaggaacgcaatccgttactctgacccacctgttccctttgtgccggacaccacaatttgcattttataatgaggaccaagaattgccttgtccactggggcccggcgaatgttacgaacttcatgtgcactgtaaaaccagcttcgttggctattttccagctactgtgttgtgggagcttctagggccaggtgagagtggatccgaaggtgcaggaaccttttatatagctaggttccttgccgctgttgcacacagccctctggcagctcagctgaagccgatgaccccctttaagcggacgcgaatcaccggtaaccctgtagtgacaaacaggatcgaagagggcgaaaggccagaccgggctaaagggtatgatctggaactgtccatggccttggggacctattatccgcctccaagactgcgccagctattgcccatgctcctgcaggggacaagtatctttactgccccaaaggaaatagctgagatcaaagcccagctcgagacggctcttaagtggagaaactatgaagttaaacttagactcctgctccacctcgaggagctgcagatggaacacgacataaggcactatgacctcgagagtgtgcccatgacatgggatcccgttgaccagaatccccgccttctaaccttggaggttcctggcgtcactgaaagccggccttcagtgctgagaggagatcaccttttcgcacttcttagcagcgaaacacaccaggaagacccgataacttataagggattcgtgcataaagtggagctggaccgggtgaagctgtctttctccatgagtctcttatctcggtttgtcgacggcttaacattcaaggtaaattttacttttaacaggcagccattaagggtccaacatcgggccctggagttgacgggacgttggctgctgtggcccatgctattccctgttgcaccccgcgatgtcccgctactcccctccgatgtcaagttaaagctctacgacagaagtctagagtctaaccccgagcagttgcaggcaatgcgccacatcgtgaccggcactacgagacctgccccctacatcattttcggcccgcctggtacgggaaagacagtgactcttgtcgaggccattaagcaagttgtgaaacatctgccaaaggcccacatcttggcctgtgctcctagtaacagcggcgctgacttgctttgccagcgactacgagtgcacctcccatcgtccatttatcgcctccttgctccgagtagagacatccggatggttcctgaagatattaagccatgctgtaactgggatgctaagaaaggcgagtatgtcttccccgcaaaaaagaaacttcaggagtaccgcgttctcattactaccctcataacagccggtaggcttgttagtgctcagtttccaatagaccacttcacacacattttcattgatgaagctggccattgcatggagccagaaagtctggttgcaattgccgggctgatggaggtgaaggaaacaggggatcctggtggtcagttagtcttggccggagaccctagacagctcggcccagttctacgatctccactcacccaaaagcatgggctcggttattccctgctggaacgcctgttgacatataactctctgtacaaaaaggggcccgacgggtatgatccgcaatttattacgaaacttctgcgtaattataggtcacaccccacaatactggatattccaaatcagctatattatgagggagaactgcaggcatgcgccgatgtagtcgacagggagagattttgtaggtgggccggcctgccaagacagggatttcccattatttttcacggggtgatggggaaagacgagagggaaggtaacagcccaagcttctttaatcctgaggaggccgcaacagtgacaagctacttgaagctgctgcttgctcccagttcaaagaagggaaaggcacggctttcgccccgatccgtgggggtgataagtccttaccggaagcaggtcgagaaaatacgctattgtattacaaaactcgatcgcgaactgcgagggctggacgacattaaagacctgaaggtggggagtgtggaggagttccaaggacaggaaagaagtgtcattcttatctccaccgtcagatcttcacagagctttgttcaactggatctagatttcaatctaggtttcctgaaaaaccctaagagattcaatgtagctgttacccgagctaaggcactgctcattatcgtaggcaacccgctgttgctgggtcacgacccggattggaaggtgtttttagaattctgcaaagagaatggcggttatactggctgccccttccctgctaaactcgatttacagcagggccagaacctgctgcaggggttaagtaagctcagcccttctacctccggtcctcactcacatgattacctgccacaggagagggagggggaggggggtctgtctttacaggtagagcctgagtggaggaacgagctgtag

SEQ ID NO: 195676 - DNA, 2844 bp, Artificial Sequence
  Description of Artificial Sequence: Synthetic coding sequence
atgctgtacggcatgaagatcgccaacctggcctacgtgaccaagactagggttcggttttttcggctggatagatgggctgatgtgcggtttccggagaagcgccgcatgaagctgggcagcgatatatcaaagcaccataagtccctgctcgcgaagatcttttatgacagggccgaatatttacacggaaagcatggggtggatgtggaggtgcaggggccccacgaggctagggacgggcaattgctgataagactggatttgaatcggaaggaagttctcaccctacgactcaggaacggcgggactcaatctgtgacacttacccatctgttccccctgtgccggacacctcagttcgccttctacaatgaagaccaggagctcccatgtccattaggaccgggagaatgctacgaactgcatgtccattgtaagacttcattcgttggatacttccccgctaccgtcctctgggaactgctgggaccaggggagtccggatctgagggtgcaggcactttctacattgccagatttcttgccgccgtggctcacagcccccttgctgcccagctcaagcctatgacgccctttaagcggactagaatcactggcaaccctgtcgtcactaatcgaattgaggaaggggagcgcccagaccgggccaagggctatgacctcgaactctccatggccctaggcacatattacccccctccgcgtctccgccagctgctcccgatgttactgcaaggcacgtctatatttaccgcccccaaggaaatagctgagatcaaggcccagctggagacggccctcaagtggagaaattatgaggtcaagctgcggcttctgctacacctggaggagctacagatggagcacgatatccggcattatgacctggaaagcgtgccaatgacctgggatcccgtggatcagaacccccgactccttactctggaagtcccaggggtgacggagtcacgaccatccgtgctgcgtggagaccacctattcgccctgttgagctcagagacacatcaggaagaccccattacatataaaggattcgtgcacaaagtggagctggatagggttaaattaagcttttccatgagcctgctttctcggttcgtggatggactgacctttaaggtgaattttaccttcaaccggcagcctctgcgcgtacaacaccgtgcactggagttgaccggaagatggctgctgtggccaatgctctttcctgtggccccacgggacgtgccactgttgccttcggacgtgaagctgaagctctacgaccgcagtctggaatccaacccagagcaacttcaggccatgagacacattgtaactggaacaacacggccggctccatatataatttttggacctccaggaactggtaaaaccgtaaccttggtcgaagctataaagcaggtcgtcaaacatctgcctaaagctcatatcctggcctgcgccccttctaacagtggtgcagacctgctctgccagcgactgagagtgcacctgccaagctctatctaccggctgctcgcaccctctcgtgatatcaggatggtcccggaagacatcaaaccctgttgcaattgggacgcaaaaaagggggagtatgtcttccccgctaagaaaaagcttcaggaatacagagtactgattacgacactgatcacagcaggtagactggtaagtgctcagttccccatagaccatttcacgcacattttcatagacgaagccgggcattgtatggagccagaatcacttgtggccattgcgggcctcatggaagtaaaagaaaccggtgaccccgggggacagctcgtgttagctggtgatcccagacagctagggccagtattgcggtcaccactcacacaaaagcacgggttagggtatagcctgcttgagcggctactgacgtataattccctctataagaaaggaccagatggctatgatccgcagtttatcacaaagctgcttaggaactaccgaagtcaccctaccatattagatattccaaatcagctgtattacgagggcgagctgcaggcgtgcgctgacgttgtggatagagagagattctgtagatgggctgggttgccccggcagggcttccccatcattttccatggggtgatggggaaggatgagagagaaggaaacagcccaagcttcttcaatcctgaagaagctgctacagtgacatcttaccttaagctgttgttggccccgtctagtaagaaggggaaggcacgactgtccccccgtagcgtaggggtgatttctccatatcggaagcaagtcgagaagatacgttactgcatcaccaagctcgaccgagagctaaggggcttggacgacattaaggatttaaaagtgggctctgtcgaggagttccaaggtcaggaacgtagcgtgatcctgatatcaactgtcaggtcctctcagtcttttgtgcaactcgatctcgactttaacctgggcttcttaaaaaatccaaagcgatttaacgtcgctgtgactcgcgctaaggccctgcttattattgtgggtaatccactgctcctcggtcacgaccctgattggaaagtgttcctggaattctgtaaggagaacggcggttacaccggctgccccttcccggcgaagctcgatctccagcaggggcaaaatctactgcagggtctcagcaaactctcaccgtctactagtgggccccacagccatgattacctaccacaagaaagagaaggagaagggggtctttctctgcaagttgaacctgagtggcgcaatgaactgtag

SEQ ID NO: 195677 - DNA, 3012 bp, Artificial Sequence
  Description of Artificial Sequence: Synthetic coding sequence
atgcccagcaagttcagctgccggcagctgcgggaggccggccagtgctttgagtctttcttagtggttcgcggtctagacatggaaactgatcgcgagcgcctcagaactatctacaaccgcgactttaagattagcttcggtacacccgcgcccggattcagtagcatgctgtatggcatgaaaattgcaaatctcgcctacgttacgaagaccagagtgaggttcttcagactcgaccggtgggccgacgtgcgatttccagaaaagcgacgtatgaagctgggatccgacatctccaagcatcataaatcactcctcgctaagatcttctacgacagagccgagtacctgcacggaaagcacggggtagatgtcgaggtgcaggggccgcacgaggcacgggacggtcagctgctcattaggctagacctgaacagaaaagaagtcctaaccctgcgcctgagaaacggcgggacccagtcggtgaccctgactcatcttttccctttgtgcagaacaccccagttcgctttctacaacgaagatcaggagttgccgtgcccgttgggacctggggaatgttatgagcttcatgtgcactgtaagacctcgtttgtcggatactttcctgctactgtgttgtgggagttgctgggaccaggtgagtcaggttcagagggagccggaacattctatatagcaagatttttagccgcggtggcccactccccactggcagcccaactgaaaccaatgacccctttcaagagaacgaggattacaggtaatccagtagtgactaacagaattgaggaaggagagaggcccgacagggctaaaggctacgatttggagctcagcatggctctgggcacttattaccctccacctcgcttacgacaactactgccaatgcttctgcagggcacctctatattcactgctcctaaagagattgccgagattaaggcccagctggagactgccctaaagtggagaaattacgaagtgaagctgcgactgcttcttcacttggaggaactgcagatggagcacgacattagacattatgatctggagagcgtccctatgacttgggacccagtcgatcagaaccccagacttctgaccctcgaagtgcctggcgttactgagagtagaccttcagttctgcggggggatcatctgtttgccctgctcagctcagagacccaccaggaggatccaataacatataagggctttgtgcataaagtggagttagaccgcgtgaagctcagtttctctatgtctctgcttagccggtttgttgacggcctgacttttaaagtcaatttcacgttcaaccgccagcctctgcgtgttcagcatagggctctcgaactgaccggaagatggttgctgtggcccatgctctttccagtagcccctcgtgatgttccactccttccttccgatgtgaagctcaagctgtatgataggtccctcgaatccaatccagagcaactacaggcaatgagacacatcgtgaccggcaccacccgccccgcaccgtacataattttcgggcccccaggcaccggcaaaacagtgaccctggtggaggccattaagcaggttgtgaagcatctgcccaaggctcacatactcgcctgtgctccctcaaactcgggtgcagacctactctgccaacggctacgcgtacacctccctagctcaatctatcggctgcttgcccccagtagagatattaggatggtgcccgaagatatcaaaccatgctgcaattgggatgccaagaagggtgagtacgtgtttcccgccaagaagaaactgcaggagtacagggtcctgattaccaccttaatcactgcaggacggctggtcagtgcccagtttccaatagaccacttcactcatatctttatagacgaagcaggacattgtatggagcctgagtccctcgttgctatcgctggactcatggaagtgaaggagaccggagaccccggtggccagctcgtgctggctggggatccgaggcagctggggcccgtattgagatctccattaactcagaagcacgggctagggtacagcctcctcgagcgcctacttacttacaactccctttacaagaaaggccccgatgggtatgatccccaattcatcacaaagctcctacgcaactacagatcacatcctacaatcttggacattccaaatcagttgtattacgagggagagcttcaagcctgtgccgacgttgtggatagagagcgtttttgtcgctgggcgggccttccacgccaagggttcccaatcatatttcacggggtcatggggaaagacgagagggaggggaactccccctccttttttaaccccgaggaggccgccacagtaaccagctatctgaaactgctgctggctcctagctccaagaaaggtaaagcaaggttgtccccccggtccgtaggagtcattagtccgtatagaaaacaggtggaaaagattcgctattgcattaccaaacttgatcgggagctgaggggtctggatgatatcaaggatctgaaagtgggatctgtggaggaattccagggccaggagaggagcgtgattctgatcagtacagtcagatctagccaaagtttcgtgcaactggacctcgattttaatcttggctttctgaagaatccaaaaaggttcaacgtagccgtgaccagagccaaggcactcttgattatcgtaggaaaccccctgctcctggggcacgaccccgattggaaagtctttcttgaattctgcaaagaaaatggcggatacactggatgtccattccctgccaaattagacctgcagcagggccagaatcttctgcagggtcttagcaagctatcaccatccacctcaggcccccattcacatgattatttgccacaggagagagagggggagggtggcctcagcctgcaagtggaaccagaatggcgcaatgaactgtag

SEQ ID NO: 195678 - DNA, 2826 bp, Artificial Sequence
  Description of Artificial Sequence: Synthetic coding sequence
atggagaccgaccgggagcggctgcggaccatctacaaccgggacttcaaaatttcctttggcactcctgcacccggattttcttccatgctttacggtatgaagatcgccaacctcgcttatgtcactaagactcgcgtgagatttttccgtctggatcgctgggctgacgtgagattccctgaaaaaaggcgcatgaaactgggctctgacattagcaaacatcacaagtcacttctcgcaaaaatcttctatgaccgcgccgagtatctccacggtaagcatggtgggacccagagtgtcactctgacacacctctttccactctgtcgcactcctcagtttgccttctacaacgaggaccaagagctgccctgcccgctcggccccggggaatgttatgaactgcatgttcactgcaagacgagttttgttggatacttccctgccacggttctttgggaactgctcggcccaggagaatctggatcagaaggggcaggtaccttctacattgccaggttcctggcggcagtggcacacagccccctcgctgcacaactgaaaccaatgacaccattcaagagaacgagaattacaggcaatcctgttgttacaaataggatcgaggagggtgagcgccccgacagggccaaggggtatgatctggaactctccatggcgctgggtacatactacccaccacctcgcctccgccagttactccctatgcttctgcaaggaactagtatcttcacagcccccaaggaaatcgctgagatcaaggcacagctggagaccgccctcaaatggcggaactacgaggtgaagctgcgcttgctgcttcacctcgaagagttgcagatggaacatgatatccgacactatgaccttgagagtgttccaatgacctgggaccccgtggaccagaacccgagactcctgacgcttgaagttcctggagtgaccgaatctcgcccatctgttcttcgcggggaccacttatttgctctcctgtcttcagagacccaccaggaggaccctatcacatataaaggattcgtgcacaaagtagaactggatcgggtgaagctcagtttcagcatgagcctcttgtccagattcgtggacggtttaacgttcaaagtgaacttcacgtttaacagacagcctctgcgcgttcagcacagggcactcgagctgacgggtaggtggctactgtggcccatgttattcccagtggccccaagagacgttcctctgctgccatccgacgtcaaactgaagctgtatgaccgctccctggagagtaaccccgagcagcttcaagcaatgcgacacatcgttaccggaacaacacggcccgctccctatattatcttcggaccgcccgggacggggaagactgtcaccctcgtggaggcaattaaacaggtggtcaagcacttgcctaaggcgcatattcttgcctgcgcgccctcgaactcaggcgctgatctgctatgtcagcggctgcgcgtccacctcccttcctctatatatcgcctgctagcgccatcacgggatattcgcatggtccctgaggacatcaagccctgttgtaactgggatgccaaaaaaggagagtacgttttcccagctaagaaaaagttgcaagagtaccgcgtcctgattaccacactgatcacggccggccgtttagtaagtgcccagttccctattgaccactttacccatatttttatcgacgaggcaggtcattgtatggaaccagaaagcctggtcgccatcgccgggcttatggaagtgaaagaaaccggggaccccggcggacagctggtcctcgccggtgacccaagacagctgggccccgttttgagatctccgttgacccagaagcacggcctgggatacagcctgctggagaggttgctgacgtacaattcactttacaagaagggacccgatggctacgacccccagttcatcaccaaacttctgcgcaactaccgctcccatcccactattctcgacatccctaatcagctctactatgaaggcgagttacaggcatgtgctgacgtcgtagacagggagaggttttgtcggtgggcaggtctgcctcgccagggattcccaattatcttccatggggtaatgggcaaggacgaacgcgaaggaaactccccttcattttttaatccggaagaggctgccacagtgacctcctacttgaagcttttactggctccaagctcgaaaaagggcaaagcacgattgagcccacgctcagttggggtgattagtccctatagaaagcaggtggaaaaaattaggtactgcatcacaaagctggaccgggaactgagaggtcttgatgatataaaagatctgaaggtcggatctgtcgaagagtttcaaggtcaggagcgcagcgtcatactgataagcacggttcgctcttcgcagtccttcgtacagttagacctggacttcaatttgggcttcttgaaaaacccaaagagatttaatgttgctgtgacaagagcgaaggccttgctaataattgtgggtaatcctctgcttctgggtcacgacccagattggaaggtcttcctggagttctgtaaagagaacgggggctacaccggctgtccatttcccgctaagctggacttgcagcagggtcagaacctactgcaggggctgtccaaactgtcacctagcacatccggacctcattcccacgattatttaccccaggaacgtgagggtgagggggggcttagcctgcaggtagaacctgagtggagaaacgagctgtag

SEQ ID NO: 195679 - DNA, 3012 bp, Artificial Sequence
  Description of Artificial Sequence: Synthetic coding sequence
atgcccagcaagttcagctgccggcagctgcgggaggccggccagtgtttcgagagtttcttggttgtacgtgggctggatatggaaaccgatcgcgagaggcttagaaccatatataaccgcgattttaagatctcctttggcactccggctccaggcttttcaagcatgctctacgggatgaaaattgcgaacctcgcatacgtcactaaaacacgggtcagatttttcagattagatcgctgggcggatgtgagatttcctgagaaacggaggatgaagctaggaagtgacataagtaagcaccacaagagtttgttggctaaaatcttctatgacagagcggaatatctgcatggcaagcacggggtagacgtggaggtacagggtcctcacgaggctagggacgggcagctactcatccgcctggatctcaatcgaaaagaagtgttaaccctgcgcctgaggaatggaggtacccagtccgtgacgctcactcatttgttcccactgtgcagaaccccgcaattcgctttttacaacgaggaccaggagttgccttgcccactaggacctggggaatgctatgaattacacgtccattgcaagacttcgttcgtggggtattttcctgctactgttctgtgggagctgcttgggcctggagagagcggaagcgaaggcgctggcaccttctatatcgccagatttctggccgcggtagcccacagtcctctggcagcccagttaaaacccatgacccccttcaaaaggacgcgtatcacgggcaaccccgttgtcaccaaccgcatcgaagagggcgagagaccagatagagctaagggctacgatctcgagctgagtatggccctcgggacatattatcctcctccccgactgaggcagctgctgcctatgttactgcagggtaccagtatcttcactgctcctaaagaaatcgccgaaataaaggcccagctggagacagcactaaaatggcgcaactacgaggtgaagctgcggcttctcctccatctggaagagctgcagatggaacatgacattcggcattatgacctcgagagtgtacctatgacttgggatccagtcgatcagaacccgcgtctgctgaccctggaggtgccaggagtcaccgagagccggccaagcgtgctcaggggagatcatttatttgcactattaagcagcgaaacccaccaggaggacccaataacatacaaaggcttcgtccataaagtcgaattggaccgggtcaaactgtccttctctatgtctctgttaagccgctttgttgatggactgacctttaaggtgaactttacttttaatagacagcctcttagggtgcagcatagggccctggagttgaccggcaggtggctcttatggcccatgttgtttcctgtggcgcccagggacgtccctcttctccctagtgatgtcaagttaaagctgtacgacagaagcctggagagcaacccagaacaactccaggctatgaggcacatagtgaccggcacaactagacctgctccctatattatcttcgggccccccggcacgggtaaaactgtgactctcgttgaagccataaagcaggtggtgaagcacctgcctaaagcacacatactggcctgcgcaccatctaacagtggggcagaccttctgtgtcagagactgcgcgtccacctgcccagttctatctatcgcctgttggctccttctcgagatatacgcatggtcccggaggatattaagccttgttgcaactgggatgctaaaaaaggggaatatgtgtttcctgccaaaaaaaagctccaggagtatcgggtgctaatcaccacgcttattaccgccggtcgcctcgtctcagcacagttccccatcgatcacttcacacatattttcattgacgaggctggccattgcatggagcccgaatcacttgtagcgatcgcagggctcatggaagtcaaagagactggtgaccctggcgggcagctggttctggccggagaccctcggcagctaggccctgtgcttaggtctcccttgacccaaaaacatggacttggctactcactgttggagcgccttctcacttacaatagtctctataagaagggcccagatggttacgaccctcaattcatcacaaaactgttgcgaaactatcggagccaccccactatcctggacattcctaaccagctgtattatgagggcgagttgcaggcttgcgcagacgtggttgaccgcgagcggttttgtcgctgggcaggcttgcccaggcaggggttcccaatcatcttccatggagtaatgggaaaagatgagcgcgagggaaattcaccaagcttctttaatccagaggaggctgctaccgtaacatcatacctgaagctcctcctggcaccatcctcaaaaaagggaaaggctagactgtcacctcggagcgttggagtcatctctccctatcggaagcaagtagagaaaattaggtactgtatcaccaagctggaccgtgagctaaggggccttgatgacattaaggatctgaaggtaggcagcgtggaagagttccaggggcaggagcgatctgtgatccttattagtacggtgcgctcaagtcagtccttcgtgcagcttgatctcgactttaatctagggtttctgaaaaatcctaaaaggttcaacgttgcggtcacacgagcaaaggctctcctgatcattgtgggtaacccgctccttttggggcacgaccccgactggaaagtctttctcgagttctgcaaggagaatggaggatacacaggatgtccctttccagctaaactggaccttcagcaggggcaaaacctactgcagggactgtccaagctcagtccgagcacctccggacctcacagccacgattatctaccccaggaacgggagggtgaggggggcctgtcactccaggtcgaacctgaatggaggaatgaactgtag

SEQ ID NO: 195680 - DNA, 171 bp, Artificial Sequence
  Description of Artificial Sequence: Synthetic coding sequence
atgcccagcaagttcagctgccggcagctgcgggaggccggccagtgtttcgagtcctttctagttgttaggggcctcgatatggaaacggatcgcgagcgccttaggactatctacaacagggacttcaagatttctctggctagttccaagtcgatcctgcagagttag

SEQ ID NO: 195681 - DNA, 3636 bp, Artificial Sequence
  Description of Artificial Sequence: Synthetic coding sequence
atgctgagcctggccgccaagctggtggccttcttctggcggaccgccgacacacccagggaagaggctggccagctggaacccgagctggccgagggagatacgaagctgaagaccgtcagaggtgtggtgacccggtactgctccgactacggaatgattgacgacatgatttactttagctctgacgccgtcacctctagagtgctgctcaatgtgggtcaagaggtcatcgctgtggtggaagaaaataaagtgtccaatggcctaaaggccatcagggtggaagctgtgagtgacaagtgggaggatgactcccgcaaccatgggagtccatctgactgcggccccagagtcttaatcggctgtgtgacatcactggtggaaggcgctgggtgtatctctcaaaccacttacttttcactggaatctgtgtgcgaaggtttcgagccttgcaaaggcgactgggtggaggcagagtaccgcatccgccccggaacatggtcaagcgaggcgacaagtgtaaagcctcttcggtacaagagggttgataaggtgtgcatatctagcctctgtggtcgaaacggagtcctggaagagagcatattctttacgctcgacagtttgaagctgcctgacggttacactccgagaaggggcgacgtggtaaacgcggtggtcgtcgaatccagccagtcatgttacgtgtggcgggcgttatgcatgacgctcgtgaaacgccgggacgcggccccagtccacgaggccacccacttttacggcactattctgctgaaaaacaaaggagatatcgaggtgacacaggttacccacttcggcacactgaaagaggggcgcagcaaaaccatggtgatatggatcgagaataagggggatatacctcagaacctggtgtcttgtaaactggccggctgggacaagtccaagcagttccgcttccagatgctagataaggaccagatgtgtcccgtggtgtcctttgtctctgtgccagaaaaggagaacagctcggatgaaaatatcaattccttgaactcccacacaaagaataaaacttcccagatgagcgagagctcactagtcaacaatcgaggaatctcaccaggcgactgcacgtgcaaaggggaaaatggcgagaaggataacatcctgagccggaaacaaatgaccgagcccgaacccggagggctagtcccccctgggggtaagacatttatagtagtgatttgtgacgggaagaatccgggccgttgcaaagaacttctgctgctgtgtttcagtgacttcctgattggtaggtacctcgaagtcaatgtgatttccggcgaagaaagcctgatcgcagccagggaacccttctcttggaagaagctcaagtcttcacaagctttgacctcagctaagaccacagtagtggtgaccgcacagaaacgaaattcaagaaggcaactccctagcttcctgccgcagtacccaattcctgacaggctgcggaaatgcgtcgaacagaagattgacatcctgacgttccagccactgctcgctgaattgctaaatatgtcaaactacaaggagaaatttagcaccctgctgtggcttgaagagatttacgccgaaatggagctaaaagagtataacatgtctggaattatcttgagaaggaatggcgaccttctcgtgctggaagtccctggcctggctgagggtaggccctccctatatgctggagataagctgattctcaaaactcaggaatacaacggtcatgccatcgagtacatctcatacgtgacagaaattcacgaggaagatgtgaccctcaagattaacccagaattcgagcaagcatacaatttcgagcctatggacgtggaatttacttacaatagaacaaccagtaggcgatgccactttgccctggaacacgtgatccatctcggcgtcaaagtcttgtttcctgaagagattatcttacaatcaccccaagtgaccggcaattggaatcatgctcaggacacaaagtcaagtggtcagtccaccagcaagaaaaatagaaaaactatgacagatcaagcagagcacggcactgaggaaagaagggtgggcgacaaggaccttcctgtgctcgcccctttcaccgcagaaatgtccgactgggtggacgagatacagacgcccaaagcccggaaaatggaattcttcaatcctgtcttgaatgagaaccaaaaactagctgtgaagaggatcctctccggcgactgccggccgttaccctacatcctatttggaccgcctgggacaggtaagacagttaccattatcgaggccgtgcttcaggtgcactttgctctgcctgactcgagaatattagtgtgtgcccctagcaactcagctgctgatttagtttgtctccgcctgcatgagagcaaggtgctccagccagcgacgatggttagagtaaacgccacatgtagattcgaggagatcgttattgatgccgtcaaaccatactgcagggatggagaggatatctggaaggcttccaggtttaggatcattatcaccacttgttcgtcctctggcctgttctatcaaatcggcgtcagagtcggccacttcacccatgtgtttgtcgacgaggcaggtcaggcctctgagcctgagtgcctgatccccctgggcttaatgagcgacatcagtggacagattgtgctggccggtgaccccatgcagctggggcccgtgatcaagtcccggctggccatggcttatggccttaatgtgagctttctggagagactcatgtctaggcccgcctatcagcgggacgagaatgccttcggggcctgtggcgctcacaatcccctgctggtcactaaactggtgaagaactacagatcacatgaagctctgcttatgctgccgagcagactgttctaccaccgcgaactggaagtgtgcgccgatcctaccgtggtcacttccctcctgggatgggagaagctgcccaagaaagggttcccactgatcttccacggcgtcagagggtcagaagcgagggagggaaaatcaccctcatggtttaatcctgccgaggctgtccaagtgctgcgctattgttgcttgctcgcacacagcatcagctctcaggtaagtgccagcgatatcggagtgattactccatacagaaaacaagttgaaaagattcggattctgcttagaaatgtggatctcatggacataaaagtgggaagcgtcgaagaattccagggccaggagtatctcgtgattattatctccaccgtgcggtctaatgaggacaggtttgaggacgacagatacttcctgggcttcctttccaactccaaaagattcaacgtggccatcacacggcccaaagccctcttaatagtgctcggaaatccacacgtgctcgttcgagacccctgtttcggggccttgctcgaatatagcataacaaatggtgtttatatgggctgtgatctgcctcccgccctgcaatccttgcaaaattgcggcgagggcgtagctgacccttcctatccagttgtgcctgaatccacggggcctgagaaacaccaagagcccagctag

SEQ ID NO: 195682 - DNA, 378 bp, Artificial Sequence
  Description of Artificial Sequence: Synthetic coding sequence
atgagcgacatcagcggccaggtgaccaagctggtgaagaactaccgctctcatgaggcattactcatgctgccatcacggttgttttaccacagagaactggaggtgtgcgcagaccctacagtggtgacatcactcctgggctgggagaagctccctaaaaaggggtttccattgatcttccacggtgtacggggtagtgaggccagagagggcaagagcccatcttggtttaatcctgctgaggctgtccaggtactcaggtactgttgtctccttgctcactccatctcaagccaggtgtctgcctccgatatcggggtcatcacaccatatcggaagcaggttcgtcccgcccaagcaagattagttttatag

SEQ ID NO: 195683 - DNA, 378 bp, Artificial Sequence
  Description of Artificial Sequence: Synthetic coding sequence
atgagcgacatcagcggccaggtgaccaagctggtgaagaactacaggtctcatgaggccctcttgatgctgcccagccgtttgttctatcaccgggaattagaagtgtgcgccgatcccacggtcgtcaccagcctgctcgggtgggaaaagttacctaaaaaaggctttcccctcatcttccatggagtgcggggcagcgaagcgcgcgagggcaagtctccaagttggttcaatcctgccgaggcggtccaagtgctaaggtactgctgtcttttagctcacagtatatcctcccaagttagcgcttccgatatcggtgttattacgccttaccgtaaacaagtgaggcccgctcaggcccgccttgtgctgtag

SEQ ID NO: 195684 - DNA, 1017 bp, Artificial Sequence
  Description of Artificial Sequence: Synthetic coding sequence
atgttccgggtgggccacttcacccacgtgttcgtggacgaggccggtcaagccagcgagcccgaatgtctaatccccctgggactcatgtccgatataagcgggcagatcgtgcttgctggtgatccaatgcagctgggccccgttattaagtccagattggcaatggcatatggcctcaacgtcagctttctcgaaagactgatgtctaggccagcttaccagcgggacgagaacgcattcggcgcatgcggcgcgcacaacccccttttggttactaaactcgttaagaattaccgatcccatgaagctctgctgatgcttccctctcgcttgttctaccatcgcgagttggaggtttgcgccgatcccacggtggtgacttcattactcggatgggaaaaactgccaaagaaagggttccctttaatctttcacggtgtccgtgggagtgaagcccgtgaagggaaatctccctcatggtttaaccccgccgaggccgtccaggttctccgttattgctgcctcctcgcacactcaatatccagtcaggtttcggcatctgacatcggagtgattaccccttatagaaagcaggttgaaaagattaggatactgctccgcaatgtagacctcatggatatcaaggtcgggtccgtggaagagtttcagggccaagagtacttggtcatcataattagcaccgtgcggtctaatgaagatcgtttcgaagacgaccgatacttcctgggatttctcagtaatagtaaacggttcaacgtcgccatcacccgtcccaaggccctgttaattgtgctgggaaaccctcatgtgcttgtccgcgatccctgttttggtgccctcctggaatactcaatcacaaacggggtatatatgggctgtgacctcccacctgccttgcagtcactgcagaattgcggcgagggggtcgcagatcctagctacccggttgtcccagagtctacaggacctgagaagcatcaggaaccaagttag

SEQ ID NO: 195685 - DNA, 3498 bp, Artificial Sequence
  Description of Artificial Sequence: Synthetic coding sequence
atgctgagcctggccgccaagctggtggccttcttctggcggaccgcggatacaccacgcgaggaggccggacagctcgagccggaattggcagagggtgacacaaaacttaaaaccgttagaggggttgtgacgcgctattgctccgattacggcatgattgatgacatgatttacttcagtagtgatgctgtcaccagcagagtcctgttaaatgtgggccaggaagtgattgctgtggtcgaagagaataaagtgtccaatggactgaaggccatccgggtggaagccgtgtctgacaagtgggaagatgactcccgcaaccacggctcaccaagcgactgtggaccacgcgtgcttataggctgtgtgacgtcacttgtcgagggcgctggatgcatcagccagacaacttacttttccttggaaagcgtgtgtgaaggctttgagccctgcaaaggagattgggttgaggccgagtaccgcatcaggccgggaacctggtccagcgaggccacgtccgtgaaacctttgaggtataagcgtgtcgacaaggtctgtatttcgtcactttgcggacggaatggagtgctcgaagagtccattttcttcactctcgatagcttgaaactccctgacggttacacaccgcgtcgaggcgacgtggtgaacgcagtggtggttgaatcttcccagtcgtgctatgtgtggcgagccctctgcatgaccctcgttaaacgcagagatgcagctcctgtgcatgaggccactcacttctacggcaccatcctgctgaagaacaaaggagatattgaggtcacccaggtaacgcacttcggtacattaaaggaaggacgaagcaaaactatggtaatctggatagaaaacaagggggacattccacagaatctggtctcatgtaagctggcaggttgggacaagagcaaacagttccggttccagatgctggacaaagaccagatgtgtcctgtcgtgagtttcgtcagtgtccccgagaaagagaatagtagcgatgagaatattaattccctgaatagtcacacaaaaaataagacctcccagatgagtgaaagctctctggtcaacaatagaggtataagcccaggagactgcacttgcaaaggggagaacggcgagaaggacaatatattgagtcgcaaacagatgacagaaccagagcctggggggctggtcccccccggtggcaaaaccttcatcgtggtcatttgcgacgggaagaatcccggtcgctgcaaagaactgctgctgctttgtttttccgattttttaattggcaggtacctcgaagtaaacgtgatcagcggggaggaatctctgatagctgcacgggagcccttttcttggaagaagctgaagtcgagtcaggctcttacttcagctaaaaccaccgttgtcgttaccgcacaaaagcgaaattctcggagacagctgcccagcttcctgccacaatatccgatcccggacagacttagaaaatgcgtcgaacagaaaatcgacattttgacgttccagcccctcctggcggaactgttgaatatgagcaattacaaggagaaatttagcactcttttgtggttggaggagatctacgctgagatggagctgaaagagtacaatatgtccgggattatcctgagaagaaacggggacttgctagtgttagaagtgcctggcctggctgagggtcggccctccctgtacgcaggagacaagctgatcttgaagacgcaggaatataacgggcatgcgatcgagtacatttcttacgtgactgaaatacacgaggaggatgtgactcttaagataaaccctgagttcgagcaggcttacaattttgaaccaatggacgtggagtttacatacaataggaccacttcaagacggtgccactttgctctggagcatgtaatccacttaggggtgaaagtcctattccccgaggagataattctgcagtcccctcaggtgaccggaaattggaaccatgcacaggatacaaagtcctccggtcaaagcacatccaaaaagaatcgcaaaactatgacagaccaggccgagcatggcaccgaggagcgtcgtgttggcgacaaagacttgcccgttcttgctccttttacagctgagatgagtgactgggtggacgaaatacaaacacccaaagctagaaaaatggagttctttaacccagtgttaaacgaaaatcagaagttagctgttaagcgaatcttgagtggcgattgccggcccctgccctacatcctcttcggtccccccggaactgggaaaacagtcaccattattgaagcagtgcttcaggtgcatttcgcactccccgacagccgtattctggtctgcgcaccatccaacagtgccgccgacttggtgtgtctccggctgcacgagtccaaggtgttgcagccggctaccatggtcagagtgaacgctacttgtcggttcgaggagattgtaatcgacgccgtcaagccctactgccgtgatggggaggatatctggaaggctagccgattccggatcattatcactacttgctcttcaagcgggcttttttatcagatcggcgtcagggtagggcattttacgcacgtgtttgtcgatgaagctggtcaagcatctgagcctgagtgcctgataccgttgggcttgatgagtgatatctccggtcagattgtactcgccggcgaccctatgcagttaggccctgtcatcaaatcacgtctggccatggcctatggccttaatgtgagctttttagagaggctcatgtcacggcccgcgtaccagagggacgagaacgcgttcggggcatgcggggcacataatccactactggtaactaagctggtcaaaaactataggtcacatgaagccttattgatgttacccagcaggctgttttaccacagggagctagaagtatgcgccgacccaacggtggtgacctcactcctcggctgggaaaagctccccaagaagggctttcctttgatctttcacggagttagggggtccgaagcccgtgaaggaaagagcccgagctggttcaaccctgccgaagctgttcaggtcctcaggtactgttgcttgttggcccattcgatttcgtcccaggtgagtgcctccgacattggcgtcattacaccatatcggaaacaggttgaaaaaattagaatcctgctccggaacgtcgatcttatggatatcaaagtaggttccgtggaagagttccagggtcaagagtatcttgtgattatcatttccaccgatccctgtttcggagcactcttagaatattccatcactaacggggtttacatgggctgcgacctaccccccgccctccagagtctgcaaaattgtggggaaggcgtggccgatccgtcctaccccgttgtccctgagagtaccggaccagagaaacaccaggagccaagttag

SEQ ID NO: 195686 - DNA, 636 bp, Artificial Sequence
  Description of Artificial Sequence: Synthetic coding sequence
atgagcttcctgcccgtgcggagcgtgatcggcggcggcgacaccaagctcaaaacagtccgaggggtcgttacaaggtactgctctgactatggcatgatcgacgacatgatatacttctcaagtgacgccgttacctcccgagtgttgcttaatgtgggtcaggaggttatcgccgttgtagaagagaacaaggtctccaacggtctgaaggccattcgtgtggaggctgtgagcgacaagtgggaggatgatagtaggaatcacggaagcccgagcgattgtggccctcgggtgctgatcggatgtgtcacctcgttggttgaaggtgccggctgcatttctcagactacttacttctccttggagtcagtttgtgagggattcgaaccatgtaagggagattgggtagaagcagaataccgcatccgtcccggcacctggtcttcagaggctacgtctgtgaaaccgctgcgctataagagggtggacaaagttgcatgtcggttagtggcccccctgtgtgccagcggccggccagcgatccgtggcaacctccacggtccgggtttttcctgtatgtgttggaagcccgggaagatcaagctctgccacgggcagcgcgagaaaaaatag

SEQ ID NO: 195687 - DNA, 3498 bp, Artificial Sequence
  Description of Artificial Sequence: Synthetic coding sequence
atgagcttcctgcccgtgcggagcgtgatcggcggcggcgacaccaagttaaaaacagttcgtggagtcgtgacacggtactgttccgactacggcatgatcgatgatatgatctacttctcgtctgacgcggtgaccagcagagtcctgttgaatgtaggacaggaagtcattgctgtggttgaagagaataaagtgagcaacggcctgaaagcaatcagggtggaggctgtgtccgataaatgggaagatgactcaagaaatcatggaagcccatctgattgtggtccccgggtgctcattggttgtgtgacaagtctcgtggaaggtgccgggtgtatctctcaaactacatacttctccctggaaagcgtttgcgagggttttgaaccttgtaagggcgactgggtggaggctgaatatcggatacgcccgggaacctggtcatcagaggctacgtcagtaaagccactgagatataagcgggtagacaaggtctgtatttcaagcctgtgcgggcgcaatggcgtgttggaagaaagcatcttttttactttggacagtcttaaacttccagatggctacactccaagaagaggcgatgttgtgaatgctgtggtggtggagtcaagtcaaagctgctatgtctggagggccctgtgtatgacattggttaagagaagagatgccgcgccagtccacgaggctactcatttctacggaactatcctgctaaagaataagggagacatcgaagtgacacaggttactcattttggaacgcttaaagagggtaggtctaagactatggtgatttggatcgagaacaagggcgacattccccagaacctcgtgtcatgcaagttagccggatgggacaaaagtaaacagttcaggtttcagatgcttgacaaagatcagatgtgccctgtagtgagttttgtatccgtacccgagaaagagaactcttcggatgagaatatcaattctctgaactcgcacacaaaaaataagacgtcacagatgtcagaatcaagtcttgtgaataacaggggcatttctccgggcgattgcacgtgtaaaggcgaaaatggtgaaaaggacaacatactgtctcgtaagcaaatgacggagccagagcccgggggacttgtgccacccggaggcaagaccttcatcgtggtaatatgtgacgggaagaaccccggaagatgcaaagaactgcttctcctgtgcttttccgacttccttatcggacgttatctcgaggtcaatgtgatttctggcgaggagtctctcatcgctgcacgcgagcccttctcctggaaaaagctcaagagttcccaggcattaacttccgctaaaacaactgtagtggttacagcccagaagaggaacagccgtaggcagctcccttcatttctgccacagtacccaattccagacagactaagaaaatgcgtggagcagaaaattgacatactcacatttcagcccctgctggcagaactgctcaatatgtcaaactacaaggagaaattcagcactctcttgtggttagaagagatttatgcggagatggaactgaaggaatacaacatgagcggcataattctgcgcagaaatggagacctgttggtactagaagtcccaggcttggccgagggacgcccaagtttgtacgccggcgacaaactgatactcaagacccaggagtataacggtcacgcaatagagtacattagttacgtgacggagatccacgaagaagacgttactctcaaaatcaaccctgaattcgagcaggcctacaatttcgagccgatggatgtggaattcacatacaataggacgacctcacggaggtgtcattttgcgctggagcacgttatccatctcggcgtcaaggtcctcttccccgaagagataattcttcagagtccacaagtcacaggcaattggaatcatgcacaagacaccaagtcaagcggccaaagtacctccaaaaagaataggaaaacgatgaccgatcaggctgaacatggcacagaggagaggagggttggagacaaggatttgcctgtgctggcaccgtttacagcagagatgagcgactgggtcgacgaaatccagaccccaaaggcccggaagatggagttttttaatccagttctaaacgaaaatcagaagctagcagttaagagaatattgtctggggactgtcggccgctgccttacatactcttcggccccccaggaactggcaaaacagtgactattattgaggccgtactgcaggtgcactttgcccttcctgactcccgcatcctggtctgtgccccttccaattcggcagccgaccttgtgtgcctgcgcctgcatgaaagcaaggtcctgcagcccgccactatggtgcgagtgaacgcaacttgccgtttcgaagaaattgtgatagacgctgtgaaaccgtactgcagggatggcgaggacatttggaaggcatctcggttccgtatcatcatcactacatgtagctccagcggactgttctatcagatcggagtccgggtgggccactttacacacgtctttgtggatgaggctggccaagcaagcgaaccggaatgtttaattcctctgggtctgatgagtgatatttctggccaaattgttctggcgggcgaccccatgcaactcggtccagttataaagtctcgccttgccatggcatacggcctcaatgtgtctttcctcgagcgcctgatgagccgacctgcatatcagagagacgagaacgcgttcggggcttgcggggcccacaatcctttgttggtcaccaaactcgtcaaaaactatagatctcatgaagccctgcttatgctacctagtaggctgttttaccaccgggaactggaggtgtgtgctgacccaactgtggtgacatctctgctgggctgggagaaattacccaaaaaggggttcccattgatctttcacggcgtccgcggctccgaggcccgggaaggtaagagcccctcatggttcaatccagcagaggcagtccaagtccttaggtactgttgcctgctggcacacagcatcagctcacaagtcagcgccagcgacattggcgttatcaccccttacaggaaacaggtcgagaagatccgaatacttctcaggaacgtggacctgatggacattaaggttggaagtgtggaagaatttcagggccaggagtacctcgtgatcattattagcacagtaagatcaaatgaggatcggttcgaagacgatcgctatttcctagggttcctgtcgaactcaaagcgtttcaatgtggccatcaccagacccaaggctttattgattgtccttggaaatcctcatgtcttagttcggctctggcgcggaggtggaagacccctactaccttcaggcgctcgtatccaccggacccgcgaggcaagtggggcccagctgatctgctccggctag

SEQ ID NO: 195688 - DNA, 3636 bp, Artificial Sequence
  Description of Artificial Sequence: Synthetic coding sequence
atgctgagcctggccgccaagctggtggccttcttctggcggaccgccgatacaccaagagaagaggccggccagcttgaacctgagctggctgaaggcgatactaaactaaaaacagtgcggggtgtggtgacaaggtactgctccgattacggcatgattgacgacatgatatacttttcctctgacgccgtcacgtcccgggtgttgctgaacgtaggacaagaggttatagcggtcgtcgaagagaacaaggtctcaaatggcttaaaggcgattcgggttgaggcagtttcagacaagtgggaggatgattctcgtaatcatggttcaccctccgactgtggtccgcgggtgctgattggctgcgtcacctccctagtggagggagcggggtgcattagccagaccacgtacttttcactggagagtgtatgcgaggggtttgagccatgcaaaggggactgggttgaagctgagtaccgtatccgtccgggaacgtggagtagtgaagctacttccgtcaaacctctgcgttataagcgggtcgacaaggtgtgcatatcttcgctgtgcgggaggaatggggtgctagaagagagtatattttttaccctggattccctcaagctgccggatgggtacacaccaagacggggagatgtggtgaatgcagtggtggtggaatcctcccagtcctgttatgtgtggcgcgccctgtgcatgaccctcgtgaagaggagagacgccgcaccagtgcacgaggccacacacttctacggcactatactgctcaagaacaagggcgacattgaggtgacacaggtgacccacttcggtaccctgaaagagggaaggagcaagaccatggtcatttggatagagaacaagggagacattccacagaacctggtgagctgtaagcttgctggctgggataagtccaaacagttcagatttcaaatgctcgacaaagatcaaatgtgtccggtagtctcctttgtctccgtacctgagaaggagaacagtagtgatgaaaatattaatagcctgaactctcataccaaaaataagacaagccagatgagtgaatcaagcctggtgaacaacaggggaatctcccctggagactgtacctgcaagggagaaaatggggaaaaagacaacatcttgtctagaaagcaaatgacggaacccgaaccaggcggtctggtacctccaggaggcaagacctttattgttgtgatatgtgatgggaaaaatcctggccgttgcaaagaactgttacttctgtgttttagcgatttcctgattgggcgatacctggaggtcaacgtgattagcggcgaggaatctttaattgccgcgagggagcctttcagctggaaaaagctgaaatcatcacaggcattgacttccgccaagaccaccgttgttgtgaccgcacaaaaaaggaactctagaaggcagttaccttcattcctgccgcagtatccaatccctgaccggctgcggaaatgcgtagaacagaaaatagacatcctcacgtttcagccgctccttgccgagttgctcaacatgtccaactacaaagaaaagttcagcactctgctatggctcgaggagatttatgctgagatggaattaaaggaatataatatgagcggaattattttgcggcgaaacggcgatttgctggtgctggaggttcccgggctggccgagggacgcccttcgctgtatgccggtgacaagctaattctgaagacacaggaatataacggacatgccatagagtacattagttacgtgacagaaatccatgaggaggacgttactctgaaaattaatccggaatttgagcaggcttacaattttgaaccaatggatgtcgagttcacctacaacaggacgacctccaggagatgccacttcgcgctcgaacacgtgatccatctgggtgtgaaagtgctcttcccagaggaaattattctgcaaagtcctcaggtcactggcaactggaaccatgcacaagacaccaagtctagtggtcaatcaaccagcaagaagaaccggaaaacaatgaccgaccaggcggaacacgggacagaagagcgccgggtaggtgataaagatctcccagtcctggccccctttaccgcagaaatgagtgattgggtggacgagattcagaccccgaaagcacgtaaaatggaattcttcaatccggtgctcaatgagaatcagaagctcgctgtcaagcgcattttgtctggagactgccgaccactgccatatattttatttggccctcccgggactggcaagaccgttaccataatcgaggctgtgttgcaggtgcatttcgccctgccagactcacgaatcctggtgtgtgccccatccaattccgccgcggacttagtgtgcctcagactccacgaatctaaagtgttgcaaccagcaactatggtcagagtgaacgccacttgtcggtttgaagaaatcgtaattgatgccgtcaaaccctactgccgggacggggaggacatatggaaggcttctagatttcgcataatcatcacaacatgttctagtagcgggctgttctatcaaattggggttagggtcggccactttacccacgtcttcgtggacgaagccgggcaggccagcgagcctgagtgcctcattcccctggggctgatgtcagatatttccggccagattgtgctggcaggtgatcctatgcagctgggacccgtgatcaagtccaggctggctatggcatacggcctcaatgtgtcttttctagagaggctgatgtctcggcctgcatatcagcgggatgagaacgcctttggagcgtgcggcgcacacaaccctctattggtaaccaaactggttaagaattacaggtctcacgaagctctgttgatgttaccatctaggctgttctaccatcgagagctagaggtttgtgctgatcccacagttgtaacatccctcctaggatgggaaaaactgcccaagaagggattcccactcatcttccatggggtgaggggctccgaagcaagagaaggcaaaagtccatcctggttcaatccagccgaggccgtgcaggtgctgcgttactgttgcctcctcgcccactccatctcgtcccaggtgtctgcctctgacattggggtgattactccctaccgcaaacaggtagaaaaaattaggattctgctgcggaacgtggatctcatggacataaaagtgggatctgtcgaggaatttcaggggcaggagtaccttgttattataatatcaacagtcagaagcaatgaggaccggtttgaggatgaccgctatttccttggtttcctgagcaactccaagcggtttaatgtcgcaattacacgccccaaggcccttctgattgtcctcggcaatccccatgtgcttgttcgggatccatgttttggtgctttattggagtactctattacaaatggtgtatacatggggtgtgatctcccacctgctctccagtcattgcagaactgcggagagggtgttgcagacccatcctatcccgtggttcccgaaagtaccgggccagaaaagcaccaggaaccttcctag

SEQ ID NO: 195689 - DNA, 483 bp, Artificial Sequence
  Description of Artificial Sequence: Synthetic coding sequence
atggccgccgagcggaagacccggctgagcaagaacctgctgcggatgaaattcatgcagagaggactagatagcgaaactaaaaagcagctcgaggaagaagagaagaagataatttccgaggaacattggtatttggatctcccagagctaaaggagaaggagtcattcattattgaggagcagagctttctcctgtgcgaggacctgctctatgggcggatgtcatttcgggggttcaaccccgaagttgagaaactcatgctgcagatgaatgccaagcacaaagcggaggaagtcgaagatgagacagtggagctagacgtctcggacgaggagatggctcgtcgctatgagactctggtcggaacgatcgggaaaaagtttgcccgcaagcgggatcacgccaactacgaggaagatgaaaatggtgacattaccccaataaaagcgaaaaagatgttcctgaaaccacaagactag

SEQ ID NO: 195690 - DNA, 627 bp, Artificial Sequence
  Description of Artificial Sequence: Synthetic coding sequence
atgaaggcctgcaagcggggcaacagcgacatcgtgcggctggtgatagagtgcggcgcagattgcaacatcttgagcaaacaccagaatagtgccctgcacttcgccaaacaatccaataatgtcctggtgtacgacctcttaaagaatcacctggaaactctcagtagagtcgcggaagagaccatcaaggactactttgaggcccgccttgccctgcttgagccagtctttcctattgcatgccatagattgtgtgagggacccgatttttctaccgatttcaactacaagcccccccagaacatcccagagggctctggcatactgctgttcatctttcatgcaaatttcctgggcaaggaggttatcgcaaggctctgcgggccatgtagcgtccaagcggtcgtgcttaacgataaattccagctccccgtcttcttgaccggatctcgaagcgtggtgcaagcgggcgttcagtggcgcggcctgcagctgacgggagtccttacttcgcaagctcaggcaattttgcccccacagcctccgaactacctagggctcaagatgaccgtgatactgttcacccattcagctttgctccaggtgccgatcaactcgagctag

SEQ ID NO: 195691 - DNA, 2583 bp, Artificial Sequence
  Description of Artificial Sequence: Synthetic coding sequence
atggagcaggtggccgagggcgcccgggtgaccgccgtgcccgtgagcgccgcggatagtactgaggagctggccgaggttgaggaaggggtgggggttgtgggggaggataacgatgcggccgctcgcggagccgaagccttcggagatagcgaggaggatggtgaagatgtattcgaggtggagaaaatcctagatatgaaaacagagggaggcaaggtgctttacaaggtgcgttggaagggctacactagcgacgacgacacctgggagcccgaaatccatctagaggattgcaaggaggtgttgcttgagttcagaaagaagatcgccgagaataaagccaaagccgtcagaaaagatattcagagactcagcctcaacaacgacatcttcgaggcgaactctgattcagatcagcagagcgagacaaaagaggacacctctccaaaaaaaaagaagaagaaactgcggcagagagaggagaaatccccggatgatcttaaaaagaagaaagctaaagccggcaagttaaaggacaaatctaagccagatctggagtcgtccttggagtctctagtcttcgatttacggacgaaaaaacgcatttccgaggccaaggaggagcttaaggagagcaagaaaccaaagaaagacgaggtgaaggaaaccaaagagttgaaaaaggtaaagaagggcgaaattcgggatctgaaaaccaagactcgggaagaccctaaagaaaatagaaaaactaagaaagagaagtttgttgagtcgcaggttgagtctgagtccagcgtgctcaacgattctccctttccagaggatgactccgagggactgcattctgacagcagggaggagaagcagaataccaagtccgcccgggaaagggccgggcaggatatggggcttgagcacggatttgaaaaaccacttgacagtgccatgagcgccgaagaagataccgatgtacgaggaaggaggaaaaagaaaacaccaagaaaagccgaggatacccgagaaaatcgaaaactcgagaataaaaatgcatttttagagaagaaaaccgtgccaaaaaagcaacgcaaccaagaccggagcaagagtgctgcggaattggaaaagctaatgcccgtctccgcccagacccccaaaggccgcagactctcgggtgaagagagagggctctggtccactgattccgccgaagaagacaaagaaaccaagcggaacgagtcaaaagagaagtaccagaaaagacacgacagcgataaggaagagaaggggagaaaagaaccaaaagggctcaaaactttaaaggagataaggaacgcctttgacttgtttaagcttacacccgaagagaagaacgatgtctctgagaacaacagaaaacgcgaagaaattcccctggattttaaaacgatcgatgaccacaaaacaaaagagaataagcaatctctgaaggagcgaagaaatacaagagatgaaaccgatacttgggcctatatcgccgcggaaggggaccaggaggtgctggatagtgtttgccaggccgatgaaaattcagacgggaggcagcaaattctgtctctgggaatggatctgcagctggaatggatgaaactcgaagacttccaaaagcatctcgatggcaaagatgagaatttcgccgccaccgacgccatcccaagtaatgttctccgggatgcagtgaagaatggcgactatataacagttaaagtcgccctcaattccaacgaggagtataatctcgatcaagaagacagctcaggtatgaccctggtaatgctagcggctgcgggagggcaggacgatctactgcgcctcctcattactaaaggagctaaggttaacggtcgccaaaagaacggaacaaccgccttaatccatgcagcagaaaagaatttcctaactactgtagctatcttgttggaggcaggagccttcgtcaacgtccagcagagtaatggtgagacagcactgatgaaagcttgtaagcgagggaatagtgatatagttcggctggtgatcgagtgcggcgctgattgcaatatactctccaagcaccagaattccgccttgcacttcgccaaacagtctaacaacgtcctggtgtatgatcttcttaagaatcacctggagacgctttcgagagtcgcagaagagacgattaaagattacttcgaagcgcgcttggcacttctggagccggtcttcccaatcgcttgtcatcgactctgtgaaggtcccgatttcagcactgacttcaattataaacctccacagaacatccccgaaggatccggtattctgctttttattttccatgccaacttcttaggtaaggaggtaattgcccgcctgtgcggaccatgcagcgtgcaggctgtggttctaaacgataaatttcagctccccgtttttctggatagtcactttgtgtacagcttctcgccagtagctgggccaaacaagctgttcatcagattaaccgaggccccttctgctaaggttaagctgctgatcggagcctaccgagtccagttgcagtag

SEQ ID NO: 195692 - DNA, 2604 bp, Artificial Sequence
  Description of Artificial Sequence: Synthetic coding sequence
atggagcaggtggccgagggcgcccgggtgaccgccgtgcccgtgagtgcggctgactctacagaagagctcgctgaggttgaggaaggggttggagttgtcggtgaggacaacgacgctgctgcaaggggagccgaggccttcggcgatagcgaggaagatggtgaagatgtgttcgaagtggagaaaattctggatatgaagaccgaaggcggtaaggtgctgtacaaagtccgctggaaggggtacacaagtgacgacgacacctgggaaccagagatccacctggaggattgcaaagaggttctgctggagtttcgaaaaaaaatcgcagagaacaaagcgaaggcggtccgtaaggatatccagaggctgagtcttaataacgacatttttgaggctaactctgactcggatcagcagtctgagaccaaggaagacacaagccccaaaaaaaagaaaaagaaacttaggcagcgggaagagaaatcccctgacgacttgaaaaagaaaaaggccaaggccggcaaactaaaagacaagtcaaaaccggatctggaaagtagtctagaatcactcgttttcgacctgcggacaaaaaagcggatcagtgaagccaaagaggagttgaaagagtcaaaaaaacccaaaaaggatgaagtgaaagagactaaggaattgaaaaaggtgaagaaaggcgaaatcagggacctgaaaactaaaacgcgggaggaccccaaggagaataggaagactaaaaaggaaaaattcgtcgagagtcaagtggagtccgagtcctccgtgctgaacgacagtccctttcctgaggacgatagcgaaggcttgcatagtgattccagagaagagaaacagaatacgaaatccgcccgggagagggcggggcaagacatgggattagaacacgggttcgagaaacctttagacagcgccatgtccgctgaggaggacaccgacgtacggggacgccgaaaaaaaaagacacccaggaaggctgaagatacgcgcgagaatcgtaaattggaaaataaaaacgcttttctggagaaaaagactgttcccaagaagcagagaaatcaggaccggtccaagtccgccgctgagctggaaaaattgatgcccgttagcgcacagaccccaaaggggaggaggctgagcggcgaagagcgcggattatggtctactgactccgcggaagaggacaaggagacaaaaaggaacgagagcaaggagaagtatcagaaacggcatgattctgacaaggaagagaagggtaggaaagaaccgaagggcttgaaaacccttaaagaaatacggaacgctttcgacctgttcaagttaacccctgaggagaaaaatgacgtgagcgagaacaacagaaaacgggaggagatacctctcgatttcaagacaatcgacgatcacaagactaaagagaacaagcaatccctgaaggaacggaggaacacacgggacgagactgacacctgggcttatatcgcagctgagggagatcaagaggtcctggatagcgtgtgccaggcagacgagaatagcgatggcaggcagcagatactgtcactaggaatggaccttcagttggaatggatgaaattggaggacttccaaaaacacctggacggaaaggacgagaacttcgccgccacagatgccataccaagcaatgtgctacgcgacgcagtcaagaacggtgattatatcaccgttaaagtagctctgaactctaacgaagagtataacctcgatcaggaagacagtagcggaatgacactggtgatgctagccgcagcaggcgggcaggatgacctccttcggctgctgatcactaaaggcgctaaggtgaacgggcggcagaaaaatggaacgaccgctctcatacatgctgcggagaagaattttcttaccacagtggccattctcctggaggccggggcctttgtgaatgtccagcagagtaacggagagaccgctctgatgaaagcctgcaaacgagggaatagcgacatcgttaggctggtgatcgagtgtggtgccgactgcaacattttaagcaaacaccaaaacagcgctcttcactttgctaagcagagcaataatgtgctagtatacgacctgctgaagaaccatctggagaccctttcccgagtggcagaagagactataaaggactacttcgaagctcgacttgccttgctggagcctgtctttccaattgcttgtcaccgcctttgtgagggcccagacttcagtaccgacttcaattataagccaccgcagaatattcccgagggaagcggaatcttgctgtttatcttccatgccaacttccttggtaaggaagtgatcgcacgtctctgcggcccttgttcagtgcaggctgttgtgctcaatgataaattccagctgccagtttttcttacaggctctcggagcgttgtccaggctggggtgcagtggcgtgggcttcaactgacaggagtgcttacctcccaggctcaggccatccttcctccacagcctcctaactatctgggattgaagatgcacgctaccaccagcggatag

SEQ ID NO: 195693 - DNA, 1812 bp, Artificial Sequence
  Description of Artificial Sequence: Synthetic coding sequence
atggagcaggtggccgagggcgcccgggtgaccgccgtgcccgtgagcgctgccgattccactgaggaattggctgaggttgaagagggcgttggcgtggtgggagaagataatgacgccgctgccagaggggccgaagcttttggggactctgaggaggacggagaagacgtgttcgaggtggagaagatcctggacatgaagaccgaaggcggaaaagtgttgtataaggtgcggtggaagggctatacatccgacgatgacacctgggagccagagattcatctcgaagactgcaaagaggtgctgctcgagttccgtaagaagatcgccgaaaacaaggccaaggcagtgaggaaggatattcagcgactatcactgaataatgacatttttgaggccaactcggactctgatcagcagtccgaaaccaaggaagacacttcccccaagaaaaaaaagaagaagctcagacagagagaggaaaagtctccagacgacctaaaaaagaagaaggcaaaggcaggcaagctgaaggataagtccaaacccgacctggagagttccctggaatctttagtttttgacttacgaaccaagaagcgcatttcagaggcaaaggaagaacttaaagagtcgaagaaaccgaaaaaggacgaggtgaaagagactaaggagttgaaaaaggttaagaaaggcgaaatcagggatctgaaaaccaagactcgcgaggacccaaaggagaatagaaagacaaaaaaggagaaattcgttgaatcccaagtagagagcgaatcctctgtcctgaacgacagcccctttccagaagacgacagcgaaggccttcatagcgattcacgggaggagaaacagaacaccaagtccgctcgcgagcgggccgggcaggacatgggcctggagcatggcttcgagaagcccttggattccgccatgagtgccgaagaagacacagatgtgcgaggcaggcgaaaaaagaagacacctcgtaaggcagaggacactcgcgagaacagaaagcttgaaaataaaaacgcgtttctggaaaagaaaacagttcccaagaagcagcgcaatcaggacagatccaaatctgcagctgaactcgagaagctgatgcctgtgtccgctcaaacccctaaggggagaaggctctcgggcgaagaaaggggactttggtctactgacagcgcagaggaggataaggaaactaaaaggaatgaatctaaagagaagtaccagaaacgccacgattcggataaagaggagaaggggcgaaaagagccaaagggactgaagacattgaaagagatccgcaatgcattcgatctctttaaactgaccccggaggagaagaatgacgtgagtgaaaacaatcggaagcgcgaagagatcccactcgactttaagaccatcgacgaccacaaaaccaaggagaataagcaaagtttaaaggaacgtcgcaatacaagggacgaaaccgatacttgggcttacatcgcagctgagggcgaccaagaggtgctcgattccgtctgccaggcagatgagaactccgacgggcggcagcaaattttaagcctcggcatggatctccagctggaatggatgaagttggaagacttccagaagcatttagatggtaaggacgagaactttgctgctacggacgccatccccagtaacgttctccgcgacgcggtgaagaagaaaaaaaagaagaagtttctagggacatatacgttctttttattctttttctttgagaaaccggacttagttcctctgttctag

SEQ ID NO: 195694 - DNA, 3087 bp, Artificial Sequence
  Description of Artificial Sequence: Synthetic coding sequence
atgggcttcttcagcctgagcagcgagcggaacgagagcgtgatccactatccagagtccacagagcccgaaattcaacaggaaatgagcacttcgcagcctgattgcaatgtcgattcttgctccgtgtcctctggttacgggactttttgcatctccgagctaaacctctataaatctaaggatccaaaagagttcatggagcacatcgacgtcccaaaagggcagtatgtcgccccagctgtacccgcagaaagcctagtggatggagtgaagaatgagaatttctacatccagacccccgaagagtgtcatgtttctctcaaggaggacgtgagcatttctcccggcgaatttgagcataactttttaggagaaaataaagttagtgaagtgtattccggcaaaacaaactcaaatgccattacaagttgggcccagaaacttaaacagaaccagcccaagcgggcacatgttgaagacggaggctctcgctccaaacagggcaacgagcagtccaagaaaacaccaattgagaagagtgatttcgccgccgccacacatccaagggctttctacctaagtaagcctgatgaaactcctaatgcatggatgtctgacagtgggaccgggttgacatattggaagctggaagaaaaggacatgcatcactcactgcctgagactctggaaaaaacctttatcagtttaagttccacagacgtgtccccaaatcagagcaatacgagcaacgagatgaagctgccaagcctgaaagatatttactataagaagcaaagggaaaataagcagctgcctgagcgcaacctcacctcagcctctaatccaaatcatcctcctgaggtgctcaccctggacccaaccctacacatgaagcctaagcagcaaatatcaggaatccagccccacgggctgccaaatgcacttgatgatcgcatcagtttttcccccgattctgtgttggaacccagcatgtccagcccatcagacatcgactccttcagccaggcttccaatgtgacctcacagttgcccggttttcctaaatatccgtcacacaccaaagctagtccagttgattcgtggaagaatcagacttttcagaatgagagtcggacaagtagcacattcccaagcgtttacacgattacgtctaacgatatcagcgtaaatactgtcgacgaggagaatacagtcatggtcgcctctgcctctgtgtcacagagtcagctccctgggacagccaattctgttcccgaatgcattagcctgacatcgttagaagatcccgtgatcctttctaaaataagacagaacctgaaagaaaaacatgcaaggcacatcgctgatctgcgggcctattatgaaagcgaaattaattctttgaaacagaagctggaggccaaagaaatcagcggcgtagaagattggaagattactaaccagatccttgtggatcgatgcggacaactcgatagcgctcttcatgaggcgacttccagagtgagaacactggagaataagaataacttgctggaaatcgaagtaaacgacctgcgcgagaggttctccgcagcctcctccgcatccaagattctgcaggagcgtatagaggaaatgagaaccagttccaaggaaaaagacaacactattatacgccttaagagtcgtctgcaggaccttgaggaggcttttgagaatgcctacaagctgtctgacgacaaagaagcccagctgaaacaggagaacaaaatgtttcaagatttgcttggagagtatgagtcactcggcaaggagcaccgaagggtgaaagatgccctcaacaccacagagaataaattgcttgacgcatatacccagattagcgacctgaaacggatgatatccaaattagaggcccaagttaagcaggttgagcacgagaatatgctgtctctgcggcataattcccgcattcatgttcgccccagtagggcgaacacactggccacgtccgatgtctctcgtcgaaaatggcttattccaggtgccgagtactcaattttcaccggtcaaccacttgatacacaggactctaatgtggacaaccaactggaagagacatgcagcttgggccataggtctcctctggaaaaggactcctcccctgggtcatccagcacaagtctgctgattaagaaacagcgggagaccagtgacactcccattatgagagctctcaaggagctggatgaggggaagattttcaagaattggggcacccaaactgaaaaggaggacacctctaacatcaatccgcggcagacagagacatccgtgaatgcctctcgtagccccgagaagtgtgcacagcagcgccagaagcgattaaactcggccagccaaagatcgtcgtcgttgcctccatccaacagaaagagcagtacgcctaccaaacgcgaaatcatgttaactccagttaccgtggcttactccccaaagcggagccccaaagaaaatctgagtcccgggttttcccacctcttatctaaaaacgaaagtagtcccattagattcgatatcctgttagacgatctcgacaccgtgccagtgtccactctgcagcggacaaacccgaggaaacagttgcagtttcttccactagatgattctgaggagaaaacctactcagaaaaggctacagataaccacgtgaatcatagttcatgtcctgaaccggttcctaacggagttaaaaaggtttctgtgaggacagcctgggagaaaaataaatcggtaagctatgaacaatgcaaacctgtttctgtcactccccagggaaatgatttcgagtatacagccaagatccggaccctggccgagaccgaacgcttctttgatgaactgaccaaggaaaaagatcaaatagaggccgccttatccagaatgccctcacccggcggccgcatcacgctccaaactaggctgaatcaaaccccgcagatctgcgaggagtccagtcataagtgtgcgttcgcgggacattatgtgccatgccatctgtacgattatcgcttccaaggctag

SEQ ID NO: 195695 - DNA, 3096 bp, Artificial Sequence
  Description of Artificial Sequence: Synthetic coding sequence
atgggcttcttcagcctgagcagcgagcggaacgagagcgtgatccactatccagagtccaccgagccagaaatacagcaggagatgtccaccagtcaaccggactgcaatgtagacagctgttcggtctcttctggctatggcacattctgcatcagcgagctgaatctttataaatctaaagaccctaaggagtttatggagcacatcgatgtgccaaaggggcagtatgtcgccccagccgtgccagcagagagcctggtcgatggagttaaaaacgagaatttttacatccagactcctgaagaatgccacgtatcgctgaaagaagacgtgagcatcagtcctggtgagttcgagcacaatttcctgggagagaacaaggtctccgaggtttactcgggaaaaacaaacagcaacgccataaccagctgggcccagaagttaaaacagaaccaaccaaaaagagcccatgtagaagacggcggcagtagatccaagcagggcaatgagcagagcaaaaagacccctattgagaagtcggactttgcggcggcgacacatcccagagctttttacctgtcgaagcccgacgagaccccaaatgcttggatgtcagacagcgggactgggctgacttattggaagcttgaggaaaaagacatgcaccacagcctgcccgagactctggagaagacttttatctccctgtcatcgacagatgtgtccccaaatcagagtaacacaagtaatgagatgaagctccccagcctgaaggatatctactataagaaacagcgtgagaacaaacagttgcccgaacgcaatctcacatctgccagcaacccaaaccacccgccggaggtactgactctggacccaactctgcacatgaaaccgaaacaacaaatctccggcattcagcctcacggactgcctaatgcccttgacgatcgaattagcttttcaccagattccgtgttggaaccctcaatgagctccccctccgatatcgacagtttctcacaggcatctaatgtgacatctcagttgcctggtttcccaaaatacccttcgcacaccaaggcctccccagtcgatagctggaaaaaccaaaccttccagaatgaaagtcgaacgagctccaccttccctagcgtgtacactataacttccaatgacatttctgttaacactgtcgatgaggagaacacggtcatggtggccagcgccagtgtttctcagagccaacttcctgggacagctaacagcgtcccagaatgcatctcactgacctccctggaagatccagtgatacttagtaagatcagacagaacttgaaggagaagcacgcaaggcatattgctgatctcagggcttattatgaatccgaaatcaactctttgaagcagaagctagaggcaaaagagatatcaggggtggaagattggaaaattaccaatcagatcctcgtggatagatgtggccagctggactctgctctgcacgaagcaaccagtcgcgtgcgtacactcgagaataagaacaatctgctggagatagaagttaatgaccttagagagagatttagcgctgcctctagtgctagcaaaattctccaggagcgaattgaagaaatgagaacgagctccaaggaaaaggacaatacgatcatacggctcaaaagtcgtctgcaggacctcgaagaggcttttgagaacgcctataagctcagtgacgataaggaggcccaactgaaacaggagaacaagatgttccaagacctccttggggaatacgagagcctcggaaaggaacaccggcgggttaaggatgcgttaaacacaactgaaaataagctgctggatgcttacacccaaatcagcgaccttaaacgtatgataagcaaacttgaggcgcaggttaagcaggttgaacacgaaaacatgctaagtttacggcacaacagtcgcattcatgtaaggcccagcagagccaacacccttgccaccagcgacgttagtagacggaagtggttgatcccaggcgcggagtactcaattttcactgggcagccactcgacacccaggattccaatgtcgataaccagttggaggaaacttgtagtctgggacaccggagccccctggagaaggactccagtcccggtagtagtagtactagcctgctgatcaagaaacagcgcgagacaagtgacaccccaattatgcgggcacttaaagaacttgacgaggggaaaatcttcaagaattggggcactcagactgaaaaagaggataccagcaatataaacccccgtcaaaccgagacgagcgtcaacgcaagccgatctcccgagaagtgcgcccagcagcgacagaaacggctgaactccgcgtcccagaggtcctcttctctgccgccctctaaccggaaatcgagcacccctaccaaacgggagataatgctgacacccgttacagtcgcatacagccctaagcgctcacctaaagagaacttatctcctgggttcagtcatctgctgtctaaaaacgagtcatcccctatcagatttgatatcctgctagacgatctcgacaccgtgccagtttcaaccctgcagcggaccaatcctagaaagcagttgcagtttctgccgctggacgacagcgaagagaagacttactcagaaaaggctactgacaaccacgtcaatcactcttcctgtcccgaaccagtcccaaatggagtcaaaaaggttagcgttcggactgcttgggaaaaaaacaagtctgtctcatacgaacagtgtaagcccgtgtcagttactcctcagggaaatgactttgagtatactgctaaaattaggactttggctgagactgaacgattctttgacgaactcacaaaggaaaaggatcagatcgaggctgctttgtcgaggatgccgtccccaggcgggagaatcacattacagacgcgattgaatcaggaggcgttggaggaccgcttagagcggatcaaccgcgagctcgggtctgtacggatgactttaaaaaagttccatgttctgagaacatccgccaacctgtag

SEQ ID NO: 195696 - DNA, 1167 bp, Artificial Sequence
  Description of Artificial Sequence: Synthetic coding sequence
atggagcccagccccgccgccggcggcctggagaccacccggctggtgtctccgcgcgaccggggtggggcggggggtagcctcagactgaagagcttattcactgagccaagtgaacccctccctgaagaaagcaagccagtcgagatgccgttccatcactgtcatagagaccccctgcccccaccagggctgacacctgagcgcctccacgcccggagacaactgtacgctgcgtgtgccgtgtgctttgtgttcatggctggtgaggttgtaggggggtatctggctcactccctcgctattatgactgatgcggcacacctgctggcggacgttggttctatgatgggatcacttttctccctgtggcttagcacccgtcccgctacccgtaccatgacctttgggtggcaccggtcagaaactctcggggccctcgcatctgtcgtctctctgtggatggtgactgggatcctgttatatctcgcttttgttcggctcctgcactccgattaccatatcgagggaggagccatgttgttaacggcaagcattgcggtttgtgcaaacctgcttatggcgtttgtcctccatcaagccgggccaccacacagtcacggctcccgtggagctgagtacgcgcctctggaggaagggcctgaagaaccattgccccttggcaatactagcgtccgggccgcattcgtgcacgtactgggggacctgcttcagtccttcggcgtgctcgccgcttccatattgatttactttaagcctcagtataaagccgctgatccaatctctacatttctgttcagcatctgtgcattagggtcaaccgcccccactttgcgcgatgtgctaaggattctgatggagggcacaccccggaacgtgggatttgaacctgttcgtgacaccctactgagcgtgccaggggtcagggccactcatgaactgcacctgtgggcacttacactcacctaccacgtggcatcagcacacctcgctatcgatagcacagccgaccctgaggctgtgttagcagaagcgtcaagtcgcctctatagcaggttcgggttttcctcatgcacactacaggtagaacaataccagcccgagatggcccagtgtctacgctgccaggaaccaccacaagcctag

SEQ ID NO: 195697 - DNA, 363 bp, Artificial Sequence
  Description of Artificial Sequence: Synthetic coding sequence
atgtgccacctgtacgagggccccgtggtgggcggctggtacaaggtgctggaccgtttcattcctggcacaaccaaagtggacgcgttaaagaagatgctgcttgaccagggtggctttgccccgtgctttctcggctgttttcttcccttagtgggcgccctgaatgggctgagtgctcaggataattgggccaaactgcaaagggattatcccgacgcacttatcaccaattattacctttggcctgcagtccagttggccaatttctatttagttccccttcactatagactggccgttgttcagtgtgtggcggtgatctggaactcttacctgtcttggaaagcccatcggctttag

SEQ ID NO: 195698 - DNA, 531 bp, Artificial Sequence
  Description of Artificial Sequence: Synthetic coding sequence
atggccctgtggcgggcctaccagcgggccctggccgcccacccctggaaagtgcaggttctaacggcggggtcgctgatgggactcggcgatattattagccagcagttagtggaaaggcgaggtctgcaggagcaccagcgcggtagaaccctgacaatggtcagtttaggctgcggctttgttggacccgtggtgggaggatggtacaaggtgttagacaggttcattcctggcacaactaaagtggacgccttgaagaaaatgctcctggaccagggaggctttgcgccatgtttcctgggatgcttcctgccattggtgggcgccctcaatggcctaagcgcccaggacaattgggctaagttacagagggattaccccgacgctctgataaccaattactacctctggccagcagtgcagctggccaatttctatttagtacccctgcactacagactggccgttgtgcagtgtgtggctgttatatggaactcctatttgagctggaaagcgcaccgcctctag

SEQ ID NO: 195699 - DNA, 513 bp, Artificial Sequence
  Description of Artificial Sequence: Synthetic coding sequence
atggccctgtggcgggcctaccagcgggccctggccgcccacccctggaaggtgcaggttctgacagcaggttccttaatgggacttggtgatataatctcacaacagttggtcgaacgacgcggtcttcaagagcatcagagaggccggacacttacaatggtatctcttggatgcggcttcgtgggccccgtggtgggtggatggtataaagttctggaccggttcatcccagggacaacaaaagtggacgctcttaaaaagatgctgctggaccagggtggctttgctccgtgtttcctgggctgtttcctgccgctggtgggcgcactcaacgggctgagcgcccaggataattgggctaagctgcaaagggattacccagatgcccttatcactaactattatgtgggcaggtgccccatgtgttgctgttacctcgagcttttgcctgtcctggaagggacatccgctttgtcactcccccatagtatcgtgagtactcttcagtag

SEQ ID NO: 195700 - DNA, 342 bp, Artificial Sequence
  Description of Artificial Sequence: Synthetic coding sequence
atggccctgtggcgggcctaccagcgggccctggccgcccacccctggaaggtgcaggttctcacagctgggtcactgatgggtttgggagacataatttcacagcaactggtggaaaggaggggtctacaagagcaccaaaggggacgcaccctcacaatggtcagcttaggatgcggcttcgtagactacccagatgccctgatcaccaactactacctgtggccagcagttcagctggctaacttctatctcgtgcctctgcattatcggcttgccgtggtccagtgcgtggctgtaatctggaatagctatctgagttggaaagcgcaccgactatag

SEQ ID NO: 195701 - DNA, 576 bp, Artificial Sequence
  Description of Artificial Sequence: Synthetic coding sequence
atggccctgtggcgggcctaccagcgggccctggccgcccacccctggaaggtgcaggtcttgactgccgcccacccaagacgatgccccgataatacatgcgtaccctgcattggaagtcttatggggctgggagacattattagtcagcagctcgtggagagacgtgggctgcaagagcatcagcgcggccggaccctgaccatggttagtctgggttgtggatttgtcggccccgtcgtgggaggttggtacaaagtactcgatcggttcatcccaggtacaaccaaggtagatgccttgaaaaagatgttactcgatcagggcggcttcgccccgtgttttttaggatgctttctcccactggtaggggccctcaatggcctgagcgcacaggacaattgggccaaattacagagggactatcccgatgcacttatcaccaactattatctatggcccgcagtgcagctggctaatttctacttggtgcctctccactatagactggctgttgtccagtgcgtcgcggtgatttggaacagttacctttcctggaaagcccaccggttgtag

SEQ ID NO: 195702 - DNA, 348 bp, Artificial Sequence
  Description of Artificial Sequence: Synthetic coding sequence
atgggcctgggcgacatcatcagccagcagctggtggagcggcggggcctccaagaacatcaacgcggacggactctcacaatggtttcacttgggtgtggtttcgtcggacccgtggttggcggatggtacaaggtgttagatcgttttatccctggtacgaccaaggtcgatgccctgaagaagatgcttctagatcaaggaggattcgccccttgctttctcggctgtttcctgccactagtaggcgccttgaacggactgtccgcacaagataactgggccaaactacagagggattatcctgatgccctgataaccaattactatctttggccagccgtgtag

SEQ ID NO: 195703 - DNA, 366 bp, Artificial Sequence
  Description of Artificial Sequence: Synthetic coding sequence
tgaagcctgatgggcctgggcgacatcatcagccagcagctggtggaacgacgcggcttgcaggaacaccagcgggggaggacgttaaccatggtgtctctcgggtgtggttttgttggaccggtggtcggcgggtggtataaggtcttggacagatttatcccagggacaactaaagtggacgctctgaagaaaatgctacttgatcaagactacccagatgctttaataaccaactactacttgtggcccgccgtgcaactggctaatttctatcttgtaccgctgcactatcgcctggccgtggttcagtgcgtggcagtaatctggaactcttatttgtcctggaaagcccatagactctag

SEQ ID NO: 195704 - DNA, 204 bp, Artificial Sequence
  Description of Artificial Sequence: Synthetic coding sequence
tgagacagccagggcaagaagaccggcttcaccggcatcaagaagggtgactaccctgatgctctgattactaactactatctgtggcccgcagtgcaactggcaaatttctatctggttcccctgcattaccggttagccgtagtccagtgcgtcgccgtaatctggaactcctacctgagctggaaggcccatcgtctgtag

SEQ ID NO: 195705 - DNA, 912 bp, Artificial Sequence
  Description of Artificial Sequence: Synthetic coding sequence
atggcccccgccgccgacatgaccagcctgcccctgggcgtgaaggtcgaggatagtgccttcggaaagccagccggaggtggggcgggacaagcaccttccgccgctgctgctactgctgccgccatgggcgcagatgaggaaggtgctaagcccaaggttagcccaagccttctgcccttctccgttgaggcgctgatggcagatcaccggaaaccaggggcgaaggaaagcgccctggccccgtctgaaggtgtgcaagctgcaggcgggtctgctcagccactcggtgtccccccagggtccctgggcgctccagatgcgccatcctccccacggcccctgggacatttttccgtgggcggcctactcaagttaccagaggatgcactggtcaaggccgaatcgcccgaaaaacccgagcggacaccctggatgcaatcccctcgattttccccccctcctgccagacgcctgtcacccccggcttgcactctacgcaagcacaaaactaatcgaaaaccccgaacaccctttactacggcgcagcttctcgctctggagcggaagtttcgacagaagcagtatctgtccattgctgagcgagctgagtttagttcatcactaagtctaaccgaaacccaggtcaagatttggttccagaatagacgcgccaaggcaaagaggctacaggaggcagaactggaaaaactgaaaatggctgcgaaacctatgctgccacccgccgcattcggtctatccttcccacttggaggccctgccgcagtcgccgccgcagcaggcgcgtctttatacggggcaagtggccctttccagcgcgccgcgctgcccgtcgctcccgtggggctctacacggcccacgtgggctattcaatgtatcatctgacttag

SEQ ID NO: 195706 - DNA, 804 bp, Artificial Sequence
  Description of Artificial Sequence: Synthetic coding sequence
atggccagccccagcaagggcaacgacctgttcagccccgacgaggagggaccagcagttgtggcgggacccggccctggaccagggggtgctgagggtgccgctgaagaaagacgggtcaaggtgtcgagccttccatttagcgtcgaagcccttatgagtgacaagaagccccctaaagaggcgtcgccactgccggccgagtcagcgtccgcgggcgctactctgaggccattgctgctgtctgggcacggggctcgggaagcccactcacccgggccactcgtgaagccgttcgagacagcctccgtgaaaagcgaaaatagcgaagacggagctgcttggatgcaggagccaggaagatactccccaccccctaggcatatgagtcccaccacttgcactctgcggaaacataagaccaatcgcaagccacgaactccgtttacaacatcacagttgttagctctcgaaaggaagttccgccaaaagcagtacctgagcatagccgagagagctgagttcagttcttccctaaaccttaccgagacacaggtgaagatatggttccagaatcgccgtgccaaagcaaagaggctgcaggaagcagaattggagaaacttaagatggctgcaaaacctatgctgcccagcagctttagcctgccctttcccatctcttcgccactccaggcggcctcaatctatggtgcatcatatccctttcaccgccccgtgctcccaatccccccagtggggctgtatgctactccggtagggtacggcatgtatcacctgagctag

SEQ ID NO: 195707 - DNA, 981 bp, Artificial Sequence
  Description of Artificial Sequence: Synthetic coding sequence
atgaacaccagccccggcaccgtgggcagcgaccccgtgatcctggccacagcgggctatgatcacaccgtgagattctggcaggcacatagcgggatctgcacaagaaccgtgcagcatcaggacagtcaggtcaacgctctagaggttaccccagaccggagtatgatcgccgctgccggctaccagcacataagaatgtatgatctgaatagcaataatcccaaccccataatttcatacgacggcgtcaacaagaacattgctagcgtcggattccacgaagatggaagatggatgtacaccggcggagaagactgcaccgcaagaatatgggatttgcgaagtcggaatctccaatgtcaacgaatcttccaggtgaatgcgcctatcaactgcgtgtgtctgcaccctaaccaggccgaactaatagtcggcgatcagtctggcgcaatccatatttgggatctcaaaacagaccataatgaacaactcattccagaacccgaggtatctatcacaagtgctcatatagatcctgacgcaagctatatggctgcagtgaattctaccgggaactgctatgtgtggaacctaacagggggaattggagatgaagttactcagcttattcctaagactaagatccccgcgcacacccgatatgcccttcagtgcagattttctccggacagtactctgctggctacctgttctgccgatcaaacctgtaagatctggcggacctctaattttagcctgatgacagagctcagcattaaatccggcaacccgggggaatcgagcagggggtggatgtggggttgtgcgttctccggtgactctcagtacatagtgacggcctcgtcagacaacctggctaggctctggtgtgtcgagaccggagagattaaacgcgagtatggggggcaccaaaaagccgtggtgtgcctggctttcaacgactccgtcctgggttag

SEQ ID NO: 195708 - DNA, 981 bp, Artificial Sequence
  Description of Artificial Sequence: Synthetic coding sequence
atgaacaccagccccggcaccgtgggcagcgaccccgtgatcctggccactgccgggtatgatcatacagtgcgattctggcaggcacacagtggcatatgcacacggactgtgcaacatcaggatagccaagttaatgctctggaggttactcctgatcgctcgatgatcgctgcagcgggttaccaacatattcgtatgtacgacttgaatagtaacaacccaaatcccattatctcctacgacggtgtcaataaaaacatagcctccgtgggcttccatgaagacggtcggtggatgtacacgggtggggaggactgcacggctagaatctgggacttgaggtcaaggaacctccagtgccagcggattttccaggtgaacgcgcctatcaactgcgtttgcctgcaccctaatcaggcggaattgatcgtcggtgaccaatccggagcaattcacatatgggatcttaagacagatcataatgagcaattaatccccgagccggaagtcagcatcaccagtgctcatattgacccagacgccagctatatggccgccgttaattctaccggaaactgctacgtgtggaatctaacaggaggcattggcgacgaagtgacacagttgattcccaaaaccaaaattcctgctcatactcggtatgctctgcaatgtagatttagcccagattcaactctgctagccacctgttcagccgaccaaacatgtaaaatctggcgaaccagtaactttagcctcatgaccgagctgagcattaagtccggaaatcctggagagagctccagaggttggatgtggggatgtgcctttagcggtgacagccaatacattgtgactgcaagctccgataacctcgccaggctttggtgcgtcgagactggtgagatcaagcgcgagtacgggggtcaccagaaagcagtggtgtgtctggcttttaacgatagcgtcctgggatag

SEQ ID NO: 195709 - DNA, 984 bp, Artificial Sequence
  Description of Artificial Sequence: Synthetic coding sequence
atgaacaccagccccggcaccgtgggcagcgaccccgtgatcctggcaacggccgggtatgatcacacagtcaggttttggcaagcccattccggcatctgtaccagaaccgtgcagcaccaagattctcaggtcaatgcattggaagttactcctgacagatcaatgatcgccgccgccggatatcaacatattcgcatgtacgaccttaatagcaataatccgaaccccatcatctcttacgacggagtaaacaaaaacatagcctcagtgggttttcacgaggacggccggtggatgtacactgggggggaagactgcacagcccgaatctgggatttgcgctctcgcaacttgcagtgccagagaatcttccaggttaatgcccccatcaattgtgtgtgcttgcaccctaaccaggccgaactgattgtcggcgaccagagtggtgctatacacatctgggacttaaagaccgatcacaacgaacagctgatacccgagcctgaggtctcaataacaagcgctcatatcgatcccgatgctagttacatggcagctgtaaatagcacagggaattgctacgtttggaatctaactggagggatcggagatgaggtcacgcagctcatccccaaaaccaaaatccctgcacacacgcggtatgccctccagtgcagattcagccctgatagcaccctacttgccacatgttccgccgaccagacgtgcaagatctggagaacttcgaattttagtttgatgacagaactgtccatcaaatcaggcaacccaggagaatcatcccgcgggtggatgtggggatgcgccttttcaggtgattctcagtacattgtaaccggcgagccgaggccaggactgcctcacccctggccacctgctcttgcttctcgcgcatcaccacccagactgcaattgccgctctgttggggccgcttgttagggttgcatctccgatcttag

SEQ ID NO: 195710 - DNA, 654 bp, Artificial Sequence
  Description of Artificial Sequence: Synthetic coding sequence
atggagcacgccccctggagccccggcgccagcagccgggcccgggccgggcacaccatgaatacctccccaggcacagtggggagcgacccagtgatcttggccactgccgggtatgatcacacagtgcgtttttggcaggcccactctgggatttgcaccagaaccgttcaacatcaggattcccaagtcaacgccctggaggtgactccagatcgttccatgattgccgcagccggttaccaacacatcagaatgtatgaccttaatagcaacaatccaaatcctatcatatcctacgacggcgtgaacaagaatatcgctagtgtgggcttccatgaagatggcagatggatgtacacagggggagaagattgcacggcaaggatctgggacctgcggagtcgcaacctgcagtgtcagcggatctttcaggtgaatgctccgattaactgtgtctgcttgcatcctaaccaggcggagctcattgtgggcgatcagtcaggagccatccatatctgggacctcaaaacagaccacaacgaacagctgatccccgagcccgaagtcagtattaccagcgcccatattgacccggacgccagctacatggccgctgtgaattccaccgcccccaggcacctcctgggttag

SEQ ID NO: 195711 - DNA, 981 bp, Artificial Sequence
  Description of Artificial Sequence: Synthetic coding sequence
atgaacaccagccccggcaccgtgggcagcgaccccgtgatcctggccacagcagggtacgatcataccgtgcggttttggcaagcgcacagcggcatatgtactaggacagttcagcatcaggatagccaagtgaacgctttagaggtgaccccagaccgcagcatgattgccgcggcaggatatcaacatattcggatgtacgatcttaactctaacaatccgaatcccattatctcatatgacggggtcaacaagaatatagcttcagtgggcttccatgaagatgggcgctggatgtacacaggaggtgaggactgcaccgccagaatctgggatcttcgctctagaaacctgcagtgtcaacgaatttttcaagtcaatgccccgattaattgcgtgtgcctgcacccaaaccaggcagaattaatcgtgggtgatcaaagtggggctatccatatatgggacctaaagaccgaccataatgaacagcttatcccggaacctgaggttagcatcacctcagcccacattgaccccgatgcctcttatatggcagctgtgaattctacaggcaactgctatgtgtggaacttgactgggggcataggagacgaggttacccagctcattcccaaaactaagattcctgcacacactcgatacgcgctgcagtgtcgcttttcccccgactctacccttctcgcaacttgtagcgctgatcagacatgcaagatctggaggaccagcaatttcagcctcatgacagaactctctatcaagtctggtaacccaggcgaaagcagccgtgggtggatgtggggttgtgccttttcaggggacagccagtatatcgtgacagcgtcaagcgacaacctggctaggttgtggtgtgtggaaacaggggagatcaagagagagtacgggggacatcagaaagcagttgtatgcttagcattcaatgactccgttctgggatag

SEQ ID NO: 195712 - DNA, 981 bp, Artificial Sequence
  Description of Artificial Sequence: Synthetic coding sequence
atgaacaccagccccggcaccgtgggcagcgaccccgtgatcctggcaaccgcgggctatgaccacactgtgcgtttttggcaggcccactccgggatatgcacccgcactgttcagcaccaagattctcaggtcaacgccctcgaggtgaccccggatcgctctatgatcgctgcggcgggatatcagcatatcaggatgtatgaccttaactcaaacaaccccaacccaattatatcctatgacggcgtgaataaaaatatcgcgagtgttgggtttcacgaggatggccgctggatgtacaccggcggagaggattgtaccgctaggatatgggatctgcgctctagaaacctccagtgccagcgaattttccaggtcaatgccccaataaactgtgtgtgcctccatcccaatcaggctgaactgatcgtgggtgaccagtcaggcgcaattcacatctgggacctgaagacagatcacaacgagcagctaatcccggagcccgaggtgagcatcacttccgctcacatagacccggacgcctcttacatggccgccgtgaatagcaccggcaactgctacgtttggaatttgacggggggcattggtgatgaggtgacacagctaattcccaagacaaagattccagcccatacccgctacgcccttcagtgccgcttctcacccgatagcactttactggcgacttgtagcgcagaccagacttgtaaaatttggcgaacgtcaaactttagtctgatgacggaactctccatcaaatcgggcaatcccggagaaagcagccgcgggtggatgtgggggtgcgccttctcgggagattctcagtacatcgtcactgcctcaagtgacaacttggccaggttgtggtgcgtggagacgggggaaatcaagagagagtacgggggacaccagaaagcggtagtgtgcctggcctttaatgacagcgtgctgggatag

SEQ ID NO: 195713 - DNA, 1473 bp, Artificial Sequence
  Description of Artificial Sequence: Synthetic coding sequence
atggcccagcgggccgtgtggctgatcagccacgagcccggcacccccctgtgtggcacggttagattctccagacggtaccccaccgtcgagaagagagctagagtcttcaacggagcctcatacgtcccagtcccggaagacgggcctttcttgaaagccctcctctttgaactgcgtctcctagatgacgacaaggactttgtcgagagtcgtgactcctgtagccgtatcaacaaaacaagcatctacggcctactgattggtggcgaggagttatggcccgtggttgctttcctaaaaaatgatatgatttacgcttgtgtgcccttagtcgagcagactctgagtccccggcctcctctgatttcagtgtccggcgtttcacaggggtttgagtttttatttggtattcaggatttcctgtattcgggtcagaagaatgattccgaactcaacaccaagctctcccagctgccagacctactcctgcaggcgtgccctttcggcacactgctagatgctaatctgcagaactcactggacaatacaaactttgctagcgtcacccagccacagaagcagccggcgtggaagacaggaacctacaaggggaaacctcaggtttccatttctattacggagaaggtgaagtcaatgcagtacgacaagcagggaatcgctgacacctggcaggtggtaggcactgtgacctgtaagtgcgacctggagggcattatgcctaatgtgaccatctcactttcactgccgactaatggcagccccctgcaggacatccttgtccacccatgtgtgacttccctggactccgccattctaacctcttcttctatcgatgctatggatgattctgcgtttagcgggccttataagtttccattcacaccgcctttggaaagttttaacttgtgcttttacacatcccaggtgccggtccccccaattctggggttctatcagatgaaggaggaggaggtccagctgcgtattacgattaatttgaagttgcacgaatcagtcaagaacaatttcgagttttgtgaggcacacattcccttctataataggggcccaattacccatttggagtacaagacaagtttcggccagctcgaggtcttcagagaaaagagtctgctcatttggatcattggacagaaattccccaagagtatggagatatccctctctggaaccgtgacattcggcgctaaatcacacgaaaaacagccattcgaccccatctgtaccggagagaccgcatacctgaaattacactttcgtatcctcgactacacgctgacaggttgttacgcagaccagcacagcgtacaggtgttcgccagtggcaaacctaaaatctccgcacatagaaagcttatctcaagcgactactatatctggaactctaaagcacccgcacccgtgacatacggctcactgctgctgtag

SEQ ID NO: 195714 - DNA, 16437 bp, Artificial Sequence
  Description of Artificial Sequence: Synthetic coding sequence
atgctggtgatctggatcctgaccctggccctgcggctgtgcgccagcgtgacaaccgtgactcctgagggcagcgccgtacataaggctattagtcaacagggcactctctggacaggggaagtgctggaaaaacagaccgtggaacagggcaagtctacattacggcggcagaagaaccactttcaccgctctgccggggaactgcgatgtaggaacgccctcaaggatgagggtgcgtcagctggatggtctgtgatgtttgccggggaatcagttgtggtcctagtccatctgtggatgacaggcgccagggttaagaacttgggactggtagagttcgcctcccccggtgatgacggcgatggccgagcggaaggattcagcttgggtctgccactgtcagagcaggcgcgcgctgctggcgcacgagagaaggaaaggcaggaaaccgtcatcaaccacagtaccttcagtgggttctcacagatcaccggtagcacagtgaacacctcaatcggcggcaatacaacttcagcgagcacccccagcagtagtgatccgttcacaactttttcagattatggtgtgagcgtgacgttcataacagggagtacagccacgaagcactttctcgattcctcgaccaacagcggtcatagcgaggagagcacggtgtctcattctgggcctggggcaactggcactaccttgttcccgtcccacagtgccaccagcgtctttgttggcgaacccaagacatcaccaataaccagcgcatccatggagaccaccgcccttcccggctccaccaccacagccgggctgtcagagaagtctactacattctactcttcccctcgcagccctgatcgaactttgagtccagcaaggacaacgagctcaggggtgtcggagaagtcaaccactagccactctagacccggaccaacgcacacaattgcctttccagatagtacaactatgcctggtgtctcgcaggagtcgaccgcgtcacactctattccaggaagcaccgatactaccctatctcctggtacaacaacaccctcttctctcggcccagaatccactaccttccacagcagtcccggctacacaaaaactactaggctgccagacaacacaaccacatctgggctgcttgaggcctcgacacccgtgcatagtagcacaggttcacctcatactaccctgagcccttcgagttctacgacacatgagggcgaacctaccacctttcagagttggccatccagtaaggacacctcacccgcacctagtggcacaacatctgcattcgttaagctgtcaaccacctaccacagttctccaagcagtactcccaccacacacttcagtgcatcttccaccactctcggccattcagaggagtccactccagtgcactcatccccagtcgctacggcaaccacaccacctccggccaggagcgccaccagcgggcacgttgaagaatcaacggcgtatcacagaagccctggtagtacccagactatgcattttcctgagagctccaccacatctggccactccgaggagtctgcaacatttcatgggtccacaactcacaccaagagctctacaccttccactaccgccgctcttgcccacacctcctaccatagcagccttgggtctaccgagacaacccactttcgggactcttctacgattagcgggcgcagtgaggagtccaaggcatcccattcttctcctgacgctatggccacaacggtcctgcctgctgggagtacaccttcagtccttgtaggggatagcacacccagtccaatttcctcaggttccatggagaccactgcgctaccaggcagcaccactaagcctggattgtccgagaagtctactacattctactcaagtccgaggagccctgatactacacatctcccggcatccatgacgtcaagcggagttagcgaagagagtacgacctcacattcacgccctgggagtacacacacaacagcctttcccgggtctacaacaatgcctggcctgagccaggagtcaaccgcctctcactcctctcctggtcctacggacacgacgctcagccctggttctacaaccgcatcaagcctgggcccagagtataccacttttcactctcgccccgggtcaaccgagacaacacttctcccagacaatactactgcatcaggtctgctagaggcctccatgcccgtccatagcagtacaaggtcaccccacaccaccctgagcccagctggaagcaccactcgtcagggcgaatctactacttttcactcttggccttctagtaaggacactagacccgcccctcctacaactacatctgcctttgtggagcctagtacaacatctcacgggtcacccagcagcattccaactacccatattagtgccaggtcaacaacttccggtttggtggaagaatccaccacttaccactcctcaccaggttctacccagacgatgcacttccccgagtctgacaccaccagcggaagaggcgaagaaagtaccacatctcactcttccacgactcatactatcagctctgccccttctacaacaagtgcattggtggaggaaccgactagctaccatagctcaccagggtcgaccgccactacccacttcccagatagcagtactacaagtgggcgatcggaggaatcaacagctagtcacagcagccaggatgcaactgggaccatcgtactccctgcgcgttccacaacaagcgtgctcctcggcgaatccacaacttccccaatctcgtccgggagcatggaaaccaccgccctgccaggatcaaccactacccccggcttatctgagcgttctaccaccttccatagctcccccaggtcgcctgctactacgctgagcccagcatccactactagctctggggtgtccgaggaatcgaccaccagccgttcccgacctggatctacacatacaaccgccttccccgactcaacaaccacgcctgggctctctaggcactcaactaccagccactcttcgcccgggtccactgataccactctactgcccgcttccaccaccaccagtggcccgtctcaggaatcaactaccagccattcatcttccggcagcaccgacactgcactgtctccggggagcaccactgcactgagcttcgggcaggagagcacaacattccatagcaacccaggtagcacccacacaacactcttcccagatagtactacaagcagtgggattgtggaagcctccacaagggttcacagctcaactggatccccgaggaccaccctatctcctgcctcgtccacatcccctgggttgcagggggagagtaccgcattccagacccatccagcctcaacacacactacaccttccccacccagtacagccactgctccggtggaggagagtaccacgtaccatagaagtccgggctccactccaacaactcactttccggcaagctcgactaccagtggacactcggagaagagtacaattttccacagttctcccgatgcaagcggcactactccaagtagcgctcactccacgacatccgggcgcggcgagagcacaacaagcaggatcagtcctggctctacagagatcacaaccctgcctggcagtaccacaactccggggctgagcgaggcttctacaacattttactcttccccacgctcccccactactacactgtcgcctgcctcaatgacgtcgctgggagtgggcgaggaatccactacctcccgttctcagccaggcagcactcactcgaccgtctcccctgcctccactactactcctggcctctctgaagaatctaccaccgtttatagtagcagcagaggatcaaccgaaacaacagtgtttccccatagcacaaccacctcagttcatggagaggagcccacaacgttccatagccggccagcttctacccacaccacacttttcaccgaggattcaactacatctggactgacagaggagtcaacggccttccccggttctccagcatcaacccagactggcctgcccgccactctgacgactgccgacctgggagaagaatctaccaccttcccaagctcctcaggctcaaccggcacaaagctgagccccgctcggtcaactacctctggactggtgggagaatctacaccctctaggttaagccccagttcgacagagactacaaccctcccaggctccccaacaacgccttctttaagcgagaagagcacaaccttctatacctccccacgaagcccagatgcaacccttagccctgcgaccactacaagttctggcgtcagcgaagagtcatcaacttcacattcccagcccgggagtacccacactaccgcgttcccagattctacaactacttccgaccttagtcaagaacctaccacctcccactcttcacagggatccacagaggctaccctctcacctggttctacaactgccagttccttgggtcagcagagcacgacattccacagcagtcccggtgacaccgagaccacactgctacccgatgataccatcacttctgggttagtggaagcttctactcccactcactcatctacaggtagcctgcacacaacactgacccccgcaagcagcacctctgccggcctacaggaagaaagtacaaccttccagtcctggcctagtagctcagataccacacccagtccacctgggaccacagccgcccctgtagaagtttctactacctaccactcacgcccatctagcacacccactacccatttcagtgcttccagcactacactgggtcgcagcgaagagtccacaaccgtgcatagctcccccggcgccacaggtactgctttgtttcctaccaggagcgctacctctgtcttggtcggcgagcccacgacctcacccatttcttctgggtctacagagacgacggcgctaccagggtccactacgactgcggggttgagtgagaagtccactactttctactcctctcccagatcccccgataccactctgagtcccgcctctactacatcgtctggcgtttcagaggagtctacaaccagccactctagacccgggagcacacacaccacagcattccctgggtctacaacaatgcctggggtgtcacaggagtccacggctagtcattctagccctggcagcacggataccaccttgagtcccggtagcactacagcctcatccctgggccctgaatctacaacttttcattcatcccccgggagcaccgaaacgacgctgctgccggacaacacaaccgccagcgggctgctcgaagcatccaccccggtgcattccagcaccgggtccccacatacgaccttgagccccgccggttccacaacgcggcagggggaaagcaccacctttcaatcctggccctccagcaaggatactatgccggcgcctcccaccacaacatctgcctttgtagagcttagtactacatcccacggatcacccagttccactccgaccacccacttctctgcctcttccacaaccctggggcgctctgaagagtccaccaccgttcacagttctccggtggccaccgcgaccaccccttctccggcaaggagtactacctccggactggttgaagaaagtaccgcctaccactcctcccctggcagtacccagacgatgcactttccagaatcttctaccgcttcagggagatccgaggagtctcgaacttcacatagttcaacaacgcacactataagctctccgccgtccaccacctccgccctggtagaggagcccacatcctaccattcgtcgcctggttcaaccgctacaacccatttcccagatagtagcaccacctcaggcagatcggaggagagtactgcatctcattcatcacaggatgctaccggaacgatagtccttcctgctcgatctactaccagcgtgttgctgggggaatctacaacctcccccattagctccggttctatggaaacgacagcattacctgggagtaccactacgccaggcctgagtgagaaatctactaccttccactctagcccccggtcccccgcgactacactctctccagcttccacaacatcaagcggagtctccgaagaaagcaccacttcccatagtagacccgggtcgacacacaccacagcatttccagattcaaccaccacaccaggactgtcacgccactctacaacaagtcattcttcacctggcagcaccgatactacattattacccgcatcgactacgacctcgggtccatcacaggaatcaacaacatcccactcatcacctggttcgaccgacaccgccttgagccccggaagtacgacagccttaagctttggacaggagtccacaacttttcatagctctccgggcagcacccataccacattattccctgactctaccacttccagcggtatcgtcgaggctagcacgagggtccacagcagcactggttctccaaggacaaccctatccccagccagttctactagccctggactacaaggggagtctacagctttccaaacccatccggctagcacacatactactccctcacccccatcaaccgcaaccgctcccgtggaggagtcaacaacttaccataggagcccagggagcactcccactacacactttccagccagcagtaccacaagcggccactccgaaaaatctaccatattccatagtagccctgacgcaagtgggacaactccctcatctgcacattccactaccagcggacggggagagtccacaacatctaggatttcgcccggcagcactgagattaccaccctgcccggatccaccaccactcccgggttatctgaagcttcaacaacattttacagtagcccaagaagcccaaccactaccctctcccccgcctccatgacaagcctgggggtcggcgaagaaagcactacctcccgatcgcagccagggtctacccacagcactgtctctcccgcctccacaaccacacctggacttagcgaagagtccacaaccgtatatagttccagtcctggttcaaccgagactacggtgtttcccagaactccaactaccagcgtcaggggcgaggagccaaccacctttcattctagacctgctagcacccacaccacccttttcacagaggactcaactacgtccgggttgaccgaagaaagcacggcatttcccgggagtcccgccagcacacagactggattgcctgccactctgaccaccgccgacctcggcgaggaatctactacctttccctccagtagcgggtcaacaggcaccaccctgtcacctgccagatccaccacaagcgggttggttggggagagcaccccgtctagactctcccccagctcaacagagacaactactctgcctggatctcctaccacccctagtctatcagagaaaagtaccacattttacacctcgccccgctccccagatgctaccctatctcctgccacaacaacttcatccggagtctcggaggagtctagcacaagccattctcagcccgggtctacacacaccacggcttttcctgactccacgacaacacccgggctgtcacgacatagcaccacttcacatagtagcccagggagcaccgacaccactcttcttccagcttctacgaccacttctggtccatctcaggagtctacaacctcacattcttccccgggatccactgatacagcgctgagccccggatcgacaactgccctctctttcgggcaggagtctactacattccactccagccccggatcaacccatacaaccctgtttcccgattcaaccacttcctctggcatcgtggaagccagtactcgagtgcactcgtctacgggctccccacggactactctcagcccagcctcaagtacaagtccaggtctgcaaggggaaagcacgacctttcagacacatccagcatcgacccacacaaccccgtctcctccaagcacagcaaccgctcctgttgaagagagtaccacctaccacagatctcctggttcgacaccaaccacccattttcccgccagctcaactacatcaggccatagcgagaagtcaacaatattccacagcagccctgatgcctccgggactacgccatcgagcgcccatagtacgacgtcaggacggggcgaatcaactacctccagaatatcacctggctccacggaaattacaacactgcctggtagcacaacaacacctggccttagtgaagcatcaacaacattttactcctccccccgtagcccaacaactacgctctctcctgcatctatgacaagcctgggagttggcgaggagtctactacgtctcgatcacagcctgggagcacacactctacagtgagcccagcctccaccaccacccctgggctctccgaggaaagtaccacggtttatagctcatctcctggcagtacagagactactgtgttccctcgctctaccaccacaagcgtaagaggcgaggagcctaccacgtttcactcacggccagcttctacacatacaacactgtttaccgaggatagcacgacttccggactgaccgaggagtcaacggcttttccgggtagcccagcaagcacccagaccgggttgccggccacactgacaacagctgatctcggggaagagagcacgacttttccaagctccagcggctcaaccgggactactctctccccagcccgctcaacaactagtggactggttggggagtccacacctagcaggcttagcccctcctcaactgagactactaccctgccaggcagtcccaccacacctagtttaagtgagaagtcgactacgttctacacctctcctagaagcccagacgctacgctgagccccgccaccaccactagctccggcgtcagcgaagagtcctcaacatcacactcgcagcccggatctacccatactacagcgtttcccgacagcaccacgacttctggtctatcacaagaacccacagcaagtcacagctcacagggttcaactgaggcgaccttgagcccaggaagcactaccgctagcagtcttggccagcaatccactacctttcattcctctcctggcgatacagagactacactccttcccgatgataccatcacgtcgggactggtggaagcctctactccgacccattcctctaccggctctctgcacacgacgctgacccctgcctcatctacatctgctgggctgcaggaggagagcaccacgtttcagtcatggccttcctcatctgatacaacaccgtccccaccggggactacagccgccccagttgaagtgtctacaacatatcacagccgtccaagttccacgcccactacccacttctcagcgagtagtactactttgggccgctctgaggagagtaccacagttcacagctctcccggagcaaccgggacggctttgttccctacaagaagtgccacatcagtgcttgtgggcgaaccaacaacttcacctatatcatcgggatctaccgagacaactgctctgcctggctctaccactaccgcgggtctctccgaaaagtccaccactttttacagctcccctcggagtccggacaccactctgtctcctgcttccaccacttccagcggggtgtctgaagagtcaaccacttcccactccaggcctggtagtacacacaccacagcatttcctgggagtaccactatgccaggcgtcagccaggaatctacagcatcacactcctcaccggggtctactgataccactctcagcccgggttctaccaccgcgtcctcactaggaccggaatcgaccacttttcacagtggtcccggcagcaccgaaacaaccctgctgcctgataacaccacagccagcggcctgctggaagcttctacccccgtgcacagctcgaccggatctccccataccaccctatcacctgcaggctcaaccactcggcaaggagaatccaccacattccagtcttggccaaattccaaagatacaactcccgcacccccaactaccacatctgccttcgtggagttatcaactacttcccacggctcacccagctctactccaacaactcactttagcgcctcttcaacaaccctcgggaggtctgaggaatccacaaccgttcactcgagtccggtggctacagcaaccaccccctcccctgccagaagtaccacatctgggttagtggaagaatccacaacatatcacagcagcccaggcagtacacagaccatgcactttccggagagcgacaccacctccggccgcggggaagagtctacgacaagccattcttcaacaacccacaccatctcctcagcaccatcaaccacttccgccctggtggaggagcctacctcctaccatagttcccctggatcaaccgccacgacgcattttcctgattcaagtactacctcagggagatctgaggagtccactgcctcgcacagtagccaggatgccaccggcaccatcgtactacccgcccgaagtacgacctcagttctgttaggtgagtctactacctcacccatttctagcgggtccatggaaaccaccgccctccctggaagcacaaccacacctggactgtccgagaagtcgaccacgtttcactcttccccgcgctctccggcaacaactctcagtccagcttctactaccagtagcggcgtgtcggaagagtcgactacctcacacagtagaccaggaagcacacatacaactgccttcccagactcaaccactactccaggactctcacgccactctacgacatcccactcaagcccaggttctacagatactaccctcctccccgcttccaccactacaagcggttcttctcaggaatcaactacctcgcattcctcttctggttctaccgataccgccctgtcacctgggagcactactgcgctgtcattcggccaggaaagtacgaccttccactcctcgcccgggtcaactcacactacgttgtttcctgattctacaacatctagcgggatagtggaagccagtacaagagtccactcctccactggatcccccagaaccaccctgagcccagcatctagcacctcaccaggattgcagggcgagtccaccgcctttcaaacccatccagcgtcaacacatactaccccgtcacccccctccaccgcgacggctccagtcgaagaaagcactacctatcataggtcgcctggatccactcccactacccacttcccggcctcaagcacaacctccgggcattcggaaaaatccacaatcttccatagctccccagacgcttcgggcacaacacccagcagcgcccactcgacaacatctggccggggagagtccaccaccagccgcatatctcctggctccacagagattactactctcccaggaagtaccacaacgccaggattgtccgaagcttcgaccactttttatagcagccctaggagtccaacaacaacgctgtcccccgccagcatgacttctcttggagtgggagaggagagcactaccagtcggagtcagcctggcagtacccatagcaccgtgtctcccgccagcactacgacaccagggctgagtgaggagtctacaacagtctatagcagctcacctggctctaccgaaaccaccgtgtttcctcggtctaccactacatcagtaaggagggaagagcccacaacctttcacagtcggcccgccagcacccacaccacactgttcaccgaagacagcacaacctcaggcctgaccgaagagtctaccgcctttccggggtcacccgcctcaactcagacagggctgccagccacactcacaaccgcagacctgggggaagaatctacaaccttcccctcgtcatcaggctccacaggcaccaagctctcccctgcaagaagtaccaccagcgggctcgtaggagaatccaccccatctcggttatcccctagtagcacagagaccaccacactgccgggcagcccgaccacaccttcattgtctgagaagtcaacaaccttctatacctccccgaggtcccctgacgctaccctgagccccgcgaccaccacctcaagtggcgtctccgaagagtccagtacgtcccattcccaacctggcagcacacatacaactgctttccccgactctactactacctctggcttatcccaagagccaaccacctcgcattcgagtcaagggtcaactgaggccacgctgtcacctggatctaccactgccagtagcttaggccagcagtccactacttttcacagcagccccggtgacactgaaaccacgctgcttcctgatgataccattactagtggcctggtcgaggcttcaacccccactcattctagcactgggagcctgcataccacactgactccagcaagctccaccagtacaggcctacaggaggagtccaccacatttcagagctggccgtctagctcagacaccacacctagtcctccttccaccaccgccgttccagtcgaagtgtcaacaacctatcacagccggccatccagcactccgacaacacacttctccgcctcttccacgaccttagggcgcagtgaagaatctaccacggtacacagctcaccgggcgcaactggaacagcccttttccctacacgcagcgctacaagtgtgttagtgggagagcccactacttcccctatctcttcaggctccactgagacaacggccctgccaggatcgacaactacggcaggcttgagcgagaagtctactacattctatagttcaccaagatctcctgacacaaccttgtctcctgcctctaccaccagctctggcgtttccgaagaatccacgacaagtcattctcgaccaggatccatgcatactactgcttttcccagtagcaccaccatgcctggggtatcacaagaatcaactgcgtcacatagctccccaggatctactgacacaactttgtcaccgggctctacaactgcaagctcactcggaccagagtcaaccacctttcactccagccctggttccactgaaacgactttattgccagataacactacggctagcggtctgctggaggccagcaccccggttcattcaagcaccgggtcgccacatacaacactcagcccagccggaagcaccacacggcagggggagagtacaacgttccagtcgtggccaaattccaaagatacgacccctgctccccccaccaccacctctgcctttgtggaactgagcaccaccagtcacggtagcccatctagcaccccgaccactcacttttccgcctcttcgacaactcttgggagaagcgaggaatcaaccaccgttcattcctctccagtcgccaccgcaactacgcccagccccgcccgctctactacatctggcttagtcgaggagagtacgacctatcactcatctcccggatctacccagaccatgcattttcccgagagcaatacaacctccggaagaggcgaggaatcgaccacatcccatagtagcaccactcatactatttcttcagccccttccaccactagtgccctggtagaggagccgacttcttatcactcaagtcctggcagtacagcaacaacgcactttcccgacagttccactacgtccgggcgcagcgaagagagcacggcaagtcattcatctcaggacgctacaggaactattgtactcccggccagaagcactacctcagtactcctcggcgaaagtacaaccagccctatatcctctggttcaatggagaccaccgcattgcccggctccaccactacccccgggttgtcagaaaaaagcacaacgttccactcatcacctagctccactccaacaacccacttcagcgcctcctctaccacactgggccgaagtgaggagagtactaccgtccattctagtccggtagccacggcaaccactcctagcccagcccgcagcacaactagtgggttagtggaagagagcactgcttatcactcctccccgggctcaacacaaacaatgcacttccccgagtcttcgaccgccagtgggcggagtgaggaaagtagaacctctcatagcagcaccacccataccatcagctcaccccccagcacaaccagtgcgctggtcgaggagcccaccagctatcactctagccccggctctattgctacgacacatttccctgagtcttccactaccagtggcaggtccgaggagtctacggcctcccatagctccccagatacaaatggcataacacccctgcctgctcacttcacaacaagcgggcgaatcgccgagtccaccactttctatatcagccccgggtctatggagacaaccctggcttcaactgcaaccacaccaggtctctctgccaagtctaccatcctctattcttcctcacgttcaccggaccagaccctgtccccggcctctatgactagctcatcgatctctggtgagcccacttccctgtacagtcaggctgaatctacacacacgactgcgtttcccgcctctaccaccacaagtggcctgagccaggagtctaccacattccatagcaaacctggctcaacagagacaacactgtcgccaggctccataacaacctcaagctttgcacaagagtttactaccccacatagccaacctggatcggccttgagtactgtctctccagccagtacaacggtgcctggactctccgaggagtccaccacattctattcttccccgggcagtactgagacaaccgccttttcacattcaaatacaatgagtatccatagccagcaatcaaccccttttccagacagtccaggcttcacccatacagtcctccctgcaacacttactactaccgacattggccaggaaagcaccgctttccactcatcttcagatgctacagggacaacaccattgcccgctcgcagcactgcttctgacctggtcggcgagcctaccactttctatatctcgccatcccctacgtataccacactctttcctgcatcttccagcacttctgggctgacagaggaaagtacaaccttccacacatccccgagtttcacgtcaacaatagtatctacagagtcccttgaaacactggcccccgggctttgccaggaggggcaaatttggaacggcaaacagtgcgtctgtcctcagggctatgtggggtaccaatgccttagccccttggaaagtttcccagtggagacccctgagaaactcaacgctaccctcggaatgacagtgaaagtgacttatcgtaattttactgaaaagatgaacgatgcatcgtctcaggagtaccagaacttctccacgctcttcaagaatagaatggacgtggtcctgaaaggcgataacttaccacagtacaggggcgtaaatattcggcgattgcttaacggaagcattgtcgtgaaaaatgacgtcatcctcgaggcggactacactctcgaatacgaggaactgttcgaaaatctggccgaaattgtcaaggcaaagataatgaatgagacacgaacaaccctgctcgaccccgattcatgcagaaaggctatcctttgttactcagaggaagataccttcgtagattcaagtgtaactcctggcttcgactttcaggagcagtgtacccaaaaagctgcggaaggatacacccagttctactacgttgatgttctggatggtaaattggcatgcgttaacaagtgcaccaaggggactaagtcccagatgaactgcaacttgggaacctgccaacttcagcgctctggaccccgttgcctgtgtcccaacacaaacacacactggtattggggtgagacgtgtgaatttaacatcgctaagtcactagtgtatgggatcgtgggcgcagtcatggcagtccttttgttggctctgatcatactgatcatcctcttctccctcagccagaggaaaaggcaccgggagcagtatgatgtgcctcaggagtggcggaaagagggtacacctgggattttccaaaaaactgctatttgggaagatcaaaatttacgggagtcacggtttggcctggagaacgcttacaacaattttcgcccgaccctagagaccgtcgactccggcaccgagcttcacatccagagacccgaaatggttgccagcactgtttag

SEQ ID NO: 195715 - DNA, 16008 bp, Artificial Sequence
  Description of Artificial Sequence: Synthetic coding sequence
atgctggtgatctggatcctgaccctggccctgcggctgtgcgccagcgtgaccaccgtaacgcccggcagcaccgtcaatactagcattggaggcaatactactagtgcttcaaccccgtcaagtagcgatcccttcactacatttagtgactatggcgtgagcgtcaccttcatcaccggctcaactgccactaaacactttctcgattcctccaccaacagcggtcactccgaggaatcaaccgtcagccactcaggaccaggtgctaccggcacgaccctcttcccaagtcacagcgccacctctgtgttcgtgggagagccaaaaaccagccccattacctccgcatccatggaaacgactgcacttcctggctccaccactaccgccggcctctcggagaagtcaacaaccttctactcgtctcccaggagtcccgacagaaccctgagtccagcccggaccacttcaagcggagtgagtgagaaatcaacgacgtctcatagtagaccgggacccacacatacaatcgcctttcctgacagtacgaccatgcccggggtgtcccaggagtcgaccgcctcccacagcattcccgggtccacagacactaccctgagccctggaaccacaacgccatcatccttagggccagagtcaacgaccttccactcatcccctgggtatacgaagacaacccgacttccggataacacgaccacgtctgggcttctcgaagcctctacgccggtgcactcttcaacgggcagcccacataccactctcagtccctcctcctctactactcatgagggtgaacccacaacttttcaatcttggccctctagtaaagacacatctcccgccccaagcggcactacaagtgccttcgtcaaactcagcaccacatatcacagcagcccttcttcaaccccgaccacccacttttccgcttcttcaacaactctgggacactccgaagagtccacccctgttcattcctcacccgtggccactgccacaaccccaccacccgcaagatctgcgacctccggccacgtggaggaatcgactgcataccaccggagccccggttcaacgcagacaatgcacttcccagaatcaagtacaacttcgggtcacagcgaggagtctgccacctttcatggatccacaactcacacaaaatcgtccacaccttcaaccaccgcagcgctcgcccacacatcttaccacagctcacttgggtctacagagacaactcatttcagagactcctccaccatctctgggcggtccgaagagtctaaggccagccactcatccccagatgccatggcaaccacagtattgccagccggatcaacccctagtgtcctcgtgggggactctacgccgtctccgatctcaagtggctccatggagactacggcgctgccaggttcaactactaagcccggtctgagtgagaaatctaccactttttactcctctcccaggtcacctgacactacgcatctgccagcctcaatgacttccagcggtgttagtgaagaatccaccactagccacagccggcctggctctactcatacaacggcctttcctggcagtacgacaatgcccggtctatcccaagagtctacagcttcacattcctcaccaggaccaactgacaccacactgtcccccggctccacgacggcgtcttctttggggcctgagtacacaacattccattccaggcccggtagcaccgaaactaccctacttccagacaacacaaccgcctctggtctgttagaggcttccatgccagtgcatagtagtacccgcagcccccacaccactctcagtcccgctggcagtacaacccgtcaaggcgaaagcaccacctttcattcctggcctagctccaaagatacacggcccgcacctccgaccacgacctctgcctttgtcgagccttcgactacctcacatggctccccctcctctattccaacaacccacatatcagccagatctaccacttcaggcttagtggaggaatccacaacctatcattcttcacctggaagtacacagaccatgcatttccccgaatcagacactacttccggcaggggcgaggagtctactacctctcactcttccactacgcacaccatctcaagcgccccgtcgacaacctcggcccttgtagaggagccaaccagctatcactccagccccggctcaaccgccacaacccacttcccggatagctccactacctcaggcagatccgaggagtccaccgcatcccactccagtcaggatgccaccggtaccatcgtcctcccagccagaagcaccactagcgtcttgttgggcgagagcacgacgagtcctatttcatctgggtcaatggagactaccgcgttgcccggctctactactaccccagggctgtccgaacgatccacaacgttccattccagcccgagatcaccagcgactaccctgagtcccgcaagcacaacctcgagcggcgtgagcgaagaatccaccacatcacggtcacgacccggttctacccataccactgcgttcccggattccaccaccacgcccggactttcccggcacagcactacaagccacagcagcccagggagtacggacaccacactgctgccagcgtccacaaccactagtggaccctcccaggaaagcacaacatcacactcatcctcgggatctactgatactgctctgagccctgggagcactaccgccctctcattcggccaggaatcaaccacgttccactccaatccgggatctactcacactacactgttccctgattcaacaacttctagcggcatcgtggaggcttccactagggtacacagctcgacaggatctcccagaactactttgtctccagcctcctctacttccccggggctccaaggcgaatccacagcgtttcagacgcatccggcatctacccacacaacaccctctccgccctctactgccacggctcctgtggaggagtctactacttaccacagaagtcctggatccacgcccactacgcatttcccagcatcgtcaaccacctcagggcatagtgaaaagagtaccatatttcatagctccccggacgcaagcggtactacgccaagcagcgcccactcaaccacttcaggccgaggagagtctaccaccagccggatcagcccaggatcaacagagatcacaactctgccaggctctactacaactccaggcctctccgaggcctcaacaaccttctatagctcccctagaagccctaccactactctgagcccggctagtatgacctctcttggcgttggcgaggagtccactacaagtcgttctcaaccaggcagcacacattccaccgtgtcacctgcaagcacaacaactcctggtctgagtgaagaaagcactaccgtgtactcgtccagccgtggttcgacagagacaaccgttttccctcactccacgaccacttctgtccatggggaagagcctacaacattccactctaggccagccagcacacatacaactctttttacagaagacagcaccaccagcggacttaccgaagaaagcactgcttttcccggctcacccgcctcaacccagacagggctccccgctacactgaccacagccgatcttggtgaagagtctacaactttcccttccagcagtggctccacaggaaccaaactgagtccagctaggtcgacaacctcagggctggtcggcgagtctacacccagtcgtctatccccaagctccaccgagaccactactctgcccgggagcccaaccactccatcattatccgagaaaagcacaacgttttacactagtccacggagtcctgatgctaccctgagcccagcaaccaccacgtcctctggggtgtccgaggaatcctcaactagccattcccaaccaggctctacgcataccaccgccttcccagatagcaccaccacttcagatctgtcccaggagcctaccacctcccacagcagccaaggctctacggaagcgaccttgtccccgggaagtaccacagcctcaagcctaggacagcagtcaacaacctttcactcctcccctggtgataccgaaacgactctccttcccgacgatactattacatcagggctggttgaagcatccacccccacgcactcctcaaccggctccctccacacaacactgaccccagcatcaagcaccagtgccgggctgcaggaagagtcaacaactttccagtcctggccttcttctagtgatacaacgccaagtccacctgggacaactgccgccccagtggaggtgagcaccacataccactcccgtccctctagtaccccaacaacacacttttcagccagctctaccacactgggcaggtccgaggagtcaactacggtgcactcaagtcccggagccactgggactgctctgtttccgacccgatccgccacatcagttctggttggggagccaacaactagtccaatttcttcgggctcaaccgagactactgctctccccggctctacgacaaccgctggactctcagagaaaagtacaacattctactctagccccaggtcgccagataccacactcagccccgcatctacgacctcctcgggagtgtctgaggagtccacaacatctcactcccgtcctggttctacacacaccaccgctttccccgggtccacaactatgccaggcgtcagccaggagtccaccgcttcccattcttcacctggatctacagacaccactctatcgcctggctccacaacagcttcctcactcggtccagagagtacaaccttccattccagccccggctctacggaaactactctgctccccgacaacaccaccgccagcgggctcctggaggctagcacccctgtacactcctccactgggtccccccataccaccctgtctccggcagggtcaacaacccgacagggagaaagcacaacattccagtcgtggcctagcagtaaagatacaatgccagcacctcctacaaccacttcggccttcgtggagttgagcacaacgtcccacggtagcccatctagtaccccgacaacgcacttttctgcctctagcactaccctaggccgtagcgaggagagcaccaccgttcactctagccctgtggccactgccacgaccccaagcccagctcggagcactacttccggtctcgtcgaggagtctaccgcttatcacagctccccaggttctacccaaacaatgcatttccccgaatcttcaacggcatctggaaggtccgaggagtcacgcacatctcatagcagcacaactcacaccattagctccccacctagtacaacaagtgcactcgttgaggaaccgacttcttatcactcctcccccggttctactgcaactacccatttccccgactcttccactaccagtgggaggtcagaggaatccacagcctcacactcatcccaggacgcaacggggaccattgtcctgcctgcacgtagcaccacatcggttttactgggcgagagcacaacatccccgatctcatccggtagcatggagactaccgcattgcccggtagtactacgacacccggactgagcgagaaatcaactacattccacagttcccccaggtcccccgccacaacactatccccagcttctaccactagctccggcgtatcggaagagtccacaacgtcccactctaggcctggatccacacacacaacagccttccccgactcaaccacaacgccaggactttctaggcattccacgaccagtcacagcagtccaggttcaacagacactacccttctgcctgctagcacaaccacctccggcccaagccaggaatctacaacgtcgcacagctctcctggaagtacagacaccgcattatcacctggatccaccacagcactgtccttcgggcaggagtccacaacattccactcctcccccggctcaacccataccactctgttccctgattccaccacatcatccggaatcgtagaggcctcaacacgagtccatagctctaccggctctccccgcacgaccctttctcctgctagttccacgagcccaggattgcaaggtgagtctaccgcatttcagacccatcccgcttccacccacacaacaccatctcccccctctactgctactgccccagtagaggaaagcacaacataccacaggagcccgggaagtactcctactacacattttcctgcctcaagcaccacttccgggcactccgaaaagtctactatttttcacagcagccccgatgcgtccggcacgacaccgagctctgcgcacagtaccacgtctgggaggggtgagagcaccacctcacggatttccccgggaagcaccgagatcaccaccttgccaggcagcactacaacacccggactaagcgaagcgtccactactttttattcatcacctaggagtcctactaccaccctatcacccgcctcaatgacgtctctgggagtgggtgaggagagtactacaagtcgcagccagcccggttcaacgcactctacagtgtctccagccagcaccactactccgggtctgtccgaggagtctacaacagtgtatagtagttccccaggaagcaccgaaacaactgtcttcccccgaaccccgacaacttcagtgcggggggaagaacctacaacatttcactctagacctgccagcacccataccaccctgtttaccgaagactcaacaacttctgggctgaccgaggagagtaccgcttttccaggctcgcctgcatcgacacagactgggctccccgcaaccctcactactgccgatctgggagaggaaagcaccaccttcccgtcatcaagcgggtctactggcactaccctgagtccggcacggtctaccaccagcggactggttggcgaaagcactccttcacgcctttcaccatctagtactgagacaaccacattacctggatcccctactactccgagtctctccgaaaagtccactaccttttacacaagtccccgatccccggacgccaccctgtccccagctactacaacctccagcggcgtgtcagaggagtcatccacctctcactctcagccaggctcgactcatacaacagctttccccgatagcactacgacaccagggctgtccagacattcgacaaccagccactcatcacctggctccacagatactacactgctgcccgcctctacgactacatcaggtccaagtcaggagtccaccacctctcacagtagtccaggatctacagatacagcactgagtcctggctcaacgaccgctttgagttttggccaggagagcactacgtttcacagtagtcccggatccacgcatacaacactgttccctgactctacaacatcatccggcatcgtggaggcttccacaagagtgcactccagtaccggctcaccccgcactactctgtctcctgccagcagcaccagtcctgggcttcaaggggagagcacgacattccaaacacatccggcctccacacatacaacaccctcacccccttcaacagccactgctcccgtcgaggagagcacaacttaccaccggagtcctggatccacgcctaccacccattttcctgcatcttctaccacctctggacacagcgagaagtcaaccatcttccacagctcccccgatgcgtctggcaccacccctagctctgcccatagcacgacttcaggcaggggcgagtctaccacgagccgaataagtccaggaagcaccgagattacaactctgcccggcagcacaaccacccccggactgtcagaggcttcgacaaccttctactcttcaccccgcagtccgaccaccacccttagtccagccagcatgacatccttgggcgtaggggaagagagcaccacatctcggagccagcccggctctacccatagcactgttagtccggccagtacgacgactccaggattgtcagaggagtcaaccactgtctattcctcctctcctggaagcaccgaaaccactgtattccctcgtagtactacgacatccgtgagaggcgaggaacccactacattccactcacgacccgcaagtacccacacaacactctttacagaagattccactacctctggcttgaccgaggaaagtacagcttttcccgggagcccggcttccacacagactgggctgcctgccactctgactaccgccgacctcggtgaggagagcacgacattccccagcagctccgggtcaacagggactacgctatcgcccgcccgatccactacgagcggcttagtgggtgaatcaacaccgtcccggctgagtcccagttcgactgagactactaccctgcccggctcgccaactaccccaagcctgtctgagaagagcactactttttacacttctcctaggtcccccgacgccaccctctcacctgctaccaccacatcatccggtgtgtcagaagaatcttctacctcccatagtcagccaggctccacacacactaccgcattccctgactccaccaccacatctggacttagccaggaacccacggcttcacatagctcacagggaagcaccgaagctactctgtccccaggatctaccaccgcctcctccctgggtcaacagtcaactactttccactcaagtcctggagacacagagactacactccttccagacgataccatcacaagtggtttggtggaggcctccactcccacccacagttccactggttctctgcacacaacattgaccccggcaagttccacttctgcaggcttacaggaggaaagcactaccttccagagctggcctagctcgagtgacacaaccccatctccacccggcaccactgctgccccggtggaggtgagcaccacctatcactctcgacctagcagcactccaactacccatttcagtgccagttccacaaccttagggcgcagcgaagaaagcacaactgttcattcctcgccaggggccacaggcaccgcactcttccccacacggagtgcaacgagtgtactggtgggggagcctacgacctcccctatatcctcgggcagcacagaaactactgccctgcctggcagcactacaaccgccggtctgagtgagaagtccactactttctatagctcacctcggagccctgacactaccttgagccctgccagcaccactagctccggcgtatccgaggagtctaccacctcccatagtagacctggctctacacacactacggcgtttcccggaagcacgacaatgccgggggtcagccaagagtccaccgcatcccacagcagccccggatcaacagacacaaccctctcccctggatcaacaactgcctcttcattgggtcctgagagcaccacctttcattcgggccccgggagcaccgagactactctcctgccagataacaccaccgcctcaggtttgctcgaagcctccacccctgtgcattctagcacaggtagccctcacacaaccctgagccccgcaggatccaccacacgacagggggaatctaccacctttcagtcctggccgaattccaaagatactacgcctgcccccccgaccacaaccagtgcttttgtggaattatcaacaacctcacacgggtctccgagcagcacccctaccactcacttttctgcctccagcacaacgttgggaaggagtgaagaatccacaaccgtccattcttcgcctgtagccacagcaactactccctcccctgcccggtcaaccacctccggactagtggaagagtccacaacatatcactccagcccaggatcaactcagacaatgcactttcccgaaagtgacaccacttccggtcgcggagaggaaagtacgactagtcattcatccactacccatactatcagctccgctccctccacaacatctgcgcttgtagaggagccaacctcttaccattcctcccccgggagcaccgctacaacccactttcctgattcttctaccaccagcggaagaagcgaagagagcaccgcctcacattctagtcaggacgcaaccggaactatcgtgctcccggcgcgctcaaccactagtgtgctcctcggagagagcacgacctccccaatctcctcaggttctatggagaccactgccctgcctgggtctaccaccactcccggcctaagcgaaaaaagtactactttccacagtagtcccagatcaccagcgacaactttaagccctgcatcgaccacctcttcaggggtgtcagaggagtcaacaacctcccattctaggcctggatctacacacaccaccgccttccccgatagtaccacgaccccgggacttagcagacacagcactacgagtcactccagcccgggatctacagacaccacactgttgcctgccagtacaactaccagcggatccagccaggaatcaacgacatcccacagcagctctggctcaactgataccgccttgtcccctggcagcaccaccgctctgagtttcgggcaggaaagtacaaccttccactcgtccccagggtctactcatactaccttattccctgattccactacgtcatctgggattgttgaggccagtactcgggtgcattcttccactggttctcccagaacaacgctctccccggcaagttcaacttcaccgggactgcaaggagagtcaaccgctttccagacccacccagcctcgacccacaccactccatccccaccctcaaccgccaccgccccagtggaggagagtactacttatcacaggtcacccggaagcacccccaccacccacttcccggcttcctctactactagtggacattccgagaaaagcacaattttccactcatcccccgatgcgagtggtaccaccccctcatccgcccactccaccacgagcgggcggggcgagtcgactactagcagaatttcccctggatccacagagataacaaccttgcccggatctaccaccaccccagggctgagtgaggcctccacgacgttttacagttcgcctcgctcccccaccacgacgttatcaccagccagcatgacctcgcttggagtgggagaggagtctacaacttctcgctcccagcccggctcaacccatagtacagtgtctcctgcgagcaccacgacgcccggcttgtctgaagagtccactaccgtttacagcagttctccgggcagcaccgagacaaccgtgttcccacggagcactaccaccagcgtacgtagagaagaacctactacatttcactctcgtccagcctctactcataccactctgttcactgaagactcaaccacatcaggactaacagaggagagtactgcgttcccaggatctcctgcttcaacgcagacgggcttaccagccacattaacaaccgctgaccttggggaagaatccacgacgtttccttccagtagtggcagcacaggaaccaaactcagtcccgcgaggtctaccacatctggtttggtgggggaatccaccccttcacggctctcaccctcctctacagaaacaactacactgcccggtagcccgactactcctagcctgtccgagaagtccaccacgttttatacttctccgagatcccctgacgcaaccctcagccctgcaacaactacgtcctccggagtgagcgaggagagtagcacctctcacagtcaacctggctcaacccacactacagccttcccggattccaccaccacaagcgggctgagtcaggagcccacaactagtcattcctctcagggctctactgaggcaacactttcacctgggtctaccacagcctcttccctgggccagcagtctaccacattccacagcagtccaggtgacaccgagactaccttgctgcctgacgacaccattacgagcggtcttgtagaggcgtccaccccaacacattcgtcaactggtagcctgcacactacattgacccccgctagtagtacctcaacaggcctgcaggaagaaagcaccacgtttcagtcttggcctagctcttctgacactaccccaagcccaccttccacaaccgccgttcccgttgaggtgagcactacttatcatagccgcccctcaagcacaccaacaactcacttttccgcaagcagcaccacactggggaggtctgaggaatcgaccacagtgcattcttcacctggagccacggggaccgccctctttccaacgaggagtgctactagcgtgctggtgggcgagccaacaacatcgcctatatccagcggctccaccgaaaccaccgcgttgcccggttctactactacagcaggcctgagtgagaagtctaccaccttctattccagtccacgcagcccagacacaacactttcccccgcttcaacgacttctagcggtgtgagcgaggaatctacaacctctcactctcggcctggatccatgcatactacagctttcccgtctagcactactatgcccggcgtgagccaggaatccacggccagtcacagctctccaggcagcacagacaccacattgtcacccggctcaacaacagctagttcattgggcccagagtctaccaccttccattctagcccaggctccaccgagaccaccctcctgcccgataatacaaccgcgagcggcctgctcgaagcaagcacccccgtccactcctctaccggttccccccacaccacgctgtcgcctgccggtagtaccactcggcagggggagagcactacctttcagagctggcctaactccaaggatactactccagcaccccctaccaccacgtcagctttcgtggaactctcaactacctcccacggatccccctcaagcactcccactactcacttttccgctagtagcactacacttggccgctctgaggagagtactaccgtgcattccagcccagtcgccaccgccacaacaccttcacctgctaggagtacaaccagcggcctggtggaagaaagcacaacctatcattcaagtcccggcagtactcagaccatgcattttcccgagtcaaatacaacttctggacgaggcgaggagtccactacatcccacagcagtacaactcatactatcagctccgctccttctaccaccagcgcactggtggaggagccaacctcctatcattcatcgccaggcagcacagccacaactcatttccccgacagcagcaccacgtcaggcagatcagaagaaagtacggcttctcattcaagtcaagacgccacgggcaccattgtgctgcctgcgcgttcaactacatccgttctgctgggggagagcaccacaagccctattagctccgggtctatggaaaccacagctctccccggcagcactaccactcctggtctgtcagaaaagagtacgacattccatagcagcccatcctccaccccaacgactcatttttctgcctccagcacaacattaggacgatcggaagagtccacaacagtgcactctagccccgtggcgactgctaccaccccctctccagcccggagtacaacctctggccttgtcgaggagtccaccgcataccactcatcccctggctcaacccagaccatgcactttccagagagcagcacagccagcggaaggtccgaggaatcacgtactagccatagctccactacacataccatctcctcacctccttctaccacgagcgccttggtcgaagaacccacaagttatcattcgtctcccggatccatcgccactacgcactttcccgaatcatccacaacatctggaagatctgaagagagcacagcgtctcactcaagcccagacaccaatgggattacgccacttcccgcccactttactacatctgggcgcattgcggagtccaccacattttatatcagccctggcagcatggagacaacattggcatcgacggctacgacccctggattgtctgcgaagagcactatcctgtattctagtagtcgttccccagatcagactctctccccggcctctatgacctcatccagcatttccggagaaccgacttctctgtattcccaggcagagtccacgcatacaactgcatttcctgcatctactaccacaagcggcctgtcccaggaatccacaacatttcatagtaaacctggttccacggagaccaccctgagtcctggatctattaccacaagttctttcgcgcaagaatttactactccacactcacagcccggatcagcactgtcgaccgtcagtcccgcgtcgacaacagtgcctggtctgtccgaggagagcactacgttctacagtagccccggatcaacagagactaccgccttctcccacagtaatacaatgtctattcattctcaacagtctaccccgtttcccgactcccctggcttcacacacacagtgctaccggccactcttacaacaaccgatattggccaggagtccaccgccttccattcgtcctccgatgctacaggtacaactcccctgccggcccgttctacagcatctgacttagtgggggagcctacaaccttttatatcagtccgtcacccacgtacaccaccctcttccccgctagctcttccacttccggcctcaccgaggaatctactacatttcacactagtccctcattcacgtctacaatcgttagcaccgagagtttggagacactggcacccggactttgccaggaaggccagatctggaacggaaaacagtgtgtctgcccgcaggggtatgttgggtaccagtgtctgtctccgttggagagcttccctgtggaaaccccagagaagctgaacgctaccctgggcatgaccgtgaaggtgacctataggaactttacagagaagatgaatgacgcttcatcacaggagtaccaaaacttctctacactattcaaaaaccgaatggacgtggttctcaaaggcgataatctgccacagtaccggggcgtgaacataagacggctcttgaacgggagtatcgtcgtcaagaatgatgtgattctcgaggccgactataccctggagtacgaggaattgttcgagaatctagccgaaattgttaaagcgaagatcatgaatgagacgagaacgaccctgctagatcccgactcctgcaggaaagcaattctatgctacagcgaggaggatacctttgttgactcgtcagttacaccaggcttcgatttccaagaacagtgtacacagaaggccgcagagggatacactcagttttactacgtggacgttctggacggcaagctagcatgcgtgaacaaatgtaccaagggcacgaagtcacagatgaattgtaatctcggcacatgccagcttcaaagatctgggcccaggtgtctctgtcctaacactaacacgcattggtattggggggagacctgtgagtttaacatcgccaagtctctcgtctacggaattgttggggcagtgatggccgtgctactgctcgccctaattattctcattatcctattcagtctgtcccaacgcaagaggcaccgggagcaatatgacgtcccacaggagtggaggaaagagggcacaccgggcatctttcaaaagaccgcaatctgggaagatcagaatctgagagaaagccgctttggcctggagaatgcttacaataacttccgacctactctggagactgttgatagtggtactgagttgcatattcagagacccgagatggttgcttctactgtttag

SEQ ID NO: 195716 - DNA, 1536 bp, Artificial Sequence
  Description of Artificial Sequence: Synthetic coding sequence
atgaaggccatcatccacctgaccctgctggccctgctgagcgtgaacactgcaaccaatcagggcaatagcgctgatgccgtgacaacaactgagacagccacttcagggcctaccgtggcagccgctgataccacagagaccaatttcccagagactgcttctacaacagcaaacaccccgtttcccaccgcaactagcccggccccgccaattatatcaactcacagctcttccaccatacctacaccagcaccacccattatcagtactcattcttcttccacaatccctatccctactgctgcagattcagagtctactacgaatgtcaacagtctggccacgagtgatatcatcacagcctcctccccaaatgacggactaattactatggtgccgtctgagacacaatccaacaatgaaatgtctccaaccacagaggataatcagtctagcggacccccgaccggaacggcactgctcgagacctctaccctgaattcaaccggaccttctaatccttgtcaagacgacccatgcgctgacaatagtctgtgtgtaaaacttcacaatacttctttttgcctctgccttgagggctattactataactcctccacttgcaagaagggaaaggttttcccaggcaaaattagcgttacggtgtccgagactttcgaccccgaggagaaacacagtatggcttatcaagaccttcattccgagatcacgagtctgtttaaagacgtgtttggcactagcgtgtacggccaaaccgtaattcttaccgtgtcaacctccctgagtccccggtcagaaatgagagccgacgataagttcgtgaatgtcacgattgtgactatactcgccgagacaacgagtgacaatgagaagaccgtcaccgagaaaatcaataaagccataaggtcttcctcttcaaactttcttaactacgacctgacactgaggtgtgactattacgggtgtaaccagactgctgacgactgcttgaacggacttgcctgcgactgtaaatctgatttgcagcggcctaacccccagtcccctttttgtgtcgctagtagccttaagtgtcccgatgcttgcaatgcacagcacaaacaatgcctcatcaagaagtctggaggggcacccgaatgcgcgtgtgttccaggttatcaagaggatgcaaacggcaattgtcagaagtgcgcctttggctactccggcttggattgtaaggataaatttcaactgatcctcacaatcgtgggaactattgcgggaatcgtgattctgtccatgatcatcgccctgatcgtcactgccaggtcgaacaacaagactaaacacatcgaggaggagaacctgatcgacgaagacttccagaacctgaagctgcgctccacgggattcacgaacttaggagccgagggttctgtcttccctaaggttagaattactgcttcacgcgactcacagatgcaaaatccctacagccggcattctagcatgcctagaccagattactag

SEQ ID NO: 195717 - DNA, 13482 bp, Artificial Sequence
  Description of Artificial Sequence: Synthetic coding sequence
atgccccggcccggcaccatggccctgtgcctgctgaccctggtgctgtcccttctccccccccaggccgccgctgagcaagacttaagcgtgaatagggctgtatgggatggaggaggctgcataagtcagggggatgtcttgaaccgccaatgtcagcagctgtcgcagcatgtgaggacagggagcgccgcgaataccgctacgggtaccactagcacaaacgtggtcgaaccacggatgtacctgagttgtagcaccaatcctgaaatgacatccatcgaatcgtctgtgacaagcgatactcccggggtctcctccacccgcatgactccaaccgagtcccggaccacgagcgaaagtacctctgattcaacgactttattcccctcgagtactgaagacaccagctcaccaaccacaccagaaggcacagatgtcccgatgagcactccgtcagaagaatctatcagctccaccatggcttttgtgtctaccgcgccactgccctcatttgaagcctacacatccttgacatataaagtagatatgtcgacacctttaaccaccagtacccaagctagctcttcccctaccacccctgagagtacaactattcccaaatcaacaaattccgagggatcaacccccttgacatccatgccagcatctactatgaaagtagccagtagcgaagctattaccttgctgactacacctgtggaaatctccacgccagttactatctcagcccaggcgagtagctctccaaccaccgcggagggcccaagcctatccaattctgcgccttcaggagggagtactcctctcaccagaatgcctttatctgttatgctcgtcgttagtagtgaggcctccacactgtccaccacgccagcagccactaatattcctgtaatcacctcgactgaagcttcttcctcgcccaccacagcagaaggaacatccatacctacatcaacctatactgagggcagcacccccttgacgtccaccccagcatcaactatgccagtggccacatctgagatgagtactctatccattacccctgtggacacatccactctcgtaacgacttcgaccgaaccctcatcactgcctaccactgccgaagcaaccagcatgctgacgtctactctgtctgagggctctacacctctgacaaacatgcctgtgagtaccatacttgtggctagcagtgaagcaagcacaacaagcactatacctgtcgattctaagacctttgttactacagctagtgaggcatcttcctccccaacgacagccgaagacacctccatcgcgacttccacccctagcgaaggctctaccccgctgaccagcatgccagtgtcgacaacccctgtggcttctagcgaggcttctaacctctctacgacgcccgtcgattccaagacccaggtgactacttctacagaggcctcgtcgtctcctcccaccgctgaagtgaattctatgcccacgagcactccctcagaaggaagcactccccttacatcaatgagtgtatccaccatgcccgttgctagttccgaagctagcaccctatcgacaacacctgtcgacactagcacccctgtcactaccagctctgaggcaagcagctcttccacaacaccagaagggacatctattcctacctcaaccccatccgagggaagcacacccttaacaaatatgcccgtctccacccgattagtggtgtctagcgaggcttccaccacctctacgactcccgctgattccaatacctttgtaactacatctagcgaggctagcagctctagtacaaccgccgagggaacctccatgcctacaagtacatattcggaacggggtaccacaatcacgagcatgtccgtaagtacgacactggtggccagttctgaagcaagtactctttcaaccacccctgtggactccaataccccagtaactactagcaccgaggccacttcaagcagcaccactgctgaagggacgagtatgccgacatctacctatacagagggcagcacacccttgacaagcatgcctgtcaacacaacacttgtcgcaagctctgaggcctcaacattgagtacgactcctgttgacactagcactccagtgaccacttctacggaggctagctctagccccactactgccgatggagcctctatgccaacgtctacaccttctgaagggtctaccccattgacttccatgcctgtgtcaaaaaccctgctcacttcaagcgaggcgtcaactttgtctactactcccctggacacttccactcacattactaccagtacggaggcatcctgttcccccactaccacagagggtacttctatgccaatttccacacccagcgagggctcgccactgctgaccagcataccggtcagcattactccagtgactagtccggaggcttctacgctgagcacaactcctgtcgactccaacagcccggtaacaaccagcactgaagtgagctcctctccaaccccggccgaagggacctccatgcccacaagcacatatagcgagggcaggacccccctcacttccatgcccgtctccactacactcgtcgctacttctgctatctccaccctcagcaccacccctgtcgacacctccacaccagtgactaattcaacagaagctcgcagcagccctaccactagtgaggggacatccatgcctacctctacccctggggagggctctacgccccttacctctatgcctgacagtacaacccccgtggtgtcttctgaggccaggactctgtcggctaccccagtggatacatctacgccggttaccactagcaccgaggccacaagttctcctactacagcagagggtacaagtataccaacctctaccccttcagagggaactactcctttgacgtcaacccccgttagtcacactctggtggcaaattctgaagcatcaaccctgagcactacacccgtggatagcaatacccctctcacgacatccacagaggcgtcttctccgccacctactgctgagggaacttctatgcctacatcaaccccctctgagggatccacacctctgacccgcatgcccgtttctaccaccatggtcgcttcctctgaaacatccaccttgagtaccacccccgcggacacgagcacccctgtgacgacatactcacaagcctcttcaagttccaccaccgctgacggtacctctatgcccacttccacctactccgagggatccactcccttgacatcggttcctgtgtctaccagactcgtagtgtcttcagaggcctcaacacttagcaccaccccagtcgacacttcgatacctgtgacaaccagcactgaggcttccagctccccaaccaccgctgagggaacttccatcccgacaagccctccatctgaaggcaccacccctttggcctctatgccggtctctaccacccttgtggtgagttctgaagctaacactctgtctaccactcccgtggactcaaaaacccaggtggcaacttctactgaggcttctagccctcctccaaccgccgaggtgacctcgatgcctactagcacccctggagaaaggtctacccctttgacgagcatgccagtacggcacacccccgttgcatcttctgaggccagtactctgtccacatcacccgtggatacctctaccccagtcacaacatctgccgagacatccagctctccaaccacagctgaaggaaccagcttgccaacctcgactacttccgagggcagcaccttgctcactagtattccagtaagcacaaccttggttacctccccagaagccagtacactgcttacaacacccgtagatactaaagggcctgtcgtgactagcaatgaggtaagtagctcgcccacgccagctgaggggacatctatgcccacatccacttactcagagggcagaacacccctgacgtctatccccgtcaacactacattggttgcttctagcgccatcagtatcctaagtaccacacctgtggacaacagtacccccgtgactacaagtaccgaagcttgtagctcccccacgacctcggagggcacttcaatgcctaactccaatccctccgaagggactacaccactgacttcaataccagtctctacgacgcctgtggtgtcatctgaggcatcaacactgtcggctaccccagtggacacatcaacacccggaacgactagcgccgaggcgacttctagccctaccactgctgagggaatctcgatccctacctccacgccctcagagggaaaaacacctcttaagtccatccctgtatccaatactcccgtggccaacagtgaagcatccacactatccactactccagtggactccaatagcccagttgtcactagcaccgccgtttcctcttctcctacacccgccgagggtacctccatcgcaataagtacccctagtgagggcagcactgcactgacttcaatacccgtgtcaactacaacagtggcctcttctgaaatcaacagcctgtccacaacaccagcagttacatccactcccgtaacaacctacagccaggcttcctcttcccccacaactgccgatggcacatcaatgcagaccagtacatactcggaaggtagtacaccactgacatcgttgcctgtgtccactatgttggttgtctcctccgaggctaacactctgagtaccaccccaatagactcaaaaacacaggtgaccgcttccactgaggcttcaagttcaaccaccgctgagggttccagcatgactataagtacacccagcgaaggctctcccttgttgactagcatacccgtgtcaacaactccagtggctagtcccgaagcctccaccttgagtactacccccgtggactcaaacagcccagtgatcacatccacagaagttagctcatctcccactcccgcagaaggaacatcaatgccaaccagtacttacactgagggccggaccccactaacttccattaccgtaaggactacccccgtcgcgagctctgccattagtactctaagcactactcctgtggataacagtaccccggttactactagtactgaagcaagaagtagtccaacgacctctgagggaacgtcaatgccgaactctacccctagcgagggaactactcctctgacctccatcccagtaagcacgactcctgtccttagctccgaggcgtcaacactgtctgccacaccgatcgataccagcaccccggttactactagcactgaagcaacaagttcaccaaccactgcggaaggtaccagtatcccaacatctacactgtctgaaggaatgacccctctgacttcgactcctgtttctcacacactggttgccaattccgaggcgtcaaccctgagcacaaccccggttgactctaactcacccgttgtgaccagcaccgcagtgagttctagcccaactcctgccgaaggcacatcaatcgcaactagtactccttctgaagggagcaccgcacttaccagtatccctgttagcacgaccacagtcgccagttccgagacgaacaccttgtccactactcctgctgttacaagtacccccgtgaccacatatgcccaagtgtccagcagtcccactacagctgatggatcaagcatgccaacatcaaccccaagggagggacgccccccccttacatctatccctgtcagcaccactaccgtggcgtcatcggaaatcaacactctgtccaccaccctagccgatacgagaacgccagtcaccacctatagtcaggcaagttcctcaccaacgactgccgacggaacctccatgccgacacctgcttattcagaggggtcaacccctctcacaagcatgccgctaagcactaccctcgtggttagtagtgaggcatctaccctgtcaactactccagtcgacactagcaccccagccactaccagcacagaaggaagtagcagccctacgaccgcaggcggaacctccatccagaccagcacacccagcgaacggacgactcctctggccgggatgccggtaagtactactctggttgtgtcaagcgagggtaacactttgagcaccacacccgtagactctaagacccaggttaccaattccaccgaggcatcatcctcagccaccgccgaaggctcgtctatgactatctcagcacctagcgagggctccccgctgctgacatctattcctcttagcacaacccctgtcgctagcccagaagcatctaccctgtccacaaccccggtagattctaactctcccgttattacaagtacagaagtgagctcctctcccattcctacagagggaacttctatgcagacctccacttactctgatcggcggacccctctgaccagcatgccagtttcaacaactgtggtggctagcagcgctatcagtacactgagtacaacacctgttgacaccagtaccccagtgactaacagcacagaggctagatcctctccaactacatccgaaggcaccagtatgcccacatcaactccgagcgaggggtcaacaccatttaccagtatgcctgtgtcaacaatgcccgtggtgacatctgaagccagcaccctctccgccacacccgttgatacctctaccccggtaacaacctccactgaggcaacctccagtccaacgacagctgaaggaaccagcatcccaacaagcacactatctgagggaacaacccctctgacaagtattcccgtttctcacaccttagtggcgaacagcgaggtgtccacattgtcgacaacacctgttgattctaacaccccttttacgacttcaactgaagcgagctctccgccgccaacggctgagggcacaagcatgcccacgtcaacctccagcgaaggcaataccccactgactcgtatgcctgtctccacaacgatggtcgctagctttgagacatccacattatctacaacccccgccgatacatcgacccccgttactacctattcacaggcagggtcttctcccaccacagcagatgatacttctatgccaacctccacgtatagcgaggggagcacccccctcacatccgtgccagtgtccaccatgcctgtggtgtcctccgaggccagcacccacagcactaccccggtggatacatctacccccgtcacgacttccacagaggccagctcttcgccaaccactgccgaaggcacttccatcccgacgagccccccatcagaaggcacaactcccctggcctccatgccagtgtctacaaccccagtggtctcatccgaagcaggcactcttagcacaacaccagtggatacatccacgccaatgactacttctacagaggcaagttcctcaccaaccaccgcggaggacattgtcgtgcctattagtacagcgtccgagggctctaccctgcttaccagtatcccggtttcaacaacacctgtggccagccctgaagcttccaccctttccacaacaccagttgattcaaactcacctgtcgtcacttccactgagatcagtagctccgctacctcagccgaaggtaccagcatgccaactagcacttactcagagggcagcacccctctccggtccatgccagtgtcaacaaagcctttggctagttccgaggcctccaccctgagcactactcctgttgacactagcatacccgtgaccaccagcactgagacgtcttcaagccccaccactgcaaaagacacttcaatgcctatctcaacaccctcagaggtctccactagcttaacctcgatacttgtgtccaccatgccagtggcctccagcgaagcctcgacacttagcacaacccctgtagatacaagaactttggtaaccacatccacaggcacgagctcctctcctaccactgcggaagggtctagtatgccgacctcgacccctggtgaaaggagcacccccctgaccaatatcctggtgtcgactacattgttggctaatagcgaggcaagtaccctgagcacgacaccagtcgatacatcaacgcccgtgacaacaagtgccgaggcaagctcaagcccaaccaccgccgaagggacaagtatgcggatttctactccttccgacggaagtacacccctcaccagtatcctggttagtactttgccagtagccagctccgaagcctcaacggtgagcactaccgccgtggatacttccattcctgtgaccacgagtacggaggcctcatcctcccccaccaccgctgaagtcacctcaatgcctacaagtaccccttccgaaacgtcaaccccactgacttctatgccagttaatcacacccccgtggccagcagtgaggccggcaccctaagcacaactcctgtggataccagtactccagtgaccactagcacaaaggcgagttcaagccccaccacagctgagggcatcgtggtacctatttctactgcaagtgaaggcagtaccctgctgacaagcatccctgtgagcaccacccccgttgcctcaagcgaggcatctaccctgagcaccacacctgtcgatactagtattcctgtgacaacttccactgagggaagctccagccccacaaccgccgagggaactagcatgcccatcagcacaccgtcagaggttagtacacctttgacctcaattttggtctctactgttcccgtggcaggatccgaggctagtaccctgtcaacaaccccagtcgacacccgcacccccgttactacaagtgctgaagccagctcttcccctacaactgctgagggcaccagcatgccaatcagcacaccaggcgagcgccgtactccgcttacgtctatgtctgtgtccaccatgcctgttgctagctcggaagcttccacactgagtaggacgccagcagacacgtctaccccggtaaccacaagtacagaggcttcaagcagcccaacgaccgccgagggaacagggatccccatttccactccaagtgagggatcaacaccactcacgtctatccccgtttcaaccactcctgtggctataccggaagctagcaccctttccaccactcccgttgattcaaacagtcccgtcgtaacttctacggaggtctccagttcccctactcccgccgaggggacaagcatgcccatcagtacctacagcgagggcagcacgcccttgacaggagttccagttagcaccaccccagttacaagttctgcaatctccaccctgtctaccacgcccgtggacacgtccacgcccgtgacaacgtccacagaggcgcactcctcccctactacctctgagggcacctctatgccaaccagtacaccaagtgagggcagcacaccgctgacctatatgcctgttagtactatgttggtggtgagcagcgaggattctacgctgagcgccacccccgtggacactagcactcctgttactacctccactgaggcaaccagctccaccaccgcagaagggacaagcatccctacatcaaccccaagtgagggcatgacccccttgactagtgtcccagtgagtaatactcctgtagctagctcggaagcttcgatactaagtactacacctgttgactctaacaccccacttaccacgtcaactgaggccagttccagcccgccaaccgcggagggcacctcgatgcctacttccacccccagcgaaggtagcacacctttgaccagtatgcccgtgagtacaaccacggtggcttcttccgaaacctctacgctgtccacgacacctgcagatacctctacccccgttactacctacagccaggcttcctctagcccacccatcgccgatggcacctcaatgcctacgtcaacgtatagcgagggcagcaccccactaacaaatatgagcttctccacaacccctgtggtttcttcagaggcaagtactctgtccaccactcctgtggacacctcaacccctgtcacaacgagtaccgaggcgtccctgagtcctacaacggccgagggcaccagcataccaacaagcagtccttccgaagggacaaccccgctggccagtatgcctgtctctaccaccccagtggtgtcttctgaagttaacacactgtccactacccctgtggactctaataccctggttactacctccaccgaggcatcctcaagtccaaccatcgcggaggggacctccctgcctacatccaccacttccgagggcagcacgcctctcagcattatgcccctttcaacaacacccgtggccagctccgaggcgtcaacactaagcactacacccgtggacacaagcacaccagttaccacctcatcccccaccaattcaagtcccaccaccgccgaagttacatccatgccaacttcgacggcaggtgagggaagcaccccactcaccaatatgcctgtgtccaccacaccggtggcctcatcggaggccagtacacttagtacaacccccgtggatagcaacactttcgtaacttctagcagccaagcttcttcatcccctgcaacactgcaggtgaccactatgagaatgtcaaccccatctgagggctccagctctctcactacgatgttgcttagcagtacttacgtgacttccagtgaagcctccacaccttctaccccctcagtggatagaagtacacccgtgaccacatcgacacaatcaaactccacaccaactccacctgaggtcattaccctgcccatgtcgaccccatcagaggtgtcaacgccactgacaatcatgccagttagtaccacgtcagtgacaatatctgaagctggtaccgcttccactctgccagtcgatacatctacacctgtcatcacatcaacacaagtatcttcgagccctgttactcccgaaggcactactatgcccatctggaccccctcagaaggtagtactcctctgacaaccatgcccgtgtccacgactcgagtgaccagctcggaggggagtactctcagtaccccttccgtggtaaccagtacaccagtcactacgtctacagaagctatctccagcagcgcaacgctcgactccactaccatgagcgttagtatgccaatggaaatttctaccctaggaacaacaatcctcgtctccactacccccgtgaccagattccccgaatcttcgacaccgagtatcccctcggtatatacttccatgtctatgactacagcctcagagggcagtagttcacctactacactggagggtaccactaccatgccaatgtcgaccacatccgaaagatccacacttctcactactgtactgatttcccccatatctgtgatgagcccgtctgaggccagtacattgtccacgccacctggggatactagtacccccctcctgacttccacgaaggccgggtcattctcaatccctgctgaggtaaccactattcgaatatctattacgtctgaaaggtccacccctctcaccactctgctggtgtcgactacactcccgacttcttttcctggagcttcaatagcctcaaccccccccttggatacctctaccactttcaccccatccaccgacaccgcctcgacccccaccataccggtggcaaccactatctcagtatcagttattaccgaagggtccacccccggaaccaccatatttatcccatctacacctgtcacttcatctactgcagatgtatttcctgccacgacaggtgctgtgagcacccctgttattacctcaaccgagttgaacacccctagtactagttcatcatctactacgaccagctttagcacgactaaggagttcacgacgccggcaatgaccaccgccgcccctttaacatacgttaccatgtcaaccgcgccctcaacccctagaaccacctctaggggatgtactacaagcgcttcaacactttcagcaacctctaccccacacacgagtacatccgtaactacacgcccagtcacccccagctccgaaagttccagaccgtctacaataacgagtcatactattccgcccacattccctccagcacactcaagcaccccaccaacaacttctgcaagctcgaccactgtgaaccctgaagcagtgactactatgacaactcgaaccaagccgtctacgcgaacgacaagtttcccgacagtgactacgaccgctgtccccacaaacacaactatcaagagcaaccccactagtacgcctaccgtccccagaactaccacatgtttcggagatggatgtcagaacacggccagtcgctgtaaaaacgggggcacgtgggatggtctaaagtgccagtgtcctaatctgtactatggggaactgtgtgaggaagtcgtttcttcaatcgacataggacctccagagacaattagcgcccagatggagctgaccgtgaccgtaacctcagtgaagttcacagaggaactgaaaaatcactcatctcaggaatttcaggagttcaaacaaacttttacagaacaaatgaacatagtgtattcgggcattcctgaatatgtgggcgttaacattactaaactgcgactgggaagtgtggtcgtggagcacgacgtgttgctgaggactaagtacacgcccgagtacaagaccgtgcttgacaacgctaccgaagtcgttaaggagaagattactaaagtcactacacagcagattatgataaacgacatttgttctgatatgatgtgtttcaacactactggcactcaggtccaaaatatcacagtgacacagtacgaccccgaggaagactgccgaaagatggccaaagaatacggcgattacttcgtcgttgaataccgtgaccagaaaccctactgtattagcccgtgtgaaccagggttctccgttagtaagaactgcaatctgggcaagtgccagatgagcctgtccggcccgcaatgtctctgtgttactactgagacccattggtacagtggtgaaacgtgtaaccaaggtacacagaagagcctcgtgtatggtctggttggcgctggcgtcgtcttaatgttaattatcttggtggcactgttgatgttagtctttcgctccaaaagggaagtgaaacggcaaaagtataggctgtcgcagctgtacaagtggcaggaggaagatagtggaccagcaccaggaaccttccaaaacatcgggtttgacatctgccaggatgatgactcaatccacctggagtctatttactcaaatttccagccgtccctacggcatatcgatcccgaaacaaagatcaggatacagcgaccccaggtgatgacaactagtttctag

SEQ ID NO: 195718 - DNA, 843 bp, Artificial Sequence
  Description of Artificial Sequence: Synthetic coding sequence
atgaccaccgccctgggcagccagctgagcagcagccagaccgtgatccccggaagcagcggaactatctcgcacacaacagttgccccagggtcaagcgtcaccggaaccaccaccggagcaagcgacgatcaggtgacaggctccaagactgggaccactggagtcgccctctcaactaccgttgctcccggcagtagctccactgaagccacaaccagcaccggggtacatcgcacgactgtagtggggcaaaaaacgggagccactacaaggggcagcgcaaaacaaggcactaggtccaccatagaggctaccacatcttttcgcgggacgggcactaccggcagtggtatgaacactggcaccactggtgtcgtgtcgggtaacacaatttccccaagctctttcaacacggaagctacatccgggacatccgaacgccccaatccgggctcagagatcggaacaacaggcatcgtctctgggacaacagtggctccaggctcaagcaacacagaggccaccacatcactgggtaacggcggaacaactgaggcgggtagtaagatagtaactactggaattacgacggggactaccatcgtgcccggcagcttcaatacgaaagctaccacttccaccgacgtcggggtggcaacgggtgtcgggatggcaacaggcatcactaatatcatctcaggcagatcccagccgactggatccaagacaggatacactgtgactggatcgggaacaacggcgcttccaggtggctttcgaaccgacagtcccagctttccacttttcttgatttgcagttatcgggggcataatttttag

SEQ ID NO: 195719 - DNA, 837 bp, Artificial Sequence
  Description of Artificial Sequence: Synthetic coding sequence
cccaccggcacccagacccccacccccacccccatcagcaccaccacaaccgttactcctacccccacccccacaggcacacaaacccctaccaccacacccattacgactacaactaccgtgacaccaacaccaactcccacgggtacccagactccaaccactgtgctaataacaacaacaaccacgatgactccgaccccgacgcccacttcaactaagagcactacggtgactcctattactactaccacaaccgtgaccgccacacctactccgactggaactcaaactcctacgatgattccaatctccactacaactacagtgactcctacgcccacacccaccacaggatcgacggggccacctacccatacttctacagcccctatcgcagagctgacgacgtcaaacccacctccagagtcaagtactccgcagacctctcggtcaacaagtagtccactcaccgagtccaccaccttgctttccacgttacccccagccatcgaaatgacatcaaccgccccaccctcgacgcccacggcccccactaccacatcaggaggccacacattgagcccgccgcctagcaccacaacaagcccccccggaaccccaacgcgtggaacaactactggatccagtagcgccccgaccccttcaacagtgcagaccaccaccacgagcgcatggacacccactccgaccccattgagcaccccctccatcattagaactaccggactcagaccctatccctcatcagttctgatctgctgtgtgctgaacgatacgtattacgcacctggagaggaagtatataatggttag

SEQ ID NO: 195720 - DNA, 5343 bp, Artificial Sequence
  Description of Artificial Sequence: Synthetic coding sequence
atgggcctgcccctggcccggctggccgccgtgtgcctggccctgtccctcgccggaggatctgagctgcaaaccgagggcagaacacgcaaccacggacacaatgtttgttccacttgggggaattttcattacaaaactttcgacggagacgtcttccgattcccaggtctgtgtgactacaatttcgcgagcgactgccgagggtcctacaaagagttcgcagtacatctgaaacgcggtccaggccaggcagaggctccagcgggagttgagtccatcctgctaacaatcaaggacgatactatttacctgacccggcacctggctgttctgaatggagcagtggtgagcacacctcactactccccaggcttgttgatcgagaaatccgacgcttacactaaagtgtactctagggccggcttaacactgatgtggaacagagaagatgcgctgatgttggaattggatacaaagttccgcaatcacacatgtggattgtgcggggactataatggtttgcagtcctatagcgagtttctgagcgatggagtactcttttcccccctggagtttggaaacatgcaaaaaattaatcagcccgatgtggtgtgcgaggatcctgaggaagaggtcgctcccgctagctgtagcgagcacagagcggagtgtgagcgcctgctcaccgcggaggctttcgcagactgccaagacctggtaccgcttgagccttatctgagagcttgccagcaggacaggtgccgctgcccgggcggggatacttgtgtttgctcaaccgttgctgaattctcccggcaatgttcacacgccgggggccgtcctggcaattggagaaccgcaacattgtgcccaaaaacgtgcccaggtaacctggtgtatctggagtccggcagcccgtgcatggacacatgttcccatctggaggtttcatctctttgcgaagagcaccggatggatgggtgcttttgtccggaaggaacagtatacgatgatatcggagactctgggtgcgtgccagtctcccaatgtcactgcagactacacgggcatctttacacacccgggcaggagatcaccaacgactgtgagcaatgtgtgtgcaatgccggaagatgggtgtgcaaggacctgccttgccctggcacctgcgctctggaaggcggatctcatataaccacattcgacggaaagacttatactttccatggcgattgctactatgtactcgctaaaggagatcacaacgactcatacgcccttctaggagagctggccccatgtgggagtacagacaagcagacctgcctgaagacggttgtgttgctggccgataaaaaaaaaaacgtggtggtctttaagagtgatggctcggtgttgcttaacgaactacaagtgaatcttccacatgtgacagcctccttcagcgtcttccgaccatccagctatcacatcatggtatctatggccatcggggtcagattgcaggtccagttggcccctgtcatgcagctctttgtcacgcttgatcaagccagtcagggtcaagtgcagggactttgcggcaattttaacgggctcgagggggatgactttaaaacagccagcggcctggtagaggccacaggggcagggtttgcgaatacctggaaagcccaatcctcttgccatgacaaactggattggctggatgacccatgcagtcttaatatcgagagtgcaaattatgccgagcactggtgtagtttgttgaagaagacggaaacgccctttggacgctgccattctgcggttgaccctgcagaatattacaaacgctgtaaatacgatacctgcaactgccaaaataatgaagactgtctctgcgccgccctgagcagctatgctagggcttgcacagctaagggcgttatgctgtggggttggcgggagcacgtctgtaacaaagatgtgggatcatgtcccaattcccaggtctttctgtacaaccttaccacctgtcagcagacgtgccgctccttgagcgaagctgattcacactgtctggagggatttgcacccgtggacgggtgcgggtgtcccgaccataccttcctcgatgagaaaggacgctgtgtgcccttggctaagtgtagctgttaccacaggggcctttacttagaggccggagacgtcgtggtgaggcaggaggaaagatgcgtgtgccgggatggcaggcttcattgtcgacaaatccggctgatcgggcaatcctgtacagccccaaagatccacatggattgttccaacctgacagccctggctacgagtaagcctcgcgcactgagctgccaaaccctggctgcaggctattaccacacagaatgcgtgagcggctgcgtctgcccggacgggctgatggatgacggaagggggggttgtgtggttgaaaaggagtgtccgtgtgtgcacaacaacgatctatacagttctggagctaagattaaggtcgattgtaacacgtgcacctgtaaacggggccgctgggtgtgcacccaggctgtctgtcacggtacttgctctatctacggttcgggacactatattaccttcgacggtaagtattacgactttgacggccactgcagctacgtggcggtccaagactactgcggacagaatagcagtctcggtagcttttccatcatcacagaaaatgtgccatgtggaaccacaggtgttacctgtagcaaagcgattaagatattcatgggtaggacagagcttaagctcgaagataaacatcgagtcgtcatccagagagacgagggccatcacgtggcctacaccacacgcgaggtcggacagtacttggtggtggagtcctcgacagggattattgttatttgggataagcgcaccacagtgtttattaaactggccccgtcttacaaaggtacagtctgcggactgtgcggtaactttgaccataggagtaataacgactttacgaccagagaccacatggtggtgtcctctgagcttgactttggaaatagctggaaggaagccccaacatgtcctgatgttagcaccaacccggagccttgcagtttgaatccccatagacggagctgggctgaaaagcagtgctcgatcctcaagtccagcgtattctcgatttgccatagtaaggttgaccctaagccgttctatgaggcctgtgtgcacgacagttgcagctgcgacacaggtggcgactgcgagtgcttttgtagcgccgtggcatcctatgcccaagaatgtactaaggagggagcctgtgttttttggcggactcctgatctatgtccaattttttgcgactactacaatccgccacatgaatgcgagtggcattatgagccatgtgggaaccgctctttcgagacctgtcggactataaacggtattcactcaaatatctctgtcagctatctggagggctgttatccgagatgccctaaagaccgccctatatacgaagaggacctgaaaaagtgtgtaaccgctgataagtgcggttgttatgtggaagatactcactaccccccaggcgcttctgtgcctaccgaggagacctgcaagtcgtggtgcacctgcactcaaactcatactgcttaccacgtgcacacacatggcaaaatcttaaatcagacccaagatggcgctttttgttattgggagatctgtggacccaacggaactgtagagaagcacttcaatatctgctctatcacaaccaggccaagcacgctcaccaccttcactactataaccctgcctaccacaccaaccacattcacaaccactacgacaacgactactcccacgtcctccaccgtgctgtcaacaactcctaagctgtgctgtctctggtccgattggatcaatgaagatcatcccagcagcggtagtgacgacggcgaccgagaaacttttgacggggtgtgcggggctcctgaggatatagagtgccgctctgtaaaggatccgcatctgagcctcgaacagcttggtcagaaagtccagtgtgacgtgagcgtgggtttcatctgcaagaatgaggaccaatttggcaacgggccattcggcctgtgctatgattacaagatccgcgttaactgctgctggcccatggataagtgcataacaacccccagcccgcctacgactactccatcccctccacccacctcaactactacactgccaccaacaactacaccttctccacccacaacaacgactacaacccctccacccacgaccacaccctctccacctatcacaaccaccaccactccaccccccaccaccacgccttccccaccaatctccacaacaacaacacctccccccacaaccaccccttctccccccacaaccaccccgtccccccctactaccacgccttcacctcctacaaccactactaccacccctccgcctaccactacgcccagtccccccaccaccacgcctatcacccctccggcctctaccaccaccctaccccccaccacaactcctagcccccctacaaccactactaccacacctccaccgaccactacgcccataactactacaacaacggtgactcctacaccaaccccgacgggaacccaaacccctacgacaacaccaattaccaccaccactacagtcactcctacgccgacacctaccggtacacagacccctacctccacgccaatcaccacaactacgactacccccacacctaccgctatcacaactaccactacggtcacccccacacctactcccacaggaacccaaacccctactactaccccaattactacaactacaactgtcacccctactccaactcccacaggcacccaatcgccaacaccaactgctatcaccacaaccaccaccgtcacgccaacaccaacaccgacaggtacccagacccccacctctacaccgattacaactacaactacagtaacgcccacccccaccccgactggcacccagactccaactccaacacctatttcgacaacaaccactgtgacaccaacccctacaccaacaggcactcagacccctacgacaacgcctatcactaccactactacagtaacgcccactccgactcccacaggcacacagacccctaccaccacccccacccccacttccactaagagcaccaccgtcaccccaatcactacaacgacaactgtgaccgcaacaccaacccctactgggacgcaaaccccaacaatgattccaatctctacaacgacgaccgtcacaccatag

SEQ ID NO: 195721 - DNA, 1230 bp, Artificial Sequence
  Description of Artificial Sequence: Synthetic coding sequence
gacatcgagtgccggagcgtgaaggacccccacctgagcctggagcaactgggacagaaggtccaatgcgacgttagcgtggggtttatatgcaagaacgaagatcagtttggaaacggaccatttgggctatgctatgactataagatccgggtgaattgttgttgtacccctaccaggggcacgaccacaggctcttcctccgcaccaacaccctcgacggtccagaccactacaacatctgcctggactccaactccaacacccctgtctacgccctccataatccgcactaccggtcttaggccttacccgagtagtgtccttatctgttgtgtattgaatgatacatattacgcaccaggggaggaagtatataacgggacttacggggacacttgctattttgtcaactgctccttgagttgcacgctcgagttctacaattggagttgcccatctacaccctcaccaactccaaccccatctaaaagcacccccactccttccaaaccctctagtactccatctaagcccactcctggcactaaaccgccagaatgccccgacttcgatccacccaggcaagagaacgagacgtggtggctctgtgactgcttcatggcgacctgcaagtataataatactgtggagatcgttaaagtggagtgcgagccacccccgatgcctacatgcagtaacgggctgcagcccgttagggtggaagacccagacgggtgctgctggcattgggaatgcgactgttactgtaccggatggggggacccccactacgttacgtttgatgggctgtattactcctatcaggggaactgcacctacgtcctcgtggaagagatatccccttcagtggataatttcggtgtttacatcgacaactatcattgcgaccccaacgacaaagtgtcctgccctcgcacgctcatagtcagacacgagacacaggaggtgctgatcaagaccgtgcacatgatgccgatgcaagtacaagttcaggtcaacaggcaggccgttgccctgccttataagaaatatggactcgaagtgtaccaatccggcatcaactacgtggtagacatcccggagctgggagtgctagtgagctacaatggtttaagtttcagtgtgcggctcccctaccaccggttcggcaataatacaaagggccaatgtggcacttgcaccaacacaacaagtgacgactgctag

SEQ ID NO: 195722 - DNA, 8454 bp, Artificial Sequence
  Description of Artificial Sequence: Synthetic coding sequence
atgggcctgcccctggcccggctggccgccgtgtgcctggccctgtccctggcaggaggaagtgaactccagacagaaggccggacgcgcaaccatggccacaacgtgtgctccacctgggggaacttccattataaaacctttgatggcgatgtgtttagatttcctggtctgtgcgactataattttgcatccgactgtcggggctcatacaaggagtttgccgtgcacctcaagcgtggcccgggacaagcagaagcccccgccggcgtggagtccatcctgctgacgattaaagatgataccatctaccttactcggcacctagcagttctgaacggcgccgtggtctcgacccctcattactcacccggcttacttattgagaaaagtgatgcatacacaaaggtctactctcgggcaggacttacacttatgtggaatcgagaggatgctctcatgctcgaacttgacactaaattcagaaatcatacctgtggactgtgcggtgactacaatggcctgcagtcatattctgaatttctgtccgatggagtattgttctctcccctcgagttcggaaatatgcagaagattaaccagcctgacgtagtgtgcgaggatcctgaggaagaggtagcccccgcttcttgcagcgagcacagagccgaatgtgagagattgcttactgccgaggcatttgctgattgtcaggacttggtcccactggagccatacctgagggcctgtcaacaggaccggtgtaggtgcccaggcggcgacacctgtgtctgttccaccgtagctgagttcagtcggcagtgtagtcacgctggcggccgccccggaaactggagaactgcaactctgtgccccaaaacctgtcccggaaacctggtgtatctggagagtggtagtccatgcatggacacctgttcacatctcgaggtaagtagcctctgcgaagaacacaggatggacggttgtttctgccccgaaggcactgtgtatgacgatatcggcgatagcggttgtgtcccagtcagccagtgccattgcaggctgcatggacatctctatactcctggccaggaaatcactaatgattgcgaacagtgtgtttgcaatgccggcagatgggtctgtaaggatttgccatgccccggaacctgtgcgctcgaagggggtagtcatatcactactttcgatgggaagacgtacactttccacggagactgctattatgtgctagcgaagggggaccataacgactcttatgctttactaggcgagctggcgccgtgtgggtccaccgacaaacagacttgcttgaagacggtcgtactcttggccgacaagaagaagaatgtcgttgtttttaaaagcgacggttccgtcttgctcaacgagctgcaggtgaatttgccccacgtcactgcctcttttagtgtgtttagaccaagttcctatcacatcatggtctccatggcaattggtgtgagactacaggtgcaactggctccagtgatgcaattgttcgtgacgcttgaccaggcaagccagggacaagtccagggtctgtgtggaaattttaacggacttgagggagacgattttaagactgccagcggactggtggaagctacaggggcgggctttgccaatacatggaaggcccagtcctcatgccacgataaactggattggttggacgacccctgttctcttaatatcgaatcggctaactacgcagagcattggtgctctctgctgaagaagactgagacaccgttcggaaggtgccactctgccgtggatcctgcggaatattacaagcgctgcaagtatgacacatgcaactgccagaacaacgaggattgcctttgtgcagccttaagctcttatgcccgggcatgtactgctaaaggagtaatgctctgggggtggcgcgaacacgtgtgtaacaaggacgtcggatcatgccccaacagccaagtgtttttgtacaacttaactacctgtcagcagacatgccgcagtctaagcgaagccgacagccactgtctggaaggatttgcacccgtcgatggatgtggctgccccgaccatacattcctggacgaaaaaggccgatgcgtccccctggccaagtgcagctgctaccacagaggtctgtacctcgaagctggggacgtcgtagttcggcaggaagaaaggtgcgtgtgtagggacggtagattacactgtcggcaaattagactgataggccagtcttgcacggctcccaagatccacatggactgttctaatctaacagccctcgctacaagcaaacctcgggccctgtcatgccagaccctcgcagcaggctactaccacacggaatgcgtctctggttgtgtctgtccggatggtctaatggacgacgggcgcggggggtgcgtggtggaaaaagagtgcccatgtgttcataataacgatctatactcctctggggctaagatcaaagtagattgtaacacatgtacatgcaaaagaggtcgttgggtatgtacccaggccgtgtgtcacggcacatgctcaatctacgggagtggacactacattacttttgatggaaagtattatgactttgacgggcactgcagttacgtggctgtgcaggactattgcgggcagaactctagtctcgggtcatttagcatcatcacagaaaacgtcccctgcggaacaactggggtaacttgctcaaaagccataaagatcttcatgggccgcactgaactcaagctggaagacaagcaccgagtggttatccagagagacgagggacaccacgtggcctacaccacaagagaagtgggccagtatctcgtggtcgagagctcgacgggtatcattgtcatttgggataaacgcacaaccgtgtttattaagctggctccgtcctataagggcacagtgtgcggcctgtgtggcaatttcgaccataggagcaacaatgattttacgacccgagaccacatggtcgtatcttctgagctggacttcggaaacagctggaaggaagccccaacatgccctgatgtgagcacaaatcctgaaccttgtagcctcaacccgcaccgtagatcctgggcagaaaaacaatgctctatcctcaaaagcagcgttttttctatctgtcacagcaaagtcgatccaaagccattttacgaagcttgtgtgcatgacagctgctcttgcgacaccggtggtgattgcgagtgtttttgtagcgccgtcgcatcttatgctcaggaatgcaccaaggagggagcttgtgtcttctggcgaacccctgatctgtgtcctattttttgtgactattataacccaccccatgaatgcgagtggcactatgaaccgtgtggaaatcggagtttcgaaacctgcagaaccattaacgggattcacagcaacataagcgtctcgtatctagaaggctgctatcccaggtgtccaaaggatcgtccgatctacgaagaagaccttaagaaatgtgtgactgctgacaaatgcggctgctacgtggaggacactcactacccccctggagctagtgtccctactgaggaaacatgcaagtcctgcgtgtgtaccaacagttcccaggtggtttgcagacctgaggaggggaagatattgaatcagacacaggacggggccttctgctactgggagatctgcggcccgaacggcaccgttgagaagcactttaatatttgtagcataacgactaggccttcaacgctgactactttcactaccataacgttacctaccacccctacaacattcacaactactaccactacgaccactcccaccagtagtactgtactcagcaccacaccaaaattgtgttgcttgtggtccgattggatcaatgaagaccacccttccagcggcagcgacgatggagatcgtgagactttcgatggagtatgcggggcacccgaggacattgagtgtcggtctgtgaaggacccacacctgtccctggaacagctcggccagaaggtccagtgtgacgtgtcagtgggcttcatatgtaagaatgaagaccagtttgggaacggaccattcggattgtgctatgattataaaatacgcgttaattgttgctggccaatggacaagtgtatcaccaccccctctcctcccactaccactccgagtcccccacccacttcaactacaaccctgcccccgaccaccaccccctctccacccaccacgactaccaccactccacctccgacgacaactccgtcaccccctatcactactactacgactcccccacctactactaccccatccccacccatttccacaacaaccactccgccacccaccacaactccttccccccctaccacaacccccagccctcccaccaccaccccatcccctccaaccacaacaacgacaacaccccctccgaccacaacccctagccccccaaccaccacccctattactccccccgcctctacgacaacgcttccccccacaaccacacctagtccaccaactacaacaaccactacgccgcccccaacgaccacaccaattaccacaaccactaccgttactcccacccctacgcccactggcactcagacccccactactacacctatcaccaccacaacaaccgtgacacctacccctaccccaactgggactcaaacacccacctctacaccaatcaccaccaccaccacagtgactcccactccaaccccaaccggcacacagacgcctaccaccacgcctattaccactaccactactgtgacccccacaccgactcctactggtacacaaacaccaactcccaccgcaatcacaacaaccacaaccgttacgcccacacccacgcctaccggaacacaaacgcccacaacaactcccattaccacaaccacaaccgtgactcccactccgacaccaacaggaacacagtctccaactcccaccgcgattactacgacgaccaccgtaactccaacccctaccccaaccggaacccagactcctacctcaactcccatcaccacaaccactacggtcacaccaactcccacccccaccggcacccaaacacctacaccaacacccatttccacaacaacaactgtcacaccaacgcctactcccactggcactcaaactccgaccaccaccccaataactactactaccactgtaaccccaactcccactcctacaggtactcaaaccccaacgacagtcctcatcaccactacaaccactatgactcctacacccactcccacctctaccaaatcaacaaccgtgacccctattacaacgaccactaccgtgaccgccaccccaactccaacggggactcagactcccaccatgattccaattagcacaacgactactgtgaccccaactcccacccctaccacaggttctaccggtccacccacgcatacttcaactgcacctattgccgaacttactacttctaaccccccaccagaatcctcaactccacaaacctctaggtcaactagtagtcctttaacagagtccactacactcttatccaccctgcctcccgccattgagatgactagcacggcccctcccagcactccaacagcccccactaccacctcagggggacacacactgagccccccaccatctaccaccaccagcccacctggaacacccacacgggggaccacaaccggatcatcaagcgctccaactccatccactgtgcagaccactaccacatccgcctggacccctacccctacacctcttagtacaccatctattattcgcacaactgggttacgcccctacccttcaagcgtgctcatttgttgcgtgctgaacgatacatattacgcgcctggggaggaggtgtataatggaacctacggagatacctgctacttcgtgaactgcagcctttcctgtaccctggagttctataattggtcatgcccaagcacccctagtcctaccccaactccctccaagtctacaccgactccttcgaaaccaagttccacaccttccaagcccaccccaggcaccaagccgcccgagtgtccggatttcgacccacccaggcaggaaaatgaaacatggtggctgtgtgactgcttcatggctacatgcaagtacaacaacacagtggaaatagtgaaggtggagtgtgagcctcctcctatgccaacctgttctaatggactgcagcctgtgcgtgttgaggatccagatggatgttgctggcattgggaatgtgattgctactgtactggctggggagatccccactatgtcacattcgatggcttatattattcctaccaggggaattgcacgtacgtcctggtcgaggagatctcccccagcgtagacaactttggcgtgtatattgacaattaccattgtgatccaaatgacaaagttagctgtcctcgaacactgatcgtccgacacgaaacccaggaagtgctcataaagaccgtgcatatgatgccaatgcaagtgcaggtccaggttaataggcaagccgtggccctgccatataagaagtatggtctggaagtgtatcagtccgggatcaattatgtggtggacatccctgagctgggagtgttggtgagttacaacggtctgtctttttctgtgaggttgccttaccaccgatttgggaacaacaccaaggggcagtgtgggacctgtaccaacactacatctgacgactgtatcctaccttcaggggaaatcgtgagtaactgcgaggccgcagccgatcaatggctggtgaatgaccccagcaagccccactgtccacactcaagttctacaacaaagaggcccgccgttactgtgccaggcggcggtaagaccacaccacataaggactgcacaccttccccgctgtgccagctaatcaaagacagcctgttcgctcagtgtcatgcattggtgcccccacagcattactacgacgcctgtgtgttcgacagttgttttatgccaggcagcagtcttgaatgcgcttcattgcaggcctatgccgccctctgtgcacagcaaaatatctgcctggattggcggaatcacacccacggcgcgtgcctggtggagtgcccaagccaccgtgagtaccaggcttgcggccccgccgaagaaccaacctgtaagtcatcatcatcgcagcagaacaacaccgtgttagtggaagggtgcttctgcccagagggcacaatgaattacgcaccaggtttcgatgtgtgtgtgaaaacttgtggctgtgtagggccggataatgtgcctcgggaattcggagagcactttgagtttgactgcaagaattgtgtatgcctggagggtggctccgggatcatctgtcagcccaaacggtgtagccagaaacccgtcacccattgtgttgaggacggaacatacctggccacggaagtgaacccagctgacacctgttgcaatatcactgtgtgcaagtgtaataccagtctctgtaaggaaaagccgagtgtgtgccccctggggttcgaagtgaagagcaagatggtccctgggagatgttgccctttttattggtgcgaatcaaagggcgtgtgtgtgcacgggaacgctgaatatcagcctgggtcgccagtctacagcagcaagtgtcaggactgcgtttgcactgataaggtggataataatactctgctgaacgtcatcgcgtgtactcatgtgccctgcaacaccagctgctcacccggatttgagctgatggaggctcccggagagtgttgcaaaaagtgtgagcagactcactgtattattaagagacccgataaccaacacgttatactgaagcctggggactttaagagtgatccaaagaacaattgtaccttttttagttgtgtcaaaattcacaatcagcttatctcatccgtatctaatattacgtgccctaatttcgacgcctctatctgcattcccggctcaatcacctttatgccgaatggatgctgcaagacgtgtaccccgagaaatgaaacaagagtaccttgcagcaccgtgccagtgacaacagaagtaagttacgctggatgtaccaaaacagtgttgatgaaccactgctccgggtcttgtggaacttttgttatgtattcagccaaagcccaggcccttgaccacagctgttcttgttgtaaggaagagaagacttcacagcgagaagtcgtgctatcatgtcctaacgggggctcactgacccacacctatacccacatagagagttgccagtgtcaagacaccgtttgtgggctgccaacaggcacttctcgtagggcgcgccgatctccgagacaccttggtagcggctag

SEQ ID NO: 195723 - DNA, 2631 bp, Artificial Sequence
  Description of Artificial Sequence: Synthetic coding sequence
atctacagcaccgtgagcaccagcaccaccgccatcaccagccactttaccacctccgaaactgccgtgactccaacacctgtgacccctagttcactgagcaccgacatccctacaactagcttgcgcactttgactcccagtagcgtgggcacctcgacgtcactgactactactactgacttcccttcaatacctactgacatctccacacttccaacacggacccatatcatatctagctcaccctccatccagagcacggagacaagcagccttgttggcacaacgtcccctacaatgtcaacagtacgtatgactctccggataacagaaaatacgccaatcagttccttctcaacatcgatcgtggttattcccgagaccccaacccagacaccacccgtccttacgagtgctactggaacccaaaccagcccagcccctacaaccgtcacttttggatctacagactcttctactagcaccttgcataccctgacaccaagcaccgccttgagcaccattgtgtctacatcacaggtgcctatcccttccacacactctagtacccttcagacaacaccgtccacgcccagcctccagacaagcttgacgagcacctcagagttcaccacggagtcttttactcgcggaagcacatccactaatgcaatactcaccagtttttcaactatcatctggtcctccactccaaccatcattatgtcttctagtccaagcagtgcgtccatcacccccgtgttttctaccacgatacacagcgttccatcgtcaccgtacatattcagcaccgagaacgttggatctgctagcataactgggtttccatctctctcatcatcagccaccacttccacctcttctacgtcgagcagtctgacaacagcactcaccgaaattacccccttttcctatatttcccttccaagcaccactccgtgtccagggaccattaccatcaccatagtgccagcgtctcctaccgacccttgtgtcgaaatggatccctcaacagaagctacatcccctcccacaacccccttaacagtttttccttttaccacggagatggtgacgtgtcctacatcaattagtattcagacaacgttgaccacttatatggatacttcctctatgatgccggaaagtgagtcttcgatttctcctaatgcctcatccagtacggggactggcaccgtccccaccaatacagtgtttacgagtacgcggctgcccacttcagaaacgtggctgtctaactcttctgttatacccctgcctctcccaggagttagtaccatccctctaactatgaaaccaagttcgagtctgccaacaatactgagaaccagcagcaagagtacacacccgtctccccctaccactaggacttccgagacacccgttgctaccacccagactcctactacgctcacaagccgtagaactacacggatcacatctcagatgacgacccagagcaccctgacaaccacagccggaacatgtgataacgggggaacctgggagcaaggccagtgcgcctgcctgcctggattcagtggcgaccggtgccagttacagacaaggtgccagaacggtggccagtgggacggattgaagtgtcaatgcccctcaacgttttacggttccagttgcgagtttgccgtcgaacaagtagatctggacgtagtggaaaccgaagtcggcatggaagtttccgtggaccaacagtttagccctgacttaaacgataatacaagccaggcctatagagacttcaataagacgttctggaaccagatgcagaagattttcgcagacatgcaaggcttcacatttaagggagtagaaattctgtccttacggaacggtagcatagtggtggattacctggtgctgctcgagatgcccttcagtccacaactggagagtgaatatgaacaggtgaagacaactctgaaggagggattgcagaacgcctctcaggatgctaactcttgccaagatagccagaccctttgctttaaacccgatagtatcaaggtgaacaataatagcaaaacggagctgacaccagaggccatatgcagaagagcagcccctaccggttacgaggaattttactttcccctggttgaggctacccggctgcggtgcgtgacgaaatgcacctctggggtggacaatgccatagactgccaccagggccagtgtgtgctcgagacaagcggtccagcctgcaggtgctattcaacagacacccactggttttctggccccaggtgcgaggtcgctgtccactggagggccttggtcggggggctcacagcaggcgccgcacttttggtgctgctgctgctggcattaggtgtgagggctgtaagaagtggatggtggggcggccagcgccgaggccgaagctgggatcaagacagaaaatggtttgagacatgggatgaggaagtggtcgggacctttagtaattgggggttcgaggatgacggaaccgacaaggatacgaatttccatgtcgcgctagaaaacgtcgacactacgatgaaagttcacataaaacgaccagagatgactagcagtagcgtctag

SEQ ID NO: 195724 - DNA, 927 bp, Artificial Sequence
  Description of Artificial Sequence: Synthetic coding sequence
tgcgacaacggcggcacctgggagcagggccagtgcgcctgcctgcccggattttcaggagacagatgccagttgcagaccagatgccagaacggcggccagtgggatgggctgaaatgccagtgtccatcgaccttttatggatccagctgcgagtttgcagtggaacaggtcgacctggacgtcgtcgaaacagaggtgggcatggaggtttccgttgatcagcagtttagcccggatcttaatgacaatacatcccaggcatatagagattttaacaagacattctggaatcagatgcagaaaattttcgcagatatgcaggggtttacttttaaaggagtggaaattctcagtctgaggaatgggagcatcgtggtggactatctggtgcttctcgagatgccgtttagcccccaactggagtctgagtacgaacaagtgaagaccaccctcaaggaaggactacagaatgcttcccaggatgctaattcctgccaggactctcagacactgtgctttaagccagactctattaaagtgaacaataatagcaagactgagctcacacctgaggctatttgcagacgggcggccccaaccggctacgaggagttttacttcccactcgttgaggccacacgactccgttgtgtcacaaagtgtacctccggcgtggataacgcaatcgattgtcaccagggccagtgcgtccttgaaaccagcggacctgcctgtcggtcttgggatcaagatagaaagtggttcgagacctgggacgaagaagtggtgggcacattctctaattggggtttcgaggatgacggtaccgacaaggacaccaatttccatgtggcattggagaacgttgacacgaccatgaaggtccatatcaagcgtccagaaatgacatcctcctctgtgtag

SEQ ID NO: 195725 - DNA, 3531 bp, Artificial Sequence
  Description of Artificial Sequence: Synthetic coding sequence
atgaagggcgcccggtggcggcgggtgccctgggtgagcctgagctgcctctgcttgtgcttgttaccacatgtggtacccggtatgacaactccttctctgaagactgacgggggcaggaggaccgctacctcgccaccgcctaccacctctcagaccattataagcaccattccgtccaccgccatgcatacaagaagtacagccgctccgatacctattctaccagagcgtggggttagcctgtttccttacggagcaggcgctggggatctggagtttgtgcggagaacagtggatttcacatctcccttgtttaagccagcaacaggctttcctctggggtcttcattgcgtgatagcctgtatttcaccgataacggtcagattattttccctgagagtgactaccagatcttctcctatccaaatcctctcccgaccggcttcacaggacgggatcctgtggcgctggttgcccccttctgggacgacgccgacttctctacaggtaggggaaccaccttttaccaggaatatgagacgttctatggagaacactctctcctagtacagcaggcagagagttggatcagaaaaatgacaaataacggaggttacaaggctcggtgggcgctcaaagtcacttgggtcaatgcccacgcttacccagcacagtggacacttggctccaatacttaccaagctatcctctcgacggacggaagtaggagctatgccttgtttttgtatcagagtggtggcatgcagtgggatgtcgctcaacgatctggcaatcctgttttaatggggttctcctctggcgacggatactttgaaaactcacctctgatgtctcagcccgtatgggagcgctaccgaccggaccgcttcctcaattctaatagcggcctgcaaggcctgcagttttataggttacatcgtgaggagcggccaaattataggcttgagtgtttacagtggctcaagagccaacccaggtggccaagctggggctggaaccaggtgtcatgcccctgcagttggcagcagggtagacgggacctgagatttcagcctgtcagcatcggaaggtggggactggggtccagacagctgtgttctttcaccagctggagagggggagtttgctgctcttacgggccatggggagagttccgcgagggatggcacgtgcagagaccttggcagctcgcgcaggagctggaacctcaatcttggtgttgccggtggaatgacaagccttatctctgtgcactttaccagcagagacggccacatgtcgggtgcgctacgtatagaccacctcagcccgcttggatgttcggcgatcctcacataaccaccctggacggggtttcgtatacattcaatggtcttggcgatttccttctcgttggagcgcaggacggcaatagcagttttctcctgcagggacgaacggctcagactgggagcgcccaggccactaacttcatagcctttgctgcccagtacaggagctcttcactgggccctgttacggtgcagtggttgcttgaacctcacgacgctatcagggtcttgctggataatcaaaccgtgacgtttcagcctgaccatgaggacggtggcgggcaggaaacctttaacgcaaccggggtgctgctcagccgcaatgggtccgaagtgagtgccagctttgacggttgggctacagtcagtgtcatcgccctctcaaacattctccatgcgtcagcttcgctgcccccagagtatcagaacaggactgaaggccttctgggcgtgtggaataacaaccctgaggacgactttcggatgcctaatggaagcacgatccctccgggctctcctgaagaaatgttgttccactttggaatgacctggcagataaatgggactggcttgcttggaaaacggaacgatcagttaccctccaactttacacccgtcttttattcacaactgcaaaagaactccagttgggccgagcacttgatatcaaactgcgatggagatagctcatgcatctatgacaccctcgccctcaggaacgcatccattggactgcatactagggaggtgagcaagaattacgaacaggcaaacgctaccctgaatcagtatcccccaagtatcaacggtgggagggtaatcgaggcctataagggccagacaactcttattcagtacacaagtaacgctgaagacgcgaactttaccctgagggactcatgtaccgacctggagctgttcgagaacggtactctgctttggacccccaagtccctcgagccctttaccctggaaatccttgcccgcagtgctaaaattggtcttgcgagcgctctgcagcccagaaccgttgtttgccattgtaacgctgagtcccaatgcttgtacaatcaaaccagccgggtgggcaattcctctttagaagtggcaggctgcaagtgtgacggtgggacttttggcaggtactgcgagggaagcgaagacgcatgtgaggaaccttgcttccccagcgtgcattgtgtgccaggcaaagggtgtgaggcatgtccccccaatctcactggtgacggacgtcactgtgcagccctggggtcctctttcctctgccagaaccaaagctgtccagtaaattattgttataaccaaggccattgctacatttcccagaccctcggctgccagcctatgtgcacatgcccccctgccttcaccgattcgagatgttttcttgctggtaataacttctcaccgacagtcaacctcgaactgcctctgagggtcattcaactcctgctttctgaggaggagaatgcttcaatggccgaggtaaacgcctcagtggcctatcggttaggcacattggacatgcgcgcctttctgcggaactcccaggtcgagcggatagacagtgcggcgccagcgtcaggctcacccattcagcactggatggttatcagtgagttccaatatagaccgcgcgggcctgtgattgattttttaaacaatcagctactggccgcggtggtggaagccttcctgtaccatgtccctcgccgctcagaagaaccacgcaatgatgtggtgtttcaaccaatttctggcgaagacgtgcgggatgtgacagctctaaacgtaagtaccctgaaggcttatttccgatgtgacggttacaaaggatatgatcttgtgtactcgcctcaaagcggatttacatgcgtttctccctgttcacgcggctattgcgaccacggcggacagtgtcaacacctgccaagtggcccacgatgttcatgtgtgagcttcagcatctataccgcttggggagagcactgcgaacacctgagtatgaaattggatgctttcttcggcatcttcttcggtgccctcggaggcctattgctccttggagtgggaacctttgtggtgctccgtttttggggctgttctggtgcaagattcagctactttctgaactctgctgaagctctgccgtag

SEQ ID NO: 195726 - DNA, 3378 bp, Artificial Sequence
  Description of Artificial Sequence: Synthetic coding sequence
atgaagggcgcccggtggcggcgggtgccctgggtgagcctgagctgtctctgcctctgcctgctgccacacgtggtgcctggagtttccttattcccgtatggagccggtgcaggcgatctggagtttgtaaggcgcacggtagactttactagtccactgttcaagcctgctacgggctttccgctgggttcctctcttagagactctttgtactttaccgacaatgggcaaatcatctttcccgagtctgactaccaaatctttagctacccaaacccactccccaccggctttaccggtcgggatcctgtggctttggtggcccccttctgggatgatgcagacttctctactggtcgggggacaacgttctatcaagagtatgagaccttttatggggagcactcacttttggtgcagcaggctgaatcatggatccgtaagatgactaataacggggggtacaaggcccgatgggctctgaaggtaacgtgggtcaacgcccacgcgtaccctgcccagtggacactggggtccaatacatatcaggcgatcctttccaccgatggaagcaggtcgtatgcgctgtttctgtatcagagtggaggtatgcagtgggacgttgcacagaggtccgggaaccccgtcctgatgggcttttcgagtggcgacggttattttgagaacagtcccttgatgtctcaaccggtgtgggagaggtacagacccgaccgcttcctcaatagtaactccggactccagggactgcagttttacaggcttcaccgggaggagcgcccaaattatagactggagtgcctgcaatggttaaagagccagcctcggtggccatcgtggggatggaaccaggtatcatgcccctgctcttggcaacagggtcggagggacttgcgcttccaacccgtgtccataggcagatgggggcttggcagcagacagttatgcagtttcaccagctggcgcgggggggtttgctgctcctacggaccctggggtgagttcagggaaggatggcatgtccagcggccttggcagctggctcaggagctcgagccacagagttggtgttgccgctggaatgacaaaccatacttgtgtgccctatatcagcagcggaggcctcacgtcggctgtgccacctaccggcctcctcagccagcgtggatgtttggggaccctcacatcaccaccctagatggagtctcttacacatttaacggtctgggtgatttcctgcttgtgggcgcgcaggatgggaattcttccttcctgctgcagggccgtaccgcacagactggatcagcacaggccactaatttcattgcctttgccgcccagtacagatcttcaagtcttggacccgttacagtgcagtggctgctggaacctcatgacgctattcgcgttctgctggataaccagaccgtaacgtttcagccagaccacgaggatggcggtggccaggagactttcaacgcaaccggcgtcctgctttcccgaaatgggtcagaggtctcagctagttttgatggatgggctactgtctccgtgatcgctctgagcaatattctacatgcatccgcttcactcccccctgagtaccagaataggaccgagggccttctgggagtgtggaataataatcctgaagatgatttccgcatgccaaacggcagcacgatcccccctggcagccctgaggagatgctgttccattttgggatgacctggcagataaacggcactggcctgctgggaaaaagaaacgaccagttgccctccaattttaccccagtgttctacagtcagcttcaaaaaaatagtagctgggccgagcacctaatctcaaattgcgatggcgactcttcatgtatttatgatactctagcccttcggaacgcctctatcggactgcatacccgcgaggtgagcaaaaactacgagcaggccaacgctacactgaatcaatatcccccctcaattaatggcggccgggtgatcgaagcctacaaagggcagacgactctcattcagtatacctcgaacgccgaggatgccaactttaccctgcgggattcttgtacagatttagaattattcgagaatggcacacttctctggacccctaagtctctggagccttttactctggaaattttagccaggagcgctaagattgggctagctagtgcactgcaacccaggacagtcgtgtgtcattgcaatgctgagtctcagtgtttgtataaccagaccagcagagtgggcaacagttcgctggaggtagctggatgcaagtgcgatggaggtacctttggccggtactgtgaagggtcagaagatgcatgtgaggagccatgcttccccagtgtgcactgtgttcccggtaaaggatgtgaagcctgtccacccaacctcacaggcgatggtagacattgcgccgccctgggatcaagtttcttatgtcagaatcagtcatgtccagtaaactactgctataaccaaggccactgctacatctctcaaaccctgggttgccagccaatgtgcacctgtcctcccgcctttacagatagcaggtgtttcctcgcaggaaacaacttctctcctacagtaaatctagaactgcccctgcgcgtaattcaactcctgctctccgaagaggagaacgcaagcatggccgaagttaacgcatctgtcgcctacaggctgggaacactcgacatgagagcctttctacgcaactcacaggtggagagaatagactcggcggcacctgcctccggaagccctattcagcactggatggtgatttcagaattccagtatcgaccgagaggcccagtgattgatttcctgaataatcagctgttggctgccgttgtggaggccttcctgtaccacgttccccggcggagcgaagaaccacggaacgatgtggtatttcagcctatttcaggtgaagacgtaagggacgttaccgccctgaacgttagcacactgaaagcgtactttcggtgtgacgggtacaaaggatacgatctggtatacagcccccagagcgggtttacatgtgtctcaccctgtagccggggatactgtgaccacggtggccagtgtcagcatctgccaagtggacctcggtgctcttgcgtgagtttcagcatctacacagcctggggagagcattgtgagcatctctctatgaaattagacgcttttttcggcattttcttcggggctctgggcggcctcttactgctgggagtaggaacctttgtcgtcttgcgcttttggggatgctctggagctcgattctcgtactttctgaacagtgcagaagcgctcccttag

SEQ ID NO: 195727 - DNA, 5739 bp, Artificial Sequence
  Description of Artificial Sequence: Synthetic coding sequence
cccggcaccaccgaggacaccctgatcaccggcagcaagaccgccgccccggtgacctcgacaggaagcactactgctacactagaaggacaaagcacggctgcctcgagcagaaccagcaatcaggatatctctgcgtcaagtcaaaatcaccaaaccaagtccacggaaactacgtccaaggcccaaaccgacactttgactcagatgatgaccagtaccctgttcagcagtccttcagtccataatgtgatggagacagctccaccagacgagatgacaacctcatttccttccagcgtcactaatacactgatgatgaccagtaagacgatcacaatgactacctcgactgacagtacgctcggtaatactgaggaaaccagcacagcaggcactgagtctagcacccccgtgacatcggctgtttccatcactgccggccaggagggccagagtagaaccacatcctggagaacatcaattcaagacacttccgcctcgtcccagaaccattggacaagaagcacacagacgactcgggagagccagacaagcacactgacccatcgaacgactagtaccccttccttcagcccctcggttcataatgtgaccggtaccgtgagccaaaagacctcaccatctggggaaacagcaactagctctctttgtagcgtaactaatacaagcatgatgacgagcgagaaaataaccgtgacaacctccacaggaagcactctgggcaacccaggggagacctcatcagtgccggtgacgggtagccttatgcctgttaccagcgcagcattggtcactttcgatcccgaaggccagagtccagccaccttttccaggacctctactcaggatacaacagccttcagcaagaaccaccagacccagtccgtggagaccactcgcgtgtcgcagattaacaccttgaacacactaacacccgttactacttctacagtactctcctctcccagcggattcaatccatcaggcacagttagccaggaaactttcccctctggcgaaacaacaacaagctctcccagtagcgtttccaataccttcttagtgaccagcaaggttttccggatgcctacctccagagattccactctgggaaacaccgaagaaacttctttgtctgtatcgggaaccatttctgccatcaccagtaaggtgtccacgatctggtggagtgatacattaagtaccgcattgagtccttcctcactgcccccgaagattagcaccgcttttcacacacagcaatctgagggggccgagacaacaggaagaccccacgaaaggtcgtccttttcacctggggtgagccaggaaatctttacactccacgaaacaactacatggccatcttcatttagctcgaagggacacactacatggtcacagacagaattaccctctacgtccactggggctgccacacgactggtaaccggcaaccctagtaccggtactgcggggactattcctcgtgtgccctccaaggtgtccgcaattggcgagccgggtgagcccacaacttactcaagccatagcactaccctgcccaagacaacgggagcgggcgcccagacgcagtggacacaggagaccggcacaaccggggaggcacttctctctagcccttcatacagtgtaacccaaatgatcaagactgcaacatcgcctagtagcagccctatgctggatcggcacacctctcaacagatcacaactgccccgtctaccaatcactctaccattcactctaccagcacgagtcctcaggaaagcccggctgtgagccagaggggacacacgcaggcaccacagaccacacaggagagccaaacgaccaggtcagtttcaccaatgacagatacaaagacagtcacaacaccgggcagcagttttactgcttccggccattctccatcagagatcgtgccacaagacgccccaacaatttccgccgctacgacattcgctcctgcgcccacaggggacggccacaccacccaggccccgaccactgccctccaggcggcaccttcgtcacatgacgccacattgggcccttctggaggtacttcactctccaagaccggggcgttgacgttggccaactccgtcgtctccaccccgggcggtcccgaaggccaatggaccagcgcttccgcctccacctcccccgacaccgctgctgctatgacacatacccaccaggccgaaagtacagaggcctctggccagacacagacctccgaacccgcgtcgagcggcagccggacaacctccgctgggacagcaaccccctcctcttccggcgcaagtggtaccaccccctctggatctgaggggatctccaccagtggagagactacccgtttctctagcaacccatcgcgtgacagccacacgacccagtccactaccgagctgctcagcgcgtctgccagtcatggtgcaataccagtgagcaccggaatggcatcttcaattgttcctggcacatttcacccaacgttgagcgaagctagtaccgcaggtagacctacagggcagtcatcacccaccagtccctctgcctcaccacaggagaccgcagccatctctaggatggcgcagacccagagaacccggacctccaggggttcggacacaatttccttggcgtcacaggctaccgacacattctcgacagtgcccccaaccccaccgtctatcacgagcacgggcctgactagcccccagactgaaactcatacactcagtccaagtggcagcggcaagacctttacaaccgcattgatcagtaacgctacccctcttcccgtgacatacgcatcttccgcatctacaggccacgctactcctctcgctgtctcatcagccacatctgcttctacagtcagcagcgacagccctctgaagatggagaccccagggatgactaccccctcgcttaaaaccgatggtggccggaggaccgccaccagcccccctcctacgacttcacagaccatcatttctaccatcccctctaccgcaatgcataccagatcaacggccgcacccatcccaattttaccggagagaggcgtgtcgcttttcccatatggagccggcgctggtgatctcgagtttgtgcgaaggaccgtagacttcaccagcccccttttcaaaccggccacgggctttccactgggcagttcactgagagactctctttattttactgataacgggcagatcatctttcctgagtcggactatcaaattttctcataccccaacccacttcccaccggatttacaggacgggatccggtggctttggtggcccccttctgggacgatgcggacttttccacaggtaggggcacaactttctaccaggagtacgaaacattctacggcgagcactccctgcttgttcagcaggcagagtcctggatccgaaaaatgactaataacggcggctataaggctagatgggcactcaaggttacctgggtcaatgcccatgcttaccctgctcagtggaccttaggctcaaacacctaccaggcaatactgagtaccgacggctccagaagttacgccctgtttttgtatcagtcagggggcatgcagtgggacgtggcacaacggtccggtaatcccgtgcttatgggatttagcagtggtgacggttacttcgagaatagcccactgatgtctcagccggtttgggagagatacagacctgatcgctttctgaactccaacagtggtttacagggtctacagttctatagactccaccgggaagagagacccaactacagactggaatgtcttcagtggctcaagtcacagcctcgatggccctcctggggttggaatcaggtgtcgtgcccttgttcgtggcagcagggaagaagggacctccggttccagcctgcaagccttccgcccgaatatcagaacagaaccgaaggtttgctgggggtgtggaacaataaccctgaggatgattttagaatgcctaatggcagcacgatcccgccggggtctcccgaagagatgctgttccattttgggatgacttggcagattaatggaactggactgcttggcaaaagaaacgaccaactgccaagcaattttaccccagtgttctatagccagctgcagaaaaacagctcttgggccgaacatttaatcagtaactgcgacggagacagctcctgtatctatgacaccttagctctgaggaatgcctcaatcggtctgcacaccagagaagtctccaaaaattacgagcaagcgaatgctacgttaaatcagtacccaccctccattaacggcggcagagtaatagaggcatacaaaggacagactactctgatccagtacaccagtaacgcagaagacgccaattttactctgcgcgatagctgcaccgatctcgagctgtttgagaacggaaccctgttatggaccccaaagtcactggagccattcacactggagatcctagccagatccgcgaagatcgggctggcaagtgccttgcagccacgtaccgtcgtttgccattgcaatgctgaatctcaatgcctgtataaccaaacttctcgcgtggggaactccagcctggaagtcgcagggtgtaagtgtgacggaggcacctttggtcgatactgcgagggaagtgaggatgcctgtgaggaaccctgcttcccctcagtgcactgcgtaccaggcaaagggtgtgaggcctgtccaccaaacctaaccggcgacggccgtcactgtgctgctttgggctcatctttcctgtgccagaatcagtcctgcccagttaactattgctataatcagggccattgctatatctcgcagaccttgggctgccagccgatgtgtacgtgccctccggccttcacagattctcgctgctttctggccggcaataattttagtccaacggttaacttggaattgcccctccgtgtcatccaacttctattgtccgaggaggagaatgcaagcatggccgaggtgaacgcttccgtggcctaccggttagggaccctcgatatgcgggctttcctgagaaatagccaagtggaacgcatcgattcagctgctcccgcctccgggagccccattcaacactggatggtgataagcgaatttcaatacagaccccgtggacccgtgatagactttctcaataatcagctcctggccgccgtcgtcgaggcgttcttgtatcacgtgccaaggcgcagtgaagagccgagaaacgacgtcgtctttcagcctatctcaggagaggatgtgcgggatgtcactgcccttaacgttagtaccctaaaggcttatttcagatgcgatggatacaagggctacgacctcgtctactcccctcagagcgggttcacatgcgtatcaccatgttctcggggatactgcgatcacggaggtcagtgtcagcacctgccatctggacccagatgcagctgcgtgtccttctcaatctatacagcttggggggaacactgtgagcatctgtctatgaagctggatgcatttttcggaatctttttcggggctcttggcggcctgcttctacttggagtcggaaccttcgtagttctgcgcttttgggggtgctccggcgcaagattttcatactttctgaattcggccgaggccctgccatag

SEQ ID NO: 195728 - DNA, 16239 bp, Artificial Sequence
  Description of Artificial Sequence: Synthetic coding sequence
atgaagggcgcccggtggcggcgggtgccctgggtgagcctgagctgtctctgtctctgtttactgcctcatgtcgtgcccgggacaaccgaagacactttaattacgggatccaagaccgctgctcccgtgacctcaactggcagtactaccgccaccctcgaggggcagtcaactgctgcaagttcccggacatcgaatcaggacataagcgctagtagccagaatcaccagactaagtccactgaaactaccagcaaggcacagaccgataccttgactcagatgatgaccagtaccctattctcgtcgccttcagtacataacgtgatggagaccgcacctccggacgaaatgacgaccagttttcccagctcagtcactaatactctcatgatgaccagcaagacgatcactatgaccacttctacagactctactttaggcaatactgaggagaccagcacagccggcacggagagcagcacccctgtcactagcgctgtatcgattacagccgggcaagagggacagtcccgcaccacatcatggagaacgtccatacaggatacttccgcgagcagtcagaatcattggacccgtagtacgcaaaccacaagagaatcgcagacctcgactttaacgcacagaaccacatctactccctctttctctccatccgtgcacaatgtaaccggcacagtctcgcaaaagacttcaccaagcggtgaaaccgctacttcatccttgtgcagcgtgaccaatacttccatgatgacatcagaaaagatcacagtcaccacctctactggatcaacattgggtaatccgggtgaaacctcatctgtgcccgtgaccggctctctcatgcccgttacttcagccgcgctagtgacgtttgatcccgagggtcaatctcccgccacattttcacgcacatcaactcaggatacgacagcttttagcaaaaaccatcagactcagtccgtggagaccacaagggtttcccagatcaacacacttaacacactgactcctgtcacgacaagcactgtcctgtccagcccttcggggtttaacccctcagggactgttagtcaggagaccttcccttctggggagaccaccacaagctctccaagtagtgtctcaaataccttcttggtaacctctaaagtttttaggatgccaacttctcgggactctacactggggaatactgaggaaacttcgttgtccgtgtctggtaccattagcgcgattacctctaaagtcagcactatttggtggtctgacaccctcagcacggcactgtcaccaagcagtcttcccccaaagatctccactgcctttcacacccaacagtccgaaggcgctgaaacaacaggacggcctcatgagaggagctccttcagccctggagtgtcccaggagatctttacactccatgaaaccacaacatggccatcctctttctcatccaagggtcacacaacctggtctcagacagaattaccctcaacaagtaccggggccgcaactcgcctcgtcacggggaatccctccacaggcacagctgggacgattccgagggtcccatcaaaggtgtcagctatcggagagcctggcgagccaaccacttacagtagtcactccactacccttccgaaaacgacaggcgccggcgctcagacccagtggacacaggaaactggcactacaggcgaggctcttctgtctagtccttcctacagcgtaactcagatgattaaaactgcgacttccccatctagcagccccatgttagataggcacacaagccagcagataacaacagcaccatcaaccaatcacagtactatccactccacctccacctctccacaggagtcaccagccgtgtctcagcgcggacatacgcaggcaccccagaccacgcaagaatcgcagaccactcgttcagtcagcccgatgacagacaccaaaacagtaactactcccggcagctcttttacggcatcaggccactctccttctgagatagttcctcaggacgctccaaccatttctgctgcaaccaccttcgctcccgccccaactggcgacgggcacaccacacaggcccccacgactgccctccaggcagctccatcttcacacgatgccacactcggaccgtccggaggcacctcccttagtaaaacaggcgctctcactctagcaaactctgtcgtcagcactcccggcgggccagaagggcaatggactagcgcctccgcaagcacatcgccggatactgctgctgcaatgacgcacacccaccaagctgagtccaccgaagcatctggacagacgcagaccagtgaaccagcgtcttccggaagcaggacaaccagcgctggaaccgcaacaccatcgtctagtggcgcaagcggaacgaccccaagcggttctgaaggtattagcactagtggagaaactacccggttctcctccaacccaagccgggacagccacacaactcagagcacaaccgagctcctgtctgccagcgctagccacggcgccatccctgtcagcaccggcatggcctccagtattgttcccggtacttttcatccaacactaagcgaagcctccaccgctggtagaccaactgggcagtccagtcccacatcccctagcgcgtctccacaggagaccgcagcaatttccagaatggctcagactcagcgcacaagaacttccagaggtagcgatacaatctccctggcatctcaggccaccgacacatttagcaccgtccctccaacaccgccgtctataacttccaccggcctcacatctccccagaccgaaacccacacactgtctccttctgggagcggaaagaccttcactactgcgctgatttctaatgccacgcctctccccgtgacatacgcgagctctgcgagtaccggacacaccaccccgctccacgtgaccgacgcctcctctgtgagcacagggcatgccaccccccttcctgtgacttctccgagtagcgtgtccaccgggcacacgactccattgccggttactgatacctccagtgaatccaccgggcatgtgaccccccttcccgttacctcctttagttctgcttcaactggagacagcacgccactacccgtgactgataccagctccgcatctactggccacgttacccctctgcctgtaacaagcctgagcagtgcctcaaccggggataccacgccactgccagtcacggatacatccagcgcctccaccggacatgctacatcactgcccgtgaccgatacttccagcgtgtccactggacatactacacctttacccgtaacagacaccagcagtgctagcacaggtcacgcgacctctctgcctgttaccgacaccagctcggtcagcacgggccacaccacacccctgcacgtaacagacgcatcttccgcaagcacggggcaggccacacctctcccagttacttcgctcagctcggtatctactggcgacactacaccattgcctgtcacttccccctcctcggccagtacgggccacgccactcctctgctggttaccgacacaagcagcgccagcaccggtcacgctacaccattgccagtgacggatgcctcaagtgtgagcaccgatcatgccacctctttgcctgtcacaattccctccgcagcatccaccggccataccacacccctgcctgtgaccgacacaagcagtgcttcaacaggacaggccacatcccttctcgttactgatacaagcagtgtgtccaccggcgataccacgccccttcctgtgactagtacatcctcagcttccacgggacacgtgacacccctacacgtgacatcccccagctccgcaagcactggtcatgcaactccactgcccgtaacttcattaagtagcgcttccaccggcgatactatgcccttgcccgttacatcaccatcctcagccagtaccggcgataccacccccttgcctgtgacggatgccagctcagtgagcactggccacacgacacccctccacgttaccgacgccagtagcgcttctacagggcaggccactcccctccctgtgacctctttaagctcagtgagcacgggggataccactccgctgccagtgacttccccctctagcgcatctacaggacatgcaaccccacttttggttactgacacgtcctccgcgagcacaggacacgccaccccgcttccagtgacagatgcctcctctgtgagcaccgaccacgctacatccctccctgtcacgatcccaagcgccgcatcgacaggccacacaactccgctgcctgtcaccgacactagttcggcctccacgggacaggcaacatcactcctggtgacggacacaagcagtgtcagtacaggcgacaccacaccgttgcccgttacaagcaccagttccgcatccactggccacgtgacaccgctgcatgtcacatccccaagcagcgccagcaccggacatgcaaccccactacctgtgacgagcttgtcatcagcatcaactggggatacaatgccccttccagtcacatccccctcctctgcatcgaccggcgatacgaccccactcccggtgaccgacgcctctagcgtctcaacaggccacactactcctctccccgttacatccccaagcagtgcttcaaccggacacactacccctttacctgtcactgacaccagttccgcctctaaaggcgatacaaccccactgcctgtgaccagcccgagcagcgcgtcaactgggcacactacccccctgcctgtcacggatacgtccagcgctagcaccggggacaccacgccactacccgttacaaatgccagctcactcagcaccggtcatgcaacacccctgcatgtgacaagccccagtagtgcctcaactggacatgccaccccgctgccagtcacatcaacctcatctgcgtccaccggacatgccactccactacccgtgacggggctgtcatccgccaccactgacgatactactcgactgcccgtaacagatgtgtcatctgcatcaactggacaggctaccccgctaccagttacaagcctcagctccgtcagcacgggcgatacaactccgctgccagtgacttccccctcatctgcatccacaggccatgcatcacctctgctcgtgaccgatgctagttctgcttctaccggccaggcaacacctctgcccgtgacggacaccagctccgtgtcaacggcgcacgctacaccactccccgtgacaggcctcagcagcgcgagtactgacgatactacacgactgccagtgacagatgtgtcctctgcgagtacaggacaggctatccctttgcctgtcacttctccatcatctgcgtcaacaggagatacaaccccactacccgtgaccgatgcttccagcgccagcaccggagacaccacttcgctgccagttaccatcccctcttccgcttcttccggacacactactagccttcccgtgacagacgcctcatcagtcagcactggccatgccacgtcactgcttgtgacagatgccagctctgtctcaaccggagacaccacccctctgcctgtcacagacaccaactcggcctcaaccggagacactacccccttgcatgttactgacgcatcctccgtgtccaccggtcacgccacaagcctgcccgtcaccagcctgtccagcgcctccacaggcgataccacaccactgcccgtcacgagccccagctccgccagttccggccacacaacaccgttacccgtgacagacgccagttcagttcctacaggtcatgctacctccctgcccgtgaccgacgcctcctcagtatcgacaggccacgcgactccactacccgtgaccgacgcctcgtctgtatccaccggtcacgccactccattgccagtgacagatacgtcatcagtgagcaccggccaagctaccccccttcccgtgacttccctgtcaagcgccagcacaggggataccacaccacttccagtcaccgacacatcaagcgccagtaccggccaggacacaccacttcctgtgacctccttgtccagtgttagcacaggcgatacaacccccctgcccgtgaccaatccttccagcgcctctaccggccatgccacacccctgctggttactgacgcctcttctattagtaccggccatgcgacctctcttctagtgactgacgctagcagcgtcagcacggggcacgctaccgcactccatgacacagatgcttcctcactgagtaccggtgataccacgccactacctgtgacctctcctagttcaacgagcacaggagacactacaccgctgcccgtcacagagacttctagcgtaagcaccggccatgcgaccagcctgcccgtgacagatacaagcagcgcctccaccggccatgcgacctcactgcccgtcaccgatacaagtagcgccagcactgggcacgcaacgccgctccccgttacagatacttcctcagctagcactggacaggctaccccactgccagtgacctctcctagctccgccagcaccggccatgccatacctctgctggtgacagacaccagctctgcaagtactggacaagctaccccactgccagtgacatccctgtcaagcgctagtaccggcgataccacgccgttacccgttactgacgcaagtagcgtcagcaccggacatgctacctctttgccggtcacttcactgagcagtgtatctaccggggacaccactccactgcccgtcacatctccatcaagcgctagtactggccacgctactcctctgcatgtcactgacgcctcttcagcgtcaaccgggcacgcaaccccccttcccgtgaccagcctgtcgtcagcctctaccggagacaccacacccctacctgtcacttctccctctagcgcctctactgggcatgccacacctttgcatgttacagatgccagttctgtaagcactggagacactactccattaccagtcacatcttcgtccagtgccagttcaggccacacaacaccgttgcccgttaccgacgcctcgtccgcatcgactggtgacaccacaccacttcccgtgacagacacttctagcgcgagcaccgggcacgccacacacctgccggtcaccggcctgtcctctgcatctaccggggataccacccggttgccagtaaccaacgtaagcagtgcttctaccggacatgctactcccttgccagtcaccagtacatctagtgctagcaccggggataccacacccctgccaggaacagacacctcctctgtgagtaccggccataccacaccactgctggtgaccgacgctagctctgtgtccacgggggataccacacgcctgcctgtaactagccctagcagcgcgagtaccgggcacaccactcccctcccagtgaccgatacaccctcagccagcacaggcgatactacccctctgcctgtcacgaatgccagcagtctgtcaacacggcacgcaacttctctgcacgtgacctcccctagctccgccagtaccggccatgccacgtccctgcctgtcacggacacctctgctgccagcaccggccatgccacacctctgccagttacaagcacctccagcgcgagtacaggagacacaaccccactgcccgtgaccgatacctattcggccagtactggtcaagctactccgctgccggtgacttccctctcgagtgtgtctaccggggacacaacacctttaccagtgacctcgccctcaagtgcttcaacagggcacgccacaccactgctggtcactgatgcaagctcagcatcaaccggtcaggctacccctctgcccgtgactagtttgtcatccgtgagcaccggtgacactacccccctgccagtcacgtccccttctagtgcttctaccgggcacgccacttcactgccagtgaccgacacatcaagcgcatcaaccggcgacactacaagtctccccgtaacagacaccagctccgcttataccggtgatacaacctcacttcctgtaaccgacactagcagctcctccaccggagataccacacctttacttgttaccgagacctcgtcagtgagtaccggtgatacaactcccttgccagtcacggatacctccagtgctagcactggccatgccacccctcttcctgtgacaaataccagcagcgtgagtactgggcatgccacccctctacacgtcacctcaccttcctccgcctccaccggccatacaactccacttcctgtgaccgacgcctcaagtgtgtctaccggccacgcaacctctctgcctgtaaccgatgcctcatcagtcttcaccggccatgcgaccagcctgccagtcaccatcccaagttccgcctcctccgggcacaccactccccttcctgttacggatgcttctagcgtcagcacagggcatgcgaccagtctgccggtcaccgacgccagtagtgtgagtacaggccacgcaacccctctccccgtaaccgatgcatcctccgtctcaactgggcatgctacccctcttcctttaacctctctatcttccgtctctaccggagatacaacgcccctgccagtgaccgacactagcagcgcgtctacagggcaagccacccctttaccagtcactagtctctcttccgttagtaccggcgatacaaccccgttgccggtcacggatacctcaagcgcctccacaggacacgccacctccctcccagttacagacacttcttctgcctccacaggacacgcaacaccactgccagacactgatacaagttcggcgtctactggccacgctaccctgttgccggtcaccgatacatccagcgccagtatcggacacgcaacaagtctgcctgttaccgatacttcttcaatcagcactggacacgctactcccctacacgttacttctcctagcagcgctagcaccggtcacgccacaccactcccggtcactgacacaagctcagcttcgaccggacacgcgaaccccctccacgttacttcgccttcaagcgcaagcacggggcacgccacccccctgcctgtaaccgatacaagttcggcttccacaggtcacgcaactccactacctgtaactagtttgtctagtgtcagcactggcgacactacgcctctgcccgtgacaagccctagcagcgcatccacaggccatacaacaccacttccagtcactgatactagttcagctagtaccggccaggccacagctctgccagtcacctctacgtcttccgcctccacaggggatactacccctctgcctgtgacagatacctcctccgcgagcacgggtcaggccaccccgcttccagtgacctccctgtccagcgtgtcaactggagatacaacgccgctgcccgtgactagtccaagttccgctagcactgggcatgcgacgccactgctagtgacagacgcttctagtgcttccacaggacaagctaccccattgcctgtgaccagtttatcctctgtgtctacaggcgatactaccccactcccagtcacaagtcctagtagtgcttcaacaggccacgctacctcactccccgtaacagacacttcctctgcctcaactggggacactacttcccttccagttacagataccagttccgcctataccggtgacactacttccttacctgtgacggatacctcctcgagtagtaccggagacacaacccccttgcttgtcaccgaaacttcctcggtcagcaccgggcacgctacaccactattagtcactgatgctagctctgcctctacaggccacgccacaccactgcacgtcacctctcctagctccgccagtactggagataccacaccagttcctgtgactgacacttcatcagtgtcaacaggccatgctacacctcttcccgtgactgggctgtccagcgctagcacaggcgacaccactaggttacccgtgactgacatctcctctgcaagtactgggcaggccacccccttacccgtcacgaatacttctagcgtcagcacaggcgacacaatgcccctccctgtgacatccccctcctcagcaagcaccggtcatgccacccctttaccggtaacatccacctctagcgctagtacaggccatgcaacacccgtgccagtgacaagcacatctagcgcgtctacaggccacaccacgcctctgcctgtaaccgacactagcagcgctagcacgggagacaccactcccctcccagttactagtcccagtagtgcttccactgggcataccacgcctctgcatgttacaatcccctcctcagcaagtaccggagatacttcaaccttgccagttaccggggcttcttcagcttccaccgggcacgctactcctttgccagtgactgacacttcttctgtcagcaccggacatgctacgccgctccctgtgacctcactgagctcagtgagcaccggtgatacgacaccgctccccgtaacagacgcttcttcagccagcacagggcaggcaacgccgctcccagtgacatccttatcttctgtgtcaaccggcgatacaactcccttgctcgttactgacgcctcttctgtctccaccgggcatgctactcccctccctgtgaccgacacatcttccgccagcactggagatactacacggctgccagttactgacacttctagtgcatccaccggccaagcgaccccactgccagtgacttccctgagcagtgtatccacaggcgacacgacgcccctcctggtgactgatgcaagttctgtctctaccggacacgcgactccactgcccgtgactgacactagtagtgcaagcacaggagacactacccgcctgcccgtgacagacacatcctccgctagtacaggccaggcgacccccctgcctgtgactataccttccagttcctcctccggccacaccactcctctgcctgtaaccagtacatctagtgtgagcaccggtcatgtgactcccctgcacgtcactagtccctcaagtgcatcaacgggccacgtcaccccactgccagtcacatctacgtcctcagccagcaccggacatgccacacccttactggtgacagacgcatcatcagtcagcaccgggcatgccacgccgctgccggttactgacgcctcttcagcctcaacgggtgatacgacccccctgcccgttactgacaccagttcagcctccacaggacaggcaacgccattgccagtgacttctctgagcagcgtctctactggggacaccacccccctgcctgttacagatgcatcttcggcttcgactggccacgccacccccttacctgttaccatccccagcagtgtgtctacaggagacactatgcctttacctgtaacttctccctcctcagcaagtacaggccacgcgacccccttacccgtgacaggactgtctagcgcttctaccggtgatacaacaccacttcctgttaccgacacaagttcagcctccacgcgtcatgccactccattaccagtaaccgatacaagctccgcgtccactgacgatactacacgcttgcccgtgacagatgtcagcagtgcctccaccggtcacgccactccactgcccgtgacatctacttcaagcgcaagtacaggcgatacaacccctttacccgttacagacaccagttcagtctccacagggcacgcaacctccctcccggtcacctcccgttcctctgcaagcacagggcacgctacgcctcttccagttacagacacaagctctgttagcaccgggcacgctactcctctgcccgtgacgtctacatcttccgtgtcaaccggtcatgctacccctctacctgtgacgtcacctagctccgcgtcaacgggccacgcaactcccgtgcctgtgactagtacttctagcgcgagtacaggagacaccacgccgttacccgtgacaaatgcctcgtccttatccaccggccacgcaacaccactgcatgtcacctcccctagcagtgcatcgaggggcgatacatctacattacctgtcaccgacgcgtcgtcagcctcaaccggccacgcaaccccgctacctctcacctcactgagcagcgtcagcacgggcgacactaccccactgcctgtgacagatacctccagcgcgagcaccggccaggcgacaccgttacctgtgacttctctctcctcagtttccactggcgacacaacccccctgccggttaccatcccgtcatctgcgtccagtggtcacactacaagtctacccgtgactgatgcatccagcgtgagtacaggccacggcacacccctgcccgtgacgagtacaagtagtgcgtccacaggagacactaccccccttcctgtcacagacacatctagcgcttctactgggcatgccactccactccctgtgaccgataccagcagcgccagcaccggccatgccactcccttacctgtcactagcttgtccagcgtgagtacaggccatgccacacctctagcagtgtctagcgccacttccgcgtctacggtgtcctccgattcgcctttgaagatggagaccccaggcatgaccacgccgagcctgaaaactgatgggggtcggaggacagccacctcccccccacccacaacaagccagaccattatcagcacaataccctcaaccgctatgcatactcggagtaccgcagcgccaatcccaatcttgcccgagcgcggagtgtctctgtttccatacggcgctggcgcgggcgatcttgagtttgtacgccgaacggtcgacttcacgtctcctctgtttaaacctgccacggggtttcctttgggatcatccttgagggatagcctgtacttcactgacaatggccagataattttccctgagagcgactaccagatttttagttatccaaaccctttgcccacagggtttactggacgggacccagttgctctagtggcccctttctgggatgacgctgatttcagtactggaaggggcaccacattctaccaggaatacgagactttttatggagagcatagcctactggtacagcaggctgaatcctggatcaggaaaatgacaaataatggggggtacaaagctcgatgggctttgaaagtgacatgggtcaatgcccacgcgtacccagctcaatggacgctgggatccaacacataccaagcaatcctatcaactgatggcagcaggagttacgctctctttctctatcagagtggtggcatgcagtgggacgtggctcagcgttcagggaaccccgtcctcatgggtttcagtagcggagacgggtactttgagaacagtccactgatgagccagcccgtctgggaacgataccgccctgaccggtttcttaacagcaacagtgggcttcaagggttgcaattctataggctgcatagggaagaacgaccgaattatcgactggagtgtctccaatggttaaagtcacagccccggtggccctcttggggctggaaccaggtgtcttgtccctgctcatggcagcagggccgtcgggatctgagatttcagcccgtgtccatcggtcgctggggattaggtagcaggcagctgtgcagcttcacatcatggcggggaggtgtgtgttgctcatatggtccgtggggggagttccgagaaggatggcatgtacagaggccctggcagctcgcccaagagctcgagccccagtcttggtgttgcagatggaacgataaaccctacttgtgcgctctctaccaacagagaaggccgcacgtgggctgtgcaacctacagacctccgcagccggcctggatgttcggggaccctcatattacaacgttagacggggtgagttacaccttcaatggacttggcgattttctgctagtcggagctcaggacgggaatagcagcttcttactccagggaagaactgcccaaactgggagtgcccaggccacgaatttcatcgcctttgcagcacagtatcgctccagtagcctaggacccgtcaccgttcagtggctactggaaccacatgatgccatcagggtgctgctcgacaaccaaactgtgacctttcaaccagatcacgaagacggtggtggccaagagacttttaacgccacaggtgtgctgctgtctcgcaatgggtctgaggtgagtgctagttttgatggttgggcaaccgtttccgttatagcgctctcaaacatactgcatgcgtcagcctccttgccacccgaataccagaacaggactgaaggcctgcttggggtctggaacaacaaccctgaggacgattttagaatgccgaacggttccactatacccccaggtagcccagaagagatgctgttccacttcgggatgacgtggcagataaatggtaccgggttactcggcaagcgcaatgatcagttaccaagtaacttcacgcctgtgttttacagtcaattgcagaagaactctagttgggcggagcatctgatctccaactgtgatggtgattcaagttgcatttatgatacactcgccctaagaaacgcctcaattggactgcacaccagggaggtgtccaagaattatgaacaggccaatgccacgctcaatcagtacccaccttctattaacggcggtcgcgtcattgaggcatacaaagggcagacaacacttatccaatacaccagtaacgccgaagacgccaatttcactttgcgtgactcgtgcaccgacctggagctcttcgagaacgggaccctgttgtggacacccaagagtctggagcccttcaccctggaaatcctcgcccgctcggctaaaattggcctggcttcagccctgcaacctagaactgtcgtgtgccactgtaatgccgagtcacagtgcctgtacaaccagacttcaagagtgggaaactccagtctggaagttgccggatgcaaatgtgatggtggaactttcggcaggtattgcgaaggcagcgaagacgcgtgtgaagagccatgttttccttctgtgcactgtgtgccgggcaaaggttgtgaggcttgtcctccgaacctaactggagatggccgacactgcgccgctcttggtagttcgttcctatgccagaaccagtcctgtccagtgaactactgctacaaccagggtcattgctacatttcccagaccctcggatgccaacccatgtgcacctgtccaccagctttcacagattctaggtgctttctagccggaaacaacttctcaccaaccgtgaacctggagctcccgctcagagtgattcagctcctcctcagcgaggaagagaatgcaagcatggcggaggtgaacgcctcagttgcgtatcggctgggaaccttggacatgagggccttcttgcgcaacagtcaagtggagcggatcgattctgcagctccggcttctggctctccaattcagcactggatggtgatatccgaattccagtataggccacgcggcccagtcatcgacttcctgaacaatcaactgcttgccgccgtggtcgaagcattcctgtaccacgtccctcggcgctcggaggagcctagaaatgacgtggtgtttcaaccaatttcaggtgaggacgttagggacgtcaccgcgttaaacgtgtcaaccctgaaggcttactttcgctgcgacggatacaaggggtatgacctggtgtactctccacagagtggtttcacttgcgttagcccatgctcacggggatattgcgaccacgggggccaatgccagcacctgccatctggtccgagatgctcttgcgtttcatttagcatctatacagcctggggggaacactgtgaacacctcagcatgaaactggatgctttcttcggtatcttttttggtgccttggggggactgttgttgcttggagtgggcacattcgtagtcttaaggttttggggctgcagcggcgccaggttctcttattttttaaactctgcggaagcactcccgtag

SEQ ID NO: 195729 - DNA, 16083 bp, Artificial Sequence
  Description of Artificial Sequence: Synthetic coding sequence
atgaagggcgcccggtggcggcgggtgccctgggtgagcctgagctgtctgtgtctgtgccttttgccacatgtcgtgccaggcacaaccgaagataccttaataaccggtagtaagacggcggcccctgtgacatccactggaagtaccactgctactttggaaggccagtcaaccgcggcctccagcaggacttccaaccaagacatatctgcatcttctcagaaccaccagaccaaatccacggagactacatctaaagcacagactgacacactcacccagatgatgacctcgaccctgttcagtagcccaagcgtgcataacgtcatggaaaccgcaccacctgacgaaatgaccacaagctttccaagcagcgtgaccaacacactgatgatgaccagcaagacaatcactatgaccaccagcaccgactccacacttggcaacaccgaagagaccagtaccgcaggcactgaatcaagtactcccgtaacatcagcggtctctataaccgccggtcaggaaggtcagtcacgcacaacaagctggcgcacctctatccaggatacctccgcgtcttctcagaaccattggacccggtcgacccaaacgacacgcgagtcacagacttccaccctcacccatcgaacgacgtccaccccgagcttctcacccagcgtccataatgttactggcacagtctctcagaaaacctcacctagcggcgagacagctacatcaagcctatgctctgtcactaacaccagcatgatgacctcggagaagattactgtaactacaagcactggctccacactcgggaatccgggggaaacatccagcgtgcccgtgacaggttcgctgatgccagtgacctccgcagcgctggtgacatttgaccctgagggccagagtcctgcaaccttctcaagaaccagcacccaggacacgaccgccttcagcaagaatcaccagactcaatcagtcgagaccactagagtgtcgcagattaacacactgaatacgttgactccagttaccaccagcacggttctaagtagccctagcggtttcaatccaagcggcactgtctcccaagaaactttcccctctggcgaaacaaccacaagttcaccttcatcagtgagcaacaccttcctcgtcaccagtaaagtgttcaggatgcctacatcacgggacagcactcttgggaatactgaggaaacctccctgtccgtcagtgggaccatctcagccatcacgagcaaggtttccacgatatggtggtctgatactttgtccaccgccttatctccatcgagcctccccccaaagatttctacagcttttcatacacagcagtccgagggggccgaaactactggtagaccacacgagaggtccagcttcagcccaggagtgtcacaggaaattttcacacttcacgagacaaccacttggcccagctcattttcgagcaagggccatacaacttggtcccagaccgagctgccttccacttcaaccggcgccgccactcggctggtgacagggaacccctctaccggcaccgccggaacaatacctagagtgcccagcaaagtgagcgccatcggtgaaccgggtgagccgaccacttatagttcgcacagtacaaccttgcccaagacaacaggcgcaggtgcccagacgcaatggacccaggagacaggtaccacaggggaggccctgctgagcagcccctcctattctgtgacccagatgatcaaaacagctacctccccatcttcgtctcctatgctggataggcacacgtctcaacagatcaccacagctccctctacgaatcactctaccatccacagcaccagcacctctccacaagagtctcccgcggtttcccagagaggacacactcaggccccccagacaacccaggaatctcagacaacgagatctgtttcgcccatgactgataccaaaactgttaccacacctgggtcaagttttacagcgtccggtcattcgccgagcgaaatcgtgccccaggatgcgcctacgataagtgcggccaccacatttgcccccgctcccacgggagatgggcacacgacccaggctccaaccactgcactacaggccgcacccagtagtcacgacgcgaccctgggtccaagcggcgggacatccttatcaaagactggtgcactgaccctggctaattctgttgtcagcacaccagggggccctgagggccagtggacctctgcctctgccagcacaagccctgatacagctgctgcaatgacacatacgcatcaggccgagtctacagaggcttcagggcaaactcagacctccgagcccgccagctccggcagtaggactaccagtgccggaacagccacaccatcgagcagcggggccagcggtaccaccccttccgggagtgaggggattagcacaagcggtgaaaccaccagatttagctcgaatccttcgcgagactctcataccacccagtccactactgagctgctatcagcctcggcatcccacggcgctattccagtctccacaggaatggctagctccatcgtgcctgggacctttcaccccaccctgagcgaagcttcaactgcgggccggcctacggggcagagctcaccaacatccccaagcgccagtccccaggaaactgccgctattagccgtatggctcaaactcaacgaactcgcactagccgaggaagcgatactatttccctggccagtcaagccaccgatactttctcaaccgtcccaccaacaccaccttccattacctccactgggttgacctctccacagacagagactcacacgttatccccttctgggtccgggaaaacattcactacagcccttatctctaatgcaactcccctgccagtcacatatgcaagttctgcttctacgggccatacaactcccttacacgtgacagatgcttcttctgtcagcacaggtcacgcaacacccttgcccgtcacgtccccttcctctgtttctactggtcacaccaccccgctgccagtaaccgacacatcaagtgagagtacaggtcatgtgaccccactgcctgtgacgtcattcagttctgcctcgactggggactccaccccactgcctgtgaccgacaccagcagtgcatcgactggccatgtcacccctctgcctgtgacctccctgtcctcagccagcaccggcgatactacccctctcccggtaaccgacacaagctccgctagcaccggccacgccactagcctgcccgtcactgatacctcctccgtctctactggccataccacccctcttcctgtgactgacacttcctccgcttcaaccggccatgccacttctctgcctgtgacggatacctcctccgtctctaccggccacacaaccccactgcacgttacggacgcctcttctgctagtactgggcaggcgacacctcttcccgtgacatctctaagcagcgtgagtaccggggacacaacacccctgcccgtgacctcacccagcagcgcttcaacgggtcacgcaacaccattgctggtcactgatacaagctcagcaagtactgggcacgcaactccgctgccggtcacggatgcatctagcgttagtaccgaccacgcaaccagcctgcccgtcaccattccaagcgctgcatccacggggcatacaacaccattacccgtaacagatacatcaagtgcttctacaggccaggccacatccctcctggtgacagatacctccagtgtctcaactggagacacgaccccattaccagtcaccagtacttcgtccgcatcaactggccatgtcactccactgcacgtcacaagtccaagtagcgcaagcaccgggcatgccacaccgctgcctgtcacttcgctgtccagcgcctcaacgggagacaccatgcctctccctgtgacttcaccgagtagtgccagtacgggagacacaacaccattgcccgtcacagacgcctcttctgtctctacagggcacactacgcccctacatgttaccgatgccagttctgcctcaaccggtcaggcaacccctctgcctgtcacctctctgtcttcagtctccacaggggacactactcccctcccagtgacttctccatcctcggcctcaacagggcacgctacaccactcctggtcaccgacacttcctccgcgagcacagggcatgcaactcccctaccagttactgacgcaagttccgtgagcaccgatcacgccacgtctctgcccgtgacgatcccttcagcggcatccaccgggcataccactcctctccctgtaacggatacatcctctgccagtaccggccaggccaccagcctgcttgttaccgatacgagctctgtgagcacaggagataccactccccttcctgtcacgtcaacaagctctgcatctacggggcatgtgacccctctgcacgtcacctcacctagctccgctagcactggccatgcaaccccccttcccgtgacctccttgagtagcgcttcgaccggcgacacgatgcccttgcccgtcaccagcccaagcagcgccagtacgggtgacacaacaccccttcctgtgactgatgcgtccagcgtaagcactggccatacaactccattacccgtgacttcaccctcctccgcatccacaggtcacacaacccccctgccggtgaccgatacatctagcgcttccaaaggcgacactacgcctctccctgttacttccccctcaagcgcttccaccggccacaccacacctctgcccgtaacagacacctcctccgcctccaccggtgatactactccactccccgtcactaatgccagttccctgtcaacaggccatgccacacccctccacgttacaagcccatcaagcgccagtaccggtcacgcaactccccttcccgtgacctccaccagcagcgcatccacagggcatgctaccccccttcctgtgacaggattgtcttctgcaacgacagacgacactacacgtctccccgtcaccgatgtgagcagcgcctccacgggccaggcaacacctctgcccgtaacaagtctgagttccgtgagcaccggtgatactacaccactcccagtaacctcaccttccagtgcctcgaccgggcatgcatcgccgttgttggttacggacgctagttctgcctctaccggccaggctaccccactgccggtgacagatacctcttccgtgagcactgcccatgcaacgcccctgccagtgactggcttgagctccgcatcaaccgacgacaccacacgcctgcctgtgaccgacgtgagttccgcgtctacaggacaggcaattccattgccggtgacaagtccaagttccgcatcaactggcgacacgacacctctgccagttaccgacgcctcctctgcctctactggcgataccacttctctccccgtcactataccaagctccgcctcatctgggcatacaactagcctgccagtgacggatgcgtcctccgtttcaaccggacatgcaacatcattgctagttaccgatgcatcctctgtgagcacaggcgatactaccccactcccagtgaccgacacaaatagtgcatccactggtgacactacgcctctgcacgtcaccgacgcctcatccgtttccaccgggcatgcgacaagcctcccggtcactagtctgtcaagcgccagcaccggcgacactactccgctacccgttactagtccatcttccgcctcttctggacacacaacacctttacctgtcacagacgccagctccgtgcccaccggtcacgccacgagtttacctgtgacagacgcatcctctgtaagcaccggccacgccacacctttgccggtgaccgacgcaagttccgtttcaaccggacacgcaacccctctgcctgttacagatacatcctccgtaagcaccgggcaggcaacaccactgcctgtgacctctctctcatctgcttccacaggggacaccacccccttacctgtgacagatacttcctccgccagcaccggacaggacaccccgctgcccgtgacctctttgtctagtgtttccacaggtgacactactccattgcccgtgactaatcccagctctgccagcaccggccacgcaacccctctcctcgtaaccgacgcctcgtcgatttcaaccggacatgctactagtctactcgttactgatgcctcctctgtgtctacagggcatgcgaccgctctccatgatacagatgccagctctctttccactggggatacaactcccctgccagttaccagccctagttccacttccactggagatacgacgcccctgcctgttacagaaacgagttctgtttcaaccggtcacgccacatcattgcccgtcacagatacatcctccgcttctacaggacacgcaactagcttgccagtgactgacacgagtagcgctagcactgggcatgctactcctcttccagtgaccgacacgtcaagcgcatccacagggcaagcaacgcctcttcccgtgaccagccctagctccgcaagcacggggcacgcaatacctctgcttgtgaccgatacgtcatccgcatcaacaggccaggcgaccccgctgcctgttaccagtctgagcagcgcatctaccggggataccaccccactacccgtcaccgacgcctcctcagtgagtaccggtcacgcaacctctctaccagtgacatcactgtcttcagtatcaacaggggacactacgcccctccccgtcaccagtccatcttctgcctctactggacatgccacacctctgcatgtgacagatgccagcagcgctagcaccggccatgcgacgcccttaccagtgaccagcttgtcatcagcttccactggtgataccacacctctcccagtaacctcccccagctctgcttctaccgggcacgctacgccacttcatgtgacagatgcaagttctgtctcaactggtgatacaactcctctgcccgtgaccagctcctcctcagcttcgtcggggcacactacgccccttcctgttactgatgcatccagcgctagcacaggcgacacaacacctctcccagttactgacacctcttccgcctccactggacatgcaactcacttgcctgtgacgggactgagttccgcatcaacgggcgataccacccgacttcctgtgacaaacgtcagcagcgctagcaccggccacgccacaccccttcctgtgacttcgacgtcctcagcctctacaggagatactaccccgcttccgggcaccgacacttccagtgtcagtacaggccacaccactcctctactggtgaccgacgcttcttccgtttcaacaggtgataccactcgactccctgtcactagcccctcgagtgcttctacagggcataccactcctctgcctgtaaccgatactcctagtgcctcaactggagatacaacaccactacctgtgactaatgcaagctcgctttctaccaggcacgccacgagcctgcatgtgactagtcccagcagcgcgtccacaggccacgcaaccagcctgcctgtgaccgacacatccgccgcttccaccggtcatgcgaccccccttcctgttaccagcacctcatctgcctcgacgggtgacactaccccattacccgtaacggacacatattcagccagcaccggacaagctactcctctgcctgtcactagcctatctagcgtgagtaccggcgacactactccccttcccgtgacctctccaagctccgccagtactggtcatgccacccctctgctggtgacagatgcttcttccgcatcaactgggcaggccacaccgctccctgtgacatcactttcatccgtgtctacaggggacaccaccccattacctgtgaccagcccgtcttctgccagtaccgggcacgcaacttcactccccgtcacggatacaagcagcgcctctaccggagacacaacttcattacccgttaccgacacgagtagtgcatacaccggcgacactactagtttgcctgtgactgacaccagctcatcttctactggcgatacaactcctctgttggtcactgaaacatccagtgtgtcaaccggggacactaccccattgcccgtcacagatacaagcagtgccagtactgggcatgcgactccactcccggtcaccaacacatcatccgtctcgaccggccatgctacacccctgcacgtaacctcaccttcctcggctagtaccggccataccactccgctcccggttactgatgccagctctgtctccacagggcatgctacaagtctgcccgtcaccgacgcttcctccgtgttcactgggcacgctacctctttgccagtgacgattccctcctctgcttcatctggccacactaccccactgcccgtgacggacgcctcgagtgtgtctaccggacacgcaacaagtctgccagtgacagatgccagtagcgtgtccaccggtcacgcaacccccctgcctgtgaccgatgcctcgtctgtcagtacgggccacgccacaccgctgcccctcactagcctctcctctgtgagcacaggggacaccaccccattgcctgtcacagatacctctagcgcgtccaccggacaagccactcccctgcccgtgaccagtttgtcaagtgtgagtaccggggatactacccctctgcccgtaactgatacgtcaagcgcctcaaccggccacgctacgagcctgcccgtcactgacacatccagtgcaagcactgggcacgctacacctctccccgacacagacacatcctcagcttccaccggccacgccaccctcctgcccgtgacagataccagctcagcttcgatcggacacgccaccagccttcctgtgacggatacctcgtccataagcactggtcatgctacacccctccacgtcacctcaccctccagcgccagcactgggcatgctacacctctccctgtcactgacacatcgtccgccagtaccggccacgctaaccccttgcatgtgacatcacctagttctgcctccacaggccacgcaactcccctgcctgtaacagacacctcctccgctagtaccgggcacgccaccccactcccggtgacttcattgtcaagtgtgtctactggagacacaactccactccccgtcacatctccatctagtgcctccaccggtcacacaaccccattgcctgttacggatacatcatccgcttctactggccaggccaccgccttacccgtgaccagcacctcttccgcttcgacaggtgatacaaccccgctccctgtcaccgacacatcttctgcgagtacaggccaagccacaccgctgcccgtcactagcttgagtagcgtgagtacaggtgatacaacacctcttcccgtgacttccccatcttccgcctcaacaggacacgctacccccctgctagtgaccgacgcatcctcagcctccacaggccaggcgaccccacttcccgttaccagcctgagctccgtctctacaggggacaccaccccgctcccggtcaccagcccaagttctgcgagcacagggcacgccacttcattgcccgtcaccgacacctcttcagctagcaccggagacacgacatccttgccagtgacggatacttcttcagcctacactggggacactacaagtctgcctgtaaccgacacctctagcagttctacaggcgatactactccactcctggtgactgagacgagctcggtctcaacaggacatgctactcctctgctggttactgacgcgtcaagtgcctctaccggacacgctacgccactgcatgtaacatcccccagttctgccagtacaggcgatactacaccagtgcccgttaccgacacatccagcgttagcacaggtcacgcaacacccttaccagtgactggtttgtccagcgcaagcacgggggataccacgcgactaccagtaacagatatctcgtccgccagtaccggacaggcaaccccattacctgtcacaaatacatctagtgtgtcaactggagatacaatgcccctgcctgtgacctctccctcttcggcttccacaggtcacgcgactccgctcccggtgacaagcacctctagcgcaagcactggacatgcaacaccagtgccagtcaccagtacctccagtgctagcacagggcataccactcccctacccgtcacggatactagtagcgccagcactggagatactacaccccttcctgtgacttctccctcttccgcctcaacagggcacaccacaccactgcacgtgaccataccctcatctgcgagcacaggagacacttccacactccctgtgaccggggcatctagcgccagcaccgggcacgccactcccctgccagttacagatacctcctccgttagcactgggcatgctactccgctgcccgtgacgtcccttagtagtgtctctaccggtgacacgacaccattacccgtcaccgacgcttctagtgcaagcactggtcaggccacccccctccctgtcacgtcgctctcgtccgtttccactggagatactacccctctcttggtaacggacgcctcatccgtgtccaccggacacgccacacctttaccagtcacagatacatcttcagcttctaccggggataccacgagattacccgtaacagacacctcctcagcctcaaccgggcaggccacacctctgcctgtaacgtcattatccagcgtctctaccggcgacacgactcctctactagtgacagatgcatcatctgtctcaaccggccacgccacaccgttacctgtgaccgatacttctagcgcttctacaggcgacactacccgactgcctgttacagatacctctagtgctagtaccggtcaggctactcccctccctgttactatcccatcctcatcctcgagtgggcacaccactcccctaccagtcacgtccacatcgagcgtgtctacaggccatgtgacacccctgcacgtgacatcaccttcatccgcctcaactggccatgtgacccccctgcctgtgaccagcactagttctgctagtactggccacgctactccattgctagttaccgacgcttcatctgtaagcacagggcacgcaacaccactgccagtgacagacgcatccagcgcaagtaccggcgacacaacaccgctgcctgtcactgacacgagctccgcaagcacgggccaggccacgccgctccccgtcacgtcgctttctagcgttagtaccggagacaccaccccactccccgtgaccgatgctagttcggcctccacgggccatgccacgcctctcccggtcacaataccatcctctgtgagtaccggagacacgatgcctctgccagtaacatcaccatcttcagcctcgaccggacatgctacacccctgccagtcactggtctcagttctgcaagcaccggggataccaccccacttcctgtgacagacacttcttctgcatcaacacgccacgccacccctttaccagtcacagatacttcaagtgcatcaacagatgacacaacacggttacctgtcacggatgtgagctcggcatcaacaggacatgctacccctctgccagtgacttccaccagctccgcaagcaccggagacactacccccctcccagtcacggacacaagttctgtttctactggccatgctacctcgttaccggtgacctctcgctcttccgcaagcaccggtcatgcgacgcccctgccagtgaccgacacaagctcagttagtactggacacgccactcctctccctgtcacgagtacatcctccgtcagcactggacacgccaccccacttccagtcaccagtccttcgtcagcctccaccggccatgccacaccggtcccagttacatccacttcgtcagccagcactggggacaccactcctttacccgttaccaacgcctccagcctatccacgggccacgcaacacctctccacgtaaccagtccttcgagtgccagtcgcggagacacctccacgctgcccgtaacagatgcgtcaagcgccagcacaggacatgcaactccacttcccctgacaagtctgagtagtgtctcaacaggagacaccacccctctccccgtgaccgacacctcctctgcgagcactgggcaggcaactcctctgcccgtgaccagcctgtctagcgtgagcacgggggacacaacaccattaccagtgaccattccttcttctgcaagcagcggccacactacttccctacctgtgaccgatgcatcttccgtctcaacaggccatggcacccctcttcccgtaacatccacatccagcgcctcaaccggcgacaccactcctctccccgtcacagacactagctctgccagcaccggtcacgcgactcccttgcctgttaccgacacctcctccgcatccaccggccacgcaactccacttcccgtgacaagcttgagctcagtgtccacaggacacgccacccctttagccgtgagcagcgccacctcagcatcaactgtgtcctcagactcaccactgaaaatggaaacacccggcatgactaccccttcactcaagactgacggggggagaagaactgccactagcccaccccccactactagccaaacaatcatctccaccattcccagcacagccatgcacacaagatctacagcggcccccattccaatcctgccagagagaggagtaagtctcttcccttacggcgctggcgccggcgatctagagtttgtgcgccgaactgtagattttactagcccactgtttaaaccagcaaccgggttcccgcttggaagttccctgcgagattccctgtattttacagacaacgggcagatcattttcccagagagcgactaccagatttttagttaccccaatccactccccaccgggttcaccggacgagacccagtggccttagttgccccattttgggatgacgcggatttttccaccggccggggaacaaccttctatcaatctaacacataccaagcgatcctatcaaccgacgggagccgcagttatgcactgtttctgtatcagagcggaggaatgcagtgggacgttgctcagcggtccggtaaccctgtgctcatgggattttcttccggagacggctactttgaaaattcaccactcatgagccagcccgtgtgggaacgatacagacctgaccgctttctcaactccaattcaggattacagggactccagttctatagactccacagggaggagaggccaaactacaggcttgaatgcctccagtggctgaaaagtcagccgcgctggccaagctgggggtggaatcaggtgtcttgtccttgctcctggcagcaagggaggcgcgatttgagatttcagccggtctctatcggcaggtggggtctgggctcacgacagctgtgtagctttactagctggcggggaggggtgtgctgcagctatggcccctggggagaattccgagagggatggcatgtgcagaggccttggcagttggcacaagaactggagccccagagctggtgttgtagatggaacgacaagccctacctgtgcgcactctaccagcagagacgaccccatgtgggatgtgctacatacaggcctcctcagcccgcatggatgttcggagaccctcacatcaccactttagatggggttagctataccttcaacggcctcggggacttcttgcttgttggagctcaagatggaaatagttccttcttgctgcaggggcgaaccgcccagaccgggtccgcccaggctactaattttattgcctttgctgcacagtacagatcgagcagcctgggtccagtgaccgtgcaatggctcctggagcctcacgatgccatccgggtgctgcttgataaccagactgttacattccagcctgaccacgaagacgggggtggacaagagacatttaacgctaccggagtgttactgtctcgaaatggaagcgaagtttctgcatcatttgacgggtgggcgacggtttcagtcatagccctgtcaaacatcctacatgcgagtgcaagcttgcctccagaataccagaaccggactgaagggctgctgggagtgtggaataataaccctgaagacgacttccgcatgcctaatggttccacaatccccccgggaagtcctgaggaaatgctgtttcattttggaatgacatggcaaataaatgggaccggcttgttgggaaagcgcaacgaccaactgccttcgaactttacccccgtcttctattcccaactgcagaagaattctagctgggccgagcatctcatttcaaattgtgacggcgacagctcttgtatctacgatacacttgccctgagaaacgcatccataggcctgcacaccagagaagtcagcaaaaattatgagcaagccaacgctaccctcaaccagtatccacccagtattaatggtgggcgcgtcattgaggcatataagggacaaactacactgatacagtacacaagtaatgccgaagatgccaacttcacgttgcgggatagctgcactgatctagagcttttcgagaacggcaccctgctgtggacgcccaagtctctcgagccatttaccctcgaaatcttggctaggtcagccaagattggcctcgctagtgccctccagccgcggaccgtagtatgccactgcaatgcagagtcacagtgtctgtacaaccagacaagtcgagtaggaaattcaagcttagaggtggccggctgtaaatgcgatggaggcaccttcggacgatactgcgaggggagtgaggatgcctgcgaagagccctgctttcctagcgtccattgcgtccccggcaaggggtgcgaagcttgcccccctaacctcactggggatgggcggcactgcgccgcattgggctcatccttcttgtgccaaaatcagtcttgcccggttaattattgctacaatcaaggacactgttatatcagccagaccctgggctgccaacccatgtgcacctgccccccagcatttaccgacagcaggtgcttcttggcaggcaataacttcagtccaacagtaaatttagaactccccctgagagttatccagctgttgctatcagaggaagaaaatgcctctatggctgaagtaaacgccagcgtagcatatagactcgggacactggatatgcgtgcctttcttcgaaacagccaggtcgaacgcatcgattccgctgctcccgcgtctgggagtcctattcagcattggatggtaattagtgagtttcaataccggccacgcggacccgtcattgacttcttaaataaccaactgctcgctgctgtggtcgaggctttcttgtaccacgtgcccaggagaagcgaagagccaagaaacgatgtggtgtttcaaccaatatctggggaggatgtcagggatgtgactgccttaaacgtttctaccctaaaggcttatttccgatgcgatggatacaagggatatgatttagtgtacagccctcagagcggttttacatgtgtttctccttgtagcaggggctattgtgaccacggaggacagtgtcagcatctcccctccggaccaagatgttcttgtgtgagcttcagcatctacaccgcctggggcgaacactgcgaacacctaagcatgaagttagatgctttttttggaattttttttggggcactgggggggttgctcctgctgggagttggcacttttgtagtgttgaggttttggggttgttccggggcaagattttcctacttcctgaatagtgctgaagccctgccgtag

SEQ ID NO: 195730 - DNA, 1863 bp, Artificial Sequence
  Description of Artificial Sequence: Synthetic coding sequence
atgagcgtgggccggcggaagctggccctgctgtgggccctggccctcgcgcttgcttgcacacgacatacagggcacgcccaggacggttcatccgaatctagctacaagcatcatcccgcactatctcccattgcccgcggcccctccggcgtgccactcagaggggcaactgttttcccttctctcaggaccattcccgtggtgcgggcttccaatcccgctcacaatggacgtgtctgttccacctgggggtcctttcactataaaacgtttgatggcgatgtgttcagatttcctggactctgcaactatgtcttttcagagcattgtggcgcggcatatgaggactttaaccccgctactccacaacctggcgtcagcggacctcatgcggagcagggtcctcacgagggagggtggagaggacatccagccgaccaggggctgcgtcctggtcagagaccgccaggcccggcagccctgcagcccgtctggggtccccatagtcgggcggcggccacccccagatggagacccgggtgggccctcagcagttgcggcaccacaatgactgcctgctgttggctcgatacaaagtacgctaataaattgtgggccctgtggggactacagagggacgctcggggacagcgcgcacctctgccccagcatcaggctgacacgcatggcattcgcgagcctgcaagatggacgactcctagatcatccgtgcggaccctctcacttaaccctaggggcaccgcccccctggctctgggtatttgcgaggagctcctccacggccaactattttcaggctgcgtcgcgctggtggatgtgggcagctatctggaggcttgcaggcaagatttatgcttctgcgaggatactgacctactgtcgtgtgtgtgtcacactttggccgagtatagcaggcagtgcacacacgccgggggattgcctcaggactggagaggccccgatttttgcccccaaaaatgccctaacaatatgcaataccacgagtgcagaagcccatgcgctgacacctgttccaaccaggagcattctcgagcctgtgaggaccactgcgtcgctggatgcttctgcccagagggtactgtcctggatgacatcggtcagactggctgcgtacccgtctctaagtgcgcctgcgtctataacggcgctgcttatgcccccggcgccacatactccaccgactgcaccaactgcacctgctctgggggtcgatggagctgccaagaagtaccctgccctggaacctgctctgttctgggcggagcgcatttttccacatttgacggtaagcaatacaccgtgcacggcgattgttcctacgtcctgaccaaaccctgcgacagtagtgctttcaccgttctggcagaactgagaagatgtgggttaactgattccgagacctgtctgaaaagcgtgaccctcagcttggatggcgtgcaaaccgtggtggtaattaaagcgtccggagaggtctttttgaaccagatatatacacagctgcctattagtgccgcaaatgtgacgatctttaggccgtcaacattcttcattatcgcccagaccagtcttgggctacagctaaatctacagctcgtgcccaccatgcagctctttatgcagctcgctccaaagctgcggggccagacctgcggtctgtgcggaaattttaattccatacaggctgatgatttccgcaccttgtcaggcgtagtcgaggcaactgctgccgctttcttcaatacattcaagacacaagcggcctgtccaaacattagaaatagcttcgaggatccctgtagtctgagcgtggagaattag

SEQ ID NO: 195731 - DNA, 1872 bp, Artificial Sequence
  Description of Artificial Sequence: Synthetic coding sequence
atgagcgtgggccggcggaagctggccctgctgtgggccctggccttagccttggcctgcacaagacataccggccacgcccaggacgggtccagcgagagtagctataaacatcatcccgctttatccccgattgcccgcggccccagtggggtgcccttacgtggagctacggttttccccagccttcgaactattcccgtggttagagcatccaatcccgcccataacggacgcgtgtgtagcacatgggggagctttcactacaaaaccttcgatggagacgtgttccgctttcccggcttatgcaattacgtttttagcgagcattgcggcgctgcctatgaagactttaatatccagctgagacgttcccaggaatccgcagccccaactctcagccgggtactcatgaaggtggacggcgtcgtaatacagctgactaaaggctccgtgcttgttaacgggcatcccgtcctgctgcctttctcacagtccggggtcctgattcagcagtcttcatcctacacgaaagttgaggcacgcctgggtctagttctgatgtggaatcacgacgacagcctgctgctggaattggacactaaatacgctaataagacatgcggactgtgtggtgacttcaacgggatgcccgtcgtgagcgaactgttgtcacataacacaaaactcacccctatggaattcgggaatctgcagaaaatggacgatccaaccgaacagtgccaagatccagtgccggaaccgcccaggaattgttcgactggctttggaatctgcgaagaactcctccatggccagctgttcagtggttgcgttgctcttgtggacgtggggtcgtatctggaggcctgtcggcaggacctctgtttctgcgaagacactgatttgctgtcgtgcgtctgccatacactggccgaatatagtaggcagtgcacccatgctgggggtctccctcaggattggcggggccctgacttttgtcctcagaagtgcccaaataacatgcagtatcacgaatgtcgttcaccatgcgccgatacatgcagtaaccaggagcatagccgcgcatgtgaggatcactgtgtggccggatgcttctgcccggagggaacggtcctggatgatatcggccagacaggatgcgtgcccgtgtcgaagtgcgcatgcgtgtataacggggctgcctacgcaccaggggccacttatagcaccgattgcacaaactgtacttgcagtgggggaagatggagctgccaggaagtcccttgtcctggtacctgtagtgtgctcgggggagcacacttttctaccttcgacggcaagcagtacacggttcacggtgattgctcttacgtgcttacgaagccatgcgactcgtctgcatttacagtccttgcagagctgcgacgatgcggcctgaccgattctgaaacctgcctcaagtccgtcacgctgtccttggatggggtccagactgtggtcgttatcaaagcatcgggcgaggtgtttttaaaccaaatttatacacagctacctattagtgccgctaatgtgaccatcttccgccccagtacttttttcatcatagcccagaccagtctgggtttgcagttgaacctccaactggtgcccacaatgcagctgtttatgcagctggcccctaaattacgcggtcagacctgcgggctttgcggtaatttcaacagcatccaggcagatgattttcgcacgctgagcggagtcgtggaggccaccgcggctgctttctttaatacgttcaagacccaagcagcatgtcccaacatcagaaactcttttgaggatccttgttctctctcagtggaaaattag

SEQ ID NO: 195732 - DNA, 17121 bp, Artificial Sequence
  Description of Artificial Sequence: Synthetic coding sequence
atgggcgcccccagcgcctgccggaccctggtgctggccctggccgccatgctggtggtaccacaggccgagactcaggggcccgtagaaccttcctgggagaacgcaggccacaccatggacggaggcgccccaactagcagcccaacacgacgggtttcatttgtccccccggtcaccgtgtttccatctttaagccccttgaatcctgcacataacgggcgggtgtgtagcacctggggagactttcattacaaaacgttcgatggggatgtgttcagatttcccggcctctgcaattatgtgttcagcgagcactgccgtgctgcctacgaagacttcaatgtccaactgcgaagagggttggtggggtcccggcccgttgtcacccgggtcgtgattaaggcccaggggctggtactggaagcaagtaacggaagcgtgctaattaacgggcagcgcgaagagctgccttactctagaaccggactgctggtggagcagagtggagattacatcaaagtgtctattcgtctggtcctgacttttctgtggaatggggaggacagcgcattgctcgaactggatccaaagtatgccaaccagacctgtgggctctgtggcgacttcaacggcctgcccgcttttaatgagttctatgcacacaatgctaggctcacccctctgcagttcgggaacctgcagaagttagacgggcctactgaacagtgccctgaccccctccctctgccggcaggaaattgcaccgatgaagagggcatctgtcataggaccttactgggccccgcattcgccgagtgtcacgctctggtcgactcaactgcttatctggccgcttgcgctcaggacctgtgtagatgtcctacttgtccatgtgcaacattcgtagagtatagccgtcagtgtgctcatgccggtgggcagccgagaaactggcggtgccccgagctctgtccccgaacatgccctctgaacatgcagcatcaggaatgtggatccccgtgtacagatacctgttccaatccccaacgggcacagctgtgtgaggaccactgcgtcgacggatgtttctgtcctccgggatccactgttctggatgatataacccacagcggatgtcttccactcgggcagtgcccatgtacccacggtggcaggacctatagccccggcacctccttcaacacaacatgctctagctgcacctgcagcggagggttgtggcagtgccaggacctgccttgccccggaacatgcagtgtccaaggaggggctcacatcagcacctatgatgaaaagctatacgacttgcatggcgattgttcttacgtgctctccaagaagtgcgccgattcttcttttactgtcttggccgaacttagaaagtgcggtctgacggacaacgaaaactgccttaaagccgttaccctaagcctggacggcggtgatacagccatacgcgtgcaggcagacggaggcgtttttcttaacagcatctatacacaactcccattatctgctgccaatatcaccctcttcactccatctagtttctttatcgtggtgcaaaccggactgggcctccagctgctagtccagctggtgccattaatgcaggtcttcgtgcgccttgacccagctcaccagggccagatgtgcggactttgtgggaatttcaaccagaaccaggcagacgatttcaccgcactgagtggcgtggtcgaggcaacaggagccgctttcgcaaatacatggaaggcacaagcggcttgtgccaatgccaggaattcattcgaggacccatgcagtctcagcgtagaaaatgagaattacgcacggcactggtgcagcaggctaactgaccccaattccgcattctcacgctgtcatagtattattaaccccaaaccatttcattcaaattgtatgttcgatacgtgtaactgtgaacgctccgaggactgtctctgtgccgcccttagcagctatgttcacgcttgtgcagctaaaggggtccagctgagtgattggcgtgatggggtgtgtaccaaatatatgcaaaactgccccaagtcccagaggtacgcatacgtggtagacgcatgtcaacctacctgcaggggcctctctgaagctgatgtcacttgctctgtctctttcgtgccggttgacgggtgtacgtgtcccgctgggaccttccttaatgatgcgggagcctgcgtacccgcgcaggagtgcccatgctacgctcatggtactgtccttgcacctggggaggtggtgcacgatgaaggtgcagtctgttcctgcacaggcggtaagctgtcatgcctgggggcctcactgcaaaaatcaaccggttgcgccgccccaatggtgtatctagattgctctaacagcagtgcaggtactccaggcgccgaatgcctgcgctcatgtcatactctggatgtcggctgcttttcaacacactgcgtgagcggatgcgtgtgtcctcctggcttggtgtccgacgggagcggtggatgcatcgctgaggaggattgcccatgtgttcataacgaggcaacatataaaccgggtgagactatccgcgtggactgtaatacctgtacttgtcgtaataggagatgggagtgcagtcacaggctgtgcctaggaacctgtgtggcttacggggacggccacttcataacatttgatggtgacaggtactcttttgagggctcctgcgagtatattctggcccaggattattgtggcgataataccacccacgggactttcaggatcgtgactgaaaatattccgtgcggcactaccggtacaacatgttcaaaagccattaaattatttgtagagagttatgaactgatcctgcaggagggtacttttaaggctgtagctcggggtccgggcggggatcccccttacaagattcgttacatgggcatatttctcgttatagagacacacggtatggctgtgtcttgggaccgaaagacttctgtgttcatacggctccaccaggactataagggacgagtgtgtggactgtgcggcaacttcgacgataacgccatcaatgattttgcgactcgctccagatccgtagtcggtgatgcccttgagttcgggaacagctggaaactcagtcctagttgtcccgatgcactcgcccccaaagacccttgcactgccaaccccttcagaaagagttgggcccaaaagcagtgctcaatcctgcacggacccaccttcgccgcatgtcgcagccaggtggactctaccaaatactatgaggcatgcgtgaacgacgcgtgcgcgtgcgatagtggaggcgattgtgagtgcttctgtacagcggtggcagcgtacgcgcaggcttgccacgacgccggcctgtgtgtttcgtggcggaccccggacacttgtccactgttttgcgacttttacaatccgcacggcgggtgcgaatggcactatcagccttgcggtgccccttgccttaaaacctgccgaaatcccagcggccactgcctggtggatttaccaggcctggagggctgctaccctaaatgtccaccgtcgcaacctttttttaacgaggaccagatgaagtgtgtggcccagtgcgggtgttacgataaagacggaaactattatgatgtaggtgccagggtgcccaccgctgagaattgccagagctgcaactgcaccccatctggcattcagtgcgctcattccctggaggcatgtacttgtacttatgaagaccgtacttattcctatcaggacgtcatctacaacactaccgacgggctcggcgcttgccttatcgccatctgcggctccaacggaaccattataaggaaagccgtggcctgtcctggaacaccggcaaccacccctttcactttcactaccgcctgggtcccacactcaaccacatctccagcacttccagtgagcactgtatgtgttcgggaggtttgtagatggagctcatggtataatggccataggccggaaccaggtctcggaggcggcgattttgagacctttgagaacttgcgccagcgagggtaccaggtatgcccagtgctcgccgacatcgaatgccgagccgcacagttgccagatatgcctctggaggaactggggcagcaagttgattgtgaccgtatgcgcggcttgatgtgcgctaactcgcaacagagtcccccactgtgtcatgattatgagctaagagtactgtgttgtgagtatgtgccctgtggccctagccccgcccccggcacgagcccccagccctctctgagtgcttctaccgaacccgccgttcccactccaactcagaccacagcaaccgagaagactacactttgggtgacacctagcattcgcagcactgccgccctcacttcccagaccgggtcctcttccggcccggtgacagtgaccccttccgcgcccggcacgacgacctgccagcctaggtgtcagtggaccgaatggttcgatgaggactatcctaaaagcgagcagctgggaggcgacgtagagtcttacgacaaaattagggccgcgggaggccatctctgccagcagcctaaagacatcgagtgccaggccgaaagcttccctaattggaccctggcgcaggtggggcagaaagttcattgcgatgtccatttcggcttagtgtgtaggaactgggagcaggaaggggtgtttaagatgtgttacaactaccgaattcgagtgctatgttgctccgatgaccactgccgcggcagggccacaactccaccccctaccaccgaactagagacagccacaaccacaactactcaggcacttttttctaccccacaaccaaccagttctccaggactgactcgtgcaccccctgccagcacgacagccgtccctactctgtccgaggggttaacttcgccccgttatacatctacccttgggaccgccaccaccgggggacctaccacacccgcagggagcacagaacctacagtgcctggagtagccacatccaccctgcccacacgctctgcattgcccggaaccactggaagcctgggcacctggagaccttctcagcctcctacactggcacctactacaatggctacatcccgcgcgaggcccacaggtaccgctagtaccgcctctaaggagcctttaactacttctttagcccccacgttaactagcgaactcagcacctcacaagcagaaacgtccaccccacggacagagaccactatgtcacccctgactaatactaccacaagccaaggtacgacccgctgccagcctaagtgtgagtggacagaatggtttgatgttgacttccctacatccggtgtagctggcggcgacatggagacctttgaaaatattagggctgcaggaggcaaaatgtgttgggcaccaaagtctatcgaatgccgcgcggagaactatcccgaagtctcgatcgaccaggtaggccaggtactgacttgctcattagagacgggcctgacttgcaagaatgaagaccagaccgggcgattcaatatgtgctttaactacaacgttagagtgctctgctgcgatgactattctcactgcccttctactcccgccacaagttctacagccaccccttcctccacaccaggcacaacatggattctgacaaagccgactactaccgccactacgacagcctctactgggtcaactgccaccccaacatctacactgaggactgctccgcccccgaaagtgctgactacgactgccactacccccacggtcacctccagtaaggcaacccctagcagttcacctggcaccgcgactgctttgcctgccttacgttcaactgctactaccccgacagccactagcgtgacccccatcccgagcagctctctggggacaacctggacccggttaagccaaactaccactccaactgccacaatgtctacggcaaccccctcctcaacacccgaaactgctcacacctctaccgtgctgaccgcgaccgctactactacaggcgccacaggcagtgttgccaccccatcttctacgcctggaacagcacacaccactaaggtgccaactacgactacaactgggtttactgctacaccctctagcagccccggcactgccctgacaccccccgtttggatttctaccacgaccacccccacaaccagagggtcaaccgtcacaccctcaagcatccccggtacaacccataccgccaccgtcttgactacgacaacaaccacagtggcaacaggatcgatggccaccccttctagtagcacgcagacgagcggcacaccaccctccctgaccaccaccgcaacaactattacagctaccggctctaccaccaacccatcctctaccccaggcaccacaccaatcccccctgtgctaaccaccacggccactacgcccgctgccacctccaacacagtcacacccagctcagccttggggacaacacataccccacccgttcccaatactatggcaacaactcacggaagatctctgcccccttcgagtccacacactgtcagaactgcctggacttcagccacaagcggcattttagggactacacacattaccgaacctagcaccgtaacctcacacacactggccgcgactaccggtaccactcagcattctacgcctgcgctgtccagtccacacccttcatctcggaccaccgagagcccaccttctccgggaacaaccacacccggtcacactactgccactagtcggaccaccgctacagcaaccccgagtaagactagaacatcaaccctgctgccttcttcgccaacatccgcgccgatcactacagttgtgaccatgggctgtgagccgcagtgtgcatggagcgaatggctcgattactcttaccccatgccaggcccttcagggggggacttcgatacctatagcaacatccgagccgccgggggcgctgtatgtgaacagcccctgggtctcgagtgtagggcccaggcacagcccggcgttccattgcgggagctgggccaggtggttgaatgctctctggactttgggctagtgtgcagaaaccgcgagcaggttggcaagtttaaaatgtgttttaactacgagattagagtgttttgctgcaattacgggcattgcccttccactccagcaacttctagtacagccatgccctcgtctacacctgggacaacttggattttgactgagctgacaaccacagccaccactaccgagtcaacaggctctaccgccacaccttcatccacacctgccactgcgggcactccccacgtgtctaccactgccaccacgccgactgtgacatcgagtaaggccacacccttcagctccccagggactgcgactgcactaccagcactcaggtcaacagctaccactccaactgctacaagtttcactgcgatcccctcttcatcactgggcaccacctggaccaggctaagtcagactactacccctacagctaccatgtcaacggcgactccaagttctacacctgagaccgttcacacctctaccgtgctgaccaccacagcaactacaacaggcgccacgggtagcgtggcaacaccctcgagcacaccgggcacagcccacaccaccaaagtgctgactaccactaccaccggcttcacagcgacccccagttcttcccccggaaccgccaggacgcttcccgtgtggatttcaaccacaactacaccaactaccagaggctccaccgtgacacccagctccataccggggacaacccatactccgactgtcctaacaactactacaaccactgtcgcgaccggctctatggctactccctcaagctcaacacaaacctctggaacacctccctctctcacaaccaccgctaccaccattacagcaactggctctacaaccaacccctcatctacccccggcaccaccccaatccctccagtgctcacgactaccgcaactacacccgcggctactagctccaccgttactccctcatccgcactcggcactacccacaccccacctgtcccaaacaccacagccaccactcacggcagaagcctctcgccatcctctcctcatacagttcggaccgcctggacttcagccacgagcggcacgctaggtaccacccacattaccgagccttctacaggcaccagccacactcctgctgccacaaccggcactacacagcacagcacccctgcactcagcagtcctcacccctctagcagaaccacagagagcccccctagccctggcacaactacccccggccacacacgcgctactagccgaaccaccgctaccgctactccttctaaaaccagaaccagcacgcttcttccctcctcacctacgtccgcaccaattacaactgttgtgacgatgggctgcgaaccgcagtgtgcctggagcgagtggcttgactactcgtaccccatgccaggacctagcggtggtgatttcgacacatactctaacattcgcgccgccggaggtgctgtctgtgagcaacctctagggctggagtgtagagctcaggcccagcctggcgtgcccctgcgggaactggggcaagttgttgagtgttccctggatttcggactggtttgtagaaatcgagagcaggtcggaaaatttaagatgtgttttaactatgagatccgggttttttgttgcaactatggacactgcccctccacccctgctacatctagcacagcaactccctccagcacacccggcacaacttggatactcaccgaacagactactgccgccactaccacggccacaacgggcagcacagccatccccagctcgacaccgggaaccgctcctccacctaaggttctcacttccaccgccaccaccccaaccgccacctcaagtaaagccacaagttcatccagtcccaggactgctaccactctccccgttcttacttctacggccaccaaaagcaccgccacttcctttacacctattccaagctttacactgggcacaaccgggaccctaccggagcagacaactacacctatggctaccatgagcactattcatccctccagcacccctgagactactcatacctctaccgtgttgaccactaaggccacgacaactcgggctacatcttcaatgtccacacctagtagcacccccgggactacttggatcctgactgagctcaccactgccgctacgaccaccgcagctacaggccccacagccacgccaagttccacccctgggacgacctggattttgacagaaccctccaccaccgcaacagtgaccgtccccacaggatctacagccaccgccagtagcacccgcgccaccgccggtacactcaaagtgctgacctccaccgctacaacacccaccgttatttcctctcgggccacccccagcagttcccccggaacagccactgcgttgccggctctcaggtccacggcgaccacacccactgccactagcgtcactgccattccatccagtagtctcggaactgcttggactaggctgtctcaaaccaccaccccaaccgccaccatgtcgacagccactccttcttctacaccggagacggtccatacctccacggtactgacaactacgaccacaaccaccagggccactggcagtgtagctacgccttccagcaccccaggaacggcacatacgacaaaggtgccgacaacaacaaccactggttttacggctactccatcgtctagccccggaactgcactgaccccacccgtgtggatttctactactaccacccctacgacaagggggagcactgtcacgccaagctccatacctgggactacccacacggccactgttcttacaactacgaccacaaccgtcgctacagggtcaatggccaccccatcctcctccacccagacctccggcactccacccagcttgaccacaacagcaacaaccattacggccacaggctcaacaaccaaccccagcagtacacccggcacgacccctatccctcccgtgttgaccacaaccgccacaactcctgcagcaaccagctctaccgtgacccctagctccgccctggggactacccatacacctcccgtgccgaacaccaccgcgactactcacggtaggtccttgcctcccagctcaccccacactgtgcgtactgcgtggaccagcgccacttcggggatactgggcacaacgcatatcacggagccgtcaaccgtgacatcacatacaccggctgctacgacctccactacacagcactccaccccagctctatcatcacctcatccatcttccaggaccacagaatctcccccttcgccaggaaccacaacccctgggcacacaagaggcacgagtagaacaactgcgacagcgaccccaagtaaaacgaggaccagtaccttgttgccatcgtcccccacctcagcacctattaccaccgtggtcaccaccggctgtgagcctcagtgtgcctggagcgagtggttggactattcttatcctatgcctgggccgtccggcggcgattttgatacctattccaatatcagggcagccggaggggcggtgtgcgaacagcccctgggtctagagtgccgagcacaggctcagcccggtgttccacttagggagctgggccaggtcgtggaatgttcattggactttggacttgtctgccgaaaccgtgagcaggtcgggaaattcaagatgtgctttaattatgaaatcagagtgttttgctgcaattatggacattgtccgagcactcccgccacgtccagcacagctactccttcaagcactcctggaactacctggatcctcacgaaactgacaaccactgcaacgaccactgagtccacgggttcaacagccacaccctctagtacacccggtgccactgctggaacccctcacgtttcaaccacagccaccacacccacagttacctccagcaaggccactccattctcctctccaggaaccgctacagcgctccctgcactgcgctctacagccactacaccaaccgctacctcctttacggccatcccaagcagctctttgggcaccacatggacgcggttgagccagacaacaacgcccactgctaccatgtctacagccaccccatcaagcacgccagaaaccgctcatacaagtaccgtgctgacgacaaccgctaccactactagggctacaggttccgtggcaaccccttcaagtacacccggaaccgctcacaccaccaaggttcccactacaacgactaccggatttactgtgaccccgagctcctcgccaggcacggctagaactcctccagtgtggatatcaactactaccactcccacgacctccggtagcacagtgacaccgagttccgtccccggtacaactcacaccccaactgtgctgactaccaccaccactaccgtggctaccggaagtatggccacgccctcttcttctacccagacttcagggactcctccatccctcattacaactgctacaactattaccgccaccggcagcactactaacccaagttccactcctgggacaaccccaatcccccccgtcctgacgacaactgctacaacacctgctgctaccagctcgacagtgacgccaagcagcgccttggggaccacacatacacctccagtgcccaatactacggctaccacccatggaagatctctttcgccctcttcccctcataccgttagaactgcctggacttccgctacctctgggactctggggactacccatatcacggagcctagtactggtacatcccataccccagcagcaacaacaggaacaacgcagcactctacccctgcgctctctagcccgcaccccagttcccggaccaccgaatcgcctcctagcccagggacaacaactcctggccacacgaccgctactagtcgtaccactgctacagcaacaccctccaagactcggacctcaaccttactgccgtccagccctacatccgcaccaattactaccgttgtgacgaccggatgcgagccgcagtgcgcctggagcgaatggctggactactcctatccaatgcctggtcctagcggcggagacttcgacacatactcaaatatcagagcagcaggaggtgccgtctgtgagcagccactgggcctggagtgcagggcccaggcacagccaggggtgcctttgggtgagttgggccaagtggttgaatgttcattagactttggcttggtctgccggaaccgagagcaggtagggaagtttaagatgtgcttcaactacgagatcagagtgttctgctgtaactatggacattgtccatctacccctgccacctcttcgacagctatgccttcttctactcctggcacaacgtggattctgacagagctaacaactacggctaccaccacagcctcaacaggatcaaccgctacaccaagttctactcctggaactgctcctcctccaaaagtattaacctccccagctaccacaccaacagccacatcttcgaaagccacgagctccagttctcccaggaccgctaccacccttccggtcctgacttccactgccaccaaaagtactgcaacctctgtaacgccgattccatctagcaccctcgggacgacaggcactttacctgagcagaccaccacacccgtggctacaatgtctacaattcatcccagtagtacccctgaaaccacccataccagcacagttttgaccacaaaggctaccactacacgggcgaccagcagcacttcaactccctcatctacacctgggaccacttggatccttaccgagctgaccacggctgcaaccaccaccgccgctaccggccccacagccactccctcctctacccccgggaccacctggattctcacggagctgacaacaactgctaccactaccgcatccaccggttcaaccgccaccccgtcgtcgaccccagggactacttggattctgacagagccgtccactactgcaacagtgaccgttcccacgggcagtacggccacagcgtcgagtacacaggcgactgccggcaccccccatgtgtccacgaccgccaccaccccaacagtgacctcctccaaggctacaccaagctcttcacctgggactgctacagctctgccagccttgaggtctacagccaccacgccaacagcaacctcattcaccgcaataccatcatcttcgttaggcactacgtggacccgcttgagccagaccacaacacccacggcaaccatgagcactgcgacgccttcctctactccagagaccgttcatacgagcactgtattaactgccaccgccacaacgactggcgcaaccggtagcgtcgccacacccagctcaacacccggaactgcccataccaccaaggtgccaactaccacaaccacgggctttactgcaacaccctcgagttctccaggcacagcactgactccaccagtgtggatctcaaccaccactactcccacgacaacaacccccactacgagcgggtctaccgtcacacctagcagcatcccaggtaccacacacaccgcaagggttctgacaaccactactacaaccgtggccaccggctctatggccaccccaagtagctcaacacaaactagcggtaccccacccagcctcacaacaaccgccaccaccattaccgcaacaggctccacaactaatccatcttcgaccccaggcacaacccctataacgcctgtgctcacttcgaccgcaactacacctgctgccactagttccaaagctacgtccagctcctcaccccgcaccgccactactctgcctgtgctcaccagcactgctacaaagtccactgctaccagtttcacgccaataccctcctccacattatggaccacttggaccgtccctgctcagaccaccacacccatgtctacaatgtccacaatccacacatcatctactcccgagacaacacatacctccactgtgctaactaccactgccaccatgactcgcgcgaccaattcaaccgcaaccccatcatccacattgggtacgacaaggatattgactgaactgacaactaccgcaactacgacagcagcgactgggagtacggccactctgtctagcacgcctgggaccacctggatactcacagaacccagtactatcgccactgtgatggtgccaaccggttctaccgccactgcttcgtctactttgggaactgctcacacgccaaaggtcgtcacgaccatggctacgatgccgactgcaactgcctccaccgtcccctccagctccacggtaggcactacgcggacccccgctgtgcttccgtcatccctccctacattctccgtgagcacggtgagcagtagcgtactgacgactctacgccccaccggcttcccatcttcccatttttccacaccctgcttctgccgcgcttttggacagtttttcagtccgggagaggttatctataataagactgaccgagccggatgtcacttctacgctgtctgtaatcagcactgcgacatcgacaggttccagggggcctgtcctacatctccgcctcctgttagcagcgcccctctgtcctcaccatccccagctcccggttgtgataacgccatcccattaagacaggtgaacgaaacgtggactctggagaactgcacggtggctagatgcgtgggagacaatagagtagtgctgctcgatcccaaacctgtggcaaacgtcacctgtgtgaataaacatcttcctatcaaagtgagcgatccctcacaaccctgtgactttcattatgaatgtgaatgtatctgctccatgtggggcggatcccattactccacttttgacggcacaagttacacctttcgcggcaattgcacgtatgtgttgatgagagaaatacacgcacgcttcggaaacttgagcctgtacttggataaccattattgcacggcctctgctactgccgctgcggccaggtgtccccgcgcccttagcatacactacaagagcatggacatcgtacttacagtgacgatggtccatggcaaagaagaaggcttgatcctgtttgaccagatacctgttagtagtggttttagcaagaacggtgtgctcgtgtccgtgctgggaactaccacaatgcgcgttgatatcccagccctgggggtgtcggtcacttttaatgggcaggtcttccaggcgaggctgccgtactcactcttccacaacaacactgaaggtcaatgtgggacctgtactaataaccagcgggatgactgcttgcagagagacggtacgaccgctgcatcttgcaaagacatggccaaaacctggctagtgcctgactctcgtaaagatggttgctgggcacccaccggcaccccgcccacggctagtcctgcagcacccgtgagttcaactccaacgcctaccccctgccctcctcagcctctctgcgatctgatgttgtcccaggtgttcgctgagtgccataatctggtgcctccaggaccgttcttcaacgcgtgcatttcagatcactgcagaggaagactcgaggttccctgccagtctttggaggcctatgcagagctttgtcgggcacgcggcgtatgtagtgactggcggggagccaccgggggcttgtgtgatcttacctgccccccaaccaaagtatacaaaccctgcggccccattcagcccgccacgtgtaacagccggaaccagagccctcagctggaagggatggctgaagggtgtttttgtccagaggatcaaatcctcttcaatgcacacatggggatttgcgtgcaggcctgtccgtgcgtcggaccagacggctttcccaaattccctggcgaacgctgggtgagtaattgtcagtcttgtgtctgtgacgagggatccgtgtcagtgcaatgcaaaccacttccatgcgacgctcagggccagccccccccttgcaacagacccgggtttgttaccgtgacgcgacctcgcgcagagaatccctgttgcccggaaactgtgtgtgtgtgtaacaccacgacctgcccccaaagtctcccagtgtgtccacctgggcaggagtcaatctgcacccaggaagagggagattgttgcccgacatttcgttgccgcccacagctgtgctcctacaacggaaccttctatggagtaggagcaacctttcccggtgccctgccttgccacatgtgcacgtgcctgtcgggggatacccaagatcctacagtgcagtgtcaggaggacgcctgtaataataccacatgtccccagggattcgagtataaaagagtggccggccagtgctgtggagagtgtgttcagacagcttgtctcacacccgatggacagcccgtgcagttaaatgagacctgggtaaatagccatgtggataactgtacagtgtatttgtgcgaggcagaaggcggtgtgcaccttctgacaccccaacccgcctcatgccctgatgtaagttcgtgtcggggtagcttgcgcaagaccggctgctgttactcttgcgaagaggactcttgccaagtccggattaatacaacaatcttatggcatcagggttgcgaaaccgaagtaaacattaccttctgcgaagggtcatgccccggagcctccaagtacagcgcggaagcacaggcaatgcagcaccagtgcacctgctgtcaggagcgacgagtccacgaagagacagtaccactccattgtccaaatggctctgcgatcctgcacacctatacgcatgtggatgagtgtggatgcaccccattttgtgtccccgctcccatggctcctccacacacccggggatttcccgcacaagaggctaccgctgtgtag

SEQ ID NO: 195733 - DNA, 16587 bp, Artificial Sequence
  Description of Artificial Sequence: Synthetic coding sequence
gccccccggatgggcgcccccagcgcctgccggaccctggtgctggcacttgcagcaatgctcgttgtcccacaggctggcaaatccccccccctcagaccgctgtccagaaattctggagccggacttgatggtggagcgccaacaagcagccccacaagaagggtcagcttcgtgccacctgtgactgtgtttcctagcctgagccggaagcaaatgcttccgctgccggcgggaaaaggcgtgttcgccagcccaaaggggggagggccagaccttggagttcagctgccccctgcactgaatcctgcccacaatggccgagtgtgcagtacttggggcgatttccactacaaaacatttgatggggatgtcttcagatttccaggcctgtgtaattacgttttttctgagcactgcagggccgcttacgaagatttcaacgtccaattgcgaaggggccttgttggaagcaggcccgtggtgacgcgggtcgtgattaaggcccaaggcctcgttctggaggccagcaacggatccgtgctgatcaatggacaacgcgaagaactcccttactcccggaccggcttactcgtggagcagtctggtgattacataaaagttagcatccggctcgtgctcacgtttctttggaacggagaagattcagcattactggagttggacccaaagtacgccaaccagacttgtggactgtgcggggacttcaacggacttcctgcctttaacgaattctacgctcacaacgcccggctcacccctctccaattcggcaatctccagaagctggacggtcctactgaacagtgccctgaccccctgcccctgccagccggaaactgtacagatgaggagggaatatgtcaccgtacactgttgggccctgccttcgctgaatgtcatgcactcgttgatagcaccgcgtacttggctgcgtgcgctcaggatctctgtagatgccccacttgcccctgtgccacattcgttgagtatagtcgacagtgcgctcacgcgggcggtcagcctagaaattggagatgcccggaactttgccctcgcacctgcccactgaacatgcaacaccaggaatgtggatccccgtgcactgacacttgcagcaacccgcagagagctcagctgtgtgaggaccactgcgtggacggctgcttctgccccccaggacgctcctgcaccgtgttagacgacattacccattcggggtgtttgcctctcgggcaatgtccttgtacgcacggtggccgaacctactctccaggtacttcatttaacacgacatgctcgtcttgtacttgctctgggggactttggcagtgccaggacttaccatgtcctggtacttgttccgtgcagggcggagctcatatctccacgtacgacgagaaactctacgacctgcatggcgactgctcatacgtgctgtccaaaaaatgtgctgattcttcctttacagtgctggccgaactgagaaaatgtggactcactgacaatgaaaattgcttaaaggctgtgaccctttccttggacggcggagacaccgccatccgagtgcaggccgacgggggcgtatttctgaattcaatttacacccagcttccgctgtcagctgctaacattaccctatttaccccgtcatcattctttatcgtggttcagaccggcctcgggctacagctcctggttcagctggtgcccctgatgcaggtgttcgtccgcctggatccagctcatcaaggccagatgtgtggcttgtgcggaaactttaaccaaaatcaagctgatgatttcaccgccctctcgggtgtggtcgaagccaccggtgcagctttcgcgaatacatggaaagcccaggcggcatgtgccaatgctcgcaatagctttgaagacccttgcagcctgtccgtcgaaaacgaaaattatgctaggcattggtgtagccgtttaactgatcctaatagcgcattttccaggtgtcactctatcataaatcctaagcccttccactccaattgcatgttcgatacgtgtaattgcgagcggagcgaggactgtctttgtgccgccctgtcctcatatgtgcatgcgtgcgccgctaaaggggttcaactctccgattggcgggacggagtctgcactaagtacatgcagaactgccccaagagccagcgatatgcatatgtagttgatgcgtgccaacccacctgtcgagggttgtctgaagccgatgtgacttgtagcgttagtttcgtacctgtcgatgggtgtacatgccccgcaggaaccttccttaacgatgcaggagcctgcgtcccagcgcaggaatgcccatgttacgcacatggtacagtgttggcacccggcgaggtggtgcacgacgaaggtgccgtctgcagctgcactggcggcaaactgagttgcctaggtgccagcctgcagaaatccactgggtgcgcagctcctatggtttacctggattgctccaacagttcagctggcaccccaggagcagagtgccttcgctcttgtcacacactcgacgtgggctgcttctccactcattgcgtgtctggttgcgtctgcccccccgggctggtgagcgatgggagcggcggctgtatcgccgaagaagattgtccctgcgtccataacgaggccacctataagcccggagagaccatccgagttgattgcaacacctgtacctgtcgcaacagaagatgggagtgcagccatcgtctgtgtctcgggacctgcgttgcgtacggggatggccactttatcaccttcgacggtgatagatactcctttgagggctcatgtgagtatattctggcacaagactactgcggcgacaatacgacgcatggaactttcagaatcgtcacagagaatatcccgtgtgggactaccggcactacttgttcgaaagctataaagttgttcgtcgaggttcgaactgccccggctgtgagcaccccggatccagcggctaatgagccagccccccgtgaggcttctgtgggctttcggcagaggctgccacctctccagagctacgagctcattctgcaggaagggaccttcaaggcagtggctcgcggacctggcggagacccgccgtacaaaatccgctacatggggatctttctcgtgattgagacgcacgggatggcggtgtcgtgggatagaaagacatctgtgttcattcgtctgcatcaggattacaagggcagagtgtgcggtctttgtggcaactttgatgacaacgccattaatgattttgcgacacgtagtagaagtgtcgtgggagacgccctggaatttggcaacagctggaaactgtctcccagctgtcccgatgccctagccccgaaagacccttgcacagccaatccattccgcaagtcgtgggcacagaagcagtgcagtatacttcatggaccgaccttcgcagcgtgccgcagccaggtggactctacaaagtattacgaggcttgtgtgaacgatgcctgtgcttgcgacagcgggggtgactgtgagtgtttttgtacagcagttgcggcctacgcccaagcctgtcatgacgctggactgtgtgtcagctggcggacgcccgatacatgtcctctattttgtgacttttataacccacatggagggtgcgagtggcactatcagccatgcggtgccccgtgtctcaagacgtgcagaaacccatcggggcactgcctggtggatctcccgggtcttgagggctgctatcctaagtgccctccctcccagccattcttcaatgaggaccagatgaagtgcgtggcccagtgtggatgctatgacaaagatggcaactactatgatgttggagctcgggttccaactgccgagaactgccaaagttgcaactgcacacccagtggaattcagtgtgcgcacagcctggaggcatgcacctgtacatatgaggaccgcacttatagttaccaggacgtcatttataacacaacggatgggctgggtgcctgcctgatcgccatatgtgggtctaatggaaccattattagaaaagcagttgcatgccccgggacccctgcaaccactcccttcacatttaccacagcctgggtccctcactccacaacctcccctgcccttccagtatcaacggtctgcgtccgggaagtttgtagatggtcaagctggtataatggtcacagacctgagcccggcctggggggtggggactttgagactttcgaaaacctccgccagcgcgggtatcaagtttgccccgtgttagcagatattgaatgcagagctgcccagctccccgatatgccactcgaagagttgggccagcaagtcgattgcgacagaatgcgtgggttgatgtgcgcaaacagtcagcaaagccctcccctatgtcacgattatgagctccgcgtgctatgttgcgagtacgttccatgtgggcctagcccagcccctggaacctcccctcagccaagcctttcagcgtctacagaaccagccgtccctaccccgactcaaaccacggcaaccgagaagactaccctctgggtgactccgtcaatacggtctaccgccgctctgacaagtcagacaggcagttctagtggacccgtgacggttacgccaagtgcaccgggtaccactacatgtcaaccaaggtgccaatggaccgagtggttcgatgaagactatcccaagtctgaacagcttggtggggatgtggaatcatatgacaaaattcgggcagctggaggccacctgtgtcagcagcccaaggacatagaatgtcaggctgaatccttccctaattggacattagcgcaagtgggccagaaggttcactgcgatgtgcactttggcttggtctgtcgcaattgggagcaagaaggcgtatttaagatgtgctacaattaccgcatccgagtactatgctgctcggacgaccattgcaggggccgcgcaaccacgcctccacctacaaccgagttggaaaccgccactacgaccaccacacaagccctgttctctacaccacagcccacctcctcgccagggcttacccgggcaccaccggcctcgaccaccgcagtgcctacgttaagcgagggactcactagcccacgttacacgagcacgctgggcactgctaccacaggcggccctacaactcctgctgggtcaaccgagcccactgttccaggggtcgcaacctcaacattaccaactcggtccgcattgcctggtaccacaggtagcctggggacttggaggccgagccagccccctaccctggcacccacaacaatggcaacttcacgggcacggcctaccggtaccgcctcaacagcatctaaggaaccactcaccactagcctcgctccaacactgaccagtgagctgtccacatcccaagctgaaaccagcacacctcgcaccgagaccacaatgtctcccctgaccaacactaccacctcccagggcaccactcgctgccagccgaaatgtgaatggacagaatggttcgatgtcgacttccctacgtctggagtcgctggaggagacatggagacctttgaaaacatcagagctgcaggcgggaagatgtgttgggcaccaaagagcattgagtgcagggcagaaaattatcctgaggtttctattgaccaagtggggcaagttctgacctgttcgctggagactggacttacctgtaaaaacgaggaccagacgggtaggttcaacatgtgcttcaattacaacgtgcgcgtgctctgctgtgatgactattctcactgtcctagtactcctgcaacctcctccactgccacaccgtcgagcactcccggcactacatggatcctaaccaagcccaccaccacagctacgactacagccagcactggctcaacagcaacacccacgtccaccctccgtacagcgcctccacccaaggttctcaccactaccgccacgactccgacagtgacttcatcgaaagcaactccgtccagttccccagggacagcaacagcattgccggctctgcggtctaccgctactacgccaacggctacctcggtgactcctattccttccagctccctgggcactacatggaccaggttgtcccagacaaccacacctacagccaccatgtcgaccgcaacccctagttctacccccgaaaccgcacatacatcaaccgttctgaccgcaaccgcaaccacaacaggcgctaccggcagcgttgcaactccaagtagcacccccggtactgcccacacaacgaaggtgcctactactaccactacaggattcacagcgaccccatcaagctcaccaggtacagcgctgaccccacccgtttggatctctactaccactacacccacgacccgggggagcacggtcacaccatcatccattcctgggactacccacactgccacggttttaactactacaacaaccactgttgccacaggatccatggctaccccatcaagcagcacccagacgtctggtacgacacacactcctcctgttcctaatactatggcgaccacacacggcagatcactgccaccatcctcccctcacacagtgcgcactgcgtggacgagtgcaacaagcgggattctggggactacacacataacggagcctagcactgtgacatcacacaccctagcagccactacaggcactactcaacattccactccagccctgtcctctccccatcccagctcaagaacaactgaaagccccccatctcccgggaccacgacacccggacacactactgctacttcccggaccacagcaacagccactcctagtaagacaaggacttccactttgctgccatcttcccccaccagcgccccaatcaccacagtggtaacaatgggttgcgaaccacagtgcgcttggtctgagtggctggactactcctacccgatgccaggaccttcaggaggtgacttcgacacatatagcaacattcgggccgctggaggagctgtctgcgagcagcccctgggtctggaatgtagagcccaggctcagccaggtgtgcccttgagagagctcggccaagtggttgagtgttcccttgactttggactagtgtgtagaaaccgagagcaggtgggtaaatttaagatgtgtttcaattatgagatccgcgtgttctgttgtaattatggacactgcccctctacccccgctacttccagtaccgccatgccatccagtacccccgggactacctggatcctgactgaactgaccaccacagccactaccacagaatcaaccgggagtaccgctaccccttcttccacacctggcacaacctggattctaactgagccttccacgactgccactgtgaccgtcccgacaggctctactgccaccgccagttcaactcaggctacagctgggactccgcatgtgtccaccacagccaccacccccacggtgaccagttcaaaggccacgccattctccagtcccggcaccgctacagcacttccagcactccgtagcaccgccaccacgcccaccgccacttcttttaccgccattccatcctcttctttaggcaccacttggaccagactgagccaaactaccacgcccacagcgacgatgagcacagccacccccagttctaccccagaaacagtgcacacctccaccgttctcaccaccacagctactacaacaggggccacagggagcgtagccacaccctccagtacacctggcactgctcacacaaccaaagtgctcacaacaaccacaaccgggtttaccgcgaccccgtccagttctcctggcacagctcggactctgcctgtctggatcagcaccacgactaccccaacaacccgcggttcaaccgtaactccctcttctatccccgggacgacccacacgcctaccgtgctgactaccaccacaacaacggtcgctaccgggagcatggccactccgagctccagcacacagaccagcggcaccacccacactccgccagtgccaaatactactgcaaccacccatgggaggtctttgtccccttccagccctcataccgtgcgcaccgcatggacttcagccacgtctggcaccctcggtaccacccacattaccgaaccctccaccgggacatcccacacaccagctgctactaccggcactacccagcattcaacccccgccttgtcttcaccccacccgagctcccgaactacagagtcccctccgtcccctggaactaccacacctggtcacacaagagcaacatctcgaacaactgctactgcaaccccaagtaagacgagaacctcaaccctgctgccgtcctccccaaccagcgctcccatcaccaccgtagtcaccatgggctgcgaaccacaatgcgcatggagcgaatggctggactattcctatcccatgcctggtccttctgggggggattttgacacctattccaacattcgggccgcaggaggggccgtgtgcgagcaacccctgggccttgagtgtagggctcaggctcagccaggggtgccactcagggaacttggccaagtagttgagtgctcacttgatttcggcctggtttgtcggaatagggaacaggtggggaagtttaaaatgtgcttcaattatgagatccgagttttctgttgtaattatgggcactgcccctccacaccggcaacgagttctacagctactcctagttccactccaggaacaacttggattttgacagagcagacaacagctgctaccactacagctacgacaggtagcaccgcaattccatcctcaacacctggcaccgcccctcctcccaaggttctgacatccaccgcaaccacccctactgccacatcttccaaggcaacatcctctagctcccccaggacggcgacaacactcccagtccttaccagtaccgctaccaaatctaccgctacttcctttaccccaatcccttcgtttacactgggcaccactggtacactgcctgaacagacaactactccgatggcgaccatgtctacgatccacccttcttccaccccagagactacacataccagcacagttctgaccaccaaggccacaacaactcgcgcaacatcaagcatgagcacaccaagttccactcccggcactacctggatcctaacggagctcacgaccgccgctacaacaacagccgccacaggaccaaccgccaccccctcctcgactcccggtaccacgtggatcctgactgagccaagtacaaccgcaaccgtaacagtgcccactgggagcaccgcaacagcctcttccacccgggcaactgccggaactcttaaagtcctcacctccaccgctaccacacctacggtcatatcctcacgggctactccctcatccagtcccggcaccgccacggccctccctgccctgcgttccaccgccactactcccacagccacttctgtgacggccatcccaagcagttcactcggtaccgcgtggacacgccttagccagactacgacgcctacagctacaatgtctacagcgactcctagtagcacacccgaaacagtgcatacttcgactgtacttacaaccaccactaccactactagggccacagggtcagtggcaacaccatcatcaactcctggtacagcccacaccaccaaagtgcctacaactactactacagggtttaccgcaacgccaagctcaagccctggcactgctctgaccccacccgtttggataagtaccacaactacccctactacacgaggttcaactgtcacccctagcagcatccctgggacaactcatacagctacggtcctgaccacaaccacaaccaccgtggccactggctctatggctaccccctctagctcgacgcagactagcggcaccacacacacaccccctgtgcccaacaccaccgccacaactcacggaaggtcattgcccccaagctcccctcatactgttcgtactgcctggacctcagcgacctcaggcatactgggcacaacccacatcaccgagccgtccactgtcacatcccatacccctgcagccaccacctctacaactcaacacagcaccccggcactgtcctccccacatccctcaagccgcacaaccgaatcgccaccatctccaggcaccaccacaccagggcacacacgtggcacttcgagaactaccgcgactgcaaccccatcaaagacccggaccagcaccctcttaccgagcagcccaactagtgcacccatcaccacggtggtgacaactggctgcgagccacagtgtgcttggtctgagtggctcgattactcataccccatgcccggcccaagcggcggggattttgacacatattcaaacatacgggcagccggtggagcagtctgtgagcagcccttagggctcgagtgccgtgctcaggcacagcccggagtgccgttgagggaattgggacaagtggtcgagtgttcacttgatttcggtctcgtgtgccggaacagagaacaagtgggaaagttcaagatgtgctttaactacgagatccgtgtcttctgctgtaactatgggcattgtccaagcacacccgccacatcatccaccgcaactcccagttccacgcctggtaccacctggatactcacgaaacttaccacgaccgcaactactacagagtctacaggatccactgccactccgtcttctacgcctggcaccacttggattctgacagagccttccaccaccgcaaccgtcaccgtgcccaccgggtctaccgctactgcatccagtacacaggctacagccggcactcctcacgtttctacaacagccacgactccaaccgttacctctagcaaagccacaccatttagtagtcctggcaccgctaccgctctgcctgccctccgctcaactgctaccacccccacagcgacatcgttcaccgccattccatccagctctctgggtaccacatggacaaggttgagccaaaccacaacccccactgccacgatgagcactgccacccccagttccacgcccgagaccgcacacactagtactgtcctaaccacgaccgccaccaccacacgggcaacaggatcagtcgccactccctcttctaccccgggtaccgcccatacaacgaaagtgccaactacaacaacgacaggatttactgtgacgccttcctcttctcccgggaccgctaggacgccgcctgtgtggatatcaactaccaccaccccaactactagcggtagcaccgtcaccccttctagtgttcctggcactacccataccccaaccgtgctcactactactaccactactgtcgcaaccgggtccatggccacaccctcttcaagtactcaaacatctggcaccacgcatacccctccagtccccaataccaccgctaccactcacggcagaagcttgtcaccaagctcccctcacacggtacgcaccgcgtggacaagtgccacatccggtactctggggacaacccatattaccgaacccagcacaggcacttcccatacccctgccgcaactaccgggactacacaacactctacccctgccctgtcatcaccccatccctccagccgaaccacagagagtccaccttcaccaggaacaaccacccccgggcatacaaccgcgacttctagaaccacagcgaccgcaactccctctaagactaggacttccacactcctgccctcctcccccacatctgccccaattaccacagtggtcaccacaggctgcgagccacagtgtgcttggagcgagtggcttgactacagctatcctatgcccgggcctagtgggggcgactttgatacctacagcaacatacgagcagccggcggagccgtgtgcgagcagccattgggtttggagtgtcgggcccaggcccagcccggggtaccattgggcgaattaggccaagtcgtggaatgttctctggatttcggccttgtgtgtcggaaccgcgagcaagtcggtaaattcaaaatgtgcttcaattacgaaatccgggttttttgctgcaactacggacattgtccttccacccccgccaccagctcgaccgcgatgccctcatcaacccctggcacaacctggatcctgacggaactgacgaccaccgcaaccactacagccagtaccggaagcacggctaccccgtctagtactccgggcactgcccctcccccgaaagtgctgacatctccggccaccacccctacagccacctcttctaaagcaacatcgagctcttcaccccgcaccgcaacaacactgccggttctcacgtccacagcaacaaagtcaactgccacttccgtgacacctataccgagttcaacacttggcaccaccgggacgttgcctgagcagaccaccacccccgtcgcaactatgtctacgattcacccaagctccacaccggagaccacgcacacttctacggtactgaccactaaagccacaaccaccagagcaacatcaagcaccagcacccccagttccacacctggcaccacatggatcctgaccgaactgactaccgctgcaaccacaaccgccgctaccggccctacagctacaccttcctctacaccgggcactacgtggatcctgactgagctaactaccacagcaacaaccactgcatcaaccggcagcacagccactccttcttctacccctggtacaacttggatcctaacagagccttctactaccgcaaccgttactgtgccgacaggatccaccgcgactgcctccagcacccaggctaccgctgggacaccacacgtcagcaccaccgctacaaccccaaccgtcacatcttccaaagccactcccagtagttctcctggaacagccacagctctcccagctctgcggagtaccgcaacaacacccacagccaccagtttcaccgccatcccctcgtcctctctgggcaccacctggactcgcttatctcaaactaccacacctactgcaacgatgtccactgccacccctagcagtacacctgagaccgtgcacacctctactgtacttaccgctaccgctacaaccacgggcgcaacaggcagcgttgccactccgtctagtactccgggaactgcccatacgaccaaggttccaaccactaccacaaccgggtttactgcaacaccatcatcctctcccggtacagcgctcacaccccccaccaccacacccatgtctaccatgtcaactatacatacatccagtacccccgaaaccacccacacctccacagtgctcacgacaaccgccaccatgactcgggccaccaattcgacagccacaccgtcttccacgctcggtaccacaaggatactcaccgaactaactaccaccgccactaccaccgctgcgaccggctcgactgctactcttagcagcactcccggtactacctggattctcaccgagccgtccaccattgccacagttatggtgccaaccgggtccactgcgacagcctcatccactctgggcaccgcccatacaccaaaggtcgtgacaaccatggcgacaatgcctaccgctactgcctccaccgtaccaagctcttcaaccgtgggtaccacgaggacacccgcagtgcttccttctagccttcctacgtttagcgtcagcacagtatcttcaagtgtgctcacgaccctgaggcctaccggcttcccctcatctcacttttcaaccccgtgtttctgccgtgccttcggacaattcttcagcccaggcgaagtcatctacaataagacagaccgggctggatgccacttttatgccgtgtgcaatcagcattgtgacatcgaccgctttcagggggcttgtcccacctcacctccgccagtaagtagtgctcccctcagcagcccaagtccagccccgggttgtgacaatgccatcccactccggcaggtgaacgagacatggactctcgagaactgcactgtggctcggtgcgtgggggataaccgggttgtgctgttggatccaaaacctgtggcgaacgttacatgcgtgaacaaacatctacccatcaaagtgagcgatcctagccaaccctgtgactttcactacgaatgtgagtgtgaatgcgttggtggccgcggaatcacaccaggagcgggcatctgctccatgtggggagggtcccattattctacctttgacggcacttcttataccttccgggggaattgtacctatgtgctgatgagagagattcatgcccgatttggcaatctctctctgtatctggataaccactattgcaccgctagtgcgaccgcagctgctgctcggtgtccccgagctctgtctatccattataaaagcatggatatagtcctgaccgttaccatggtccacggtaaagaggagggcctgatcctcttcgaccagattcccgtgtcttcaggctttagtaagaacggggtgttggtgtctgtcttgggtaccacgaccatgcgcgtggacatccctgccctgggcgtgtcggtaaccttcaacggccaggtgttccaagctcgacttccgtactcactctttcataataatacagaaggacagtgtggaacctgcaccaataaccagagggatgactgcttgcaaagagacggcaccacagcggcctcttgtaaggatatggccaagacctggttggtaccagattctaggaaagacggatgttgggctcccaccggtaccccccctaccgcgagccctgcagcccccgtgtcctccactcctactcccactccttgtcccccacagccattgtgtgatctgatgctgagccaagtatttgccgagtgtcacaacctggtacccccaggaccgtttttcaatgcctgtatttccgaccactgccgcgggaggttggaagtgccttgccagtctctcgaagcatacgccgaactgtgcagggcccgcggcgtgtgttccgactggaggggcgccacaggtggactgtgtgacctgacctgtccccctactaaagtgtacaagccttgcgggccaattcagcccgcgacgtgcaacagccggaatcagtccccccaactagagggcatggctgaggggtgtttctgccccgaagaccaaattctgttcaatgcacatatgggaatctgtgtacaggcttgcccttgcgtcgggccagacggcttccctaagttcccaggagagaggtgggtatctaactgccaatcctgtgtttgtgatgagggtagtgtatccgtacagtgcaaaccacttccttgtgatgcccaagggcaaccacccccatgtaataggcctgggtttgttaccgtgacacgacctcgagcggaaaacccatgttgcccagagactgtgtgtgtctgtaacaccactacctgcccacagtctctcccagtgtgcccccccgggcaggaaagcatttgcacccaggaagagggcgactgctgcccaaccttccgctgccggccacagttgtgctcatacaacgggaccttctacggagtaggcgcgacgtttcccggggctctgccctgccacatgtgcacgtgtttgtcaggagacacccaagatcccacagtgcagtgccaggaggacgcgtgtaacaacacaacctgtccccagggattcgagtacaagcgtgtcgcaggccagtgttgtggcgagtgcgtgcagaccgcatgcctcaccccggatggccagcctgtgcagctcaatgagacctgggtcaattcccatgtggataactgcaccgtgtacttatgcgaggccgagggaggagtgcatttgcttaccccacagccagcatcatgccccgacgtcagttcatgccgagggtccctcaggaagaccggatgctgttactcctgcgaggaagactcctgtcaagttcggattaataccaccattctctggcaccagggatgtgaaactgaagtgaacatcaccttctgcgaggggtcgtgccccggggcctctaaatacagtgccgaagcacaggcaatgcagcaccagtgcacatgttgccaggagcggagagtccatgaggaaaccgtacctctgcactgtcctaacggtagtgccattctgcacacatatacccatgcggtacaggtgctctgtgggcttctcgcatggggcctacaggccggaggacacatcaggggggcagttcaagacccacagcaaccactgaaagatcaggaggcatctggcaaggctcggcaggggggcgggtatcgccaaacggttgcatggggagacaagtcaaacgctagagcctggctgcaaaaacccgttgtgtgggtgcagtcaggcgccttcccgaccccagggccggcgtccgcactgtgcccatggtag

SEQ ID NO: 195734 - DNA, 17298 bp, Artificial Sequence
  Description of Artificial Sequence: Synthetic coding sequence
atgggcgcccccagcgcctgccggaccctggtgctggccctggccgctatgctggtggtcccgcaggcagaaacccaaggtcctgtggagccgtcttgggaaaatgctggccacactatggatggaggagctccaaccagtagtccaacacgtagggtgagttttgtcccccctgtgaccgtatttccttcactgtccccacttaatcctgcccacaatggacgggtgtgttccacttggggagatttccactataagacattcgatggcgatgtattccgcttccccggcctctgtaactatgttttctcagaacattgcagggctgcctatgaggacttcaatgttcaactcaggaggggcctggtgggcagtcgtcctgtcgtcacccgcgtggtcatcaaggcccaagggttagtactggaggccagcaacggctcagtcttgatcaatggccaacgcgaggaactaccctattctaggactggtctgttggtagagcagagcggagattatataaaagtgtcaatccggttggttctgacctttctctggaacggggaagactcggccttactcgaactggatccaaagtacgcaaaccaaacatgcggcctgtgtggcgacttcaacggcctgccagccttcaatgaattctatgctcacaacgctagattaacgcctctacagtttggcaacctgcaaaagctcgacggccccaccgagcagtgtcccgacccgctgccccttccagcgggcaactgtaccgacgaggagggcatctgccaccgtaccctccttgggccagcgttcgccgagtgccatgcgctcgttgacagcacagcatacctggccgcctgcgcccaggatctgtgtcgctgccctacctgcccctgtgcaacattcgtggaatattctcggcagtgcgcacacgctggcgggcaaccacggaactggcgatgtccagagctttgtccgcgaacatgcccgctgaacatgcagcaccaggagtgcggctcaccctgcaccgacacatgctcaaacccgcagcgagcccagctttgtgaggatcactgcgtggacggctgtttttgtcccccaggcagaagctgcaccgttcttgacgacattactcacagtggttgcttgcctctgggccagtgcccctgcactcacggcggacggacctactcccctgggacatcgttcaacacgacgtgcagctcttgtacatgttcagggggcttatggcagtgccaagacctgccttgcccggggacctgtagcgttcagggcggtgcacacattagcacatacgatgaaaagctatacgatctgcacggggattgctcttacgtgctcagtaaaaaatgcgcagactcttcattcacggttctggctgagttaaggaagtgtggcctgactgacaatgaaaattgcctgaaggcagtgacattatcactcgacgggggtgataccgcgatccgtgtgcaggccgatgggggagtgttcctgaactcaatttacactcagctgcctttaagtgctgctaatatcacacttttcactccgtctagcttcttcattgtggtgcagacagggcttggcttgcagcttttagtgcaacttgtccctcttatgcaagtttttgtaaggttagaccctgcccatcaagggcagatgtgcggcctgtgtggcaattttaaccagaatcaggccgatgacttcacagcactctcaggtgtcgtggaagctacaggtgccgccttcgccaacacatggaaggcccaggccgcctgtgctaatgctagaaattccttcgaggatccatgtagcctgagtgtggagaatgagaattacgccaggcactggtgcagcaggctgaccgatcccaactcagcatttagtcggtgccatagcatcatcaacccaaaacccttccactcaaattgcatgttcgacacctgtaactgtgaacgaagcgaagactgtctgtgtgcggctctgagcagctacgttcatgcctgcgccgcaaaaggtgtgcagctctcagactggcgcgacggtgtatgtaccaaatacatgcaaaattgtcctaagtctcagcgatacgcttacgtggtggatgcctgtcagccaacctgtcgaggcctctccgaagcagacgtgacttgctcagttagtttcgtcccagtggacggctgcacatgtccagccggaaccttcctgaacgatgccggggcttgtgtgccagctcaagagtgtccttgttacgctcacggcaccgtccttgcgcccggagaggtcgtccacgacgaaggcgccgtctgctcatgtaccggcggcaagttgtcctgcctaggtgcttcgctgcagaaatcaacaggatgcgccgccccgatggtgtacttggattgctctaactcctccgccgggacacctggtgctgaatgcctacggagttgccacaccctcgacgtcggatgcttctccacgcattgtgtgtctgggtgcgtttgccccccagggcttgtttcagacgggagtggcggctgcattgcagaagaggactgtccgtgcgtgcataacgaagccacttataaacctggggagaccatccgggtagactgcaatacctgtacctgtagaaacagaaggtgggaatgcagccatcgcctgtgtctcggcacgtgcgtcgcttacggcgacggccattttatcacatttgacggcgaccgttatagttttgaaggatcctgtgagtacattctggcacaagactactgtggcgataacaccacacatggcaccttccggattgttactgaaaacattccctgtggcacgacggggaccacctgctctaaggctataaagctgttcgtcgagtcttacgagctcatcctgcaggaggggaccttcaaggccgtggctcgtggtccaggtggcgatcccccatacaaaatacgctatatgggcatcttcctggttattgaaacacacggcatggcggtgagttgggatcggaaaactagcgtgtttattcgcctccaccaggattacaaaggccgagtttgtggtctgtgtggcaactttgacgataatgctattaatgattttgcaacccggtctagatcagttgtcggggatgctctcgagtttggaaacagttggaagctaagtcctagctgtcccgatgcactggcacctaaggatccttgtacagctaacccttttcgtaaaagctgggcccagaaacagtgctctatcctgcatggacctacgttcgccgcctgcaggagtcaggtcgacagtactaagtattacgaggcatgcgtcaacgacgcttgtgcttgcgacagtgggggtgattgtgaatgcttttgcacagcggtcgccgcatacgcgcaagcctgtcacgacgccggcttatgtgtgagctggcgcaccccagatacatgcccccttttttgcgacttttataacccacacggcgggtgcgaatggcactaccagccgtgtggtgccccatgcttaaagacctgtcgcaacccttctggacactgcttggtggacctgcctggactggaaggttgctatcccaagtgccctccttcacagcccttcttcaatgaagatcagatgaagtgcgtggctcagtgtggctgttacgataaagatggtaactactacgacgtgggggctagggtgcccacagccgagaattgtcaatcctgtaactgtacaccctctggaatccaatgtgcccattctctagaggcttgtacatgcacttacgaagatcgaacttactcctaccaggatgtgatttataataccaccgacggccttggagcttgccttattgccatctgtgggtcaaacggtacaatcatcagaaaggcagtagcatgccctggtaccccagccaccaccccatttacattcaccactgcctgggtgcctcattctaccactagcccagcgttgcctgtgtccacagtttgcgttcgcgaggtgtgcagatggtctagctggtacaacggacaccgtccggagcccggtctcggcgggggcgatttcgagacctttgagaacctccgtcaaagagggtatcaggtatgtccagtgcttgcagatattgagtgcagagcagcgcagctgccagatatgccccttgaagagctgggccagcaggtagactgtgaccggatgaggggcctgatgtgtgccaactcacagcagagcccacctttatgccacgattatgagctaagagtgctttgctgcgagtacgtaccctgtggacccagccctgctcctggcactagtccacagccatcacttagcgcctcgacagagcctgccgtccctaccccaactcaaaccaccgctactgaaaagacaaccctctgggtgacccctagtataaggtcaacagccgctctgactagccagactggcagtagctcaggcccggttaccgttacaccttcagcacctggcaccacgacctgtcagccaaggtgtcagtggactgagtggttcgacgaagattaccctaaaagtgaacagttagggggggacgtcgaaagctacgataaaattagagctgccggcggtcacctatgtcagcagcctaaggacatagagtgccaagccgaatcatttccaaactggaccttggcccaggttgggcagaaggtgcactgcgatgtgcactttggcctggtgtgccgcaactgggagcaagagggtgtgtttaagatgtgttataactacaggattcgcgttttatgttgctccgatgaccactgtagaggacgggccaccacgcccccccctacaacggaactcgaaaccgcgactactaccactacccaagctttgttttccacaccgcagcccacctcctcaccaggccttacacgagctcctcccgccagcaccaccgctgttcctaccctctctgaaggattgaccagccctaggtatacttccactctcgggaccgcaacaacaggaggcccgaccacccccgctgggtccaccgaacctaccgtgccaggagtggccacatctactttacccactaggagcgccctcccaggcactaccgggagtctggggacatggcggccgtcgcagcctccaacactagcccccaccactatggcaacctcacgcgcccggcccacggggactgcctcgaccgcgagcaaagagcctttgacaacttcactggcaccaacactcacatccgagctcagcacctcccaggccgagacctctacgcccaggactgagacaaccatgagccctttgacgaacacgacaacctctcagggcaccacccgatgtcaacctaagtgcgagtggaccgaatggttcgatgtggatttccctacttccggcgtggccgggggcgacatggagactttcgagaacatccgtgccgctggcggtaaaatgtgttgggctcccaagtccattgagtgtcgggctgaaaattaccctgaagtctcaatcgatcaggttgggcaggttctaacatgtagtctggagaccggactgacctgtaaaaatgaggaccagaccggtaggtttaacatgtgcttcaattataatgtgagagtgctgtgctgcgatgattattcccactgtcccagcaccccagcaacatcctccactgctaccccatcaagcacaccaggcacgacatggatcctgaccaagccaactaccactgccaccaccaccgcctccacagggtcaactgccacaccaacttcaacacttcggactgcccctcccccaaaggtgttgaccaccaccgccacaacccccaccgtaacatcaagcaaagcgacacctagctcctctccggggaccgcaacagccctcccagctctccggtccacagccacaactcctaccgctacttctgtgacccctatcccaagctctagcctgggcacgacatggacaagactgagtcagacaacgaccccgactgccaccatgagcacagcgaccccctcgtctacccccgaaaccgctcacacaagcacagtcctcaccgccacggccaccactactggggcaactggaagcgttgcaactccgagctccacacctggtaccgcacacacaacaaaggttccgaccacgaccacaactggatttaccgccactcctagctcgagtcccgggacggcgctcaccccgccagtgtggataagtacaaccactaccccaaccacaaggggcagcactgtgaccccctcttccattccggggactacgcatacagcgaccgtgctgacaactacaacaacaacagtcgccacgggctccatggctactcccagttcctctacccagactagcggaacacccccgtcccttaccaccacagccactacaataacggctacagggagcacaacaaatccctccagcactcctggaacaactccgattccaccagtcctgacaacaacagccaccacgcccgctgccacaagtaatacagtgactccatcctcagcgctaggcaccactcataccccccccgtcccaaacaccatggcaaccacccatgggaggagcttgccgcccagttctcctcatacggtaagaactgcctggacttccgcgacgtccggcattctgggcaccactcatatcacggaaccctccacagtcacctcacacacgctggcggccacaactgggacgacccagcatagcactcctgcgctgtcctcccctcatccatcttctagaaccaccgagtcaccaccctcccccggcactacaacaccaggccataccacagctaccagccggacgacagcaacagccacccccagcaaaaccagaacaagtactcttctgccttctagccctacctccgcaccaatcaccacggtggtcacaatgggatgcgaacctcagtgcgcttggtctgagtggctggactattcttaccccatgccgggcccaagtggcggagacttcgatacctattcaaacattagagccgcagggggtgctgtctgcgagcagccactaggattagagtgcagggctcaagcacagcctggggtccccctgcgcgagctgggccaggtcgttgagtgctccctcgactttggcctggtgtgtcgaaaccgggaacaagtgggcaagttcaagatgtgctttaactacgagatccgggtgttttgctgcaactacggccattgcccttctacaccagctactagctcgacagccatgcccagctcaaccccaggcacaacttggatcctgacggaactgactaccacagccaccactacggagtccaccgggtcgacagctaccccttctagcacccctggtactacgtggatcctgactgagccttccactacagcaacagtcactgtccctaccggcagtactgcgactgcatcctccacacaggccacagccgggaccccccacgtcagcaccactgctaccacacctactgtcacctccagtaaagccaccccattctcatcgccaggcacagctaccgccctgcctgccctgagatccacggcgacaactccaaccgccaccagcttcaccgcaatcccctcctcatcgctgggtaccacctggacccgcctctctcagactaccactccaaccgccacaatgtctactgcaacaccaagctccacccctgaaactgtgcacacttccacagtcctgactacaacggctacgacaacaggggcaactggctccgtcgctactccatcctccaccccaggaaccgcgcataccaccaaagtgttaactacaacaacaactggcttcaccgccactccctcctcgtcaccaggaaccgccagaaccctccccgtgtggataagtactaccaccacccccactactagaggcagtacagtcacaccttcttcaataccaggcacgacacacacccctaccgtccttacgactacaaccacaaccgtggccaccggctccatggccaccccttcatcttccacccaaaccagcggtactcctccgagcctgacaacaaccgctaccacaattactgcaactggctcaacgaccaatcccagctccacccccggaacaacacctatcccaccagtccttaccaccacagctaccaccccggcagcaacgtccagcaccgtaaccccctcatcagcgctgggtaccacacatactcctcccgtgcctaatactaccgccactacccacggtcggtccctcagtccgagctccccacacaccgttagaaccgcctggaccagcgcgacaagcggaacattaggaacgacccacattaccgaacctagcacaggcacctctcatactcccgctgcgacaacagggacaacccagcattccacgcctgccctgtccagtccacacccgtcttcacggacgactgagagcccccccagtccaggcaccaccactcctggccatacccgtgctacaagcaggactaccgccactgctacgcccagcaagaccaggacgagcactcttcttccaagctcgccgacatctgctccaatcaccacagtggtaaccatggggtgtgagccacagtgtgcatggtccgaatggctggactattcgtatccaatgccaggtccgtcaggaggggacttcgatacatattccaacatccgggccgccgggggggctgtttgtgagcagcccctgggactggagtgcagagcccaggctcagcccggggtgccacttcgtgagctgggtcaagtggtggaatgctccttggactttgggttggtttgtcgaaacagggagcaggtagggaaatttaaaatgtgttttaattatgagatcagagtgttctgctgtaactatggacactgcccgagcacacctgcaaccagctccacagcaaccccctcatctactccgggcacaacctggatcctgactgagcagacaacagccgccactacaaccgcaacaacaggctcgaccgcaattcctagttcaacacctgggaccgctcctccccctaaagtcctcacctctacagctacaactcctacagccacatcatctaaggctacatcgtccagcagcccaagaaccgctaccacgctgccagtgcttacgagcacggcaacaaagagcaccgccacctcttttacccctattccatcttttactctgggtacgacaggtacactgcctgagcaaacaacaacccctatggccactatgtctaccattcacccatcatccacccctgaaaccactcataccagcaccgtcctaaccaccaaggccaccacaactcgtgctacttctagtatgtcaaccccatcctccacacctgggaccacctggatcctgaccgagctgactactgcagctaccaccacggcagcgactgggccaacagccaccccctccagcacaccagggacaacttggatcctgactgagcccagcacgactgcgacagtgacagttcccacaggttcgaccgcaactgccagctccacccgcgcaactgctggtactctaaaagtgcttacttccactgccacaacaccgacggtcatcagtagcagagccaccccgagtagttccccagggacagctaccgcgcttcctgcgttaaggtccaccgcaaccaccccgaccgccacttctgtgacggctattccctcatccagcctcggaacggcttggacgcggttgagtcagactacaaccccgaccgcaactatgtcaaccgcaacccccagtagtactccagagacagttcatacttccaccgtgttgacaaccaccacaaccactacaagagccactggttccgtggctactccgtcttcaaccccaggaacagcacatacgaccaaggtccccacgactaccacaaccgggttcaccgcaacacccagttcttcacctggtactgctctcacaccccccgtctggatctccaccacaacaacacccacgacgaggggatccacagtcactccttcaagcatacctgggaccacgcataccgccacagttctcaccactacaacgaccactgtggcgactggatcaatggccaccccctcctcaagcactcagacaagtggaacaccaccctctttgaccaccaccgcaaccacaatcacggcaacggggtcaacaaccaacccaagctcgactcccggcacgacccccatccccccggtcctcaccacgactgcaactaccccagcggctactagctccaccgtaaccccatccagtgcgcttggaacaacccatactccccccgtaccgaatactacggccaccactcatggccgctcattaccacctagctctccacacacagttcgcaccgcctggacatccgcaacttctgggatccttggtacaacgcatatcaccgagccatctacagtgacgtcacataccccggctgctactacctccacgacccagcactcaaccccggccctgtctagtccacatccgtcaagccggactacagagagcccacctagccccggcacaacaacccctgggcatacacgtggaacaagccgcaccacagctactgccactccttcaaaaacaaggacgagcacacttctacccagttcgcctacatctgccccaattaccaccgttgttaccaccggctgtgaacctcagtgtgcctggtcagaatggcttgattattcctatccaatgccaggtcccagtggcggcgatttcgatacatattctaacataagggctgccggaggcgccgtttgcgaacagccactaggcctggagtgccgggcccaagcccagccaggcgtccctcttagagagctggggcaagtagttgaatgttctctggacttcgggcttgtctgtcggaaccgggaacaagttggaaaattcaagatgtgtttcaactatgaaattcgcgttttctgttgtaattacggccactgcccttccacacctgctacttcttctactgccactcccagctctacccctgggaccacctggatccttaccaaacttacaaccacagccactactacagagtcaaccgggtcaaccgctaccccctcaagcacacctgggaccacctggattctgaccgagccttctaccacggccactgttaccgtgccgaccggcagtaccgcaaccgcgtcctctacgcaggccaccgctggcactccccacgtgagcaccacagccacaacacctactgtgacatcctcaaaggcgactcccttctctagcccaggcacagccaccgccctgccagccttgcggtccacggctaccactccaaccgctacctcatttacagccatccccagtagttcgctaggtaccacatggacccgactgagccagaccacaacacctacagccacaatgtcaacagctacgccttccagcactcccgaaaccgcacacacttccacggtactcacaacaactgctactacgacccgggccaccgggagcgtcgccacaccatcctctactccgggcactgcacataccaccaaagtccccacaaccacaactacaggatttactgtgacacccagttcttcacctggcacagccagaacccccccagtgtggatcagcactacaaccactcccaccacgtcggggtctaccgtcactccttcatctgtgcccgggaccacacacactccgaccgtgctgacaacaacgacgacaaccgtggctactggcagcatggcaacccccagctccagcacacagacctccggaactcctccctctttgatcactacagctactaccattacagccaccggcagtacaacgaatccgtccagcacaccggggactacacccattccgcccgtgttaaccaccacggccaccacccctgcagcgacatcttccaccgtgactccgtcttctgcactgggaaccacgcatacgccccccgtgcctaatactaccgcaacgacacacgggcggagtctgtcaccctcatctccacatacggttaggaccgcttggacatcagctacatcaggaacactaggaacaacacatattacagaaccctctacggggaccagccacacccctgctgctacgacaggcacgactcagcactctacgcccgccctttcatcacctcacccaagctcacggaccaccgaaagtccgccttcccccgggaccaccacgcccggtcacaccacagctacaagtcgaacaaccgcaaccgcaaccccatccaagacccgaacctctacgcttttaccctcatctcctacctccgctccaattacgacggtggtgactactggttgtgaaccgcagtgcgcgtggagcgagtggctcgattatagttatcccatgccgggcccatccggaggtgacttcgatacctactctaatatcagggcggctggcggtgccgtatgtgagcagcctctcggcctggagtgccgagcccaggcacagccaggcgtccctttaggagagcttggtcaagtcgtggagtgttcccttgatttcggactggtctgtcgcaaccgtgagcaggttggtaagttcaaaatgtgcttcaactatgagattcgcgtattctgttgcaactatgggcactgtccatcgaccccagccacctcatcaacggccatgcccagctccactcctggcactacgtggattctgacagagctaacgacgacagcaacaacgaccgcatccaccggctcgacagctacccccagttccacccctggaaccgctccacctccaaaggtcctgacctcaccagccaccacaccgaccgccacaagctcaaaagccacttcctcctcttcaccacgcacagcaaccacattgcctgtgctcaccagcacggccactaagagcaccgccacttcggtgacccccataccttcctctaccctgggaactactggcactttaccggaacagactacgaccccagtggcaaccatgtccacaattcatccaagcagcactccagagactacgcatacctccactgtgctgacaacgaaggcaaccaccactagggccacctcgtcaaccagtacccccagctcaacaccgggcactacctggattctgaccgagctgaccaccgccgctaccacgactgcagcgaccggtcccacagccactccaagctctaccccggggacgacatggatcctgaccgaactgacgactaccgcaaccacaaccgccagcactggatctaccgcaaccccttcatctacccccggaaccacatggatactgactgagccttcaactaccgccaccgtgaccgtcccgacgggaagcacggcgacggcttcctctacccaggccacagctggcacaccccacgtctccacaacagccacgacacccactgttacttcgagcaaagctactcctagctcatcgcccggaacagctaccgccctaccagctctcaggtcaaccgcgactactcctaccgctaccagcttcaccgcgattccctcttcttcgctcggaacaacctggacgcggctcagtcagactactacacctaccgcaactatgtccacagccaccccatcttcgaccccggagacggtccacacatccactgtgcttaccgccacggcgacgaccaccggtgcaaccggctccgttgccactccatctagtacacctggcacagcccatactacaaaagtaccgacaactaccacgaccggatttacagctaccccttcctcatccccaggaacagcactgacccccccagtttggatctctacaactaccacacctactacgaccacacctaccacgtctggcagtacagtgacccctagcagcattcccggcaccacacacactgcccgcgtcctcacaaccacaaccaccaccgtcgccaccggcagtatggccacccccagctcctccactcagacctccgggacccctcctagtctgaccaccacagccaccaccataacagctaccggatctacgacgaatccctcttccacgcccggcaccacaccaatcacgcccgtcctaaccagtactgccactacacctgccgcaacttcatccaaggctacaagtagcagctcccccaggaccgcaaccactttgccagtgctgacttcaactgccacaaagtccacggccaccagttttacgcctatcccttcctccacattgtggactacttggacagttcccgctcagacaacgactcccatgtctacaatgagcaccattcacactagttctaccccagagactacgcatacgagtactgtgctgacaacgactgcaaccatgacaagagccactaactccaccgcaaccccgtcctcaacactcgggacgacacgaattctgactgagctcaccaccactgccaccactacagcagccactggatctacggccacattgtcgtccactcccggaacgacatggatcctgaccgagccttcaacaatcgcaaccgtcatggttccaacaggatccactgccaccgctagttccactctgggaactgcccacacaccaaaggttgtgacgactatggcgactatgccgacggcaacagccagtaccgtcccaagcagctccacagtagggacaacaaggacccccgctgtcctccctagttcactccccacattcagcgtgtccactgtgtccagcagcgtgctgactacactgagaccgaccggattcccaagttcccacttttctactccatgtttttgcagagcattcgggcagtttttctcacccggagaggtgatatacaacaagactgaccgggccgggtgccacttctacgcagtttgcaaccagcactgtgatattgaccgtttccagggtgcatgccctacatcccccccccccgttagctctgccccgttatctagccctagccctgcccctgggtgcgataatgcaatcccactacgccaggtaaacgagacgtggaccctggaaaactgcaccgtcgcccgttgtgttggggacaacagagtggtcctgctggatccaaaaccagtcgctaacgtcacatgtgttaacaaacacttgcccatcaaagtctccgacccctcacagccttgtgacttccactacgaatgcgagtgtatatgttccatgtggggtggcagccactattccaccttcgacggaacctcctatacttttcgggggaactgcacttacgtgcttatgcgggagatacacgctcggtttggtaacctgagcctttaccttgataaccactattgcaccgcgtccgctacagccgctgccgcaagatgccccagagcactctcaatacactacaagagcatggacatcgtgttgaccgtgaccatggtgcatggcaaagaagaggggctgatcctgttcgaccagattccggtgtccagtggattctccaaaaacggcgttctcgtgagtgttctggggacaaccaccatgcgggtagacatcccagcgctgggagtctcggtaacctttaacggtcaagtcttccaggcaagactcccctacagcctgtttcacaataataccgagggacagtgtggaacctgcacaaataatcagagggacgattgtcttcagagagacgggaccaccgccgcatcatgtaaggatatggctaagacctggctagtcccagattcgcgtaaggatgggtgttgggctccaaccgggacccctccgactgcctcccccgctgcaccagtcagtagtactcccactccaacaccctgtcccccgcagcccctgtgtgacctgatgttgagccaggtgttcgctgaatgtcacaacttggtcccccccgggcccttcttcaacgcttgtattagtgaccattgcaggggaaggctagaggtgccatgccagagccttgaggcctatgccgagttgtgcagggctcgcggggtctgtagcgattggcgaggggccaccggcggcctttgtgatcttacatgccctccgaccaaagtttataaaccctgtggcccaatacaaccagccacatgcaactctcgcaaccagtcaccacagctcgagggcatggcagaaggctgcttttgccctgaggatcagatcctgtttaacgctcacatgggcatttgcgtgcaggcctgtccctgcgtggggcctgatggctttccgaagtttcctggcgagaggtgggtctccaactgccaatcctgcgtttgcgatgaaggcagcgtgagcgtgcagtgcaaacctctgccttgtgacgcccagggccagccccctccttgtaatcgacccggatttgtcaccgttacgcggcccagggctgaaaatccgtgctgcccagagactgtttgcgtgtgcaacaccaccacttgccctcagagcttgcctgtgtgtccaccaggccaggaatctatctgcactcaggaggagggggattgctgcccaacattcagatgccgcccacaattgtgttcatacaacggaaccttctacggcgtgggggccacttttccaggagccctcccatgccacatgtgcacatgcctgagtggcgacacacaagaccctaccgtgcagtgccaggaagatgcttgtaataataccacttgtccccaaggattcgagtacaaaagagtggcaggacaatgctgcggggagtgcgtccagactgcttgtctaacacctgacggccagccggtgcaactgaatgagacctgggtgaacagtcacgtggacaattgtacggtttatctgtgtgaggcagaagggggtgtgcaccttctgaccccccaacccgccagttgtcccgacgtttcatcctgtcgaggatcacttcgcaaaacgggctgttgttacagctgtgaggaggattcctgccaggtgaggattaatactacaatattatggcaccagggatgtgaaaccgaggtcaacattacattctgtgaaggcagttgtcccggcgcgagcaaatactcagcagaagctcaggcaatgcagcaccaatgtacctgctgtcaggaaaggcgcgtgcatgaagaaaccgtgcccctgcattgccctaacggctcagctatccttcatacttatacccacgtggacgaatgcggatgcacccccttttgtgtcccagcacccatggctcctcctcacacacgaggtttccccgcgcaagaggccactgcagtttag

SEQ ID NO: 195735 - DNA, 17289 bp, Artificial Sequence
  Description of Artificial Sequence: Synthetic coding sequence
atgggcgcccccagcgcctgccggaccctggtgctggccctggccgctatgctcgtggtgccccaggcggagactcagggaccggtcgagccctcttgggaaaacgctggacatacaatggatggaggagcaccaactagcagccctaccaggcgggtttcctttgtgcccccagttacggtgtttccaagcctgtcgcctctgaacccagcccataacggacgtgtttgcagtacttggggtgatttccactacaaaacattcgacggcgacgtgttccgcttcccaggcctctgtaactacgtgttcagcgaacattgtagagccgcgtatgaggacttcaacgtgcaactacggaggggtttggtgggcagcaggccagtggtaacccgagtagttatcaaagcacagggcttggtgttggaagcaagcaatgggagtgtccttattaatggccagcgggaggaactgccatattcgcgcacggggttgctggtggagcagagtggtgactacattaaggtttccatccggctggtccttaccttcctctggaacggagaagactctgctcttttagagcttgatccaaagtatgcaaatcaaacctgtggcctgtgtggcgatttcaatgggttaccggcattcaacgagttctacgcccacaatgccagattgacacccttacaatttggtaacctacagaagctggatggcccaactgagcagtgtcccgatccacttccgctgcctgctgggaattgcactgacgaggaaggcatatgccacaggaccctcctggggcctgctttcgccgaatgccatgcactggtagattcaaccgcatacctggcggcctgtgctcaggacctgtgtcggtgtcccacgtgtccctgtgccaccttcgtagaatactcccgacagtgtgcccacgccggtggtcaacctcgtaactggcgatgtcccgagttgtgtccaaggacctgccctttgaatatgcagcatcaagagtgcggaagtccatgcacagacacttgctcaaatcctcaacgagctcagctgtgcgaggatcattgcgtggacggatgcttttgtccacctgggaccgtgcttgatgacataacccattcagggtgccttccgctgggccagtgcccctgcacgcatggaggccgtacttactctccgggcactagttttaacacaacctgcagcagttgcacgtgctcggggggattatggcagtgccaggatcttccctgccccgggacttgctcggtccagggaggcgcccacatctccacctacgacgagaaactgtatgatctgcacggagattgctcttatgtcctctccaaaaagtgtgcagattcctcctttacggttttggcagagctccgaaagtgtgggctgaccgataacgaaaactgcctgaaggctgtcacactgagcttagacggcggggatacagctatacgtgtacaggcagatggaggagttttcctgaattccatttatacgcagctcccattatctgccgccaacattacactttttactccatcttcctttttcatcgtggtacaaacaggactagggctacagctgctagtacagcttgtccctctcatgcaggtatttgtccgactggatcccgcacaccagggacagatgtgcggcctctgcggaaatttcaatcaaaatcaagcagatgactttaccgctctcagtggagtggtggaggctacgggggccgccttcgcaaacacctggaaggctcaggccgcatgcgctaacgcaaggaacagctttgaggatccgtgctccctgtcagtcgagaacgagaattatgcccgccattggtgcagtcggctgacggacccaaattccgcattcagtcggtgccatagcatcattaatccgaagccgtttcatagcaattgcatgttcgatacttgtaactgcgagaggtcagaggattgcctttgcgccgctcttagcagttacgtgcatgcctgtgccgccaaaggagtgcagctctctgattggcgggatggagtttgcacaaaatatatgcagaactgtcctaagtctcagcgctacgcgtacgtggtggatgcatgtcagcctacctgtcggggtctgagtgaagccgacgtgacttgttcagtttcatttgttcctgtggacggctgcacctgtcctgcgggcacttttctgaacgatgctggtgcctgcgtccccgcccaagagtgtccatgctacgcgcacggcactgtgcttgcccccggcgaagtcgtacatgacgagggagctgtgtgctcctgcacgggagggaagttatcctgtctgggagcatcactgcagaagtccactggctgtgcagcgccaatggtgtacctggactgttcgaattcttctgccggaaccccaggagccgagtgtctgcgtagctgtcacacactggatgttgggtgcttttctacgcactgcgtgtccggctgcgtttgtcctccaggtctcgtgtctgatgggagtgggggctgtattgctgaagaggactgtccctgcgttcacaacgaagcaacctacaaacctggagagacaattagggtcgactgtaacacgtgtacgtgtcgaaatcggcggtgggagtgttctcaccgactgtgcctaggaacctgcgtcgcctacggcgatggccacttcattacatttgacggagaccgatattcctttgaaggctcctgtgaatatatcctggcccaagattactgtggggataacaccacgcacggtacatttaggattgtgacagagaacattccttgcggaaccacaggcactacatgttctaaagcaataaaactgtttgtcgaaagttacgagctcattttgcaggaggggacttttaaagctgttgcgagagggcctggtggtgaccccccttacaagatccggtacatgggcatatttcttgtcatagagacacacgggatggccgtaagctgggacagaaagacatccgtcttcatccgactgcaccaggactataaaggcagagtgtgcgggttgtgcggcaatttcgacgacaatgctatcaatgatttcgcaacccgcagccgatcagtggtgggggacgccctcgagtttggaaatagctggaagcttagccctagttgtcccgacgcacttgcaccaaaggatccgtgtaccgccaaccctttccgaaaaagttgggctcagaagcagtgctccatcctgcatggtccgacattcgcggcttgcagatctcaggtggattcaacaaaatattacgaagcctgcgtgaatgacgcttgcgcatgcgattctggaggagactgtgagtgtttttgcacggcagtggccgcgtacgcacaggcctgtcacgatgcaggcctgtgtgtgtcttggcgcaccccggacacttgtccccttttttgtgatttctataatccccacggtggatgcgagtggcactatcagccctgtggagccccatgtctgaagacctgtcggaacccttctgggcactgcctcgtagatctgcctggtttggagggatgctaccccaaatgcccacctagccaaccattttttaatgaggatcaaatgaaatgcgtggcccagtgtggttgctacgataaagacggaaattactacgatgtgggtgcacgcgtgcctacagccgagaactgtcagtcttgtaactgcacaccatccggaattcagtgtgcacatagtctggaagcgtgcacgtgcacctacgaagaccgtacctatagctatcaggacgttatctacaacaccactgatgggcttggcgcctgtctaattgccatctgtggttctaatggtaccatcatcagaaaggctgtggcttgtccgggaactccagcaacaaccccattcacattcacaactgcttgggtaccacactcaaccacaagcccggccctcccagtgtccaccgtctgcgtacgggaagtgtgcaggtggtcatcctggtataacgggcataggcccgagcccggtctgggaggaggcgacttcgagacgttcgagaatctaaggcaacggggctatcaggtctgccccgtcctcgccgacatagaatgtagagcagcacagctgcctgatatgccgctggaggaactgggacagcaggttgactgcgataggatgagggggttgatgtgtgctaatagccagcaatctccaccattgtgccacgattacgaactgcgggtgctgtgctgcgagtatgtgccttgcggcccctcccctgcgcccggcacctctcctcagccttccttgagcgctagtaccgagccagcagtccccacacccacgcagaccactgctaccgagaagactaccctgtgggtgacaccaagcattaggtccaccgcagcgctaaccagccaaacaggcagttcttcaggccccgtaaccgttaccccctctgcacccgggacaactacctgtcagccccgctgccaatggacagaatggtttgatgaagactatccgaagtccgagcagctcggcggcgatgttgagtcctatgacaagattagagcggctggggggcacctttgccagcagccaaaggatatcgaatgccaggctgagtcctttcccaactggactctcgcccaggtggggcagaaggtgcactgcgacgtccacttcggtctcgtgtgtcggaattgggaacaagaaggagtcttcaaaatgtgttataattacagaatacgggtcctctgctgctccgacgaccattgcaggggccgggccacaacgcccccaccaaccaccgagcttgagactgctactacgacaacgacccaagccttattttctacaccccagcctacaagctccccaggactcaccagggctcctcccgccagtacaacggctgttccgactctttccgagggcctgacgagtccaagatacacctccaccctggggactgccacaacaggaggacccacaactcccgcaggttcgaccgagccaaccgttcccggggtcgctacaagcacgctgcccacaaggtcagcattaccaggtactaccggctctcttggaacctggaggcctagccagcctcctactcttgcacctactacaatggctacctctcgggcccggccaaccggaaccgcgtccacagcttctaaagagccactgactaccagtctagcccctactttaaccagtgagttgtcaacgagccaagccgagaccagcaccccacggacagagacaacgatgtctcccctcactaatactacgacctctcagggtacgacaagatgtcagcctaagtgcgaatggacggaatggtttgacgtggattttcccacgtcaggggtggcgggaggggatatggaaacattcgagaacatccgagccgcaggcggaaagatgtgttgggccccaaaatcaatcgagtgtcgggccgagaactatcccgaggttagcatcgaccaggtgggacaagtgcttacctgctcactggaaaccggcctgacctgtaagaacgaggatcaaaccgggcggttcaacatgtgcttcaactacaatgtgagggtgctctgttgtgacgactactcccactgtccgtcgacccctgctacttcctccactgcgacccccagctcaacacccggcaccacctggatccttactaagcccacaaccacagctactactacagcaagcactggcagcacagccacccccacttccacccttaggactgcacctcccccaaaagtgctgaccacgaccgccaccacccctactgtgacctcaagtaaagcaacccccagttcttctccgggaactgcgacggctttaccagctctgcgcagtacagctacgacacccacagctacatcagtaactccaattccgtcatcctccctggggacgacatggactaggctgtcacagaccaccacaccgaccgcaacgatgagtacggcaacacctagcagcacaccagagacagcacatacttcaaccgtactcaccgctacagccacaaccacaggcgccaccggtagcgtggccacaccctcaagcaccccggggacagcacacactaccaaagtccccacaacaaccaccaccggattcaccgcgacgccatctagcagcccggggacagcactcacacctccagtgtggatatccactacaaccacccccaccacccgcgggagcacagtgaccccgtcgtctatacctggaaccactcataccgccaccgtactgaccaccaccacaacaaccgtggctaccggcagtatggctacaccctcttcgagtacccagactagcggaacccctccaagcctgaccactactgccactaccatcaccgctactggctctaccacaaatcccagctccacccctggcacgactccgatcccaccagtgctgaccacaacagctaccacccctgctgctacttctaatacggtcacacccagtagtgcactcgggactactcatacgcccccggtgccgaacacgatggcgaccacccatgggagaagtctgccccccagcagcccccacacggtgagaacggcctggacttcggccacgtctgggattcttgggacgactcatatcaccgagccaagcactgtgacatcacacactctggctgcaacgaccgggaccacacagcacagcacgcccgctctctcatccccccacccaagtagtcggacgactgaatcacctccttcccccggcactactacaccaggacataccaccgctacaagcaggacaaccgctaccgctaccccttcaaagacacgaacaagtacactgctccccagtagccccacatctgctcctattacaaccgtcgtcacaatgggatgcgagcctcagtgtgcctggtcagaatggttggactactcttacccaatgcctggaccaagcggaggagactttgatacgtactccaatatccgagctgcagggggagcagtgtgtgagcaacccctgggtcttgaatgtagggcccaagcccagccaggggtgccattgagggagctgggccaggtggtggagtgctctctcgatttcggcctggtctgccgtaatcgggaacaagtgggtaagtttaagatgtgcttcaattacgagattagagtcttctgttgtaattacggacactgtcctagtacaccagctacgagctccactgccatgccctcaagcacgccgggtaccacctggattctgacggagctcactacaaccgctacgaccaccgagagcacggggtctaccgctacccccagttctacaccagggactacatggattttaactgaacccagcaccacggccactgtgactgttcccactggaagcacagccactgcgtcgtccacacaagctaccgccggcactccacatgtgtcgaccaccgctactactcctacagtgacaagctccaaggcaacaccttttagttcccccggcactgcaacagcactgcctgccctcagatccacggcaactactcctactgctacaagtttcacggccatacccagttcctctctcgggacaacctggacacgcctgtctcagactacaacgcctactgcaaccatgtccactgctacgcccagctcaactccagaaactgttcacacctctactgtcctgacaacgacagcaaccaccactggtgctacaggaagtgtcgctacccccagctcgaccccaggcacagcccatacgactaaagtgcttacaaccaccaccaccggttttactgctactccctcatcaagtccagggaccgcgaggaccctgcccgtgtggatcagcacaactacaacccccaccacgcgtggttctactgtgactccgtctagtatacccggcaccactcacaccccgaccgtattgaccacaacaaccaccaccgtggctaccggatccatggccactccgagctccagtactcagacatcaggcacgcctccatccctgacaactactgccacaactattactgctaccggtagtactaccaacccttcttccacccctgggacgactccaatcccacccgtgcttactaccaccgccaccacccccgccgctacaagtagcacggtgacaccatcctccgcccttgggaccactcacactccccctgtgccaaataccacagcaacaactcatggacggtccctctcgccatcctccccgcacaccgtacgcacagcctggacatccgcaaccagtggaacgttagggaccacacacatcaccgaaccttccacaggcaccagccacacgccggcggccactacaggcacaacccaacatagtaccccagcactgtcatcaccacacccaagcagcaggacaaccgaatcgcctccatctcctgggaccacaactccaggccacactcgggccacaagcagaactactgcaacagctaccccgtctaagactcgtacaagcactcttctcccttcaagccccacctctgctccaattaccacagtcgtgacgatgggttgcgagccgcagtgtgcgtggtccgaatggctggactattcttatccgatgcccggaccaagtgggggcgattttgacacctactctaacatcagggccgccggtggggctgtgtgtgagcagccactggggctcgaatgcagagctcaggcccagcctggtgtgcctctccgtgaattgggccaggtggtggagtgtagcctggacttcggtctggtgtgccgcaatagggaacaggtaggtaagtttaaaatgtgttttaactacgagatcagggtcttttgctgcaattacggacactgcccaagcacacccgcgacctctagcaccgccaccccttcttcaaccccaggcacgacatggatcctgaccgaacaaaccactgcggcaaccaccacagccacaaccggaagcacagcaataccttcttcaactcccggaacggctcccccccctaaagtgcttacaagcacggccacaacccctaccgccactagcagcaaagcgactagctcctccagccctcggactgccactactcttccggtattgacgtctaccgccaccaaatcaacggcaacatcctttacacctattccctcatttacgctggggacaacagggactctgccggaacagaccaccacacccatggcaactatgtcaacgattcatccctcttcgacacccgagacaacacacacatcaaccgtgctcacaaccaaggccacgactacaagagcaacatcatctatgagcacaccatctagcacgccaggtaccacatggatcctgactgaacttactaccgcagctactaccacggcagcaaccggtccaacggctaccccgagtagcacacctggcactacctggatcctaacagaaccctcaaccactgcaaccgtaacagtgcccacaggatcaaccgccactgccagctctacacgggccacggctggcaccctaaaggttttaacatcaacggctacaactcccaccgtgatcagctcacgggccactcccagcagctcccccggtaccgcaactgctctgcccgctcttaggagcacagcaacaactcctacggccaccagtgtaacagcgataccctcttccagcctgggcaccgcctggacacgactgagtcagaccactacccctacggcaacaatgagtaccgccaccccttcaagcactccagagactgtgcacacaagtacagttctgacaaccacgacaacgacaacaagagcaacaggctcagtggccaccccgtcctccacccctggcacagcccacaccacgaaggtcccaaccacaaccactacaggcttcaccgccactccatcgagctctcccggaacggccttgactcccccagtgtggatctcaacaaccaccacgccgacgacccgaggctccaccgttacgccatcaagtatccccggaactacgcataccgcaaccgtattgactaccacaaccactacagtcgcaactggctcaatggcaacccccagttccagtacacaaacctccgggacccctccctccctaaccaccaccgctacaacaatcacagccacagggtccaccactaacccatccagtactcccggcaccaccccaatcccgccggtactgacaacgaccgccaccacgcctgcggcaacatcatctaccgtaacaccctcaagcgctctgggaaccacgcatacaccccccgttccaaacacaactgccacaacacatggccgctccctgcccccttccagtcctcacacggtccgcacagcctggacatccgctacctccggaatcctcggcacgacccacatcaccgaacccagcaccgttacatctcatacgcctgccgctacaacctctactacacagcatagcactccagcactcagctcaccccatccatccagcaggaccacggaaagtcctccaagccctggtacaaccaccccgggccatacacgcggcactagccgaaccaccgcaaccgctacaccaagcaagactcggacatctacattgctcccaagctctcccacctctgccccaattacaaccgtcgtgaccaccgggtgcgagccacagtgcgcgtggtctgagtggttggactatagctatccaatgcctgggcccagcggcggagacttcgatacctattcaaacatccgcgctgctggcggagccgtctgcgagcaacctctcggactggagtgtcgggcacaggcccagccaggcgtgccgctccgagagttaggacaagtagtcgagtgctctctggatttcgggctggtttgtcgaaaccgggagcaagtgggcaagttcaagatgtgtttcaattatgagattcgcgtgttttgttgtaattacggtcactgtccttccacccctgctactagcagcacagcaacacccagcagtacacccggaaccacctggatcctgactaagctgacaaccaccgccaccacaactgagtccactggctctacggctacgcccagttccactccagggacaacatggattctgacagagccgagcaccacagcgacagtgacagttcctaccggatcaactgctaccgcgagcagcacgcaagcgacagcaggcacgccccacgtgagcactacagcaactacccctaccgtcacttcatccaaagccacaccattttcaagcccggggaccgcaacagcgctgcccgccttacggtccactgcgacaactcccactgcgaccagcttcacagccatcccttcttcgagcttgggaactacctggacccgcctcagtcagacaactacaccaaccgcgacaatgagcaccgcgacccccagttccacaccagagaccgcgcatacgagcacagtgctgaccaccacagcaacaactacaagggcaaccggatctgtcgcgacaccctcatcgactcccggcacagcacacacaactaaggtgcccacgaccacaactacaggcttcactgtgacgccctcctcctccccaggaaccgctcggactccgcctgtttggatttcaactaccactacgccaactacaagtgggtcgacggtcaccccctcttctgttccaggcaccacacacactcctactgtgttgactaccaccactaccacagtagccaccggctctatggcaacgccatctagctctacacaaacatcaggaacacccccgtctctgattactacagctaccacgattaccgcgacggggtcgaccaccaacccatcttccactccaggaacaacccccatcccacccgtgctcacgactaccgcgaccacccctgccgctacttcttcaactgtgaccccctcatcagctctaggaacaacacacactccgccagttcccaacactacagccactacacacgggaggtctctttccccgtccagtccgcacaccgtgcgcaccgcatggacctccgcgacttccggcactttggggaccacccatatcactgagccctccaccggcacaagccataccccagcagccaccacaggcaccacccagcactctacacctgcgctttcctcaccccacccctccagcagaacaacagagtctccaccctctcccggtactacaaccccaggccataccacagccacatccaggacaaccgcaacagctaccccttcaaaaacccggacttcaactctgctaccttcgagcccaacctccgccccaattaccacagttgtgacaactggatgcgaaccccagtgtgcgtggtccgagtggctggactacagctacccaatgcccggtccttccggcggtgacttcgacacttactctaatatccgcgcagcgggaggcgccgtttgcgagcagccacttgggttggagtgtagagcccaggcacagccaggcgtgcctctgggagaactcggtcaggtggtggagtgcagtctcgacttcgggctggtgtgcagaaatagagagcaagtagggaagttcaagatgtgcttcaattatgagatcagggtgttttgctgtaattatggccactgcccctccacgcccgctacctcttccacggcaatgccctcctctactcctggcactacttggattctgaccgagctcaccaccaccgctacgacaactgctagcacaggcagtacagctactccatcttccactccaggaacagcgccccctccaaaggtactaacttctccagccacaacgcccacagctactagctcaaaagctactagttcgtcttcacccagaaccgcgaccaccctgcccgtcttgacgtccactgccaccaaatcaaccgcgacgtccgtaactcccatccctagctccaccctgggaactacaggcaccctgcctgaacagaccacaacgcccgtcgccactatgtctactatccaccctagctccacccctgaaaccacccatacatccactgtcctcaccactaaagcaaccacaactcgtgctactagctcgacctccactccttccagcaccccaggtacgacttggatcctgacggagcttaccaccgccgcaactactaccgcggcgactggccctaccgcaactccgtcttcaacacccgggaccacatggatcttgacggagctcaccacaactgccactactacggccagtaccggctccactgcaacccccagttctacacccgggaccacttggatcttgaccgaaccttctacaactgcaacagtgaccgtgccgactggctccaccgccacagccagctccactcaggctactgctggcacgccacatgtttccaccaccgctacgacccccactgtgacttcaagtaaggcgacgccatcatcctcgcccggtacagctaccgccctgcccgcactgcgtagcactgccaccacccccacggccacatcttttaccgctataccaagttcctcattaggcacaacctggacccggttgtctcagaccacgacgcctacagcgactatgagcacggcgacaccttccagtacccctgagacagttcacacgtccaccgtactgactgcaacagccactaccactggggctacaggttccgtcgccacgccgagctcaacccctggaaccgcccacacaacaaaagtccctacaaccactacaacaggattcaccgccacaccatcttcctccccagggacagcactgactccacctgtctggatctccaccacgacaacccctaccacaactacaccgacaactagtggcagtacggtaacaccttcttccattcccgggacgacccacacggccagagtccttacaacaacaacgacgaccgtggcaacaggcagcatggctacacccagcagctcgacccagacgtctggtacccctcctagcttgaccactacagctactacaataacagccactggctccaccaccaaccctagcagtaccccgggcaccacacccatcacccctgtgcttacctctactgcgaccacgcctgcggcaacatcaagcaaggcaaccagcagcagttccccacggacagctactacgttgccagtgctcacaagtacggccaccaagtccaccgccacgtccttcacgccaatcccaagctctactctgtggactacttggacagtaccagcacagacaaccacacccatgtccacaatgagtaccatccatactagttctacgcccgaaacgacccatacctcaaccgtgctaaccacgaccgcaacaatgactagggccaccaacagcacggccacccccagttcaacactcggcaccacccggatccttacggaactgacgactactgccacgacaaccgccgcaactgggagcaccgctactctgtcatcaacccccgggaccacctggatcctcactgaacccagtactatcgccaccgtcatggtgcccaccggtagcactgccacagcttcgagcacacttggcactgcccatacgccaaaggtggttaccaccatggctacaatgcctaccgctacagccagtacggttccgtcatctagtactgtgggcacaacaagaactcccgctgtgctcccgtcttcgctgccaacattctctgtttctaccgtaagctctagtgtgctgactacacttcgacccaccggttttccgtcctcccacttcagcacgccttgtttctgtcgcgcttttggccagtttttctctccgggagaggtgatctacaacaaaacagatcgcgccgggtgccatttttatgcagtgtgcaatcagcattgtgacatagatagatttcagggtgcttgtccgacctctccccctcccgtcagcagtgcccctctctcgtccccgtcccctgctcccggctgtgataatgccattccactgagacaggtcaatgagacctggactctggaaaactgcactgtagcgcgctgcgtcggtgacaatagagtggtcctccttgaccccaagccagttgccaacgtgacatgcgttaacaagcacctgccaattaaggtttccgacccctcacagccatgtgactttcactatgaatgtgaatgcatctgctcgatgtggggggggtcccattacagtacattcgatggtacatcttatactttccgtggaaactgtacatacgttctgatgagggaaatccacgcacggtttggcaacctgtctttgtacttagataatcattattgtaccgcctccgcaaccgccgccgctgcacgctgcccccgggcactcagcattcattacaaaagtatggacatcgtgcttacggtgactatggttcacgggaaagaagaaggcctgattctgttcgatcagatccccgtgagcagcggctttagcaagaacggggtcctggtgagcgttcttggcacaaccaccatgagggtagacatccccgcgctgggagtctctgttacattcaacgggcaggtctttcaggcccgactgccatatagcctcttccataataacaccgagggacagtgtgggacatgcacaaataaccaaagggacgactgcttgcaaagagacggtaccacggccgcttcatgtaaagacatggcaaaaacctggctagtgcccgattcacggaaggatggctgttgggctccgactgggactccacctactgcaagccctgcagcccccgtttcttcgacacctacacccaccccttgtccgccccaacctctgtgtgacctgatgttgtcgcaagtctttgctgaatgccacaatctggtgccgcctgggccattctttaatgcctgtattagtgatcactgtagaggacggctggaggttccctgtcagtcacttgaagcctacgcggaactgtgccgtgccagaggggtgtgtagtgattggcggggcgctactggcgggctgtgcgatctgacatgcccccctactaaagtgtataaaccttgtggtcccatccagcctgcaacatgcaattctaggaaccaatccccacagctcgaagggatggccgagggctgtttctgtccagaggatcaaattctgtttaacgcccacatggggatttgtgttcaggcatgcccgtgtgtggggcccgatggcttccccaagtttccaggcgagcgctgggtgagcaattgccagtcatgcgtctgcgacgagggctctgtttctgtccagtgtaagcctctgccctgtgatgcccagggacagcctcccccgtgcaaccgccctggattcgtgaccgtgactaggcctagggccgagaacccttgttgcccagagacagtgtgcgtgtgcaataccaccacttgtccacaatcattgccggtttgtcctcctggccaggagtctatatgcactcaggaagaaggagactgttgtcctactttcagatgccgacctcaactctgctcctataacgggactttctacggggtgggggccacctttcctggcgccctcccatgtcacatgtgtacctgtctaagtggggatacccaagatcctactgtgcagtgtcaggaggatgcctgtaacaatacaacctgtccccaaggtttcgagtataagcgcgtcgcgggccagtgctgcggggagtgtgtgcaaacagcatgtctgaccccggatgggcagcctgtccaactaaacgagacctgggttaatagtcatgtggataactgcacagtctatctttgtgaagctgagggcggcgtccacctgttgacccctcagcccgctagttgcccggatgtctcgagctgtaggggttccctcaggaaaactggatgctgctactcatgcgaggaggattcttgtcaggtgcggataaatactaccatcctttggcaccagggatgtgagactgaagttaatatcactttttgcgagggctcgtgtcccggagcaagtaaatacagcgccgaagcacaggcaatgcagcaccagtgcacatgctgccaggaacggcgggtgcatgaagagactgttccgttgcactgtccaaatggatctgcaattctccacacttatactcatgtcgatgaatgtggctgcacccctttttgcgtcccagcacccatggcccccccccacacccggggatttcctgctcaggaggcgaccgccgtctag

SEQ ID NO: 195736 - DNA, 1611 bp, Artificial Sequence
  Description of Artificial Sequence: Synthetic coding sequence
gtgttctgctgcaactacggccactgccccccccggccccccgcccttcgaccctgcccccctcccctccgcggacgacctgggtctaccgaactgacaactacagccaccacgaccgccagcacaggaagcacggctacccctagctccacccccgggactgctccccctccgaaggtactcaccagccctgctactacgccgacggccactagctcgaaagctacgagttcttccagtccaagaacggccactacgctgcctgtgctcacgtccaccgcaaccaagagcactgcaacttctgtgacgccaattccgtcctccacactcgggaccactgggactctccctgagcaaacaactactcccgtggccacaatgtccaccatccatcccagcagcacacctgaaactactcacacgtcaacggtccttacaactaaagctaccacgactcgcgctacatcctccacgagtacccctagtagcactcctgggacaacttggattctgacagaacttacaactgccgccactacaaccgcagctaccggacccaccgcgacacccagctctacaccaggcaccacctggatccttacagagctcaccaccaccgccacgacgaccgcaagtacggggtctaccgctacccctagttccacaccgggcacaacttggattttaacggaaccttctaccacagctacagtcacagtgcctactggctctacggccactgcctcaagcacacaggcgaccgcgggcacaccacacgtgtccacaaccgctaccacccctacggttacctcttcaaaggctaccccgagttccagtccaggtactgcaacggccctccccgctctccgcagtaccgctacgacccattcctaccagctgtacagccaccccctgctgctgcccactacatggactagactttctcagaccacaacacctaccgccaccatgtcaactgctactccatcttctactccggagactgtacatacaagcactgtcctcacggccaccgctaccactactggcccagccctctggcctccgccccccccaccacaagagcagctgacacttccaaagtgccggctgccacagccaagacatagtcatccattgctgcagccaagagatggcacacacgcgagttccgtggaccagcacaatcatcacacacacaaccaccacacccacaaccaatggcttcacggagaccctctattgcatcctggagaccacccccaccgccagtctgcagatcaccatcaccacaactgcacaggaagtatggctacaccaagttcaagcactcagacttctggaacacccccgagtcttactacgactgccaccacaatcaccgcaaccggcagcacaactaaccccagtagcacaccagggacaactcccattacacctgtgctgacctctactgctaccacccctgccgctacatcgagcaaggctaccagttcatcctccccacggactgcgacaactctgccggtgcttacctctactgcgacaaagtctacagctacctcatttacccccatcccaagcccttgcggcccccgaggtccctcttag

SEQ ID NO: 195737 - DNA, 561 bp, Artificial Sequence
  Description of Artificial Sequence: Synthetic coding sequence
agcagcacccccggcaccacctggatcctgaccgagcccagcaccaccgccaccgtcacggtccctaccgggagcacagcgacggcatccagcacacaggccacggctggtacacctcacgtttcgaccactgccaccactcccacagtaacgtcaagtaaggccaccccctttagcagcccaggaacagccaccgccctgccggcactgcgctcaaccgccacaactcctaccgccacttcattcaccgctattccaagttcttgggcccccccagggcccgcatatcaccgcccaccacatccccgcccaccttgccctcagcctcaccctcctcctctgcaaagactctccaccccccctcagtgtctgcctccaaggcctccccgtggtcatagactctgcggccatcccttgctgcaccctcgaaacagctctcattatcagtccgcggattaccacaaccatttcaccgccactcctagcagctccccagggactgccaggaccttacctgtttggattagcaccaccactacacccaccactcgagggagttag

SEQ ID NO: 195738 - DNA, 960 bp, Artificial Sequence
  Description of Artificial Sequence: Synthetic coding sequence
accaaggccaccaccacccgggccaccagcagcatgagcaccccctcctctactcctggtactacttggatcttaaccgaactgaccacggcggcaaccaccaccgccgccacacctcacggccaccctgtgctgcatcccagagaccatctggaccctcaccgggctcagcactacacagtgactgtgcccaccgggagtacagccactgcaagttcaactcgtgctacagcaggaacactgaaggttttaaccagccatcatactcacagtcatcagctgcagagtcacagcctcctgcagagtcgggattgtaacagacccagctctaccgaaaaacatagccatcacacccacagctaccaacggtactcacaccctctattcttgcctacggcctggactcgcctctcccaaacaaccacgcctacagctacaatgtctacggccaccccaagcagcactcccgaaaccgtacatacttccactgttttgacaacaactactaccaccacgcgagctaccctgtggccacctccccctcccccccaggagcagttaacactgccaaaatgtaggttgccacaacccaggcacagccatccactcctccagcctagggacggcactcatgcatctagtgttgaccagcacaatcaccacacacacaaccaaagattacacggtgatcctctgctgcatccaacaactcatacagcaaccgtcctgacgacaacaactaccactccactcgtcctgtggcagcatcctccactggcccatagacctgttgtaccccccagtttaaccacaactgccaccacgatcacagctaccggcagtactaccaaccccagcagcacaccaggtactactccgattccccccgtccttactacgacggcacatacgtgttcacatcaacaacattccgattcactcttatgcccacgcgattag

SEQ ID NO: 195739 - DNA, 2007 bp, Artificial Sequence
  Description of Artificial Sequence: Synthetic coding sequence
atgcgggagatccacgcccggttcggcaacctgagcctgtacctggacaatcactattgcactgccagtgccaccgctgccgcggcaaggtgtccacgcgctctgagcatacactataaatccatggacattgtcttaaccgtcacaatggttcatggaaaggaggagggcctgattctgtttgatcagatccctgtatctagtggatttagcaagaacggggttctggtatctgtgctagggactacgaccatgagagtcgacataccggccctgggagtatcagtgaccttcaatggacaggtgtttcaagcaagactgccatatagcttatttcataacaacaccgaagggcagtgtgggacctgcaccaacaaccagagggatgattgtctgcagagggatggtacgaccgcagcatcctgcaaggacatggcaaagacttggctggtccccgattcccggaaagacgggtgttgggccccgactgggacacctccgaccgcgtcaccagctgcccctgtgtcaagtaccccgacccccaccccttgcccccctcagccactgtgcgatctcatgctttcccaggtctttgccgaatgccacaacctcgtgccacctggccccttcttcaacgcttgcatttccgatcactgtagaggccgattggaagtaccatgtcagtcactggaggcttatgccgagctctgccgagcgaggggagtgtgctcagactggcgtggagcgacaggggggctttgcgacctcacttgtccccctacgaaggtgtacaagccatgtggacccatccaaccagccacctgtaattccagaaatcagagcccacagctcgaaggcatggcagagggctgcttttgccctgaagatcaaattctctttaacgcgcatatgggcatctgtgtgcaggcttgtccatgcgttggaccagacggatttcccaagtttccgggagaacggtgggtttccaattgtcagagttgtgtctgtgatgagggctccgtgagcgtgcagtgcaaaccattaccatgtgatgcccaaggccagccccctccatgcaacaggcctggattcgtgacagtcaccaggccacgcgccgaaaatccctgctgccctgagaccgtatgtgtctgcaacacaacaacctgtccacagtctctgcccgtttgcccgcccggccaggaatccatctgcacccaggaagagggggactgctgtccaactttcagatgccggccacaactttgctcctacaacggtactttttatggggtgggagccacttttccgggggcactaccctgccacatgtgcacctgcctttccggcgatacgcaggatcctacagtgcagtgccaggaggacgcatgcaacaatacaacttgtccgcagggtttcgaatataagagagtggccgggcagtgttgcggggaatgcgtccagacagcatgcctcacacccgatggacaaccggtacagctaaacgagacttgggtgaattctcatgttgataactgtaccgtctacctgtgcgaagcagaaggcggcgtgcatttactgacaccccaacctgcctcttgccctgatgtatcctcttgcagaggcagtctaaggaagaccggatgctgttatagctgcgaagaggactcgtgtcaggtgaggattaataccaccatcctttggcaccagggatgcgaaacagaagtgaatatcactttctgcgaggggagttgtcccggagcttcaaagtattctgcagaggcacaggccatgcagcatcagtgcacctgctgccaagagcgaagagttcacgaggaaaccgtacctctgcactgccccaacggcagcgcaatacttcacacatatacgcacgtcgatgaatgtggatgtactcccttctgcgtgcccgcccccatgagccctccagcatgcgtgtggcaccccgcattgagggcgcctgccgctcacttggggctggccccgccgtag

SEQ ID NO: 195740 - DNA, 7320 bp, Artificial Sequence
  Description of Artificial Sequence: Synthetic coding sequence
atggtgcagcggtggctgctgctgagctgctgcggcgccctgctgagcgctggcctagcgaacacttcttacacaagtcctggacttcaacggctgaaggactctcctcaaaccgcacccgataaaggacagtgttcaacctggggagccggccactttagtacttttgaccaccacgtgtatgactttagcggtacatgcaattacatcttcgccgccacctgcaaggatgcctttcctacattttccgtccaactgcgccgtggcccagacggctccataagtcggatcattgtcgagctcggcgcatcagtggtcaccgtttcagaggcaataatctctgtgaaggacataggagtgatatccttgccctacacttccaacgggttacagatcactccttttggccaaagcgtaagactggtcgccaaacagctcgagctcgaattagaagttgtgtggggccccgatagtcatctgatggttctcgtcgagcggaaatacatgggacagatgtgcggactgtgtggcaatttcgatggcaaggtaactaatgagtttgtctccgaggagggcaaattcttggaaccccacaagttcgcagcactacagaagctggacgatcctggagagatctgcacgttccaggatattcctagtacccatgtgagacaggcccagcacgcgcgaatttgcacccagctgttaacactcgtcgcacctgagtgttccgtgagtaaggagccttttgtgttatcctgccaggctgacgttgccgcagcaccacagccagggccccagaactcaagctgtgccaccctaagtgaatactcccgacagtgtagcatggttggacagcctgtacgcaggtggcgcagccctgggttgtgcagcgtcggacagtgcccggctaatcaagtataccaggagtgcggcagtgcttgcgtgaaaacgtgctctaacccgcaacattcttgcagttcgagctgcacttttggatgcttttgtcctgagggtaccgttctgaacgacctttctaacaatcacacttgtgtccccgtgacgcaatgtccttgtgtattgcacggagcaatgtatgccccgggtgaagtcacgattgctgcctgccagacctgtcgctgtactcttggacgatgggtctgcaccgagagaccctgtcctggtcactgctctctggagggcgggtcgtttgtgacgacatttgatgcacgtccctaccgctttcacggaacctgtacatacatcctgctccagtctccgcagctgccagaggatggcgccctgatggcagtatacgacaagtccggcgtctctcacagtgagacttcactagtggctgttgtgtacctgtctcgccaggacaaaatagtcatatcgcaagatgaggttgtaacaaacaacggcgaggccaaatggttaccttataagacccgaaatataactgtttttagacagacgtcaactcaccttcagatggccacaagttttggattggagttggttgtgcagttgaggcccatctttcaggcttacgttacagtgggcccacagttccggggacagactcgcggcttatgtggaaactttaacggtgacacgacggatgatttcaccacctctatgggaatcgccgaaggcacagcctcactcttcgtcgacagttggcgagccggcaattgccccgccgcccttgagagagagacggacccatgcagcatgagtcagctcaataaagtctgcgctgagactcattgctctatgctgcttcggacgggcactgtgttcgagagatgccacgcgaccgtaaaccccgccccattctacaagcgatgcgtgtaccaggcctgcaactacgaggagaccttcccccatatatgcgcagccctcggagattatgtgcacgcctgcagtctgagaggtgtgctgctgtggggatggcggagctccgtggataactgcactatcccgtgcacgggcaataccaccttttcatacaacagccaggcttgcgagcgaacttgtctatcccttagcgatcgggccacagagtgtcaccacagcgctgttcccgtcgacggctgcaactgcccagacggcacctatctgaatcagaaaggggagtgtgtgagaaaagcacagtgtccatgcattctcgaagggtacaaatttatcctcgccgagcagagtacagtcataaatggcataacttgccattgcatcaacggtcgactcagttgtcctcagcgcccgcagatgtttttggcctcttgtcaggcccccaagacgttcaagtcctgctcccaaagttcagagaacaagttcggtgctgcatgcgctccaacttgccagatgctagcaacaggcgttgcctgcgtccctacaaagtgtgaacccgggtgtgtgtgcgccgagggactgtatgagaatgcagacggacaatgcgtccctccggaagaatgtccctgcgagttttccggtgtgtcttatccaggaggggccgagctccacacagactgcagaacttgttcctgctccaggggacggtgggcctgtcagcagggcactcactgcccaagtacttgcaccttatacggagaaggccacgtgatcactttcgacgggcagcgatttgtgtttgatggaaactgtgagtacatcctggctactgacgtgtgcggagtcaatgatagccagcctacgtttaagatcctgactgagaatgttatttgcgggaattccggcgtcacctgttctcgggcgataaagatttttctgggcggtttgtctgtcgtgctggccgatcggaattatacagtcactggggaggaacctcacgtgcagttaggagtgacccctggagcactgtctctggtcgtcgacataagtattccgggtcgatataacctgacactgatttggaaccgccacatgaccatccttatccggatcgctcgggcatcccaagaccccctttgcggtctgtgtggaaatttcaacggaaacatgaaggacgactttgaaacccgcagcagatacgtggcctcgtccgagctcgagcttgttaatagttggaaagagtcacccttatgtggagatgtgtcctttgtcaccgatccatgtagcctgaacgccttcagacggagctgggccgagagaaaatgctctgtgataaacagtcagacatttgcgacctgtcactctaaggtatatcatctgccctactacgaggcctgcgtgagagacgcatgtgggtgcgattctggaggcgattgtgaatgtctgtgcgacgccgtggctgcatacgcacaagcgtgcctggataagggagtttgtgttgactggcgcactcctgccttctgccctatatactgcgggttctacaacacccacactcaggatgggcatggagagtatcagtatacccaagaagctaattgcacttggcactaccagccgtgcctgtgtccttcccagcctcaaagtgtgcctggtagcaatatcgaaggctgctataattgttcacaggatgaatactttgaccatgaagagggggtgtgcgtgccctgtatgccccccactaccccccagcctcctaccacccctcagctcccaactaccggcagtcgccctactcaggtttggcctatgactggtacttcgaccacaatcgggctgctatcctctacggggccctcccccagctcaaatcatacaccagcatctcctacacagactcctctgcttccagcaaccctgacatcctctaaacccactgcaagtagtggcgaacccccgcggcccacaaccgccgttaccccccaagcaacaagtggccttccccccacagctacgctgcgttccactgcaaccaagcctaccgtcacacaggccacaactagagctaccgcttctacagcgagtcccgccacgacctctacagcccagtccacgactcggacgactatgacactgcctactccagccacgtccggcacgagcccaaccctgccaaaaagcacaaaccaggagctgccaggaaccaccgctacacaaaccacgggcccccgacctacccctgcttcaacaacaggtccgaccactccccaacccggacagcctacccgccccacagcgaccgaaaccacccagacccgtactaccacagaatacactaccccccagaccccccatactacacactcaccgcccacggctggtagtcccgttccatcgactgggccagtgacggccaccagcttccatgctaccacaacttacccaaccccttctcatcccgagacaactctccccacacacgtcccacctttttccacatccttggtaactccctcaacacacacagtgataacacccactcatgcgcagatggccacttctgcatctaatcacagcgcaccaactgggactatccctccccccactacgctgaaagccacaggttcaacacatactgcccctcccattacacccactacatctggcacaagccaggcacactcttctttctccaccaacaagacacctacttcccttcattcccatacaagtagtacccaccatccagaggtcactccaaccagtacaactacaatcactcccaaccccacaagcactaggacccggacacctgtggctcataccaacagtgccacctcatctagacccccccccccgtttactacacattcacctcccaccggctcttcgccgttctcatctactgggccaatgacggctacttcgttcaaaactactacaacctatccaaccccatcccacccacagactacacttcccacccatgttcccccattttccactagtctcgtgactcccagtacacatacggtgattacacccacacacgcccagatggctacttctgcttcaatccattctatgcctaccggcacaatccccccccctacgacattaaaagcgactggtagcactcacaccgctcctaccatgacattaaccacgtccggtacatcgcaggccctctccagcctaaatacggctaagacttccacctcactccacagtcacacaagctcaacccaccacgcagaggccacatccacatcaacgacaaacataacgccgaatcccacctccaccggcaccccgccaatgaccgttacaacaagtgggacgtctcagagcaggtcctctttctcgactgcaaagacttcaacctccctgcattcccatacaagttcgacacaccatccggaggtgaccagcacatctacaactagtattacacccaaccacacatccaccggtacacgtacccccgtagcccatactaccagcgcaactagttcacgtctccccactccattcaccacccattcaccccccacaggaaccaccccaatctccagcaccgggccagtgaccgcaaccagcttccagacgacgacaacctaccctactcctagccaccctcacaccactctgccaactcatgtgccatccttcagcactagcctcgtgactccaagtacccacacagtcatcatcccgacccatactcagatggcaacgtcagctagcatccatagcatgcccacaggaacaataccccccccaacaaccattaaggcgaccgggtccacccataccgcacctccaatgacccccactacttcaggcacaagtcagagtccctcttcctttagtacggccaagaccagtacctcccttccctaccacacaagcagtacacatcatcctgaagtaactcccacctctactaccaatataactccgaaacacacgtctaccggaacgcgcacccctgtggctcacacaacctctgcatccagctcacgtttacctacgccgttcactacacattctccacccactgggagctccccttttagttccaccggccccatgacagctacctcattccagactactaccacatacccgacaccttcacaccctcaaacaactctcccaactcatgtgcccccattttccaccagtctcgtaaccccgagcacccatacggtcatcatcactacacacacccagatggcgacttcagcaagtattcacagcacgcccaccggaacagtcccaccacctaccactctgaaagccaccggatccacacatacggcccccccgatgacagtcactacatccggcaccagccagactcactcctcgtttagtacagcgacggcatcgtcaagctttataagctcctcaagctggctgcctcaaaattccagcagtcggcctccgtctagccccattacaacccagctacctcacttgtcgagtgcaaccacccctgtgtcaaccaccaatcagctgagttcttctttctctccctctcccagtgcaccaagcaccgtgagctcttacgtgcccagcagtcactcgagcccacagacgtccagcccaagcgtgggcaccagctcttctttcgtttccgcgcccgttcactcaacaaccttgtcatccgggagccattcatctctcagcacccacccgacgaccgcctctgtgtcagcatcccccttgtttcccagtagtccagccgctagcacaactattcgggccacactcccacacacaatttcctcacctttcaccctgtctgccctcctgcctataagtaccgtgaccgtctcacctactcccagctcacatctggcttcttctacaattgcctttcccagcacccctcgtacaacagcgtccacccacacagccccagcattttctagccagagcacgaccagcaggtccacttccctcaccacccgggttcctaccagcggtttcgtgtctttaacctccggcgtcaccggtattcctactagtcctgtgaccaacctcacaactcggcaccctgggcccactctatctcctacgactaggtttttaacttcctcgttgacggcccacggatccacacccgcatcagcacccgtcagttcgctcggaacaccaacccctacatcccccggagtgtgtagcgtaagagaacagcaagaggaaatcaccttcaagggctgcatggcgaacgttaccgtcacccgttgtgaaggcgcctgcataagcgccgccagcttcaacatcataacccagcaggtcgacgccaggtgctcttgttgtaggcctctccacagttatgagcagcagttggaactaccatgtccggacccaagcacccctggacggaggctggttctgacgttgcaggtgttcagccattgcgtgtgcagttctgtggcatgtggcgattag

SEQ ID NO: 195741 - DNA, 1134 bp, Artificial Sequence
  Description of Artificial Sequence: Synthetic coding sequence
atgaagaccctgcccctgttcgtgtgcatctgcgccctgagcgcctgcttcagcttttctgaaggcagagagagggatcacgagctgaggcatcgaagacaccaccatcaatctcctaaatctcacttcgaactgcctcattatccaggcctgcttgctcaccagaaacccttcattcgcaaatcttataaatgcctccataaaaggtgcaggcctaagctcccaccatcaccaaataatccaccaaagttccctaatcctcatcagccgccaaagcacccggacaaaaattccagcgtggtgaatccgaccctcgtggccacaacccagatccccagcgtaacctttccttctgcaagcacaaagattacgacactccccaacgttacatttctgccccagaacgcgaccaccatctcctcaagggaaaatgtgaacacaagctcaagcgtcgcaactttagctcccgtgaatagcccagccccacaagatacaacagcggcccctcccacgccttccgcgactacccctgccccgccatcttcgtcagcccccccagagaccaccgcagcccctcccaccccctcagccactactcaagcgccacctagctcttcagcccccccagaaactactgctgctcctccaactccgccagctaccactccagcccctccaagttcttcggctcccccagaaacaaccgcagcccctcccacccctagtgccactactccagccccccttagctcttcagccccaccagaaacaacggccgtgcctcccactccatctgcaacaacattggatcccagctctgcaagcgctcctcctgagacgacagccgcacccccaactccatccgccaccacaccggctccacccagcagtccagctccccaggagacaaccgcagcaccaattaccacacccaattcctctccaaccacactggctccagacaccagtgaaaccagtgcagctccaacacaccaaacgacgacctctgtgactacccagaccacaactactaaacagcccacatccgcaccaggccagaacaagatttcccggtttttactgtatatgaaaaacctcctcaatcgcatcatcgatgacatggtggaacagtag

SEQ ID NO: 195742 - DNA, 1134 bp, Artificial Sequence
  Description of Artificial Sequence: Synthetic coding sequence
atgaagaccctgcccctgttcgtgtgcatctgcgccctgagcgcctgctttagtttctcggagggcagagaaagagatcatgagctccgccacagacgtcaccaccaccaaagccccaagtcacatttcgagcttccacattatcccggacttctggcacaccagaagcctttcatcaggaaatcatacaagtgtttgcacaagagatgcagacccaagcttcctccgtcccccaataacccacctaagttccctaatcctcatcagcccccaaaacaccccgataagaatagtagtgttgttaacccaacgctggtcgctaccacccagattcccagcgtgacctttccatcggctagcacaaaaataactactttacccaatgttacatttctaccccagaacgccaccactatctctagcagggagaacgtgaatacctctagttctgtggccaccctcgctccagttaacagtcctgcccctcaagatactactgctgctcctcccacaccctccgccacaacacccgctccgccgtcgtcatctgccccccccgaaaccacggcagcaccaccgacgccttctgcgaccacacaggccccaccctcctcctccgcccctcctgagactacagcagcccctcccacgccgcccgccaccactcccgctcctccatcgagttcggctccaccagagaccaccgctgcaccccccacgcctagcgccaccactccagcccctttgtcatctagtgcacctccagagaccacagctgtcccaccaacaccaagtgctactacactagacccatcctcggcctcagccccaccagaaacaaccgctgcccctcctaccccgagcgcgactacaccagctccgccttcgtccccggccccacaggaaactacggcagcacccattacaactcccaacagcagccccacaacactggcacccgacactagtgaaacatccgccgcgcctacacatcagaccactacttcagtgacaacgcagacaaccactactaagcagccaacctccgcccctgggcagaataaaattagcagattcctgctgtatatgaaaaatctgttgaatagaatcatagatgatatggtggaacagtag

SEQ ID NO: 195743 - DNA, 1134 bp, Artificial Sequence
  Description of Artificial Sequence: Synthetic coding sequence
atgaagaccctgcccctgttcgtgtgcatctgcgccctgagcgcctgcttttccttttccgagggccgggagagagatcacgagctgcggcatcgccggcaccatcaccagtctcctaagtcccatttcgaactgccccactatcctggtcttttggcccaccaaaagccgtttattcgcaaatcatataagtgtctgcacaaaagatgtcggccgaagcttccgccatccccaaataacccacccaagttcccaaacccacaccagccacctaagcatcctgacaagaatagcagtgtggtcaacccaaccctggtagcaaccacccagatcccctccgtgaccttcccctctgctagtaccaagatcaccacactgcccaacgtcacgttcctccctcagaatgcaaccaccatttcaagccgcgaaaacgtaaacaccagcagctcagtagccacgctggcaccggtaaattccccggctcctcaggacaccaccgcagccccgcccaccccatcagcgacaacccctgcccctcccagttcttcagccccccccgagacaacagcagcgccccctacgccctctgcaaccactcaggcgcccccttccagtagcgccccacccgagactacagctgccccgcccacacctcccgctaccacacctgcaccgccttcctcatccgccccaccggaaactaccgccgcgccccccaccccctccgcgactactcctgctcccctcagttccagcgccccacccgagaccactgcggttcctcctacaccctccgctactacccttgatccgagtagcgcgagcgcacctccagagacgaccgccgcccccccgaccccatcagccaccactcccgccccaccttcgtctccggcccctcaggagactactgctgcacccatcactaccccgaattcgtctccaacaactttggctccagataccagcgagacctctgcggcccctactcatcagaccacgacgtctgtaaccacacagactacgacgacaaaacagccaacgagcgctcccggtcaaaacaagatcagcagatttctcctctatatgaaaaacctcttgaatcgaatcattgatgacatggtggaacagtag

SEQ ID NO: 195744 - DNA, 411 bp, Artificial Sequence
  Description of Artificial Sequence: Synthetic coding sequence
atgaagaccctgcccctgttcgtgtgcatctgcgccctgagcgcctgtttctcgttcagtgaaggaagagagcgggaccatgagctgagacaccgcaggcatcaccatcagtctcccaaatcacatttcgaactgcctcactaccccggcctcttggcccaccagaaaccgttcatcaggaaatcatataagtgtctgcacaagcggtgtcgcccgaagctgcccccgtctcccaataacccgcccaaattccctaatcctcaccagcctccaaagcacccggataagaacagctccgtcgtcaatccaacgttagtcgccacgacacagataccgtctgtgacgttccccagcgccagcacaaagatcaccacattacccaacgtgacatttctcccacagaatgcttag

SEQ ID NO: 195745 - DNA, 1743 bp, Artificial Sequence
  Description of Artificial Sequence: Synthetic coding sequence
atgaccgcccccgccggcccccggggcagcgagaccgagcggctgctgactccaaacccgggttatggcacacaggccggcccatctcccgccccacccacaccccctgaggaggaggacctccgccggaggttgaaatacttctttatgtcaccctgcgacaagtttagagccaagggacgcaaaccatgtaaactgatgctgcaagtagtgaaaatattagtcgtgacagtgcaactgatcctgtttggcctctccaaccagctggctgttacgtttagagaggagaataccatcgcctttaggcatttgttcctactcggctactcagatggtgctgatgacaccttcgccgcgtacaccagagaacagttataccaggcgatcttccacgctgtcgatcagtacctggccctcccggatgtttctctagggaggtacgcctacgtgaggggcggcggagacccttggacaaacggctcgggactggcgctgtgccagagatactatcatcgtggtcacgtcgaccccgcaaatgacacgttcgatatcgaccccatggtggtgactgactgcattcaggtagacccccccgagcgccctccccctcctccaagtgatgatctgaccttgctggaatcaagtagcagctacaagaacttaacccttaagtttcataaactcgtaaacgttacaatccattttcgtctaaagacaatcaatttgcagagtctgattaataatgagatccctgattgctacaccttttccgtccttattacattcgataacaaggcacattccggccgcataccgataagtcttgaaacacaagctcacatacaagaatgcaagcatccctcagtcttccagcacggggacaattctttccgacttctgtttgatgtggtagttattctgacgtgttccctgagtttcctattgtgtgctagaagccttctgcgggggttcctcctgcaaaacgaattcgtgggcttcatgtggagacaaaggggaagagtgatcagcctttgggagcggctcgagttcgtaaacggctggtacatcctcctggtgaccagcgacgtcctgacgattagcggcactataatgaagataggcatcgaagccaagaatttggctagctacgatgtttgtagtatcttgctgggcacctcgacccttctggtgtgggtgggggtgatacggtatctcacattcttccataactacaatattctcattgccaccctcagggtggctcttccatccgtcatgaggttctgctgctgcgtggcagtgatctacctcggctattgtttttgcgggtggatagtgctggggccgtaccatgtgaaattccgaagtctgagcatggtttcagaatgcctcttttcccttatcaatggggatgacatgttcgttacattcgccgcaatgcaggcgcagcagggtcggagttctctggtgtggttgttctcacaattatacctatacagctttatctcactcttcatttatatggtgctgtccctattcatcgccctgattacgggggcttacgacaccataaaacaccctggtggagcgggagcggaggaatctgagctacaagcatatatcgcccagtgccaggatagcccaactagtgggaaattccggcggggctctggcagcgcgtgcagcctcttatgctgctgcggaagagacccgagtgaggaacattctttgctcgtgaactag

SEQ ID NO: 195746 - DNA, 1638 bp, Artificial Sequence
  Description of Artificial Sequence: Synthetic coding sequence
atgacccccagccagcccacccggggcagcagctgcacccggccctcatccatgctgtggacgagcacgtggcgttgcctgacctgccattgggcaggtatgcgcatgagcgtggtgggcgtaaccctcggcccgatggcccagggcctgctatctgcgtccgggacaactacggaggcaacatggactcgaccaaccacccatctcacattgattcggtggtggctactaacagcctctcgctggatcccacctagcggacccctccgcccacccgcgaccatctccccgagttggaaagcggctccagtgaccagaacatctagaagcaatagtacttcaaccgcctgctctctagaaggtggcccaggatggggaaggcagcatacacgacatagccatccgtctaattacttcccaaaggtgggaaccgggccaccccgccctcgttggtgcctcctgggagagcattttccgtgccagctccagtctcagcacgtggccggggacgccggtacatggggcaggaagggaccagaggatgcacctgaccctcacccctccttgctccccaggctagttaacgtcacaattcactttcgcttgaaaacaatcaatcttcagagtttgatcaataatgagataccagattgctacacatttagcgtgctgattaccttcgacaacaaagcccatagcgggcggatccccatcagcctggaaactcaggcccatattcaagagtgcaaacatccatcggtttttcaacatggggacaatagcttcagactccttttcgatgtggtagtaatcctgacctgtagcttatccttcctgctgtgcgcccgcagtctgctccgggggttcttgcttcaaaatgaattcgtcgggttcatgtggcgacagcgggggcgagtgattagcctgtgggaaaggctggagttcgtgaatggctggtacatacttctggtcacctctgatgtgctaactatttctggaaccatcatgaaaatcggaatcgaggctaagaatctggcatcatatgacgtgtgttctattctgttgggaacttcaacgctgctcgtctgggtgggggtgattcgttaccttacattcttccataattataatatcctgattgcaacgctgagggtcgctctgccctcggttatgagattctgctgttgcgtggcagtgatctatcttggatattgtttctgcgggtggatcgtcctcggcccttatcacgttaaattccgatccctatctatggtctctgagtgccttttctcccttatcaatggagacgatatgttcgtcaccttcgccgcgatgcaagcccagcagggtcggagctcactggtgtggttattcagccaactgtacttatactccttcatctccctctttatctatatggtgctgagcctattcattgccctcattactggcgcttatgatactattaaacaccctggcggcgcgggggccgaagagagtgagctgcaggcgtatattgcacaatgccaggacagcccaactagcgggaaatttaggcgcggcagcggctccgcttgttcactgttgtgctgttgtggtagagacccatccgaggagcacagcctgctcgtgaactag

SEQ ID NO: 195747 - DNA, 1701 bp, Artificial Sequence
  Description of Artificial Sequence: Synthetic coding sequence
atggcccggcagccctaccggttcccccaggcccggatccccgagaggggaagcggcgtctttagactgacagtgcggaatgccatggctcacagagacagtgaaatgaaggaggaatgccttcgggaggacctgaagttctattttatgagcccttgcgagaaatacagagctcgcagacagattccatggaaactggggctccagatcttgaagatagttatggtgacaacccagctcgttcgcttcggcctaagtaaccaattggtcgtggcctttaaggaagataatacagtcgccttcaagcatctcttcctgaagggctattccggaacagatgaggatgattattcttgttctgtgtacactcaagaagacgcttatgaaagcattttcttcgctatcaaccagtaccaccagctgaaggatattacactgggcacgctgggctacggtgagaacgaagataacaggatcggcctcaaggtatgtaaacagcattataaaaaggggactatgttcccctctaatgaaaccttgaatattgataacgacgtggaactggattgcgtccaactcgacttgcaggatctcagtaaaaaacccccagactggaaaaactcatcatttttccggttagaattctaccgcctgctgcaggtagaaatctcttttcatctcaagggtatcgatctgcagaccatacacagtcgcgagctgcctgactgttacgtgtttcagaacaccatcatcttcgataataaggctcacagcggcaagatcaaaatttattttgactccgatgcaaaaatcgaggagtgcaaagacctcaacatctttggaagcactcagaagaacgcccagtatgtgctagtgttcgacgcgttcgtgatcgtcatatgtcttgcctctctgattctctgcacccggtccatcgtgctcgccctccgattacggaaaaggtttctgaacttcttcctcgagaaatacaaacggccagtttgcgacactgaccagtgggaatttatcaacggttggtacgtcctggtgattatatccgatctgatgacgataatcggtagcattctcaaaatggaaattaaggcgaagaacctgactaattacgatctatgctcgattttcctcggcacgagcacactgctggtctgggtgggtgtgattaggtaccttggttatttccaggcatacaatgtgctgatcttaactatgcaagccagtcttcccaaggtgcttaggttctgcgcttgtgctggcatgatctatttaggatacactttttgtggctggatcgttcttgggccgtatcacgacaagtttgaaaatctgaacaccgtggccgagtgtctcttctccctggtgaacggcgatgatatgtttgctacctttgcccagattcagcagaaaagcatccttgtgtggcttttttccagactatatctgtacagcttcataagcctgttcatctacatgattctttccctgtttatagccctcattacggacagctacgacaccatcaaaaaattccagcagaacgggttccctgagactgacctccaggagtttctgaaggaatgctcttctaaagaggaataccaaaaggagagcagcgcatttttgagctgtatctgctgcagacggaggaaacgctctgacgatcacctgatccctatctcctag

SEQ ID NO: 195748 - DNA, 1662 bp, Artificial Sequence
  Description of Artificial Sequence: Synthetic coding sequence
atggccgaccccgaggtggtggtgagcagctgcagcagccacgaggaggaaaaccgctgcaatttcaaccagcaaaccagccctagcgaagaactcttgctggaagatcaaatgaggaggaaactgaaatttttcttcatgaacccgtgcgaaaaattttgggcgcgtggccgcaaaccatggaagttggcgatccagattctgaaaatcgcgatggtgaccattcagctggtcctctttggactgagtaaccagatggtggttgcttttaaagaagagaatactatcgcgtttaagcacctcttcctaaaaggttacatggacaggatggacgacacatatgctgtgtacactcagagcgacgtatacgatcagctgatctttgccgtgaatcagtacctccagctgtacaacgtgagtgtcggcaaccatgcttatgaaaataaaggcacaaaacagtccgcaatggccatctgccagcatttctataagcgggggaacatctatcccgggaatgacacctttgatattgaccccgagatcgagacagaatgtttctttgtcgagcctgacgaaccatttcacattggcacccctgccgaaaacaaacttaatctcacgttggatttccaccgtctgttgactgtggaacttcagtttaagctcaaagctattaatctacaaactgtacggcaccaagaactgccggattgttatgacttcacgctaacaattacttttgacaataaggcccatagcggcagaattaagatctctcttgacaacgatatttctatcagggaatgtaaagattggcacgtttccggatccattcagaagaatacccactacatgatgatcttcgacgcatttgttatcttaacctgcctcgtcagtctcattctttgtatcaggtccgtcatccgcggactgcagttgcagcaagaattcgtgaacttctttctgctgcactataagaaagaggtttcggtgagcgaccagatggagttcgttaacgggtggtatattatgattatcataagcgacattttaacaatcataggctccatcctgaaaatggagattcaggccaagtcactgacctcctatgatgtgtgttccatacttttggggacatccactatgcttgtttggcttggcgtaatcagatatttggggtttttcgccaagtataacctgctcatcctgaccctccaggctgccctgcctaacgttatacggttctgctgttgcgcagcgatgatttacttgggatactgcttttgtggctggattgtgctgggaccataccatgataaattcaggtcactgaacatggtgtccgaatgccttttctctctgattaatggtgatgacatgttcgcgacatttgcaaagatgcaacagaagtcttacctggtgtggctattctcgagaatctatctgtacagcttcatctcgctatttatttatatgatccttagtctatttatagcattaattacagacacttacgaaactatcaaacaataccagcaggatgggttccctgaaaccgagctgcgcacatttatttctgagtgtaaggacctccccaactctggtaagtatcggctggaagatgatccacctgtaagccttttttgttgctgtaagaagtag

SEQ ID NO: 195749 - DNA, 1494 bp, Artificial Sequence
  Description of Artificial Sequence: Synthetic coding sequence
atggccgaccccgaggtggtggtgagcagctgcagcagccacgaggaggagaatcggtgcaactttaaccagcagacttctccctccgaagaattgctgctggaggaccagatgcggcggaagcttaagttttttttcatgaacccatgtgagaagttttgggctagaggaaggaagccatggaaactcgcaattcagattctcaaaatcgccatggtgacaatccagtatctgcagctgtataatgtatccgttggaaatcacgcctatgagaacaagggtaccaaacagagcgccatggcaatttgccagcatttttacaagcgcggtaacatctacccgggaaacgatacgtttgatatagaccccgaaatcgaaaccgagtgctttttcgtagaaccagatgagccctttcacataggcaccccggcggagaataagcttaatctcaccctggatttccacagattgttaacagtcgagctgcagttcaaactcaaggcaattaatctccaaaccgtacgccatcaagaactgccggactgctatgatttcacacttaccataacctttgacaacaaggcgcactccggcagaataaaaatatccctggataatgatatatccatcagggaatgcaaggactggcacgtcagcggatctatccagaagaacacccactatatgatgatctttgatgcatttgtcatcctcacttgcctcgtgagcctcatcctctgcattagatctgtcatcagaggccttcagctgcagcaggagtttgttaacttttttctgctgcattataaaaaggaagtatctgtgagcgatcagatggaatttgtgaacggttggtatattatgattatcatttctgatatactgacaatcattgggtctattctcaagatggagattcaggcaaaatcacttaccagctatgacgtgtgttccattctgttggggaccagcactatgctcgtgtggttgggggtcatcagatacttaggcttttttgcaaagtataatctgctgatcttgacgctgcaagctgccctgcctaacgtcattagattttgttgctgcgcagctatgatttacctcgggtactgtttctgcgggtggatcgtgctgggtccgtatcatgataagtttcgttctctgaacatggtgtcagagtgtctgtttagcctcatcaatggagacgacatgtttgccactttcgctaaaatgcagcagaaaagttacctggtgtggttgttctcccgcatatacctgtacagctttatttccctctttatctatatgatcctctccctgttcatcgctctgatcaccgacacatatgaaacaatcaagcagtatcaacaggatgggttccccgaaaccgagttgaggacgttcatatcagaatgcaaggacctaccaaactcaggtaagtaccgactggaggacgatccgccagtatccctgttttgctgctgcaaaaaatag

SEQ ID NO: 195750 - DNA, 966 bp, Artificial Sequence
  Description of Artificial Sequence: Synthetic coding sequence
atggccgaccccgaggtggtggtgagcagctgcagcagccacgaggaggagaaccgctgcaacttcaatcagcagacctctccatctgaagaactacttctagaggatcagatgcggcggaagctgaaatttttcttcatgaacccttgtgaaaagttctgggccaggggccgtaagccgtggaaacttgcaatccagatacttaaaatagccatggtgaccattcaactcgtgctgttcgggctgtcaaatcaaatggttgttgctttcaaggaagagaatactatcgcattcaagcatctgtttctgaaagggtacatggacaggatggatgatacatacgctgtgtatacccagtctgatgtctatgaccaacttatcttcgcggtgaatcagtacctgcagttgtacaacgtaagtgtgggtaaccatgcttatgagaataaaggaaccaaacaaagtgccatggcaatttgccagcatttctacaagagaggaaacatatatcccggcaacgatacttttgacattgatccagaaatcgaaaccgagtgcttttttgtggagccggatgagcccttccacattgggacacccgccgaaaataaattaaatctgacattggacttccaccggctactgaccgtggagctgcaatttaagctcaaagcaatcaatttgcagaccgtaagacaccaggagttgcctgactgctacgacttcaccctgacaattaccttcgataacaaggcccactctggtagaattaagatctccctggataatgacatcagcatcagggaatgcaaagactggcacgtctccgggagtatccagaaaaatacccactatatgatgatattcgatgcattcgtcatcctcacctgcctagtaagtttgattctctgtataaggagcgtaattagaggactccagcttcaacaagtaggaaatgtcgcattttag

SEQ ID NO: 195751 - DNA, 1494 bp, Artificial Sequence
  Description of Artificial Sequence: Synthetic coding sequence
atggccgaccccgaggtggtggtgagcagctgcagcagccacgaggaggagaaccgatgcaacttcaatcagcagacgtcaccttcagaggagctgctgctagaagatcagatgagacggaagttgaaatttttttttatgaatccctgcgaaaaattttgggcccgtgggagaaagccctggaagttagcaatccagatccttaaaatagctatggtgacaatccaatacctccagctctacaacgtgtctgtagggaaccacgcttacgaaaataagggtaccaaacagtcagccatggcaatctgccagcatttctacaagagaggcaacatttatcccggcaacgatacctttgacatcgaccccgaaatagaaaccgagtgctttttcgtcgaacctgacgagcccttccacatcggaactcccgccgagaataaactaaatttgactctggacttccaccgtctactgactgttgaactccagttcaaacttaaggctataaatctccagaccgtgagacaccaggaactaccggactgttacgactttacgctgaccataacattcgacaacaaagcacacagcgggaggattaaaatcagcctcgataatgatatcagtatccgtgagtgtaaggactggcacgtgtcgggcagcattcagaagaatactcattacatgatgatctttgacgcattcgtcattctgacctgcctggtaagcctaattttatgtatccggtcagttattcgaggcctccaactgcaacaggaatttgtgaacttctttcttctccactacaagaaagaagttagtgtttcagatcagatggagttcgtgaatggctggtatataatgattataatctctgacatcctgacaattatcggcagtatattgaagatggagatccaggcaaaatctcttacttcctacgatgtttgtagcatactgttgggcacttcgaccatgcttgtgtggctgggagtgattcgatacctgggattttttgctaaatacaatctgctcatcctgaccctgcaggcagccttaccgaatgtcatccggttttgttgttgcgctgctatgatctacctggggtactgcttctgtggctggatagtcctcggaccctatcacgacaaattcagatccctgaacatggtgagtgagtgcttgtttagcctgattaacggagacgatatgtttgctacattcgctaaaatgcagcagaaaagctacctagtgtggttgttctcacgaatctatctatactctttcatatcactatttatttatatgattctgtccctcttcattgcattgattaccgatacctatgaaactatcaaacagtatcagcaagacgggttcccagagacggagctgagaacatttatatcagagtgtaaggatctgcctaatagtggcaaatatcgtctggaggacgatccccccgtgagcctgttttgttgctgcaagaaatag

SEQ ID NO: 195752 - DNA, 1662 bp, Artificial Sequence
  Description of Artificial Sequence: Synthetic coding sequence
atggccgaccccgaggtggtggtgagcagctgcagcagccacgaggaggagaacagatgcaactttaatcaacagacctcaccgagtgaggagcttctcctggaagatcaaatgagaaggaagttgaagttcttctttatgaacccttgcgaaaagttttgggcacgaggcagaaaaccctggaagcttgcaattcaaattctcaaaattgctatggtgaccatccagcttgtgttattcgggctgagtaaccagatggttgtggctttcaaggaggagaatactatcgcttttaaacacttgtttctgaaagggtatatggatagaatggatgacacctatgcagtctacacacagtctgacgtgtacgatcaattaatctttgcagtaaatcagtatcttcagttgtacaatgtgagcgtaggcaatcatgcttatgagaacaagggcaccaagcagtctgcaatggctatctgccagcatttctacaagaggggtaacatctatcccggcaatgatacattcgacatcgatccagagatcgagaccgaatgttttttcgttgaaccggacgaaccttttcatataggaaccccagccgagaacaaattgaatctcactttggacttccacagactgctgacagttgagctccagttcaagctaaaagctatcaatctccagacagtccgccaccaggaactgccagactgctacgactttacacttactatcacctttgacaataaggctcacagcggacgcattaaaatttccctcgacaacgatattagcatccgggaatgcaaagactggcatgtctcggggagtatccagaagaacacgcattatatgatgattttcgacgcattcgttatcctgacctgcctagtgtcactcatactttgcatccgatcagtcatccgggggctccagctccagcaggaattcgttaacttttttctactgcattataagaaggaagtaagtgtctctgaccagatggaattcgtcaacggttggtacataatgatcataatttctgatatccttacaatcatcggaagcatactgaaaatggagatccaggcaaagagcctcacgtcttacgatgtctgcagcatcttgcttgggaccagcacaatgctggtttggttgggcgtgatcaggtatctgggcttcttcgccaaatacaatctcctaatcctgacactgcaggcggctctgccaaatgtgatcagattttgctgctgcgccgcaatgatatatctgggatactgtttttgcggctggatagttttaggaccttaccatgataagttccggtcgctcaacatggtcagcgaatgcctgttcagcctgatcaatggagatgacatgtttgctactttcgccaagatgcagcagaaatcctatctcgtttggctgttttcacgtatctacttgtattcctttatttctctttttatctatatgattcttagtcttttcatcgcactgataaccgacacctatgaaacaatcaaacagtaccagcaggacgggttcccggagaccgagttgagaaccttcatctccgaatgtaaggacctccctaactcaggcaagtaccgccttgaggacgatccaccagtgtctctgttctgctgttgcaaaaagtag

SEQ ID NO: 195753 - DNA, 2442 bp, Artificial Sequence
  Description of Artificial Sequence: Synthetic coding sequence
atgagcctgctgggcgaccccctgcaggccctgccccccagcgccgctccaaccgggccgctgttggccccaccagcaggcgcgacactgaaccggctccgggaacccctactccggagactcagcgagctgttggatcaggcccccgaagggagagggtggcgacgactggccgagctcgcaggctcacggggcagacttcgcttgtcatgtctggatctggaacagtgtagcctcaaagtgctggagcctgagggaagccccagcctttgcctgctcaagctgatgggagaaaagggatgcaccgtgactgaactgagtgacttccttcaagctatggaacatactgaggtgttacagcttttatctccgcctgggataaaaataacagtgaacccagagagtaaggctgtgctggccgggcagtttgtcaagctgtgctgtcgagcaacaggccacccttttgtccaataccagtggtttaagatgaataaagagatccccaacggaaacacaagtgaattgatttttaatgctgtgcacgttaaggacgccggattctacgtgtgcagggttaataataatttcacgttcgagttctcgcagtggagtcagctcgacgtatgcgacatcccggaatcgttccagaggtcagtggatggagttagcgagagtaagttgcagatatgtgtggagccaacatcacaaaagctcatgcctggatcaactttggtcttacagtgcgtcgccgtgggctcgccaattccacactatcaatggtttaaaaacgagttgccattgacccatgagacgaagaaactgtatatggtcccatacgtcgacctggagcatcaaggtacctactggtgccatgtgtacaacgatagagatagtcaagacagcaagaaagtggagataatcattgatgagctaaataacctgggccacccagacaataaggagcagacaacagaccagccgctggccaaggataaggtggccctgctgatcggaaatatgaattaccgcgaacatcccaagcttaaggccccacttgtagacgtgtatgaactaaccaaccttcttagacaacttgatttcaaggttgtttcactgttggatctgacagagtacgagatgagaaatgccgtagacgagttcttgctccttctcgacaaaggtgtatacggactcctttattatgcaggacacggttacgagaattttggtaacagctttatggtgccagttgacgctcctaatccgtatagaagcgagaactgtctatgtgttcagaatattctcaaacttatgcaagagaaggagaccggtctgaacgtgtttctcctggatatgtgccggaagcgaaatgactacgatgataccattcccattctggatgccctgaaagtgacagcaaacatcgtgtttggatatgcaacatgtcagggagccgaagcctttgagatccagcacagcggcctcgcaaacgggatcttcatgaaatttctgaaggatcggctactcgaagacaaaaagattacagttctacttgacgaggtggccgaggatatgggcaaatgtcatctgactaagggcaaacaggctctggagatacggtccagcttgagtgagaagcgagccctgaccgacccaattcaaggcacagaatactcagcagagtcattggtccggaatcttcaatgggctaaggcccacgagctcccagagagcatgtgcttgaaattcgactgtggcgttcagatccaactcggcttcgcagccgagttctccaatgtcatgatcatctatacatcaatcgtctataagcctccggagattattatgtgcgacgcctacgtgacagattttcccttggatctcgacatcgatcctaaggacgcaaacaaaggtactcctgaggagactggaagctacctggtttccaaagatttgccgaagcattgtctctacactaggctcagctccttgcaaaagctgaaagagcatttagtgtttactgtttgtctcagctaccagtatagcggactggaggacaccgtggaggacaaacaggaagttaacgtcggtaagccacttatcgccaaactggacatgcacaggggactcggccggaaaacctgtttccagacatgtctcatgtcaaacggcccttaccaatccagcgctgccacgtcagggggcgctggacactaccattcactacaggacccctttcatggggtgtatcacagtcaccccggcaacccctcaaacgtgacaccagcagacagttgccactgttccaggactcctgacgccttcatttcatcatttgcccaccatgcctcatgccacttctctcgcagcaacgtccccgtagaaactaccgacgagattccattttctttcagtgatcggctccgcatctccgagaagtag

SEQ ID NO: 195754 - DNA, 2475 bp, Artificial Sequence
  Description of Artificial Sequence: Synthetic coding sequence
atgagcctgctgggcgaccccctgcaggccctgccccccagcgccgcaccgacaggccccctccttgctccccctgccggtgctaccctgaataggctgagggagccccttctcagaaggttgtcagagctgctggatcaagcccctgagggccgaggatggagaagacttgccgagctagccggaagtcgcggtcggcttcgtttgtcatgcttggacctggagcagtgctccctgaaggttcttgagcctgaagggagcccctccctctgcttgctgaagctcatgggtgaaaaggggtgcaccgttaccgagctgtccgactttctacaggccatggagcataccgaggtgctgcagctgctgagcccacccggaatcaagatcaccgtgaacccagagtcgaaagccgtgttagctggacaatttgtaaagctttgctgcagggcaaccggccacccgtttgtgcagtaccaatggtttaagatgaacaaggaaatcccaaatggtaacacatctgaattaatatttaacgcggtgcacgtgaaggatgctggcttttatgtgtgccgggtgaacaataactttacttttgagttcagccagtggtcacaactggatgtatgcgatataccagaaagtttccagagaagcgttgacggtgtgtctgaatctaaactccagatctgtgtggaaccaacatcacagaaactaatgccaggcagtactttggtgctacagtgcgtggctgtgggatcacccataccgcactatcaatggtttaagaatgagcttccactgacgcatgaaactaaaaaactgtacatggtgccctatgtggatctggagcaccaaggaacatactggtgccatgtctataacgatcgcgatagtcaggatagcaagaaggtggagatcatcataggccgcactgacgaagcagtggaatgcacggaagatgagctaaataacctcggacacccggataataaggaacagaccacagaccagcccttagcaaaggacaaagtggcattgcttatcggcaatatgaactaccgggaacaccctaagcttaaagcacccctggtcgacgtatacgagctgactaatctgctgagacaattagactttaaggtcgtgtcgttgcttgacctgacggagtacgagatgcgcaacgctgtagacgagtttctgcttctcctggacaagggggtgtatgggctgctctactatgcaggtcacggctatgaaaatttcgggaatagcttcatggtccctgtggatgcgcctaatccgtacaggtccgagaattgcttatgtgttcagaacattctgaaacttatgcaggagaaagagaccggcctcaatgtatttctgctcgatatgtgtcggaagcgaaatgattatgacgacactattcctatccttgacgccctcaaagtgaccgctaacattgttttcggttacgcaacgtgccagggagccgaggcctttgaaattcagcattcgggcctagccaacggaatcttcatgaagttcctgaaagaccgcctactcgaggataagaaaattacagtgctgctggacgaagtcgccgaagatatgggcaagtgccaccttacaaaggggaagcaggccttagagatccggagcagtctttcagagaagagggccctgaccgaccccatccaaggtacagaatacagcgccgagtctttagtcaggaacctgcaatgggccaaggcacacgagctgcctgagtccatgtgtttaaaatttgactgtggtgtccaaattcagttaggttttgctgcagagttttccaacgtcatgataatctatacctccatcgtttataaaccccctgagatcataatgtgcgacgcatatgtaacagacttccccctcgacctggacatagatccgaaagatgccaacaaagggactccagaggagacggggtcctacctggtgagtaaggacttacctaagcactgcctttacacaagactgagttctcttcagaaattgaaggagcacctcgttttcacggtgtgcctcagctatcagtatagcggactagaggacacagtggaagataaacaggaggtcaacgtgggcaagccgcttatcgccaagctggacatgcaccgaggcctgggacgaaagacgtgcttccagacatgtctcatgtctaatggcccataccagtctagcgccgcaacatccggaggcgcagggcattaccattctctccaggacccgttccacggcgtgtatcactctcatccggggaatccctcaaatgtgacacccgccgattcatgtcattgctccaggactccagatgcctttatcagttcttttgcccatcatgcctcatgccactttagtcggtcgaacgtgccagtggagacaactgacgagattccattctcgttctccgacaggctgcgaattagcgagaagtag

SEQ ID NO: 195755 - DNA, 441 bp, Artificial Sequence
  Description of Artificial Sequence: Synthetic coding sequence
atgaccatgcggagcctgctgcggacccccttcctgtgcggcctgctctgggccttttgcgcccccggggcaagggcggaggagccagctgcctcatttagccagcctggttccatgggcctagacaagaacacagtacacgatcaagagcacatcatggaacaccttgaaggagtgatcaataaacccgaagcagagatgtccccccaggaacttcaactgcattatttcaagatgcatgattatgacggcaataatctgctggatggtctcgaacttagcactgctatcactcacgtgcataaggaggagggtagcgaacaagcaccactcatgtctgaagacgaattgataaatataattgacggggtactgcgagatgatgataagaacaacgatggttacatagattacgccgagtttgctaaatcattgcagtag

SEQ ID NO: 195756 - DNA, 441 bp, Artificial Sequence
  Description of Artificial Sequence: Synthetic coding sequence
atgaccatgcggagcctgctgcggacccccttcctgtgcggcctgctctgggccttctgcgcacccggggcccgagccgaagagccagcagcctctttctcacaaccgggctctatggggcttgacaaaaataccgtgcacgaccaggagcatatcatggagcacttggagggcgtcattaataaaccagaagctgagatgagtcctcaggaacttcagctgcattactttaaaatgcacgactacgacggcaataatctgcttgatgggctggagcttagtactgccatcacacatgtgcacaaagaagaaggcagcgaacaggcccccctgatgtctgaagatgaactgatcaacattatagacggcgtgctacgcgacgatgacaaaaacaatgacggatatattgattacgccgaattcgccaaatctcttcaatag

SEQ ID NO: 195757 - DNA, 285 bp, Artificial Sequence
  Description of Artificial Sequence: Synthetic coding sequence
atggagcacctggagggcgtgatcaacaagcccgaggccgagatgagtccccaagaattgcagttgcactatttcaagatgcacgactacgacggcaataacttgctcgacggattggaattaagcacagccattacccacgtgcacaaggaagaaggctctgaacaggcgcccctgatgtccgaagacgagctgattaacataatcgatggggttttgcgcgacgatgacaagaataacgacggttacattgactacgccgagttcgctaagagtttgcaatag

SEQ ID NO: 195758 - DNA, 441 bp, Artificial Sequence
  Description of Artificial Sequence: Synthetic coding sequence
atgaccatgcggagcctgctgcggacccccttcctgtgcggcctgttgtgggctttttgtgcaccaggcgcccgggctgaagaaccagctgcttcattctcccagccaggatcaatgggcttggataaaaacaccgtgcatgaccaagaacatatcatggaacacctggagggtgtcataaataaacccgaggctgagatgtccccgcaggagttgcagctgcattactttaagatgcacgattatgacgggaataatttgctggacggacttgagctaagcactgctatcacgcacgtccataaagaggagggctccgagcaagcacccctcatgagcgaagacgagttaattaacataatcgatggtgttcttagggacgatgataagaacaacgatggatatatagactacgcagaattcgccaaatccctgcaatag

SEQ ID NO: 195759 - DNA, 441 bp, Artificial Sequence
  Description of Artificial Sequence: Synthetic coding sequence
atgaccatgcggagcctgctgcggacccccttcctgtgcggcctgttgtgggccttctgcgcacccggagcccgcgcggaggagcccgccgctagcttctcacagccaggcagcatggggctcgataaaaacactgtgcacgaccaggagcacatcatggagcacttagagggcgttatcaataagccagaggctgagatgtcaccccaagagctacagttgcactactttaaaatgcatgactatgatggcaataacttactcgatggactcgagttgagcaccgccattacccatgtgcacaaagaagaaggtagcgaacaggctccgctcatgagcgaagacgagctcattaacataatcgatggcgtacttcgagacgacgacaagaataatgacgggtacatcgactacgccgagttcgcaaagtctcttcagtag

SEQ ID NO: 195760 - DNA, 285 bp, Artificial Sequence
  Description of Artificial Sequence: Synthetic coding sequence
atggagcacctggagggcgtgatcaacaagcccgaggccgagatgtccccccaggagcttcagctccattatttcaagatgcatgactatgacggcaacaacctgttagacggcttagagctaagtactgcaatcacccatgtgcataaagaagagggatccgagcaagcgccactgatgagtgaagacgagttaatcaacatcattgatggtgtgttgcgcgatgacgacaagaacaacgacggatacattgattacgcggagtttgccaagtctctccaatag

SEQ ID NO: 195761 - DNA, 285 bp, Artificial Sequence
  Description of Artificial Sequence: Synthetic coding sequence
atggagcacctggagggcgtgatcaacaagcccgaggccgagatgtctccacaggaacttcaactgcattactttaagatgcacgactacgatggaaacaatctgctcgacggtctggagctctctactgccatcactcatgtgcacaaggaggagggctctgaacaggccccattgatgagtgaggacgagctgattaatatcatcgacggggttttgagggacgacgacaagaacaacgatggatatatagattatgcagagttcgcaaagtcactgcaatag

SEQ ID NO: 195762 - DNA, 441 bp, Artificial Sequence
  Description of Artificial Sequence: Synthetic coding sequence
atgaccatgcggagcctgctgcggacccccttcctgtgcggcctgttatgggctttttgtgcaccaggcgcacgggccgaggagcccgcagcaagcttttctcaaccaggatcaatgggcttggacaagaatacggtccacgatcaagaacatattatggagcatctggagggtgtgatcaacaagccagaagccgaaatgtctccccaggagctccagctccactactttaaaatgcatgactatgatgggaacaatctccttgacggtcttgaactgagcacagcaattactcatgtgcacaaggaggaagggtctgagcaggctccacttatgagcgaagatgagctgatcaatatcatcgacggcgtgctccgtgatgacgataaaaacaacgacggttacatcgattacgccgaattcgctaagagcctccagtag

SEQ ID NO: 195763 - DNA, 441 bp, Artificial Sequence
  Description of Artificial Sequence: Synthetic coding sequence
atgaccatgcggagcctgctgcggacccccttcctgtgcggcctgctctgggcgttctgtgcgccaggggccagagccgaggagccagcagcaagcttttcgcagccaggatcgatgggcttagacaagaacactgtgcatgaccaagagcatatcatggaacacttagaaggggttatcaacaagccagaagctgagatgagccctcaggaactacaacttcactacttcaagatgcacgactacgacggcaacaacttactcgacggtttagagctaagcacagctatcacccatgtacacaaggaagagggctcagagcaggccccacttatgtcggaggacgaactgattaatataatcgacggcgtgctccgtgatgatgacaagaataatgacggctacattgattacgcggagttcgctaagtccctccagtag

SEQ ID NO: 195764 - DNA, 186 bp, Artificial Sequence
  Description of Artificial Sequence: Synthetic coding sequence
atgaccatgcggagcctgctgcggacccccttcctgtgcggcctgctgtgggccttttgtgccccaggcgcacgggccgaggagcccgccgcatcattttcacagcccggctctatgggactcgacaaaaacacagtgcacgaccaggagcatattatggagcacctcgaaggggtgattaactag

SEQ ID NO: 195765 - DNA, 384 bp, Artificial Sequence
  Description of Artificial Sequence: Synthetic coding sequence
atgctgagcgtgtgcagctgccggaccagcagcggcatgcggagccagtggccttccgcgcgtcagcggagcagttcgctgtctacgttcagacatataatggaacacctggaaggcgttatcaataagccagaggcagagatgagcccccaagagctgcaactgcactacttcaaaatgcacgactacgatggcaataacctccttgacggactcgaacttagcaccgccatcactcacgtacacaaagaggaagggagtgaacaggcaccactgatgtcggaggacgaactcatcaacatcatcgacggagtgctacgagatgacgacaagaacaacgacggttacatagattatgcggaatttgcaaaaagtctccagtag

SEQ ID NO: 195766 - DNA, 3423 bp, Artificial Sequence
  Description of Artificial Sequence: Synthetic coding sequence
atggtgatcagcctgaacagctgcctgagcttcatctgcctgctgctctgtcattggataggcacggcatcacctctcaatctagaggatccgaatgtgtgttcccactgggaaagttattctgttacagttcaggagtcgtacccgcaccccttcgaccagatttactacacaagttgtacagatatcctgaactggttcaagtgcaccagacaccgggtctcttatagaaccgcctatcgacatggagaaaaaacgatgtatagacgcaaaagtcaatgctgtcccggcttctatgagagtggagagatgtgcgtcccacattgtgctgacaaatgtgtccacgggaggtgcattgcaccaaatacatgccaatgcgagcccggatggggcgggaccaactgcagttccgcttgtgacggggatcactggggcccgcactgtacctcaagatgtcaatgtaagaacggcgcactgtgcaacccgatcactggagcctgccactgtgccgcggggtttagaggatggcgctgcgaggacagatgcgaacaggggacatacggtaatgattgtcaccagagatgccagtgccagaatggtgccacatgtgatcatgtgactggtgaatgtcggtgcccacctggatataccggtgcgttttgtgaggatctctgtcccccaggtaaacacggtcctcagtgcgaacagcggtgtccttgtcaaaatggcggggtctgtcaccacgtcacaggcgagtgttcctgcccttccggctggatggggacagtgtgcggccagccttgtcctgaaggcagatttggcaaaaactgtagccaggaatgccagtgtcacaacgggggcacctgcgacgcagctactgggcagtgccactgtagtccagggtacactggcgagcgatgccaggatgaatgtcccgtgggcacatatggtgtactgtgcgccgagacttgccagtgcgttaacgggggcaagtgttaccatgtgagtggcgcctgtctatgcgaagcagggttcgctggtgaacgatgtgaggcaagactgtgtcccgagggcctgtacgggatcaagtgcgacaagcgttgtccctgtcatctggagaacacacatagttgccaccctatgagtggagaatgcgcgtgcaagccaggttggtctggcctgtattgcaacgagacttgttcccccggattctatggcgaggcctgtcaacagatctgtagctgccagaatggcgctgattgtgacagcgtgaccggaaagtgtacttgtgcacctggtttcaaaggcattgattgttccacaccatgtcctctgggcacctatggaatcaattgttcatctcgctgtgggtgcaaaaacgatgcggtctgctcacctgtggacggctcttgtacatgtaaggctggctggcatggcgtggattgtagtatccgctgccctagcggtacctggggatttgggtgtaatttaacatgtcagtgccttaacggtggagcttgcaataccttggatggtacttgcacctgcgcccccgggtggcgaggagagaaatgcgagctgccgtgccaggacggtacatacggattgaactgtgccgagagatgtgattgttcacacgccgatggctgtcaccccacaactggtcactgtcgatgtctccccggttggtccggcgtccattgcgacagcgtctgcgctgagggcaggtggggacctaattgttcactgccttgctattgtaagaacggcgcgtcttgctcacccgatgatggcatttgcgaatgtgctcctggattccgaggcacaacgtgccagcgcatttgctctcctgggttttatggacacaggtgtagccagacatgcccccagtgtgtccactcgtcaggaccctgtcatcacatcacaggcctgtgcgattgtctgccagggttcaccggtgctctgtgcaatgaggtatgcccaagcggcagattcggcaagaattgcgccggtatctgtacctgtacgaacaatggcacctgcaaccccattgatcgctcatgtcagtgctaccccggctggatcggcagcgactgttcacagccatgtccccccgcacattggggcccaaactgcattcacacttgcaattgtcacaacggcgcattttgtagcgcttatgatggcgagtgcaaatgcaccccagggtggaccggcctctactgtacacaaaggtgtccactgggtttctatgggaaggattgcgcgctgatctgtcaatgccagaatggtgcagattgcgaccacatttccgggcagtgcacgtgtcggactggtttcatgggacggcactgcgagcaaaaatgtccttccggcacatatggatatggctgcagacagatttgtgactgcttgaacaactccacatgtgaccacatcacggggacatgctactgtagcccagggtggaagggcgcccgttgcgatcaggctggcgttatcatcgtgggcaacctgaatagcctgtctcgtacttctactgcccttcccgcggacagctaccagataggagctatcgcaggcatcatcatccttgtcctggttgtgctgtttctattggcactctttattatctatcgacataaacaaaaaggaaaagagagttcaatgccagcagttacctacacccccgcaatgagggtggttaacgctgattacaccatatccggcactctcccacactcgaacggagggaacgcgaactcacactattttaccaatccctcttaccacacactgactcagtgcgccaccagccctcatgtgaacaatagggaccggatgaccgtgacaaagtccaaaaataaccagttgtttgtcaacttgaaaaacgtgaaccctggtaaacgtgggcctgtcggggactgcactggaactcttccagctgactggaagcacgggggctacctgaatgaactgggagcgttcggcttagatcggtcgtacatgggtaaatccctgaaggatctcggaaaaaactcagagtacaactcaagcaactgtagtctgtcctcaagtgaaaacccgtacgctaccattaaggatccaccagtgctcatccctaagtcatctgaatgtggctacgtggaaatgaagtcaccagccagacgggattctccttatgcagaaattaacaatagcacgtcagccaatagaaatgtgtacgaggttgagcctacagtttcagttgtgcagggtgtcttttctaataacggacgactgagccaggatccatatgatcttccaaaaaactcccatattccttgtcattacgatctgttgcctgtgcgggacagttcctcatcgcctaagcaagaggactctggaggatcgtcctccaatagttcttcttcctcagaatag

SEQ ID NO: 195767 - DNA, 1704 bp, Artificial Sequence
  Description of Artificial Sequence: Synthetic coding sequence
atggtgatcagcctgaacagctgcctgagcttcatctgcctgctgctgtgccactggatcggtacggcttcccccctgaacctggaggatccaaacgtgtgttcccactgggagtcctacagcgtgacagttcaagagagttaccctcacccatttgaccagatttattatacatcttgcacagacattctaaactggttcaaatgcacccggcatcgggtgtcatacagaaccgcctatcggcatggcgaaaaaactatgtacaggcggaaatcccagtgttgtccgggattttatgaatctggagaaatgtgcgtaccccactgtgcggacaaatgcgtacacggtaggtgcattgcaccgaatacatgccagtgtgaacccgggtgggggggtactaactgtagtagtgcttgtgatggagaccattggggtccccactgcacctcaagatgtcagtgcaagaacggggcgctttgcaaccccataactggagcctgtcactgcgctgcagggttcagaggttggcgctgtgaggacaggtgcgaacaaggaacctacggtaatgactgtcaccagcggtgtcagtgccagaacggcgccacgtgtgatcatgttaccggggaatgtcgatgtccgcctggttatacaggagcgttctgcgaagacctgtgccccccagggaagcacggacctcagtgcgaacaacggtgtccttgccagaacgggggcgtgtgccatcatgtgacaggtgaatgcagttgtcctagcgggtggatgggcactgtctgcggccagccttgccctgaagggcgcttcgggaagaattgctctcaggaatgtcagtgccataatggtggtacttgtgatgccgctacaggtcagtgtcactgcagcccagggtacacaggtgaaagatgtcaggacgaatgtccagtgggcacctacggagttctgtgcgccgagacttgccagtgtgtgaacggagggaagtgttaccacgtgtcaggcgcctgcctttgcgaagccggcttcgctggagagaggtgtgaggcaagactgtgcccggaaggcctgtacggtattaagtgcgacaaacggtgcccttgtcatttagagaatacccattcttgtcacccaatgtctggagagtgcgcctgcaagcccggctggtcggggctctactgtaatgaaacctgttctcccggtttctacggagaggcttgtcagcagatctgctcatgtcagaacggggccgattgcgacagcgttaccggcaagtgcacctgtgctccaggtttcaagggtatcgactgctctaccccctgtcctctgggcacttacggcatcaattgcagctccagatgtgggtgcaaaaacgacgctgtgtgcagcccagttgatggtagctgcacgtgtaaggccggatggcatggcgttgactgtagcattaggtgcccaagcggtacttggggtttcggttgtaatctgacgtgtcagtgcctgaatgggggtgcctgcaacactcttgacggcacctgcacatgtgcacctggctggcgaggggagaagtgcgaactgccgtgtcaggatggtacttatgggttaaattgcgctgagcggtgtgattgcagtcatgcagatggatgccatccaaccaccgggcactgccgctgcctgccaggctggtctggtctgttttag
